US012617821B2

(12) United States Patent  
Kelsic et al.

(10) Patent No.: US 12,617,821 B2  
(45) Date of Patent: *May 5, 2026

(54) ENGINEERED VIRAL CAPSID POLYPEPTIDES AND USES THEREOF

(71) Applicant: PRESIDENT AND FELLOWS OF HARVARD COLLEGE, Cambridge, MA (US)

(72) Inventors: Eric Kelsic, Cambridge, MA (US); Sam Sinai, Somerville, MA (US); Pierce Ogden, Somerville, MA (US); George M. Church, Brookline, MA (US)

(73) Assignee: PRESIDENT AND FELLOWS OF HARVARD COLLEGE;

( * ) Notice: Subject to any disclaimer, the term of this patent is extended or adjusted under 35 U.S.C. 154(b) by 800 days.

This patent is subject to a terminal disclaimer.

(21) Appl. No.: 17/774,306

(22) PCT Filed: Nov. 6, 2020

(86) PCT No.: PCT/US2020/059294  
§ 371 (c)(1),  
(2) Date: May 4, 2022

(87) PCT Pub. No.: WO2021/092298  
PCT Pub. Date: May 14, 2021

(65) Prior Publication Data

US 2023/0002451 A1  Jan. 5, 2023

Related U.S. Application Data

(60) Provisional application No. 62/932,646, filed on Nov. 8, 2019.

(51) Int. Cl.  
*C07K 14/075* (2006.01)  
*C12N 15/861* (2006.01)

(52) U.S. Cl.  
CPC .......... *C07K 14/075* (2013.01); *C12N 15/861* (2013.01); *C12N 2750/14122* (2013.01); *C12N 2750/14143* (2013.01)

(58) Field of Classification Search  
CPC ............... C07K 14/075; C12N 15/861; C12N 2750/14122; C12N 2750/14143  
See application file for complete search history.

(56) References Cited

U.S. PATENT DOCUMENTS

| | | | |
|---|---|---|---|
| 6,156,303 A | 12/2000 | Russell et al. | |
| 9,233,131 B2 * | 1/2016 | Schaffer | C07K 14/005 |
| 9,441,244 B2 * | 9/2016 | Schaffer | A61P 31/12 |
| 2009/0215879 A1 | 8/2009 | Diprimio et al. | |
| 2014/0050701 A1 | 2/2014 | Zhong et al. | |
| 2014/0341852 A1 | 11/2014 | Srivastava et al. | |
| 2017/0096683 A1 | 4/2017 | Scaria et al. | |
| 2022/0396808 A1 | 12/2022 | Kelsic | |

FOREIGN PATENT DOCUMENTS

| | | |
|---|---|---|
| WO | 2001068888 A2 | 9/2001 |
| WO | 2002053703 A2 | 7/2002 |
| WO | 2003052051 A2 | 6/2003 |
| WO | 2004111248 A2 | 12/2004 |
| WO | 2005005610 A2 | 1/2005 |
| WO | 2005033321 A2 | 4/2005 |
| WO | 2008124724 A1 | 10/2008 |
| WO | 2013170078 A1 | 11/2013 |
| WO | 2013173512 A2 | 11/2013 |
| WO | 2015/121501 | 2/2015 |
| WO | 2017147477 A1 | 2/2017 |
| WO | 2017106236 A1 | 6/2017 |
| WO | 2019006046 A2 | 1/2019 |

OTHER PUBLICATIONS

Aslanidi et al. "Optimization of the capsid of recombinant adeno-associated virus 2 (AAV2) vectors: the final threshold?." PloS one 8.3 (2013): e59142.

De Silva et al. "Single residue AAV capsid mutation improves transduction of photoreceptors in the Abca4-/- mouse and bipolar cells in the rd1 mouse and human retina ex vivo." Gene Therapy 23(11): 767-774 (2016).

Perabo et al. "In vitro selection of viral vectors with modified tropism: the adeno-associated virus display." Molecular therapy 8.1 (2003): 151-157.

Wooley et al. "A directed evolution approach to select for novel Adeno-associated virus capsids on an HIV-1 producer T cell line." Journal of virological methods 250 (2017): 47-54.

Wu et al. "Mutational analysis of the adeno-associated virus type 2 (AAV2) capsid gene and construction of AAV2 vectors with altered tropism." Journal of Virology 74(18): 8635-8647 (2000).

Tseng et al. "Mapping the AAV capsid host antibody response toward the development of second generation gene delivery vectors." Frontiers in immunology 5: 9 (2014).

UNIPROT. Accession No. A0A513ZUC6_9VIRU. Retrieved from the Internet at <https://www.uniprot.org/uniprotkb/A0A513ZUC6/entry> (2018).

Büning et al. "Capsid modifications for targeting and improving the efficacy of AAV vectors." Molecular Therapy—Methods & Clinical Development 12: 248-265 (2019).

(Continued)

*Primary Examiner* — Fereydoun G Sajjadi  
*Assistant Examiner* — Joel D Levin  
(74) *Attorney, Agent, or Firm* — NIXON PEABODY LLP; David S. Resnick; Mark J. Fitzgerald

(57) ABSTRACT

The technology described herein provides variant adeno-associated viral capsid polypeptides and viruses comprising the same. Such variant viral capsid polypeptides bear a mutation relative to SEQ ID NO: 2 (WT AAV2) in a region corresponding to amino acids 561-588, wherein the region corresponding to amino acids 561-588 comprises a sequence selected from SEQ ID NO: 4-41,337. Further provided herein are methods for delivering a viral payload using viruses comprising variant capsid polypeptides described herein.

18 Claims, 1 Drawing Sheet

Specification includes a Sequence Listing.

(56)                    References Cited

OTHER PUBLICATIONS

Kanaan et al. "Rationally engineered AAV capsids improve transduc-
tion and volumetric spread in the CNS." Molecular Therapy—
Nucleic Acids 8: 184-197 (2017).
Yu et al. "A muscle-targeting peptide displayed on AAV2 improves
muscle tropism on systemic delivery." Gene therapy 16.8: 953-962
(2009).
Gao et al. "Clades of Adeno-associated viruses are widely dissemi-
nated in human tissues." Journal of virology 78.12: 6381-6388
(2004).
Gao. "Adeno-associated virus isolate hu. 63 capsid protein VP1 (cap
gene, complete cds." Retrieved from NCBI Database, accession No.
AY530624 (2004).

* cited by examiner

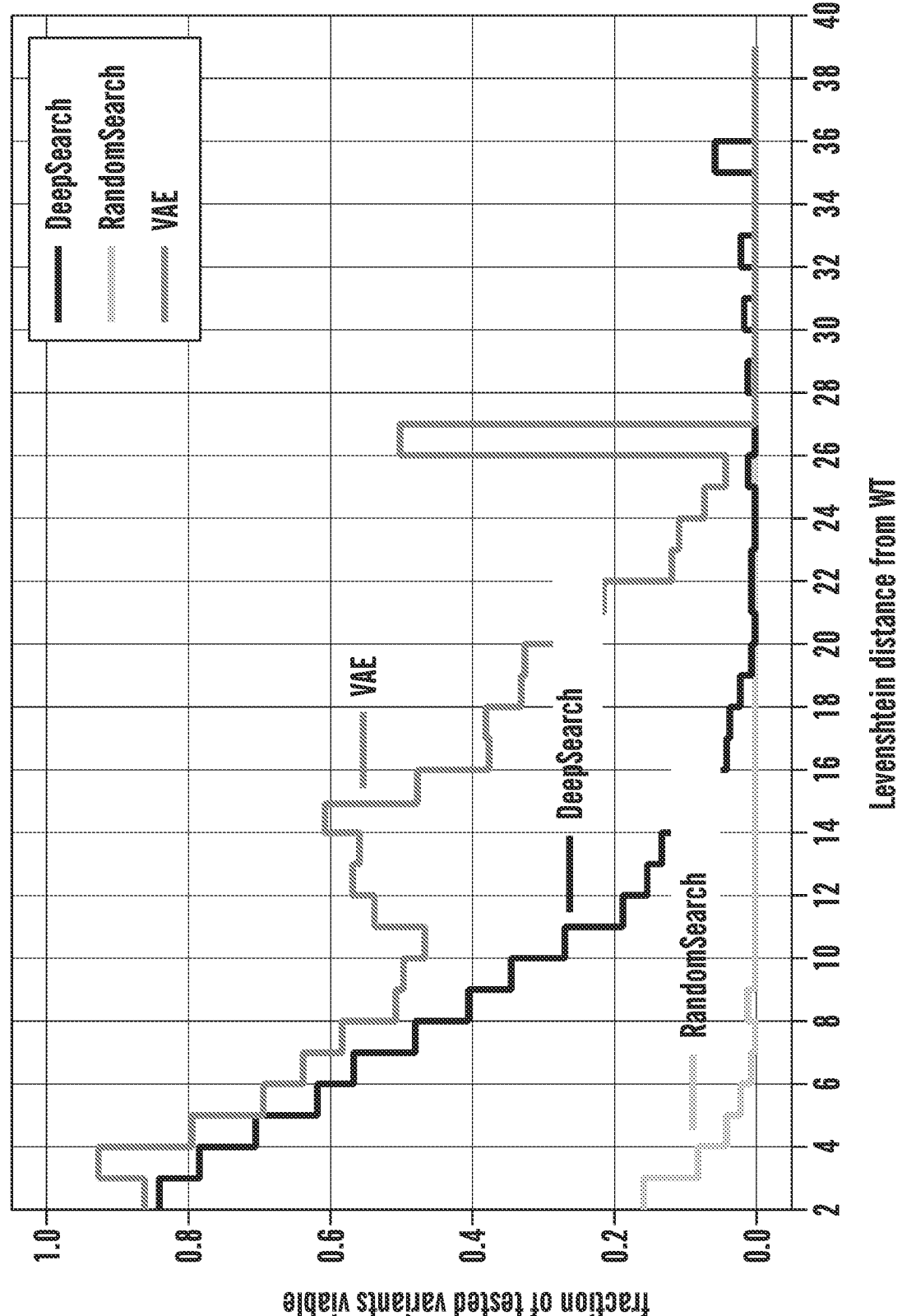

ENGINEERED VIRAL CAPSID POLYPEPTIDES AND USES THEREOF

CROSS-REFERENCE TO RELATED APPLICATIONS

This application is a 35 U.S.C. § 371 National Phase Entry Application of International Application No. PCT/US2020/059294 filed Nov. 6, 2020, which designates the U.S. and claims benefit under 35 U.S.C. § 119 (e) of U.S. Provisional Application No. 62/932,646 filed Nov. 8, 2019, the content of which is incorporated herein by reference in their entirety.

GOVERNMENT SUPPORT

This invention was made with government support under HG008525 and HG005550 awarded by National Institutes of Health. The government has certain rights in the invention.

SEQUENCE LISTING

The instant application contains a Sequence Listing which has been submitted electronically in ASCII format and is hereby incorporated by reference in its entirety. Said ASCII copy, created on Oct. 30, 2019, is named 002806-096400PL01_SL.txt and is 16,548,992 bytes in size.

TECHNICAL FIELD OF THE INVENTION

This invention is related to engineering viral vectors.

BACKGROUND OF THE INVENTION

Adeno-associated virus (AAV) is an attractive agent for use as gene delivery vector. Its simple structure also makes it an attractive target for genetic improvement programs. Nonetheless, there is a continuing need in the art to improve delivery of DNA using AAV and other viral vectors.

SUMMARY OF THE INVENTION

Described herein are viral vectors comprising a variant sequence of the capsid gene, VP1. Such vectors provide, e.g., an improvement in the degree of tissue targeting, payload packaging, delivery efficiency, etc., attainable with such vectors. In particular, viral vectors with capsid polypeptide mutations that modify tropism of the viral particles relative to particles with wild-type capsid polypeptide are described.

Accordingly, one aspect provided herein is a viral capsid polypeptide bearing a mutation relative to SEQ ID NO: 2 (WT AAV2) in a region corresponding to amino acids 561-588.

In one embodiment of any aspect provided herein, the region corresponding to amino acids 561-588 comprises a sequence selected from SEQ ID NO: 4-41,337.

In one embodiment of any aspect provided herein, the capsid is an AAV capsid. In one embodiment of any aspect provided herein, the capsid is an AAV2 capsid.

In one embodiment of any aspect provided herein, the only variation relative to a wild-type AAV viral capsid is in the region corresponding to amino acids 561-588 of SEQ ID NO: 2.

Another aspect described herein provides an AAV VP1 capsid polypeptide bearing a mutation in the region corresponding to amino acids 561-588 of SEQ ID NO: 2.

In one embodiment of any aspect provided herein, the region corresponding to amino acids 561-588 of SEQ ID NO: 2 comprises a sequence selected from SEQ ID NO: 4-41,337.

In one embodiment of any aspect provided herein, the AAV VP1 polypeptide described herein is an AAV2 capsid polypeptide.

Another aspect described herein provides a viral capsid polypeptide comprising a sequence of SEQ ID NO: 2, wherein the region of amino acids 561-588 of SEQ ID NO: 2 comprises a variant sequence selected from SEQ ID NO: 4-41,337.

Another aspect described herein provides a variant of the viral capsid polypeptide of SEQ ID NO: 2, wherein the region of amino acids 561-588 comprises a sequence selected from SEQ ID NO: 4-41,337.

Another aspect described herein provides an AAV2 capsid polypeptide comprising a sequence of SEQ ID NO: 2, wherein the region of amino acids 561-588 of SEQ ID NO: 2 comprises a variant sequence selected from SEQ ID NO: 4-41,337.

Another aspect described herein provides an engineered AAV vector having at least one viral capsid polypeptide comprising any of the capsid polypeptides described herein.

Another aspect described herein provides a nucleic acid encoding any of the capsid polypeptide described herein.

Another aspect described herein provides a viral particle comprising any of the capsid polypeptide described herein.

Another aspect described herein provides a method for delivering a payload, the method comprising contacting a cell with any of the engineered AAV vectors described herein, or any of the viral particles described herein.

In one embodiment of any aspect provided herein, the contacting is sufficient to allow for expression of the payload in the cell.

Another aspect described herein provides a method for administering a payload, the method comprising administering to a subject any of the engineered AAV vectors described herein, or any of the viral particles described herein.

In one embodiment of any aspect provided herein, the administering is sufficient to allow for expression of the payload in the cell.

In one embodiment of any aspect provided herein, the payload is selected from the group consisting of: a nucleic acid, a polypeptide, an inhibitory RNA, an antibody or antibody reagent, an oligonucleotide, and an miRNA.

In yet another aspect, provided herein is a cell comprising a variant capsid polypeptide described herein or a polynucleotide encoding same. For example, a cell comprising a viral particle, where the viral particle comprises a variant capsid polypeptide described herein.

In still another aspect provided herein is a composition, e.g., a pharmaceutical composition comprising a variant capsid polypeptide described herein or a polynucleotide encoding same.

BRIEF DESCRIPTION OF THE DRAWINGS

FIG. 1 is a plot showing the proportion of attempted variants that demonstrate viable packaging ability using each method (VAE and DeepSearch). We include as baseline the success of random sampling for comparison.

DETAILED DESCRIPTION OF THE INVENTION

Described herein are viral vectors containing amino acid mutations in the capsid protein, VP1. Such vectors provide improvements in various functions of the viral vector, e.g., improvement in the degree of tissue targeting (e.g., tropism), payload packaging, delivery efficiency, etc. relative to vectors with wild-type capsid polypeptide. Alternatively, a viral vector comprising a mutated VP1 sequence has a decreased function, e.g., reduced or broadened tropism, relative to vectors with wild-type capsid polypeptide. In one embodiment, a viral vector comprising a mutated VP1 polypeptide comprises an improvement or reduction in at least two functions of the viral vector.

Mutations can be combined together in a single viral nucleic acid or a single viral protein sequence for improved properties. The following describes mutations to viral capsid polypeptides that permit viral genome packaging, yet modify viral vector function, including but not limited to, tropism, either positively, negatively, or both when mutations are combined, relative to given tissues or cell types. Also described are methods of using mutated viral capsid polypeptides and viral vectors comprising them to introduce nucleic acids to desired tissue or cell types, e.g., with improved selectivity for those tissue or cell types. The following provides description of various mutations and considerations for their use to generate viral vectors with improved properties. Mutant capsid proteins and nucleic acids encoding them can be used, e.g., for further viral improvement, for virus preparation and manufacture, and for safety and efficacy studies.

Mutant Capsid Polypeptides

One aspect of the technology described herein provides a viral capsid polypeptide bearing a mutation relative to SEQ ID NO: 2 in a region that corresponds to amino acids 561-588 (SEQ ID NO: 3). SEQ ID NO: 2 is an amino acid sequence encoding wild-type AAV2 capsid protein.

(SEQ ID NO: 2)
MAADGYLPDWLEDTLSEGIRQWWKLKPGPPPPKPAERHKDDSRGLV

LPGYKYLGPFNGLDKGEPVNEADAAALEHDKAYDRQLDSGDNPYLK

YNHADAEFQERLKEDTSFGGNLGRAVFQAKKRVLEPLGLVEEPVKTA

PGKKRPVEHSPVEPDSSSGTGKAGQQPARKRLNFGQTGDADSVPDPQ

PLGQPPAAPSGLGTNTMATGSGAPMADNNEGADGVGNSSGNWHCDS

TWMGDRVITTSTRTWALPTYNNHLYKQISSQSGASNDNHYFGYSTPW

GYFDFNRFHCHFSPRDWQRLINNNWGFRPKRLNFKLFNIQVKEVTQN

DGTTTIANNLTSTVQVFTDSEYQLPYVLGSAHQGCLPPFPADVFMVPQ

YGYLTLNNGSQAVGRSSFYCLEYFPSQMLRTGNNFTFSYTFEDVPFHS

SYAHSQSLDRLMNPLIDQYLYYLSRTNTPSGTTTQSRLQFSQAGASDIR

DQSRNWLPGPCYRQQRVSKTSADNNNSEYSWTGATKYHLNGRDSLV

NPGPAMASHKDDEEKFFPQSGVLIFGKQGSEKTNVDIEKVMITDEEEIR

TTNPVATEQYGSVSTNLQRGNRQAATADVNTQGVLPGMVWQDRDV

YLQGPIWAKIPHTDGHFHPSPLMGGFGLKHPPPQILIKNTPVPANPSTTF

-continued
SAAKFASFITQYSTGQVSVEIEWELQKENSKRWNPEIQYTSNYNKSVN

VDFTVDTNGVYSEPRPIGTRYLTRNL

SEQ ID NO: 3 is an amino acid sequence encoding the amino acid region between amino acids 561-588 of SEQ ID NO: 2.

(SEQ ID NO: 3)
DEEEIRTTNPVATEQYGSVSTNLQRGNR

In one embodiment, the region corresponding to amino acids 561-588 comprises a sequence selected from SEQ ID NO:4-41,337.

In one embodiment, the capsid is an AAV capsid. In one embodiment, the capsid is an AAV2 capsid.

Further provided herein is an AAV VP1 capsid polypeptide bearing a mutation in the region corresponding to amino acids 561-588 of SEQ ID NO: 2. In one embodiment, the region corresponding to amino acids 561-588 of SEQ ID NO: 2 comprises a sequence selected from SEQ ID NO: 4-41,337. In one embodiment of any aspect provided herein, the AAV VP1 polypeptide described herein is an AAV2 capsid polypeptide.

Further provided herein is a viral capsid polypeptide comprising a sequence of SEQ ID NO: 2, wherein the region of amino acids 561-588 comprises a sequence SEQ ID NO: 4-41,337.

Further provided herein is a variant of the viral capsid polypeptide of SEQ ID NO: 2, wherein the region of amino acids 561-588 comprises a sequence of SEQ ID NO: 4-41, 337.

Viruses are typically tropic for certain types of cells and or tissues in the natural host. In one embodiment, a mutant (i.e., variant) sequence of VP1 described herein alters tropism of the virus comprising the variant sequence. As used herein the term "alters tropism" refers to a mutation or set of mutations that changes the efficiency with which a viral vector delivers a nucleic acid to a given tissue or cell type, e.g., blood, brain, heart, kidney, liver, lung, or spleen, among others. In other words, a viral vector comprising a variant viral capsid polypeptide described herein exhibits altered characteristics in comparison to a viral vector comprising the wild-type capsid polypeptide, e.g., a polypeptide of SEQ ID NO: 2, including but not limited to, altered cellular or tissue tropism, cellular or tissue transduction, and/or antigenic properties.

The tropism of a virus or viral vector is generally defined by the structure of its outer surface that interacts with receptors or other cell surface determinants on target cells. For AAV vectors, among others, viral vector tropism is determined primarily by viral capsid polypeptides, and as described herein, the tropism of such vectors can be changed by changing the amino acid sequence of the viral capsid polypeptide. An amino acid change that changes the efficiency of viral vector delivery of a nucleic acid to a target cell or tissue type by at least 10% relative to a reference vector, often, but not necessarily relative to a wild-type vector, is an altered tropism. To be clear, an altered tropism can be an increase/enrichment by at least 10% (1.1×) or a decrease/de-enrichment by at least 10% (0.9×).

The term "tropism" refers to the ability of a viral vector to infect one or more specified cell types, but can also encompass how the vector functions to transduce the cell in the one or more specified cell types. In other words, tropism refers to preferential entry of the viral vector into certain cell or tissue type(s) and/or preferential interaction with the cell surface that facilitates entry into certain cell or tissue types, optionally and preferably followed by expression (e.g., transcription and, optionally, translation) of a transgene carried by the viral vector/particle in the cell. As used herein, the term "tropism profile" refers to the pattern of transduction of one or more target cells, tissues and/or organs.

As used herein, the term "transduction" refers to the introduction, by a viral vector, of a genetic payload and expression of one or more genes encoded therein. Thus, transduction refers to entry of the vector into the cell and the transfer of genetic material contained within the vector into the cell to obtain expression from the vector genome. In some cases, but not all cases, transduction and tropism may correlate.

As used here, "systemic tropism" and "systemic transduction" (and equivalent terms) indicate that the viral vector exhibits tropism for or transduces, respectively, tissues throughout the body (e.g., brain, lung, skeletal muscle, heart, liver, kidney and/or pancreas).

Methods for measuring viral vector tropism are known in the art. For example, viral vector tropism can be determined by measuring the ability of viral vector to transduce transgene in a cell of interest. This can be measured by the expression of a reporter protein and compared to a control viral vector, e.g., wild-type viral vector. Some exemplary reporter proteins include, but are not limited to, GFP, YFP, red cherry, β-galactosidase, or other reporter proteins known in the art.

In one embodiment, the mutation of the capsid polypeptide increases tropism, e.g., the virus comprising the mutated viral capsid polypeptide more efficiently delivers nucleic acid to the target cell type as compared a virus comprising a wild-type, or other reference, viral capsid polypeptide. In one embodiment, tropism is at least 1.1-fold (e.g., 10% greater than reference level, or 110% of the level reference level) more efficient as compared to a wild-type, or other reference, viral capsid polypeptide. In one embodiment, the delivery of a nucleic acid is at least 1.5-fold, at least 2-fold, at least 4-fold, at least 5-fold, at least 10-fold, or more, more efficient as compared to a virus comprising the wild-type viral capsid polypeptide. One of ordinary skill in the art can measure the delivery efficiency of a viral particle comprising any of the viral capsid polypeptides described herein, e.g., using PCR-based assays on an isolated targeted cell or tissue type (e.g., blood, heart, kidney, liver, lung, or spleen) to assess if the nucleic acid is delivered to and/or expressed in that targeted cell type. The expression of the nucleic acid delivered by a viral particle comprising either a viral capsid polypeptide as described herein or a wild-type, or other reference, viral capsid polyprotein can be compared to determine the change in expression as a measure of the efficiency of delivery.

In some embodiments of any one of the aspects, a viral vector comprising a variant viral capsid polypeptide as described herein exhibits increased tropism, as compared to a wild-type, or other reference, viral capsid polypeptide, for a cell or tissue selected from skeletal muscle, cardiac muscle, diaphragm muscle, pancreas (including (β-islet spleen, the gastrointestinal tract (e.g., epithelium and/or smooth muscle), cells of the central nervous system, liver, lung, joint cells, and/or kidney. For example, a viral vector comprising a variant viral capsid polypeptide as described herein exhibits increased tropism for a tissue or cell type selected from blood, brain, heart, kidney, liver, lung, and spleen.

In one embodiment, the mutation of the capsid polypeptide decreases tropism, e.g., the virus comprising the mutated viral capsid polypeptide delivers nucleic acid to a broader range of target cell types as compared to a virus comprising the wild-type, or other reference, viral capsid polypeptide. In one embodiment, the tropism is decreased by at least 10%. In other embodiments, the tropism is decreased by at least 20%, at least 30%, at least 40%, at least 50%, at least 60%, at least 70%, at least 80%, at least 90%, at least 99%, or more as compared to a virus comprising the wild-type, or other reference, viral capsid polypeptide. One skilled in the art can assess tropism of a virus using standard techniques, e.g., measuring local expression of a virus following in vivo delivery.

In some embodiments of any one of the aspects, a viral vector comprising a variant viral capsid polypeptides described herein exhibits a decreased tropism, as compared to a wild-type, or other reference, viral capsid polypeptide, for a cell or tissue selected from skeletal muscle, cardiac muscle, diaphragm muscle, pancreas (including (β-islet cells), spleen, the gastrointestinal tract (e.g., epithelium and/or smooth muscle), cells of the central nervous system, liver, lung, joint cells, and/or kidney. For example, a viral vector comprising a variant viral capsid polypeptides described herein exhibits decreased tropism for a tissue or cell type selected from blood, brain, heart, kidney, liver, lung, and spleen.

Variant VP1 polypeptides have been identified and assessed for effects on viral DNA packaging and viral infectivity of particular tissues. In one embodiment, the viral packaging is increased by at least 10%. In other embodiments, the viral packaging is increased or altered by at least 20%, at least 30%, at least 40%, at least 50%, at least 60%, at least 70%, at least 80%, at least 90%, at least 99%, or more as compared to a virus comprising the wild-type, or other reference, viral capsid polypeptide.

In one embodiment, the viral packaging is decreased by at least 10%. Alterations in packaging include, but are not limited to alterations in the rate or efficiency of packaging, or, for example, alterations in the amount of vector sequence that can be packaged while retaining viral infectivity. In one embodiment, the viral infectivity is increased by at least 10% or more. In one embodiment, the viral infectivity is increased by 10%. In other embodiments, the viral infectivity is increased by 20%, 30%, 40%, 50%, or more as compared to a virus comprising the wild-type viral capsid polypeptide. In one embodiment, the viral infectivity is decreased by at least 10%. In other embodiments, the viral infectivity is decreased by at least 20%, at least 30%, at least 40%, at least 50%, at least 60%, at least 70%, at least 80%, at least 90%, at least 99%, or more as compared to a virus comprising the wild-type, or other reference, viral capsid polypeptide. A decreased in infectivity can be tolerated, e.g., where there are other beneficial changes provided by the mutation. Viral packaging and infectivity can be assessed by one skilled in the art using standard techniques, e.g., measuring the viral titer in a sample that has been contacted with an AAV virus or viral particle comprising any of the viral capsid polypeptides described herein.

Particular regions of AAV2 capsid protein tolerate amino acid alterations, e.g., deletion, insertion, or substitution better than others, and changes to certain regions that tolerate such change can have pronounced impact on viral vector tropism, among other functions. The region of the AAV2 capsid polypeptide of SEQ ID NO: 3, which is amino acids 561-588 of SEQ ID NO: 2, is identified herein as being tolerant of a variety of changes.

One aspect of the technology described herein is a nucleic acid, e.g., a polynucleotide encoding any of the viral capsid polypeptides described herein. One skilled in the art can alter the wild-type VP1 sequence (SEQ ID NO: 1), e.g., by introducing at least one base pair substitution, such that the altered sequence encodes a variant amino acid sequence. The nucleic acid sequence for each codon is known in the art and presented herein in Table 1. For example, to alter an amino acid from an isoleucine (which is translated by the nucleotide sequence AUU) to valine (which is translated by the nucleotide sequence GUU), one would change the first nucleotide from an A to G. In one embodiment, the nucleic acid sequence of SEQ ID NO: 1 is altered such that the region of amino acids 561-588 of the altered sequence encodes a sequence of SEQ ID NO: 4-41,337. Site-directed mutagenesis is known in the art and can be used to introduce a point mutation(s) (e.g., amino acid substitutions, insertions, or deletions) or other mutations or combinations thereof to a viral capsid polypeptide. Site-directed mutagenesis is further described in, e.g., Li B, et al. *Hum Gene Ther Methods.* 2015 December: 26(6):211-20, and Bachman, *J. Methods Enzymol.* 2013; 529:241-248, which are incorporated herein by reference in their entireties.

In one embodiment, the nucleotide sequence comprises at least 1 point mutation. In one embodiment, the nucleotide sequence comprises at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84 or more point mutations.

In some embodiments, the nucleotide sequence comprises no more than 2, no more than 3, no more than 4, no more than 5, no more than 6, no more than 7, no more than 8, no more than 9, no more than 10, no more than 11, no more than 12, no more than 13, no more than 14, no more than 15, no more than 16, no more than 17, no more than 18, no more than 19, no more than 20, no more than 21, no more than 22, no more than 23, no more than 24, no more than 25, no more than 26, no more than 27, no more than 28, no more than 29, no more than 30, no more than 31, no more than 32, no more than 33, no more than 34, no more than 35, no more than 36, no more than 37, no more than 38, no more than 39, no more than 40, no more than 41, no more than 42, no more than 43, no more than 44, no more than 45, no more than 46, no more than 47, no more than 48, no more than 49, no more than 50, no more than 51, no more than 52, no more than 53, no more than 54, no more than 55, no more than 56, no more than 57, no more than 58, no more than 59, no more than 60, no more than 61, no more than 62, no more than 63, no more than 64, no more than 65, no more than 66, no more than 67, no more than 68, no more than 69, no more than 70, no more than 71, no more than 72, no more than 73, no more than 74, no more than 75, no more than 76, no more than 77, no more than 78, no more than 79, no more than 80, no more than 81, no more than 82, no more than 83, or no more than 84 point mutations.

In one embodiment, the nucleotide sequence comprises at least 1 point mutation in the region encoding amino acids 561-588 of SEQ ID NO: 2. For example, the nucleotide sequence comprises at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, or 84 point mutations in the region encoding amino acids 561-588 of SEQ ID NO: 2.

In some embodiments, the nucleotide sequence comprises no more than 1, no more than 2, no more than 3, no more than 4, no more than 5, no more than 6, no more than 7, no more than 8, no more than 9, no more than 10, no more than 11, no more than 12, no more than 13, no more than 14, no more than 15, no more than 16, no more than 17, no more than 18, no more than 19, no more than 20, no more than 21, no more than 22, no more than 23, no more than 24, no more than 25, no more than 26, no more than 27, no more than 28, no more than 29, no more than 30, no more than 31, no more than 32, no more than 33, no more than 34, no more than 35, no more than 36, no more than 37, no more than 38, no more than 39, no more than 40, no more than 41, no more than 42, no more than 43, no more than 44, no more than 45, no more than 46, no more than 47, no more than 48, no more than 49, no more than 50, no more than 51, no more than 52, no more than 53, no more than 54, no more than 55, no more than 56, no more than 57, no more than 58, no more than 59, no more than 60, no more than 61, no more than 62, no more than 63, no more than 64, no more than 65, no more than 66, no more than 67, no more than 68, no more than 69, no more than 70, no more than 71, no more than 72, no more than 73, no more than 74, no more than 75, no more than 76, no more than 77, no more than 78, no more than 79, no more than 80, no more than 81, no more than 82, no more than 83, or no more than 84 point mutations in the region encoding amino acids 561-588 of SEQ ID NO: 2.

In one embodiment, the nucleic acid sequence is altered such that it encodes at least 1 variant amino acid. In one embodiment, the nucleic acid sequence is altered such that it encodes at least 2, 3, 4, 5, 6, 7, 8, 9, 10, 11, 12, 13, 14, 15, 16, 17, 18, 19, 20, 21, 22, 23, 24, 25, 26, 27, 28 or more variant amino acids. For clarity, it is noted that a variant amino acid means an amino acid that is different from the one encoded by a nucleic acid sequence encoding SEQ ID NO: 2.

In some embodiments, the nucleic acid sequence is altered such that it encodes no more than 2, no more than 3, no more than 4, no more than 5, no more than 6, no more than 7, no more than 8, no more than 9, no more than 10, no more than 11, no more than 12, no more than 13, no more than 14, no more than 15, no more than 16, no more than 17, no more than 18, no more than 19, no more than 20, no more than 21, no more than 22, no more than 23, no more than 24, no more than 25, no more than 26, no more than 27, or no more than 28 variant amino acids.

In one embodiment, the nucleic acid sequence is altered such that it encodes at least 1 variant amino acid in the region corresponding to amino acids 561-588 of SEQ ID NO: 2. For Example, the nucleic acid sequence is altered such that it encodes at least 2, 3, 4, 5, 6, 7, 8, 9, 10, 11, 12, 13, 14, 15, 16, 17, 18, 19, 20, 21, 22, 23, 24, 25, 26, 27, 28 or more variant amino acids in the region corresponding to amino acids 561-588 of SEQ ID NO: 2.

In some embodiments, the nucleic acid sequence is altered such that it encodes no more than 2, no more than 3, no more than 4, no more than 5, no more than 6, no more than 7, no more than 8, no more than 9, no more than 10, no more than 11, no more than 12, no more than 13, no more than 14, no more than 15, no more than 16, no more than 17, no more than 18, no more than 19, no more than 20, no more than 21, no more than 22, no more than 23, no more than 24, no more than 25, no more than 26, no more than 27, or no more than 28 variant amino acids in the region corresponding to amino acids 561-588 of SEQ ID NO: 2.

TABLE 1

Nucleotide codons for amino acids

| AA | Codons |
|---|---|
| Ala | GCT, GCC, GCA, GCG |
| Arg | CGT, CGC, CGA, CGG, AGA, AGG |
| Asn | AAT, AAC |
| Asp | GAT, GAC |
| Cys | TGT, TGC |
| Gln | CAA, CAG |
| Glu | GAA, GAG |
| Gly | GGT, GGC, GGA, GGG |
| His | CAT, CAC |
| Ile | ATT, TAC, ATA |
| Leu | TTA, TTG, CTT, CTA, CTG |
| Lys | AAA, AAG |
| Met | ATG |
| Phe | TTT, TTC |
| Pro | CCT, CCC, CCA, CCG |
| Ser | TCT, TCC, TCA, TCG, AGT, AGC |
| Thr | ACT, ACC, ACA, ACG |
| Trp | TGG |
| Tyr | TAT, TAC |
| Val | GTT, GTC, GTA, GTG |
| Start | ATG |
| Stop | TAA, TGA, TAG |

In some embodiments, a polynucleotide encoding a variant viral capsid polypeptide described herein is operably linked to a promoter sequence, for example, a promoter sequence that drives expression of the polynucleotide in a cell. In some embodiments, the polynucleotide further comprises a sequence that encodes a REP protein, e.g., an AAV rep protein. In some embodiments, the polynucleotide further comprises a sequence that encodes a CAP protein, e.g., an AAV CAP protein.

Another aspect of the technology described herein is a viral particle comprising any of the viral capsid polypeptides described herein. It is noted that a viral particle comprising a variant capsid polypeptide as described herein can be replication-competent or replication-incompetent. Thus, in some embodiments, the viral particle comprising a variant capsid polypeptide as described herein is replication-competent. As used herein, the term "replication-competent" refers to a virus or viral particle that is infectious, and is also capable of being replicated in an infected cell (i.e. in the presence of a helper virus or helper virus functions). In the case of AAV, replication competence generally requires the presence of functional AAV packaging genes.

In some other embodiments, the viral particle comprising a variant capsid polypeptide as described herein is replication-incompetent or replication defective. As used herein, the terms "replication-incompetent" and "replication defective" refer to a virus or viral particle that cannot independently replicate and package its genome. For example, when a cell is infected with the virus or viral particle, the heterologous gene is expressed in the infected cells, however, the virus or the viral particle is not able to replicate further.

In some embodiments, the viral particle further comprises a polynucleotide encoding a transgene, e.g., a polynucleotide comprising a sequence that encodes a gene product such as a therapeutic gene product. In some embodiments, the polynucleotide is flanked on the 5' and 3' ends by functional AAV inverted terminal repeat (ITR) sequences. By "functional AAV ITR sequences" is meant that the ITR sequences function as intended for the rescue; replication and packaging of the AAV virion. Hence; AAV ITRs for use in the gene delivery vectors need not have a wild-type nucleotide sequence, and can be altered by the insertion, deletion or substitution of nucleotides or the AAV ITRs can be derived from any of several AAV serotypes, e.g. AAV1, AAV2, AAV3, AAV4, AAV5, AAV6, AAV7, AAV8, AAV9, and AAV10. In some embodiments, the viral particles have the wild type REP and CAP genes deleted in whole or part, but retain functional flanking ITR sequences.

One skilled in the art can make viral particles comprising a variant capsid polypeptide described herein using standard methods. For example, an AAV expression vector comprising a polynucleotide cassette can be introduced into a producer cell, followed by introduction of an AAV helper construct comprising a polynucleotide sequence encoding a variant capsid polypeptide described herein, and where the helper construct includes AAV coding regions capable of being expressed in the producer cell and which complement AAV helper functions absent in the AAV vector. This is followed by introduction of helper virus and/or additional vectors into the producer cell, wherein the helper virus and/or additional vectors provide accessory functions capable of supporting efficient rAAV virus production. The producer cells are then cultured to produce rAAV. Some exemplary methods for producing viral particles amenable to the presently disclosed technology are described, for example, in U.S. Pat. Nos. 5,436,146; 5,753,500; 6,040,183, 6,093,570 and 6,548,286, contents of each of which is incorporated herein by reference in their entireties.

In one example, viral particles comprising a variant polypeptide described herein can be produced by first generating a DNA library of AAV capsid variants. Libraries of AAV2 capsid gene sequence variants are cloned into a plasmid containing the AAV Inverted Terminal Repeat regions (ITRs). The final ITR plasmids contain, e.g., a cytomegalovirus (CMV) promoter upstream of the Cap gene. AAV virus libraries are produced from the DNA libraries. The capsid library plasmids, AAV pHelper plasmids, and plasmids containing the AAV2 Rep gene are co-transfected into HEK-293T cells using PEI. Capsids are purified using standard techniques for cell lysis (freeze-thaw or addition of 5 M NaCl), treatment with benzonase to remove unpackaged genomes, and purification and concentration by iodixanol ultra-centrifugation.

In preparing the viral particles, any host cells for producing recombinant viral particles can be employed, including, for example, mammalian cells, insect cells, plant cells, microorganisms and yeast. Host cells can also be packaging cells in which the AAV rep and cap genes are stably maintained in the host cell or producer cells in which the AAV vector genome is stably maintained and packaged. Exemplary packaging and producer cells include but are not limited to HeLa cells, COS cells, COS-1 cells, COS-7 cells, HEK293 cells, A549 cells, BHK cells, BSC-1 cells, BSC-40 cells, Vero cells, Sfc9 cells, Sf-21 cells, Tn-368 cells, BTI-Tn-5B1-4 (High-Five) cells, Saos cells, C2C12 cells, L cells, HT1080 cells, HepG2 cells, WEHI cells, 3T3 cells, 10T1/2 cells, MDCK cells, BMT-10 cells, WI38 cells, or primary fibroblast, hepatocyte or myoblast cells derived from mammals.

In vivo packaging ability of viral capsid variants was measured, e.g., using methods described herein above. The number of viruses that were packaged ("virus") compared to the number of input viral genomes ("plasmid") were determined. Measuring the frequency of capsid (or other library component) mutants before and after selection reveals which mutations are beneficial and which are deleterious based on the particular selection method.

Also provided herein is a cell comprising a variant viral capsid polypeptide described herein or a polynucleotide encoding a variant viral capsid polypeptide described herein. The cell can be a prokaryotic cell or a eukaryotic cell. For example, the cell can be a mammalian cell, insect cell, plant cell, bacterial cell or yeast cell. Some exemplary cells include, but are not limited to, alveolar cells, basophils, cardiac smooth muscle cells, cardiomyocytes, collecting duct intercalated cells, collecting duct principal cells, ectodermal cells, endocardial cells, endoderm cells, eosinophils, epithelial cells, hepatic stellate cells, interstitial kidney cells, intrahepatic lymphocytes, kidney distal tubule cells, kidney glomerulus parietal cells, kidney glomerulus podocytes, kidney proximal tubule brush border cells, loop of Henle thin segment cells, lung epithelial cells, lung smooth muscle cells, lymphocytes, monocytes, muscle cells, neutrophils, non-parenchymal cells, parenchymal cells, phagocytic Kupffer cells, platelets, red blood cells, sinusoidal endothelial cells, splenic endothelial cells, splenic fibroblasts, splenocytes, and thick ascending limb cells.

In some embodiments, the cell can be a cell used for producing a viral particle, e.g., a producer cell.

In some embodiments, the cell can be a cell which has been transduced, infected, transfected or transformed with a viral vector described herein. Typically, a cell is referred to as "transduced", "infected"; "transfected" or "transformed" dependent on the means used for administration, introduction or insertion of heterologous DNA (i.e., the viral vector) into the cell.

Also provided herein are pharmaceutical compositions comprising a variant capsid polypeptide described herein or a polynucleotide encoding same and one or more pharmaceutically acceptable diluent, carrier, or excipient. For example, the composition can comprise a viral particle comprising a variant capsid polypeptide described herein. In some embodiments, the composition can comprise a cell, wherein the cell comprises a variant capsid polypeptide described herein or a polynucleotide encoding same.

For example, the variant capsid polypeptide or a polynucleotide encoding same (as is or as encompassed in a viral particle or cell) can be combined with pharmaceutically-acceptable carriers, diluents and reagents useful in preparing a formulation that is generally safe, non-toxic, and desirable, and includes excipients that are acceptable for primate use. Such excipients can be solid, liquid, semisolid, or, in the case of an aerosol composition, gaseous. Examples of such carriers or diluents include, but are not limited to, water, saline, Ringer's solutions, dextrose solution, and 5% human serum albumin. Supplementary active compounds can also be incorporated into the formulations. Solutions or suspensions used for the formulations can include a sterile diluent such as water for injection, saline solution, fixed oils, polyethylene glycols, glycerine, propylene glycol or other synthetic solvents; antibacterial compounds such as benzyl alcohol or methyl parabens; antioxidants such as ascorbic acid or sodium bisulfite; chelating compounds such as ethylenediaminetetraacetic acid (EDTA); buffers such as acetates, citrates or phosphates; detergents such as Tween 20 to prevent aggregation; and compounds for the adjustment of tonicity such as sodium chloride or dextrose. The pH can be adjusted with acids or bases, such as hydrochloric acid or sodium hydroxide. In particular embodiments, the pharmaceutical compositions are sterile. For instances in which ocular cells are to be contacted in vivo, the subject polynucleotide cassettes or gene delivery vectors comprising the subject polynucleotide cassette can be treated as appropriate for delivery to the eye.

Pharmaceutical compositions can further include sterile aqueous solutions or dispersions and sterile powders for the extemporaneous preparation of sterile injectable solutions or dispersion. For intravenous administration, suitable carriers include physiological saline, bacteriostatic water, or phosphate buffered saline (PBS). In some cases, the composition is sterile and should be fluid to the extent that easy syringability exists. In certain embodiments, it is stable under the conditions of manufacture and storage and is preserved against the contaminating action of microorganisms such as bacteria and fungi. The carrier can be, e.g., a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the internal compositions can be brought about by including in the composition an agent which delays absorption, for example, aluminum monostearate and gelatin.

Corresponding Mutations

Mutations at corresponding locations in, for example homologous viral capsid polypeptides, would be expected to have similar effects on viral function. Corresponding locations can include, for example, a location relative to the full length capsid polypeptide (e.g., SEQ ID NO: 2), or for that matter, a location relative to a sub-domain or sub-region of the full length capsid polypeptide (e.g., SEQ ID NO: 3). In one aspect, a viral capsid polypeptide is provided herein that bears a mutation that corresponds to a mutation of the polypeptide of SEQ ID NO: 2, e.g., SEQ ID NO: 4-41,337, as described herein. In one embodiment, a homologous viral capsid polypeptide has at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or more sequence identity to wild-type AAV2 capsid protein (e.g., SEQ ID NO: 2). In another embodiment, the viral capsid polypeptides of AAV serotypes 1, and 3-13 are homologous to an AAV2 capsid polypeptide.

One aspect described herein is a viral capsid polypeptide comprising a region corresponding to the amino acid sequence of SEQ ID NO: 3, wherein the region corresponding to the amino acid sequence of SEQ ID NO: 3 comprises a mutation relative to SEQ ID NO: 3 that, e.g., alters the function of the virus comprising the viral capsid polypeptide, wherein the mutation is selected from SEQ ID NO: 4-41,337. In one embodiment, a homologous viral capsid polypeptide has a region with at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or more sequence identity to SEQ ID NO: 3.

As noted elsewhere herein, the identification of amino acid sites or regions of amino acid sequence in the AAV2 capsid polypeptide of SEQ ID NO: 2 that tolerate change in general, i.e., that permit functions of the viral vector can be used to guide changes in the capsid polypeptides of other AAV serotypes to similarly influence function or provide for modified properties. Thus, through use of sequence alignment, a mutation or set of mutations that provides a desired change in function for AAV2 capsid polypeptide of SEQ ID NO: 2 can be introduced to the corresponding location of the capsid polypeptide of another AAV serotype to similarly influence those properties in that serotype. It is contemplated that the introduction of changes identified herein in this amino acid 561-588 sub-region of the AAV2 capsid polypeptide to the corresponding region or sub-region of another AAV serotype capsid polypeptide will influence the function of that AAV serotype in a similar manner.

As used herein, "mutation" refers to any change in the amino acid sequence, e.g., a substitution, insertion, or deletion of at least one amino acid. Site-directed mutations in the nucleic acid sequence can be generated by one skilled in the art using techniques known in the art or described herein.

Mutations that are at equivalent positions in other homologous viruses can be made and used for improving, e.g., virus packaging and virus infectivity. Examples of other homologous viruses include any of AAV serotypes 1, and 3-12, as well as other natural isolates or synthetic sequences. Corresponding positions in homologous viruses can be inferred from sequence homology to AAV2. In one embodiment, the mutations described herein are introduced into the corresponding amino acid sequence of an AAV1, AAV3, AAV3B, AAV4, AAV5, AAV6, AAV7, AAV8, AAV9, AAV10, AAV11, AAV12, or AAV13 capsid polypeptide.

Methods for Delivering Nucleic Acid

Provided herein is a method of delivering a payload to a cell comprising contacting a cell with an AAV virus or viral particle comprising any of the viral capsid polypeptides described herein. In one embodiment, the contacting occurs in vitro. In one embodiment, the contacting occurs ex vivo.

The term "contacting" or "contact" as used herein in connection with contacting a cell with an AAV virus or viral particle includes subjecting the cell to an appropriate culture medium which comprises the AAV virus or viral particle. Where the cell is in vivo, "contacting" or "contact" includes administering the AAV virus or viral particle in a pharmaceutical composition to a subject via an appropriate administration route such that the virus or viral particle contacts the cell in vivo.

Further provided herein is a method of delivering a payload in vivo to a target cell, comprising administering an AAV virus or viral particle comprising any of the viral capsid polypeptides described herein to a subject. In one embodiment, in vivo is systemic delivery.

Exemplary target or host cells include blood cells (e.g., red blood cells, platelets, neutrophils, eosinophils, basophils, lymphocytes, or monocytes); heart cells (e.g., cardiomyocyte, endocardial cells, or cardiac smooth muscle cells); muscle cells; epithelial cells; endoderm cells; ectodermal cells; kidney cells (e.g., kidney glomerulus parietal cells, kidney glomerulus podocytes, kidney proximal tubule brush border cells, loop of Henle thin segment cells, thick ascending limb cells, kidney distal tubule cells, collecting duct principal cells, collecting duct intercalated cells, and interstitial kidney cells); liver cells (e.g., parenchymal cells, non-parenchymal cells, sinusoidal endothelial cells, phagocytic Kupffer cells, hepatic stellate cells, and intrahepatic lymphocytes); lung cells (e.g., lung epithelial cells, lung smooth muscle cells, and alveolar cells); and spleen cells (e.g., splenocytes, splenic endothelial cells and splenic fibroblasts).

In vivo delivery of the AAV virus or viral particle can be, for example, by injection, infusion, instillation, inhalation, or ingestion. "Injection" includes, without limitation, intravenous, intramuscular, intraarterial, intrathecal, intraventricular, intracapsular, intraorbital, intracardiac, intradermal, intraperitoneal, transtracheal, subcutaneous, subcuticular, intraarticular, sub capsular, subarachnoid, intraspinal, intracerebro spinal, intrasternal injection and infusion. The AAV virus or viral particle can be administered as a single bolus or multiple boluses, as a continuous infusion, or a combination thereof. In some embodiments, the AAV virus or viral particle can be administered into the blood stream of the subject.

The dose of AAV virions or viral particles required to achieve a particular "therapeutic effect," e.g., the units of dose in vector genomes/per kilogram of body weight (vg/kg), will vary based on several factors including, but not limited to: the route of AAV virus or viral particle administration, the level of gene expression required to achieve a therapeutic effect, the specific disease or disorder being treated, a host immune response to the AAV virus or viral particle, a host immune response to the gene expression product, and the stability of the gene product. One of skill in the art can readily determine a AAV virus or viral particle dose range to treat a patient having a particular disease or disorder based on the aforementioned factors, as well as other factors that are well known in the art. Generally speaking, by "therapeutic effect" is meant a level of expression of one or more transgenes in the AAV virus or viral particle sufficient to alter a component of a disease (or disorder) toward a desired outcome or clinical endpoint, such that a patient's disease or disorder shows clinical improvement, often reflected by the amelioration of a clinical sign or symptom relating to the disease or disorder. Exemplary doses for achieving therapeutic effects are AAV virus or viral particle titers of at least about $10^5$, $10^6$, $10^7$, $10^8$, $10^9$, $10^{10}$, $10^{11}$, $10^{12}$, $10^{13}$, $10^{14}$, $10^{15}$, $10^{16}$ transducing units or more. For example, from about $10^8$ to about $10^{13}$ transducing units. It is noted that more than one administration (e.g., two, three, four, or more administrations) can be employed to achieve desired (e.g. therapeutic) levels of gene expression.

Levenshtein Distance

The Levenshtein distance has been calculated for the variant capsid polypeptides described herein. As used herein, the "Levenshtein distance" refers to a string metric for measuring the difference between two sequences. For example, the Levenshtein distance between two sequences is the minimum number of single-base pair edits (i.e. insertions, deletions, or substitutions) required to change one sequence into the other. In one embodiment, the variant capsid polypeptide has a Levenshtein distance of 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36 or more as compared to SEQ ID NO: 2 (wild-type VP1). The Levenshtein distance can be calculated by one skilled in the art, e.g., using the formula herein below the Levenshtein distance between two strings a, b (of length |a| and |b| respectively) is given by leva,b(|a|,|b|) where:

$$lev_{a,b}(i, j) = \begin{cases} \max(i, j) & \text{if } \min(i, j) = 0, \\ \min \begin{cases} lev_{a,b}(i-1, j)+1 \\ lev_{a,b}(i, j-1)+1 \\ lev_{a,b}(i-1, j-1)+1_{(a_i \neq b_j)} \end{cases} & \text{otherwise.} \end{cases}$$

where 1(ai≠bi) is the indicator function equal to 0 when ai≠bi and equal to 1 otherwise, and leva, b(i,j) is the distance between the first i characters of a and the first j characters of b.

Note that the first element in the minimum corresponds to deletion (from a to b), the second to insertion and the third to match or mismatch, depending on whether the respective symbols are the same.

Table 2 denotes the SEQ ID NOs that correspond to a particular Levenshtein distance to the wild-type (e.g., SEQ ID NO: 2). The SEQ IN NOs boundaries are inclusive (e.g. start_SEQ ID NO: 10, and end_SEQ ID NO: 15, means both SEQ ID NO: 10 and SEQ ID NO: 15 are included in the range).

TABLE 2

Levenshtein distance of sequences to the wild-type (SEQ ID NO: 2)

| Distance from Wild-type | Start SEQ ID NO | End SEQ ID NO |
|---|---|---|
| 0 | 2 | 3 |
| 2 | 4 | 5946 |
| 3 | 5947 | 14914 |
| 4 | 14915 | 23541 |
| 5 | 23542 | 30508 |
| 6 | 30509 | 36121 |
| 7 | 36122 | 37072 |
| 8 | 37073 | 37874 |
| 9 | 37875 | 38557 |
| 10 | 38558 | 39153 |
| 11 | 39154 | 39632 |
| 12 | 39633 | 39955 |
| 13 | 39956 | 40167 |
| 14 | 40168 | 40326 |
| 15 | 40327 | 40444 |
| 16 | 40445 | 40521 |
| 17 | 40522 | 40597 |
| 18 | 40598 | 40675 |
| 19 | 40676 | 40766 |
| 20 | 40767 | 40880 |
| 21 | 40881 | 41009 |
| 22 | 41010 | 41157 |
| 23 | 41158 | 41251 |
| 24 | 41252 | 41310 |
| 25 | 41311 | 41327 |
| 26 | 41328 | 41331 |
| 28 | 41332 | 41333 |
| 30 | 41334 | 41334 |
| 32 | 41335 | 41335 |
| 35 | 41336 | 41336 |
| 36 | 41337 | 41337 |

Some exemplary embodiments of the invention can be described by the following numbered embodiments:

Embodiment 1: A viral capsid polypeptide bearing a mutation relative to SEQ ID NO: 2 (WT AAV2) in a region corresponding to amino acids 561-588.

Embodiment 2: The viral capsid polypeptide of Embodiment 1, wherein the region corresponding to amino acids 561-588 comprises a sequence selected from SEQ ID NO: 4-41,337.

Embodiment 3: The viral capsid polypeptide of Embodiments 1 or 2, which is an AAV capsid polypeptide.

Embodiment 4: The viral capsid polypeptide of any of Embodiments 1-3, which is an AAV2 capsid polypeptide.

Embodiment 5: An AAV VP1 capsid polypeptide bearing a mutation in the region corresponding to amino acids 561-588 of SEQ ID NO: 2.

Embodiment 6: The AAV VP1 capsid polypeptide of Embodiment 5, wherein the region corresponding to amino acids 561-588 of SEQ ID NO: 2 comprises a sequence selected from SEQ ID NO: 4-41,337.

Embodiment 7: The AAV VP1 capsid polypeptide of Embodiments 5 or 6, which is an AAV2 capsid polypeptide.

Embodiment 8: A viral capsid polypeptide comprising a sequence of SEQ ID NO: 2, wherein the region of amino acids 561-588 of SEQ ID NO: 2 comprises a variant sequence selected from SEQ ID NO: 4-41,337.

Embodiment 9: A variant viral capsid polypeptide of SEQ ID 2, wherein the region of amino acids 561-588 comprises a sequence of SEQ ID NO: 4-41,337.

Embodiment 10: An AAV2 capsid polypeptide comprising a sequence of SEQ ID NO: 2, wherein the region of amino acids 561-588 of SEQ ID NO: 2 comprises a variant sequence selected from SEQ ID NO: 4-41,337.

Embodiment 11: An engineered AAV vector having at least one capsid polypeptide comprising any one of the capsid polypeptides of Embodiments 1-10.

Embodiment 12: A nucleic acid encoding the capsid polypeptide of any one of Embodiments 1-10.

Embodiment 13: A viral particle comprising a capsid polypeptide of any one of Embodiments 1-10.

Embodiment 14: A method for delivering a payload, the method comprising contacting a cell with any of the engineered AAV vectors of Embodiment 12, or viral particles of Embodiment 13.

Embodiment 15: The method of Embodiment 14, wherein the contacting is sufficient to allow for expression of the payload in the cell.

Embodiment 16: A method for administering a payload, the method comprising administering to a subject any of the engineered AAV vectors of Embodiment 12, or viral particles of Embodiment 13.

Embodiment 17: The method of Embodiment 16, wherein the administering is sufficient to allow for expression of the payload in the cell.

Embodiment 18: The method of any of Embodiments 14-17, wherein the payload is selected from the group consisting of: a nucleic acid, a polypeptide, an inhibitory RNA, an antibody or antibody reagent, an oligonucleotide, and a miRNA.

Definitions

For convenience, the meaning of some terms and phrases used in the specification, examples, and appended claims, are provided below. Unless stated otherwise, or implicit from context, the following terms and phrases include the meanings provided below. The definitions are provided to aid in describing particular embodiments, and are not intended to limit the claimed technology, because the scope of the technology is limited only by the claims. Unless otherwise defined, all technical and scientific terms used herein have the same meaning as commonly understood by one of ordinary skill in the art to which this technology belongs. If there is an apparent discrepancy between the usage of a term in the art and its definition provided herein, the definition provided within the specification shall prevail.

Definitions of common terms in immunology and molecular biology can be found in The Merck Manual of Diagnosis and Therapy, 19th Edition, published by Merck Sharp & Dohme Corp., 2011 (ISBN 978-0-911910-19-3); Robert S. Porter et al. (eds.), The Encyclopedia of Molecular Cell Biology and Molecular Medicine, published by Blackwell Science Ltd., 1999-2012 (ISBN 9783527600908); and Robert A. Meyers (ed.), Molecular Biology and Biotechnology: a Comprehensive Desk Reference, published by VCH Publishers, Inc., 1995 (ISBN 1-56081-569-8); Immunology by Werner Luttmann, published by Elsevier, 2006; Janeway's Immunobiology, Kenneth Murphy, Allan Mowat, Casey Weaver (eds.), Taylor & Francis Limited, 2014 (ISBN 0815345305, 9780815345305); Lewin's Genes XI, published by Jones & Bartlett Publishers, 2014 (ISBN- 1449659055); Michael Richard Green and Joseph Sambrook, Molecular Cloning: A Laboratory Manual, 4th ed., Cold Spring Harbor Laboratory Press, Cold Spring Harbor, N.Y., USA (2012) (ISBN 1936113414); Davis et al., Basic Methods in Molecular Biology, Elsevier Science Publishing, Inc., New York, USA (2012) (ISBN 044460149X); Laboratory Methods in Enzymology: DNA, Jon Lorsch (ed.) Elsevier, 2013 (ISBN 0124199542); Current Protocols in Molecular Biology (CPMB), Frederick M. Ausubel (ed.), John Wiley and Sons, 2014 (ISBN 047150338X, 9780471503385), Current Protocols in Protein Science (CPPS), John E. Coligan (ed.), John Wiley and Sons, Inc., 2005; and Current Protocols in Immunology (CPI) (John E. Coligan, ADA M Kruisbeek, David H Margulies, Ethan M Shevach, Warren Strobe, (eds.) John Wiley and Sons, Inc., 2003 (ISBN 0471142735, 9780471142737), the contents of which are all incorporated by reference herein in their entireties. As used herein, the term "comprising" means that other elements can also be present in addition to the defined elements presented. The use of "comprising" indicates inclusion rather than limitation.

The term "consisting of" refers to compositions, methods, and respective components thereof as described herein, which are exclusive of any element not recited in that description of the embodiment.

As used herein the term "consisting essentially of" refers to those elements required for a given embodiment. The term permits the presence of additional elements that do not materially affect the basic and novel or functional characteristic(s) of that embodiment of the technology.

The word "or" is intended to include "and" unless the context clearly indicates otherwise.

In some embodiments, the terms "a" and "an" and "the" and similar references used in the context of describing a particular embodiment of the invention (especially in the context of certain of the following claims) can be construed to cover both the singular and the plural. The recitation of ranges of values herein is merely intended to serve as a shorthand method of referring individually to each separate value falling within the range. Unless otherwise indicated herein, each individual value is incorporated into the specification as if it were individually recited herein. All methods described herein can be performed in any suitable order unless otherwise indicated herein or otherwise clearly contradicted by context. The use of any and all examples, or exemplary language (e.g. "such as") provided with respect to certain embodiments herein is intended merely to better illuminate the invention and does not pose a limitation on the scope of the invention otherwise claimed. No language in the specification should be construed as indicating any non-claimed element essential to the practice of the invention.

The abbreviation, "e.g." is derived from the Latin Exempli gratia, and is used herein to indicate a non-limiting example. Thus, the abbreviation "e.g." is synonymous with the term "for example."

As used herein, the term "viral capsid polypeptide" refers to the proteinaceous shell or coat of a viral particle. At a minimum, a viral capsid polypeptide as described herein permits packaging or assembly of the capsid polypeptide into a viral particle that is competent for delivery of nucleic acid to the host cell. Capsids function to encapsidate, protect, transport, and release into a host cell a viral genome. Capsids are generally comprised of oligomeric structural subunits of a polypeptide of the viral capsid polypeptides. As used herein, the term "encapsidated" means enclosed within a viral capsid. As an example, the AAV genome comprises three overlapping sequences which encode capsid proteins, VP1, VP2 and VP3, which start from one promoter, p40. The AAV capsid is composed of a mixture of VP1, VP2, and VP3 totaling 60 monomers arranged in icosahedral symmetry in a ratio of 1:1:10.

As used herein, "packaging" refers to a series of intracellular events that result in the assembly and encapsidation of an AAV particle.

As used herein, "payload" refers to a nucleic acid which is encapsidated within a viral vector, e.g., an AAV vector. A payload nucleic acid can encode, e.g., a polypeptide, an inhibitory RNA, an antibody or antibody reagent, an oligonucleotide, or a miRNA.

The term "polypeptide" as used herein refers to a polymer of amino acids. The terms "protein" and "polypeptide" are used interchangeably herein. A peptide is a relatively short polypeptide, typically between about 2 and 60 amino acids in length. Polypeptides used herein typically contain amino acids such as the 20 L-amino acids that are most commonly found in proteins. However, other amino acids and/or amino acid analogs known in the art can be used. One or more of the amino acids in a polypeptide may be modified, for example, by the addition of a chemical entity such as a carbohydrate group, a phosphate group, a fatty acid group, a linker for conjugation, functionalization, etc. A polypeptide that has a nonpolypeptide moiety covalently or noncovalently associated therewith is still considered a "polypeptide." Exemplary modifications include glycosylation and palmitoylation. Polypeptides can be purified from natural sources, produced using recombinant DNA technology or synthesized through chemical means such as conventional solid phase peptide synthesis, etc. The term "polypeptide sequence" or "amino acid sequence" as used herein can refer to the polypeptide material itself and/or to the sequence information (i.e., the succession of letters or three letter codes used as abbreviations for amino acid names) that biochemically characterizes a polypeptide. A polypeptide sequence presented herein is presented in an N-terminal to C-terminal direction unless otherwise indicated.

A given amino acid can be replaced by a residue having similar physicochemical characteristics, e.g., substituting one aliphatic residue for another (such as Ile, Val, Leu, or Ala for one another), or substitution of one polar residue for another (such as between Lys and Arg; Glu and Asp; or Gln and Asn). Other such conservative substitutions, e.g., substitutions of entire regions having similar hydrophobicity characteristics, are well known. Polypeptides comprising conservative amino acid substitutions can be tested in any one of the assays described herein to confirm that a desired activity, e.g. ligand-mediated receptor activity and specificity of a native or reference polypeptide is retained.

Amino acids can be grouped according to similarities in the properties of their side chains (in A. L. Lehninger, in Biochemistry, second ed., pp. 73-75, Worth Publishers, New York (1975)): (1) non-polar: Ala (A), Val (V), Leu (L), Ile (I), Pro (P), Phe (F), Trp (W), Met (M); (2) uncharged polar: Gly (G), Ser (S), Thr (T), Cys (C), Tyr (Y), Asn (N), Gln (Q); (3) acidic: Asp (D), Glu (E); (4) basic: Lys (K), Arg (R), His (H). Alternatively, naturally occurring residues can be divided into groups based on common side-chain properties: (1) hydrophobic: Norleucine, Met, Ala, Val, Leu, Ile; (2) neutral hydrophilic: Cys, Ser, Thr, Asn, Gln; (3) acidic: Asp, Glu; (4) basic: His, Lys, Arg; (5) residues that influence chain orientation: Gly, Pro; (6) aromatic: Trp, Tyr, Phe. Non-conservative substitutions will entail exchanging a member of one of these classes for another class. Particular conservative substitutions include, for example; Ala into Gly or into Ser; Arg into Lys; Asn into Gln or into His; Asp into Glu; Cys into Ser; Gln into Asn; Glu into Asp; Gly into Ala or into Pro; His into Asn or into Gln; Ile into Leu or into Val; Leu into Ile or into Val; Lys into Arg, into Gln or into Glu; Met into Leu, into Tyr or into Ile; Phe into Met, into Leu or into Tyr; Ser into Thr; Thr into Ser; Trp into Tyr; Tyr into Trp; and/or Phe into Val, into Ile or into Leu.

In some embodiments, a polypeptide described herein (or a nucleic acid encoding such a polypeptide) can be a functional fragment of one of the amino acid sequences described herein. As used herein, a "functional fragment" is a fragment or segment of a peptide which retains at least 50% of the wild-type reference polypeptide's activity according to an assay known in the art or described below herein. For example, a functional fragment described herein would retain at least 50% of the VP1 capsid function. One skilled in the art can assess the function of VP1 using standard techniques, for example those described herein below. A functional fragment can comprise conservative substitutions of the sequences disclosed herein.

In some embodiments, a polypeptide described herein can be a variant of a polypeptide or molecule as described herein. In some embodiments, the variant is a conservatively modified variant. Conservative substitution variants can be obtained by mutations of native nucleotide sequences, for example. A "variant," as referred to herein, is a polypeptide substantially homologous to a native or reference polypeptide, e.g., SEQ ID NO: 2, but which has an amino acid sequence different from that of the native or reference polypeptide because of one or a plurality of deletions, insertions or substitutions. A variant capsid polypeptide as the term is used herein retains the capacity for assembly into a viral capsid. Variant polypeptide-encoding DNA sequences encompass sequences that comprise one or more additions, deletions, or substitutions of nucleotides when compared to a native or reference DNA sequence, e.g., SEQ ID NO: 1, but that encode a variant protein or fragment thereof that retains activity of the non-variant polypeptide. A wide variety of PCR-based site-specific mutagenesis approaches are known in the art and can be applied by the ordinarily skilled artisan.

A variant amino acid or DNA sequence can be at least 90%, at least 91%, at least 92%, at least 93%, at least 94%, at least 95%, at least 96%, at least 97%, at least 98%, at least 99%, or more, identical to a native or reference sequence. The degree of homology (percent identity) between a native and a mutant sequence can be determined, for example, by comparing the two sequences using computer programs commonly employed for this purpose, e.g., that are freely available on the world wide web (e.g. BLASTp or BLASTn with default settings). Alterations of the native amino acid sequence can be accomplished by any of a number of techniques known to one of skill in the art. Mutations can be introduced, for example, at particular loci by synthesizing oligonucleotides containing a mutant sequence, flanked by restriction sites permitting ligation to fragments of the native sequence. Following ligation, the resulting reconstructed sequence encodes an analog having the desired amino acid insertion, substitution, or deletion. Alternatively, oligonucleotide-directed site-specific mutagenesis procedures can be employed to provide an altered nucleotide sequence having particular codons altered according to the substitution, deletion, or insertion required. Techniques for making such alterations are well established and include, for example, those disclosed by Walder et al. (Gene 42:133, 1986); Bauer et al. (Gene 37:73, 1985); Craik (BioTechniques, January 1985, 12-19); Smith et al. (Genetic Engineering: Principles and Methods, Plenum Press, 1981); and U.S. Pat. Nos. 4,518,584 and 4,737,462, which are herein incorporated by reference in their entireties. Any cysteine residue not involved in maintaining the proper conformation of a polypeptide also can be substituted, generally with serine, to improve the oxidative stability of the molecule and prevent aberrant crosslinking. Conversely, cysteine bond(s) can be added to a polypeptide to improve its stability or facilitate oligomerization.

As used herein, the term "DNA" is defined as deoxyribonucleic acid. The term "polynucleotide" is used herein interchangeably with "nucleic acid" to indicate a polymer of nucleosides. Typically, a polynucleotide is composed of nucleosides that are naturally found in DNA or RNA (e.g., adenosine, thymidine, guanosine, cytidine, uridine, deoxyadenosine, deoxythymidine, deoxyguanosine, and deoxycytidine) joined by phosphodiester bonds. However, the term encompasses molecules comprising nucleosides or nucleoside analogs containing chemically or biologically modified bases, modified backbones, etc., whether or not found in naturally occurring nucleic acids, and such molecules may be preferred for certain applications. Where this specification refers to a polynucleotide it is understood that both DNA, RNA, and in each case both single- and double-stranded forms (and complements of each single-stranded molecule) are provided. "Polynucleotide sequence" as used herein can refer to the polynucleotide material itself and/or to the sequence information (i.e. the succession of letters used as abbreviations for bases) that biochemically characterizes a specific nucleic acid. A polynucleotide sequence presented herein is presented in a 5' to 3' direction unless otherwise indicated.

As used herein, the term "viral vector" refers to a nucleic acid vector construct that includes at least one element of viral origin and has the capacity to be packaged into a viral particle. The viral vector can contain a nucleic acid (e.g., a payload) encoding a polypeptide as described herein in place of non-essential viral genes. The vector and/or particle may be utilized for the purpose of transferring nucleic acids into cells either in vitro or in vivo. Numerous forms of viral vectors are known in the art.

As used herein, an "AAV virus" or "AAV viral particle" refers to a viral particle composed of at least one AAV capsid protein such as VP1 (typically by all of the capsid proteins of a wild-type AAV) and an encapsidated polynucleotide rAAV vector. If the particle comprises a heterologous polynucleotide (i.e. a polynucleotide other than a wild-type AAV genome, such as a transgene to be delivered to a mammalian cell), it is typically referred to as a "recombinant AAV vector particle" or simply a "rAAV vector". Thus, production of a rAAV particle necessarily includes production of a rAAV vector, as such a vector is contained within a rAAV particle.

As used herein, the term "corresponding to," when used in reference to an amino acid or polynucleotide sequence means that a given amino acid or polynucleotide sequence in one polypeptide or polynucleotide molecule has structural properties, functional properties, or both that are similar relative to an amino acid or polynucleotide sequence in a similar location in another polypeptide or polynucleotide molecule. Homologues of a given polypeptide in different species "correspond to" each other, as do regions or domains of homologous polypeptides from different species. Similarly, capsid polypeptides of different serotypes of viral vectors, including but not limited to adeno-associated virus (AAV) vectors, "correspond to" each other, as do regions of such polypeptides, defined, for example by alignment of their amino acid sequences. While other alignment parameters can be used to define such regions, for the avoidance of doubt, alignment can be performed using BLAST® (Basic Local Alignment Search Tool) using default parameters of version BLAST+ 2.8.0 released Mar. 28, 2018.

As used herein, a "transgene" is a polynucleotide encoding a gene that is delivered to a cell by a vector.

A "gene" refers to a polynucleotide containing at least one open reading frame that is capable of encoding a particular gene product after being transcribed, and sometimes also translated. The term "gene" or "coding sequence" refers to a nucleotide sequence in vitro or in vivo that encodes a gene product. In some instances, the gene consists or consists essentially of coding sequence, that is, sequence that encodes the gene product. In other instances, the gene comprises additional, non-coding, sequence that permits, facilitates or directs the cellular expression machinery to express the encoded product. Such sequences can include, but are not limited to promoters, enhancers, transcriptional termination and/or poly(A) addition signals, and elements that affect transcript processing and/or stability. A gene may or may not include regions preceding and following the coding region, e.g. 5' untranslated (5' UTR) or "leader" sequences and 3' UTR or "trailer" sequences, as well as intervening sequences (introns) between individual coding segments (exons).

A "gene product" is a molecule resulting from expression of a particular gene. Gene products include, e.g., a polypeptide, an aptamer, an interfering RNA, an mRNA, and the like. In particular embodiments, a "gene product" is a polypeptide, peptide, protein or interfering RNA including short interfering RNA (siRNA), miRNA or small hairpin RNA (shRNA). In particular embodiments, a gene product is a therapeutic gene product, e.g., a therapeutic protein, or a therapeutic RNA.

As used herein, a "therapeutic gene" refers to a gene that, when expressed, produces a therapeutic gene product that confers a beneficial effect on the cell or tissue in which it is present, or on a mammal in which the gene is expressed. Examples of beneficial effects include amelioration of a sign or symptom of a condition or disease, prevention or inhibition of a condition or disease, or conferral of a desired characteristic. Therapeutic genes include, but are not limited to, genes that correct a genetic deficiency in a cell or mammal.

All patents, patent applications, and publications identified are expressly incorporated herein by reference for the purpose of describing and disclosing, for example, the methodologies described in such publications that might be used in connection with the present invention. These publications are provided solely for their disclosure prior to the filing date of the present application. Nothing in this regard should be construed as an admission that the inventors are not entitled to antedate such disclosure by virtue of prior invention or for any other reason. All statements as to the date or representation as to the contents of these documents is based on the information available to the applicants and does not constitute any admission as to the correctness of the dates or contents of these documents.

SEQUENCE LISTING (41337 sequences)

SEQ ID NO: 1 - DNA, 2208 bp, Adeno-associated virus - 2
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 2 - protein, 735 aa, Adeno-associated virus - 2 [sequence omitted]

SEQ ID NO: 3 - protein, 28 aa, Adeno-associated virus - 2
DEEEIRTTNPVATEQYGSVSTNLQRGNR

SEQ ID NO: 4 - protein, 28 aa, Artificial Sequence
  Description of Artificial Sequence: Synthetic peptide
DEEEIRTTNPVATEQYGQVSTNLQRGNQ

SEQ ID NO: 5 - protein, 28 aa, Artificial Sequence
  Description of Artificial Sequence: Synthetic peptide
DEEEIRTTNPVAHEQYGDVSTNLQRGNR

SEQ ID NO: 6 - protein, 28 aa, Artificial Sequence
  Description of Artificial Sequence: Synthetic peptide
DEEEIRTTNPVATEQYGSMSDNLQRGNR

SEQ ID NO: 7 - protein, 28 aa, Artificial Sequence
  Description of Artificial Sequence: Synthetic peptide
DEIEIRTTNPVATEQYGSVSTNLQRGNT

SEQ ID NO: 8 - protein, 29 aa, Artificial Sequence
  Description of Artificial Sequence: Synthetic peptide
DEEEIRTTNPVATEQYGSVSTNLQCRGNN

SEQ ID NO: 9 - protein, 29 aa, Artificial Sequence
  Description of Artificial Sequence: Synthetic peptide
DEEEIRTTNPVATEQYGSVSTNLQIRGNT

SEQ ID NO: 10 - protein, 29 aa, Artificial Sequence
  Description of Artificial Sequence: Synthetic peptide
DEEEIRTTNPVATEQYWGSVSTNLQRGNQ

SEQ ID NO: 11 - protein, 29 aa, Artificial Sequence
  Description of Artificial Sequence: Synthetic peptide
DEEEIRTTNPVATEQYGSVSTNEQLRGNR

SEQ ID NO: 12 - protein, 29 aa, Artificial Sequence
  Description of Artificial Sequence: Synthetic peptide
DEEEIRTVNPVATEQYGSVSTNLQRGVNR

SEQ ID NO: 13 - protein, 28 aa, Artificial Sequence
  Description of Artificial Sequence: Synthetic peptide
DEEEIETTNPVATETYGSVSTNLQRGNR

SEQ ID NO: 14 - protein, 29 aa, Artificial Sequence
  Description of Artificial Sequence: Synthetic peptide
DEEEIRTTNPVATEQYGSVSTNLQERGNE

SEQ ID NO: 15 - protein, 28 aa, Artificial Sequence
  Description of Artificial Sequence: Synthetic peptide
DEEEIRTTNPVATEQYGSVSTNLQTGNG

SEQ ID NO: 16 - protein, 28 aa, Artificial Sequence
  Description of Artificial Sequence: Synthetic peptide
DEEEITTTNPVATEQYGSVSTNLQRGNN

SEQ ID NO: 17 - protein, 29 aa, Artificial Sequence
  Description of Artificial Sequence: Synthetic peptide
DEEEIRTTNPVATEQYGSVSTNLQFGTNR

SEQ ID NO: 18 - protein, 28 aa, Artificial Sequence
  Description of Artificial Sequence: Synthetic peptide
DEEEIRTTNPVATEQYGSVSTNEQQGNR

SEQ ID NO: 19 - protein, 29 aa, Artificial Sequence
  Description of Artificial Sequence: Synthetic peptide
DEEEIRTTNPIATEQYGSVSTNLQRGENR

SEQ ID NO: 20 - protein, 29 aa, Artificial Sequence
  Description of Artificial Sequence: Synthetic peptide
DEEEIRTTNPVATEQYGSVSTNLQRGNPT

SEQ ID NO: 21 - protein, 28 aa, Artificial Sequence
  Description of Artificial Sequence: Synthetic peptide
DEEEIRTTNPVATEQYGNSSTNLQRGNR

SEQ ID NO: 22 - protein, 29 aa, Artificial Sequence
  Description of Artificial Sequence: Synthetic peptide
DEEEIRTTNPVATEQYGSVSTNLQRGDNL

SEQ ID NO: 23 - protein, 28 aa, Artificial Sequence
  Description of Artificial Sequence: Synthetic peptide
DEEEIRTTNPVATEQYGSVSTNQIRGNR

SEQ ID NO: 24 - protein, 29 aa, Artificial Sequence
  Description of Artificial Sequence: Synthetic peptide
DEEEIRTTNPVATEQYGSVSTNLQDVGNR

SEQ ID NO: 25 - protein, 28 aa, Artificial Sequence
  Description of Artificial Sequence: Synthetic peptide
DEEEIMTTNPVATEQYGSVSENLQRGNR

SEQ ID NO: 26 - protein, 28 aa, Artificial Sequence
  Description of Artificial Sequence: Synthetic peptide
DPEEIRTTNPVATEQYGSVSTGLQRGNR

SEQ ID NO: 27 - protein, 28 aa, Artificial Sequence
  Description of Artificial Sequence: Synthetic peptide
DEEEIRTTNPVATEQYGWVSTNLQRGNC

SEQ ID NO: 28 - protein, 28 aa, Artificial Sequence
  Description of Artificial Sequence: Synthetic peptide
DEEEIRTTNPEATEQYGSVSTNLQRGNL

SEQ ID NO: 29 - protein, 29 aa, Artificial Sequence
  Description of Artificial Sequence: Synthetic peptide
DEEEIRTVNPVATEQYGSVSTNLQRGNLR

SEQ ID NO: 30 - protein, 28 aa, Artificial Sequence
  Description of Artificial Sequence: Synthetic peptide
MEEEIRTTNPVATEQYGSVSTNLQRGNS

SEQ ID NO: 31 - protein, 28 aa, Artificial Sequence
  Description of Artificial Sequence: Synthetic peptide
DEEEIRTTNPDATEQYGSVSTNEQRGNR

SEQ ID NO: 32 - protein, 28 aa, Artificial Sequence
  Description of Artificial Sequence: Synthetic peptide
DEEEITTTNPVATEQYGSVSTNLQAGNR

SEQ ID NO: 33 - protein, 28 aa, Artificial Sequence
  Description of Artificial Sequence: Synthetic peptide
DEEEIYTTNPVATEQYGSVSINLQRGNR

SEQ ID NO: 34 - protein, 28 aa, Artificial Sequence
  Description of Artificial Sequence: Synthetic peptide
DEEEIRTTNPVATEQYGSVSTNVQRGNI

SEQ ID NO: 35 - protein, 28 aa, Artificial Sequence
  Description of Artificial Sequence: Synthetic peptide
DEEEIRTTNPTATEQYGSVSTNLIRGNR

SEQ ID NO: 36 - protein, 29 aa, Artificial Sequence
  Description of Artificial Sequence: Synthetic peptide
DEEEIRTTNPVATEQYGSVSTNLQRKGNA

SEQ ID NO: 37 - protein, 28 aa, Artificial Sequence
  Description of Artificial Sequence: Synthetic peptide
DEEEIRTTNPIATEQYGSVSTNLQRGDR

SEQ ID NO: 38 - protein, 29 aa, Artificial Sequence
  Description of Artificial Sequence: Synthetic peptide
DEEEIRTTNPVATEQYGSVSTNGQRGNDR

SEQ ID NO: 39 - protein, 28 aa, Artificial Sequence
  Description of Artificial Sequence: Synthetic peptide
DEEEIRTTNPVATEQYGSSSTELQRGNR

SEQ ID NO: 40 - protein, 28 aa, Artificial Sequence
  Description of Artificial Sequence: Synthetic peptide
DEEEIRTTNPVATEQYGSVSTNLQQGYR

SEQ ID NO: 41 - protein, 29 aa, Artificial Sequence
  Description of Artificial Sequence: Synthetic peptide
DEEEIRCTNPVATEQYGSVSTNLQQRGNR

SEQ ID NO: 42 - protein, 28 aa, Artificial Sequence
  Description of Artificial Sequence: Synthetic peptide
DEEEIRTTNPVATEQYGSVDDNLQRGNR

SEQ ID NO: 43 - protein, 30 aa, Artificial Sequence
  Description of Artificial Sequence: Synthetic polypeptide
DEEEIRTTNPVATEQYGSVNSTNPLQRGNR

SEQ ID NO: 44 - protein, 28 aa, Artificial Sequence
  Description of Artificial Sequence: Synthetic peptide
DEEEIRTTNPVATEQYGFVSDNLQRGNR

SEQ ID NO: 45 - protein, 28 aa, Artificial Sequence
  Description of Artificial Sequence: Synthetic peptide
DELEIRTTNPVATEQYGSVSDNLQRGNR

SEQ ID NO: 46 - protein, 28 aa, Artificial Sequence
  Description of Artificial Sequence: Synthetic peptide
DEEEIRTTNPVATEQYGSVETNLQRGNA

SEQ ID NO: 47 - protein, 28 aa, Artificial Sequence
  Description of Artificial Sequence: Synthetic peptide
DEPEIRTTNPVATEQYGSVSENLQRGNR

SEQ ID NO: 48 - protein, 29 aa, Artificial Sequence
  Description of Artificial Sequence: Synthetic peptide
DEEEIRTTNPVATEQYGSVSTNLQNGDNR

SEQ ID NO: 49 - protein, 29 aa, Artificial Sequence
  Description of Artificial Sequence: Synthetic peptide
DEEEIRTTNPVATEQYGSVSTNLQIRGNQ

SEQ ID NO: 50 - protein, 28 aa, Artificial Sequence
  Description of Artificial Sequence: Synthetic peptide
VEEEIRTTNPCATEQYGSVSTNLQRGNR

SEQ ID NO: 51 - protein, 29 aa, Artificial Sequence
  Description of Artificial Sequence: Synthetic peptide
DEEEIRTTNPVATEQYGSVSTDNDQRGNR

SEQ ID NO: 52 - protein, 28 aa, Artificial Sequence
  Description of Artificial Sequence: Synthetic peptide
DEECIRTTNPVVTEQYGSVSTNLQRGNR

SEQ ID NO: 53 - protein, 29 aa, Artificial Sequence
  Description of Artificial Sequence: Synthetic peptide
DEEEIRTTNPVATEQYGSVSTYNLQRGER

SEQ ID NO: 54 - protein, 28 aa, Artificial Sequence
  Description of Artificial Sequence: Synthetic peptide
DEEEIRATNPVATEQYGSVSTCLQRGNR

SEQ ID NO: 55 - protein, 29 aa, Artificial Sequence
  Description of Artificial Sequence: Synthetic peptide
DEETIRTTNPVATEQYGSVCSTNLQRGNR

SEQ ID NO: 56 - protein, 29 aa, Artificial Sequence
  Description of Artificial Sequence: Synthetic peptide
DEEEIRTTNPVATEQYGSVPTNLWQRGNR

SEQ ID NO: 57 - protein, 28 aa, Artificial Sequence
  Description of Artificial Sequence: Synthetic peptide
DEEEIRTTNPVATEQYGSVSTNLQRGTE

SEQ ID NO: 58 - protein, 28 aa, Artificial Sequence
  Description of Artificial Sequence: Synthetic peptide
DGEEIRTTNPVATEQYGSVSTGLQRGNR

SEQ ID NO: 59 - protein, 30 aa, Artificial Sequence
  Description of Artificial Sequence: Synthetic polypeptide
DEEEIRTTNPVATEQYGSVSLTNLQIRGNR

SEQ ID NO: 60 - protein, 28 aa, Artificial Sequence
  Description of Artificial Sequence: Synthetic peptide
DEEEIRTTNPVATEQYGSVDTNLQRGNS

SEQ ID NO: 61 - protein, 28 aa, Artificial Sequence
  Description of Artificial Sequence: Synthetic peptide
DEEEIRTTNPVATEQYGSVSTNLNRGND

SEQ ID NO: 62 - protein, 29 aa, Artificial Sequence
  Description of Artificial Sequence: Synthetic peptide
DEEEIRQTNPVATEQYGSVSTNLQRGENR

SEQ ID NO: 63 - protein, 28 aa, Artificial Sequence
  Description of Artificial Sequence: Synthetic peptide
SEEEIRTTNPVATEQYGNVSTNLQRGNR

SEQ ID NO: 64 - protein, 28 aa, Artificial Sequence
  Description of Artificial Sequence: Synthetic peptide
DEEEIRTTNPVATEQYGSVSTNLMRGNM

SEQ ID NO: 65 - protein, 29 aa, Artificial Sequence
  Description of Artificial Sequence: Synthetic peptide
DEEEIRTTNPVATEQYGSVSTNLVQVGNR

SEQ ID NO: 66 - protein, 28 aa, Artificial Sequence
  Description of Artificial Sequence: Synthetic peptide
DEEEIRTTNPVATEQYGSVSTNDQRGNN

SEQ ID NO: 67 - protein, 29 aa, Artificial Sequence
  Description of Artificial Sequence: Synthetic peptide
DEECIRTTNPVATEQYGSYVSTNLQRGNR

SEQ ID NO: 68 - protein, 28 aa, Artificial Sequence
  Description of Artificial Sequence: Synthetic peptide
DEQEIRTTNPVATEQWGSVSTNLQRGNR

SEQ ID NO: 69 - protein, 29 aa, Artificial Sequence
  Description of Artificial Sequence: Synthetic peptide
DEEEIRTTNPVATEQYGSVSTNLQDQGNR

SEQ ID NO: 70 - protein, 28 aa, Artificial Sequence
  Description of Artificial Sequence: Synthetic peptide
DEEEIRTTNPVATEQYGSVSENLQRGHR

SEQ ID NO: 71 - protein, 28 aa, Artificial Sequence
  Description of Artificial Sequence: Synthetic peptide
DEEEIRTTNPVATEQYGSVSTEEQRGNR

SEQ ID NO: 72 - protein, 29 aa, Artificial Sequence
  Description of Artificial Sequence: Synthetic peptide
DEEEIRTTNPVATEQYGSVSTNGDQRGNR

SEQ ID NO: 73 - protein, 29 aa, Artificial Sequence
  Description of Artificial Sequence: Synthetic peptide
DEEEIRTTNPVATEQYGSVSATNLQLGNR

SEQ ID NO: 74 - protein, 28 aa, Artificial Sequence
  Description of Artificial Sequence: Synthetic peptide
DEEEIRTTNPVGTEQYGSVSTNGQRGNR

SEQ ID NO: 75 - protein, 28 aa, Artificial Sequence
  Description of Artificial Sequence: Synthetic peptide
DEEEIWTTNPVATEQYGSVSTNLQRGNF

SEQ ID NO: 76 - protein, 28 aa, Artificial Sequence
  Description of Artificial Sequence: Synthetic peptide
DEEEIRTTNPVATEQWGSVSMNLQRGNR

SEQ ID NO: 77 - protein, 28 aa, Artificial Sequence
  Description of Artificial Sequence: Synthetic peptide
DEEEIRTTNPVATEQYGSASTNLQQGNR

SEQ ID NO: 78 - protein, 28 aa, Artificial Sequence
  Description of Artificial Sequence: Synthetic peptide
DEEEISTTNPVATEQYGSVYTNLQRGNR

SEQ ID NO: 79 - protein, 28 aa, Artificial Sequence
  Description of Artificial Sequence: Synthetic peptide
DEEEIRTTNPFATFQYGSVSTNLQRGNR

SEQ ID NO: 80 - protein, 28 aa, Artificial Sequence
  Description of Artificial Sequence: Synthetic peptide
DEEEIRTTNPVATEQYGSVSVGLQRGNR

SEQ ID NO: 81 - protein, 28 aa, Artificial Sequence
  Description of Artificial Sequence: Synthetic peptide
DEEEIRTTNPCATEQYGSVSTALQRGNR

SEQ ID NO: 82 - protein, 28 aa, Artificial Sequence
  Description of Artificial Sequence: Synthetic peptide
DEEEIRTTNPVATEIYGSVSTNLQRGNP

SEQ ID NO: 83 - protein, 28 aa, Artificial Sequence
  Description of Artificial Sequence: Synthetic peptide
DEEEIRTTNPVATEVYGSVSTNLQRFNR

SEQ ID NO: 84 - protein, 28 aa, Artificial Sequence
  Description of Artificial Sequence: Synthetic peptide
DEPEIRTTNPLATEQYGSVSTNLQRGNR

SEQ ID NO: 85 - protein, 28 aa, Artificial Sequence
  Description of Artificial Sequence: Synthetic peptide
DEEEIRTTNPVATEQYGSVSTNLQQGER

SEQ ID NO: 86 - protein, 28 aa, Artificial Sequence
  Description of Artificial Sequence: Synthetic peptide
DEEEIRTTNPVATEQYGSVSTNLQRENA

SEQ ID NO: 87 - protein, 28 aa, Artificial Sequence
  Description of Artificial Sequence: Synthetic peptide
DEEEICTTNPVATEQYGSVSTNLQRGNF

SEQ ID NO: 88 - protein, 28 aa, Artificial Sequence
  Description of Artificial Sequence: Synthetic peptide
DEEEIRTTNPVATEQYGSVSTDLQRGNY

SEQ ID NO: 89 - protein, 28 aa, Artificial Sequence
  Description of Artificial Sequence: Synthetic peptide
DEEEIRTTNPVATEQYGSYSTNLQRGNM

SEQ ID NO: 90 - protein, 28 aa, Artificial Sequence
  Description of Artificial Sequence: Synthetic peptide
DEEEIRTTNPVATEQYGSVSTNLETGNR

SEQ ID NO: 91 - protein, 29 aa, Artificial Sequence
  Description of Artificial Sequence: Synthetic peptide
DEEEIRTTNPVATEQYGSVSTNLNQEGNR

SEQ ID NO: 92 - protein, 29 aa, Artificial Sequence
  Description of Artificial Sequence: Synthetic peptide
DEEEIRTTNPVATEQYGSVCSTNLQRGDR

SEQ ID NO: 93 - protein, 29 aa, Artificial Sequence
  Description of Artificial Sequence: Synthetic peptide
DEEEIRTTNPVATEFYGSVSSTNLQRGNR

SEQ ID NO: 94 - protein, 28 aa, Artificial Sequence
  Description of Artificial Sequence: Synthetic peptide
DEEEIRTTNPVATEQYGSVSTPLQSGNR

SEQ ID NO: 95 - protein, 28 aa, Artificial Sequence
  Description of Artificial Sequence: Synthetic peptide
DEEEIRTTNPVATELYGDVSTNLQRGNR

SEQ ID NO: 96 - protein, 28 aa, Artificial Sequence
  Description of Artificial Sequence: Synthetic peptide
DEEEIRTTNPFATEQYGSVSTNLQRGNT

SEQ ID NO: 97 - protein, 29 aa, Artificial Sequence
  Description of Artificial Sequence: Synthetic peptide
DEEEIRTTNPVATEQYGSVSTNPEQRGNR

SEQ ID NO: 98 - protein, 28 aa, Artificial Sequence
  Description of Artificial Sequence: Synthetic peptide
DEEEIRTTNPVATEQYGVWSTNLQRGNR

SEQ ID NO: 99 - protein, 28 aa, Artificial Sequence
  Description of Artificial Sequence: Synthetic peptide
DEEEIRTTNPTATEQYGSVSTNLQKGNR

SEQ ID NO: 100 - protein, 29 aa, Artificial Sequence
  Description of Artificial Sequence: Synthetic peptide
DEEEIRTTNPVATEQYGSVSTNLQRGDNQ

SEQ ID NO: 101 - protein, 29 aa, Artificial Sequence
  Description of Artificial Sequence: Synthetic peptide
DEEEIRTTNPVATEQYGSVSCTNLQNGNR

SEQ ID NO: 102 - protein, 28 aa, Artificial Sequence
  Description of Artificial Sequence: Synthetic peptide
DEEEITTTNPVATEQYGSVSTNLQFGNR

SEQ ID NO: 103 - protein, 28 aa, Artificial Sequence
  Description of Artificial Sequence: Synthetic peptide
DEEEIGTTNPVATEQYGGVSTNLQRGNR

SEQ ID NO: 104 - protein, 28 aa, Artificial Sequence
  Description of Artificial Sequence: Synthetic peptide
DEEEIRTTNPVATEQYGSVSTNVQRGNW

SEQ ID NO: 105 - protein, 28 aa, Artificial Sequence
  Description of Artificial Sequence: Synthetic peptide
DEEEIRTTNPVATEQYGSVSTALARGNR

SEQ ID NO: 106 - protein, 29 aa, Artificial Sequence
  Description of Artificial Sequence: Synthetic peptide
DEEEIRTTNPVATEQYGSVSTNLQRGINF

SEQ ID NO: 107 - protein, 28 aa, Artificial Sequence
  Description of Artificial Sequence: Synthetic peptide
DEGEIRTTNPVATEQYGDVSTNLQRGNR

SEQ ID NO: 108 - protein, 28 aa, Artificial Sequence
  Description of Artificial Sequence: Synthetic peptide
DEEEIGTTNPVATEQYGSVSENLQRGNR

SEQ ID NO: 109 - protein, 29 aa, Artificial Sequence
  Description of Artificial Sequence: Synthetic peptide
DEEEIRTTNPVATEQYGSVSTNLVQRGER

SEQ ID NO: 110 - protein, 28 aa, Artificial Sequence
  Description of Artificial Sequence: Synthetic peptide
DEEEIRTTNPVATEQYGDVSTNLQRGNC

SEQ ID NO: 111 - protein, 29 aa, Artificial Sequence
  Description of Artificial Sequence: Synthetic peptide
DEEEIRTTNPVATEQYGSVSTNLQRNGNI

SEQ ID NO: 112 - protein, 30 aa, Artificial Sequence
  Description of Artificial Sequence: Synthetic polypeptide
DEEEIRTTNPVATEQYGSVSETNLVQRGNR

SEQ ID NO: 113 - protein, 28 aa, Artificial Sequence
  Description of Artificial Sequence: Synthetic peptide
DEEEVRTTNPVATEAYGSVSTNLQRGNR

SEQ ID NO: 114 - protein, 28 aa, Artificial Sequence
  Description of Artificial Sequence: Synthetic peptide
DSEEIRTTNPFATEQYGSVSTNLQRGNR

SEQ ID NO: 115 - protein, 29 aa, Artificial Sequence
  Description of Artificial Sequence: Synthetic peptide
DEEEIRTTNPVATEQYGSVSTPLQDRGNR

SEQ ID NO: 116 - protein, 28 aa, Artificial Sequence
  Description of Artificial Sequence: Synthetic peptide
DEEEIRSTNPVATEQYGSVSTNLQSGNR

SEQ ID NO: 117 - protein, 29 aa, Artificial Sequence
  Description of Artificial Sequence: Synthetic peptide
DEEEIRTTNPVATEQYGSVSQTNLQRGNA

SEQ ID NO: 118 - protein, 29 aa, Artificial Sequence
  Description of Artificial Sequence: Synthetic peptide
KEEEIRTTNPVATEQYGSVSLTNLQRGNR

SEQ ID NO: 119 - protein, 28 aa, Artificial Sequence
  Description of Artificial Sequence: Synthetic peptide
DEEEIRTTNPVATEQFGSVSTNLQRGNP

SEQ ID NO: 120 - protein, 29 aa, Artificial Sequence
  Description of Artificial Sequence: Synthetic peptide
DEEEIRTTNPVATEQYGSVSITNLQNGNR

SEQ ID NO: 121 - protein, 28 aa, Artificial Sequence
  Description of Artificial Sequence: Synthetic peptide
DEEEIRTTNPVATEQYGSVSDPLQRGNR

SEQ ID NO: 122 - protein, 28 aa, Artificial Sequence
  Description of Artificial Sequence: Synthetic peptide
DDEEIRTTNPVATETYGSVSTNLQRGNR

SEQ ID NO: 123 - protein, 28 aa, Artificial Sequence
  Description of Artificial Sequence: Synthetic peptide
DNEEIRTTNPVATEQYGSVWTNLQRGNR

SEQ ID NO: 124 - protein, 28 aa, Artificial Sequence
  Description of Artificial Sequence: Synthetic peptide
DEEEIRTTNPVATEIYGLVSTNLQRGNR

SEQ ID NO: 125 - protein, 29 aa, Artificial Sequence
  Description of Artificial Sequence: Synthetic peptide
AEEEIRTTNPVATEQYGSVSTNLQRGNDR

SEQ ID NO: 126 - protein, 29 aa, Artificial Sequence
  Description of Artificial Sequence: Synthetic peptide
DEEEIRTTNPVATEQYGSVSDTELQRGNR

SEQ ID NO: 127 - protein, 28 aa, Artificial Sequence
  Description of Artificial Sequence: Synthetic peptide
DEEEIRTTNPVATECYGSVSTPLQRGNR

SEQ ID NO: 128 - protein, 29 aa, Artificial Sequence
  Description of Artificial Sequence: Synthetic peptide
DEEEIRTTNPVATEQYGSVSTNGLQIGNR

SEQ ID NO: 129 - protein, 28 aa, Artificial Sequence
  Description of Artificial Sequence: Synthetic peptide
DEIEIRTTNPVATEQYGSVSTNLQRGNN

SEQ ID NO: 130 - protein, 28 aa, Artificial Sequence
  Description of Artificial Sequence: Synthetic peptide
DEEEIRTTNPAATEQYGSVSTNLQRGNG

SEQ ID NO: 131 - protein, 28 aa, Artificial Sequence
  Description of Artificial Sequence: Synthetic peptide
DEEEIRTTNPVATEQYGSVSYNLQRINR

SEQ ID NO: 132 - protein, 28 aa, Artificial Sequence
  Description of Artificial Sequence: Synthetic peptide
DEAEIRTTNPVATEQYGSVSTNIQRGNR

SEQ ID NO: 133 - protein, 28 aa, Artificial Sequence
  Description of Artificial Sequence: Synthetic peptide
DEEEIRCTNPVATEQYGSVSTNEQRGNR

SEQ ID NO: 134 - protein, 28 aa, Artificial Sequence
  Description of Artificial Sequence: Synthetic peptide
DEEEIRTCNPVATEQYGSVSVNLQRGNR

SEQ ID NO: 135 - protein, 28 aa, Artificial Sequence
  Description of Artificial Sequence: Synthetic peptide
MEEEIRTTNPVATEQYGSVSTNLQNGNR

SEQ ID NO: 136 - protein, 29 aa, Artificial Sequence
  Description of Artificial Sequence: Synthetic peptide
KEEEIRTTNPVATEQYGSVSTNLQRGNDR

SEQ ID NO: 137 - protein, 28 aa, Artificial Sequence
  Description of Artificial Sequence: Synthetic peptide
DEEEIRTTNPVATEQYGSVSTNLQVGNG

SEQ ID NO: 138 - protein, 28 aa, Artificial Sequence
  Description of Artificial Sequence: Synthetic peptide
DEEEIRTTNPDATEQYGSVSTNLQNGNR

SEQ ID NO: 139 - protein, 28 aa, Artificial Sequence
  Description of Artificial Sequence: Synthetic peptide
DEEEIRTTNPVATCQYGSVSTNLQRGER

SEQ ID NO: 140 - protein, 28 aa, Artificial Sequence
  Description of Artificial Sequence: Synthetic peptide
DEEEIRTTNPDATAQYGSVSTNLQRGNR

SEQ ID NO: 141 - protein, 28 aa, Artificial Sequence
  Description of Artificial Sequence: Synthetic peptide
DEEEICTTNPVATEQYGSASTNLQRGNR

SEQ ID NO: 142 - protein, 28 aa, Artificial Sequence
  Description of Artificial Sequence: Synthetic peptide
DEEEIRTTNCVATEQYGSVSTNLQRGNC

SEQ ID NO: 143 - protein, 28 aa, Artificial Sequence
  Description of Artificial Sequence: Synthetic peptide
DEEEIRTTNPVSTEQYGSVQTNLQRGNR

SEQ ID NO: 144 - protein, 28 aa, Artificial Sequence
  Description of Artificial Sequence: Synthetic peptide
DEEEIRTTNPVATEQYGSVTTNLQYGNR

SEQ ID NO: 145 - protein, 28 aa, Artificial Sequence
  Description of Artificial Sequence: Synthetic peptide
DEEEIATTNPVATEQFGSVSTNLQRGNR

SEQ ID NO: 146 - protein, 29 aa, Artificial Sequence
  Description of Artificial Sequence: Synthetic peptide
DEEEIRTTNPVATEQYGSVSTNLQERGNF

SEQ ID NO: 147 - protein, 28 aa, Artificial Sequence
  Description of Artificial Sequence: Synthetic peptide
HEEEIRTTNPVAHEQYGSVSTNLQRGNR

SEQ ID NO: 148 - protein, 28 aa, Artificial Sequence
  Description of Artificial Sequence: Synthetic peptide
DEEEIATTNPVATEQYGSVSTNLQYGNR

SEQ ID NO: 149 - protein, 28 aa, Artificial Sequence
  Description of Artificial Sequence: Synthetic peptide
DENEISTTNPVATEQYGSVSTNLQRGNR

SEQ ID NO: 150 - protein, 28 aa, Artificial Sequence
  Description of Artificial Sequence: Synthetic peptide
DEEEIRTTNPVATEQYGSVSTNLQIGNS

SEQ ID NO: 151 - protein, 28 aa, Artificial Sequence
  Description of Artificial Sequence: Synthetic peptide
QEEEISTTNPVATEQYGSVSTNLQRGNR

SEQ ID NO: 152 - protein, 29 aa, Artificial Sequence
  Description of Artificial Sequence: Synthetic peptide
DEEEIRTTNPVATEQYGSVQSTNLQRLNR

SEQ ID NO: 153 - protein, 30 aa, Artificial Sequence
  Description of Artificial Sequence: Synthetic polypeptide
DEEEIRTTNPVATEQYGSVSTNLQRGVNER

SEQ ID NO: 154 - protein, 30 aa, Artificial Sequence
  Description of Artificial Sequence: Synthetic polypeptide
DEEEIRTTNPVATEQYGSVDSETNLQRGNR

SEQ ID NO: 155 - protein, 28 aa, Artificial Sequence
  Description of Artificial Sequence: Synthetic peptide
FDEEIRTTNPVATEQYGSVSTNLQRGNR

SEQ ID NO: 156 - protein, 28 aa, Artificial Sequence
  Description of Artificial Sequence: Synthetic peptide
DEEEIRTTNPVCTEQYGSVSTNLQRGNG

SEQ ID NO: 157 - protein, 30 aa, Artificial Sequence
  Description of Artificial Sequence: Synthetic polypeptide
DEEEIRTTNPVATEQYGSVDSTNLQLRGNR

SEQ ID NO: 158 - protein, 28 aa, Artificial Sequence
  Description of Artificial Sequence: Synthetic peptide
DEEEIRTTNPVATEQYGSVSTNLQYGNI

SEQ ID NO: 159 - protein, 30 aa, Artificial Sequence
  Description of Artificial Sequence: Synthetic polypeptide
DEEEIRTTNPVATEQYGSVSCTNPLQRGNR

SEQ ID NO: 160 - protein, 29 aa, Artificial Sequence
  Description of Artificial Sequence: Synthetic peptide
DEEEIRTTNPVATEQYGSVSTNLQPGDNR

SEQ ID NO: 161 - protein, 28 aa, Artificial Sequence
  Description of Artificial Sequence: Synthetic peptide
MEEEIRTTNPVATEQHGSVSTNLQRGNR

SEQ ID NO: 162 - protein, 28 aa, Artificial Sequence
  Description of Artificial Sequence: Synthetic peptide
DEEEIRTTNPVATEQYGLVSTNLQRGND

SEQ ID NO: 163 - protein, 29 aa, Artificial Sequence
  Description of Artificial Sequence: Synthetic peptide
DEEEIRTTNPVATEGYGSVSTMNLQRGNR

SEQ ID NO: 164 - protein, 28 aa, Artificial Sequence
  Description of Artificial Sequence: Synthetic peptide
DEQEIRTTNPVATEQYGAVSTNLQRGNR

SEQ ID NO: 165 - protein, 29 aa, Artificial Sequence
  Description of Artificial Sequence: Synthetic peptide
DEEEIRTTNPVATEQYGSVSTNLQVGNDR

SEQ ID NO: 166 - protein, 30 aa, Artificial Sequence
  Description of Artificial Sequence: Synthetic polypeptide
DEEEIRTTNPVATEQYGSVYSTNLQLRGNR

SEQ ID NO: 167 - protein, 29 aa, Artificial Sequence
  Description of Artificial Sequence: Synthetic peptide
DEEEIRTTNPVATEQYGSVSTNLQDRGNN

SEQ ID NO: 168 - protein, 28 aa, Artificial Sequence
  Description of Artificial Sequence: Synthetic peptide
DEEEIRTTNPAATEQYGSVSTNLQRGTR

SEQ ID NO: 169 - protein, 30 aa, Artificial Sequence
  Description of Artificial Sequence: Synthetic polypeptide
DEEEIRTTNPVATEQYGSVSDTNLQRGNDR

SEQ ID NO: 170 - protein, 28 aa, Artificial Sequence
  Description of Artificial Sequence: Synthetic peptide
DEEEIRTTNPVATEQYGWVSMNLQRGNR

SEQ ID NO: 171 - protein, 29 aa, Artificial Sequence
  Description of Artificial Sequence: Synthetic peptide
DEEEIRTTNPVATEQYGSVWTENLQRGNR

SEQ ID NO: 172 - protein, 28 aa, Artificial Sequence
  Description of Artificial Sequence: Synthetic peptide
DEQEIRTTNPVATEQYGSVSTNLQRGNE

SEQ ID NO: 173 - protein, 30 aa, Artificial Sequence
  Description of Artificial Sequence: Synthetic polypeptide
DEEEIRTTNPVATEQYGSVSTNLQREGNPR

SEQ ID NO: 174 - protein, 30 aa, Artificial Sequence
  Description of Artificial Sequence: Synthetic polypeptide
DEEEIRTTNPVATEQYGSVASTNPLQRGNR

SEQ ID NO: 175 - protein, 29 aa, Artificial Sequence
  Description of Artificial Sequence: Synthetic peptide
DEEEIRTTNPVATELYGSVSTNLPQRGNR

SEQ ID NO: 176 - protein, 30 aa, Artificial Sequence
  Description of Artificial Sequence: Synthetic polypeptide
DEEEIRTTNPVATEQYGESVESTNLQRGNR

SEQ ID NO: 177 - protein, 28 aa, Artificial Sequence
  Description of Artificial Sequence: Synthetic peptide
DEEEIATTNPVATEQYGSASTNLQRGNR

SEQ ID NO: 178 - protein, 29 aa, Artificial Sequence
  Description of Artificial Sequence: Synthetic peptide
DEEEIRTTNPVATEQYGSVLSTNLQRGMR

SEQ ID NO: 179 - protein, 28 aa, Artificial Sequence
  Description of Artificial Sequence: Synthetic peptide
DPEEIRTTNPVATEQYGSVSTNLQRGNP

SEQ ID NO: 180 - protein, 28 aa, Artificial Sequence
  Description of Artificial Sequence: Synthetic peptide
DEEEIRTTNPVATEQYGFVSENLQRGNR

SEQ ID NO: 181 - protein, 28 aa, Artificial Sequence
  Description of Artificial Sequence: Synthetic peptide
DEEEIRTTNPVATEQYGAVSTNLQDGNR

SEQ ID NO: 182 - protein, 28 aa, Artificial Sequence
  Description of Artificial Sequence: Synthetic peptide
DEEEIRTTNPVATEQYGSVTTNLQFGNR

SEQ ID NO: 183 - protein, 28 aa, Artificial Sequence
  Description of Artificial Sequence: Synthetic peptide
DEREIRTTNPVATEQYGSVSTVLQRGNR

SEQ ID NO: 184 - protein, 29 aa, Artificial Sequence
  Description of Artificial Sequence: Synthetic peptide
DEEEIRTVNPVATEQYGSVSTNLQRGNDR

SEQ ID NO: 185 - protein, 29 aa, Artificial Sequence
  Description of Artificial Sequence: Synthetic peptide
DEEEIRTTNPVATEQYGSVSTNLQVRGER

SEQ ID NO: 186 - protein, 30 aa, Artificial Sequence
  Description of Artificial Sequence: Synthetic polypeptide
DEEEIRTTNPVATEQYGSVSTNPLVQRGNR

SEQ ID NO: 187 - protein, 28 aa, Artificial Sequence
  Description of Artificial Sequence: Synthetic peptide
DEEEIRSTNPVATEQYGWVSTNLQRGNR

SEQ ID NO: 188 - protein, 28 aa, Artificial Sequence
  Description of Artificial Sequence: Synthetic peptide
DEEEIRTTNPVATEQYGNVGTNLQRGNR

SEQ ID NO: 189 - protein, 30 aa, Artificial Sequence
  Description of Artificial Sequence: Synthetic polypeptide
DEEEIRTTNPVATEQYGSVSCTNLQRAGNR

SEQ ID NO: 190 - protein, 30 aa, Artificial Sequence
  Description of Artificial Sequence: Synthetic polypeptide
DEEEIRTTNPVATEQYGSVSTNLQCRGENR

SEQ ID NO: 191 - protein, 29 aa, Artificial Sequence
  Description of Artificial Sequence: Synthetic peptide
DEEEIRTTNPVATEQYGSVETNLFQRGNR

SEQ ID NO: 192 - protein, 29 aa, Artificial Sequence
  Description of Artificial Sequence: Synthetic peptide
DEEEIRTTNPVATEQYGSVSTNNLQSGNR

SEQ ID NO: 193 - protein, 29 aa, Artificial Sequence
  Description of Artificial Sequence: Synthetic peptide
DEREIRTTNPVATEQYGSVSTNLQQRGNR

SEQ ID NO: 194 - protein, 28 aa, Artificial Sequence
  Description of Artificial Sequence: Synthetic peptide
DEEEIRTTNPVATEQYGSVSTNLQIGER

SEQ ID NO: 195 - protein, 28 aa, Artificial Sequence
  Description of Artificial Sequence: Synthetic peptide
DEEEIRQTNPVATEQYGSVSTNQQRGNR

SEQ ID NO: 196 - protein, 28 aa, Artificial Sequence
  Description of Artificial Sequence: Synthetic peptide
DEEEIYTTNPVATEQYGSVATNLQRGNR

SEQ ID NO: 197 - protein, 28 aa, Artificial Sequence
  Description of Artificial Sequence: Synthetic peptide
DEEEISTTNPVATEQFGSVSTNLQRGNR

SEQ ID NO: 198 - protein, 28 aa, Artificial Sequence
  Description of Artificial Sequence: Synthetic peptide
DEEEVRTTNPVATEQYGSVSTNLQRLNR

SEQ ID NO: 199 - protein, 28 aa, Artificial Sequence
  Description of Artificial Sequence: Synthetic peptide
DEEEIRTTNPVATEQYWSWSTNLQRGNR

SEQ ID NO: 200 - protein, 29 aa, Artificial Sequence
  Description of Artificial Sequence: Synthetic peptide
DEEEIRTTNPVATEQYGSVSDTNLDRGNR

SEQ ID NO: 201 - protein, 28 aa, Artificial Sequence
  Description of Artificial Sequence: Synthetic peptide
DEEEIATTNPVATEQYGSVSTNEQRGNR

SEQ ID NO: 202 - protein, 28 aa, Artificial Sequence
  Description of Artificial Sequence: Synthetic peptide
DEEEIHTTNPVATEQYGSVSTNLQRYNR

SEQ ID NO: 203 - protein, 28 aa, Artificial Sequence
  Description of Artificial Sequence: Synthetic peptide
DEEEIRTTNPVATEQYGWVSNNLQRGNR

SEQ ID NO: 204 - protein, 29 aa, Artificial Sequence
  Description of Artificial Sequence: Synthetic peptide
DEEEIRTTNPVATEQYGSVGTMNLQRGNR

SEQ ID NO: 205 - protein, 29 aa, Artificial Sequence
  Description of Artificial Sequence: Synthetic peptide
DEEEIRTTNPVATEQYGDVSATNLQRGNR

SEQ ID NO: 206 - protein, 30 aa, Artificial Sequence
  Description of Artificial Sequence: Synthetic polypeptide
DEEEIRTTNPVATEQYGSVSTGNLQVRGNR

SEQ ID NO: 207 - protein, 29 aa, Artificial Sequence
  Description of Artificial Sequence: Synthetic peptide
DEEEIRTTNPVATEQYGGVSTNLQDRGNR

SEQ ID NO: 208 - protein, 28 aa, Artificial Sequence
  Description of Artificial Sequence: Synthetic peptide
DEEEIRAVNPVATEQYGSVSTNLQRGNR

SEQ ID NO: 209 - protein, 28 aa, Artificial Sequence
  Description of Artificial Sequence: Synthetic peptide
DEEEIRTTNPVATEQYGSVSTNLQGGNV

SEQ ID NO: 210 - protein, 28 aa, Artificial Sequence
  Description of Artificial Sequence: Synthetic peptide
QEEEINTTNPVATEQYGSVSTNLQRGNR

SEQ ID NO: 211 - protein, 29 aa, Artificial Sequence
  Description of Artificial Sequence: Synthetic peptide
DEVEIRTTNPVATEQYGSVSTENLQRGNR

SEQ ID NO: 212 - protein, 29 aa, Artificial Sequence
  Description of Artificial Sequence: Synthetic peptide
DEEEIRTTNPVATEQYGSVSTNLQSQGNR

SEQ ID NO: 213 - protein, 28 aa, Artificial Sequence
  Description of Artificial Sequence: Synthetic peptide
DEEEIRTTNPVATEQYGSVSTNLQHGNL

SEQ ID NO: 214 - protein, 28 aa, Artificial Sequence
  Description of Artificial Sequence: Synthetic peptide
DEEEIRTTNPVATEQYGSVSAGLQRGNR

SEQ ID NO: 215 - protein, 28 aa, Artificial Sequence
  Description of Artificial Sequence: Synthetic peptide
DEEEIRTTNIVATEQYGSVSTNLQIGNR

SEQ ID NO: 216 - protein, 30 aa, Artificial Sequence
  Description of Artificial Sequence: Synthetic polypeptide
DEEEIRTTNPVATEQYGSVSTINLQRGNPR

SEQ ID NO: 217 - protein, 29 aa, Artificial Sequence
  Description of Artificial Sequence: Synthetic peptide
DEEEIRTTNPVATEQYGSVSTNYLQRGNQ

SEQ ID NO: 218 - protein, 28 aa, Artificial Sequence
  Description of Artificial Sequence: Synthetic peptide
DEEEIRTTNPVATEQYGDVSTDLQRGNR

SEQ ID NO: 219 - protein, 28 aa, Artificial Sequence
  Description of Artificial Sequence: Synthetic peptide
DEEEIRTTNPVATENYGLVSTNLQRGNR

SEQ ID NO: 220 - protein, 28 aa, Artificial Sequence
  Description of Artificial Sequence: Synthetic peptide
DEEEIRTTNPVATEQYGSVSTNEQRGNQ

SEQ ID NO: 221 - protein, 29 aa, Artificial Sequence
  Description of Artificial Sequence: Synthetic peptide
DEDEIRTTNPVATEQYGSVSTNLQDRGNR

SEQ ID NO: 222 - protein, 28 aa, Artificial Sequence
  Description of Artificial Sequence: Synthetic peptide
DEEEIKTTNPVATEQYGVVSTNLQRGNR

SEQ ID NO: 223 - protein, 29 aa, Artificial Sequence
  Description of Artificial Sequence: Synthetic peptide
SEEEIRTTNPVATEQYGSVSTNLQLRGNR

SEQ ID NO: 224 - protein, 28 aa, Artificial Sequence
  Description of Artificial Sequence: Synthetic peptide
DEEEIRTTNPVATEQYWSVSTGLQRGNR

SEQ ID NO: 225 - protein, 28 aa, Artificial Sequence
  Description of Artificial Sequence: Synthetic peptide
DEEEIRTTNPVATEQYGSVSTDLQMGNR

SEQ ID NO: 226 - protein, 28 aa, Artificial Sequence
  Description of Artificial Sequence: Synthetic peptide
DEEEIRTTNPCATEQYGSVSTDLQRGNR

SEQ ID NO: 227 - protein, 28 aa, Artificial Sequence
  Description of Artificial Sequence: Synthetic peptide
HEEEISTTNPVATEQYGSVSTNLQRGNR

SEQ ID NO: 228 - protein, 29 aa, Artificial Sequence
  Description of Artificial Sequence: Synthetic peptide
DEEEIRTTNPVATEQYGSVSTNLQGGDNR

SEQ ID NO: 229 - protein, 30 aa, Artificial Sequence
  Description of Artificial Sequence: Synthetic polypeptide
DEEEIRTTNPVATEQYGSVSSTLNLQRGNR

SEQ ID NO: 230 - protein, 29 aa, Artificial Sequence
  Description of Artificial Sequence: Synthetic peptide
DEEEIRTTNPVATEQYGSVSTNLQVGENR

SEQ ID NO: 231 - protein, 28 aa, Artificial Sequence
  Description of Artificial Sequence: Synthetic peptide
DEEEIRTTNPVSTEQYGSVSTNEQRGNR

SEQ ID NO: 232 - protein, 28 aa, Artificial Sequence
  Description of Artificial Sequence: Synthetic peptide
DEEEIRGTNPVATEQYGSVSTVLQRGNR

SEQ ID NO: 233 - protein, 28 aa, Artificial Sequence
  Description of Artificial Sequence: Synthetic peptide
DEEEIRTTNPVATEQYGSVSTNVQRPNR

SEQ ID NO: 234 - protein, 28 aa, Artificial Sequence
  Description of Artificial Sequence: Synthetic peptide
DEEEIRTTNPVATELYGSVSTNLQRENR

SEQ ID NO: 235 - protein, 30 aa, Artificial Sequence
  Description of Artificial Sequence: Synthetic polypeptide
DEEEIRTTNPVATEQYGSVSTNPLQRQGNR

SEQ ID NO: 236 - protein, 28 aa, Artificial Sequence
  Description of Artificial Sequence: Synthetic peptide
DEEEIRTTNPVATEQYGSVSTILQRGNN

SEQ ID NO: 237 - protein, 30 aa, Artificial Sequence
  Description of Artificial Sequence: Synthetic polypeptide
DEEEIRTTNPVATEQYGESVSTGNLQRGNR

SEQ ID NO: 238 - protein, 28 aa, Artificial Sequence
  Description of Artificial Sequence: Synthetic peptide
DEESIRTTNPVATEQYGSVSTNLQPGNR

SEQ ID NO: 239 - protein, 28 aa, Artificial Sequence
  Description of Artificial Sequence: Synthetic peptide
DEEEIRTTNPVATEQYGSVHTNLQRENR

SEQ ID NO: 240 - protein, 28 aa, Artificial Sequence
  Description of Artificial Sequence: Synthetic peptide
DEEEIRTTNPIATEQFGSVSTNLQRGNR

SEQ ID NO: 241 - protein, 28 aa, Artificial Sequence
  Description of Artificial Sequence: Synthetic peptide
DEEEIRTTNPVATEQYGSVETNLQRGNF

SEQ ID NO: 242 - protein, 29 aa, Artificial Sequence
  Description of Artificial Sequence: Synthetic peptide
DEEEIRTTNPVATEQYGSVSTNLQMRGNW

SEQ ID NO: 243 - protein, 29 aa, Artificial Sequence
  Description of Artificial Sequence: Synthetic peptide
DEEEIRTTNPVATEQYGSVSITNLQAGNR

SEQ ID NO: 244 - protein, 28 aa, Artificial Sequence
  Description of Artificial Sequence: Synthetic peptide
DEEEIRTTNPTATEQYGCVSTNLQRGNR

SEQ ID NO: 245 - protein, 28 aa, Artificial Sequence
  Description of Artificial Sequence: Synthetic peptide
DEEEIRTTNPVATECYGSVSTNLQRGNF

SEQ ID NO: 246 - protein, 28 aa, Artificial Sequence
  Description of Artificial Sequence: Synthetic peptide
AEDEIRTTNPVATEQYGSVSTNLQRGNR

SEQ ID NO: 247 - protein, 28 aa, Artificial Sequence
  Description of Artificial Sequence: Synthetic peptide
DEEEIHTTNPCATEQYGSVSTNLQRGNR

SEQ ID NO: 248 - protein, 28 aa, Artificial Sequence
  Description of Artificial Sequence: Synthetic peptide
DEVEIRTTNPVATEQYGSVPTNLQRGNR

SEQ ID NO: 249 - protein, 29 aa, Artificial Sequence
  Description of Artificial Sequence: Synthetic peptide
DEEEIRTTNPVATEQYGSVSTPNDQRGNR

SEQ ID NO: 250 - protein, 28 aa, Artificial Sequence
  Description of Artificial Sequence: Synthetic peptide
DEEEIRTTNPVATEQYGSVSTNLQMGNE

SEQ ID NO: 251 - protein, 28 aa, Artificial Sequence
  Description of Artificial Sequence: Synthetic peptide
DEEEIRTTNPVATEQYGSVSTNEERGNR

SEQ ID NO: 252 - protein, 28 aa, Artificial Sequence
  Description of Artificial Sequence: Synthetic peptide
DEEEIRTTNPIATEQYGSVSTNLQRGNP

SEQ ID NO: 253 - protein, 28 aa, Artificial Sequence
  Description of Artificial Sequence: Synthetic peptide
DEEEIRCTNPVATEQYGVVSTNLQRGNR

SEQ ID NO: 254 - protein, 30 aa, Artificial Sequence
  Description of Artificial Sequence: Synthetic polypeptide
DEEEIRTTNPVATEQYGSVISTNLQRGDNR

SEQ ID NO: 255 - protein, 28 aa, Artificial Sequence
  Description of Artificial Sequence: Synthetic peptide
DEEEIRTTNPDATEQYGSVSTNLQRGER

SEQ ID NO: 256 - protein, 28 aa, Artificial Sequence
  Description of Artificial Sequence: Synthetic peptide
DEEEIRTTNPVATEQYGSVSTNLQGGNT

SEQ ID NO: 257 - protein, 28 aa, Artificial Sequence
  Description of Artificial Sequence: Synthetic peptide
DEEEIRTTNPVATEQYWSVSTNLQRGNI

SEQ ID NO: 258 - protein, 28 aa, Artificial Sequence
  Description of Artificial Sequence: Synthetic peptide
DEEEIRTTNPVATEQYGSVSTNLQGGNH

SEQ ID NO: 259 - protein, 29 aa, Artificial Sequence
  Description of Artificial Sequence: Synthetic peptide
DEEEIRTTNPVATEQYGSVSEMNLQRGNR

SEQ ID NO: 260 - protein, 28 aa, Artificial Sequence
  Description of Artificial Sequence: Synthetic peptide
DEEEIRTTNPVATEQYGHVSTNLLRGNR

SEQ ID NO: 261 - protein, 28 aa, Artificial Sequence
  Description of Artificial Sequence: Synthetic peptide
DEEEIRTTNPVATEQYGSVSTNLQRGMI

SEQ ID NO: 262 - protein, 29 aa, Artificial Sequence
  Description of Artificial Sequence: Synthetic peptide
DEEEIRTTNPVATEQYGSVSTANPQRGNR

SEQ ID NO: 263 - protein, 29 aa, Artificial Sequence
  Description of Artificial Sequence: Synthetic peptide
DEEEIRTTNPVATEQYGHSVSTNLQRGDR

SEQ ID NO: 264 - protein, 28 aa, Artificial Sequence
  Description of Artificial Sequence: Synthetic peptide
DEEEIRTTNPVATEQYGDVSTNLQRYNR

SEQ ID NO: 265 - protein, 28 aa, Artificial Sequence
  Description of Artificial Sequence: Synthetic peptide
DEEEIRTTNPVATEQYGSVSEYLQRGNR

SEQ ID NO: 266 - protein, 28 aa, Artificial Sequence
  Description of Artificial Sequence: Synthetic peptide
DEEEIRTTNPVATECYGTVSTNLQRGNR

SEQ ID NO: 267 - protein, 29 aa, Artificial Sequence
  Description of Artificial Sequence: Synthetic peptide
DEEEIRTTNPVATEQYGSWSETNLQRGNR

SEQ ID NO: 268 - protein, 29 aa, Artificial Sequence
  Description of Artificial Sequence: Synthetic peptide
DEEEIRTTNPTATEQYGSVSTNLQRGNTR

SEQ ID NO: 269 - protein, 29 aa, Artificial Sequence
  Description of Artificial Sequence: Synthetic peptide
DEEEIRTTNPVATEQFGSVSTNLQRGENR

SEQ ID NO: 270 - protein, 28 aa, Artificial Sequence
  Description of Artificial Sequence: Synthetic peptide
DEEEIRTTNPVATEQYGSVSTNLQRGDT

SEQ ID NO: 271 - protein, 28 aa, Artificial Sequence
  Description of Artificial Sequence: Synthetic peptide
DEEEIRTTNPVATELYGSVSTNLQRGLR

SEQ ID NO: 272 - protein, 30 aa, Artificial Sequence
  Description of Artificial Sequence: Synthetic polypeptide
DEEEIRTTNPVATEQYGSVSTNWLQRGSNR

SEQ ID NO: 273 - protein, 28 aa, Artificial Sequence
  Description of Artificial Sequence: Synthetic peptide
DEEEIRTTNPVATEQYGSVSTPLFRGNR

SEQ ID NO: 274 - protein, 28 aa, Artificial Sequence
  Description of Artificial Sequence: Synthetic peptide
DEEEIRTTNPVATEQYGSVSTALQQGNR

SEQ ID NO: 275 - protein, 28 aa, Artificial Sequence
  Description of Artificial Sequence: Synthetic peptide
AEEEIRTTNPVATEQYGDVSTNLQRGNR

SEQ ID NO: 276 - protein, 28 aa, Artificial Sequence
  Description of Artificial Sequence: Synthetic peptide
AEEEIRTTNPVATEQYGSVSTNLQRGER

SEQ ID NO: 277 - protein, 29 aa, Artificial Sequence
  Description of Artificial Sequence: Synthetic peptide
DEEEIRTTNPVATEQYGSVSDVNLQRGNR

SEQ ID NO: 278 - protein, 28 aa, Artificial Sequence
  Description of Artificial Sequence: Synthetic peptide
DEEEIRYTNPVATEQYGSVSTNLIRGNR

SEQ ID NO: 279 - protein, 28 aa, Artificial Sequence
  Description of Artificial Sequence: Synthetic peptide
DEEEIRTTNPVATEQYGSVSTNLYRGDR

SEQ ID NO: 280 - protein, 28 aa, Artificial Sequence
  Description of Artificial Sequence: Synthetic peptide
DEEEIRTTNPVATEQYGSVSTGLQPGNR

SEQ ID NO: 281 - protein, 28 aa, Artificial Sequence
  Description of Artificial Sequence: Synthetic peptide
DEEEIRTTNPVATEGYGSVSTNLQEGNR

SEQ ID NO: 282 - protein, 29 aa, Artificial Sequence
  Description of Artificial Sequence: Synthetic peptide
DEEEIRTTNPVATEQYGSVSTNGWQRGNR

SEQ ID NO: 283 - protein, 28 aa, Artificial Sequence
  Description of Artificial Sequence: Synthetic peptide
DEEEIRTTNPVATEQYGSVSTNLQSGNA

SEQ ID NO: 284 - protein, 28 aa, Artificial Sequence
  Description of Artificial Sequence: Synthetic peptide
DEEEIRTTNPVATEQYGDVSCNLQRGNR

SEQ ID NO: 285 - protein, 30 aa, Artificial Sequence
  Description of Artificial Sequence: Synthetic polypeptide
DEEEIRTTNPVATEQYGSVSTTNLQVRGNR

SEQ ID NO: 286 - protein, 29 aa, Artificial Sequence
  Description of Artificial Sequence: Synthetic peptide
DEEEIRTTNPVATEQYGSVSTNLQRGLNW

SEQ ID NO: 287 - protein, 28 aa, Artificial Sequence
  Description of Artificial Sequence: Synthetic peptide
DEEEIRTTNPVATEQYGSVSTNDERGNR

SEQ ID NO: 288 - protein, 30 aa, Artificial Sequence
  Description of Artificial Sequence: Synthetic polypeptide
DEEEIRTTNPVATEQYGMSVSTNLQRGLNR

SEQ ID NO: 289 - protein, 30 aa, Artificial Sequence
  Description of Artificial Sequence: Synthetic polypeptide
DEEEIRTTNPVATEQYGSVSTGNLQREGNR

SEQ ID NO: 290 - protein, 28 aa, Artificial Sequence
  Description of Artificial Sequence: Synthetic peptide
DEEEIRTTNPVATEKYGSVSTNLQEGNR

SEQ ID NO: 291 - protein, 28 aa, Artificial Sequence
  Description of Artificial Sequence: Synthetic peptide
DEEEIRTTNPAATEQYGCVSTNLQRGNR

SEQ ID NO: 292 - protein, 28 aa, Artificial Sequence
  Description of Artificial Sequence: Synthetic peptide
NEEEIRTTNPVASEQYGSVSTNLQRGNR

SEQ ID NO: 293 - protein, 28 aa, Artificial Sequence
  Description of Artificial Sequence: Synthetic peptide
DENEIRTTNPVATEQYGSVSTNLNRGNR

SEQ ID NO: 294 - protein, 28 aa, Artificial Sequence
  Description of Artificial Sequence: Synthetic peptide
DEEEIRTTNPVATEIYGSVSTNLQHGNR

SEQ ID NO: 295 - protein, 29 aa, Artificial Sequence
  Description of Artificial Sequence: Synthetic peptide
DENEIRTTNPVATEQYGSVSTNLQDRGNR

SEQ ID NO: 296 - protein, 29 aa, Artificial Sequence
  Description of Artificial Sequence: Synthetic peptide
DEEEIRTTNPFATEQYGSVSDTNLQRGNR

SEQ ID NO: 297 - protein, 28 aa, Artificial Sequence
  Description of Artificial Sequence: Synthetic peptide
DEEEIRTTNPVATEQYGSADTNLQRGNR

SEQ ID NO: 298 - protein, 29 aa, Artificial Sequence
  Description of Artificial Sequence: Synthetic peptide
DEEEIRTTNPVATEPYGSVSTNLQRNGNR

SEQ ID NO: 299 - protein, 28 aa, Artificial Sequence
  Description of Artificial Sequence: Synthetic peptide
DEEEIRTTNPVATEQYGSVSTNLMRGTR

SEQ ID NO: 300 - protein, 29 aa, Artificial Sequence
  Description of Artificial Sequence: Synthetic peptide
DEEEIKTTNPVATEQYGSVSTNLQERGNR

SEQ ID NO: 301 - protein, 28 aa, Artificial Sequence
  Description of Artificial Sequence: Synthetic peptide
DEEEITCTNPVATEQYGSVSTNLQRGNR

SEQ ID NO: 302 - protein, 28 aa, Artificial Sequence
  Description of Artificial Sequence: Synthetic peptide
DEEEIRTTNPVATEQYGSASTNLQYGNR

SEQ ID NO: 303 - protein, 28 aa, Artificial Sequence
  Description of Artificial Sequence: Synthetic peptide
DEEEIRTTNPVATEQYGSVSTNLQRGET

SEQ ID NO: 304 - protein, 29 aa, Artificial Sequence
  Description of Artificial Sequence: Synthetic peptide
DEEEICTTNPVATEQYGSVSATNLQRGNR

SEQ ID NO: 305 - protein, 29 aa, Artificial Sequence
  Description of Artificial Sequence: Synthetic peptide
DEEEIRTTNPVATEQYGSVSTNLQRNGNH

SEQ ID NO: 306 - protein, 28 aa, Artificial Sequence
  Description of Artificial Sequence: Synthetic peptide
DEEEIRTTNPVATEQYGSVSENLQRGNW

SEQ ID NO: 307 - protein, 28 aa, Artificial Sequence
  Description of Artificial Sequence: Synthetic peptide
DEEEISTTNPVATEQYGSVSTNLQVGNR

SEQ ID NO: 308 - protein, 28 aa, Artificial Sequence
  Description of Artificial Sequence: Synthetic peptide
DESEIRTTNPVATEQYGSVSTNLQRGNC

SEQ ID NO: 309 - protein, 28 aa, Artificial Sequence
  Description of Artificial Sequence: Synthetic peptide
DENEIRTTNPVATEQYGSVSTNLQNGNR

SEQ ID NO: 310 - protein, 28 aa, Artificial Sequence
  Description of Artificial Sequence: Synthetic peptide
DEEEIRTTNPVATECYGSVSTNLQNGNR

SEQ ID NO: 311 - protein, 28 aa, Artificial Sequence
  Description of Artificial Sequence: Synthetic peptide
DEEEIRTTNPVATEQYGSVSTNLQSGNL

SEQ ID NO: 312 - protein, 28 aa, Artificial Sequence
  Description of Artificial Sequence: Synthetic peptide
DEEEIRTTNPDATEQYGSVSTNLQVGNR

SEQ ID NO: 313 - protein, 28 aa, Artificial Sequence
  Description of Artificial Sequence: Synthetic peptide
DEEEIRTVNPVATEQYGSVSTNLQRGGR

SEQ ID NO: 314 - protein, 28 aa, Artificial Sequence
  Description of Artificial Sequence: Synthetic peptide
DENEIRTTNPVATEQYGSVSTNLQPGNR

SEQ ID NO: 315 - protein, 29 aa, Artificial Sequence
  Description of Artificial Sequence: Synthetic peptide
DEEEIRTTNPVATEQYGVVSTNLQDRGNR

SEQ ID NO: 316 - protein, 28 aa, Artificial Sequence
  Description of Artificial Sequence: Synthetic peptide
DEEEIRTTNPVATEQYGSVSTNLQFGNV

SEQ ID NO: 317 - protein, 29 aa, Artificial Sequence
  Description of Artificial Sequence: Synthetic peptide
DEEEIRTTNPVATEQYGSVSTNLQLGNDR

SEQ ID NO: 318 - protein, 28 aa, Artificial Sequence
  Description of Artificial Sequence: Synthetic peptide
DEQEIRTTNPVATEQYGSVSTNLQGGNR

SEQ ID NO: 319 - protein, 28 aa, Artificial Sequence
  Description of Artificial Sequence: Synthetic peptide
DEEEIRTTNPVATEQYGGVSTNEQRGNR

SEQ ID NO: 320 - protein, 28 aa, Artificial Sequence
  Description of Artificial Sequence: Synthetic peptide
DEEEIRTTNPVATEQYGWVSTQLQRGNR

SEQ ID NO: 321 - protein, 30 aa, Artificial Sequence
  Description of Artificial Sequence: Synthetic polypeptide
DEEEIRTTNPVATEQYGSVCSTNLQSRGNR

SEQ ID NO: 322 - protein, 28 aa, Artificial Sequence
  Description of Artificial Sequence: Synthetic peptide
SEEEIRTTNPVATEQYGSVSTNLQRGNQ

SEQ ID NO: 323 - protein, 30 aa, Artificial Sequence
  Description of Artificial Sequence: Synthetic polypeptide
DEEEIRTTNPVATEQYGSVSTLNLQRGVNR

SEQ ID NO: 324 - protein, 29 aa, Artificial Sequence
  Description of Artificial Sequence: Synthetic peptide
DEEEIRTTNPDATEQYGSVSTNLQRGGNR

SEQ ID NO: 325 - protein, 28 aa, Artificial Sequence
  Description of Artificial Sequence: Synthetic peptide
DEEEIRTTNPVATEQYGSVSTDLQNGNR

SEQ ID NO: 326 - protein, 28 aa, Artificial Sequence
  Description of Artificial Sequence: Synthetic peptide
DEEEIRTTNPVATEQYGVVSTNLQRGNC

SEQ ID NO: 327 - protein, 28 aa, Artificial Sequence
  Description of Artificial Sequence: Synthetic peptide
DEEEIRTTNPVCTEQYGSVSTNLNRGNR

SEQ ID NO: 328 - protein, 28 aa, Artificial Sequence
  Description of Artificial Sequence: Synthetic peptide
DEEEIRTTNPVATENYGSASTNLQRGNR

SEQ ID NO: 329 - protein, 29 aa, Artificial Sequence
  Description of Artificial Sequence: Synthetic peptide
DEEEIRTTNPVATEQYGSVSTNLERGNER

SEQ ID NO: 330 - protein, 28 aa, Artificial Sequence
  Description of Artificial Sequence: Synthetic peptide
DEEEICTTNPVATEQYGDVSTNLQRGNR

SEQ ID NO: 331 - protein, 29 aa, Artificial Sequence
  Description of Artificial Sequence: Synthetic peptide
DEEEIRTTNPIATEQYGSVSTNLQMRGNR

SEQ ID NO: 332 - protein, 28 aa, Artificial Sequence
  Description of Artificial Sequence: Synthetic peptide
DEEEIRTTNPVATEQYGSVSTNLQNGNN

SEQ ID NO: 333 - protein, 29 aa, Artificial Sequence
  Description of Artificial Sequence: Synthetic peptide
DEEEIRTTNPVATEQYGSVSTNGLQQGNR

SEQ ID NO: 334 - protein, 28 aa, Artificial Sequence
  Description of Artificial Sequence: Synthetic peptide
DEEEIRTTNPVATEQYGSASTDLQRGNR

SEQ ID NO: 335 - protein, 28 aa, Artificial Sequence
  Description of Artificial Sequence: Synthetic peptide
DEEEIRTTNPIACEQYGSVSTNLQRGNR

SEQ ID NO: 336 - protein, 28 aa, Artificial Sequence
  Description of Artificial Sequence: Synthetic peptide
DEEEIRTTNPVATEQYGSVSTNLQTGNW

SEQ ID NO: 337 - protein, 30 aa, Artificial Sequence
  Description of Artificial Sequence: Synthetic polypeptide
DEEEIRTTNPVATEQYGSVSTINLQERGNR

SEQ ID NO: 338 - protein, 28 aa, Artificial Sequence
  Description of Artificial Sequence: Synthetic peptide
DEEEIRTTNPVATEQYGSVSTPLERGNR

SEQ ID NO: 339 - protein, 28 aa, Artificial Sequence
  Description of Artificial Sequence: Synthetic peptide
MEEEIRTTNPVATEQYGSVSTNLQRGND

SEQ ID NO: 340 - protein, 28 aa, Artificial Sequence
  Description of Artificial Sequence: Synthetic peptide
DEEEIRTTNPIATEQYGSVSSNLQRGNR

SEQ ID NO: 341 - protein, 28 aa, Artificial Sequence
  Description of Artificial Sequence: Synthetic peptide
DEEEIRTTNPVATEQYGFVSTGLQRGNR

SEQ ID NO: 342 - protein, 28 aa, Artificial Sequence
  Description of Artificial Sequence: Synthetic peptide
DEEEIRTTNPVATEQYGSAPTNLQRGNR

SEQ ID NO: 343 - protein, 30 aa, Artificial Sequence
  Description of Artificial Sequence: Synthetic polypeptide
DEEEIRTTNPVATEQYGSVSTPNLQRNGNR

SEQ ID NO: 344 - protein, 29 aa, Artificial Sequence
  Description of Artificial Sequence: Synthetic peptide
DEEEIRTTNPVATEQYGSVSTNLQMGDNR

SEQ ID NO: 345 - protein, 29 aa, Artificial Sequence
  Description of Artificial Sequence: Synthetic peptide
SEEEIRTTNPVATEQYGSVSTNLQREGNR

SEQ ID NO: 346 - protein, 29 aa, Artificial Sequence
  Description of Artificial Sequence: Synthetic peptide
DEEEIRTTNPVATEQYGSVSTNLQMMGNR

SEQ ID NO: 347 - protein, 29 aa, Artificial Sequence
  Description of Artificial Sequence: Synthetic peptide
DEEEIRTTNPVATEQYGSVSTNLVQRGNF

SEQ ID NO: 348 - protein, 28 aa, Artificial Sequence
  Description of Artificial Sequence: Synthetic peptide
DEEEIRTTNPCATEQYGSVSTNDQRGNR

SEQ ID NO: 349 - protein, 28 aa, Artificial Sequence
  Description of Artificial Sequence: Synthetic peptide
DEEEIRTTNPVCTEQYGSVSTNWQRGNR

SEQ ID NO: 350 - protein, 28 aa, Artificial Sequence
  Description of Artificial Sequence: Synthetic peptide
DTEEIRTTNPVATEQYGSWSTNLQRGNR

SEQ ID NO: 351 - protein, 28 aa, Artificial Sequence
  Description of Artificial Sequence: Synthetic peptide
DEEEIATTNPVATEQYGSVSTNLQNGNR

SEQ ID NO: 352 - protein, 28 aa, Artificial Sequence
  Description of Artificial Sequence: Synthetic peptide
DEEEIRTTNPCATEQYGHVSTNLQRGNR

SEQ ID NO: 353 - protein, 28 aa, Artificial Sequence
  Description of Artificial Sequence: Synthetic peptide
DEEEIRATNPVATEQYGSVSTNLQSGNR

SEQ ID NO: 354 - protein, 30 aa, Artificial Sequence
  Description of Artificial Sequence: Synthetic polypeptide
DEEEIRTTNPVATEQYGSVSETNLQRGENR

SEQ ID NO: 355 - protein, 28 aa, Artificial Sequence
  Description of Artificial Sequence: Synthetic peptide
DENEIRTTNPVATEQYGSASTNLQRGNR

SEQ ID NO: 356 - protein, 28 aa, Artificial Sequence
  Description of Artificial Sequence: Synthetic peptide
KEEEIRTTNPVATEQYGSVATNLQRGNR

SEQ ID NO: 357 - protein, 28 aa, Artificial Sequence
  Description of Artificial Sequence: Synthetic peptide
DEEEVRTTNPVATEQYGSVSTNLQRGND

SEQ ID NO: 358 - protein, 28 aa, Artificial Sequence
  Description of Artificial Sequence: Synthetic peptide
DEEEIRTTNPVCTEQYGSVSTNLQRGND

SEQ ID NO: 359 - protein, 29 aa, Artificial Sequence
  Description of Artificial Sequence: Synthetic peptide
DEEEIRTTNPVATEQYGSSVSQNLQRGNR

SEQ ID NO: 360 - protein, 28 aa, Artificial Sequence
  Description of Artificial Sequence: Synthetic peptide
DEEEIRTTNPVATEQYGSVSTELQRGNV

SEQ ID NO: 361 - protein, 29 aa, Artificial Sequence
  Description of Artificial Sequence: Synthetic peptide
DEEEIRTTNPVATEQYGSVSLTNLQRGNK

SEQ ID NO: 362 - protein, 28 aa, Artificial Sequence
  Description of Artificial Sequence: Synthetic peptide
DEEEVRTTNPVATEMYGSVSTNLQRGNR

SEQ ID NO: 363 - protein, 28 aa, Artificial Sequence
  Description of Artificial Sequence: Synthetic peptide
DEEEIRTTNPVATEQYGSVSTNLQVGDR

SEQ ID NO: 364 - protein, 28 aa, Artificial Sequence
  Description of Artificial Sequence: Synthetic peptide
DEEEIRTTNPVATEQYGSVSTNLDEGNR

SEQ ID NO: 365 - protein, 28 aa, Artificial Sequence
  Description of Artificial Sequence: Synthetic peptide
DEEEIRTVNPEATEQYGSVSTNLQRGNR

SEQ ID NO: 366 - protein, 28 aa, Artificial Sequence
  Description of Artificial Sequence: Synthetic peptide
DEEEIRTTNPVASEQYGSVSTNLQHGNR

SEQ ID NO: 367 - protein, 28 aa, Artificial Sequence
  Description of Artificial Sequence: Synthetic peptide
DEEEIRTTNPVATEQYGDVSTNLQRGNE

SEQ ID NO: 368 - protein, 28 aa, Artificial Sequence
  Description of Artificial Sequence: Synthetic peptide
DEEEIRTTNPVATEQYGSVSTNLERGDR

SEQ ID NO: 369 - protein, 28 aa, Artificial Sequence
  Description of Artificial Sequence: Synthetic peptide
DEEEIRTTNIVATEQYGSVSTNLQRGNN

SEQ ID NO: 370 - protein, 28 aa, Artificial Sequence
  Description of Artificial Sequence: Synthetic peptide
DEEEIRTTNPVATEQYGSVSTPLQVGNR

SEQ ID NO: 371 - protein, 28 aa, Artificial Sequence
  Description of Artificial Sequence: Synthetic peptide
DEEEIRTVNPVATEQYGSVSTNLQAGNR

SEQ ID NO: 372 - protein, 28 aa, Artificial Sequence
  Description of Artificial Sequence: Synthetic peptide
DEDEIRTTNPVATEQYGSASTNLQRGNR

SEQ ID NO: 373 - protein, 30 aa, Artificial Sequence
  Description of Artificial Sequence: Synthetic polypeptide
DEEEIRTTNPVATEQYGSVSTNPLQRGNDR

SEQ ID NO: 374 - protein, 28 aa, Artificial Sequence
  Description of Artificial Sequence: Synthetic peptide
DEEEVRTTNPVATEIYGSVSTNLQRGNR

SEQ ID NO: 375 - protein, 28 aa, Artificial Sequence
  Description of Artificial Sequence: Synthetic peptide
DEEEIGTTNPVATENYGSVSTNLQRGNR

SEQ ID NO: 376 - protein, 28 aa, Artificial Sequence
  Description of Artificial Sequence: Synthetic peptide
DEELIRTTNPVATEQYGSVSTNLIRGNR

SEQ ID NO: 377 - protein, 28 aa, Artificial Sequence
  Description of Artificial Sequence: Synthetic peptide
DEEEIRTTNPVATEQYGWVSTELQRGNR

SEQ ID NO: 378 - protein, 28 aa, Artificial Sequence
  Description of Artificial Sequence: Synthetic peptide
NESEIRTTNPVATEQYGSVSTNLQRGNR

SEQ ID NO: 379 - protein, 28 aa, Artificial Sequence
  Description of Artificial Sequence: Synthetic peptide
DEEEISTTNPVATEQYGWVSTNLQRGNR

SEQ ID NO: 380 - protein, 30 aa, Artificial Sequence
  Description of Artificial Sequence: Synthetic polypeptide
DEEEIRTTNPVATEQYGSVSTMNLQQRGNR

SEQ ID NO: 381 - protein, 28 aa, Artificial Sequence
  Description of Artificial Sequence: Synthetic peptide
DEEEIRTTNPVATECYGSVSTNLQRGTR

SEQ ID NO: 382 - protein, 30 aa, Artificial Sequence
  Description of Artificial Sequence: Synthetic polypeptide
DEEEIRTTNPVATEQYGSVESTNLQDRGNR

SEQ ID NO: 383 - protein, 28 aa, Artificial Sequence
  Description of Artificial Sequence: Synthetic peptide
DEEEIRTTNPVATEQYGSVSTNLQRGEC

SEQ ID NO: 384 - protein, 29 aa, Artificial Sequence
  Description of Artificial Sequence: Synthetic peptide
DEEEIRTTNPVATEQYGSVTTSNLQRGNR

SEQ ID NO: 385 - protein, 28 aa, Artificial Sequence
  Description of Artificial Sequence: Synthetic peptide
DEEEIWTTNPVATEQYGSVSTNLQRGNG

SEQ ID NO: 386 - protein, 28 aa, Artificial Sequence
  Description of Artificial Sequence: Synthetic peptide
DEVEIRTTNPVATEQYGSVSTNLQAGNR

SEQ ID NO: 387 - protein, 28 aa, Artificial Sequence
  Description of Artificial Sequence: Synthetic peptide
DEEEIRTTNPVATEQYGSVSTGLQNGNR

SEQ ID NO: 388 - protein, 29 aa, Artificial Sequence
  Description of Artificial Sequence: Synthetic peptide
DEEEIRTTNPVATEIYGSVSTNLQDRGNR

SEQ ID NO: 389 - protein, 28 aa, Artificial Sequence
  Description of Artificial Sequence: Synthetic peptide
DEEEIVTTNPVATEQYGSVSTELQRGNR

SEQ ID NO: 390 - protein, 28 aa, Artificial Sequence
  Description of Artificial Sequence: Synthetic peptide
NEEEIRSTNPVATEQYGSVSTNLQRGNR

SEQ ID NO: 391 - protein, 30 aa, Artificial Sequence
  Description of Artificial Sequence: Synthetic polypeptide
DEEEIRTTNPVATEQYGSVSTLNLQDRGNR

SEQ ID NO: 392 - protein, 28 aa, Artificial Sequence
  Description of Artificial Sequence: Synthetic peptide
DEEEIRTTNPVATEQYGSVSTNWQRGLR

SEQ ID NO: 393 - protein, 28 aa, Artificial Sequence
  Description of Artificial Sequence: Synthetic peptide
DEEEIRQTNPVATEQYGWVSTNLQRGNR

SEQ ID NO: 394 - protein, 28 aa, Artificial Sequence
  Description of Artificial Sequence: Synthetic peptide
DEEEIRTTNPVATEQYGSVSNNLQRGNG

SEQ ID NO: 395 - protein, 28 aa, Artificial Sequence
  Description of Artificial Sequence: Synthetic peptide
DEECIRTTNPFATEQYGSVSTNLQRGNR

SEQ ID NO: 396 - protein, 28 aa, Artificial Sequence
  Description of Artificial Sequence: Synthetic peptide
DECEIRSTNPVATEQYGSVSTNLQRGNR

SEQ ID NO: 397 - protein, 29 aa, Artificial Sequence
  Description of Artificial Sequence: Synthetic peptide
DEFEIRTTNPVATEQYGSVSTNLQRGNYR

SEQ ID NO: 398 - protein, 29 aa, Artificial Sequence
  Description of Artificial Sequence: Synthetic peptide
DEEEIRTTNPVATEQYGSVSTGNLQRGNV

SEQ ID NO: 399 - protein, 29 aa, Artificial Sequence
  Description of Artificial Sequence: Synthetic peptide
DEEEIRTTNPVATEQYGSVSTNLQQGNTR

SEQ ID NO: 400 - protein, 28 aa, Artificial Sequence
  Description of Artificial Sequence: Synthetic peptide
DEMEIRTTNPVATEQYGSVSDNLQRGNR

SEQ ID NO: 401 - protein, 30 aa, Artificial Sequence
  Description of Artificial Sequence: Synthetic polypeptide
DEEEIRTTNPVATEQYGSVSATNLQRAGNR

SEQ ID NO: 402 - protein, 28 aa, Artificial Sequence
  Description of Artificial Sequence: Synthetic peptide
DEEEIRQTNPVATEQYGSVSTNLIRGNR

SEQ ID NO: 403 - protein, 29 aa, Artificial Sequence
  Description of Artificial Sequence: Synthetic peptide
DEEEIRTTNPVATEQYGSVSTANLQYGNR

SEQ ID NO: 404 - protein, 28 aa, Artificial Sequence
  Description of Artificial Sequence: Synthetic peptide
DEEEIRTTNPVATETFGSVSTNLQRGNR

SEQ ID NO: 405 - protein, 30 aa, Artificial Sequence
  Description of Artificial Sequence: Synthetic polypeptide
DEEEIRTTNPVATEQYGSVSTNLVQDRGNR

SEQ ID NO: 406 - protein, 29 aa, Artificial Sequence
  Description of Artificial Sequence: Synthetic peptide
DEEEIRTTNPVATEQYGSVSTPNLDRGNR

SEQ ID NO: 407 - protein, 29 aa, Artificial Sequence
  Description of Artificial Sequence: Synthetic peptide
DEEEIRTTNPVATEFYGSVSNTNLQRGNR

SEQ ID NO: 408 - protein, 28 aa, Artificial Sequence
  Description of Artificial Sequence: Synthetic peptide
DEEEIRTTNPVATEQYGEVSTNLQGGNR

SEQ ID NO: 409 - protein, 30 aa, Artificial Sequence
  Description of Artificial Sequence: Synthetic polypeptide
DEEEIRTTNPVATEQYGSVSTNLVQRDGNR

SEQ ID NO: 410 - protein, 28 aa, Artificial Sequence
  Description of Artificial Sequence: Synthetic peptide
DEFEIGTTNPVATEQYGSVSTNLQRGNR

SEQ ID NO: 411 - protein, 29 aa, Artificial Sequence
  Description of Artificial Sequence: Synthetic peptide
DEEEIRTTNPVATEQYGSVSTNLQRNGNE

SEQ ID NO: 412 - protein, 28 aa, Artificial Sequence
  Description of Artificial Sequence: Synthetic peptide
DEEEIRTTNPVATEQYGQMSTNLQRGNR

SEQ ID NO: 413 - protein, 28 aa, Artificial Sequence
  Description of Artificial Sequence: Synthetic peptide
DEEEIRTTNPVATEQYGSVSTNLERGNW

SEQ ID NO: 414 - protein, 29 aa, Artificial Sequence
  Description of Artificial Sequence: Synthetic peptide
DEEEIRTTNPVATEWYGQSVSTNLQRGNR

SEQ ID NO: 415 - protein, 28 aa, Artificial Sequence
  Description of Artificial Sequence: Synthetic peptide
DEEEIRTTNPVATEQYGSVSTILQHGNR

SEQ ID NO: 416 - protein, 29 aa, Artificial Sequence
  Description of Artificial Sequence: Synthetic peptide
DEEEIRTTNPVATEQYGSFVWTNLQRGNR

SEQ ID NO: 417 - protein, 28 aa, Artificial Sequence
  Description of Artificial Sequence: Synthetic peptide
DEEEIRTTNPVATEQYGSVSTGLQRGNE

SEQ ID NO: 418 - protein, 29 aa, Artificial Sequence
  Description of Artificial Sequence: Synthetic peptide
DEEEIRTTNPVATEQYGSVSTNLQIRGNW

SEQ ID NO: 419 - protein, 28 aa, Artificial Sequence
  Description of Artificial Sequence: Synthetic peptide
DEVEIVTTNPVATEQYGSVSTNLQRGNR

SEQ ID NO: 420 - protein, 29 aa, Artificial Sequence
  Description of Artificial Sequence: Synthetic peptide
DEEEIRTTNPVATEQYGSVSTNLYLRGNR

SEQ ID NO: 421 - protein, 29 aa, Artificial Sequence
  Description of Artificial Sequence: Synthetic peptide
DEEEIRTTNPVATEQYGSVSTNLQRGDND

SEQ ID NO: 422 - protein, 28 aa, Artificial Sequence
  Description of Artificial Sequence: Synthetic peptide
DEEEVRTTNPVATEQYGVVSTNLQRGNR

SEQ ID NO: 423 - protein, 29 aa, Artificial Sequence
  Description of Artificial Sequence: Synthetic peptide
DEEEIRTTNPVATEQYGSVSTLNLERGNR

SEQ ID NO: 424 - protein, 28 aa, Artificial Sequence
  Description of Artificial Sequence: Synthetic peptide
DEEEIRTTNPVATEQYGSVSTVLQHGNR

SEQ ID NO: 425 - protein, 29 aa, Artificial Sequence
  Description of Artificial Sequence: Synthetic peptide
DEEEIRTTNPVATEQYGSVSTALQRGNDR

SEQ ID NO: 426 - protein, 28 aa, Artificial Sequence
  Description of Artificial Sequence: Synthetic peptide
DEEEIRTTNPVATEQYGSVSTTLQHGNR

SEQ ID NO: 427 - protein, 28 aa, Artificial Sequence
  Description of Artificial Sequence: Synthetic peptide
DEEELRTTNPVATEQYGSVSTNLQRGER

SEQ ID NO: 428 - protein, 29 aa, Artificial Sequence
  Description of Artificial Sequence: Synthetic peptide
DEEEIRTTNPVATEQYGSVSTNLQREGNE

SEQ ID NO: 429 - protein, 28 aa, Artificial Sequence
  Description of Artificial Sequence: Synthetic peptide
DEEEIRQTNPVATEQYGSVSTNLQRGNF

SEQ ID NO: 430 - protein, 30 aa, Artificial Sequence
  Description of Artificial Sequence: Synthetic polypeptide
DEEEIRTTNPVATEQYGSVSTENLVQRGNR

SEQ ID NO: 431 - protein, 28 aa, Artificial Sequence
  Description of Artificial Sequence: Synthetic peptide
DEEEIRTTNPVATEQYGSVSDNLQRGND

SEQ ID NO: 432 - protein, 29 aa, Artificial Sequence
  Description of Artificial Sequence: Synthetic peptide
DEEEIRTTNPVATEQYGSVSLNLQRGMNR

SEQ ID NO: 433 - protein, 28 aa, Artificial Sequence
  Description of Artificial Sequence: Synthetic peptide
DEEEIRTTNPVATEVYGSVSTNLERGNR

SEQ ID NO: 434 - protein, 29 aa, Artificial Sequence
  Description of Artificial Sequence: Synthetic peptide
VEEEIRTTNPVATEQYGSVSTNPLQRGNR

SEQ ID NO: 435 - protein, 29 aa, Artificial Sequence
  Description of Artificial Sequence: Synthetic peptide
DEEEIRTTNPVATEQYGSVSTEPLQRGNR

SEQ ID NO: 436 - protein, 29 aa, Artificial Sequence
  Description of Artificial Sequence: Synthetic peptide
DEEEIRTTNPVATEQYGSVASTNLQRGNT

SEQ ID NO: 437 - protein, 28 aa, Artificial Sequence
  Description of Artificial Sequence: Synthetic peptide
DEEEIRTTNPVATEQYGSVSTNLQHGNT

SEQ ID NO: 438 - protein, 28 aa, Artificial Sequence
  Description of Artificial Sequence: Synthetic peptide
DEEEIRTTNPVATEQYGSVSTALQIGNR

SEQ ID NO: 439 - protein, 28 aa, Artificial Sequence
  Description of Artificial Sequence: Synthetic peptide
MEDEIRTTNPVATEQYGSVSTNLQRGNR

SEQ ID NO: 440 - protein, 28 aa, Artificial Sequence
  Description of Artificial Sequence: Synthetic peptide
DEEMIRTTNPVATEQYGSVDTNLQRGNR

SEQ ID NO: 441 - protein, 28 aa, Artificial Sequence
  Description of Artificial Sequence: Synthetic peptide
DEEEISTTNPVATEQYGSVSTNLQNGNR

SEQ ID NO: 442 - protein, 29 aa, Artificial Sequence
  Description of Artificial Sequence: Synthetic peptide
DEEEIRTTNPVATEQYGSVSTNGPQRGNR

SEQ ID NO: 443 - protein, 28 aa, Artificial Sequence
  Description of Artificial Sequence: Synthetic peptide
DEEEIRTTNPVATIQYGDVSTNLQRGNR

SEQ ID NO: 444 - protein, 28 aa, Artificial Sequence
  Description of Artificial Sequence: Synthetic peptide
DEEEIRTTNPVSTEQYGTVSTNLQRGNR

SEQ ID NO: 445 - protein, 28 aa, Artificial Sequence
  Description of Artificial Sequence: Synthetic peptide
DEEEIYTTNPVATEQYGSVSTNLQRGNM

SEQ ID NO: 446 - protein, 30 aa, Artificial Sequence
  Description of Artificial Sequence: Synthetic polypeptide
DEEEIRTTNPVATEQYGSVTSTNLQRDGNR

SEQ ID NO: 447 - protein, 28 aa, Artificial Sequence
  Description of Artificial Sequence: Synthetic peptide
DEEEIRSTNPVATEQYGNVSTNLQRGNR

SEQ ID NO: 448 - protein, 30 aa, Artificial Sequence
  Description of Artificial Sequence: Synthetic polypeptide
DEEEIRTTNPVATEQYGSVSTNLPQLRGNR

SEQ ID NO: 449 - protein, 29 aa, Artificial Sequence
  Description of Artificial Sequence: Synthetic peptide
DEEEIRTTNPVATEQYGSVSVTDLQRGNR

SEQ ID NO: 450 - protein, 28 aa, Artificial Sequence
  Description of Artificial Sequence: Synthetic peptide
EEEEIRTTNPVATEQYGSVSENLQRGNR

SEQ ID NO: 451 - protein, 28 aa, Artificial Sequence
  Description of Artificial Sequence: Synthetic peptide
DEEEIRTVNPVATEQYGSVSTNLQTGNR

SEQ ID NO: 452 - protein, 30 aa, Artificial Sequence
  Description of Artificial Sequence: Synthetic polypeptide
DEEEIRTTNPVATEQYGSVSTNLQREGNDR

SEQ ID NO: 453 - protein, 28 aa, Artificial Sequence
  Description of Artificial Sequence: Synthetic peptide
DEHEIRTTNPVATEQYGDVSTNLQRGNR

SEQ ID NO: 454 - protein, 28 aa, Artificial Sequence
  Description of Artificial Sequence: Synthetic peptide
DEEEIRTTNPCATEQYGSVSTNLQDGNR

SEQ ID NO: 455 - protein, 28 aa, Artificial Sequence
  Description of Artificial Sequence: Synthetic peptide
EEEEIRTTNPVATEQYGSVSTNAQRGNR

SEQ ID NO: 456 - protein, 28 aa, Artificial Sequence
  Description of Artificial Sequence: Synthetic peptide
VEEEVRTTNPVATEQYGSVSTNLQRGNR

SEQ ID NO: 457 - protein, 28 aa, Artificial Sequence
  Description of Artificial Sequence: Synthetic peptide
DEEEIRTTNPVATEQYGSVSTNDQRGNF

SEQ ID NO: 458 - protein, 28 aa, Artificial Sequence
  Description of Artificial Sequence: Synthetic peptide
DEEEIRTTNPVATEQYGSVPTNEQRGNR

SEQ ID NO: 459 - protein, 28 aa, Artificial Sequence
  Description of Artificial Sequence: Synthetic peptide
DEEEIRTTNPVATEQYGSVSTVLQRGDR

SEQ ID NO: 460 - protein, 28 aa, Artificial Sequence
  Description of Artificial Sequence: Synthetic peptide
DEEEIRTTNPVATEDYGSVSTNLGRGNR

SEQ ID NO: 461 - protein, 29 aa, Artificial Sequence
  Description of Artificial Sequence: Synthetic peptide
DEEEIRTTNPEATEQYGSVSTNLQDRGNR

SEQ ID NO: 462 - protein, 28 aa, Artificial Sequence
  Description of Artificial Sequence: Synthetic peptide
DEEEIRCTNAVATEQYGSVSTNLQRGNR

SEQ ID NO: 463 - protein, 30 aa, Artificial Sequence
  Description of Artificial Sequence: Synthetic polypeptide
DEEEIRTTNPVATEQYGSVSATNLQRNGNR

SEQ ID NO: 464 - protein, 28 aa, Artificial Sequence
  Description of Artificial Sequence: Synthetic peptide
DETEIRTTNPCATEQYGSVSTNLQRGNR

SEQ ID NO: 465 - protein, 28 aa, Artificial Sequence
  Description of Artificial Sequence: Synthetic peptide
DEEEIRTTNPVATEQYGCVSANLQRGNR

SEQ ID NO: 466 - protein, 28 aa, Artificial Sequence
  Description of Artificial Sequence: Synthetic peptide
DEEEIRTTNPVAHEQYGSVSTNLQRINR

SEQ ID NO: 467 - protein, 29 aa, Artificial Sequence
  Description of Artificial Sequence: Synthetic peptide
DEEEIRTTNPVATEQYGSVSTNLQRGENF

SEQ ID NO: 468 - protein, 28 aa, Artificial Sequence
  Description of Artificial Sequence: Synthetic peptide
DEEEIRCTNPVATETYGSVSTNLQRGNR

SEQ ID NO: 469 - protein, 28 aa, Artificial Sequence
  Description of Artificial Sequence: Synthetic peptide
DEEEIRTTNPVATECYGSVETNLQRGNR

SEQ ID NO: 470 - protein, 28 aa, Artificial Sequence
  Description of Artificial Sequence: Synthetic peptide
DEEEITTTNPVATEQYGSVSTNLQQGNR

SEQ ID NO: 471 - protein, 29 aa, Artificial Sequence
  Description of Artificial Sequence: Synthetic peptide
DEEEIRTTNPVATEQYGSVSTNLQDRGNH

SEQ ID NO: 472 - protein, 28 aa, Artificial Sequence
  Description of Artificial Sequence: Synthetic peptide
DEEEIRTTNPVATEQYGSVSTNLQDGNA

SEQ ID NO: 473 - protein, 28 aa, Artificial Sequence
  Description of Artificial Sequence: Synthetic peptide
DEEEIRTTNPVATEQYGSVSTNLERGNI

SEQ ID NO: 474 - protein, 28 aa, Artificial Sequence
  Description of Artificial Sequence: Synthetic peptide
DEEEIRQTNPVATEQYGSVATNLQRGNR

SEQ ID NO: 475 - protein, 28 aa, Artificial Sequence
  Description of Artificial Sequence: Synthetic peptide
DEEEIRTTNIVATEQYGSVSTNLQRGNS

SEQ ID NO: 476 - protein, 28 aa, Artificial Sequence
  Description of Artificial Sequence: Synthetic peptide
DEEEIRTTNPVAHEQFGSVSTNLQRGNR

SEQ ID NO: 477 - protein, 28 aa, Artificial Sequence
  Description of Artificial Sequence: Synthetic peptide
DEEEIRTTNPVATEYYGSVSTNLGRGNR

SEQ ID NO: 478 - protein, 29 aa, Artificial Sequence
  Description of Artificial Sequence: Synthetic peptide
DEEEIRTTNPVATEQYGCVSTMNLQRGNR

SEQ ID NO: 479 - protein, 29 aa, Artificial Sequence
  Description of Artificial Sequence: Synthetic peptide
DEEEIRTTNPVATEQYGCSVSTNLQRGER

SEQ ID NO: 480 - protein, 28 aa, Artificial Sequence
  Description of Artificial Sequence: Synthetic peptide
DEEEIRTTNIVATEQYGSVSTNLQRGNC

SEQ ID NO: 481 - protein, 28 aa, Artificial Sequence
  Description of Artificial Sequence: Synthetic peptide
DEEEIRTTNPVATEQYGSNSTNLQRGNA

SEQ ID NO: 482 - protein, 30 aa, Artificial Sequence
  Description of Artificial Sequence: Synthetic polypeptide
DEEEIRTTNPVATEQYGSVSTENLQRGDNR

SEQ ID NO: 483 - protein, 28 aa, Artificial Sequence
  Description of Artificial Sequence: Synthetic peptide
DENEIRTTNPVATEQYGSVSTALQRGNR

SEQ ID NO: 484 - protein, 30 aa, Artificial Sequence
  Description of Artificial Sequence: Synthetic polypeptide
DEEEIRTTNPVATEQYGSVSTNNLQRGDNR

SEQ ID NO: 485 - protein, 28 aa, Artificial Sequence
  Description of Artificial Sequence: Synthetic peptide
DEVEIRTTNPVATEQYGSVSTNLQQGNR

SEQ ID NO: 486 - protein, 28 aa, Artificial Sequence
  Description of Artificial Sequence: Synthetic peptide
DTEEIRTTNPVATEQYGSVSTNDQRGNR

SEQ ID NO: 487 - protein, 29 aa, Artificial Sequence
  Description of Artificial Sequence: Synthetic peptide
DEEEIRTTNPVATEQYGSVSTNLQRGNLL

SEQ ID NO: 488 - protein, 28 aa, Artificial Sequence
  Description of Artificial Sequence: Synthetic peptide
DEEEIRTTNPVATEQYGSWSTNLQRGNN

SEQ ID NO: 489 - protein, 28 aa, Artificial Sequence
  Description of Artificial Sequence: Synthetic peptide
DEEEIRTTNPVATEQYGSWSENLQRGNR

SEQ ID NO: 490 - protein, 28 aa, Artificial Sequence
  Description of Artificial Sequence: Synthetic peptide
DEEEIRTTNPVATEQYGSVSTNLWRENR

SEQ ID NO: 491 - protein, 28 aa, Artificial Sequence
  Description of Artificial Sequence: Synthetic peptide
DEEEIRTTNPVATEQYGSVPTNLQRGNM

SEQ ID NO: 492 - protein, 28 aa, Artificial Sequence
  Description of Artificial Sequence: Synthetic peptide
DEEEIRTTNPVATEQYGSVSTELQRGER

SEQ ID NO: 493 - protein, 29 aa, Artificial Sequence
  Description of Artificial Sequence: Synthetic peptide
DEEEIRTTNPVATEQYGDVSCTNLQRGNR

SEQ ID NO: 494 - protein, 28 aa, Artificial Sequence
  Description of Artificial Sequence: Synthetic peptide
DEEEIRTTNPVATECYGSVSTNLQRGNN

SEQ ID NO: 495 - protein, 28 aa, Artificial Sequence
  Description of Artificial Sequence: Synthetic peptide
KEEEIRTTNPVATEQYGSVSTNLQRGNN

SEQ ID NO: 496 - protein, 29 aa, Artificial Sequence
  Description of Artificial Sequence: Synthetic peptide
DEEEIRTTNPVATEQYGSVSTNLPQRGND

SEQ ID NO: 497 - protein, 29 aa, Artificial Sequence
  Description of Artificial Sequence: Synthetic peptide
DEEEIRTTNPVATEQYGSYVSTNLQRGNG

SEQ ID NO: 498 - protein, 30 aa, Artificial Sequence
  Description of Artificial Sequence: Synthetic polypeptide
DEEEIRTTNPVATEQYGSVSTNLQEREGNR

SEQ ID NO: 499 - protein, 28 aa, Artificial Sequence
  Description of Artificial Sequence: Synthetic peptide
DEEEIRTTNPFATEQYGSVSTNLQGGNR

SEQ ID NO: 500 - protein, 28 aa, Artificial Sequence
  Description of Artificial Sequence: Synthetic peptide
DESEIRTCNPVATEQYGSVSTNLQRGNR

SEQ ID NO: 501 - protein, 28 aa, Artificial Sequence
  Description of Artificial Sequence: Synthetic peptide
DEEEVRTTNPVCTEQYGSVSTNLQRGNR

SEQ ID NO: 502 - protein, 28 aa, Artificial Sequence
  Description of Artificial Sequence: Synthetic peptide
DEEEIRTTNPVATEQYGSVSENPQRGNR

SEQ ID NO: 503 - protein, 28 aa, Artificial Sequence
  Description of Artificial Sequence: Synthetic peptide
GEEEIRTTNPVATEQYGSVSTNLQPGNR

SEQ ID NO: 504 - protein, 28 aa, Artificial Sequence
  Description of Artificial Sequence: Synthetic peptide
DEEEIRTTNPVATEVYGSVGTNLQRGNR

SEQ ID NO: 505 - protein, 28 aa, Artificial Sequence
  Description of Artificial Sequence: Synthetic peptide
DEEEIRTTNPYATEAYGSVSTNLQRGNR

SEQ ID NO: 506 - protein, 29 aa, Artificial Sequence
  Description of Artificial Sequence: Synthetic peptide
DEEEIRTTNPVATEQYGSVSTGLQIRGNR

SEQ ID NO: 507 - protein, 28 aa, Artificial Sequence
  Description of Artificial Sequence: Synthetic peptide
DEEEIRTTNPVATEQYGSVSTNLQNGNG

SEQ ID NO: 508 - protein, 28 aa, Artificial Sequence
  Description of Artificial Sequence: Synthetic peptide
SEEEIRTTNPVATEQYGSVSTNLQFGNR

SEQ ID NO: 509 - protein, 29 aa, Artificial Sequence
  Description of Artificial Sequence: Synthetic peptide
DEEEIRTTNPVATEQYGISVSTNLQRGDR

SEQ ID NO: 510 - protein, 28 aa, Artificial Sequence
  Description of Artificial Sequence: Synthetic peptide
MEEEIRTTNPVATEQYGSVSTNLQRGNM

SEQ ID NO: 511 - protein, 28 aa, Artificial Sequence
  Description of Artificial Sequence: Synthetic peptide
DEEEIRTTNPVATEQYGSVSTNPQRGNV

SEQ ID NO: 512 - protein, 28 aa, Artificial Sequence
  Description of Artificial Sequence: Synthetic peptide
DEEEIRTTNPVATEQYGSVSTALQRGNL

SEQ ID NO: 513 - protein, 28 aa, Artificial Sequence
  Description of Artificial Sequence: Synthetic peptide
DEEEIRTTNPVATEQYGSVSTNPQRGNA

SEQ ID NO: 514 - protein, 28 aa, Artificial Sequence
  Description of Artificial Sequence: Synthetic peptide
DEEEIRTTNPVATEQYGSVSENLMRGNR

SEQ ID NO: 515 - protein, 28 aa, Artificial Sequence
  Description of Artificial Sequence: Synthetic peptide
DEEEIRTTNPVAHEQYGSVSTNLIRGNR

SEQ ID NO: 516 - protein, 29 aa, Artificial Sequence
  Description of Artificial Sequence: Synthetic peptide
DEEEIRTTNPVATEQYGSVSTNLQREGNF

SEQ ID NO: 517 - protein, 28 aa, Artificial Sequence
  Description of Artificial Sequence: Synthetic peptide
DEEEIRTTNPVATEQYGSVSTPLQRGNS

SEQ ID NO: 518 - protein, 28 aa, Artificial Sequence
  Description of Artificial Sequence: Synthetic peptide
DEEEIRTTNPVATEQYGSVSTNLQHENR

SEQ ID NO: 519 - protein, 29 aa, Artificial Sequence
  Description of Artificial Sequence: Synthetic peptide
DEEEIRTTNPVATEQYGSVSTNLQRGVNN

SEQ ID NO: 520 - protein, 28 aa, Artificial Sequence
  Description of Artificial Sequence: Synthetic peptide
DEEEIRTTNPVATEQYGSVSTNLQWGNL

SEQ ID NO: 521 - protein, 30 aa, Artificial Sequence
  Description of Artificial Sequence: Synthetic polypeptide
DEEEIRTTNPVATEQYGSVSTANLQRGNWR

SEQ ID NO: 522 - protein, 28 aa, Artificial Sequence
  Description of Artificial Sequence: Synthetic peptide
DEEEIRTTNPVATEQYGSVSTNLQWGNS

SEQ ID NO: 523 - protein, 28 aa, Artificial Sequence
  Description of Artificial Sequence: Synthetic peptide
DEEEIRTTNIVATEQYGSVSTNLQRGER

SEQ ID NO: 524 - protein, 30 aa, Artificial Sequence
  Description of Artificial Sequence: Synthetic polypeptide
DEEEIRTTNPVATEQYGCSVYSTNLQRGNR

SEQ ID NO: 525 - protein, 28 aa, Artificial Sequence
  Description of Artificial Sequence: Synthetic peptide
DEEEIRTTNPVGTEQYGSVSTNEQRGNR

SEQ ID NO: 526 - protein, 28 aa, Artificial Sequence
  Description of Artificial Sequence: Synthetic peptide
DEEEIRTTNPVAYEQYGCVSTNLQRGNR

SEQ ID NO: 527 - protein, 28 aa, Artificial Sequence
  Description of Artificial Sequence: Synthetic peptide
DEEEIRTTNPVASEVYGSVSTNLQRGNR

SEQ ID NO: 528 - protein, 28 aa, Artificial Sequence
  Description of Artificial Sequence: Synthetic peptide
DEEEIRTTNPVATEQYGSVHTNDQRGNR

SEQ ID NO: 529 - protein, 28 aa, Artificial Sequence
  Description of Artificial Sequence: Synthetic peptide
DEEEIRTTNPVATEQYGSVDTNLQHGNR

SEQ ID NO: 530 - protein, 28 aa, Artificial Sequence
  Description of Artificial Sequence: Synthetic peptide
DEEEIRQTNPVATEQYGSVSTNLQRENR

SEQ ID NO: 531 - protein, 29 aa, Artificial Sequence
  Description of Artificial Sequence: Synthetic peptide
DEEEIRTTNPSATEQYGSVSTNLQRGNNR

SEQ ID NO: 532 - protein, 29 aa, Artificial Sequence
  Description of Artificial Sequence: Synthetic peptide
DEEEIRTTNPVATEQYGSVSTELQLRGNR

SEQ ID NO: 533 - protein, 28 aa, Artificial Sequence
  Description of Artificial Sequence: Synthetic peptide
DEEEIRTTNPVATESYGSVSTNLQEGNR

SEQ ID NO: 534 - protein, 28 aa, Artificial Sequence
  Description of Artificial Sequence: Synthetic peptide
DEEEIRATNPVATEQFGSVSTNLQRGNR

SEQ ID NO: 535 - protein, 29 aa, Artificial Sequence
  Description of Artificial Sequence: Synthetic peptide
MEEEIRTTNPVATEQYGSVSTNLQRGNDR

SEQ ID NO: 536 - protein, 28 aa, Artificial Sequence
  Description of Artificial Sequence: Synthetic peptide
DEEEIRTTNPVCYEQYGSVSTNLQRGNR

SEQ ID NO: 537 - protein, 28 aa, Artificial Sequence
  Description of Artificial Sequence: Synthetic peptide
DEEEIRTTNPVATEQYGSVSTNVQRGGR

SEQ ID NO: 538 - protein, 29 aa, Artificial Sequence
  Description of Artificial Sequence: Synthetic peptide
KEEEIRTTNPVATEQYGSVSTNLQERGNR

SEQ ID NO: 539 - protein, 29 aa, Artificial Sequence
  Description of Artificial Sequence: Synthetic peptide
DEEEIRTTNPVATEQFGSVSTNLQRAGNR

SEQ ID NO: 540 - protein, 28 aa, Artificial Sequence
  Description of Artificial Sequence: Synthetic peptide
DEEEIRTTNPVAVEQYGSVSTNLQYGNR

SEQ ID NO: 541 - protein, 28 aa, Artificial Sequence
  Description of Artificial Sequence: Synthetic peptide
MEEEIRTTNPVATEQYGSVETNLQRGNR

SEQ ID NO: 542 - protein, 29 aa, Artificial Sequence
  Description of Artificial Sequence: Synthetic peptide
DEEEIRTTNPVATEQYGSVSTNEQNRGNR

SEQ ID NO: 543 - protein, 28 aa, Artificial Sequence
  Description of Artificial Sequence: Synthetic peptide
DEEEITTTNPVATEQYGIVSTNLQRGNR

SEQ ID NO: 544 - protein, 30 aa, Artificial Sequence
  Description of Artificial Sequence: Synthetic polypeptide
DEEEIRTTNPVATEQYGSVCSTNLQRDGNR

SEQ ID NO: 545 - protein, 29 aa, Artificial Sequence
  Description of Artificial Sequence: Synthetic peptide
DEEEIRTTNPVATECYGSVSTNLQIRGNR

SEQ ID NO: 546 - protein, 28 aa, Artificial Sequence
  Description of Artificial Sequence: Synthetic peptide
DEEEINTTNVVATEQYGSVSTNLQRGNR

SEQ ID NO: 547 - protein, 28 aa, Artificial Sequence
  Description of Artificial Sequence: Synthetic peptide
DEEEIRTTNPVATEQYGSVDTNLQRGNE

SEQ ID NO: 548 - protein, 28 aa, Artificial Sequence
  Description of Artificial Sequence: Synthetic peptide
DEEEISTTNPVATEQYGSVSTNLQRGIR

SEQ ID NO: 549 - protein, 28 aa, Artificial Sequence
  Description of Artificial Sequence: Synthetic peptide
DEEEIKTTNPVATEQYGGVSTNLQRGNR

SEQ ID NO: 550 - protein, 28 aa, Artificial Sequence
  Description of Artificial Sequence: Synthetic peptide
DPEEIRTTNPVATEQYGSVSTNEQRGNR

SEQ ID NO: 551 - protein, 28 aa, Artificial Sequence
  Description of Artificial Sequence: Synthetic peptide
DEEEITTTNPVATEQYGSVATNLQRGNR

SEQ ID NO: 552 - protein, 29 aa, Artificial Sequence
  Description of Artificial Sequence: Synthetic peptide
DEEEIRTTNPVATEQYGSVSADNLQRGNR

SEQ ID NO: 553 - protein, 29 aa, Artificial Sequence
  Description of Artificial Sequence: Synthetic peptide
DEEEIRTTNPVATEQYGSVASTNLQRDNR

SEQ ID NO: 554 - protein, 28 aa, Artificial Sequence
  Description of Artificial Sequence: Synthetic peptide
DEEEIRTTNPVATEQYGWASTNLQRGNR

SEQ ID NO: 555 - protein, 29 aa, Artificial Sequence
  Description of Artificial Sequence: Synthetic peptide
DEEEIRTTNPFATEQYGSVSTNLQRAGNR

SEQ ID NO: 556 - protein, 29 aa, Artificial Sequence
  Description of Artificial Sequence: Synthetic peptide
DEEEIRTTNPVATEQYGSVSTNLQMKGNR

SEQ ID NO: 557 - protein, 28 aa, Artificial Sequence
  Description of Artificial Sequence: Synthetic peptide
DEEEIRTTNPVATEQSGSVSTNLQRGND

SEQ ID NO: 558 - protein, 28 aa, Artificial Sequence
  Description of Artificial Sequence: Synthetic peptide
DEEEIRTTNPVATEQYGSVSTGTQRGNR

SEQ ID NO: 559 - protein, 28 aa, Artificial Sequence
  Description of Artificial Sequence: Synthetic peptide
DEEEIRTTNPVSTEQYGSVSTNDQRGNR

SEQ ID NO: 560 - protein, 28 aa, Artificial Sequence
  Description of Artificial Sequence: Synthetic peptide
DEEEIATTNPVATEQYGSVSTQLQRGNR

SEQ ID NO: 561 - protein, 28 aa, Artificial Sequence
  Description of Artificial Sequence: Synthetic peptide
DEEEIRTTNPVATEQYGSVSTGLQRGNF

SEQ ID NO: 562 - protein, 28 aa, Artificial Sequence
  Description of Artificial Sequence: Synthetic peptide
DEEEIRTTNPVATEQFGSVSTNLQRGNI

SEQ ID NO: 563 - protein, 28 aa, Artificial Sequence
  Description of Artificial Sequence: Synthetic peptide
DEEEIRTTNPVATEQYGSVCTNLDRGNR

SEQ ID NO: 564 - protein, 28 aa, Artificial Sequence
  Description of Artificial Sequence: Synthetic peptide
DEEEIRTTNPEATEQYGSVSTNLQSGNR

SEQ ID NO: 565 - protein, 28 aa, Artificial Sequence
  Description of Artificial Sequence: Synthetic peptide
DEEEIRTTNPVATEMYGSVSTNEQRGNR

SEQ ID NO: 566 - protein, 29 aa, Artificial Sequence
  Description of Artificial Sequence: Synthetic peptide
DEEEIRTTNPVATEQYGSVSTNLQRGNDN

SEQ ID NO: 567 - protein, 28 aa, Artificial Sequence
  Description of Artificial Sequence: Synthetic peptide
DEVEIRTTNPVATEQYGSVSTVLQRGNR

SEQ ID NO: 568 - protein, 28 aa, Artificial Sequence
  Description of Artificial Sequence: Synthetic peptide
DEEEIRTTNPYATEQYGSVSTNLQRGDR

SEQ ID NO: 569 - protein, 28 aa, Artificial Sequence
  Description of Artificial Sequence: Synthetic peptide
DEEEIRTTNPVATEQYGIVSTNLQRGNS

SEQ ID NO: 570 - protein, 28 aa, Artificial Sequence
  Description of Artificial Sequence: Synthetic peptide
DEEEIRTTNPVATEQYGSVSTNLIRGNF

SEQ ID NO: 571 - protein, 28 aa, Artificial Sequence
  Description of Artificial Sequence: Synthetic peptide
DEEEIRTTNPVATEQYGSVSTTLQRGER

SEQ ID NO: 572 - protein, 29 aa, Artificial Sequence
  Description of Artificial Sequence: Synthetic peptide
DEEEIRTTNPVATEQYGSVSHNLQRGDNR

SEQ ID NO: 573 - protein, 28 aa, Artificial Sequence
  Description of Artificial Sequence: Synthetic peptide
DEEEIRTTNPVATEQYGSVSTNLQRGWV

SEQ ID NO: 574 - protein, 28 aa, Artificial Sequence
  Description of Artificial Sequence: Synthetic peptide
DEEEIRTTNPVATEQYGSVSTNLARGNF

SEQ ID NO: 575 - protein, 28 aa, Artificial Sequence
  Description of Artificial Sequence: Synthetic peptide
DENEIRTTNPVATEQYGSVSTNLQLGNR

SEQ ID NO: 576 - protein, 29 aa, Artificial Sequence
  Description of Artificial Sequence: Synthetic peptide
DEEEIRTTNPVATEQYGSVSTINLQAGNR

SEQ ID NO: 577 - protein, 29 aa, Artificial Sequence
  Description of Artificial Sequence: Synthetic peptide
DEEEIRTTNPVATEQYGSVSTNLQLRGNY

SEQ ID NO: 578 - protein, 28 aa, Artificial Sequence
  Description of Artificial Sequence: Synthetic peptide
DEEEIRTTNPVATEWYGSVSTALQRGNR

SEQ ID NO: 579 - protein, 28 aa, Artificial Sequence
  Description of Artificial Sequence: Synthetic peptide
DEVEIRTTNPVATEQYGGVSTNLQRGNR

SEQ ID NO: 580 - protein, 30 aa, Artificial Sequence
  Description of Artificial Sequence: Synthetic polypeptide
DEEEIRTTNPVATEQYGSVTSDTNLQRGNR

SEQ ID NO: 581 - protein, 28 aa, Artificial Sequence
  Description of Artificial Sequence: Synthetic peptide
DEEEIRTTNPVATEQYGSVFTNLQRENR

SEQ ID NO: 582 - protein, 28 aa, Artificial Sequence
  Description of Artificial Sequence: Synthetic peptide
DEEEIRTTNPVATEQYGSVQTNLQRGNP

SEQ ID NO: 583 - protein, 29 aa, Artificial Sequence
  Description of Artificial Sequence: Synthetic peptide
DEEEIRTTNPTATEQYGSVSTNLQRGDNR

SEQ ID NO: 584 - protein, 29 aa, Artificial Sequence
  Description of Artificial Sequence: Synthetic peptide
DEEEIRTTNPVATEQYGSVSTDLQDRGNR

SEQ ID NO: 585 - protein, 30 aa, Artificial Sequence
  Description of Artificial Sequence: Synthetic polypeptide
DEEEIRTTNPVATEQYGSVSETNMLQRGNR

SEQ ID NO: 586 - protein, 29 aa, Artificial Sequence
  Description of Artificial Sequence: Synthetic peptide
DEEEIRSTNPVATEQYGSVSTNLQRGNDR

SEQ ID NO: 587 - protein, 30 aa, Artificial Sequence
  Description of Artificial Sequence: Synthetic polypeptide
DEEEIRTTNPVATEQYGSVSTNLTQRGNDR

SEQ ID NO: 588 - protein, 29 aa, Artificial Sequence
  Description of Artificial Sequence: Synthetic peptide
DEEEIRTTNPVATECYGSVSTNLQRGNDR

SEQ ID NO: 589 - protein, 28 aa, Artificial Sequence
  Description of Artificial Sequence: Synthetic peptide
NEEEIMTTNPVATEQYGSVSTNLQRGNR

SEQ ID NO: 590 - protein, 29 aa, Artificial Sequence
  Description of Artificial Sequence: Synthetic peptide
DEEEIRTTNPVATEQYGSWSTNLPQRGNR

SEQ ID NO: 591 - protein, 28 aa, Artificial Sequence
  Description of Artificial Sequence: Synthetic peptide
DEEEIRTTNPVATEQYGSVSTNLQWGNQ

SEQ ID NO: 592 - protein, 28 aa, Artificial Sequence
  Description of Artificial Sequence: Synthetic peptide
DEEEIRTTNPVATEQYGSVSTNLQIGNN

SEQ ID NO: 593 - protein, 28 aa, Artificial Sequence
  Description of Artificial Sequence: Synthetic peptide
MEEEIRTTNPVATEQYGSVSTNLQRGNF

SEQ ID NO: 594 - protein, 29 aa, Artificial Sequence
  Description of Artificial Sequence: Synthetic peptide
DEEELRTTNPVATEQYGSVSTNLQDRGNR

SEQ ID NO: 595 - protein, 30 aa, Artificial Sequence
  Description of Artificial Sequence: Synthetic polypeptide
DEEEIRTTNPVATEQYGSVSTVNLQRGPNR

SEQ ID NO: 596 - protein, 28 aa, Artificial Sequence
  Description of Artificial Sequence: Synthetic peptide
DEEEIRTTNPVATEMYGSVSTNLQRGNV

SEQ ID NO: 597 - protein, 28 aa, Artificial Sequence
  Description of Artificial Sequence: Synthetic peptide
DDEEIRTTNPVATEQYGSVSTNLQRGQR

SEQ ID NO: 598 - protein, 28 aa, Artificial Sequence
  Description of Artificial Sequence: Synthetic peptide
DEEEIRTTNPVSTEQYGSVSTNLQRGNQ

SEQ ID NO: 599 - protein, 29 aa, Artificial Sequence
  Description of Artificial Sequence: Synthetic peptide
DEEEIRTTNPVATEQYGSVSVTNLQAGNR

SEQ ID NO: 600 - protein, 28 aa, Artificial Sequence
  Description of Artificial Sequence: Synthetic peptide
DEEEIRTTNPVATEQYGSVSTDLQRGNS

SEQ ID NO: 601 - protein, 29 aa, Artificial Sequence
  Description of Artificial Sequence: Synthetic peptide
DEEEIRTTNPMATEQYGSVSTNLQRGNQR

SEQ ID NO: 602 - protein, 30 aa, Artificial Sequence
  Description of Artificial Sequence: Synthetic polypeptide
DEEEIRTTNPVATEQYGSVVSTNLQRGDNR

SEQ ID NO: 603 - protein, 28 aa, Artificial Sequence
  Description of Artificial Sequence: Synthetic peptide
DEEEIRTTNPVATEQYGGVSTNLQRGAR

SEQ ID NO: 604 - protein, 28 aa, Artificial Sequence
  Description of Artificial Sequence: Synthetic peptide
DEEEIRTTNPVATEQYGSVSTNDQRGNT

SEQ ID NO: 605 - protein, 28 aa, Artificial Sequence
  Description of Artificial Sequence: Synthetic peptide
DEEEIRTTNPVATEQYGSVSTGLTRGNR

SEQ ID NO: 606 - protein, 28 aa, Artificial Sequence
  Description of Artificial Sequence: Synthetic peptide
DEEEIRTTNPVATEQYGSVSTNLDRGNW

SEQ ID NO: 607 - protein, 28 aa, Artificial Sequence
  Description of Artificial Sequence: Synthetic peptide
DDEEIRTTNPVATEQYGSVSANLQRGNR

SEQ ID NO: 608 - protein, 28 aa, Artificial Sequence
  Description of Artificial Sequence: Synthetic peptide
DEEEIRTTNPVSTEQYGSVSTNLQRGER

SEQ ID NO: 609 - protein, 28 aa, Artificial Sequence
  Description of Artificial Sequence: Synthetic peptide
DEEEIRTTNPVATEQYGSVSTELQYGNR

SEQ ID NO: 610 - protein, 28 aa, Artificial Sequence
  Description of Artificial Sequence: Synthetic peptide
DEEEIRCTNPVATEQYGSVSTALQRGNR

SEQ ID NO: 611 - protein, 28 aa, Artificial Sequence
  Description of Artificial Sequence: Synthetic peptide
DEEEIRTTNPNATEQYGSVSTDLQRGNR

SEQ ID NO: 612 - protein, 28 aa, Artificial Sequence
  Description of Artificial Sequence: Synthetic peptide
DEEEIRTTNPCATEQYGSVSTNLQAGNR

SEQ ID NO: 613 - protein, 30 aa, Artificial Sequence
  Description of Artificial Sequence: Synthetic polypeptide
DEEEIRTTNPVATEQYGSVHSTMNLQRGNR

SEQ ID NO: 614 - protein, 28 aa, Artificial Sequence
  Description of Artificial Sequence: Synthetic peptide
DEEEIRSTNPVATEQYGIVSTNLQRGNR

SEQ ID NO: 615 - protein, 28 aa, Artificial Sequence
  Description of Artificial Sequence: Synthetic peptide
DESEIRTTNPVATEQYGSVSTNLQRLNR

SEQ ID NO: 616 - protein, 30 aa, Artificial Sequence
  Description of Artificial Sequence: Synthetic polypeptide
DEEEIRTTNPVATEQYGSVSTTNLQRGENR

SEQ ID NO: 617 - protein, 29 aa, Artificial Sequence
  Description of Artificial Sequence: Synthetic peptide
DEEEIRTTNPVATEQYGSYVSTNLQQGNR

SEQ ID NO: 618 - protein, 28 aa, Artificial Sequence
  Description of Artificial Sequence: Synthetic peptide
DEEEIRTTNPVATEQYGSVSTNPQRGNN

SEQ ID NO: 619 - protein, 28 aa, Artificial Sequence
  Description of Artificial Sequence: Synthetic peptide
DEEEIRTTNPVATEQYGSVSTPLQRGTR

SEQ ID NO: 620 - protein, 28 aa, Artificial Sequence
  Description of Artificial Sequence: Synthetic peptide
DEEEIRTTNPVATEQYGSVSTNQQNGNR

SEQ ID NO: 621 - protein, 28 aa, Artificial Sequence
  Description of Artificial Sequence: Synthetic peptide
DEEEIFTTNPVATEQYGSVSTNLQLGNR

SEQ ID NO: 622 - protein, 29 aa, Artificial Sequence
  Description of Artificial Sequence: Synthetic peptide
DEEEIRTTNPVATEQYGSVSTNLQQRGND

SEQ ID NO: 623 - protein, 28 aa, Artificial Sequence
  Description of Artificial Sequence: Synthetic peptide
DEEEIRTTNPFATEQYGSVSTNLQRGER

SEQ ID NO: 624 - protein, 30 aa, Artificial Sequence
  Description of Artificial Sequence: Synthetic polypeptide
DEEEIRTTNPVATEQYGSVSDTPNLQRGNR

SEQ ID NO: 625 - protein, 29 aa, Artificial Sequence
  Description of Artificial Sequence: Synthetic peptide
DEEEIRTTNPVATEQYGSVSTPNLQRGER

SEQ ID NO: 626 - protein, 30 aa, Artificial Sequence
  Description of Artificial Sequence: Synthetic polypeptide
DEEEIRTTNPVATEQYGSVESTPNLQRGNR

SEQ ID NO: 627 - protein, 30 aa, Artificial Sequence
  Description of Artificial Sequence: Synthetic polypeptide
DEEEIRTTNPVATEQYGSVSTNPLQERGNR

SEQ ID NO: 628 - protein, 29 aa, Artificial Sequence
  Description of Artificial Sequence: Synthetic peptide
DEEEIRTTNPVATEQYGSVSNNLQCRGNR

SEQ ID NO: 629 - protein, 29 aa, Artificial Sequence
  Description of Artificial Sequence: Synthetic peptide
DEEEIRTTNPVATEQYGSVSTLNLQRGNP

SEQ ID NO: 630 - protein, 29 aa, Artificial Sequence
  Description of Artificial Sequence: Synthetic peptide
DEEEIRTTNPVATEPYGSVSATNLQRGNR

SEQ ID NO: 631 - protein, 28 aa, Artificial Sequence
  Description of Artificial Sequence: Synthetic peptide
DEGEIRTTNPVATEQYGSVSVNLQRGNR

SEQ ID NO: 632 - protein, 28 aa, Artificial Sequence
  Description of Artificial Sequence: Synthetic peptide
DEENIRTTNPVATEQYGSVSENLQRGNR

SEQ ID NO: 633 - protein, 28 aa, Artificial Sequence
  Description of Artificial Sequence: Synthetic peptide
CEEEIRTTNPVATEQYGIVSTNLQRGNR

SEQ ID NO: 634 - protein, 29 aa, Artificial Sequence
  Description of Artificial Sequence: Synthetic peptide
DEEEIRTTNPVATEQYGSVDSTNLERGNR

SEQ ID NO: 635 - protein, 28 aa, Artificial Sequence
  Description of Artificial Sequence: Synthetic peptide
DEEEIRTTNPVATEQYGSVSANLQVGNR

SEQ ID NO: 636 - protein, 29 aa, Artificial Sequence
  Description of Artificial Sequence: Synthetic peptide
DEEEIRTTNPVATEQYGSVSTNPLQRGNN

SEQ ID NO: 637 - protein, 28 aa, Artificial Sequence
  Description of Artificial Sequence: Synthetic peptide
DEEEIRTTNPTATEQYGSVSTNLQRGNF

SEQ ID NO: 638 - protein, 28 aa, Artificial Sequence
  Description of Artificial Sequence: Synthetic peptide
DEEEIRTTNPFATEQYGSVSTNLQRGNQ

SEQ ID NO: 639 - protein, 29 aa, Artificial Sequence
  Description of Artificial Sequence: Synthetic peptide
DEEEIRTTNPVATEQYGSVSTNPQERGNR

SEQ ID NO: 640 - protein, 28 aa, Artificial Sequence
  Description of Artificial Sequence: Synthetic peptide
DEDEIRTTNPVATEQYGSTSTNLQRGNR

SEQ ID NO: 641 - protein, 30 aa, Artificial Sequence
  Description of Artificial Sequence: Synthetic polypeptide
DEEEIRTTNPVATEQYGSVSCTNLQRNGNR

SEQ ID NO: 642 - protein, 28 aa, Artificial Sequence
  Description of Artificial Sequence: Synthetic peptide
DEEEIRTTNPSATEQYGSVSTNLARGNR

SEQ ID NO: 643 - protein, 29 aa, Artificial Sequence
  Description of Artificial Sequence: Synthetic peptide
DEEEIRTTNPVATEQYGSVSTNLQVVGNR

SEQ ID NO: 644 - protein, 28 aa, Artificial Sequence
  Description of Artificial Sequence: Synthetic peptide
DDEEIVTTNPVATEQYGSVSTNLQRGNR

SEQ ID NO: 645 - protein, 30 aa, Artificial Sequence
  Description of Artificial Sequence: Synthetic polypeptide
DEEEIRTTNPVATEQYGSVSVTTNLQRGNR

SEQ ID NO: 646 - protein, 30 aa, Artificial Sequence
  Description of Artificial Sequence: Synthetic polypeptide
DEEEIRTTNPVATEQYGSVSATNLQLRGNR

SEQ ID NO: 647 - protein, 28 aa, Artificial Sequence
  Description of Artificial Sequence: Synthetic peptide
DEEEIRTTNPVATEQYGSVSTNLQQGNI

SEQ ID NO: 648 - protein, 30 aa, Artificial Sequence
  Description of Artificial Sequence: Synthetic polypeptide
DEEEIRTTNPVATEQYGSVSTNLQWRGNPR

SEQ ID NO: 649 - protein, 28 aa, Artificial Sequence
  Description of Artificial Sequence: Synthetic peptide
DEEEIRTTNPVATEQYGSVSTNLQTGDR

SEQ ID NO: 650 - protein, 29 aa, Artificial Sequence
  Description of Artificial Sequence: Synthetic peptide
DEEEIRTTNPVATEIYGSVSATNLQRGNR

SEQ ID NO: 651 - protein, 28 aa, Artificial Sequence
  Description of Artificial Sequence: Synthetic peptide
DEEEIATTNPVATEQYGSVSTNLQVGNR

SEQ ID NO: 652 - protein, 28 aa, Artificial Sequence
  Description of Artificial Sequence: Synthetic peptide
DEEEIRTTNPVATELWGSVSTNLQRGNR

SEQ ID NO: 653 - protein, 28 aa, Artificial Sequence
  Description of Artificial Sequence: Synthetic peptide
DEEEIRTTNPVATEQYGSVSTNLQRQNY

SEQ ID NO: 654 - protein, 28 aa, Artificial Sequence
  Description of Artificial Sequence: Synthetic peptide
DEEEIRTTNPVAWEQYGSVSTNLQDGNR

SEQ ID NO: 655 - protein, 29 aa, Artificial Sequence
  Description of Artificial Sequence: Synthetic peptide
DEEEIRTTNPVATELYGSVSTLNLQRGNR

SEQ ID NO: 656 - protein, 28 aa, Artificial Sequence
  Description of Artificial Sequence: Synthetic peptide
DEEEIRATNPVATEQYGNVSTNLQRGNR

SEQ ID NO: 657 - protein, 28 aa, Artificial Sequence
  Description of Artificial Sequence: Synthetic peptide
DEEEIRQTNPVATEQYGSVSTNLQRGNE

SEQ ID NO: 658 - protein, 28 aa, Artificial Sequence
  Description of Artificial Sequence: Synthetic peptide
DPEEIRTTNPVATEQYGSVSTPLQRGNR

SEQ ID NO: 659 - protein, 28 aa, Artificial Sequence
  Description of Artificial Sequence: Synthetic peptide
DEEEIRATNPVATEQYGSVSTNLQRGNG

SEQ ID NO: 660 - protein, 30 aa, Artificial Sequence
  Description of Artificial Sequence: Synthetic polypeptide
DEEEIRTTNPVATEQYGYSVQSTNLQRGNR

SEQ ID NO: 661 - protein, 29 aa, Artificial Sequence
  Description of Artificial Sequence: Synthetic peptide
GEEEIRTTNPVATEQYGSVSTNLQRHGNR

SEQ ID NO: 662 - protein, 28 aa, Artificial Sequence
  Description of Artificial Sequence: Synthetic peptide
DEEEIRTTNPVATEQYGSVSTNLQNGNI

SEQ ID NO: 663 - protein, 29 aa, Artificial Sequence
  Description of Artificial Sequence: Synthetic peptide
DEEEIRTTNPVATEQYGSVTSTNLQRGNA

SEQ ID NO: 664 - protein, 28 aa, Artificial Sequence
  Description of Artificial Sequence: Synthetic peptide
DEEEIRTTNPFATEQYGSVSENLQRGNR

SEQ ID NO: 665 - protein, 28 aa, Artificial Sequence
  Description of Artificial Sequence: Synthetic peptide
DEEEIRGTNPVATEQYGSVSTNLQLGNR

SEQ ID NO: 666 - protein, 29 aa, Artificial Sequence
  Description of Artificial Sequence: Synthetic peptide
DEEEIRTTNPVATEQYGSVSITNSQRGNR

SEQ ID NO: 667 - protein, 29 aa, Artificial Sequence
  Description of Artificial Sequence: Synthetic peptide
DEEEIRTTNPVATEQYGSVSTNLQDWGNR

SEQ ID NO: 668 - protein, 29 aa, Artificial Sequence
  Description of Artificial Sequence: Synthetic peptide
DEEEIRTTNPVATEQYGSVSTNLEERGNR

SEQ ID NO: 669 - protein, 29 aa, Artificial Sequence
  Description of Artificial Sequence: Synthetic peptide
DEEEIRTTNPVATEQYGSVSTNLQERGER

SEQ ID NO: 670 - protein, 28 aa, Artificial Sequence
  Description of Artificial Sequence: Synthetic peptide
DEEEIRTTNPVATEQYGSVSTGVQRGNR

SEQ ID NO: 671 - protein, 28 aa, Artificial Sequence
  Description of Artificial Sequence: Synthetic peptide
DEEEINTTNPVATEQYGSVSNNLQRGNR

SEQ ID NO: 672 - protein, 28 aa, Artificial Sequence
  Description of Artificial Sequence: Synthetic peptide
DEEELRTTNPVATEQYGSVSTNQQRGNR

SEQ ID NO: 673 - protein, 28 aa, Artificial Sequence
  Description of Artificial Sequence: Synthetic peptide
DEEEIRTTNPVASEIYGSVSTNLQRGNR

SEQ ID NO: 674 - protein, 28 aa, Artificial Sequence
  Description of Artificial Sequence: Synthetic peptide
DEEEIATTNPVATEQYGIVSTNLQRGNR

SEQ ID NO: 675 - protein, 28 aa, Artificial Sequence
  Description of Artificial Sequence: Synthetic peptide
DEQEIRATNPVATEQYGSVSTNLQRGNR

SEQ ID NO: 676 - protein, 29 aa, Artificial Sequence
  Description of Artificial Sequence: Synthetic peptide
DEEEIRTTNPVATEQYGFVSTNLQSRGNR

SEQ ID NO: 677 - protein, 28 aa, Artificial Sequence
  Description of Artificial Sequence: Synthetic peptide
DEEEIRTTNPVATECYGVVSTNLQRGNR

SEQ ID NO: 678 - protein, 28 aa, Artificial Sequence
  Description of Artificial Sequence: Synthetic peptide
REEEIRTTNPVATECYGSVSTNLQRGNR

SEQ ID NO: 679 - protein, 30 aa, Artificial Sequence
  Description of Artificial Sequence: Synthetic polypeptide
DEEEIRTTNPVATEQYGSVYSTNLQRSGNR

SEQ ID NO: 680 - protein, 28 aa, Artificial Sequence
  Description of Artificial Sequence: Synthetic peptide
DEEEIRTTNPVATEQYGSVATNLDRGNR

SEQ ID NO: 681 - protein, 28 aa, Artificial Sequence
  Description of Artificial Sequence: Synthetic peptide
MEEEIRTVNPVATEQYGSVSTNLQRGNR

SEQ ID NO: 682 - protein, 28 aa, Artificial Sequence
  Description of Artificial Sequence: Synthetic peptide
DEEEIRTTNPVATEQYGSVSTELQQGNR

SEQ ID NO: 683 - protein, 28 aa, Artificial Sequence
  Description of Artificial Sequence: Synthetic peptide
DEEEIRTTNPVATEIYGSVSTNLQRGTR

SEQ ID NO: 684 - protein, 28 aa, Artificial Sequence
  Description of Artificial Sequence: Synthetic peptide
DEEEIRTTNPVATELYGSVSTNLQRGNF

SEQ ID NO: 685 - protein, 28 aa, Artificial Sequence
  Description of Artificial Sequence: Synthetic peptide
DEEEIRTTNPAATEQFGSVSTNLQRGNR

SEQ ID NO: 686 - protein, 28 aa, Artificial Sequence
  Description of Artificial Sequence: Synthetic peptide
DEEEIRTTNPVATEVYGSVSTNLQRGNT

SEQ ID NO: 687 - protein, 28 aa, Artificial Sequence
  Description of Artificial Sequence: Synthetic peptide
DEQEIRTTNPVATEQYGSVSTDLQRGNR

SEQ ID NO: 688 - protein, 28 aa, Artificial Sequence
  Description of Artificial Sequence: Synthetic peptide
DEEEIRCTNPVATEQYGSVSTNLQHGNR

SEQ ID NO: 689 - protein, 28 aa, Artificial Sequence
  Description of Artificial Sequence: Synthetic peptide
DEEEIRTTNPVATELYGSVSTNLERGNR

SEQ ID NO: 690 - protein, 29 aa, Artificial Sequence
  Description of Artificial Sequence: Synthetic peptide
DEEEIRTTNPVATEQYGSYSTNLQRGNDR

SEQ ID NO: 691 - protein, 28 aa, Artificial Sequence
  Description of Artificial Sequence: Synthetic peptide
DEEEIRTTNPVATEQYGSVSTNLMRGDR

SEQ ID NO: 692 - protein, 28 aa, Artificial Sequence
  Description of Artificial Sequence: Synthetic peptide
DEEEIRTTNPVATEQYGSVSTNLQMGND

SEQ ID NO: 693 - protein, 29 aa, Artificial Sequence
  Description of Artificial Sequence: Synthetic peptide
DEEEIRTTNPVATEQYGSVSEVNLQRGNR

SEQ ID NO: 694 - protein, 29 aa, Artificial Sequence
  Description of Artificial Sequence: Synthetic peptide
DEEEIRTTNPVATEQYGSVSTNLQRGENN

SEQ ID NO: 695 - protein, 28 aa, Artificial Sequence
  Description of Artificial Sequence: Synthetic peptide
DENEIRTTNPVATEQYGDVSTNLQRGNR

SEQ ID NO: 696 - protein, 30 aa, Artificial Sequence
  Description of Artificial Sequence: Synthetic polypeptide
DEEEIRTTNPVATEQYGSVSTNLQRGMNPR

SEQ ID NO: 697 - protein, 28 aa, Artificial Sequence
  Description of Artificial Sequence: Synthetic peptide
DEEEIRTTNPVATEQYGWVSTNLQRGGR

SEQ ID NO: 698 - protein, 28 aa, Artificial Sequence
  Description of Artificial Sequence: Synthetic peptide
DEEEIRTTNPVATEQYGSVSTNLNTGNR

SEQ ID NO: 699 - protein, 29 aa, Artificial Sequence
  Description of Artificial Sequence: Synthetic peptide
DEEEIRTTNPVATEQYGSVSTMNHQRGNR

SEQ ID NO: 700 - protein, 28 aa, Artificial Sequence
  Description of Artificial Sequence: Synthetic peptide
DEEEIRTTNPVATEQYGSVSTNLENGNR

SEQ ID NO: 701 - protein, 28 aa, Artificial Sequence
  Description of Artificial Sequence: Synthetic peptide
DEWEIRTTNPVATEQYGSVSTNLQPGNR

SEQ ID NO: 702 - protein, 28 aa, Artificial Sequence
  Description of Artificial Sequence: Synthetic peptide
DEEEIRTTNPVATEQYGSVSTNLQWGNT

SEQ ID NO: 703 - protein, 29 aa, Artificial Sequence
  Description of Artificial Sequence: Synthetic peptide
DEEEIRTTNPVATEQYGSVTSTNLQQGNR

SEQ ID NO: 704 - protein, 28 aa, Artificial Sequence
  Description of Artificial Sequence: Synthetic peptide
DEEEIRTTNPVATEQYGSVSTNLQRGTM

SEQ ID NO: 705 - protein, 29 aa, Artificial Sequence
  Description of Artificial Sequence: Synthetic peptide
DEMEIRTTNPVATEQYGSVSTNLDQRGNR

SEQ ID NO: 706 - protein, 29 aa, Artificial Sequence
  Description of Artificial Sequence: Synthetic peptide
DEECIRTTNPVATEQYGSVSTVNLQRGNR

SEQ ID NO: 707 - protein, 28 aa, Artificial Sequence
  Description of Artificial Sequence: Synthetic peptide
DEEEIRTTNPVATEQYGSVSTNLQRGDH

SEQ ID NO: 708 - protein, 28 aa, Artificial Sequence
  Description of Artificial Sequence: Synthetic peptide
DEEEIRTTNPVATEQWGSVSTNLMRGNR

SEQ ID NO: 709 - protein, 28 aa, Artificial Sequence
  Description of Artificial Sequence: Synthetic peptide
DEEEIRTTNPVATEQYGSVSTGLQRGND

SEQ ID NO: 710 - protein, 29 aa, Artificial Sequence
  Description of Artificial Sequence: Synthetic peptide
DEEEIRTTNPVATEQYGSVCSTDLQRGNR

SEQ ID NO: 711 - protein, 28 aa, Artificial Sequence
  Description of Artificial Sequence: Synthetic peptide
DEEEIRTTNPVATEQYGSVETNLQRGNI

SEQ ID NO: 712 - protein, 28 aa, Artificial Sequence
  Description of Artificial Sequence: Synthetic peptide
DEEEIRTTNPEATEQYGSVSTNLQRGNS

SEQ ID NO: 713 - protein, 29 aa, Artificial Sequence
  Description of Artificial Sequence: Synthetic peptide
DEEEIRTTNPEATEQYGSVSTNLQVRGNR

SEQ ID NO: 714 - protein, 28 aa, Artificial Sequence
  Description of Artificial Sequence: Synthetic peptide
DEEEIITTNPVATEQYGSVSTLLQRGNR

SEQ ID NO: 715 - protein, 29 aa, Artificial Sequence
  Description of Artificial Sequence: Synthetic peptide
DPEEIRTTNPVATEQYGSVSTNLVQRGNR

SEQ ID NO: 716 - protein, 28 aa, Artificial Sequence
  Description of Artificial Sequence: Synthetic peptide
DEEEIRTTNPVAWEQYGSVSTNLQQGNR

SEQ ID NO: 717 - protein, 28 aa, Artificial Sequence
  Description of Artificial Sequence: Synthetic peptide
AEEEIRTTNPVCTEQYGSVSTNLQRGNR

SEQ ID NO: 718 - protein, 28 aa, Artificial Sequence
  Description of Artificial Sequence: Synthetic peptide
DEEEIRTTNPVATEQYGSVSTNLQFGNA

SEQ ID NO: 719 - protein, 28 aa, Artificial Sequence
  Description of Artificial Sequence: Synthetic peptide
DEEEIRTTNPVATEQYGSVSTDLQRLNR

SEQ ID NO: 720 - protein, 28 aa, Artificial Sequence
  Description of Artificial Sequence: Synthetic peptide
DEEEIRTTNPVATEQYGSVSTNLFRGNM

SEQ ID NO: 721 - protein, 29 aa, Artificial Sequence
  Description of Artificial Sequence: Synthetic peptide
DEEEIRTTNPVATEQYGSVSTNLQREGNA

SEQ ID NO: 722 - protein, 28 aa, Artificial Sequence
  Description of Artificial Sequence: Synthetic peptide
DEEEIRTTNPVATEQYGSVSTNLQNGNW

SEQ ID NO: 723 - protein, 28 aa, Artificial Sequence
  Description of Artificial Sequence: Synthetic peptide
DEEEIRTTNPVATEQYGSVDTNLQRENR

SEQ ID NO: 724 - protein, 29 aa, Artificial Sequence
  Description of Artificial Sequence: Synthetic peptide
DEEEIRTTNPVATEQYGSVDSTNLQPGNR

SEQ ID NO: 725 - protein, 29 aa, Artificial Sequence
  Description of Artificial Sequence: Synthetic peptide
DEEEIRTTNPVATEQYGSSSTNLQRGNHR

SEQ ID NO: 726 - protein, 28 aa, Artificial Sequence
  Description of Artificial Sequence: Synthetic peptide
DEEEIMTTNPCATEQYGSVSTNLQRGNR

SEQ ID NO: 727 - protein, 28 aa, Artificial Sequence
  Description of Artificial Sequence: Synthetic peptide
DEEEIRTTNPVATEQYGSVSTCLQRGNA

SEQ ID NO: 728 - protein, 28 aa, Artificial Sequence
  Description of Artificial Sequence: Synthetic peptide
DEQEIRTTNPVATEQYGSVSTNLQRGTR

SEQ ID NO: 729 - protein, 28 aa, Artificial Sequence
  Description of Artificial Sequence: Synthetic peptide
DEEEIRTTNPVSTEQYGSVGTNLQRGNR

SEQ ID NO: 730 - protein, 28 aa, Artificial Sequence
  Description of Artificial Sequence: Synthetic peptide
DETEIRTTNPVATEQYGSVSTNLQRGNQ

SEQ ID NO: 731 - protein, 28 aa, Artificial Sequence
  Description of Artificial Sequence: Synthetic peptide
DEEEIRTTNPVAHEQYGSVSDNLQRGNR

SEQ ID NO: 732 - protein, 29 aa, Artificial Sequence
  Description of Artificial Sequence: Synthetic peptide
DEEEIRTTNPVATEQYGSVSFENLQRGNR

SEQ ID NO: 733 - protein, 28 aa, Artificial Sequence
  Description of Artificial Sequence: Synthetic peptide
DEEEIRTTNPVATEQYGSVSTELERGNR

SEQ ID NO: 734 - protein, 28 aa, Artificial Sequence
  Description of Artificial Sequence: Synthetic peptide
DEEELRTTNPVATEQFGSVSTNLQRGNR

SEQ ID NO: 735 - protein, 30 aa, Artificial Sequence
  Description of Artificial Sequence: Synthetic polypeptide
DEEEIRTTNPVATEQYGSVSDTNLQERGNR

SEQ ID NO: 736 - protein, 28 aa, Artificial Sequence
  Description of Artificial Sequence: Synthetic peptide
DEEEIRTTNPVATEHYGSVGTNLQRGNR

SEQ ID NO: 737 - protein, 30 aa, Artificial Sequence
  Description of Artificial Sequence: Synthetic polypeptide
DEEEIRTTNPVATEQYGSVSTINPLQRGNR

SEQ ID NO: 738 - protein, 28 aa, Artificial Sequence
  Description of Artificial Sequence: Synthetic peptide
DEEEIRTTNPVASEGYGSVSTNLQRGNR

SEQ ID NO: 739 - protein, 28 aa, Artificial Sequence
  Description of Artificial Sequence: Synthetic peptide
DEEEIRTTNPVATEQYGDVSTNPQRGNR

SEQ ID NO: 740 - protein, 29 aa, Artificial Sequence
  Description of Artificial Sequence: Synthetic peptide
DEEEIRTTNPVATETYGSVISTNLQRGNR

SEQ ID NO: 741 - protein, 29 aa, Artificial Sequence
  Description of Artificial Sequence: Synthetic peptide
DEEEIRTTNPVATEQYGSVSTNLQMRGNM

SEQ ID NO: 742 - protein, 28 aa, Artificial Sequence
  Description of Artificial Sequence: Synthetic peptide
DEEEIRTTNPVCTEQYGSVSTNLQSGNR

SEQ ID NO: 743 - protein, 29 aa, Artificial Sequence
  Description of Artificial Sequence: Synthetic peptide
DEEEIRTTNPVATEQYGCYVSTNLQRGNR

SEQ ID NO: 744 - protein, 30 aa, Artificial Sequence
  Description of Artificial Sequence: Synthetic polypeptide
DEEEIRTTNPVATEQYGSVSTENLQRGVNR

SEQ ID NO: 745 - protein, 28 aa, Artificial Sequence
  Description of Artificial Sequence: Synthetic peptide
FEEEIRTTNPVATEQYGSVSTNLQGGNR

SEQ ID NO: 746 - protein, 28 aa, Artificial Sequence
  Description of Artificial Sequence: Synthetic peptide
DEEEIRTTNPVATEQWGSVSTNLQVGNR

SEQ ID NO: 747 - protein, 28 aa, Artificial Sequence
  Description of Artificial Sequence: Synthetic peptide
DEEEIRTTNPVATEQYGEVNTNLQRGNR

SEQ ID NO: 748 - protein, 28 aa, Artificial Sequence
  Description of Artificial Sequence: Synthetic peptide
DENEIRTTNPVATEQYGSVSTNLQRGNL

SEQ ID NO: 749 - protein, 29 aa, Artificial Sequence
  Description of Artificial Sequence: Synthetic peptide
DEEEIRTTNPVATEQYGSVSTDLPQRGNR

SEQ ID NO: 750 - protein, 28 aa, Artificial Sequence
  Description of Artificial Sequence: Synthetic peptide
DEEEIRTTNPVATEQYGSVETNLQDGNR

SEQ ID NO: 751 - protein, 29 aa, Artificial Sequence
  Description of Artificial Sequence: Synthetic peptide
DEEEIRTTNPVATEQYGSVSENLQDRGNR

SEQ ID NO: 752 - protein, 28 aa, Artificial Sequence
  Description of Artificial Sequence: Synthetic peptide
DEEEIRTTNPVATEKYGSVSENLQRGNR

SEQ ID NO: 753 - protein, 29 aa, Artificial Sequence
  Description of Artificial Sequence: Synthetic peptide
DEEEIRTTNPVATEQYGSVDSTNLQRGNW

SEQ ID NO: 754 - protein, 28 aa, Artificial Sequence
  Description of Artificial Sequence: Synthetic peptide
DEEEIRTTNPVATEQYGSVSMNLQTGNR

SEQ ID NO: 755 - protein, 29 aa, Artificial Sequence
  Description of Artificial Sequence: Synthetic peptide
DEEEIRTTNPVATEQYGQSVSTNAQRGNR

SEQ ID NO: 756 - protein, 28 aa, Artificial Sequence
  Description of Artificial Sequence: Synthetic peptide
KEEEIRTTNPVATEQYGSVSTNLQRGDR

SEQ ID NO: 757 - protein, 29 aa, Artificial Sequence
  Description of Artificial Sequence: Synthetic peptide
DEEEIRTTNPVATEQYGSVADTNLQRGNR

SEQ ID NO: 758 - protein, 30 aa, Artificial Sequence
  Description of Artificial Sequence: Synthetic polypeptide
DEEEIRTTNPVATEQYGSVSTNLQREGENR

SEQ ID NO: 759 - protein, 29 aa, Artificial Sequence
  Description of Artificial Sequence: Synthetic peptide
QEEEIRTTNPVATEQYGSVSATNLQRGNR

SEQ ID NO: 760 - protein, 28 aa, Artificial Sequence
  Description of Artificial Sequence: Synthetic peptide
QEEEIRTTNPVATEQYGSVSTNLQRGNF

SEQ ID NO: 761 - protein, 28 aa, Artificial Sequence
  Description of Artificial Sequence: Synthetic peptide
DEEEIRTTNPVATELYGSVSTNLQQGNR

SEQ ID NO: 762 - protein, 28 aa, Artificial Sequence
  Description of Artificial Sequence: Synthetic peptide
DEEEIRTTNPVATEQYGSVSTILQRGER

SEQ ID NO: 763 - protein, 28 aa, Artificial Sequence
  Description of Artificial Sequence: Synthetic peptide
DEEEIRTTNPVATEQYGSVSENLQRGER

SEQ ID NO: 764 - protein, 30 aa, Artificial Sequence
  Description of Artificial Sequence: Synthetic polypeptide
DEEEIRTTNPVATEQYGSVSTNLQRGQNMR

SEQ ID NO: 765 - protein, 28 aa, Artificial Sequence
  Description of Artificial Sequence: Synthetic peptide
DENEIRTTNPVATEQYGSVSTILQRGNR

SEQ ID NO: 766 - protein, 29 aa, Artificial Sequence
  Description of Artificial Sequence: Synthetic peptide
DEEEIRQTNPVATEQYGSVSTNLQRNGNR

SEQ ID NO: 767 - protein, 30 aa, Artificial Sequence
  Description of Artificial Sequence: Synthetic polypeptide
DEEEIRTTNPVATEQYGSVSATNLQRGNDR

SEQ ID NO: 768 - protein, 28 aa, Artificial Sequence
  Description of Artificial Sequence: Synthetic peptide
DEEEIRTTNPVATEQYGSVSTNLWRGND

SEQ ID NO: 769 - protein, 28 aa, Artificial Sequence
  Description of Artificial Sequence: Synthetic peptide
DEEEIRATNPVATEQYGSVSTNLQRGGR

SEQ ID NO: 770 - protein, 28 aa, Artificial Sequence
  Description of Artificial Sequence: Synthetic peptide
DEEEIRTTNPVATEQYGTVSNNLQRGNR

SEQ ID NO: 771 - protein, 28 aa, Artificial Sequence
  Description of Artificial Sequence: Synthetic peptide
DEEEIRTTNPVATEQYGSVSTNLDRGDR

SEQ ID NO: 772 - protein, 30 aa, Artificial Sequence
  Description of Artificial Sequence: Synthetic polypeptide
DEEEIRTTNPVATEQYGSVSTNLQVRGNDR

SEQ ID NO: 773 - protein, 28 aa, Artificial Sequence
  Description of Artificial Sequence: Synthetic peptide
MEEEIRCTNPVATEQYGSVSTNLQRGNR

SEQ ID NO: 774 - protein, 28 aa, Artificial Sequence
  Description of Artificial Sequence: Synthetic peptide
DEEEIRSTNPVATEQYGSVSTNLQHGNR

SEQ ID NO: 775 - protein, 30 aa, Artificial Sequence
  Description of Artificial Sequence: Synthetic polypeptide
DEEEIRTTNPVATEQYGSVSETNLQRGNER

SEQ ID NO: 776 - protein, 28 aa, Artificial Sequence
  Description of Artificial Sequence: Synthetic peptide
DEEELRTTNPVATEQYGAVSTNLQRGNR

SEQ ID NO: 777 - protein, 29 aa, Artificial Sequence
  Description of Artificial Sequence: Synthetic peptide
DEEEIRTTNPVATEQYGSVSTELQRGENR

SEQ ID NO: 778 - protein, 29 aa, Artificial Sequence
  Description of Artificial Sequence: Synthetic peptide
DEEEIRTTNPVATEQYGSVSDTNLQNGNR

SEQ ID NO: 779 - protein, 28 aa, Artificial Sequence
  Description of Artificial Sequence: Synthetic peptide
DCEEIRTTNPVATEQYGSVSTNLQNGNR

SEQ ID NO: 780 - protein, 28 aa, Artificial Sequence
  Description of Artificial Sequence: Synthetic peptide
DEEEIRTTNPVATEQYGSVSTPLDRGNR

SEQ ID NO: 781 - protein, 29 aa, Artificial Sequence
  Description of Artificial Sequence: Synthetic peptide
DEEEIRTTNPVATEQYGSVSTNLQDRGFR

SEQ ID NO: 782 - protein, 28 aa, Artificial Sequence
  Description of Artificial Sequence: Synthetic peptide
DEEEIRTTNPIATEVYGSVSTNLQRGNR

SEQ ID NO: 783 - protein, 30 aa, Artificial Sequence
  Description of Artificial Sequence: Synthetic polypeptide
DEEEIRTTNPVATEQYGSVISTENLQRGNR

SEQ ID NO: 784 - protein, 29 aa, Artificial Sequence
  Description of Artificial Sequence: Synthetic peptide
DEEEIRTTNPVATEQYGSVCSTNLQHGNR

SEQ ID NO: 785 - protein, 28 aa, Artificial Sequence
  Description of Artificial Sequence: Synthetic peptide
DEEEIRTTNPVATEQYGSVHTNLQRFNR

SEQ ID NO: 786 - protein, 29 aa, Artificial Sequence
  Description of Artificial Sequence: Synthetic peptide
DEEEIRTTNPVATEQYGSVGTNLQRGVNR

SEQ ID NO: 787 - protein, 28 aa, Artificial Sequence
  Description of Artificial Sequence: Synthetic peptide
DEEEIRTTNPTATEQYGSVSTNLQRGND

SEQ ID NO: 788 - protein, 28 aa, Artificial Sequence
  Description of Artificial Sequence: Synthetic peptide
DEEEIRTTNPTATELYGSVSTNLQRGNR

SEQ ID NO: 789 - protein, 28 aa, Artificial Sequence
  Description of Artificial Sequence: Synthetic peptide
DEEEIRTTNPVATELYGCVSTNLQRGNR

SEQ ID NO: 790 - protein, 28 aa, Artificial Sequence
  Description of Artificial Sequence: Synthetic peptide
DEDEIRTTNPVSTEQYGSVSTNLQRGNR

SEQ ID NO: 791 - protein, 28 aa, Artificial Sequence
  Description of Artificial Sequence: Synthetic peptide
DEEEIRTTNPVATEQYGSVSTNLQNGNL

SEQ ID NO: 792 - protein, 28 aa, Artificial Sequence
  Description of Artificial Sequence: Synthetic peptide
SEEEIRTTNPVATEQYGSVSTELQRGNR

SEQ ID NO: 793 - protein, 28 aa, Artificial Sequence
  Description of Artificial Sequence: Synthetic peptide
DEEEIRTTNIVATEQYGSVSTNLQRGNY

SEQ ID NO: 794 - protein, 28 aa, Artificial Sequence
  Description of Artificial Sequence: Synthetic peptide
DEEEIRTTNPMATEQYGSYSTNLQRGNR

SEQ ID NO: 795 - protein, 28 aa, Artificial Sequence
  Description of Artificial Sequence: Synthetic peptide
DEEEIRTTNPFATEQYGSVSTNLQRGNV

SEQ ID NO: 796 - protein, 28 aa, Artificial Sequence
  Description of Artificial Sequence: Synthetic peptide
DEEEIRTTNPVATEAYGSVSENLQRGNR

SEQ ID NO: 797 - protein, 28 aa, Artificial Sequence
  Description of Artificial Sequence: Synthetic peptide
DEEEIRTTNPVATEQYGSVSTNLQEGND

SEQ ID NO: 798 - protein, 30 aa, Artificial Sequence
  Description of Artificial Sequence: Synthetic polypeptide
DEEEIRTTNPVATEQYGSVISTMNLQRGNR

SEQ ID NO: 799 - protein, 28 aa, Artificial Sequence
  Description of Artificial Sequence: Synthetic peptide
DEGEITTTNPVATEQYGSVSTNLQRGNR

SEQ ID NO: 800 - protein, 28 aa, Artificial Sequence
  Description of Artificial Sequence: Synthetic peptide
MEEEIRTTNPVATEQYGSVSTNLQRGNL

SEQ ID NO: 801 - protein, 28 aa, Artificial Sequence
  Description of Artificial Sequence: Synthetic peptide
DEEEIRTTNPTATEQYGSVSANLQRGNR

SEQ ID NO: 802 - protein, 28 aa, Artificial Sequence
  Description of Artificial Sequence: Synthetic peptide
DEEEIRTTNPVATEQYGSVSENLQRGDR

SEQ ID NO: 803 - protein, 29 aa, Artificial Sequence
  Description of Artificial Sequence: Synthetic peptide
DEEEIRTTNPVATEQYGSVSTGNLQQGNR

SEQ ID NO: 804 - protein, 28 aa, Artificial Sequence
  Description of Artificial Sequence: Synthetic peptide
DEEEIRTTNPVATEQYGSVSTNLQEGNM

SEQ ID NO: 805 - protein, 28 aa, Artificial Sequence
  Description of Artificial Sequence: Synthetic peptide
DEEEIRTTNPVATEQYGSVSTELQHGNR

SEQ ID NO: 806 - protein, 28 aa, Artificial Sequence
  Description of Artificial Sequence: Synthetic peptide
DEEEIRTTNPVATEQYGSVSDNLQAGNR

SEQ ID NO: 807 - protein, 28 aa, Artificial Sequence
  Description of Artificial Sequence: Synthetic peptide
DEEEIRTTNPVATELYGSVSTNLQAGNR

SEQ ID NO: 808 - protein, 28 aa, Artificial Sequence
  Description of Artificial Sequence: Synthetic peptide
AEEEIRTTNPVATEQYGSVSTVLQRGNR

SEQ ID NO: 809 - protein, 29 aa, Artificial Sequence
  Description of Artificial Sequence: Synthetic peptide
DEEEIRTTNPVATEQYGSVSTNLQQGVNR

SEQ ID NO: 810 - protein, 28 aa, Artificial Sequence
  Description of Artificial Sequence: Synthetic peptide
DEEEIRTTNPVATEQFGGVSTNLQRGNR

SEQ ID NO: 811 - protein, 28 aa, Artificial Sequence
  Description of Artificial Sequence: Synthetic peptide
QEEEIRTTNPIATEQYGSVSTNLQRGNR

SEQ ID NO: 812 - protein, 28 aa, Artificial Sequence
  Description of Artificial Sequence: Synthetic peptide
DEEEICTTNPVATEQYGSVSTNLQRGNS

SEQ ID NO: 813 - protein, 29 aa, Artificial Sequence
  Description of Artificial Sequence: Synthetic peptide
DEEEIRTTNPVATEQYGSVSTNLQHNGNR

SEQ ID NO: 814 - protein, 28 aa, Artificial Sequence
  Description of Artificial Sequence: Synthetic peptide
DEEEVRTTNPVATEQYGSVSTELQRGNR

SEQ ID NO: 815 - protein, 28 aa, Artificial Sequence
  Description of Artificial Sequence: Synthetic peptide
DEEEIRTTNPVATEQYGSVSTWLQHGNR

SEQ ID NO: 816 - protein, 29 aa, Artificial Sequence
  Description of Artificial Sequence: Synthetic peptide
DEEEIRTTNPVATEQYGSVSTNLQLLGNR

SEQ ID NO: 817 - protein, 28 aa, Artificial Sequence
  Description of Artificial Sequence: Synthetic peptide
DEEEIRATNPVATEQYGSVSTNLQRGND

SEQ ID NO: 818 - protein, 29 aa, Artificial Sequence
  Description of Artificial Sequence: Synthetic peptide
DEEEIRTTNPVATEQYGSVSCTNLQVGNR

SEQ ID NO: 819 - protein, 29 aa, Artificial Sequence
  Description of Artificial Sequence: Synthetic peptide
DEQEIRTTNPVATEQYGSVSTNLQDRGNR

SEQ ID NO: 820 - protein, 29 aa, Artificial Sequence
  Description of Artificial Sequence: Synthetic peptide
DEEEIRTTNPVATEQYGSVSTNLQPGQNR

SEQ ID NO: 821 - protein, 28 aa, Artificial Sequence
  Description of Artificial Sequence: Synthetic peptide
DEEEIRTTNPVATELYGSVSTNLQRGNE

SEQ ID NO: 822 - protein, 28 aa, Artificial Sequence
  Description of Artificial Sequence: Synthetic peptide
DEEEIRTTNPVATEQYGSVSTNLQMGNA

SEQ ID NO: 823 - protein, 28 aa, Artificial Sequence
  Description of Artificial Sequence: Synthetic peptide
NEEEIRTTNPDATEQYGSVSTNLQRGNR

SEQ ID NO: 824 - protein, 28 aa, Artificial Sequence
  Description of Artificial Sequence: Synthetic peptide
DEEEIRTTNPVSTEQYGSVSTNLQRGNS

SEQ ID NO: 825 - protein, 29 aa, Artificial Sequence
  Description of Artificial Sequence: Synthetic peptide
DEEEIRTTNPVATEQYGSVSQTNEQRGNR

SEQ ID NO: 826 - protein, 29 aa, Artificial Sequence
  Description of Artificial Sequence: Synthetic peptide
DEEEIRTTNPVATEQYGSVSTNLQRGNDV

SEQ ID NO: 827 - protein, 28 aa, Artificial Sequence
  Description of Artificial Sequence: Synthetic peptide
DEEEIRTTNPVATEQYGVVSTNLQRGNW

SEQ ID NO: 828 - protein, 29 aa, Artificial Sequence
  Description of Artificial Sequence: Synthetic peptide
DEEEIRTTNPVATEQYGSVSTNLQRGNTS

SEQ ID NO: 829 - protein, 28 aa, Artificial Sequence
  Description of Artificial Sequence: Synthetic peptide
DEEEIRTTNIVATEQYGSVSTNLQWGNR

SEQ ID NO: 830 - protein, 30 aa, Artificial Sequence
  Description of Artificial Sequence: Synthetic polypeptide
DEEEIRTTNPVATEQYGSVSTTNLQRGLNR

SEQ ID NO: 831 - protein, 30 aa, Artificial Sequence
  Description of Artificial Sequence: Synthetic polypeptide
DEEEIRTTNPVATEQYGSVSTTENLQRGNR

SEQ ID NO: 832 - protein, 30 aa, Artificial Sequence
  Description of Artificial Sequence: Synthetic polypeptide
DEEEIRTTNPVATEQYGSVSTNLQLRGENR

SEQ ID NO: 833 - protein, 28 aa, Artificial Sequence
  Description of Artificial Sequence: Synthetic peptide
DEHEIRTTNPVATEQYGSVSTNLQRGNT

SEQ ID NO: 834 - protein, 28 aa, Artificial Sequence
  Description of Artificial Sequence: Synthetic peptide
DELEIRTTNPVATEQYGSVSTNLQRGTR

SEQ ID NO: 835 - protein, 29 aa, Artificial Sequence
  Description of Artificial Sequence: Synthetic peptide
DEEEIRTTNPVATEQYGSVSTNEPQRGNR

SEQ ID NO: 836 - protein, 30 aa, Artificial Sequence
  Description of Artificial Sequence: Synthetic polypeptide
DEEEIRTTNPVATEQYGSVDSTNLQRGDNR

SEQ ID NO: 837 - protein, 29 aa, Artificial Sequence
  Description of Artificial Sequence: Synthetic peptide
DEEEIRTTNPVATEQYGSVSTNLQERGNV

SEQ ID NO: 838 - protein, 28 aa, Artificial Sequence
  Description of Artificial Sequence: Synthetic peptide
DEEEIRTTNPCATECYGSVSTNLQRGNR

SEQ ID NO: 839 - protein, 28 aa, Artificial Sequence
  Description of Artificial Sequence: Synthetic peptide
DEEEIRTTNPVATEQYGSVTTNLNRGNR

SEQ ID NO: 840 - protein, 29 aa, Artificial Sequence
  Description of Artificial Sequence: Synthetic peptide
DEEEIRTTNPVATEQYGSVSATNLQRGQR

SEQ ID NO: 841 - protein, 28 aa, Artificial Sequence
  Description of Artificial Sequence: Synthetic peptide
DEEEIRTTNPVATEQYGSVNTNLQQGNR

SEQ ID NO: 842 - protein, 28 aa, Artificial Sequence
  Description of Artificial Sequence: Synthetic peptide
DDEEIMTTNPVATEQYGSVSTNLQRGNR

SEQ ID NO: 843 - protein, 28 aa, Artificial Sequence
  Description of Artificial Sequence: Synthetic peptide
DEEEIRTTNPVATELYGSVSTNLQRGNM

SEQ ID NO: 844 - protein, 30 aa, Artificial Sequence
  Description of Artificial Sequence: Synthetic polypeptide
DEEEIRTTNPVATEQYGSVSTANLQRGNTR

SEQ ID NO: 845 - protein, 28 aa, Artificial Sequence
  Description of Artificial Sequence: Synthetic peptide
DEEEIRTTNPVATEQYGSVSTNLQQGNF

SEQ ID NO: 846 - protein, 30 aa, Artificial Sequence
  Description of Artificial Sequence: Synthetic polypeptide
DEEEIRTTNPVATEQYGSVDSTNPLQRGNR

SEQ ID NO: 847 - protein, 28 aa, Artificial Sequence
  Description of Artificial Sequence: Synthetic peptide
DEEEIRTTNPVATEQYGSASTNEQRGNR

SEQ ID NO: 848 - protein, 28 aa, Artificial Sequence
  Description of Artificial Sequence: Synthetic peptide
DEEEIRTTNPVATEQYGVVSTNLQRGNG

SEQ ID NO: 849 - protein, 28 aa, Artificial Sequence
  Description of Artificial Sequence: Synthetic peptide
DEEEIRTTNPVATEQYGCVSTNLQGGNR

SEQ ID NO: 850 - protein, 29 aa, Artificial Sequence
  Description of Artificial Sequence: Synthetic peptide
DEHEIRTTNPVATEQYGSVSTNLQRAGNR

SEQ ID NO: 851 - protein, 28 aa, Artificial Sequence
  Description of Artificial Sequence: Synthetic peptide
DEEEIRTTNPVATEQYGSVSTNMIRGNR

SEQ ID NO: 852 - protein, 29 aa, Artificial Sequence
  Description of Artificial Sequence: Synthetic peptide
DEEEIRTTNPVATEQYGSVSTGLQERGNR

SEQ ID NO: 853 - protein, 28 aa, Artificial Sequence
  Description of Artificial Sequence: Synthetic peptide
DEEEIRTTNPDATEQYGSVSTNLQTGNR

SEQ ID NO: 854 - protein, 29 aa, Artificial Sequence
  Description of Artificial Sequence: Synthetic peptide
DEEEIRTTNPVATEVYGSVSATNLQRGNR

SEQ ID NO: 855 - protein, 30 aa, Artificial Sequence
  Description of Artificial Sequence: Synthetic polypeptide
DEEEIRTTNPVATEQYGSVSTNLVQRGNPR

SEQ ID NO: 856 - protein, 29 aa, Artificial Sequence
  Description of Artificial Sequence: Synthetic peptide
DEEEIRTTNPVATEQYGSVSTNLQATGNR

SEQ ID NO: 857 - protein, 29 aa, Artificial Sequence
  Description of Artificial Sequence: Synthetic peptide
DEEEIRTTNPVATEQYGSYVSTNLQRGER

SEQ ID NO: 858 - protein, 28 aa, Artificial Sequence
  Description of Artificial Sequence: Synthetic peptide
DEEEISQTNPVATEQYGSVSTNLQRGNR

SEQ ID NO: 859 - protein, 30 aa, Artificial Sequence
  Description of Artificial Sequence: Synthetic polypeptide
DEEEIRTTNPVATEQYGSVSTVNLQRGNDR

SEQ ID NO: 860 - protein, 29 aa, Artificial Sequence
  Description of Artificial Sequence: Synthetic peptide
DEQEIRTTNPVATEQYGSVSATNLQRGNR

SEQ ID NO: 861 - protein, 30 aa, Artificial Sequence
  Description of Artificial Sequence: Synthetic polypeptide
DEEEIRTTNPVATEQYGSVSTPNLPQRGNR

SEQ ID NO: 862 - protein, 28 aa, Artificial Sequence
  Description of Artificial Sequence: Synthetic peptide
DEIEIRTTNPVATEQYGDVSTNLQRGNR

SEQ ID NO: 863 - protein, 28 aa, Artificial Sequence
  Description of Artificial Sequence: Synthetic peptide
DENEIATTNPVATEQYGSVSTNLQRGNR

SEQ ID NO: 864 - protein, 29 aa, Artificial Sequence
  Description of Artificial Sequence: Synthetic peptide
DEEEIRTTNPVATEQYGSVSTNLQLVGNR

SEQ ID NO: 865 - protein, 28 aa, Artificial Sequence
  Description of Artificial Sequence: Synthetic peptide
DEEEIRTTNPVATEQYGSVSTNLQNGNA

SEQ ID NO: 866 - protein, 28 aa, Artificial Sequence
  Description of Artificial Sequence: Synthetic peptide
SEEEIRTTNPVATEQYGSVSTNDQRGNR

SEQ ID NO: 867 - protein, 28 aa, Artificial Sequence
  Description of Artificial Sequence: Synthetic peptide
DEEEIRTTNPVATEQYGSVSFNLQRGNG

SEQ ID NO: 868 - protein, 29 aa, Artificial Sequence
  Description of Artificial Sequence: Synthetic peptide
DEEEIRCTNPVATEQYGSVSTNLTQRGNR

SEQ ID NO: 869 - protein, 28 aa, Artificial Sequence
  Description of Artificial Sequence: Synthetic peptide
DEEEIRTTNPVATEQYGSVSTNLQGENR

SEQ ID NO: 870 - protein, 29 aa, Artificial Sequence
  Description of Artificial Sequence: Synthetic peptide
DEEEIRCTNPVATEQYGSVSTNLQRGDNR

SEQ ID NO: 871 - protein, 28 aa, Artificial Sequence
  Description of Artificial Sequence: Synthetic peptide
DEEEIITTNPVATEQYGSCSTNLQRGNR

SEQ ID NO: 872 - protein, 28 aa, Artificial Sequence
  Description of Artificial Sequence: Synthetic peptide
DEQEIRTTNPVATEQYGSVSTNLQRGER

SEQ ID NO: 873 - protein, 28 aa, Artificial Sequence
  Description of Artificial Sequence: Synthetic peptide
DEEEIRTTNPVATEQYGSVSTDLQRENR

SEQ ID NO: 874 - protein, 29 aa, Artificial Sequence
  Description of Artificial Sequence: Synthetic peptide
DEEEIRTTNPVATEQYGSVSTNLQRKGNE

SEQ ID NO: 875 - protein, 28 aa, Artificial Sequence
  Description of Artificial Sequence: Synthetic peptide
DEEEIRTTNPVATEQYGSVSTNLQSGND

SEQ ID NO: 876 - protein, 28 aa, Artificial Sequence
  Description of Artificial Sequence: Synthetic peptide
DEEEIRTTNPVATEQYGSVSMNLERGNR

SEQ ID NO: 877 - protein, 28 aa, Artificial Sequence
  Description of Artificial Sequence: Synthetic peptide
DEEEIRTTNPVATEQYGSVSGNLQPGNR

SEQ ID NO: 878 - protein, 29 aa, Artificial Sequence
  Description of Artificial Sequence: Synthetic peptide
DEEEIRTTNPVATEQWGSVSTNLQMRGNR

SEQ ID NO: 879 - protein, 29 aa, Artificial Sequence
  Description of Artificial Sequence: Synthetic peptide
DEEEIRTTNPVATEQYGSVSTNLQRGNDM

SEQ ID NO: 880 - protein, 28 aa, Artificial Sequence
  Description of Artificial Sequence: Synthetic peptide
DEEEIRTTNPVATEQYGSVSTNLQIGIR

SEQ ID NO: 881 - protein, 30 aa, Artificial Sequence
  Description of Artificial Sequence: Synthetic polypeptide
DEEEIRTTNPVATEQYGSVSTMNLMQRGNR

SEQ ID NO: 882 - protein, 30 aa, Artificial Sequence
  Description of Artificial Sequence: Synthetic polypeptide
DEEEIRTTNPVATEQYGSVSTTNLQERGNR

SEQ ID NO: 883 - protein, 28 aa, Artificial Sequence
  Description of Artificial Sequence: Synthetic peptide
DETEIRTTNPVATEQYGTVSTNLQRGNR

SEQ ID NO: 884 - protein, 28 aa, Artificial Sequence
  Description of Artificial Sequence: Synthetic peptide
DEEEIRTTNPVATEQYGSVSTAEQRGNR

SEQ ID NO: 885 - protein, 30 aa, Artificial Sequence
  Description of Artificial Sequence: Synthetic polypeptide
DEEEIRTTNPVATEQYGSVSTNLQRGENER

SEQ ID NO: 886 - protein, 29 aa, Artificial Sequence
  Description of Artificial Sequence: Synthetic peptide
DEEEIRTTNPVATEQYGSVHSTNLDRGNR

SEQ ID NO: 887 - protein, 29 aa, Artificial Sequence
  Description of Artificial Sequence: Synthetic peptide
DEEEIRTTNPVATEQYGSVSTNLQRGNDE

SEQ ID NO: 888 - protein, 29 aa, Artificial Sequence
  Description of Artificial Sequence: Synthetic peptide
DEEELRTTNPVATEQYGSVSTNLQRAGNR

SEQ ID NO: 889 - protein, 28 aa, Artificial Sequence
  Description of Artificial Sequence: Synthetic peptide
DEEEIRTTNPVALEQYGSVSTNDQRGNR

SEQ ID NO: 890 - protein, 28 aa, Artificial Sequence
  Description of Artificial Sequence: Synthetic peptide
DEEEIRTTNPVATEQYGSVDTDLQRGNR

SEQ ID NO: 891 - protein, 28 aa, Artificial Sequence
  Description of Artificial Sequence: Synthetic peptide
DEEEIVTTNPVATEHYGSVSTNLQRGNR

SEQ ID NO: 892 - protein, 28 aa, Artificial Sequence
  Description of Artificial Sequence: Synthetic peptide
MEEEIRTTNPVATEQYGSVSTNLQRGDR

SEQ ID NO: 893 - protein, 28 aa, Artificial Sequence
  Description of Artificial Sequence: Synthetic peptide
EEEEIRTTNPVATDQYGSVSTNLQRGNR

SEQ ID NO: 894 - protein, 28 aa, Artificial Sequence
  Description of Artificial Sequence: Synthetic peptide
DEEEIRTTNPVATEQYGDVSSNLQRGNR

SEQ ID NO: 895 - protein, 29 aa, Artificial Sequence
  Description of Artificial Sequence: Synthetic peptide
DEEEIRTTNPVATEQYGSVSTNLQRGNDG

SEQ ID NO: 896 - protein, 28 aa, Artificial Sequence
  Description of Artificial Sequence: Synthetic peptide
DEEEIRGTNPVATEQYGSCSTNLQRGNR

SEQ ID NO: 897 - protein, 28 aa, Artificial Sequence
  Description of Artificial Sequence: Synthetic peptide
DEEEIRTTNSVATEQYGSVSTNLQRGNL

SEQ ID NO: 898 - protein, 28 aa, Artificial Sequence
  Description of Artificial Sequence: Synthetic peptide
DDEEIRTTNPVATEQYGSVSMNLQRGNR

SEQ ID NO: 899 - protein, 30 aa, Artificial Sequence
  Description of Artificial Sequence: Synthetic polypeptide
DEEEIRTTNPVATEQYGSVSVTNLTQRGNR

SEQ ID NO: 900 - protein, 28 aa, Artificial Sequence
  Description of Artificial Sequence: Synthetic peptide
DEEEIRTTNIVATEQYGSVSTNDQRGNR

SEQ ID NO: 901 - protein, 28 aa, Artificial Sequence
  Description of Artificial Sequence: Synthetic peptide
DEEEIRTTNPVATEQYGSVSTNLQGGNY

SEQ ID NO: 902 - protein, 28 aa, Artificial Sequence
  Description of Artificial Sequence: Synthetic peptide
DEEEIRTTNPVATEQYGDVVTNLQRGNR

SEQ ID NO: 903 - protein, 29 aa, Artificial Sequence
  Description of Artificial Sequence: Synthetic peptide
DEEEIRTTNPVATEQYGSVSTANLQRGNI

SEQ ID NO: 904 - protein, 28 aa, Artificial Sequence
  Description of Artificial Sequence: Synthetic peptide
MEEEIRTTNPVATEQYGSVSTNLQTGNR

SEQ ID NO: 905 - protein, 28 aa, Artificial Sequence
  Description of Artificial Sequence: Synthetic peptide
DEEEIRTTNPVATECYGDVSTNLQRGNR

SEQ ID NO: 906 - protein, 29 aa, Artificial Sequence
  Description of Artificial Sequence: Synthetic peptide
DEEEIRTTNPVATEQYGSVSTNPQRGNDR

SEQ ID NO: 907 - protein, 28 aa, Artificial Sequence
  Description of Artificial Sequence: Synthetic peptide
DDEEIRTTNPVATEQYGWVSTNLQRGNR

SEQ ID NO: 908 - protein, 28 aa, Artificial Sequence
  Description of Artificial Sequence: Synthetic peptide
DEEEIRTTNPTATEQYGSVSTNLQLGNR

SEQ ID NO: 909 - protein, 29 aa, Artificial Sequence
  Description of Artificial Sequence: Synthetic peptide
DEEEIRTTNPVATEQYGSVSTNLQIRGNM

SEQ ID NO: 910 - protein, 28 aa, Artificial Sequence
  Description of Artificial Sequence: Synthetic peptide
DEEEIRTTNPVATEQYGSVSTALQEGNR

SEQ ID NO: 911 - protein, 28 aa, Artificial Sequence
  Description of Artificial Sequence: Synthetic peptide
DEEEIRPTNPVATEQYGSVSTNLQRGNC

SEQ ID NO: 912 - protein, 28 aa, Artificial Sequence
  Description of Artificial Sequence: Synthetic peptide
DEEEIRTTNPVATEQYGSVSTGLQRGNA

SEQ ID NO: 913 - protein, 28 aa, Artificial Sequence
  Description of Artificial Sequence: Synthetic peptide
DEEEIRTTNPVATEQYGSVSTNLQNGNM

SEQ ID NO: 914 - protein, 28 aa, Artificial Sequence
  Description of Artificial Sequence: Synthetic peptide
DEEEIRTTNPVATEQYGSTSTALQRGNR

SEQ ID NO: 915 - protein, 28 aa, Artificial Sequence
  Description of Artificial Sequence: Synthetic peptide
DEEEIRTTNPVATEQYGSVSTNLQRGES

SEQ ID NO: 916 - protein, 29 aa, Artificial Sequence
  Description of Artificial Sequence: Synthetic peptide
DEEEIRTTNPVATEQYGSVSTNLQRGNDQ

SEQ ID NO: 917 - protein, 28 aa, Artificial Sequence
  Description of Artificial Sequence: Synthetic peptide
DEMEIRTTNPVATEQYGSVSTNPQRGNR

SEQ ID NO: 918 - protein, 28 aa, Artificial Sequence
  Description of Artificial Sequence: Synthetic peptide
DEEEIASTNPVATEQYGSVSTNLQRGNR

SEQ ID NO: 919 - protein, 28 aa, Artificial Sequence
  Description of Artificial Sequence: Synthetic peptide
DEEEIRTTNPVATEQYGCVGTNLQRGNR

SEQ ID NO: 920 - protein, 28 aa, Artificial Sequence
  Description of Artificial Sequence: Synthetic peptide
DEEEIRGTNPVATEQYGTVSTNLQRGNR

SEQ ID NO: 921 - protein, 29 aa, Artificial Sequence
  Description of Artificial Sequence: Synthetic peptide
DEEEIRTTNPVATEQYGSVSTNLQDRGNG

SEQ ID NO: 922 - protein, 29 aa, Artificial Sequence
  Description of Artificial Sequence: Synthetic peptide
DEEEIRQTNPVATEQYGSVSTNLQRGPNR

SEQ ID NO: 923 - protein, 29 aa, Artificial Sequence
  Description of Artificial Sequence: Synthetic peptide
DEEEIRTTNPVATEQYGSVSTNQQERGNR

SEQ ID NO: 924 - protein, 29 aa, Artificial Sequence
  Description of Artificial Sequence: Synthetic peptide
DEEEIRTTNPVATEQYGSVSLTNEQRGNR

SEQ ID NO: 925 - protein, 28 aa, Artificial Sequence
  Description of Artificial Sequence: Synthetic peptide
DEEEIRTTNPVATEQYGSVFTNLQAGNR

SEQ ID NO: 926 - protein, 29 aa, Artificial Sequence
  Description of Artificial Sequence: Synthetic peptide
DEEEIRTTNPVATEQYGSVSTGNLQRGNG

SEQ ID NO: 927 - protein, 28 aa, Artificial Sequence
  Description of Artificial Sequence: Synthetic peptide
DEEEITTTNPVATEQYGSVSTNLQRGND

SEQ ID NO: 928 - protein, 28 aa, Artificial Sequence
  Description of Artificial Sequence: Synthetic peptide
KEEEIRTTNPVATEQYGDVSTNLQRGNR

SEQ ID NO: 929 - protein, 29 aa, Artificial Sequence
  Description of Artificial Sequence: Synthetic peptide
DEEEIRTVNPVATEQYGSVSTNLQRGENR

SEQ ID NO: 930 - protein, 28 aa, Artificial Sequence
  Description of Artificial Sequence: Synthetic peptide
DEEEIRTTNPVATEQYGGVSENLQRGNR

SEQ ID NO: 931 - protein, 29 aa, Artificial Sequence
  Description of Artificial Sequence: Synthetic peptide
DEEEIRTTNPVASEQYGSVSATNLQRGNR

SEQ ID NO: 932 - protein, 28 aa, Artificial Sequence
  Description of Artificial Sequence: Synthetic peptide
DEEEIRTTNPVATESYGSVSTNDQRGNR

SEQ ID NO: 933 - protein, 28 aa, Artificial Sequence
  Description of Artificial Sequence: Synthetic peptide
DEEEIRTTNPVATEQYGSVSDNLQRGNW

SEQ ID NO: 934 - protein, 28 aa, Artificial Sequence
  Description of Artificial Sequence: Synthetic peptide
DEEEIRTTNPVATEMYGSVSTNLQRGER

SEQ ID NO: 935 - protein, 28 aa, Artificial Sequence
  Description of Artificial Sequence: Synthetic peptide
DEEEIRTTNPVATEQYGSVSDNLNRGNR

SEQ ID NO: 936 - protein, 29 aa, Artificial Sequence
  Description of Artificial Sequence: Synthetic peptide
DEEEIRTTNPVATEQYGSVSTNLQRGDNW

SEQ ID NO: 937 - protein, 28 aa, Artificial Sequence
  Description of Artificial Sequence: Synthetic peptide
GEEEIRTTNPVATEQYGSVSTNLQRGDR

SEQ ID NO: 938 - protein, 28 aa, Artificial Sequence
  Description of Artificial Sequence: Synthetic peptide
DEEEIRTTNPVATEQYGSVGTNIQRGNR

SEQ ID NO: 939 - protein, 28 aa, Artificial Sequence
  Description of Artificial Sequence: Synthetic peptide
DENEIRTTNPVATEVYGSVSTNLQRGNR

SEQ ID NO: 940 - protein, 28 aa, Artificial Sequence
  Description of Artificial Sequence: Synthetic peptide
DEEEIRTTNPVSTEQYGSVSMNLQRGNR

SEQ ID NO: 941 - protein, 30 aa, Artificial Sequence
  Description of Artificial Sequence: Synthetic polypeptide
DEEEIRTTNPVATEQYGSVSTNLQDRGDNR

SEQ ID NO: 942 - protein, 28 aa, Artificial Sequence
  Description of Artificial Sequence: Synthetic peptide
DEEEIRTTNPVATEQYGSVSTNLQPGNV

SEQ ID NO: 943 - protein, 28 aa, Artificial Sequence
  Description of Artificial Sequence: Synthetic peptide
DEEEIETTNPVSTEQYGSVSTNLQRGNR

SEQ ID NO: 944 - protein, 28 aa, Artificial Sequence
  Description of Artificial Sequence: Synthetic peptide
DEEEIRTTNPVATEQWGSVSTNLQRGNF

SEQ ID NO: 945 - protein, 28 aa, Artificial Sequence
  Description of Artificial Sequence: Synthetic peptide
DEEEIRTTNPVATEQYGSVSTAPQRGNR

SEQ ID NO: 946 - protein, 28 aa, Artificial Sequence
  Description of Artificial Sequence: Synthetic peptide
DEEEIRTTNPVCTEQYGSVSENLQRGNR

SEQ ID NO: 947 - protein, 29 aa, Artificial Sequence
  Description of Artificial Sequence: Synthetic peptide
DEEEIRTTNPVATEQYGSVSTNLQFGNDR

SEQ ID NO: 948 - protein, 28 aa, Artificial Sequence
  Description of Artificial Sequence: Synthetic peptide
DEEEIRTTNPVATEQYGSVSTFLQQGNR

SEQ ID NO: 949 - protein, 29 aa, Artificial Sequence
  Description of Artificial Sequence: Synthetic peptide
DEEEIRTTNPVATEQYGSVSTNLQRGDNI

SEQ ID NO: 950 - protein, 28 aa, Artificial Sequence
  Description of Artificial Sequence: Synthetic peptide
DEEEIRTTNPVATEQYGNVSENLQRGNR

SEQ ID NO: 951 - protein, 28 aa, Artificial Sequence
  Description of Artificial Sequence: Synthetic peptide
DEEEIRQTNPVATEQYGSVSDNLQRGNR

SEQ ID NO: 952 - protein, 29 aa, Artificial Sequence
  Description of Artificial Sequence: Synthetic peptide
DEEEIRTTNPVATEQYGSVSTNEQRGNDR

SEQ ID NO: 953 - protein, 28 aa, Artificial Sequence
  Description of Artificial Sequence: Synthetic peptide
DEEEIRTTNPVATEQYGSVDTNLQRGNH

SEQ ID NO: 954 - protein, 28 aa, Artificial Sequence
  Description of Artificial Sequence: Synthetic peptide
DEEEIRGTNPVATEQYGSVSENLQRGNR

SEQ ID NO: 955 - protein, 28 aa, Artificial Sequence
  Description of Artificial Sequence: Synthetic peptide
DEEEIRTTNPVATEQYGSVSTNLMAGNR

SEQ ID NO: 956 - protein, 28 aa, Artificial Sequence
  Description of Artificial Sequence: Synthetic peptide
DEEEIRTTNPVATEQYGSVSTDLQRGNM

SEQ ID NO: 957 - protein, 30 aa, Artificial Sequence
  Description of Artificial Sequence: Synthetic polypeptide
DEEEIRTTNPVATEQYGSVSTNNLQLRGNR

SEQ ID NO: 958 - protein, 28 aa, Artificial Sequence
  Description of Artificial Sequence: Synthetic peptide
DEEEIRTTNPEATEQYGSVSTNLQRGNN

SEQ ID NO: 959 - protein, 28 aa, Artificial Sequence
  Description of Artificial Sequence: Synthetic peptide
DEEEIATTNPVATEQYGSVSTNLQRGDR

SEQ ID NO: 960 - protein, 29 aa, Artificial Sequence
  Description of Artificial Sequence: Synthetic peptide
DEEEIRTTNPVATEQYGSWSTNLQRGNDR

SEQ ID NO: 961 - protein, 29 aa, Artificial Sequence
  Description of Artificial Sequence: Synthetic peptide
DEEEIRTTNPVATGQYGSVSTGNLQRGNR

SEQ ID NO: 962 - protein, 28 aa, Artificial Sequence
  Description of Artificial Sequence: Synthetic peptide
DEEEIATVNPVATEQYGSVSTNLQRGNR

SEQ ID NO: 963 - protein, 30 aa, Artificial Sequence
  Description of Artificial Sequence: Synthetic polypeptide
DEEEIRTTNPVATEQYGSVSCTENLQRGNR

SEQ ID NO: 964 - protein, 28 aa, Artificial Sequence
  Description of Artificial Sequence: Synthetic peptide
DEEEIRTTNPVATEIYGSVSTNLQRGNA

SEQ ID NO: 965 - protein, 28 aa, Artificial Sequence
  Description of Artificial Sequence: Synthetic peptide
DEEEIRTTNPVATEQYGSVETNLQRGNS

SEQ ID NO: 966 - protein, 28 aa, Artificial Sequence
  Description of Artificial Sequence: Synthetic peptide
DEEEIRTTNPCATEQYGSVSTNLQQGNR

SEQ ID NO: 967 - protein, 28 aa, Artificial Sequence
  Description of Artificial Sequence: Synthetic peptide
DEEEIRTTNPAATEQYGSVSTNLQRGNA

SEQ ID NO: 968 - protein, 28 aa, Artificial Sequence
  Description of Artificial Sequence: Synthetic peptide
DEEEIRTTNPVATDQYGSVSTNLQRGNL

SEQ ID NO: 969 - protein, 28 aa, Artificial Sequence
  Description of Artificial Sequence: Synthetic peptide
DEEEIRTTNPVATEQYGSVSANLMRGNR

SEQ ID NO: 970 - protein, 28 aa, Artificial Sequence
  Description of Artificial Sequence: Synthetic peptide
DEEEIRTTNPVATEQYGSVSTNLQSGNT

SEQ ID NO: 971 - protein, 28 aa, Artificial Sequence
  Description of Artificial Sequence: Synthetic peptide
DEEEIRTTNPIATEMYGSVSTNLQRGNR

SEQ ID NO: 972 - protein, 28 aa, Artificial Sequence
  Description of Artificial Sequence: Synthetic peptide
DEEEIRTTNPVATEMYGSVSTNLQRVNR

SEQ ID NO: 973 - protein, 28 aa, Artificial Sequence
  Description of Artificial Sequence: Synthetic peptide
DEEEIRTTNPVATEQYGSVSTNLQHGNV

SEQ ID NO: 974 - protein, 28 aa, Artificial Sequence
  Description of Artificial Sequence: Synthetic peptide
DEEEIRTTNPVATEQYGSVCTNLQRGDR

SEQ ID NO: 975 - protein, 28 aa, Artificial Sequence
  Description of Artificial Sequence: Synthetic peptide
DEDEIRTTNPVATEQYGSVSTNLQRLNR

SEQ ID NO: 976 - protein, 28 aa, Artificial Sequence
  Description of Artificial Sequence: Synthetic peptide
DEEEIRTTNPVATEIYGSVSTNLERGNR

SEQ ID NO: 977 - protein, 28 aa, Artificial Sequence
  Description of Artificial Sequence: Synthetic peptide
DEEEIRTTNPVADEQYGSVSTVLQRGNR

SEQ ID NO: 978 - protein, 29 aa, Artificial Sequence
  Description of Artificial Sequence: Synthetic peptide
AEEEIRTTNPVATEQYGSVSTTNLQRGNR

SEQ ID NO: 979 - protein, 29 aa, Artificial Sequence
  Description of Artificial Sequence: Synthetic peptide
DEEEIRTTNPVATEQYGSVSTMNLQRGNT

SEQ ID NO: 980 - protein, 29 aa, Artificial Sequence
  Description of Artificial Sequence: Synthetic peptide
DEEEIRTTNPTATEQYGSVSTNLQRGNDR

SEQ ID NO: 981 - protein, 29 aa, Artificial Sequence
  Description of Artificial Sequence: Synthetic peptide
DEEEIRTTNPDATEQYGSVSTNLQRGNER

SEQ ID NO: 982 - protein, 29 aa, Artificial Sequence
  Description of Artificial Sequence: Synthetic peptide
DEEEIRTTNPVATELYGSVSTNLQARGNR

SEQ ID NO: 983 - protein, 29 aa, Artificial Sequence
  Description of Artificial Sequence: Synthetic peptide
DEEEIRTTNPVATEQYGEVSATNLQRGNR

SEQ ID NO: 984 - protein, 28 aa, Artificial Sequence
  Description of Artificial Sequence: Synthetic peptide
DEEEIRTTNPVATEQYGSVATELQRGNR

SEQ ID NO: 985 - protein, 28 aa, Artificial Sequence
  Description of Artificial Sequence: Synthetic peptide
DEEEIRTTNPVATEQYGSVSDNLQRYNR

SEQ ID NO: 986 - protein, 29 aa, Artificial Sequence
  Description of Artificial Sequence: Synthetic peptide
DEEEIRTTNPCATEQYGSVSTNLQRGNDR

SEQ ID NO: 987 - protein, 28 aa, Artificial Sequence
  Description of Artificial Sequence: Synthetic peptide
DEEEIRTTNPVATEQYGSVSTNLQCGER

SEQ ID NO: 988 - protein, 28 aa, Artificial Sequence
  Description of Artificial Sequence: Synthetic peptide
DEEEIRTTNPVATEQYGSVSTNLQVGNV

SEQ ID NO: 989 - protein, 29 aa, Artificial Sequence
  Description of Artificial Sequence: Synthetic peptide
DEEEIRTTNPVATEQYGSHVSTNLQRGNP

SEQ ID NO: 990 - protein, 28 aa, Artificial Sequence
  Description of Artificial Sequence: Synthetic peptide
CEEEIRTTNPVATEQYGSVSTNVQRGNR

SEQ ID NO: 991 - protein, 28 aa, Artificial Sequence
  Description of Artificial Sequence: Synthetic peptide
DAEEIRTTNPVATEQYGSVSTNLQRLNR

SEQ ID NO: 992 - protein, 28 aa, Artificial Sequence
  Description of Artificial Sequence: Synthetic peptide
DEHEIRTTNPVASEQYGSVSTNLQRGNR

SEQ ID NO: 993 - protein, 29 aa, Artificial Sequence
  Description of Artificial Sequence: Synthetic peptide
DEEEIRTTNPVATEQYGSVSTNLQRNSNR

SEQ ID NO: 994 - protein, 28 aa, Artificial Sequence
  Description of Artificial Sequence: Synthetic peptide
DEEEITTTNPVATEQYGSVSTNLQRGNE

SEQ ID NO: 995 - protein, 28 aa, Artificial Sequence
  Description of Artificial Sequence: Synthetic peptide
DEEEIRTTNPVCTEQYGSVATNLQRGNR

SEQ ID NO: 996 - protein, 28 aa, Artificial Sequence
  Description of Artificial Sequence: Synthetic peptide
DEEEIRTTNPVATEQYGSVSTNDQRGER

SEQ ID NO: 997 - protein, 28 aa, Artificial Sequence
  Description of Artificial Sequence: Synthetic peptide
DEEEIRTTNPVATECYGSVSTNLNRGNR

SEQ ID NO: 998 - protein, 29 aa, Artificial Sequence
  Description of Artificial Sequence: Synthetic peptide
DEEEIRTTNPVATEQYGSVSTNLQERPNR

SEQ ID NO: 999 - protein, 29 aa, Artificial Sequence
  Description of Artificial Sequence: Synthetic peptide
DEEEIATTNPVATEQYGSVSTNLQIRGNR

SEQ ID NO: 1000 - protein, 28 aa, Artificial Sequence
  Description of Artificial Sequence: Synthetic peptide
DEEEIRQTNPVATEQYGSVSTNLQRGNN

SEQ ID NO: 1001 - protein, 28 aa, Artificial Sequence
  Description of Artificial Sequence: Synthetic peptide
DEEEIRTTNPEATEQYGSVSTDLQRGNR

SEQ ID NO: 1002 - protein, 28 aa, Artificial Sequence
  Description of Artificial Sequence: Synthetic peptide
SEEEIRTTNPVATEIYGSVSTNLQRGNR

SEQ ID NO: 1003 - protein, 30 aa, Artificial Sequence
  Description of Artificial Sequence: Synthetic polypeptide
DEEEIRTTNPVATEQYGSVSITNLQRDGNR

SEQ ID NO: 1004 - protein, 28 aa, Artificial Sequence
  Description of Artificial Sequence: Synthetic peptide
DEEEIRSTNPVATEQYGSVSTALQRGNR

SEQ ID NO: 1005 - protein, 28 aa, Artificial Sequence
  Description of Artificial Sequence: Synthetic peptide
DEEGIRTTNPVATEQYGSVSTVLQRGNR

SEQ ID NO: 1006 - protein, 28 aa, Artificial Sequence
  Description of Artificial Sequence: Synthetic peptide
DEEEIHTTNPVATEQYGSVSTNLQRGER

SEQ ID NO: 1007 - protein, 28 aa, Artificial Sequence
  Description of Artificial Sequence: Synthetic peptide
DEEEIVTTNPVATEQYGNVSTNLQRGNR

SEQ ID NO: 1008 - protein, 28 aa, Artificial Sequence
  Description of Artificial Sequence: Synthetic peptide
DEEEIRTTNPAATEQYGSVSTNLQNGNR

SEQ ID NO: 1009 - protein, 28 aa, Artificial Sequence
  Description of Artificial Sequence: Synthetic peptide
SEEEIRCTNPVATEQYGSVSTNLQRGNR

SEQ ID NO: 1010 - protein, 29 aa, Artificial Sequence
  Description of Artificial Sequence: Synthetic peptide
DEEEIRTTNPVATEQYGSVSTNLELRGNR

SEQ ID NO: 1011 - protein, 28 aa, Artificial Sequence
  Description of Artificial Sequence: Synthetic peptide
DESEIRTTNPVATEQYGSVSDNLQRGNR

SEQ ID NO: 1012 - protein, 28 aa, Artificial Sequence
  Description of Artificial Sequence: Synthetic peptide
DEEEIRHTNPVATEQYGSVSTNLQRGNI

SEQ ID NO: 1013 - protein, 28 aa, Artificial Sequence
  Description of Artificial Sequence: Synthetic peptide
DEFEIRTTNPVATEQYGSVSTNLQHGNR

SEQ ID NO: 1014 - protein, 29 aa, Artificial Sequence
  Description of Artificial Sequence: Synthetic peptide
DEEEIRTTNPVATEQYGSVSTNLQDHGNR

SEQ ID NO: 1015 - protein, 29 aa, Artificial Sequence
  Description of Artificial Sequence: Synthetic peptide
DEVEIRTTNPVATEQYGSVSTNLQRGNSR

SEQ ID NO: 1016 - protein, 29 aa, Artificial Sequence
  Description of Artificial Sequence: Synthetic peptide
DEEEIRTTNPVATEQYGSVSENLQRGVNR

SEQ ID NO: 1017 - protein, 30 aa, Artificial Sequence
  Description of Artificial Sequence: Synthetic polypeptide
DEEEIRTTNPVATEQYGSVSTNLVQVRGNR

SEQ ID NO: 1018 - protein, 28 aa, Artificial Sequence
  Description of Artificial Sequence: Synthetic peptide
DEEEIRTTNPVATEQYGSVSTLLQQGNR

SEQ ID NO: 1019 - protein, 28 aa, Artificial Sequence
  Description of Artificial Sequence: Synthetic peptide
DEEEISTTNPVATEQYGSNSTNLQRGNR

SEQ ID NO: 1020 - protein, 28 aa, Artificial Sequence
  Description of Artificial Sequence: Synthetic peptide
DEEEIRTTNPVATEQYGSVNTNLQRGNP

SEQ ID NO: 1021 - protein, 28 aa, Artificial Sequence
  Description of Artificial Sequence: Synthetic peptide
DENEIRTTNPVATEQYGSVSTNLDRGNR

SEQ ID NO: 1022 - protein, 28 aa, Artificial Sequence
  Description of Artificial Sequence: Synthetic peptide
DENEIRTTNPVATEQYGSVSTNLQRGNE

SEQ ID NO: 1023 - protein, 28 aa, Artificial Sequence
  Description of Artificial Sequence: Synthetic peptide
DEEEIRTTNPVATEQYGSVSTPLQIGNR

SEQ ID NO: 1024 - protein, 28 aa, Artificial Sequence
  Description of Artificial Sequence: Synthetic peptide
DEEEIATTNPVATEQYGSSSTNLQRGNR

SEQ ID NO: 1025 - protein, 28 aa, Artificial Sequence
  Description of Artificial Sequence: Synthetic peptide
DEEEIRTTNPVATEQYGDMSTNLQRGNR

SEQ ID NO: 1026 - protein, 28 aa, Artificial Sequence
  Description of Artificial Sequence: Synthetic peptide
DEEEITTTNPVATEQYGSVSTALQRGNR

SEQ ID NO: 1027 - protein, 28 aa, Artificial Sequence
  Description of Artificial Sequence: Synthetic peptide
NEEEIRTTNPVAYEQYGSVSTNLQRGNR

SEQ ID NO: 1028 - protein, 28 aa, Artificial Sequence
  Description of Artificial Sequence: Synthetic peptide
DECEIRTTNPVATEQYGSVSTALQRGNR

SEQ ID NO: 1029 - protein, 28 aa, Artificial Sequence
  Description of Artificial Sequence: Synthetic peptide
DEEEIRTTNPVATEQYGSVSTELQWGNR

SEQ ID NO: 1030 - protein, 29 aa, Artificial Sequence
  Description of Artificial Sequence: Synthetic peptide
DENEIRTTNPVATEQYGSVSTNLQRGNDR

SEQ ID NO: 1031 - protein, 28 aa, Artificial Sequence
  Description of Artificial Sequence: Synthetic peptide
DEEEIRTTNPYATEQYGSVSTNEQRGNR

SEQ ID NO: 1032 - protein, 29 aa, Artificial Sequence
  Description of Artificial Sequence: Synthetic peptide
DEEEIRTTNPVATEQYGSYSTNLQERGNR

SEQ ID NO: 1033 - protein, 28 aa, Artificial Sequence
  Description of Artificial Sequence: Synthetic peptide
DEEEITTTNPVATEQYGSVSTLLQRGNR

SEQ ID NO: 1034 - protein, 28 aa, Artificial Sequence
  Description of Artificial Sequence: Synthetic peptide
DEEEIRTTNIVATEQYGSVSTNEQRGNR

SEQ ID NO: 1035 - protein, 28 aa, Artificial Sequence
  Description of Artificial Sequence: Synthetic peptide
DEEEIRTTNPVATEQYGSVSTNLQVGNN

SEQ ID NO: 1036 - protein, 28 aa, Artificial Sequence
  Description of Artificial Sequence: Synthetic peptide
DEEEIRTTNPVATEQYGSVATNLQRGPR

SEQ ID NO: 1037 - protein, 28 aa, Artificial Sequence
  Description of Artificial Sequence: Synthetic peptide
DEEEIRTTNPVATEQYGSVSTNLQVGNL

SEQ ID NO: 1038 - protein, 28 aa, Artificial Sequence
  Description of Artificial Sequence: Synthetic peptide
DEQEIRTTNPVATEQYGSVSTNLQIGNR

SEQ ID NO: 1039 - protein, 28 aa, Artificial Sequence
  Description of Artificial Sequence: Synthetic peptide
DEEEIRTTNPVATEQYGSVSTNLQGGNA

SEQ ID NO: 1040 - protein, 29 aa, Artificial Sequence
  Description of Artificial Sequence: Synthetic peptide
DEEEIRTTNPVATEQYGSVSTMNLQQGNR

SEQ ID NO: 1041 - protein, 28 aa, Artificial Sequence
  Description of Artificial Sequence: Synthetic peptide
DEEEIRTTNPVATHQYGSVSTNLQMGNR

SEQ ID NO: 1042 - protein, 28 aa, Artificial Sequence
  Description of Artificial Sequence: Synthetic peptide
DEEEIRTTNPVATLQYGSVSTNLIRGNR

SEQ ID NO: 1043 - protein, 28 aa, Artificial Sequence
  Description of Artificial Sequence: Synthetic peptide
DEEEIRATNPVSTEQYGSVSTNLQRGNR

SEQ ID NO: 1044 - protein, 28 aa, Artificial Sequence
  Description of Artificial Sequence: Synthetic peptide
DEEEIRTTNPVATEQYGSVSTNLMHGNR

SEQ ID NO: 1045 - protein, 29 aa, Artificial Sequence
  Description of Artificial Sequence: Synthetic peptide
DEEEIATTNPVATEQYGSVCSTNLQRGNR

SEQ ID NO: 1046 - protein, 30 aa, Artificial Sequence
  Description of Artificial Sequence: Synthetic polypeptide
DEEEIRTTNPVATEQYGSVSITMNLQRGNR

SEQ ID NO: 1047 - protein, 28 aa, Artificial Sequence
  Description of Artificial Sequence: Synthetic peptide
DEEEIRTTNPVATEQYGVVSTNLQRGER

SEQ ID NO: 1048 - protein, 28 aa, Artificial Sequence
  Description of Artificial Sequence: Synthetic peptide
DEEEIRTTNPVATEQYGIASTNLQRGNR

SEQ ID NO: 1049 - protein, 28 aa, Artificial Sequence
  Description of Artificial Sequence: Synthetic peptide
DEEEIRTTNPVATECYGSVSTNLQRGND

SEQ ID NO: 1050 - protein, 28 aa, Artificial Sequence
  Description of Artificial Sequence: Synthetic peptide
DEEEIRCTNPVATEQYGSVSTNLQIGNR

SEQ ID NO: 1051 - protein, 28 aa, Artificial Sequence
  Description of Artificial Sequence: Synthetic peptide
DEEEIRTTNPVATEQYGSASTVLQRGNR

SEQ ID NO: 1052 - protein, 30 aa, Artificial Sequence
  Description of Artificial Sequence: Synthetic polypeptide
DEEEIRTTNPVATEQYGSVSTGNLQRGINR

SEQ ID NO: 1053 - protein, 28 aa, Artificial Sequence
  Description of Artificial Sequence: Synthetic peptide
DEEEIRTTNPVATEQYGAVSTNLQGGNR

SEQ ID NO: 1054 - protein, 28 aa, Artificial Sequence
  Description of Artificial Sequence: Synthetic peptide
DEEEISTTNPVATEQYGSVSTNDQRGNR

SEQ ID NO: 1055 - protein, 28 aa, Artificial Sequence
  Description of Artificial Sequence: Synthetic peptide
DEEEIRTTNPVATEQYGSVSENLQRGNE

SEQ ID NO: 1056 - protein, 30 aa, Artificial Sequence
  Description of Artificial Sequence: Synthetic polypeptide
DEEEIRTTNPVATEQYGSVSTNLQRDGENR

SEQ ID NO: 1057 - protein, 28 aa, Artificial Sequence
  Description of Artificial Sequence: Synthetic peptide
DEEEIRTTNPDATEQYGSVSTNLERGNR

SEQ ID NO: 1058 - protein, 29 aa, Artificial Sequence
  Description of Artificial Sequence: Synthetic peptide
DEEEIRTTNPVATEQYGSVSTNLQQEGNR

SEQ ID NO: 1059 - protein, 28 aa, Artificial Sequence
  Description of Artificial Sequence: Synthetic peptide
DEQEIRTTNPVATEQYGVVSTNLQRGNR

SEQ ID NO: 1060 - protein, 28 aa, Artificial Sequence
  Description of Artificial Sequence: Synthetic peptide
DEEEIRTTNPVATCQYGSVSTNLQRGNP

SEQ ID NO: 1061 - protein, 28 aa, Artificial Sequence
  Description of Artificial Sequence: Synthetic peptide
NENEIRTTNPVATEQYGSVSTNLQRGNR

SEQ ID NO: 1062 - protein, 28 aa, Artificial Sequence
  Description of Artificial Sequence: Synthetic peptide
DEEEIRTVNPVATEQYGSVSTNLQRGPR

SEQ ID NO: 1063 - protein, 28 aa, Artificial Sequence
  Description of Artificial Sequence: Synthetic peptide
DEEELRTTNPVATEQYGSVSTNIQRGNR

SEQ ID NO: 1064 - protein, 28 aa, Artificial Sequence
  Description of Artificial Sequence: Synthetic peptide
DAEEIRTTNPVATDQYGSVSTNLQRGNR

SEQ ID NO: 1065 - protein, 29 aa, Artificial Sequence
  Description of Artificial Sequence: Synthetic peptide
DEEEIRTTNPVATEQYGVSHSTNLQRGNR

SEQ ID NO: 1066 - protein, 28 aa, Artificial Sequence
  Description of Artificial Sequence: Synthetic peptide
DETEIRTTNPVATEQWGSVSTNLQRGNR

SEQ ID NO: 1067 - protein, 29 aa, Artificial Sequence
  Description of Artificial Sequence: Synthetic peptide
DEEEIRTTNPEATEQYGSVSTNPLQRGNR

SEQ ID NO: 1068 - protein, 29 aa, Artificial Sequence
  Description of Artificial Sequence: Synthetic peptide
DEEEIRTTNPVATETYGSVSTNLQRNGNR

SEQ ID NO: 1069 - protein, 28 aa, Artificial Sequence
  Description of Artificial Sequence: Synthetic peptide
DEEEIVTTNPVATEQYGSVSTNLQRENR

SEQ ID NO: 1070 - protein, 28 aa, Artificial Sequence
  Description of Artificial Sequence: Synthetic peptide
DEEEIRTTNPVATEQYGSVGTNLQRGER

SEQ ID NO: 1071 - protein, 28 aa, Artificial Sequence
  Description of Artificial Sequence: Synthetic peptide
DEEEIRTTNPVATEMYGSVSTNLQNGNR

SEQ ID NO: 1072 - protein, 28 aa, Artificial Sequence
  Description of Artificial Sequence: Synthetic peptide
DEEEIRTTNPVATEQYGSVSTNDQRGNQ

SEQ ID NO: 1073 - protein, 29 aa, Artificial Sequence
  Description of Artificial Sequence: Synthetic peptide
DEEEIRTTNPVATEQYGSVSTMNLQRGNE

SEQ ID NO: 1074 - protein, 28 aa, Artificial Sequence
  Description of Artificial Sequence: Synthetic peptide
DEEEIRTTNPVATEQYGSVSTNLQEGER

SEQ ID NO: 1075 - protein, 29 aa, Artificial Sequence
  Description of Artificial Sequence: Synthetic peptide
DEEEIRTTNPDATEQYGSVSTNLQLRGNR

SEQ ID NO: 1076 - protein, 28 aa, Artificial Sequence
  Description of Artificial Sequence: Synthetic peptide
HEEEIRTTNPVATEQYGSVSTNLQRGDR

SEQ ID NO: 1077 - protein, 28 aa, Artificial Sequence
  Description of Artificial Sequence: Synthetic peptide
IEEEIRTTNPVATEPYGSVSTNLQRGNR

SEQ ID NO: 1078 - protein, 28 aa, Artificial Sequence
  Description of Artificial Sequence: Synthetic peptide
DEEEIRTTNPVATEQYGSVSTNLDSGNR

SEQ ID NO: 1079 - protein, 28 aa, Artificial Sequence
  Description of Artificial Sequence: Synthetic peptide
DEEEIRTTNPVATEQYGSWSTNLQRGNW

SEQ ID NO: 1080 - protein, 28 aa, Artificial Sequence
  Description of Artificial Sequence: Synthetic peptide
DEEMIRTTNVVATEQYGSVSTNLQRGNR

SEQ ID NO: 1081 - protein, 28 aa, Artificial Sequence
  Description of Artificial Sequence: Synthetic peptide
NEEEIATTNPVATEQYGSVSTNLQRGNR

SEQ ID NO: 1082 - protein, 28 aa, Artificial Sequence
  Description of Artificial Sequence: Synthetic peptide
DEEEIRTTNPVATEQYGSVSTMLQRFNR

SEQ ID NO: 1083 - protein, 29 aa, Artificial Sequence
  Description of Artificial Sequence: Synthetic peptide
DEEEIRTTNPVAWEQYGSVSTMNLQRGNR

SEQ ID NO: 1084 - protein, 29 aa, Artificial Sequence
  Description of Artificial Sequence: Synthetic peptide
DEEEIRTTNPVATEQYGDVSTTNLQRGNR

SEQ ID NO: 1085 - protein, 29 aa, Artificial Sequence
  Description of Artificial Sequence: Synthetic peptide
DEEEIRTTNPVATEQYGSVSTNLQRKGNF

SEQ ID NO: 1086 - protein, 28 aa, Artificial Sequence
  Description of Artificial Sequence: Synthetic peptide
DEEEIRTTNPVATEQYGSVSTNEQRGNE

SEQ ID NO: 1087 - protein, 29 aa, Artificial Sequence
  Description of Artificial Sequence: Synthetic peptide
DEEEIRTTNPVATEQYGSVLSTNLQRGNP

SEQ ID NO: 1088 - protein, 28 aa, Artificial Sequence
  Description of Artificial Sequence: Synthetic peptide
QEEEIRTTNPVATEQYGSVSTNLQIGNR

SEQ ID NO: 1089 - protein, 28 aa, Artificial Sequence
  Description of Artificial Sequence: Synthetic peptide
AEEEIRTTNPVATEQYGSVSTNLQRGNP

SEQ ID NO: 1090 - protein, 29 aa, Artificial Sequence
  Description of Artificial Sequence: Synthetic peptide
DEEEIRTTNPVATEQYGSVSTNLQNGENR

SEQ ID NO: 1091 - protein, 28 aa, Artificial Sequence
  Description of Artificial Sequence: Synthetic peptide
DEEEIRTTNPVATEQYGSVSVDLQRGNR

SEQ ID NO: 1092 - protein, 28 aa, Artificial Sequence
  Description of Artificial Sequence: Synthetic peptide
DEEEIRTTNPVATEQYGSVSTALQRGNS

SEQ ID NO: 1093 - protein, 29 aa, Artificial Sequence
  Description of Artificial Sequence: Synthetic peptide
DEEEIRTTNPVATEQYGSVSTNLQQGLNR

SEQ ID NO: 1094 - protein, 29 aa, Artificial Sequence
  Description of Artificial Sequence: Synthetic peptide
DEEEIRTTNPVATEQYGHVSTDNLQRGNR

SEQ ID NO: 1095 - protein, 28 aa, Artificial Sequence
  Description of Artificial Sequence: Synthetic peptide
DENEIRTTNPVATEHYGSVSTNLQRGNR

SEQ ID NO: 1096 - protein, 29 aa, Artificial Sequence
  Description of Artificial Sequence: Synthetic peptide
DEEEIRTTNPVATEQYGSVETNLQRLGNR

SEQ ID NO: 1097 - protein, 28 aa, Artificial Sequence
  Description of Artificial Sequence: Synthetic peptide
DEEEIRTTNPVATEQYGSVSTNLQHGNA

SEQ ID NO: 1098 - protein, 28 aa, Artificial Sequence
  Description of Artificial Sequence: Synthetic peptide
DEEEIRTTNPVATETYGSVSTNLQRGPR

SEQ ID NO: 1099 - protein, 30 aa, Artificial Sequence
  Description of Artificial Sequence: Synthetic polypeptide
DEEEIRTTNPVATEQYGSVSQTNLQRMGNR

SEQ ID NO: 1100 - protein, 28 aa, Artificial Sequence
  Description of Artificial Sequence: Synthetic peptide
DEEEIRTTNPVATEQYGSVSTNLQIGNI

SEQ ID NO: 1101 - protein, 28 aa, Artificial Sequence
  Description of Artificial Sequence: Synthetic peptide
DEEEIRQTNPVATEQGGSVSTNLQRGNR

SEQ ID NO: 1102 - protein, 28 aa, Artificial Sequence
  Description of Artificial Sequence: Synthetic peptide
DEEEIRATNPTATEQYGSVSTNLQRGNR

SEQ ID NO: 1103 - protein, 28 aa, Artificial Sequence
  Description of Artificial Sequence: Synthetic peptide
DEEEIRTTNPVATEQYGSVSTNEQRGNS

SEQ ID NO: 1104 - protein, 28 aa, Artificial Sequence
  Description of Artificial Sequence: Synthetic peptide
DECEIRTTNPCATEQYGSVSTNLQRGNR

SEQ ID NO: 1105 - protein, 28 aa, Artificial Sequence
  Description of Artificial Sequence: Synthetic peptide
DEEEIRTTNPVATEQYGDVSTALQRGNR

SEQ ID NO: 1106 - protein, 29 aa, Artificial Sequence
  Description of Artificial Sequence: Synthetic peptide
DEEEIRTTNPVATEQYGSVSTNLQDRGNL

SEQ ID NO: 1107 - protein, 28 aa, Artificial Sequence
  Description of Artificial Sequence: Synthetic peptide
DDEEIRTTNPVATEQYGVVSTNLQRGNR

SEQ ID NO: 1108 - protein, 28 aa, Artificial Sequence
  Description of Artificial Sequence: Synthetic peptide
DDEEIRTTNPVATEQYGSVSNNLQRGNR

SEQ ID NO: 1109 - protein, 28 aa, Artificial Sequence
  Description of Artificial Sequence: Synthetic peptide
DEEEIVTTNPVATEQYGSVSTNLQSGNR

SEQ ID NO: 1110 - protein, 28 aa, Artificial Sequence
  Description of Artificial Sequence: Synthetic peptide
DEESIRTTNPVATEQYGSVSTNLQVGNR

SEQ ID NO: 1111 - protein, 29 aa, Artificial Sequence
  Description of Artificial Sequence: Synthetic peptide
DEEEIRTTNPVATEQYGSVSFTNLQQGNR

SEQ ID NO: 1112 - protein, 28 aa, Artificial Sequence
  Description of Artificial Sequence: Synthetic peptide
DEEEIRTTNPVATEQYGSVSTNLQHGNP

SEQ ID NO: 1113 - protein, 29 aa, Artificial Sequence
  Description of Artificial Sequence: Synthetic peptide
DEEEIRTTNPDATEQYGSVSTNLQERGNR

SEQ ID NO: 1114 - protein, 28 aa, Artificial Sequence
  Description of Artificial Sequence: Synthetic peptide
DEQEIRTTNPVATEQYGSVSTNDQRGNR

SEQ ID NO: 1115 - protein, 28 aa, Artificial Sequence
  Description of Artificial Sequence: Synthetic peptide
DEEEIRTTNPVATEQYGCVDTNLQRGNR

SEQ ID NO: 1116 - protein, 29 aa, Artificial Sequence
  Description of Artificial Sequence: Synthetic peptide
DETEIRTTNPVATEQYGSVSTNLQRGNDR

SEQ ID NO: 1117 - protein, 29 aa, Artificial Sequence
  Description of Artificial Sequence: Synthetic peptide
DENEIRTTNPVATEQYGSVSTDNLQRGNR

SEQ ID NO: 1118 - protein, 30 aa, Artificial Sequence
  Description of Artificial Sequence: Synthetic polypeptide
DEEEIRTTNPVATEQYGSVSITNLQLRGNR

SEQ ID NO: 1119 - protein, 29 aa, Artificial Sequence
  Description of Artificial Sequence: Synthetic peptide
DEEEIRTTNPVATEQYGSVSATNLQRGER

SEQ ID NO: 1120 - protein, 29 aa, Artificial Sequence
  Description of Artificial Sequence: Synthetic peptide
DEEEIRTVNPVATEQYGSVSTNLQRNGNR

SEQ ID NO: 1121 - protein, 28 aa, Artificial Sequence
  Description of Artificial Sequence: Synthetic peptide
DEEEIRCTNPVATEMYGSVSTNLQRGNR

SEQ ID NO: 1122 - protein, 28 aa, Artificial Sequence
  Description of Artificial Sequence: Synthetic peptide
DEEEIRTTNPVATEWYGSVSTNLQRGNF

SEQ ID NO: 1123 - protein, 30 aa, Artificial Sequence
  Description of Artificial Sequence: Synthetic polypeptide
DEEEIRTTNPVATEQYGSVSTNLQLRGNDR

SEQ ID NO: 1124 - protein, 28 aa, Artificial Sequence
  Description of Artificial Sequence: Synthetic peptide
DEEEIRTTNPVATEQYGSVSTLLQRGMR

SEQ ID NO: 1125 - protein, 28 aa, Artificial Sequence
  Description of Artificial Sequence: Synthetic peptide
DEEEIRTTNPVATEQYGSVATNLQRGNG

SEQ ID NO: 1126 - protein, 30 aa, Artificial Sequence
  Description of Artificial Sequence: Synthetic polypeptide
DEEEIRTTNPVATEQYGSVSTMNLLQRGNR

SEQ ID NO: 1127 - protein, 30 aa, Artificial Sequence
  Description of Artificial Sequence: Synthetic polypeptide
DEEEIRTTNPVATEQYGSVSTNLQRNGNSR

SEQ ID NO: 1128 - protein, 28 aa, Artificial Sequence
  Description of Artificial Sequence: Synthetic peptide
DEDEIRTTNPVATEQYGSVSMNLQRGNR

SEQ ID NO: 1129 - protein, 28 aa, Artificial Sequence
  Description of Artificial Sequence: Synthetic peptide
DEEEIRTTNPVATEHYGSVATNLQRGNR

SEQ ID NO: 1130 - protein, 29 aa, Artificial Sequence
  Description of Artificial Sequence: Synthetic peptide
DEEEIRTTNPVATEQYGSYVSTNLERGNR

SEQ ID NO: 1131 - protein, 28 aa, Artificial Sequence
  Description of Artificial Sequence: Synthetic peptide
DEEEIRTTNPVATEQYGSVSTNLQLGNL

SEQ ID NO: 1132 - protein, 28 aa, Artificial Sequence
  Description of Artificial Sequence: Synthetic peptide
MEEEIRATNPVATEQYGSVSTNLQRGNR

SEQ ID NO: 1133 - protein, 28 aa, Artificial Sequence
  Description of Artificial Sequence: Synthetic peptide
DEEEIRTTNPFATEQYGNVSTNLQRGNR

SEQ ID NO: 1134 - protein, 28 aa, Artificial Sequence
  Description of Artificial Sequence: Synthetic peptide
DEEEIATTNPVATEQYGSVSTNLQRGTR

SEQ ID NO: 1135 - protein, 29 aa, Artificial Sequence
  Description of Artificial Sequence: Synthetic peptide
DEEEIRTTNPVATEQYGSYVDTNLQRGNR

SEQ ID NO: 1136 - protein, 28 aa, Artificial Sequence
  Description of Artificial Sequence: Synthetic peptide
DEEEIRTTNPVATEQYGSVSTPLQNGNR

SEQ ID NO: 1137 - protein, 29 aa, Artificial Sequence
  Description of Artificial Sequence: Synthetic peptide
SEEEIRTTNPVATEQYGSVSTNLQRGENR

SEQ ID NO: 1138 - protein, 28 aa, Artificial Sequence
  Description of Artificial Sequence: Synthetic peptide
DEEEITTTNPVATELYGSVSTNLQRGNR

SEQ ID NO: 1139 - protein, 28 aa, Artificial Sequence
  Description of Artificial Sequence: Synthetic peptide
DEEEIRTTNPVATEQYGSVSTNLQYGNA

SEQ ID NO: 1140 - protein, 29 aa, Artificial Sequence
  Description of Artificial Sequence: Synthetic peptide
DEEEIRTTNPVATEQYGSVSATNLQDGNR

SEQ ID NO: 1141 - protein, 28 aa, Artificial Sequence
  Description of Artificial Sequence: Synthetic peptide
DDEEIRTTNPVATEQYGSVSTNLQRPNR

SEQ ID NO: 1142 - protein, 28 aa, Artificial Sequence
  Description of Artificial Sequence: Synthetic peptide
DEEEIRTTNPVASECYGSVSTNLQRGNR

SEQ ID NO: 1143 - protein, 28 aa, Artificial Sequence
  Description of Artificial Sequence: Synthetic peptide
DEEMIRTTNPVATEQYGSVSTNLQRGNP

SEQ ID NO: 1144 - protein, 28 aa, Artificial Sequence
  Description of Artificial Sequence: Synthetic peptide
DEEEIRTTNPVATEQYGVVSTNLQRGNV

SEQ ID NO: 1145 - protein, 28 aa, Artificial Sequence
  Description of Artificial Sequence: Synthetic peptide
DEEEIRTTNPVATEAYGSVSTNLQRINR

SEQ ID NO: 1146 - protein, 30 aa, Artificial Sequence
  Description of Artificial Sequence: Synthetic polypeptide
DEEEIRTTNPVATEQYGSNVSTNLEQRGNR

SEQ ID NO: 1147 - protein, 30 aa, Artificial Sequence
  Description of Artificial Sequence: Synthetic polypeptide
DEEEIRTTNPVATEQYGSVSLTPNLQRGNR

SEQ ID NO: 1148 - protein, 29 aa, Artificial Sequence
  Description of Artificial Sequence: Synthetic peptide
DEEEICTTNPVATEQYGSVSTANLQRGNR

SEQ ID NO: 1149 - protein, 28 aa, Artificial Sequence
  Description of Artificial Sequence: Synthetic peptide
DEEEIRTTNPVSTEQYGSVSTNLQRLNR

SEQ ID NO: 1150 - protein, 28 aa, Artificial Sequence
  Description of Artificial Sequence: Synthetic peptide
DEEEVRTTNPVATEQYGHVSTNLQRGNR

SEQ ID NO: 1151 - protein, 28 aa, Artificial Sequence
  Description of Artificial Sequence: Synthetic peptide
DEEEIRTTNPTATEQYGSVSTNLQQGNR

SEQ ID NO: 1152 - protein, 29 aa, Artificial Sequence
  Description of Artificial Sequence: Synthetic peptide
DEEEIRTTNPVATEQYGSSVSTNLQRGNM

SEQ ID NO: 1153 - protein, 28 aa, Artificial Sequence
  Description of Artificial Sequence: Synthetic peptide
DEEEIRTTNPVATEIYGSVSTNLQRGND

SEQ ID NO: 1154 - protein, 28 aa, Artificial Sequence
  Description of Artificial Sequence: Synthetic peptide
DEEEIRTTNPVATEQYGSVSTNLQRGEL

SEQ ID NO: 1155 - protein, 29 aa, Artificial Sequence
  Description of Artificial Sequence: Synthetic peptide
DEEEIRTTNPVATEQYGSVSTNDQDRGNR

SEQ ID NO: 1156 - protein, 29 aa, Artificial Sequence
  Description of Artificial Sequence: Synthetic peptide
DEEEIRTTNPVATEQYGSVSNNGLQRGNR

SEQ ID NO: 1157 - protein, 29 aa, Artificial Sequence
  Description of Artificial Sequence: Synthetic peptide
DEEEIRTTNPVATEQYGSVSTNDQLRGNR

SEQ ID NO: 1158 - protein, 30 aa, Artificial Sequence
  Description of Artificial Sequence: Synthetic polypeptide
DEEEIRTTNPVATEQYGSVSTMNLQRGDNR

SEQ ID NO: 1159 - protein, 30 aa, Artificial Sequence
  Description of Artificial Sequence: Synthetic polypeptide
DEEEIRTTNPVATEQYGSVSTFNLQRGNDR

SEQ ID NO: 1160 - protein, 30 aa, Artificial Sequence
  Description of Artificial Sequence: Synthetic polypeptide
DEEEIRTTNPVATEQYGSVSTGNLQRGNDR

SEQ ID NO: 1161 - protein, 28 aa, Artificial Sequence
  Description of Artificial Sequence: Synthetic peptide
DEGEIRQTNPVATEQYGSVSTNLQRGNR

SEQ ID NO: 1162 - protein, 28 aa, Artificial Sequence
  Description of Artificial Sequence: Synthetic peptide
DELEIRTTNPVATEQYGSVSTNLQRLNR

SEQ ID NO: 1163 - protein, 29 aa, Artificial Sequence
  Description of Artificial Sequence: Synthetic peptide
DEEEIRTTNPVATEPYGSVSVTNLQRGNR

SEQ ID NO: 1164 - protein, 28 aa, Artificial Sequence
  Description of Artificial Sequence: Synthetic peptide
DEQEIRTTNPVATEQYGSVSTNLQVGNR

SEQ ID NO: 1165 - protein, 29 aa, Artificial Sequence
  Description of Artificial Sequence: Synthetic peptide
DEEEIRTTNPVATEQYGSVSATNLQRGNT

SEQ ID NO: 1166 - protein, 28 aa, Artificial Sequence
  Description of Artificial Sequence: Synthetic peptide
DEEEIRTTNPVATEQYGSVSTDLQIGNR

SEQ ID NO: 1167 - protein, 28 aa, Artificial Sequence
  Description of Artificial Sequence: Synthetic peptide
DENEIRTTNPVATELYGSVSTNLQRGNR

SEQ ID NO: 1168 - protein, 28 aa, Artificial Sequence
  Description of Artificial Sequence: Synthetic peptide
GEEEIATTNPVATEQYGSVSTNLQRGNR

SEQ ID NO: 1169 - protein, 29 aa, Artificial Sequence
  Description of Artificial Sequence: Synthetic peptide
REEEIRTTNPVATEQYGSVSTNLQRGNDR

SEQ ID NO: 1170 - protein, 28 aa, Artificial Sequence
  Description of Artificial Sequence: Synthetic peptide
DEECIRTTNPVATEQYWSVSTNLQRGNR

SEQ ID NO: 1171 - protein, 28 aa, Artificial Sequence
  Description of Artificial Sequence: Synthetic peptide
DEEEIRTTNPVATEQYGSVSTELQEGNR

SEQ ID NO: 1172 - protein, 28 aa, Artificial Sequence
  Description of Artificial Sequence: Synthetic peptide
DEEEIRTTNPVATEQYGSVSTNLQGGER

SEQ ID NO: 1173 - protein, 28 aa, Artificial Sequence
  Description of Artificial Sequence: Synthetic peptide
DEEEIRTTNPVATEQYGSVDTELQRGNR

SEQ ID NO: 1174 - protein, 28 aa, Artificial Sequence
  Description of Artificial Sequence: Synthetic peptide
DEEEIRTTNPVATEQYGSVSTNEQRGDR

SEQ ID NO: 1175 - protein, 29 aa, Artificial Sequence
  Description of Artificial Sequence: Synthetic peptide
DEEEIRTTNPVATEQYGSVSTVPLQRGNR

SEQ ID NO: 1176 - protein, 28 aa, Artificial Sequence
  Description of Artificial Sequence: Synthetic peptide
DEEEIRTTNPVATEQYGSVSTPLQPGNR

SEQ ID NO: 1177 - protein, 29 aa, Artificial Sequence
  Description of Artificial Sequence: Synthetic peptide
DEEEIRTTNPVATEQYGSVSTPNLQRGND

SEQ ID NO: 1178 - protein, 28 aa, Artificial Sequence
  Description of Artificial Sequence: Synthetic peptide
DEEEIRTTNPAATEHYGSVSTNLQRGNR

SEQ ID NO: 1179 - protein, 28 aa, Artificial Sequence
  Description of Artificial Sequence: Synthetic peptide
DEEEIRTTNPVATEQYGSVSTNIQRGER

SEQ ID NO: 1180 - protein, 29 aa, Artificial Sequence
  Description of Artificial Sequence: Synthetic peptide
DEEEIRTTNPVATEQYGSVSTMNLQRGTR

SEQ ID NO: 1181 - protein, 29 aa, Artificial Sequence
  Description of Artificial Sequence: Synthetic peptide
DEEEIRTTNPVATEQYGDVSTNLQREGNR

SEQ ID NO: 1182 - protein, 28 aa, Artificial Sequence
  Description of Artificial Sequence: Synthetic peptide
DEEEIRTTNPVATEQYGTVSTNLQRGNQ

SEQ ID NO: 1183 - protein, 28 aa, Artificial Sequence
  Description of Artificial Sequence: Synthetic peptide
DEEEIRTTNPVSTEQYGSTSTNLQRGNR

SEQ ID NO: 1184 - protein, 29 aa, Artificial Sequence
  Description of Artificial Sequence: Synthetic peptide
DEEEIRTTNPVATEQYGSVSTNEQDRGNR

SEQ ID NO: 1185 - protein, 28 aa, Artificial Sequence
  Description of Artificial Sequence: Synthetic peptide
HEEEIRTTNPVATEQYGSVSTNLQHGNR

SEQ ID NO: 1186 - protein, 29 aa, Artificial Sequence
  Description of Artificial Sequence: Synthetic peptide
DEEEIRTTNPVATEQYGSVSTVNLQRENR

SEQ ID NO: 1187 - protein, 28 aa, Artificial Sequence
  Description of Artificial Sequence: Synthetic peptide
SESEIRTTNPVATEQYGSVSTNLQRGNR

SEQ ID NO: 1188 - protein, 28 aa, Artificial Sequence
  Description of Artificial Sequence: Synthetic peptide
DEEEIRTTNPVATEQYGSVDTNLQNGNR

SEQ ID NO: 1189 - protein, 28 aa, Artificial Sequence
  Description of Artificial Sequence: Synthetic peptide
VEEEIRTTNPVATEQYGSVSDNLQRGNR

SEQ ID NO: 1190 - protein, 30 aa, Artificial Sequence
  Description of Artificial Sequence: Synthetic polypeptide
DEEEIRTTNPVATEQYGSVYSTNGLQRGNR

SEQ ID NO: 1191 - protein, 28 aa, Artificial Sequence
  Description of Artificial Sequence: Synthetic peptide
DEEEIRTTNPVATEQYGSVSTDLQDGNR

SEQ ID NO: 1192 - protein, 28 aa, Artificial Sequence
  Description of Artificial Sequence: Synthetic peptide
DEEEIRTTNPVATEQYGSVSTCLQRGNS

SEQ ID NO: 1193 - protein, 28 aa, Artificial Sequence
  Description of Artificial Sequence: Synthetic peptide
DEEEIRTTNPVATEQYGDVSTNLQRNNR

SEQ ID NO: 1194 - protein, 28 aa, Artificial Sequence
  Description of Artificial Sequence: Synthetic peptide
DEVEIRSTNPVATEQYGSVSTNLQRGNR

SEQ ID NO: 1195 - protein, 28 aa, Artificial Sequence
  Description of Artificial Sequence: Synthetic peptide
DEEEIRTTNPVATEQYGSVSTNLQMGNF

SEQ ID NO: 1196 - protein, 29 aa, Artificial Sequence
  Description of Artificial Sequence: Synthetic peptide
DTEEIRTTNPVATEQYGSVSTNGLQRGNR

SEQ ID NO: 1197 - protein, 30 aa, Artificial Sequence
  Description of Artificial Sequence: Synthetic polypeptide
DEEEIRTTNPVATEQYGSFVSTNELQRGNR

SEQ ID NO: 1198 - protein, 28 aa, Artificial Sequence
  Description of Artificial Sequence: Synthetic peptide
DEVEIRTTNPVATEQYGSVSTALQRGNR

SEQ ID NO: 1199 - protein, 29 aa, Artificial Sequence
  Description of Artificial Sequence: Synthetic peptide
DEEEIRTTNPVATEQYGSVSTNLQERGDR

SEQ ID NO: 1200 - protein, 28 aa, Artificial Sequence
  Description of Artificial Sequence: Synthetic peptide
DEEEIRTTNPFATEQYGSVSTNLDRGNR

SEQ ID NO: 1201 - protein, 28 aa, Artificial Sequence
  Description of Artificial Sequence: Synthetic peptide
DEEEIRTTNPVATEQYGDVATNLQRGNR

SEQ ID NO: 1202 - protein, 28 aa, Artificial Sequence
  Description of Artificial Sequence: Synthetic peptide
DEEEIRTTNPVATECYGSVSTNLQRGNQ

SEQ ID NO: 1203 - protein, 28 aa, Artificial Sequence
  Description of Artificial Sequence: Synthetic peptide
DEEEIRTTNIVATEQYGSVSTNLQYGNR

SEQ ID NO: 1204 - protein, 28 aa, Artificial Sequence
  Description of Artificial Sequence: Synthetic peptide
DEEEIRTTNPVATEQYGSVSTNLQDGNH

SEQ ID NO: 1205 - protein, 28 aa, Artificial Sequence
  Description of Artificial Sequence: Synthetic peptide
DEDEIRTTNPVATEQYGSVATNLQRGNR

SEQ ID NO: 1206 - protein, 28 aa, Artificial Sequence
  Description of Artificial Sequence: Synthetic peptide
AEEEIRTTNPVATEQYGVVSTNLQRGNR

SEQ ID NO: 1207 - protein, 28 aa, Artificial Sequence
  Description of Artificial Sequence: Synthetic peptide
DEEEIRTTNPVATEQYGSVSTNLQHGNF

SEQ ID NO: 1208 - protein, 28 aa, Artificial Sequence
  Description of Artificial Sequence: Synthetic peptide
DEEEIRATNPAATEQYGSVSTNLQRGNR

SEQ ID NO: 1209 - protein, 28 aa, Artificial Sequence
  Description of Artificial Sequence: Synthetic peptide
DEEEIRTTNPVATEQYGSVSTNLQNGND

SEQ ID NO: 1210 - protein, 28 aa, Artificial Sequence
  Description of Artificial Sequence: Synthetic peptide
DEEEIRTTNPVATEQYGGVSTNLQQGNR

SEQ ID NO: 1211 - protein, 30 aa, Artificial Sequence
  Description of Artificial Sequence: Synthetic polypeptide
DEEEIRTTNPVATEQYGSVSCTNLQCRGNR

SEQ ID NO: 1212 - protein, 28 aa, Artificial Sequence
  Description of Artificial Sequence: Synthetic peptide
DEEEIRTTNPVAAEQYGSVSTPLQRGNR

SEQ ID NO: 1213 - protein, 29 aa, Artificial Sequence
  Description of Artificial Sequence: Synthetic peptide
VEEEIRTTNPVATEQYGSVSTNLQRGNDR

SEQ ID NO: 1214 - protein, 29 aa, Artificial Sequence
  Description of Artificial Sequence: Synthetic peptide
DEEEIRTTNPTATEQYGSVSTNLQLRGNR

SEQ ID NO: 1215 - protein, 29 aa, Artificial Sequence
  Description of Artificial Sequence: Synthetic peptide
DEQEIRTTNPVATEQYGSVSTNLQRGDNR

SEQ ID NO: 1216 - protein, 28 aa, Artificial Sequence
  Description of Artificial Sequence: Synthetic peptide
DEEEIRTTNPVATEQYGSVSTNLQWGER

SEQ ID NO: 1217 - protein, 28 aa, Artificial Sequence
  Description of Artificial Sequence: Synthetic peptide
DEEEIRTTNPVCTEQYGSVSMNLQRGNR

SEQ ID NO: 1218 - protein, 28 aa, Artificial Sequence
  Description of Artificial Sequence: Synthetic peptide
SEEEIRTTNPVATEQYGSVSTNLQSGNR

SEQ ID NO: 1219 - protein, 28 aa, Artificial Sequence
  Description of Artificial Sequence: Synthetic peptide
DESEIVTTNPVATEQYGSVSTNLQRGNR

SEQ ID NO: 1220 - protein, 29 aa, Artificial Sequence
  Description of Artificial Sequence: Synthetic peptide
QEEEIRTTNPVATEQYGSVSTNLQRAGNR

SEQ ID NO: 1221 - protein, 28 aa, Artificial Sequence
  Description of Artificial Sequence: Synthetic peptide
DEEEIRTTNPVATEQYGWVSTDLQRGNR

SEQ ID NO: 1222 - protein, 29 aa, Artificial Sequence
  Description of Artificial Sequence: Synthetic peptide
DEEEIRTTNPVATEQYGSVSTNLQLRGNI

SEQ ID NO: 1223 - protein, 30 aa, Artificial Sequence
  Description of Artificial Sequence: Synthetic polypeptide
DEEEIRTTNPVATEQYGSVSTNLQRDGDNR

SEQ ID NO: 1224 - protein, 29 aa, Artificial Sequence
  Description of Artificial Sequence: Synthetic peptide
DEEEIRTTNPVATEQYGSVSTNLQERGNT

SEQ ID NO: 1225 - protein, 28 aa, Artificial Sequence
  Description of Artificial Sequence: Synthetic peptide
DEEEIETTNPVATEQYGSVSENLQRGNR

SEQ ID NO: 1226 - protein, 28 aa, Artificial Sequence
  Description of Artificial Sequence: Synthetic peptide
DEECIRTTNPVATEQYGSWSTNLQRGNR

SEQ ID NO: 1227 - protein, 28 aa, Artificial Sequence
  Description of Artificial Sequence: Synthetic peptide
DEEEIRTTNPVATEQYGGVSTNLLRGNR

SEQ ID NO: 1228 - protein, 28 aa, Artificial Sequence
  Description of Artificial Sequence: Synthetic peptide
DEEEIRTTNPVATEQYGSVSTELQRGNG

SEQ ID NO: 1229 - protein, 28 aa, Artificial Sequence
  Description of Artificial Sequence: Synthetic peptide
DEEEIRTTNPVATEQYGSVSTNLSRGER

SEQ ID NO: 1230 - protein, 30 aa, Artificial Sequence
  Description of Artificial Sequence: Synthetic polypeptide
DEEEIRTTNPVATEQYGSVSTFNLQRGENR

SEQ ID NO: 1231 - protein, 30 aa, Artificial Sequence
  Description of Artificial Sequence: Synthetic polypeptide
DEEEIRTTNPVATEQYGSVSATNLQRDGNR

SEQ ID NO: 1232 - protein, 28 aa, Artificial Sequence
  Description of Artificial Sequence: Synthetic peptide
DEEEIRTTNPVATEQYGIVSDNLQRGNR

SEQ ID NO: 1233 - protein, 28 aa, Artificial Sequence
  Description of Artificial Sequence: Synthetic peptide
DEEEIRTTNPVATEQYGSVSTNLEYGNR

SEQ ID NO: 1234 - protein, 28 aa, Artificial Sequence
  Description of Artificial Sequence: Synthetic peptide
DEEEIRTTNPVATEQYGTVSTVLQRGNR

SEQ ID NO: 1235 - protein, 29 aa, Artificial Sequence
  Description of Artificial Sequence: Synthetic peptide
DEEEIRTTNPVATEQYGSVSTDLQRKGNR

SEQ ID NO: 1236 - protein, 29 aa, Artificial Sequence
  Description of Artificial Sequence: Synthetic peptide
DEEEIRTTNPVATEQYGSVNSTNLSRGNR

SEQ ID NO: 1237 - protein, 29 aa, Artificial Sequence
  Description of Artificial Sequence: Synthetic peptide
DEEEIRTTNPVATEQYGVVSATNLQRGNR

SEQ ID NO: 1238 - protein, 29 aa, Artificial Sequence
  Description of Artificial Sequence: Synthetic peptide
DEEEICTTNPVATEQYGSVSCTNLQRGNR

SEQ ID NO: 1239 - protein, 28 aa, Artificial Sequence
  Description of Artificial Sequence: Synthetic peptide
DEEEIRTTNPVATEMYGSVSTNLQRGPR

SEQ ID NO: 1240 - protein, 30 aa, Artificial Sequence
  Description of Artificial Sequence: Synthetic polypeptide
DEEEIRTTNPVATEQYGSVSTQNLQRGENR

SEQ ID NO: 1241 - protein, 28 aa, Artificial Sequence
  Description of Artificial Sequence: Synthetic peptide
DEVEIRTTNPVATEQYGSVSTNLQRGTR

SEQ ID NO: 1242 - protein, 29 aa, Artificial Sequence
  Description of Artificial Sequence: Synthetic peptide
DEEEIRTTNPVATEQYGSVSTMNWQRGNR

SEQ ID NO: 1243 - protein, 29 aa, Artificial Sequence
  Description of Artificial Sequence: Synthetic peptide
DEEEIRTTNPVATEQYGSVSTNLRQDGNR

SEQ ID NO: 1244 - protein, 29 aa, Artificial Sequence
  Description of Artificial Sequence: Synthetic peptide
DEEEIRTTNPVATEQYGSVSTLLQRGDNR

SEQ ID NO: 1245 - protein, 29 aa, Artificial Sequence
  Description of Artificial Sequence: Synthetic peptide
DEEEIRTTNPVATEQYGSVSVDNLQRGNR

SEQ ID NO: 1246 - protein, 28 aa, Artificial Sequence
  Description of Artificial Sequence: Synthetic peptide
DEEEIRTTNPVSTEQYGSVSTNLQRGGR

SEQ ID NO: 1247 - protein, 28 aa, Artificial Sequence
  Description of Artificial Sequence: Synthetic peptide
DEEEIRTTNPIATEQYGSVSNNLQRGNR

SEQ ID NO: 1248 - protein, 29 aa, Artificial Sequence
  Description of Artificial Sequence: Synthetic peptide
DETEIRTTNPVATEQYGSVSTTNLQRGNR

SEQ ID NO: 1249 - protein, 28 aa, Artificial Sequence
  Description of Artificial Sequence: Synthetic peptide
DEEEIRTTNPVATEQYGSVSTGLQRGER

SEQ ID NO: 1250 - protein, 29 aa, Artificial Sequence
  Description of Artificial Sequence: Synthetic peptide
DEEEIRTTNPVATEQYGSVSTMNLQRGNN

SEQ ID NO: 1251 - protein, 28 aa, Artificial Sequence
  Description of Artificial Sequence: Synthetic peptide
DEEEIRTTNIVATEQYGSVSTDLQRGNR

SEQ ID NO: 1252 - protein, 28 aa, Artificial Sequence
  Description of Artificial Sequence: Synthetic peptide
DEEEIRTTNPVATEQYGSVSMPLQRGNR

SEQ ID NO: 1253 - protein, 28 aa, Artificial Sequence
  Description of Artificial Sequence: Synthetic peptide
DEEEIRTTNPVATEQYGSVETELQRGNR

SEQ ID NO: 1254 - protein, 28 aa, Artificial Sequence
  Description of Artificial Sequence: Synthetic peptide
DEEEIRTTNPVAGEQYGSVSTNLQDGNR

SEQ ID NO: 1255 - protein, 29 aa, Artificial Sequence
  Description of Artificial Sequence: Synthetic peptide
DEEEIRTTNPVATEQYGSVITENLQRGNR

SEQ ID NO: 1256 - protein, 28 aa, Artificial Sequence
  Description of Artificial Sequence: Synthetic peptide
DEEEIRPTNPVATEQYGSVSTNDQRGNR

SEQ ID NO: 1257 - protein, 28 aa, Artificial Sequence
  Description of Artificial Sequence: Synthetic peptide
DEQEIRTTNPVATEQYGDVSTNLQRGNR

SEQ ID NO: 1258 - protein, 28 aa, Artificial Sequence
  Description of Artificial Sequence: Synthetic peptide
DEEEIRTTNPVATEQYGSVSTNLERGNS

SEQ ID NO: 1259 - protein, 28 aa, Artificial Sequence
  Description of Artificial Sequence: Synthetic peptide
DEEEIRTTNPVSTEQYGSVSTNQQRGNR

SEQ ID NO: 1260 - protein, 28 aa, Artificial Sequence
  Description of Artificial Sequence: Synthetic peptide
DEVEIRTTNPVATEQYGSVSTNEQRGNR

SEQ ID NO: 1261 - protein, 28 aa, Artificial Sequence
  Description of Artificial Sequence: Synthetic peptide
DEREIQTTNPVATEQYGSVSTNLQRGNR

SEQ ID NO: 1262 - protein, 28 aa, Artificial Sequence
  Description of Artificial Sequence: Synthetic peptide
DEEEIRTTNPVATENYGAVSTNLQRGNR

SEQ ID NO: 1263 - protein, 28 aa, Artificial Sequence
  Description of Artificial Sequence: Synthetic peptide
DEEEIRTTNPVATEQYGSHSTALQRGNR

SEQ ID NO: 1264 - protein, 29 aa, Artificial Sequence
  Description of Artificial Sequence: Synthetic peptide
DEEEIRTTNPVATETYGSVSTNLQREGNR

SEQ ID NO: 1265 - protein, 28 aa, Artificial Sequence
  Description of Artificial Sequence: Synthetic peptide
DEEEIVTTNPVATEVYGSVSTNLQRGNR

SEQ ID NO: 1266 - protein, 28 aa, Artificial Sequence
  Description of Artificial Sequence: Synthetic peptide
QEEEIRTTNPVATEQYGDVSTNLQRGNR

SEQ ID NO: 1267 - protein, 28 aa, Artificial Sequence
  Description of Artificial Sequence: Synthetic peptide
DETEIRTTNPVATEQYGSVSTNLQRGGR

SEQ ID NO: 1268 - protein, 28 aa, Artificial Sequence
  Description of Artificial Sequence: Synthetic peptide
DEEEIRTTNPVATEQYGSVSTNKQRGER

SEQ ID NO: 1269 - protein, 28 aa, Artificial Sequence
  Description of Artificial Sequence: Synthetic peptide
DEEEIRTTNPVATEQYGSVSTELQRGDR

SEQ ID NO: 1270 - protein, 28 aa, Artificial Sequence
  Description of Artificial Sequence: Synthetic peptide
DEEEIAATNPVATEQYGSVSTNLQRGNR

SEQ ID NO: 1271 - protein, 28 aa, Artificial Sequence
  Description of Artificial Sequence: Synthetic peptide
DEEEIRTTNPVATEQYGSVSTNLQQGNQ

SEQ ID NO: 1272 - protein, 28 aa, Artificial Sequence
  Description of Artificial Sequence: Synthetic peptide
DEEEIRTTNPVATEQYGSVSTNLERGTR

SEQ ID NO: 1273 - protein, 28 aa, Artificial Sequence
  Description of Artificial Sequence: Synthetic peptide
NEEEIRTTNPCATEQYGSVSTNLQRGNR

SEQ ID NO: 1274 - protein, 29 aa, Artificial Sequence
  Description of Artificial Sequence: Synthetic peptide
DEEEIRTTNPVATEQYGSVSTNLQRYGTR

SEQ ID NO: 1275 - protein, 29 aa, Artificial Sequence
  Description of Artificial Sequence: Synthetic peptide
DEIEIRTTNPVATEQYGSVSTNGLQRGNR

SEQ ID NO: 1276 - protein, 29 aa, Artificial Sequence
  Description of Artificial Sequence: Synthetic peptide
DEEEIRTTNPVATEQYGSVHSYNLQRGNR

SEQ ID NO: 1277 - protein, 30 aa, Artificial Sequence
  Description of Artificial Sequence: Synthetic polypeptide
DEEEIRTTNPVATEQYGSVSTMNLVQRGNR

SEQ ID NO: 1278 - protein, 28 aa, Artificial Sequence
  Description of Artificial Sequence: Synthetic peptide
DEEEIRTTNPVATEQYGSVSTNLQQGNL

SEQ ID NO: 1279 - protein, 28 aa, Artificial Sequence
  Description of Artificial Sequence: Synthetic peptide
DEEELRTTNPVATEQYGSTSTNLQRGNR

SEQ ID NO: 1280 - protein, 28 aa, Artificial Sequence
  Description of Artificial Sequence: Synthetic peptide
DEEEIRTTNPVATEQYGSVSTPLQRGNY

SEQ ID NO: 1281 - protein, 28 aa, Artificial Sequence
  Description of Artificial Sequence: Synthetic peptide
DEEEIMTTNPVATEQYGSVSTELQRGNR

SEQ ID NO: 1282 - protein, 28 aa, Artificial Sequence
  Description of Artificial Sequence: Synthetic peptide
DEEEIRTTNPVATENYGNVSTNLQRGNR

SEQ ID NO: 1283 - protein, 28 aa, Artificial Sequence
  Description of Artificial Sequence: Synthetic peptide
DEEEIRTTNPVATEQYGSVSTNLQRGTS

SEQ ID NO: 1284 - protein, 28 aa, Artificial Sequence
  Description of Artificial Sequence: Synthetic peptide
DEEEIRTTNPVATEHYGDVSTNLQRGNR

SEQ ID NO: 1285 - protein, 28 aa, Artificial Sequence
  Description of Artificial Sequence: Synthetic peptide
DEEEIRTTNPVATEQYGSVSTNLQQENR

SEQ ID NO: 1286 - protein, 28 aa, Artificial Sequence
  Description of Artificial Sequence: Synthetic peptide
DEQEIRTTNPVATEQYGSVSTNLQRGNG

SEQ ID NO: 1287 - protein, 28 aa, Artificial Sequence
  Description of Artificial Sequence: Synthetic peptide
DEEEIRATNPVATEQYGSVSTELQRGNR

SEQ ID NO: 1288 - protein, 28 aa, Artificial Sequence
  Description of Artificial Sequence: Synthetic peptide
DEEEIRTTNPVATEQYGNVSANLQRGNR

SEQ ID NO: 1289 - protein, 28 aa, Artificial Sequence
  Description of Artificial Sequence: Synthetic peptide
DEEEIRTTNPAATEQYGSVSTNLQRGNN

SEQ ID NO: 1290 - protein, 29 aa, Artificial Sequence
  Description of Artificial Sequence: Synthetic peptide
DEEEIRTTNPVATEQYGSVSTNEQREGNR

SEQ ID NO: 1291 - protein, 28 aa, Artificial Sequence
  Description of Artificial Sequence: Synthetic peptide
DEEEICTTNPVATEQYGIVSTNLQRGNR

SEQ ID NO: 1292 - protein, 29 aa, Artificial Sequence
  Description of Artificial Sequence: Synthetic peptide
DEEEIRTTNPVATEQYGSVESTNLQRGNN

SEQ ID NO: 1293 - protein, 30 aa, Artificial Sequence
  Description of Artificial Sequence: Synthetic polypeptide
DEEEIRTTNPVATEQYGSVSTNLQRDGNER

SEQ ID NO: 1294 - protein, 28 aa, Artificial Sequence
  Description of Artificial Sequence: Synthetic peptide
DEEEIRTTNPCATEQYGSVSTNLQTGNR

SEQ ID NO: 1295 - protein, 29 aa, Artificial Sequence
  Description of Artificial Sequence: Synthetic peptide
DEEEIRTTNPVATEQYGSVSTNLQVRGNV

SEQ ID NO: 1296 - protein, 29 aa, Artificial Sequence
  Description of Artificial Sequence: Synthetic peptide
DEEEIRTTNPVATELYGSVSATNLQRGNR

SEQ ID NO: 1297 - protein, 28 aa, Artificial Sequence
  Description of Artificial Sequence: Synthetic peptide
DEEEIATTNPVATEQYGSMSTNLQRGNR

SEQ ID NO: 1298 - protein, 29 aa, Artificial Sequence
  Description of Artificial Sequence: Synthetic peptide
DEEEIRTTNPVATEQYGVVSTNLQVRGNR

SEQ ID NO: 1299 - protein, 28 aa, Artificial Sequence
  Description of Artificial Sequence: Synthetic peptide
DEEEIRTTNPVATEQYGSVSTNLQYGNV

SEQ ID NO: 1300 - protein, 28 aa, Artificial Sequence
  Description of Artificial Sequence: Synthetic peptide
DEEEIRTTNPVATEQYGSVSVNLQRGPR

SEQ ID NO: 1301 - protein, 28 aa, Artificial Sequence
  Description of Artificial Sequence: Synthetic peptide
DEEEIRTTNPVATEQYGSVSTNLQTGNQ

SEQ ID NO: 1302 - protein, 28 aa, Artificial Sequence
  Description of Artificial Sequence: Synthetic peptide
DENEIRTTNPVATEQYGIVSTNLQRGNR

SEQ ID NO: 1303 - protein, 28 aa, Artificial Sequence
  Description of Artificial Sequence: Synthetic peptide
DEEEIRTTNPVATECYGSVSTNLQRGNA

SEQ ID NO: 1304 - protein, 29 aa, Artificial Sequence
  Description of Artificial Sequence: Synthetic peptide
DEEEIRTTNPVATEQYGSASTNLQRGFNR

SEQ ID NO: 1305 - protein, 29 aa, Artificial Sequence
  Description of Artificial Sequence: Synthetic peptide
DEEEIRTTNPVATEQYGSVSMNLQREGNR

SEQ ID NO: 1306 - protein, 28 aa, Artificial Sequence
  Description of Artificial Sequence: Synthetic peptide
DEEEIRTTNPVATEQYGSVSDNLQRGNQ

SEQ ID NO: 1307 - protein, 28 aa, Artificial Sequence
  Description of Artificial Sequence: Synthetic peptide
DEEEIRTTNPVATEQYGSVCTNLQRPNR

SEQ ID NO: 1308 - protein, 28 aa, Artificial Sequence
  Description of Artificial Sequence: Synthetic peptide
DEEEIRTVNPVSTEQYGSVSTNLQRGNR

SEQ ID NO: 1309 - protein, 28 aa, Artificial Sequence
  Description of Artificial Sequence: Synthetic peptide
DEEECRTTNPVATEQYGSVGTNLQRGNR

SEQ ID NO: 1310 - protein, 28 aa, Artificial Sequence
  Description of Artificial Sequence: Synthetic peptide
DEEEIRCTNPVATEQYGSVSTNLERGNR

SEQ ID NO: 1311 - protein, 30 aa, Artificial Sequence
  Description of Artificial Sequence: Synthetic polypeptide
DEEEIRTTNPVATEQYGSVSTTMNLQRGNR

SEQ ID NO: 1312 - protein, 28 aa, Artificial Sequence
  Description of Artificial Sequence: Synthetic peptide
DEEEIRTVNPVATEQYGSVSTELQRGNR

SEQ ID NO: 1313 - protein, 28 aa, Artificial Sequence
  Description of Artificial Sequence: Synthetic peptide
DEEEIRTTNPEATEQYGSVSTPLQRGNR

SEQ ID NO: 1314 - protein, 29 aa, Artificial Sequence
  Description of Artificial Sequence: Synthetic peptide
MEEEIRTTNPVATEQYGSVSTNLQDRGNR

SEQ ID NO: 1315 - protein, 28 aa, Artificial Sequence
  Description of Artificial Sequence: Synthetic peptide
DEEEIRTTNPVATEQFGSVSTNLQRGNN

SEQ ID NO: 1316 - protein, 28 aa, Artificial Sequence
  Description of Artificial Sequence: Synthetic peptide
DEEEIRTTNPVATEQYGSVSTNPQNGNR

SEQ ID NO: 1317 - protein, 28 aa, Artificial Sequence
  Description of Artificial Sequence: Synthetic peptide
DEEEIVTTNPVATEQYGAVSTNLQRGNR

SEQ ID NO: 1318 - protein, 28 aa, Artificial Sequence
  Description of Artificial Sequence: Synthetic peptide
DEEEIRTTNPVATEQYGSVDTNLQSGNR

SEQ ID NO: 1319 - protein, 28 aa, Artificial Sequence
  Description of Artificial Sequence: Synthetic peptide
SEEEIRTTNPVATEQYGSVSTNPQRGNR

SEQ ID NO: 1320 - protein, 28 aa, Artificial Sequence
  Description of Artificial Sequence: Synthetic peptide
DEEEIRTTNPVATEQYGSVFTNLQRGNN

SEQ ID NO: 1321 - protein, 28 aa, Artificial Sequence
  Description of Artificial Sequence: Synthetic peptide
DEEEVRTTNPVATEQYGSVATNLQRGNR

SEQ ID NO: 1322 - protein, 29 aa, Artificial Sequence
  Description of Artificial Sequence: Synthetic peptide
DEEEIRTTNPVATEQYGSVSCTNLQCGNR

SEQ ID NO: 1323 - protein, 28 aa, Artificial Sequence
  Description of Artificial Sequence: Synthetic peptide
DEEEIRTCNPVATENYGSVSTNLQRGNR

SEQ ID NO: 1324 - protein, 28 aa, Artificial Sequence
  Description of Artificial Sequence: Synthetic peptide
DEEEIRTTNPVCTEIYGSVSTNLQRGNR

SEQ ID NO: 1325 - protein, 28 aa, Artificial Sequence
  Description of Artificial Sequence: Synthetic peptide
DEEEIRTTNPVATEQYGIVSTNLQRANR

SEQ ID NO: 1326 - protein, 29 aa, Artificial Sequence
  Description of Artificial Sequence: Synthetic peptide
DEEEIRTTNPVATEQYGSVDTNLQQRGNR

SEQ ID NO: 1327 - protein, 28 aa, Artificial Sequence
  Description of Artificial Sequence: Synthetic peptide
DEEEIRTTNPVATEQYGSVSTCMQRGNR

SEQ ID NO: 1328 - protein, 28 aa, Artificial Sequence
  Description of Artificial Sequence: Synthetic peptide
DEEEIRTTNPVATEQYGSVSTNDQQGNR

SEQ ID NO: 1329 - protein, 28 aa, Artificial Sequence
  Description of Artificial Sequence: Synthetic peptide
GEEEIRCTNPVATEQYGSVSTNLQRGNR

SEQ ID NO: 1330 - protein, 28 aa, Artificial Sequence
  Description of Artificial Sequence: Synthetic peptide
DEEEIRTTNPVATEQYGSVSTELQRGNT

SEQ ID NO: 1331 - protein, 28 aa, Artificial Sequence
  Description of Artificial Sequence: Synthetic peptide
DEEEIVTTNPVATEQYGSVSTTLQRGNR

SEQ ID NO: 1332 - protein, 28 aa, Artificial Sequence
  Description of Artificial Sequence: Synthetic peptide
DEEEIRTTNPVSTEQYGSVSTNLQLGNR

SEQ ID NO: 1333 - protein, 28 aa, Artificial Sequence
  Description of Artificial Sequence: Synthetic peptide
DEIEIRTTNPVATEQYGSVSTDLQRGNR

SEQ ID NO: 1334 - protein, 28 aa, Artificial Sequence
  Description of Artificial Sequence: Synthetic peptide
DEEEIRTTNPDATEQYGSVSTNLQRENR

SEQ ID NO: 1335 - protein, 28 aa, Artificial Sequence
  Description of Artificial Sequence: Synthetic peptide
QEEEIRTTNPVATEVYGSVSTNLQRGNR

SEQ ID NO: 1336 - protein, 29 aa, Artificial Sequence
  Description of Artificial Sequence: Synthetic peptide
KEEEIRTTNPVATEQYGSVSTMNLQRGNR

SEQ ID NO: 1337 - protein, 28 aa, Artificial Sequence
  Description of Artificial Sequence: Synthetic peptide
DEIEIRTTNPVATEQYGSVSTNLQRGER

SEQ ID NO: 1338 - protein, 28 aa, Artificial Sequence
  Description of Artificial Sequence: Synthetic peptide
DEEEITTTNPVATEQYGSVSTNVQRGNR

SEQ ID NO: 1339 - protein, 29 aa, Artificial Sequence
  Description of Artificial Sequence: Synthetic peptide
DEEEIRTTNPVATEQYGSVSTNLQRGNDL

SEQ ID NO: 1340 - protein, 28 aa, Artificial Sequence
  Description of Artificial Sequence: Synthetic peptide
DEEEIETTNPVATEQYGSVSTNLQRGNQ

SEQ ID NO: 1341 - protein, 28 aa, Artificial Sequence
  Description of Artificial Sequence: Synthetic peptide
DEEEIRTTNIVATEQYGSVSTNLQVGNR

SEQ ID NO: 1342 - protein, 28 aa, Artificial Sequence
  Description of Artificial Sequence: Synthetic peptide
DEEEIRTTNPVATEQYGSVSTNLQHGMR

SEQ ID NO: 1343 - protein, 29 aa, Artificial Sequence
  Description of Artificial Sequence: Synthetic peptide
DEEEIRTTNPVATELYGSVSTNGLQRGNR

SEQ ID NO: 1344 - protein, 29 aa, Artificial Sequence
  Description of Artificial Sequence: Synthetic peptide
DEEEIRTTNPVATEQYGSVSVTNGQRGNR

SEQ ID NO: 1345 - protein, 28 aa, Artificial Sequence
  Description of Artificial Sequence: Synthetic peptide
CEEEIRTTNPVATEQYGSVSTDLQRGNR

SEQ ID NO: 1346 - protein, 29 aa, Artificial Sequence
  Description of Artificial Sequence: Synthetic peptide
DEEEIRTTNPVATEQYGSVSTNLQRGNDF

SEQ ID NO: 1347 - protein, 28 aa, Artificial Sequence
  Description of Artificial Sequence: Synthetic peptide
DEEEIRTTNPVATEQYGSVSTGLQRGNY

SEQ ID NO: 1348 - protein, 29 aa, Artificial Sequence
  Description of Artificial Sequence: Synthetic peptide
DEEEIRTTNPVATEQYGSYVSTNPQRGNR

SEQ ID NO: 1349 - protein, 29 aa, Artificial Sequence
  Description of Artificial Sequence: Synthetic peptide
DEEEIRTTNPVATEQYGSVSITNLQVGNR

SEQ ID NO: 1350 - protein, 29 aa, Artificial Sequence
  Description of Artificial Sequence: Synthetic peptide
DEEEIRTTNPVATEQYGSVSATDLQRGNR

SEQ ID NO: 1351 - protein, 30 aa, Artificial Sequence
  Description of Artificial Sequence: Synthetic polypeptide
DEEEIRTTNPVATEQYGESVSTNLQIRGNR

SEQ ID NO: 1352 - protein, 28 aa, Artificial Sequence
  Description of Artificial Sequence: Synthetic peptide
DEEEISTTNPVATEQYGSVSTNLQRGER

SEQ ID NO: 1353 - protein, 28 aa, Artificial Sequence
  Description of Artificial Sequence: Synthetic peptide
DEEEIRTTNPVAVEQYGSVSTNLQRGER

SEQ ID NO: 1354 - protein, 29 aa, Artificial Sequence
  Description of Artificial Sequence: Synthetic peptide
DEEEIRTTNPVATEQYGSVSANLQGRGNR

SEQ ID NO: 1355 - protein, 29 aa, Artificial Sequence
  Description of Artificial Sequence: Synthetic peptide
DEEEIRTTNPVATEQYGSVLHTNLQRGNR

SEQ ID NO: 1356 - protein, 28 aa, Artificial Sequence
  Description of Artificial Sequence: Synthetic peptide
DEEEIRTTNIVATEQYGSVSTNLQLGNR

SEQ ID NO: 1357 - protein, 28 aa, Artificial Sequence
  Description of Artificial Sequence: Synthetic peptide
DEEEIRTTNPYATEQYGSVSTNLQRGGR

SEQ ID NO: 1358 - protein, 29 aa, Artificial Sequence
  Description of Artificial Sequence: Synthetic peptide
DEEEIRTTNPTATEQYGSVSTNLQRGPNR

SEQ ID NO: 1359 - protein, 28 aa, Artificial Sequence
  Description of Artificial Sequence: Synthetic peptide
DEEEIATTNPVATEQYGSISTNLQRGNR

SEQ ID NO: 1360 - protein, 28 aa, Artificial Sequence
  Description of Artificial Sequence: Synthetic peptide
DEEEIRTTNPVATEQYGSVSTNLQLGDR

SEQ ID NO: 1361 - protein, 30 aa, Artificial Sequence
  Description of Artificial Sequence: Synthetic polypeptide
DEEEIRTTNPVATEQYGSVDSTNLQRGNDR

SEQ ID NO: 1362 - protein, 28 aa, Artificial Sequence
  Description of Artificial Sequence: Synthetic peptide
DEEEIRTTNPVSTEQYGSVSTNLQRGNK

SEQ ID NO: 1363 - protein, 28 aa, Artificial Sequence
  Description of Artificial Sequence: Synthetic peptide
DEEEIRTTNPVATEQYGVVSTNLQRGTR

SEQ ID NO: 1364 - protein, 28 aa, Artificial Sequence
  Description of Artificial Sequence: Synthetic peptide
DEEEIRTTNPVATEQYGSVHTNLLRGNR

SEQ ID NO: 1365 - protein, 29 aa, Artificial Sequence
  Description of Artificial Sequence: Synthetic peptide
DEEEIRTTNPVATEQYGSVDSTNLQRGER

SEQ ID NO: 1366 - protein, 29 aa, Artificial Sequence
  Description of Artificial Sequence: Synthetic peptide
DEEEIRTTNPVATEQYGSVSTNLMRGNNR

SEQ ID NO: 1367 - protein, 28 aa, Artificial Sequence
  Description of Artificial Sequence: Synthetic peptide
DEEEIRTTNPVATEVYGSVSTNLDRGNR

SEQ ID NO: 1368 - protein, 28 aa, Artificial Sequence
  Description of Artificial Sequence: Synthetic peptide
DEEEIRTTNPVATEQYGSVSVVLQRGNR

SEQ ID NO: 1369 - protein, 28 aa, Artificial Sequence
  Description of Artificial Sequence: Synthetic peptide
DEMEIRTTNPVATEQYGSVSTNLDRGNR

SEQ ID NO: 1370 - protein, 28 aa, Artificial Sequence
  Description of Artificial Sequence: Synthetic peptide
DEEEIRTTNPVATEQYGSVSTNLQRGTG

SEQ ID NO: 1371 - protein, 28 aa, Artificial Sequence
  Description of Artificial Sequence: Synthetic peptide
DEEELRTTNPVATEQYGSVSTNLQPGNR

SEQ ID NO: 1372 - protein, 28 aa, Artificial Sequence
  Description of Artificial Sequence: Synthetic peptide
DEEEIRTTNPVATEQYGSVSTCDQRGNR

SEQ ID NO: 1373 - protein, 28 aa, Artificial Sequence
  Description of Artificial Sequence: Synthetic peptide
DEEEIRTTNPVATEQYGSVSTNLQIGNT

SEQ ID NO: 1374 - protein, 29 aa, Artificial Sequence
  Description of Artificial Sequence: Synthetic peptide
DEEEIRTTNPVATEQYGSVSENLQERGNR

SEQ ID NO: 1375 - protein, 28 aa, Artificial Sequence
  Description of Artificial Sequence: Synthetic peptide
DEMEIRATNPVATEQYGSVSTNLQRGNR

SEQ ID NO: 1376 - protein, 28 aa, Artificial Sequence
  Description of Artificial Sequence: Synthetic peptide
DEEEIRTTNPVATEQYGSVSTNLQLGND

SEQ ID NO: 1377 - protein, 28 aa, Artificial Sequence
  Description of Artificial Sequence: Synthetic peptide
DEEEIRTTNPVATETYGSVATNLQRGNR

SEQ ID NO: 1378 - protein, 29 aa, Artificial Sequence
  Description of Artificial Sequence: Synthetic peptide
DEEEIRTTNPTATEQYGSVSFTNLQRGNR

SEQ ID NO: 1379 - protein, 28 aa, Artificial Sequence
  Description of Artificial Sequence: Synthetic peptide
DEEEIRTTNPVATEQYGSVSDNLQRGNH

SEQ ID NO: 1380 - protein, 29 aa, Artificial Sequence
  Description of Artificial Sequence: Synthetic peptide
DEEEIRTTNPVATEQYGSVSTNLQIIGNR

SEQ ID NO: 1381 - protein, 29 aa, Artificial Sequence
  Description of Artificial Sequence: Synthetic peptide
DEEEIRTTNPVATEQYGSVSTNLDRGNPR

SEQ ID NO: 1382 - protein, 28 aa, Artificial Sequence
  Description of Artificial Sequence: Synthetic peptide
DEEEIRTTNPCATEQYGSVSTNLQRENR

SEQ ID NO: 1383 - protein, 28 aa, Artificial Sequence
  Description of Artificial Sequence: Synthetic peptide
DEEEIRTTNIVATEQYGSVSTNLQRGNF

SEQ ID NO: 1384 - protein, 29 aa, Artificial Sequence
  Description of Artificial Sequence: Synthetic peptide
DEEEIRTTNPVATEQYGSVSTNLQRNGND

SEQ ID NO: 1385 - protein, 28 aa, Artificial Sequence
  Description of Artificial Sequence: Synthetic peptide
DEEEIRTTNPVATEQYGCVSTNLQRGND

SEQ ID NO: 1386 - protein, 28 aa, Artificial Sequence
  Description of Artificial Sequence: Synthetic peptide
DEEEIRTTNPVATQQYGSVSTNPQRGNR

SEQ ID NO: 1387 - protein, 29 aa, Artificial Sequence
  Description of Artificial Sequence: Synthetic peptide
DEEEIRTTNPVATEQYGSVSVENLQRGNR

SEQ ID NO: 1388 - protein, 29 aa, Artificial Sequence
  Description of Artificial Sequence: Synthetic peptide
DEEEIRTTNPVATEQYGSVSCTNLQSGNR

SEQ ID NO: 1389 - protein, 29 aa, Artificial Sequence
  Description of Artificial Sequence: Synthetic peptide
GEEEIRTTNPVATEQYGSVSTNLQLRGNR

SEQ ID NO: 1390 - protein, 29 aa, Artificial Sequence
  Description of Artificial Sequence: Synthetic peptide
DEEEIRTTNPVATEQYGSVSDTNLQRGDR

SEQ ID NO: 1391 - protein, 28 aa, Artificial Sequence
  Description of Artificial Sequence: Synthetic peptide
DEEEIRTTNIVATEQYGSVSTNLQRGNG

SEQ ID NO: 1392 - protein, 28 aa, Artificial Sequence
  Description of Artificial Sequence: Synthetic peptide
MEEEIRTTNPVATEQYGSVSTELQRGNR

SEQ ID NO: 1393 - protein, 28 aa, Artificial Sequence
  Description of Artificial Sequence: Synthetic peptide
VEEEIRTTNPVATEQYGSVSTNLQRGND

SEQ ID NO: 1394 - protein, 28 aa, Artificial Sequence
  Description of Artificial Sequence: Synthetic peptide
DEEEIYTTNPVATEQYGSVSTNLQRGNH

SEQ ID NO: 1395 - protein, 29 aa, Artificial Sequence
  Description of Artificial Sequence: Synthetic peptide
DEEEIRTTNPVATEQYGSVSTNDQREGNR

SEQ ID NO: 1396 - protein, 28 aa, Artificial Sequence
  Description of Artificial Sequence: Synthetic peptide
DEEEISTTNPVATMQYGSVSTNLQRGNR

SEQ ID NO: 1397 - protein, 28 aa, Artificial Sequence
  Description of Artificial Sequence: Synthetic peptide
DEEEIRTTNPVASEQYGSVPTNLQRGNR

SEQ ID NO: 1398 - protein, 29 aa, Artificial Sequence
  Description of Artificial Sequence: Synthetic peptide
DEEEIRTTNPVATECYGSVSTNLQRGLNR

SEQ ID NO: 1399 - protein, 29 aa, Artificial Sequence
  Description of Artificial Sequence: Synthetic peptide
DEEEICTTNPVATEQYGSVSTNLQDRGNR

SEQ ID NO: 1400 - protein, 30 aa, Artificial Sequence
  Description of Artificial Sequence: Synthetic polypeptide
DEEEIRTTNPVATEQYGSVSTANLQLRGNR

SEQ ID NO: 1401 - protein, 29 aa, Artificial Sequence
  Description of Artificial Sequence: Synthetic peptide
DEEEIRTTNPVATEQYGSSSTNLVQRGNR

SEQ ID NO: 1402 - protein, 29 aa, Artificial Sequence
  Description of Artificial Sequence: Synthetic peptide
DEEEIRTTNPVATEQYGDVSTMNLQRGNR

SEQ ID NO: 1403 - protein, 28 aa, Artificial Sequence
  Description of Artificial Sequence: Synthetic peptide
DEEEVRTTNPVATEQYGSVSTNLQRGER

SEQ ID NO: 1404 - protein, 29 aa, Artificial Sequence
  Description of Artificial Sequence: Synthetic peptide
DEEEIRTTNPVATEQYGSVSANNLQRGNR

SEQ ID NO: 1405 - protein, 28 aa, Artificial Sequence
  Description of Artificial Sequence: Synthetic peptide
DEEEIRTTNPVATEQYGSVSTNLLRGNQ

SEQ ID NO: 1406 - protein, 28 aa, Artificial Sequence
  Description of Artificial Sequence: Synthetic peptide
DEEEIRTTNPVATEQYGSVSTNEQRGNG

SEQ ID NO: 1407 - protein, 29 aa, Artificial Sequence
  Description of Artificial Sequence: Synthetic peptide
DEEEIRTTNPVATEQYGSVSTVNLQRGNH

SEQ ID NO: 1408 - protein, 29 aa, Artificial Sequence
  Description of Artificial Sequence: Synthetic peptide
DEEEIRTTNPVATEQYGSVSTNLPQRGER

SEQ ID NO: 1409 - protein, 28 aa, Artificial Sequence
  Description of Artificial Sequence: Synthetic peptide
DEEEIRTTNPVATEQYGGVSTNLQRGPR

SEQ ID NO: 1410 - protein, 28 aa, Artificial Sequence
  Description of Artificial Sequence: Synthetic peptide
DESEIRTTNPCATEQYGSVSTNLQRGNR

SEQ ID NO: 1411 - protein, 28 aa, Artificial Sequence
  Description of Artificial Sequence: Synthetic peptide
DEEEIRTTNPIATEQYGSVSTNLERGNR

SEQ ID NO: 1412 - protein, 28 aa, Artificial Sequence
  Description of Artificial Sequence: Synthetic peptide
DEEEIRTTNPVATEQYGSVSTNLQGGNQ

SEQ ID NO: 1413 - protein, 29 aa, Artificial Sequence
  Description of Artificial Sequence: Synthetic peptide
DEEEIRTTNPVATEQYGSVSTNPLQLGNR

SEQ ID NO: 1414 - protein, 30 aa, Artificial Sequence
  Description of Artificial Sequence: Synthetic polypeptide
DEEEIRTTNPVATEQYGSVSTNNLQQRGNR

SEQ ID NO: 1415 - protein, 30 aa, Artificial Sequence
  Description of Artificial Sequence: Synthetic polypeptide
DEEEIRTTNPVATEQYGSVSTMNLQRGNTR

SEQ ID NO: 1416 - protein, 29 aa, Artificial Sequence
  Description of Artificial Sequence: Synthetic peptide
DEEEIRTTNPVATWQYGSVSTNLQQRGNR

SEQ ID NO: 1417 - protein, 28 aa, Artificial Sequence
  Description of Artificial Sequence: Synthetic peptide
DEEEIRTTNPVATEQYGSVSTNLQMGNI

SEQ ID NO: 1418 - protein, 29 aa, Artificial Sequence
  Description of Artificial Sequence: Synthetic peptide
DEEEIRTTNPVATEQYGSVSTNLQRGNDI

SEQ ID NO: 1419 - protein, 29 aa, Artificial Sequence
  Description of Artificial Sequence: Synthetic peptide
DEEEIRTTNPVATEQYWSVSTNLQREGNR

SEQ ID NO: 1420 - protein, 28 aa, Artificial Sequence
  Description of Artificial Sequence: Synthetic peptide
DEEEIKTTNPVATEQYGSASTNLQRGNR

SEQ ID NO: 1421 - protein, 28 aa, Artificial Sequence
  Description of Artificial Sequence: Synthetic peptide
DEEEIRTTNPIATEQYGSVSTNLQRGNL

SEQ ID NO: 1422 - protein, 28 aa, Artificial Sequence
  Description of Artificial Sequence: Synthetic peptide
DEQEIRTTNPVATENYGSVSTNLQRGNR

SEQ ID NO: 1423 - protein, 28 aa, Artificial Sequence
  Description of Artificial Sequence: Synthetic peptide
DEEEIRTTNPVATEQYGSVSTNLQVGNS

SEQ ID NO: 1424 - protein, 28 aa, Artificial Sequence
  Description of Artificial Sequence: Synthetic peptide
DEEEIRTTNPVATEQYGSVSTNLQRGTF

SEQ ID NO: 1425 - protein, 28 aa, Artificial Sequence
  Description of Artificial Sequence: Synthetic peptide
DEEEIRTTNPVSTEMYGSVSTNLQRGNR

SEQ ID NO: 1426 - protein, 28 aa, Artificial Sequence
  Description of Artificial Sequence: Synthetic peptide
DEEEIRTTNPVATEQYGDTSTNLQRGNR

SEQ ID NO: 1427 - protein, 28 aa, Artificial Sequence
  Description of Artificial Sequence: Synthetic peptide
DEEEIRTTNPVATEQYGSVWTNLQRGNH

SEQ ID NO: 1428 - protein, 28 aa, Artificial Sequence
  Description of Artificial Sequence: Synthetic peptide
DEEEIRTTNPVATEGYGSVSDNLQRGNR

SEQ ID NO: 1429 - protein, 28 aa, Artificial Sequence
  Description of Artificial Sequence: Synthetic peptide
KEEEIRTTNPVATEQYGSVSTNLQVGNR

SEQ ID NO: 1430 - protein, 28 aa, Artificial Sequence
  Description of Artificial Sequence: Synthetic peptide
DEEEIRTTNPVATEQYGSVSTNGQRGNP

SEQ ID NO: 1431 - protein, 28 aa, Artificial Sequence
  Description of Artificial Sequence: Synthetic peptide
DEEEIRTTNPVATEQYGSVSTNLQGGNL

SEQ ID NO: 1432 - protein, 30 aa, Artificial Sequence
  Description of Artificial Sequence: Synthetic polypeptide
DEEEIRTTNPVATEQYGSVSTNGLQRGNDR

SEQ ID NO: 1433 - protein, 28 aa, Artificial Sequence
  Description of Artificial Sequence: Synthetic peptide
DEEEIRTTNPVATEQYGDVSTNLQRGDR

SEQ ID NO: 1434 - protein, 28 aa, Artificial Sequence
  Description of Artificial Sequence: Synthetic peptide
DEAEIRTTNPVATEQYGSVSTNLQNGNR

SEQ ID NO: 1435 - protein, 28 aa, Artificial Sequence
  Description of Artificial Sequence: Synthetic peptide
HEEEIRTTNPVATEQYGSVSTNEQRGNR

SEQ ID NO: 1436 - protein, 28 aa, Artificial Sequence
  Description of Artificial Sequence: Synthetic peptide
DEEEIRTVNPVATEQYGSVSTNLQRGDR

SEQ ID NO: 1437 - protein, 29 aa, Artificial Sequence
  Description of Artificial Sequence: Synthetic peptide
DEEEIRTTNPVATEQCGSVSTGNLQRGNR

SEQ ID NO: 1438 - protein, 29 aa, Artificial Sequence
  Description of Artificial Sequence: Synthetic peptide
DEEEIRTTNPVATEQYGSVSTFNLQRGNA

SEQ ID NO: 1439 - protein, 28 aa, Artificial Sequence
  Description of Artificial Sequence: Synthetic peptide
DEEEIRTTNPTATEQYGSVSTNLQVGNR

SEQ ID NO: 1440 - protein, 28 aa, Artificial Sequence
  Description of Artificial Sequence: Synthetic peptide
DESEIRTTNPVATEGYGSVSTNLQRGNR

SEQ ID NO: 1441 - protein, 28 aa, Artificial Sequence
  Description of Artificial Sequence: Synthetic peptide
HEEEIRTTNPVATEQYGSVSNNLQRGNR

SEQ ID NO: 1442 - protein, 28 aa, Artificial Sequence
  Description of Artificial Sequence: Synthetic peptide
DEEMIRTTNPVATEQYGSVSTNLQPGNR

SEQ ID NO: 1443 - protein, 28 aa, Artificial Sequence
  Description of Artificial Sequence: Synthetic peptide
SEEEIRTTNPVATEQYGSVSTNLQGGNR

SEQ ID NO: 1444 - protein, 28 aa, Artificial Sequence
  Description of Artificial Sequence: Synthetic peptide
DEEEIRTTNPVSTEQYGSVSTNLQRGVR

SEQ ID NO: 1445 - protein, 28 aa, Artificial Sequence
  Description of Artificial Sequence: Synthetic peptide
DEEEIRTTNPVAYEQYASVSTNLQRGNR

SEQ ID NO: 1446 - protein, 28 aa, Artificial Sequence
  Description of Artificial Sequence: Synthetic peptide
DEEEIRTTNPCATEQYGSVSTNLQRLNR

SEQ ID NO: 1447 - protein, 28 aa, Artificial Sequence
  Description of Artificial Sequence: Synthetic peptide
DEEEIRTTNPDATELYGSVSTNLQRGNR

SEQ ID NO: 1448 - protein, 29 aa, Artificial Sequence
  Description of Artificial Sequence: Synthetic peptide
DEEEIRTTNPVATEQYGSVSTENLQYGNR

SEQ ID NO: 1449 - protein, 28 aa, Artificial Sequence
  Description of Artificial Sequence: Synthetic peptide
DEEEIRTTNPVATEQYGSVSTNLQVGNT

SEQ ID NO: 1450 - protein, 29 aa, Artificial Sequence
  Description of Artificial Sequence: Synthetic peptide
DEEEIRTTNPVATEQYGSVSTNLQDDGNR

SEQ ID NO: 1451 - protein, 28 aa, Artificial Sequence
  Description of Artificial Sequence: Synthetic peptide
DEEEIRSTNPDATEQYGSVSTNLQRGNR

SEQ ID NO: 1452 - protein, 28 aa, Artificial Sequence
  Description of Artificial Sequence: Synthetic peptide
DEEEIRTTNPVATEQYGSVSTNLQHGER

SEQ ID NO: 1453 - protein, 28 aa, Artificial Sequence
  Description of Artificial Sequence: Synthetic peptide
DEVEIRTTNPVATEQYGSVSTNLQRGNF

SEQ ID NO: 1454 - protein, 28 aa, Artificial Sequence
  Description of Artificial Sequence: Synthetic peptide
DEEEIRTVNPVATEQYGSVSMNLQRGNR

SEQ ID NO: 1455 - protein, 29 aa, Artificial Sequence
  Description of Artificial Sequence: Synthetic peptide
VEEEIRTTNPVATEQYGSVDSTNLQRGNR

SEQ ID NO: 1456 - protein, 28 aa, Artificial Sequence
  Description of Artificial Sequence: Synthetic peptide
DEEEIRTTNPVSTEQYGIVSTNLQRGNR

SEQ ID NO: 1457 - protein, 28 aa, Artificial Sequence
  Description of Artificial Sequence: Synthetic peptide
DEEEIRTTNPVATEQWGSVDTNLQRGNR

SEQ ID NO: 1458 - protein, 28 aa, Artificial Sequence
  Description of Artificial Sequence: Synthetic peptide
DEDEIRTTNPVATEQYGWVSTNLQRGNR

SEQ ID NO: 1459 - protein, 28 aa, Artificial Sequence
  Description of Artificial Sequence: Synthetic peptide
DESEIRTTNPVATEQYGSVSTELQRGNR

SEQ ID NO: 1460 - protein, 28 aa, Artificial Sequence
  Description of Artificial Sequence: Synthetic peptide
DEEEIRTTNPVATEQYGSVSTNLQRGED

SEQ ID NO: 1461 - protein, 29 aa, Artificial Sequence
  Description of Artificial Sequence: Synthetic peptide
DEEEIRTTNPVATEQYGESVSTDLQRGNR

SEQ ID NO: 1462 - protein, 29 aa, Artificial Sequence
  Description of Artificial Sequence: Synthetic peptide
DEEEIRTTNPVATEQYGSVSTPNLLRGNR

SEQ ID NO: 1463 - protein, 29 aa, Artificial Sequence
  Description of Artificial Sequence: Synthetic peptide
DEEETRTTNPVATEQYGSVSTENLQRGNR

SEQ ID NO: 1464 - protein, 29 aa, Artificial Sequence
  Description of Artificial Sequence: Synthetic peptide
DEEEIRTTNPVATECYGSVDSTNLQRGNR

SEQ ID NO: 1465 - protein, 28 aa, Artificial Sequence
  Description of Artificial Sequence: Synthetic peptide
DEIEIRTTNPCATEQYGSVSTNLQRGNR

SEQ ID NO: 1466 - protein, 28 aa, Artificial Sequence
  Description of Artificial Sequence: Synthetic peptide
DEEEIVTTNPVATEQYGSVSTNLQRGGR

SEQ ID NO: 1467 - protein, 28 aa, Artificial Sequence
  Description of Artificial Sequence: Synthetic peptide
DEEEIRTTNPVATEQYGWVSTNLDRGNR

SEQ ID NO: 1468 - protein, 28 aa, Artificial Sequence
  Description of Artificial Sequence: Synthetic peptide
MEEEIRTTNPVATEQYGSVSTNLQRGNH

SEQ ID NO: 1469 - protein, 28 aa, Artificial Sequence
  Description of Artificial Sequence: Synthetic peptide
DEEEIMTTNPVSTEQYGSVSTNLQRGNR

SEQ ID NO: 1470 - protein, 28 aa, Artificial Sequence
  Description of Artificial Sequence: Synthetic peptide
DEEEIRTTNPTATEQYGSVSTNLQRGNG

SEQ ID NO: 1471 - protein, 30 aa, Artificial Sequence
  Description of Artificial Sequence: Synthetic polypeptide
DEEEIRTTNPVATEQYGSYVSTPNLQRGNR

SEQ ID NO: 1472 - protein, 28 aa, Artificial Sequence
  Description of Artificial Sequence: Synthetic peptide
DEEEIRTTNPVATEIYGSVSTNLQTGNR

SEQ ID NO: 1473 - protein, 28 aa, Artificial Sequence
  Description of Artificial Sequence: Synthetic peptide
DEEEIRTTNPVATEQYGSVSTALQRGER

SEQ ID NO: 1474 - protein, 28 aa, Artificial Sequence
  Description of Artificial Sequence: Synthetic peptide
DEEEIRTTNPVATEQYGSVSVNLQRGDR

SEQ ID NO: 1475 - protein, 28 aa, Artificial Sequence
  Description of Artificial Sequence: Synthetic peptide
DENEIRTTNPVATEQYGSVWTNLQRGNR

SEQ ID NO: 1476 - protein, 29 aa, Artificial Sequence
  Description of Artificial Sequence: Synthetic peptide
DEEEIRTTNPFATEQYGSVSTNLTQRGNR

SEQ ID NO: 1477 - protein, 28 aa, Artificial Sequence
  Description of Artificial Sequence: Synthetic peptide
YEEEIRTVNPVATEQYGSVSTNLQRGNR

SEQ ID NO: 1478 - protein, 28 aa, Artificial Sequence
  Description of Artificial Sequence: Synthetic peptide
DEEEIRTTNPVATEQYGSVSTNLQQGNE

SEQ ID NO: 1479 - protein, 29 aa, Artificial Sequence
  Description of Artificial Sequence: Synthetic peptide
DEEEIRTTNPVATEQYGSVSTDLQREGNR

SEQ ID NO: 1480 - protein, 29 aa, Artificial Sequence
  Description of Artificial Sequence: Synthetic peptide
DEEEIRTTNPVATEQYGSVSTNPQRGNWR

SEQ ID NO: 1481 - protein, 29 aa, Artificial Sequence
  Description of Artificial Sequence: Synthetic peptide
DEEEIRTTNPVATEQYGSVSTMNLQIGNR

SEQ ID NO: 1482 - protein, 28 aa, Artificial Sequence
  Description of Artificial Sequence: Synthetic peptide
DEEEIRTTNPVATEQYGSVSENLPRGNR

SEQ ID NO: 1483 - protein, 28 aa, Artificial Sequence
  Description of Artificial Sequence: Synthetic peptide
DEEEIRTTNPVATELYGSVSTNIQRGNR

SEQ ID NO: 1484 - protein, 28 aa, Artificial Sequence
  Description of Artificial Sequence: Synthetic peptide
DEEEIRTTNPVATEQYGSVSTNLQSGNM

SEQ ID NO: 1485 - protein, 30 aa, Artificial Sequence
  Description of Artificial Sequence: Synthetic polypeptide
DEEEIRTTNPVATEQYGSVSETNLQRGDNR

SEQ ID NO: 1486 - protein, 28 aa, Artificial Sequence
  Description of Artificial Sequence: Synthetic peptide
DEEEIRTTNPVATEQYGSVSTNLQTGNH

SEQ ID NO: 1487 - protein, 28 aa, Artificial Sequence
  Description of Artificial Sequence: Synthetic peptide
DEEEIRTTNPVATEQYGSVETNLQRGDR

SEQ ID NO: 1488 - protein, 28 aa, Artificial Sequence
  Description of Artificial Sequence: Synthetic peptide
DEEEIRTTNPVATEQYGSVSTNLWRGNM

SEQ ID NO: 1489 - protein, 28 aa, Artificial Sequence
  Description of Artificial Sequence: Synthetic peptide
DEEEIRATNPVATEHYGSVSTNLQRGNR

SEQ ID NO: 1490 - protein, 28 aa, Artificial Sequence
  Description of Artificial Sequence: Synthetic peptide
DEEEIRTTNPVATELYGSVSTNLLRGNR

SEQ ID NO: 1491 - protein, 28 aa, Artificial Sequence
  Description of Artificial Sequence: Synthetic peptide
QESEIRTTNPVATEQYGSVSTNLQRGNR

SEQ ID NO: 1492 - protein, 28 aa, Artificial Sequence
  Description of Artificial Sequence: Synthetic peptide
DEEEIRTTNPVATEQYGSVDTNLQQGNR

SEQ ID NO: 1493 - protein, 29 aa, Artificial Sequence
  Description of Artificial Sequence: Synthetic peptide
DEEEIRTTNPVATEQYGSVSTNLQMGENR

SEQ ID NO: 1494 - protein, 28 aa, Artificial Sequence
  Description of Artificial Sequence: Synthetic peptide
DEEEIRTTNPVATEQYGSVSTNLQRGEM

SEQ ID NO: 1495 - protein, 30 aa, Artificial Sequence
  Description of Artificial Sequence: Synthetic polypeptide
DEEEIRTTNPVATEQYGSVSTQNLQSRGNR

SEQ ID NO: 1496 - protein, 28 aa, Artificial Sequence
  Description of Artificial Sequence: Synthetic peptide
DEEELRTTNPVATEQYGSVSMNLQRGNR

SEQ ID NO: 1497 - protein, 28 aa, Artificial Sequence
  Description of Artificial Sequence: Synthetic peptide
DEEEIRTTNPVATEQYGSVSTNLERGNA

SEQ ID NO: 1498 - protein, 28 aa, Artificial Sequence
  Description of Artificial Sequence: Synthetic peptide
DEEEIRQTNPVATEQYGSVSTGLQRGNR

SEQ ID NO: 1499 - protein, 30 aa, Artificial Sequence
  Description of Artificial Sequence: Synthetic polypeptide
DEEEIRTTNPVATEQYGSVSTNLQERGGNR

SEQ ID NO: 1500 - protein, 28 aa, Artificial Sequence
  Description of Artificial Sequence: Synthetic peptide
SEEEIRTTNPVATEQYGSVSTNLQRGDR

SEQ ID NO: 1501 - protein, 28 aa, Artificial Sequence
  Description of Artificial Sequence: Synthetic peptide
DEEEIRTTNPDATEQYGSVSTNLIRGNR

SEQ ID NO: 1502 - protein, 28 aa, Artificial Sequence
  Description of Artificial Sequence: Synthetic peptide
DEEEIRTTNPVATEQYGSVSTNLERGNE

SEQ ID NO: 1503 - protein, 29 aa, Artificial Sequence
  Description of Artificial Sequence: Synthetic peptide
DEEVIRTTNPVATEQYGSCVSTNLQRGNR

SEQ ID NO: 1504 - protein, 28 aa, Artificial Sequence
  Description of Artificial Sequence: Synthetic peptide
DEEEIRTTNPVAVELYGSVSTNLQRGNR

SEQ ID NO: 1505 - protein, 28 aa, Artificial Sequence
  Description of Artificial Sequence: Synthetic peptide
DEEEIRTTNPVSTEQYGSVSTNLQMGNR

SEQ ID NO: 1506 - protein, 29 aa, Artificial Sequence
  Description of Artificial Sequence: Synthetic peptide
DEEEIRTTNPVATEQYGSVSENLQRGINR

SEQ ID NO: 1507 - protein, 29 aa, Artificial Sequence
  Description of Artificial Sequence: Synthetic peptide
DEEEIRTTNPVATEQYGSSVSTNLQRGDR

SEQ ID NO: 1508 - protein, 28 aa, Artificial Sequence
  Description of Artificial Sequence: Synthetic peptide
DEEEIRTTNPVATEQYGSVSMNIQRGNR

SEQ ID NO: 1509 - protein, 29 aa, Artificial Sequence
  Description of Artificial Sequence: Synthetic peptide
DEEEIRTTNPTATEQYGSVSTNLQDRGNR

SEQ ID NO: 1510 - protein, 28 aa, Artificial Sequence
  Description of Artificial Sequence: Synthetic peptide
DEEEITTTNPVSTEQYGSVSTNLQRGNR

SEQ ID NO: 1511 - protein, 29 aa, Artificial Sequence
  Description of Artificial Sequence: Synthetic peptide
DEEEIRTTNPVATEQYGSVSDTNLQRGER

SEQ ID NO: 1512 - protein, 30 aa, Artificial Sequence
  Description of Artificial Sequence: Synthetic polypeptide
DEEEIRTTNPVATEQYGSVTSTNLQQRGNR

SEQ ID NO: 1513 - protein, 28 aa, Artificial Sequence
  Description of Artificial Sequence: Synthetic peptide
DEEEIRTTNPVASEQYGSVSTNLQRGMR

SEQ ID NO: 1514 - protein, 29 aa, Artificial Sequence
  Description of Artificial Sequence: Synthetic peptide
DEEEIRTTNPVATEQYGSYSETNLQRGNR

SEQ ID NO: 1515 - protein, 29 aa, Artificial Sequence
  Description of Artificial Sequence: Synthetic peptide
DEEEIRTTNPVATEQYGSYVSTNLQRGNP

SEQ ID NO: 1516 - protein, 29 aa, Artificial Sequence
  Description of Artificial Sequence: Synthetic peptide
DEEEIRTTNPVATEQYGSVSTNLQRGEDR

SEQ ID NO: 1517 - protein, 28 aa, Artificial Sequence
  Description of Artificial Sequence: Synthetic peptide
DEEEIRTTNPVATEQYGSVSTCLQRGNI

SEQ ID NO: 1518 - protein, 29 aa, Artificial Sequence
  Description of Artificial Sequence: Synthetic peptide
DEEEIRTTNPVATEQYGSVSTNLMLRGNR

SEQ ID NO: 1519 - protein, 28 aa, Artificial Sequence
  Description of Artificial Sequence: Synthetic peptide
DEEEIRTTNPVATEQYGSVSTNLQMGER

SEQ ID NO: 1520 - protein, 29 aa, Artificial Sequence
  Description of Artificial Sequence: Synthetic peptide
DEEEIRTTNPVATEQYGSVCETNLQRGNR

SEQ ID NO: 1521 - protein, 28 aa, Artificial Sequence
  Description of Artificial Sequence: Synthetic peptide
DEEEIRTTNPVATEQYGSVGTNLQRGNM

SEQ ID NO: 1522 - protein, 28 aa, Artificial Sequence
  Description of Artificial Sequence: Synthetic peptide
MEEEIRTTNPVATEQYGSVSTNLQRGLR

SEQ ID NO: 1523 - protein, 28 aa, Artificial Sequence
  Description of Artificial Sequence: Synthetic peptide
DEEEIRTTNPVATEQYGSVSTNLQSGNI

SEQ ID NO: 1524 - protein, 30 aa, Artificial Sequence
  Description of Artificial Sequence: Synthetic polypeptide
DEEEIRTTNPVATEQYGSVSTNLTQRLGNR

SEQ ID NO: 1525 - protein, 28 aa, Artificial Sequence
  Description of Artificial Sequence: Synthetic peptide
DEEEIRTTNPVAMEQYGSVSTNLQIGNR

SEQ ID NO: 1526 - protein, 30 aa, Artificial Sequence
  Description of Artificial Sequence: Synthetic polypeptide
DEEEIRTTNPVATEQYGSVSITNLQRGVNR

SEQ ID NO: 1527 - protein, 29 aa, Artificial Sequence
  Description of Artificial Sequence: Synthetic peptide
DEEEIRTTNPVATEQYGQVSVTNLQRGNR

SEQ ID NO: 1528 - protein, 28 aa, Artificial Sequence
  Description of Artificial Sequence: Synthetic peptide
DEQEIRTTNPVATEQYGSMSTNLQRGNR

SEQ ID NO: 1529 - protein, 28 aa, Artificial Sequence
  Description of Artificial Sequence: Synthetic peptide
NEEEIRTTNPVCTEQYGSVSTNLQRGNR

SEQ ID NO: 1530 - protein, 28 aa, Artificial Sequence
  Description of Artificial Sequence: Synthetic peptide
DEEEIYTTNPVATEQYGSVSTNLQLGNR

SEQ ID NO: 1531 - protein, 29 aa, Artificial Sequence
  Description of Artificial Sequence: Synthetic peptide
DEEEIRSTNPVATEQYGSVSETNLQRGNR

SEQ ID NO: 1532 - protein, 29 aa, Artificial Sequence
  Description of Artificial Sequence: Synthetic peptide
DECEIRTTNPVATEQYGSVSTNLQRAGNR

SEQ ID NO: 1533 - protein, 28 aa, Artificial Sequence
  Description of Artificial Sequence: Synthetic peptide
DENEIRTTNPVATEQYGSYSTNLQRGNR

SEQ ID NO: 1534 - protein, 28 aa, Artificial Sequence
  Description of Artificial Sequence: Synthetic peptide
DEEEIRTTNPVATEQYGSVSTNLERGNM

SEQ ID NO: 1535 - protein, 29 aa, Artificial Sequence
  Description of Artificial Sequence: Synthetic peptide
DEEEIRSTNPVATEQYGSVSTNLQRGENR

SEQ ID NO: 1536 - protein, 28 aa, Artificial Sequence
  Description of Artificial Sequence: Synthetic peptide
DEEEIRTTNPVATEQYGSVSTNLQTENR

SEQ ID NO: 1537 - protein, 29 aa, Artificial Sequence
  Description of Artificial Sequence: Synthetic peptide
DEEEIRTTNPVATEQYGSVISTNPQRGNR

SEQ ID NO: 1538 - protein, 28 aa, Artificial Sequence
  Description of Artificial Sequence: Synthetic peptide
DEECIRTTNPVATEQYGSVSTNLQDGNR

SEQ ID NO: 1539 - protein, 30 aa, Artificial Sequence
  Description of Artificial Sequence: Synthetic polypeptide
DEEEIRTTNPVATEQYGSVSTNLQRDGNDR

SEQ ID NO: 1540 - protein, 28 aa, Artificial Sequence
  Description of Artificial Sequence: Synthetic peptide
DEEEIRTTNPVATEQYGDVSTNLQNGNR

SEQ ID NO: 1541 - protein, 29 aa, Artificial Sequence
  Description of Artificial Sequence: Synthetic peptide
DEEEIRTTNPFATEQYGSVSTNLQRGVNR

SEQ ID NO: 1542 - protein, 28 aa, Artificial Sequence
  Description of Artificial Sequence: Synthetic peptide
DEEEIRTTNPVATEVYGSTSTNLQRGNR

SEQ ID NO: 1543 - protein, 29 aa, Artificial Sequence
  Description of Artificial Sequence: Synthetic peptide
DEEEIRTTNPVATEQYGSVSENLVQRGNR

SEQ ID NO: 1544 - protein, 28 aa, Artificial Sequence
  Description of Artificial Sequence: Synthetic peptide
DEEEIRTTNPVATEQYGSVSTNLNRGNL

SEQ ID NO: 1545 - protein, 29 aa, Artificial Sequence
  Description of Artificial Sequence: Synthetic peptide
DEEEIRTTNPVATEQYGSVSTMNLQRGNI

SEQ ID NO: 1546 - protein, 28 aa, Artificial Sequence
  Description of Artificial Sequence: Synthetic peptide
DEEEIRTTNPVATEQYGTVSTELQRGNR

SEQ ID NO: 1547 - protein, 28 aa, Artificial Sequence
  Description of Artificial Sequence: Synthetic peptide
DEEEIRTTNPVATEQYGSVSTELCRGNR

SEQ ID NO: 1548 - protein, 28 aa, Artificial Sequence
  Description of Artificial Sequence: Synthetic peptide
DEEEIRSTNPVATEQYGSVSTNLQRGNK

SEQ ID NO: 1549 - protein, 28 aa, Artificial Sequence
  Description of Artificial Sequence: Synthetic peptide
DEEEIRTTNPVATEQYGSVSTNLQGGNF

SEQ ID NO: 1550 - protein, 28 aa, Artificial Sequence
  Description of Artificial Sequence: Synthetic peptide
DEEEIRTTNPVATEQYGVNSTNLQRGNR

SEQ ID NO: 1551 - protein, 28 aa, Artificial Sequence
  Description of Artificial Sequence: Synthetic peptide
DEEEIRTTNPVATEQYGSVSTNLQRGDM

SEQ ID NO: 1552 - protein, 28 aa, Artificial Sequence
  Description of Artificial Sequence: Synthetic peptide
DEEEIRTTNPVATEPYGSVSTGLQRGNR

SEQ ID NO: 1553 - protein, 28 aa, Artificial Sequence
  Description of Artificial Sequence: Synthetic peptide
DEEEIRTTNPVATEQYGSVSTDLQVGNR

SEQ ID NO: 1554 - protein, 30 aa, Artificial Sequence
  Description of Artificial Sequence: Synthetic polypeptide
DEEEIRTTNPVATEQYGSVSATNLQREGNR

SEQ ID NO: 1555 - protein, 28 aa, Artificial Sequence
  Description of Artificial Sequence: Synthetic peptide
DEEEIRTTNPVATEQYGSVSTNLQRGDV

SEQ ID NO: 1556 - protein, 28 aa, Artificial Sequence
  Description of Artificial Sequence: Synthetic peptide
DEEEIRTTNPVATEQYGSVSTNLQVGNE

SEQ ID NO: 1557 - protein, 29 aa, Artificial Sequence
  Description of Artificial Sequence: Synthetic peptide
DEEEIRTTNPVATEQYGSVSTMNLQRGNS

SEQ ID NO: 1558 - protein, 28 aa, Artificial Sequence
  Description of Artificial Sequence: Synthetic peptide
DEEEIRTTNPVSTEQYGSVSTNLQRGDR

SEQ ID NO: 1559 - protein, 28 aa, Artificial Sequence
  Description of Artificial Sequence: Synthetic peptide
DEEEIRTTNPVATEQYGSVSTNDQRGNG

SEQ ID NO: 1560 - protein, 29 aa, Artificial Sequence
  Description of Artificial Sequence: Synthetic peptide
DEEEIRTTNPVATEQYGSVSTNLQVEGNR

SEQ ID NO: 1561 - protein, 28 aa, Artificial Sequence
  Description of Artificial Sequence: Synthetic peptide
VEEEIRTTNPVATEQYGSVGTNLQRGNR

SEQ ID NO: 1562 - protein, 28 aa, Artificial Sequence
  Description of Artificial Sequence: Synthetic peptide
GEEEIRTVNPVATEQYGSVSTNLQRGNR

SEQ ID NO: 1563 - protein, 29 aa, Artificial Sequence
  Description of Artificial Sequence: Synthetic peptide
DEEEIRTTNPVATEQCYGSVSTNLQDGNR

SEQ ID NO: 1564 - protein, 28 aa, Artificial Sequence
  Description of Artificial Sequence: Synthetic peptide
DEEEIATTNPVATEQYGVVSTNLQRGNR

SEQ ID NO: 1565 - protein, 28 aa, Artificial Sequence
  Description of Artificial Sequence: Synthetic peptide
DEEEIRTTNPVATEQYGSVSTLLQRGER

SEQ ID NO: 1566 - protein, 28 aa, Artificial Sequence
  Description of Artificial Sequence: Synthetic peptide
DEEEIRTTNPVATEQYGSVSTNLLEGNR

SEQ ID NO: 1567 - protein, 28 aa, Artificial Sequence
  Description of Artificial Sequence: Synthetic peptide
DEEEIRTTNPVATEQYGSVETNPQRGNR

SEQ ID NO: 1568 - protein, 28 aa, Artificial Sequence
  Description of Artificial Sequence: Synthetic peptide
DENEIRTTNPVATEQYGSVSTELQRGNR

SEQ ID NO: 1569 - protein, 28 aa, Artificial Sequence
  Description of Artificial Sequence: Synthetic peptide
DEEEIRTTNPVCTEVYGSVSTNLQRGNR

SEQ ID NO: 1570 - protein, 28 aa, Artificial Sequence
  Description of Artificial Sequence: Synthetic peptide
DEEEIGTTNPVATEQYGIVSTNLQRGNR

SEQ ID NO: 1571 - protein, 28 aa, Artificial Sequence
  Description of Artificial Sequence: Synthetic peptide
DEEEIRTTNPVATECYGIVSTNLQRGNR

SEQ ID NO: 1572 - protein, 28 aa, Artificial Sequence
  Description of Artificial Sequence: Synthetic peptide
DEQEIRTTNPEATEQYGSVSTNLQRGNR

SEQ ID NO: 1573 - protein, 28 aa, Artificial Sequence
  Description of Artificial Sequence: Synthetic peptide
DEIEIRTTNPVATEQYGSVSTNLQRGGR

SEQ ID NO: 1574 - protein, 28 aa, Artificial Sequence
  Description of Artificial Sequence: Synthetic peptide
DEEEIRTTNPVATEQYGTVGTNLQRGNR

SEQ ID NO: 1575 - protein, 28 aa, Artificial Sequence
  Description of Artificial Sequence: Synthetic peptide
DEEEIRTTNPVATEQYGCVSTNLQQGNR

SEQ ID NO: 1576 - protein, 28 aa, Artificial Sequence
  Description of Artificial Sequence: Synthetic peptide
DEYEIRTTNPVATEQYGSVSTNLQRINR

SEQ ID NO: 1577 - protein, 28 aa, Artificial Sequence
  Description of Artificial Sequence: Synthetic peptide
DEEEIRTTNPVATEQYGSVSTNLQFGDR

SEQ ID NO: 1578 - protein, 28 aa, Artificial Sequence
  Description of Artificial Sequence: Synthetic peptide
DEETIRTTNPVATEQYGSVSTNLQPGNR

SEQ ID NO: 1579 - protein, 28 aa, Artificial Sequence
  Description of Artificial Sequence: Synthetic peptide
DEQEIRTTNPVATEQYGSTSTNLQRGNR

SEQ ID NO: 1580 - protein, 28 aa, Artificial Sequence
  Description of Artificial Sequence: Synthetic peptide
DEEEIRSTNPVAVEQYGSVSTNLQRGNR

SEQ ID NO: 1581 - protein, 29 aa, Artificial Sequence
  Description of Artificial Sequence: Synthetic peptide
DEEEIRTTNPVATEQYGSVSTNVLHRGNR

SEQ ID NO: 1582 - protein, 28 aa, Artificial Sequence
  Description of Artificial Sequence: Synthetic peptide
DENEIRTTNPVATEQYGLVSTNLQRGNR

SEQ ID NO: 1583 - protein, 28 aa, Artificial Sequence
  Description of Artificial Sequence: Synthetic peptide
DEEEIRTTNPVASEMYGSVSTNLQRGNR

SEQ ID NO: 1584 - protein, 28 aa, Artificial Sequence
  Description of Artificial Sequence: Synthetic peptide
DEEEIRTTNPVATEQYGSVSTNLQYGER

SEQ ID NO: 1585 - protein, 28 aa, Artificial Sequence
  Description of Artificial Sequence: Synthetic peptide
DEEEIRTTNPVATEQYGAVSTNLERGNR

SEQ ID NO: 1586 - protein, 28 aa, Artificial Sequence
  Description of Artificial Sequence: Synthetic peptide
DEEEIRTTNPVATENYGSGSTNLQRGNR

SEQ ID NO: 1587 - protein, 29 aa, Artificial Sequence
  Description of Artificial Sequence: Synthetic peptide
DEEEIRTTNPVATEQYGSVSTNLVQRGND

SEQ ID NO: 1588 - protein, 28 aa, Artificial Sequence
  Description of Artificial Sequence: Synthetic peptide
DEEELRTTNPVATEQYGWVSTNLQRGNR

SEQ ID NO: 1589 - protein, 28 aa, Artificial Sequence
  Description of Artificial Sequence: Synthetic peptide
DEEEIRTTNPVATCQYGSVSTNLQQGNR

SEQ ID NO: 1590 - protein, 29 aa, Artificial Sequence
  Description of Artificial Sequence: Synthetic peptide
DEEEIRTTNPDATEQYGSVASTNLQRGNR

SEQ ID NO: 1591 - protein, 29 aa, Artificial Sequence
  Description of Artificial Sequence: Synthetic peptide
DEEEIRTTNPVATEQFGSVSTNLQRGINR

SEQ ID NO: 1592 - protein, 28 aa, Artificial Sequence
  Description of Artificial Sequence: Synthetic peptide
DEEEIRCTNPVYTEQYGSVSTNLQRGNR

SEQ ID NO: 1593 - protein, 28 aa, Artificial Sequence
  Description of Artificial Sequence: Synthetic peptide
DEEEIRTTNPEATEQYGSVSSNLQRGNR

SEQ ID NO: 1594 - protein, 30 aa, Artificial Sequence
  Description of Artificial Sequence: Synthetic polypeptide
DEEEIRTTNPVATEQYGSVSETENLQRGNR

SEQ ID NO: 1595 - protein, 29 aa, Artificial Sequence
  Description of Artificial Sequence: Synthetic peptide
DEEEIRTTNPVATEQYGSVTSTNLQRGER

SEQ ID NO: 1596 - protein, 28 aa, Artificial Sequence
  Description of Artificial Sequence: Synthetic peptide
DEEEIRTTNPVATEQYGSVSMNLQDGNR

SEQ ID NO: 1597 - protein, 28 aa, Artificial Sequence
  Description of Artificial Sequence: Synthetic peptide
LEEEIRTTNPVATEQYGSVSTNLQRGND

SEQ ID NO: 1598 - protein, 28 aa, Artificial Sequence
  Description of Artificial Sequence: Synthetic peptide
DEEEIRTCNPVATEQYGSVSTNLQYGNR

SEQ ID NO: 1599 - protein, 28 aa, Artificial Sequence
  Description of Artificial Sequence: Synthetic peptide
DEEEIRTTNPVATEQYGSVETNLQRENR

SEQ ID NO: 1600 - protein, 28 aa, Artificial Sequence
  Description of Artificial Sequence: Synthetic peptide
DEEEIRTTNPIATEQYGTVSTNLQRGNR

SEQ ID NO: 1601 - protein, 28 aa, Artificial Sequence
  Description of Artificial Sequence: Synthetic peptide
DEEEIRTTNPVATEQCGSVSTNDQRGNR

SEQ ID NO: 1602 - protein, 29 aa, Artificial Sequence
  Description of Artificial Sequence: Synthetic peptide
DEEEIRTTNPVATEQYWSVSDTNLQRGNR

SEQ ID NO: 1603 - protein, 28 aa, Artificial Sequence
  Description of Artificial Sequence: Synthetic peptide
DEEEIRTTNPVATEQYGSVSTELDRGNR

SEQ ID NO: 1604 - protein, 28 aa, Artificial Sequence
  Description of Artificial Sequence: Synthetic peptide
DEEEIRTTNPVATEQYGSVSTELQPGNR

SEQ ID NO: 1605 - protein, 28 aa, Artificial Sequence
  Description of Artificial Sequence: Synthetic peptide
DEEEIRSTNPVATEQYGSVSTNLQRGNI

SEQ ID NO: 1606 - protein, 29 aa, Artificial Sequence
  Description of Artificial Sequence: Synthetic peptide
DEEEIRTTNPVATEQYGSVSTNLQRGNDS

SEQ ID NO: 1607 - protein, 28 aa, Artificial Sequence
  Description of Artificial Sequence: Synthetic peptide
DEEEIRTTNPVATELYGSVSTNLQGGNR

SEQ ID NO: 1608 - protein, 29 aa, Artificial Sequence
  Description of Artificial Sequence: Synthetic peptide
DEEEIRTTNPVATEQYGSVSTNLQRNGER

SEQ ID NO: 1609 - protein, 28 aa, Artificial Sequence
  Description of Artificial Sequence: Synthetic peptide
DENEIRTTNPVATEQYGSVSMNLQRGNR

SEQ ID NO: 1610 - protein, 28 aa, Artificial Sequence
  Description of Artificial Sequence: Synthetic peptide
DEEEIRTTNPVATEQYGVVSTNLQRGNE

SEQ ID NO: 1611 - protein, 29 aa, Artificial Sequence
  Description of Artificial Sequence: Synthetic peptide
DEQEIRTTNPVATEQYGSVSTNLQMRGNR

SEQ ID NO: 1612 - protein, 29 aa, Artificial Sequence
  Description of Artificial Sequence: Synthetic peptide
DEEEIRTTNPVATEQYGSVSTNLQDRGNE

SEQ ID NO: 1613 - protein, 28 aa, Artificial Sequence
  Description of Artificial Sequence: Synthetic peptide
DEEEIRTTNPEATEQYGSVSTNLQRGNM

SEQ ID NO: 1614 - protein, 28 aa, Artificial Sequence
  Description of Artificial Sequence: Synthetic peptide
DEEEIRTTNPVATEQYGSVSTNLQAGNS

SEQ ID NO: 1615 - protein, 28 aa, Artificial Sequence
  Description of Artificial Sequence: Synthetic peptide
DEQEIRTTNPVATEQYGSVSTNLQRGAR

SEQ ID NO: 1616 - protein, 29 aa, Artificial Sequence
  Description of Artificial Sequence: Synthetic peptide
DEEEIRTTNPVATEQYGSVSTLNLQHGNR

SEQ ID NO: 1617 - protein, 29 aa, Artificial Sequence
  Description of Artificial Sequence: Synthetic peptide
YEEEIRTTNPVATEQYGSVSTNLQDRGNR

SEQ ID NO: 1618 - protein, 28 aa, Artificial Sequence
  Description of Artificial Sequence: Synthetic peptide
DEEEIRTTNPVATEQYGSVSDNLERGNR

SEQ ID NO: 1619 - protein, 29 aa, Artificial Sequence
  Description of Artificial Sequence: Synthetic peptide
EEEEIRTTNPVATEQYGSVSTNLQSRGNR

SEQ ID NO: 1620 - protein, 28 aa, Artificial Sequence
  Description of Artificial Sequence: Synthetic peptide
DEEEIRTTNPVATEQYGEVSTDLQRGNR

SEQ ID NO: 1621 - protein, 28 aa, Artificial Sequence
  Description of Artificial Sequence: Synthetic peptide
DEEEVRTTNPVATEQYGCVSTNLQRGNR

SEQ ID NO: 1622 - protein, 28 aa, Artificial Sequence
  Description of Artificial Sequence: Synthetic peptide
DEEEVRTTNPVATEQYGSVSTNLDRGNR

SEQ ID NO: 1623 - protein, 28 aa, Artificial Sequence
  Description of Artificial Sequence: Synthetic peptide
DVEEIRTTNPVATEQYGSVSTNLQRPNR

SEQ ID NO: 1624 - protein, 28 aa, Artificial Sequence
  Description of Artificial Sequence: Synthetic peptide
YEEETRTTNPVATEQYGSVSTNLQRGNR

SEQ ID NO: 1625 - protein, 28 aa, Artificial Sequence
  Description of Artificial Sequence: Synthetic peptide
DEIEIRTTNPVATEQYGSVSDNLQRGNR

SEQ ID NO: 1626 - protein, 28 aa, Artificial Sequence
  Description of Artificial Sequence: Synthetic peptide
DELEIRTTNPVATEQYGSVSENLQRGNR

SEQ ID NO: 1627 - protein, 29 aa, Artificial Sequence
  Description of Artificial Sequence: Synthetic peptide
DEEEIRTTNPVATEQYGSVGSTNLQRGER

SEQ ID NO: 1628 - protein, 28 aa, Artificial Sequence
  Description of Artificial Sequence: Synthetic peptide
DEEEIRTTNPVATEQYGSVSTNLQAGNI

SEQ ID NO: 1629 - protein, 28 aa, Artificial Sequence
  Description of Artificial Sequence: Synthetic peptide
DEQEIRTTNPVATEQYGNVSTNLQRGNR

SEQ ID NO: 1630 - protein, 29 aa, Artificial Sequence
  Description of Artificial Sequence: Synthetic peptide
DEEEIRTTNPVATEQYGSVSSTDLQRGNR

SEQ ID NO: 1631 - protein, 28 aa, Artificial Sequence
  Description of Artificial Sequence: Synthetic peptide
DEEEIRTTNPVATEQYGSVETNDQRGNR

SEQ ID NO: 1632 - protein, 29 aa, Artificial Sequence
  Description of Artificial Sequence: Synthetic peptide
DEEEIRTTNPVATEQYGSVSTDLQRGNDR

SEQ ID NO: 1633 - protein, 28 aa, Artificial Sequence
  Description of Artificial Sequence: Synthetic peptide
DEEEIRTTNPVASEQYGSVSTNLERGNR

SEQ ID NO: 1634 - protein, 28 aa, Artificial Sequence
  Description of Artificial Sequence: Synthetic peptide
DEEEIRTTNPVATEQFGSVSTNLQRGDR

SEQ ID NO: 1635 - protein, 28 aa, Artificial Sequence
  Description of Artificial Sequence: Synthetic peptide
DEEEIRTVNPVATEQYGSVTTNLQRGNR

SEQ ID NO: 1636 - protein, 28 aa, Artificial Sequence
  Description of Artificial Sequence: Synthetic peptide
SEEEIRTTNPVATEQYGIVSTNLQRGNR

SEQ ID NO: 1637 - protein, 29 aa, Artificial Sequence
  Description of Artificial Sequence: Synthetic peptide
DPEEIRTTNPVATEQYGSVSTNLQRGNPR

SEQ ID NO: 1638 - protein, 28 aa, Artificial Sequence
  Description of Artificial Sequence: Synthetic peptide
DEEEIRTTNPVATEQYGSVSTNLDRGER

SEQ ID NO: 1639 - protein, 29 aa, Artificial Sequence
  Description of Artificial Sequence: Synthetic peptide
DEEEIRTTNPVATEQYGSVSTNLQRGNDH

SEQ ID NO: 1640 - protein, 28 aa, Artificial Sequence
  Description of Artificial Sequence: Synthetic peptide
DEEEIRTTNPVATEQYGSVSTNLQLDNR

SEQ ID NO: 1641 - protein, 28 aa, Artificial Sequence
  Description of Artificial Sequence: Synthetic peptide
DEEEIVTTNPVATEQYGWVSTNLQRGNR

SEQ ID NO: 1642 - protein, 28 aa, Artificial Sequence
  Description of Artificial Sequence: Synthetic peptide
DEEEIRTTNPVATEQYGSWSHNLQRGNR

SEQ ID NO: 1643 - protein, 28 aa, Artificial Sequence
  Description of Artificial Sequence: Synthetic peptide
DEEEIRTTNPVATEQYGSVSTCLQVGNR

SEQ ID NO: 1644 - protein, 28 aa, Artificial Sequence
  Description of Artificial Sequence: Synthetic peptide
DEEEIRQTNPVATEQYGSVSTNLQWGNR

SEQ ID NO: 1645 - protein, 28 aa, Artificial Sequence
  Description of Artificial Sequence: Synthetic peptide
DEEEIRTTNPVATMQYGCVSTNLQRGNR

SEQ ID NO: 1646 - protein, 29 aa, Artificial Sequence
  Description of Artificial Sequence: Synthetic peptide
DEEEIRTTNPVATEQYGSCSTNLQRLGNR

SEQ ID NO: 1647 - protein, 29 aa, Artificial Sequence
  Description of Artificial Sequence: Synthetic peptide
DAEEIRTTNPVATEQYGSVSSTNLQRGNR

SEQ ID NO: 1648 - protein, 28 aa, Artificial Sequence
  Description of Artificial Sequence: Synthetic peptide
DEEEIRTTNPDATQQYGSVSTNLQRGNR

SEQ ID NO: 1649 - protein, 28 aa, Artificial Sequence
  Description of Artificial Sequence: Synthetic peptide
DEEEICTTNPVATEQYGSVSTNLQRVNR

SEQ ID NO: 1650 - protein, 29 aa, Artificial Sequence
  Description of Artificial Sequence: Synthetic peptide
DENEIRTTNPVATEQYGSVCSTNLQRGNR

SEQ ID NO: 1651 - protein, 29 aa, Artificial Sequence
  Description of Artificial Sequence: Synthetic peptide
DEEEIRTTNPVATEQYGSVSTNLQRGNSN

SEQ ID NO: 1652 - protein, 28 aa, Artificial Sequence
  Description of Artificial Sequence: Synthetic peptide
SEEEIRTVNPVATEQYGSVSTNLQRGNR

SEQ ID NO: 1653 - protein, 28 aa, Artificial Sequence
  Description of Artificial Sequence: Synthetic peptide
DEEEIRTTNPVATEQYGSVSTNLQDGNI

SEQ ID NO: 1654 - protein, 28 aa, Artificial Sequence
  Description of Artificial Sequence: Synthetic peptide
DEEEIRTTNPVSTEQYGSVSTNLERGNR

SEQ ID NO: 1655 - protein, 29 aa, Artificial Sequence
  Description of Artificial Sequence: Synthetic peptide
DPEEIRTTNPVATEQYGSVSTNLQRNGNR

SEQ ID NO: 1656 - protein, 30 aa, Artificial Sequence
  Description of Artificial Sequence: Synthetic polypeptide
DEEEIRTTNPVATEQYGDSVSTNLQRGDNR

SEQ ID NO: 1657 - protein, 29 aa, Artificial Sequence
  Description of Artificial Sequence: Synthetic peptide
DEEEIRTTNPVATEQYGSVSTNLQREGNI

SEQ ID NO: 1658 - protein, 29 aa, Artificial Sequence
  Description of Artificial Sequence: Synthetic peptide
DEEEIRTTNPVATEQYGSVSTNLQRGLNF

SEQ ID NO: 1659 - protein, 28 aa, Artificial Sequence
  Description of Artificial Sequence: Synthetic peptide
DEEEIYTTNPVATEQYGSVSTNEQRGNR

SEQ ID NO: 1660 - protein, 29 aa, Artificial Sequence
  Description of Artificial Sequence: Synthetic peptide
DEEEIRTTNPVATEQYGSVSTNLQRGNEE

SEQ ID NO: 1661 - protein, 28 aa, Artificial Sequence
  Description of Artificial Sequence: Synthetic peptide
DEEEIRQTNPVATEQYGDVSTNLQRGNR

SEQ ID NO: 1662 - protein, 29 aa, Artificial Sequence
  Description of Artificial Sequence: Synthetic peptide
DEEEIRTTNPVATEQYGSVSTNLQLRGND

SEQ ID NO: 1663 - protein, 29 aa, Artificial Sequence
  Description of Artificial Sequence: Synthetic peptide
DEEEIRTTNPVATENYGSVSATNLQRGNR

SEQ ID NO: 1664 - protein, 28 aa, Artificial Sequence
  Description of Artificial Sequence: Synthetic peptide
DEEEIRTTNPVATEQYGSVSTDLQRGNE

SEQ ID NO: 1665 - protein, 28 aa, Artificial Sequence
  Description of Artificial Sequence: Synthetic peptide
DEEEIRTTNPVATELYGSVSTDLQRGNR

SEQ ID NO: 1666 - protein, 28 aa, Artificial Sequence
  Description of Artificial Sequence: Synthetic peptide
DEEEIRTTNPVATEQYWSVSTNLQRGDR

SEQ ID NO: 1667 - protein, 28 aa, Artificial Sequence
  Description of Artificial Sequence: Synthetic peptide
REEEIRTTNPVATEQYGWVSTNLQRGNR

SEQ ID NO: 1668 - protein, 28 aa, Artificial Sequence
  Description of Artificial Sequence: Synthetic peptide
DEEEIRTTNPVAWEQYGSVSTNLQRGNG

SEQ ID NO: 1669 - protein, 29 aa, Artificial Sequence
  Description of Artificial Sequence: Synthetic peptide
DEEEIRTTNPVATEQYGDSVSTNLQRGNT

SEQ ID NO: 1670 - protein, 28 aa, Artificial Sequence
  Description of Artificial Sequence: Synthetic peptide
WEDEIRTTNPVATEQYGSVSTNLQRGNR

SEQ ID NO: 1671 - protein, 29 aa, Artificial Sequence
  Description of Artificial Sequence: Synthetic peptide
DEEEIRTTNPVATEQYGSVSTNLQERGNP

SEQ ID NO: 1672 - protein, 29 aa, Artificial Sequence
  Description of Artificial Sequence: Synthetic peptide
DEEEIRTTNPVATEQYGSVSTNLQERENR

SEQ ID NO: 1673 - protein, 28 aa, Artificial Sequence
  Description of Artificial Sequence: Synthetic peptide
DEEEIRTTNPVATEQYGSWSTNLDRGNR

SEQ ID NO: 1674 - protein, 28 aa, Artificial Sequence
  Description of Artificial Sequence: Synthetic peptide
DEEEIRTTNPVCTEQYGSVSTGLQRGNR

SEQ ID NO: 1675 - protein, 30 aa, Artificial Sequence
  Description of Artificial Sequence: Synthetic polypeptide
DEEEIRTTNPVATEQYGSVSTDNLQRGENR

SEQ ID NO: 1676 - protein, 28 aa, Artificial Sequence
  Description of Artificial Sequence: Synthetic peptide
DEPEIRTTNPVACEQYGSVSTNLQRGNR

SEQ ID NO: 1677 - protein, 29 aa, Artificial Sequence
  Description of Artificial Sequence: Synthetic peptide
DEEEIRTTNPVATEQYGSVSENLQRGQNR

SEQ ID NO: 1678 - protein, 28 aa, Artificial Sequence
  Description of Artificial Sequence: Synthetic peptide
DEEEIRTTNPVGTEQYGAVSTNLQRGNR

SEQ ID NO: 1679 - protein, 28 aa, Artificial Sequence
  Description of Artificial Sequence: Synthetic peptide
DEEEIRTTNPVATEQYGSVSTNLQPDNR

SEQ ID NO: 1680 - protein, 28 aa, Artificial Sequence
  Description of Artificial Sequence: Synthetic peptide
DEEEIRTTNPVATEQYGSVDTNLQRGNV

SEQ ID NO: 1681 - protein, 29 aa, Artificial Sequence
  Description of Artificial Sequence: Synthetic peptide
DENEIRTTNPVATEQYGSVSTNLQMRGNR

SEQ ID NO: 1682 - protein, 28 aa, Artificial Sequence
  Description of Artificial Sequence: Synthetic peptide
CESEIRTTNPVATEQYGSVSTNLQRGNR

SEQ ID NO: 1683 - protein, 28 aa, Artificial Sequence
  Description of Artificial Sequence: Synthetic peptide
DEEEIRTTNPVATEQYGSVHTNLIRGNR

SEQ ID NO: 1684 - protein, 30 aa, Artificial Sequence
  Description of Artificial Sequence: Synthetic polypeptide
DEEEIRTTNPVATEQYGSVSTNLQIRGNDR

SEQ ID NO: 1685 - protein, 29 aa, Artificial Sequence
  Description of Artificial Sequence: Synthetic peptide
DEEEIRTTNPVATEQYGSVETNLQREGNR

SEQ ID NO: 1686 - protein, 29 aa, Artificial Sequence
  Description of Artificial Sequence: Synthetic peptide
DEEEIRTTNPVATEQYGSVSTNLQYEGNR

SEQ ID NO: 1687 - protein, 28 aa, Artificial Sequence
  Description of Artificial Sequence: Synthetic peptide
DEEEIRTTNPVATEQYGSVSTNLQDGNG

SEQ ID NO: 1688 - protein, 29 aa, Artificial Sequence
  Description of Artificial Sequence: Synthetic peptide
DEEEIRTTNPVATEQYGSVSTNLMQGGNR

SEQ ID NO: 1689 - protein, 28 aa, Artificial Sequence
  Description of Artificial Sequence: Synthetic peptide
DEEEIRTTNPVATEQYGVVSTDLQRGNR

SEQ ID NO: 1690 - protein, 28 aa, Artificial Sequence
  Description of Artificial Sequence: Synthetic peptide
DEEEVRTVNPVATEQYGSVSTNLQRGNR

SEQ ID NO: 1691 - protein, 30 aa, Artificial Sequence
  Description of Artificial Sequence: Synthetic polypeptide
DEEEIRTTNPVATEQYGSVSTNLQDRGENR

SEQ ID NO: 1692 - protein, 30 aa, Artificial Sequence
  Description of Artificial Sequence: Synthetic polypeptide
DEEEIRTTNPVATEQYGSVSTNLQERGNLR

SEQ ID NO: 1693 - protein, 28 aa, Artificial Sequence
  Description of Artificial Sequence: Synthetic peptide
DEEEIRTTNPVATSQYGSVGTNLQRGNR

SEQ ID NO: 1694 - protein, 28 aa, Artificial Sequence
  Description of Artificial Sequence: Synthetic peptide
DEEEIRTTNPVATEQYGSVDTNLQLGNR

SEQ ID NO: 1695 - protein, 28 aa, Artificial Sequence
  Description of Artificial Sequence: Synthetic peptide
AEEEIRTTNPVATEVYGSVSTNLQRGNR

SEQ ID NO: 1696 - protein, 28 aa, Artificial Sequence
  Description of Artificial Sequence: Synthetic peptide
DEEEIRTTNPVATEQYGSVAMNLQRGNR

SEQ ID NO: 1697 - protein, 29 aa, Artificial Sequence
  Description of Artificial Sequence: Synthetic peptide
DEEEIRTTNPVATEQYGSVSDNLQCRGNR

SEQ ID NO: 1698 - protein, 29 aa, Artificial Sequence
  Description of Artificial Sequence: Synthetic peptide
DEEEIRTTNPVATEQYGSVSDTNLQEGNR

SEQ ID NO: 1699 - protein, 28 aa, Artificial Sequence
  Description of Artificial Sequence: Synthetic peptide
DEGEIRTTNPVATEQYGSVSTNLQRGER

SEQ ID NO: 1700 - protein, 28 aa, Artificial Sequence
  Description of Artificial Sequence: Synthetic peptide
DEEEIRTTNPVATEQYGSVSTNLCQGNR

SEQ ID NO: 1701 - protein, 28 aa, Artificial Sequence
  Description of Artificial Sequence: Synthetic peptide
DEEEIRTTNPVATEQYGSVSTYLIRGNR

SEQ ID NO: 1702 - protein, 28 aa, Artificial Sequence
  Description of Artificial Sequence: Synthetic peptide
DEEEIRTTNPMATEQYGSCSTNLQRGNR

SEQ ID NO: 1703 - protein, 28 aa, Artificial Sequence
  Description of Artificial Sequence: Synthetic peptide
MEEEIRTTNPVATECYGSVSTNLQRGNR

SEQ ID NO: 1704 - protein, 28 aa, Artificial Sequence
  Description of Artificial Sequence: Synthetic peptide
DEEEIRTTNPVAAEQYGSVSTNPQRGNR

SEQ ID NO: 1705 - protein, 28 aa, Artificial Sequence
  Description of Artificial Sequence: Synthetic peptide
DEEEIRTTNPVATEQYGSVSTNDQRGNY

SEQ ID NO: 1706 - protein, 29 aa, Artificial Sequence
  Description of Artificial Sequence: Synthetic peptide
DEEEIRTTNPVATEQYGSVSDTNLQDGNR

SEQ ID NO: 1707 - protein, 28 aa, Artificial Sequence
  Description of Artificial Sequence: Synthetic peptide
DEEEITTVNPVATEQYGSVSTNLQRGNR

SEQ ID NO: 1708 - protein, 28 aa, Artificial Sequence
  Description of Artificial Sequence: Synthetic peptide
DEEEIRTTNPVATEQYGSVSTNLQYGNH

SEQ ID NO: 1709 - protein, 28 aa, Artificial Sequence
  Description of Artificial Sequence: Synthetic peptide
DEEEIRTTNPVCTEQYGSVSTNLQEGNR

SEQ ID NO: 1710 - protein, 29 aa, Artificial Sequence
  Description of Artificial Sequence: Synthetic peptide
DEEEIRTTNPVATAQYGSVSTNLQLRGNR

SEQ ID NO: 1711 - protein, 28 aa, Artificial Sequence
  Description of Artificial Sequence: Synthetic peptide
DEEEIRCTNPVATEAYGSVSTNLQRGNR

SEQ ID NO: 1712 - protein, 29 aa, Artificial Sequence
  Description of Artificial Sequence: Synthetic peptide
DEEEIRTTNPVATEQYGSVSTNLQCEGNR

SEQ ID NO: 1713 - protein, 28 aa, Artificial Sequence
  Description of Artificial Sequence: Synthetic peptide
DEEEIRTTNPAATEQYGSVTTNLQRGNR

SEQ ID NO: 1714 - protein, 28 aa, Artificial Sequence
  Description of Artificial Sequence: Synthetic peptide
DEEEIATTNPVATEQYGLVSTNLQRGNR

SEQ ID NO: 1715 - protein, 29 aa, Artificial Sequence
  Description of Artificial Sequence: Synthetic peptide
DEEEIRTTNPVATEQYGSVHSTNLQRGNN

SEQ ID NO: 1716 - protein, 28 aa, Artificial Sequence
  Description of Artificial Sequence: Synthetic peptide
DEEEIRSTNPVATEQYGSVSTNLQPGNR

SEQ ID NO: 1717 - protein, 28 aa, Artificial Sequence
  Description of Artificial Sequence: Synthetic peptide
DEEEIRSTNPVATEQYGSVSTNLQRLNR

SEQ ID NO: 1718 - protein, 29 aa, Artificial Sequence
  Description of Artificial Sequence: Synthetic peptide
DECEIRTTNPVATEQYGSVSATNLQRGNR

SEQ ID NO: 1719 - protein, 28 aa, Artificial Sequence
  Description of Artificial Sequence: Synthetic peptide
DEEEIRTTNPVATEQYGSVSTNPQIGNR

SEQ ID NO: 1720 - protein, 30 aa, Artificial Sequence
  Description of Artificial Sequence: Synthetic polypeptide
DEEEIRTTNPVATEQYGSVSTENGLQRGNR

SEQ ID NO: 1721 - protein, 28 aa, Artificial Sequence
  Description of Artificial Sequence: Synthetic peptide
SEEEIRTTNPVATEQYGSVSTNLERGNR

SEQ ID NO: 1722 - protein, 28 aa, Artificial Sequence
  Description of Artificial Sequence: Synthetic peptide
AEEEIRTTNPVATEQYGSVSTNGQRGNR

SEQ ID NO: 1723 - protein, 28 aa, Artificial Sequence
  Description of Artificial Sequence: Synthetic peptide
DEEEIRTTNPVATEQYGSVSTPLQRGER

SEQ ID NO: 1724 - protein, 29 aa, Artificial Sequence
  Description of Artificial Sequence: Synthetic peptide
DEEEIRTTNPVATEQYGSASTNLQRGENR

SEQ ID NO: 1725 - protein, 29 aa, Artificial Sequence
  Description of Artificial Sequence: Synthetic peptide
DEQEIRTTNPVATEQYGSVSTMNLQRGNR

SEQ ID NO: 1726 - protein, 28 aa, Artificial Sequence
  Description of Artificial Sequence: Synthetic peptide
DEEQIRTTNPVATEQYGSVSTNLQRGNP

SEQ ID NO: 1727 - protein, 29 aa, Artificial Sequence
  Description of Artificial Sequence: Synthetic peptide
DEEEIRTTNPVATEQFGSVSTANLQRGNR

SEQ ID NO: 1728 - protein, 28 aa, Artificial Sequence
  Description of Artificial Sequence: Synthetic peptide
DEVEIRTTNPVATEQYGHVSTNLQRGNR

SEQ ID NO: 1729 - protein, 28 aa, Artificial Sequence
  Description of Artificial Sequence: Synthetic peptide
DEEEIRTTNPVATEQYGSVSTNLDIGNR

SEQ ID NO: 1730 - protein, 28 aa, Artificial Sequence
  Description of Artificial Sequence: Synthetic peptide
DEEEIRTTNPVATEQYGSVSTNPQRGTR

SEQ ID NO: 1731 - protein, 29 aa, Artificial Sequence
  Description of Artificial Sequence: Synthetic peptide
DEEEIRTTNPVATEQYGSVHTNALQRGNR

SEQ ID NO: 1732 - protein, 29 aa, Artificial Sequence
  Description of Artificial Sequence: Synthetic peptide
DEEEIRTTNPVATEQYGESVSTNLQRGER

SEQ ID NO: 1733 - protein, 28 aa, Artificial Sequence
  Description of Artificial Sequence: Synthetic peptide
MEEEIRTTNPVATEQYGSVSDNLQRGNR

SEQ ID NO: 1734 - protein, 28 aa, Artificial Sequence
  Description of Artificial Sequence: Synthetic peptide
DEEEIRTTNPTATEQYGSVSTNWQRGNR

SEQ ID NO: 1735 - protein, 29 aa, Artificial Sequence
  Description of Artificial Sequence: Synthetic peptide
DEEEIRTTNPVATEQYGSVSTNLQMIGNR

SEQ ID NO: 1736 - protein, 28 aa, Artificial Sequence
  Description of Artificial Sequence: Synthetic peptide
DEEEIRTTNPVATEQYGSVSTNLQGGND

SEQ ID NO: 1737 - protein, 28 aa, Artificial Sequence
  Description of Artificial Sequence: Synthetic peptide
DEEEIRTTNPVATEQYGSVSTNNQRGER

SEQ ID NO: 1738 - protein, 29 aa, Artificial Sequence
  Description of Artificial Sequence: Synthetic peptide
DEEEIRTTNPVATEQYGSVSTNLQESGNR

SEQ ID NO: 1739 - protein, 29 aa, Artificial Sequence
  Description of Artificial Sequence: Synthetic peptide
DEEEIRTTNPVATEQYGSVCSTNLQDGNR

SEQ ID NO: 1740 - protein, 28 aa, Artificial Sequence
  Description of Artificial Sequence: Synthetic peptide
DENEIRTTNPVATEQYGSVSTNLQRGND

SEQ ID NO: 1741 - protein, 28 aa, Artificial Sequence
  Description of Artificial Sequence: Synthetic peptide
DEEEIRTTNPVATEQYGSVSTFLQSGNR

SEQ ID NO: 1742 - protein, 28 aa, Artificial Sequence
  Description of Artificial Sequence: Synthetic peptide
DEEEIRTTNPVATEQYGSVSTNLQDGNE

SEQ ID NO: 1743 - protein, 28 aa, Artificial Sequence
  Description of Artificial Sequence: Synthetic peptide
DEEEIRATNPVAVEQYGSVSTNLQRGNR

SEQ ID NO: 1744 - protein, 28 aa, Artificial Sequence
  Description of Artificial Sequence: Synthetic peptide
DEEEIRTTNPVATEQYGSVSDNLQNGNR

SEQ ID NO: 1745 - protein, 28 aa, Artificial Sequence
  Description of Artificial Sequence: Synthetic peptide
DEEEIRTTNPVATEQYGSVSTNLQGGNN

SEQ ID NO: 1746 - protein, 28 aa, Artificial Sequence
  Description of Artificial Sequence: Synthetic peptide
DEEEIRTTNPVATEQYGSVSTNLIIGNR

SEQ ID NO: 1747 - protein, 28 aa, Artificial Sequence
  Description of Artificial Sequence: Synthetic peptide
DEEEIRTTNPVATEQYGSVDTNLQIGNR

SEQ ID NO: 1748 - protein, 28 aa, Artificial Sequence
  Description of Artificial Sequence: Synthetic peptide
DAEEIGTTNPVATEQYGSVSTNLQRGNR

SEQ ID NO: 1749 - protein, 30 aa, Artificial Sequence
  Description of Artificial Sequence: Synthetic polypeptide
DEEEIRTTNPVATEQYGMSVSTNLQRGNFR

SEQ ID NO: 1750 - protein, 28 aa, Artificial Sequence
  Description of Artificial Sequence: Synthetic peptide
DEEEIRTTNPVASEQYGSVSTNLQRGNI

SEQ ID NO: 1751 - protein, 28 aa, Artificial Sequence
  Description of Artificial Sequence: Synthetic peptide
DEEEIRTTNPVATEQYGGVSTNLQSGNR

SEQ ID NO: 1752 - protein, 28 aa, Artificial Sequence
  Description of Artificial Sequence: Synthetic peptide
DEEEIRTTNPCATEQYGVVSTNLQRGNR

SEQ ID NO: 1753 - protein, 29 aa, Artificial Sequence
  Description of Artificial Sequence: Synthetic peptide
DDEEIRTTNPVATEQYGSVSTNNLQRGNR

SEQ ID NO: 1754 - protein, 29 aa, Artificial Sequence
  Description of Artificial Sequence: Synthetic peptide
DEEEIRTTNPVATEQYGSVSTNLQDRGER

SEQ ID NO: 1755 - protein, 28 aa, Artificial Sequence
  Description of Artificial Sequence: Synthetic peptide
DEEEIRTTNPIATEQYGSVGTNLQRGNR

SEQ ID NO: 1756 - protein, 29 aa, Artificial Sequence
  Description of Artificial Sequence: Synthetic peptide
DEEEIRTTNPVATEQYGSVSTNLQPRGNG

SEQ ID NO: 1757 - protein, 28 aa, Artificial Sequence
  Description of Artificial Sequence: Synthetic peptide
DEEEIRTTNPVATEQYGSVSTNLQHGND

SEQ ID NO: 1758 - protein, 28 aa, Artificial Sequence
  Description of Artificial Sequence: Synthetic peptide
GEEEIMTTNPVATEQYGSVSTNLQRGNR

SEQ ID NO: 1759 - protein, 28 aa, Artificial Sequence
  Description of Artificial Sequence: Synthetic peptide
DEEEIRQTNPVATEQYGSVSTNLQRGNA

SEQ ID NO: 1760 - protein, 28 aa, Artificial Sequence
  Description of Artificial Sequence: Synthetic peptide
DESEIRTTNPVATEQYGSSSTNLQRGNR

SEQ ID NO: 1761 - protein, 28 aa, Artificial Sequence
  Description of Artificial Sequence: Synthetic peptide
LEEEIRTTNPVATEQYGSVSTNLQRPNR

SEQ ID NO: 1762 - protein, 29 aa, Artificial Sequence
  Description of Artificial Sequence: Synthetic peptide
DEEEIRTTNPVAIEQYGCSVSTNLQRGNR

SEQ ID NO: 1763 - protein, 28 aa, Artificial Sequence
  Description of Artificial Sequence: Synthetic peptide
DEEEIRTTNPVATEQYGSVDTNLQVGNR

SEQ ID NO: 1764 - protein, 28 aa, Artificial Sequence
  Description of Artificial Sequence: Synthetic peptide
DEEEIRTTNCVATEQYGSVSTNLQVGNR

SEQ ID NO: 1765 - protein, 28 aa, Artificial Sequence
  Description of Artificial Sequence: Synthetic peptide
DEIEIRTTNPVATEQYGSVSTNLQRENR

SEQ ID NO: 1766 - protein, 29 aa, Artificial Sequence
  Description of Artificial Sequence: Synthetic peptide
DEQEIRTTNPVATEQYGSVSTNLQRGENR

SEQ ID NO: 1767 - protein, 28 aa, Artificial Sequence
  Description of Artificial Sequence: Synthetic peptide
DEQEIRTTNPVATEQYGTVSTNLQRGNR

SEQ ID NO: 1768 - protein, 29 aa, Artificial Sequence
  Description of Artificial Sequence: Synthetic peptide
DEEEIRTTNPVCTEQYGSVSTNLQFRGNR

SEQ ID NO: 1769 - protein, 28 aa, Artificial Sequence
  Description of Artificial Sequence: Synthetic peptide
DEENIQTTNPVATEQYGSVSTNLQRGNR

SEQ ID NO: 1770 - protein, 28 aa, Artificial Sequence
  Description of Artificial Sequence: Synthetic peptide
DEEEIATTNPVATEQYGSVSTNLQRGNN

SEQ ID NO: 1771 - protein, 28 aa, Artificial Sequence
  Description of Artificial Sequence: Synthetic peptide
QEEEIATTNPVATEQYGSVSTNLQRGNR

SEQ ID NO: 1772 - protein, 30 aa, Artificial Sequence
  Description of Artificial Sequence: Synthetic polypeptide
DEEEIRTTNPVATEQYGSVSTNLQLRNGNR

SEQ ID NO: 1773 - protein, 28 aa, Artificial Sequence
  Description of Artificial Sequence: Synthetic peptide
DEEEIRTTNPVATEQYGSQSTYLQRGNR

SEQ ID NO: 1774 - protein, 29 aa, Artificial Sequence
  Description of Artificial Sequence: Synthetic peptide
DEEEIRTTNPVATEQYGSVSTINLQPGNR

SEQ ID NO: 1775 - protein, 28 aa, Artificial Sequence
  Description of Artificial Sequence: Synthetic peptide
DEEEIRCTNPVATEQYGSVSTNLQDGNR

SEQ ID NO: 1776 - protein, 28 aa, Artificial Sequence
  Description of Artificial Sequence: Synthetic peptide
DEEEIRTTNPVATEQYGSASTNLQRMNR

SEQ ID NO: 1777 - protein, 28 aa, Artificial Sequence
  Description of Artificial Sequence: Synthetic peptide
DEEEIRTTNPVATEQYGSVSENLFRGNR

SEQ ID NO: 1778 - protein, 28 aa, Artificial Sequence
  Description of Artificial Sequence: Synthetic peptide
DEEEIRTTNPVATEQYGSVSTNEQPGNR

SEQ ID NO: 1779 - protein, 29 aa, Artificial Sequence
  Description of Artificial Sequence: Synthetic peptide
DEEEIRTTNPVATECYGSVSTNLQRGNHR

SEQ ID NO: 1780 - protein, 29 aa, Artificial Sequence
  Description of Artificial Sequence: Synthetic peptide
DEEEIRTTNPVATEQYGSVSTNVLQLGNR

SEQ ID NO: 1781 - protein, 28 aa, Artificial Sequence
  Description of Artificial Sequence: Synthetic peptide
DEEEIRTTNPVATEQYGSVSTPLQRGNQ

SEQ ID NO: 1782 - protein, 28 aa, Artificial Sequence
  Description of Artificial Sequence: Synthetic peptide
DEEEIRTTNPTATEQYGSVSTNLQRGNS

SEQ ID NO: 1783 - protein, 28 aa, Artificial Sequence
  Description of Artificial Sequence: Synthetic peptide
DEEEIRTTNPVAYEQYGSVATNLQRGNR

SEQ ID NO: 1784 - protein, 28 aa, Artificial Sequence
  Description of Artificial Sequence: Synthetic peptide
DEEEIRTTNPVATEQYGSVSTNLQEGNY

SEQ ID NO: 1785 - protein, 28 aa, Artificial Sequence
  Description of Artificial Sequence: Synthetic peptide
DEEEIRTTNPVATEQYGSVSTNLQVGNC

SEQ ID NO: 1786 - protein, 28 aa, Artificial Sequence
  Description of Artificial Sequence: Synthetic peptide
DEEEIRTTNPVATECYGSVSTNDQRGNR

SEQ ID NO: 1787 - protein, 28 aa, Artificial Sequence
  Description of Artificial Sequence: Synthetic peptide
DEEEIRTTNPVATEMYGSMSTNLQRGNR

SEQ ID NO: 1788 - protein, 28 aa, Artificial Sequence
  Description of Artificial Sequence: Synthetic peptide
DEEEIRTTNPVATEQYGSVSTNLMRGNA

SEQ ID NO: 1789 - protein, 28 aa, Artificial Sequence
  Description of Artificial Sequence: Synthetic peptide
DNEEIRTTNPIATEQYGSVSTNLQRGNR

SEQ ID NO: 1790 - protein, 29 aa, Artificial Sequence
  Description of Artificial Sequence: Synthetic peptide
DEEEIRTTNPVATEQYGSVDETNLQRGNR

SEQ ID NO: 1791 - protein, 29 aa, Artificial Sequence
  Description of Artificial Sequence: Synthetic peptide
DEEEIRTTNPVATEQYGSVSTELQRGDNR

SEQ ID NO: 1792 - protein, 28 aa, Artificial Sequence
  Description of Artificial Sequence: Synthetic peptide
DETEIRCTNPVATEQYGSVSTNLQRGNR

SEQ ID NO: 1793 - protein, 28 aa, Artificial Sequence
  Description of Artificial Sequence: Synthetic peptide
DEEEIRTTNPVATEQYGSVSYSLQRGNR

SEQ ID NO: 1794 - protein, 28 aa, Artificial Sequence
  Description of Artificial Sequence: Synthetic peptide
DEEEIRTTNPVATEPYGSMSTNLQRGNR

SEQ ID NO: 1795 - protein, 28 aa, Artificial Sequence
  Description of Artificial Sequence: Synthetic peptide
DEEETRTTNPVATEQYGSVSTNLQQGNR

SEQ ID NO: 1796 - protein, 30 aa, Artificial Sequence
  Description of Artificial Sequence: Synthetic polypeptide
DEEEIRTTNPVATEQYGSVSCTNLQRFGNR

SEQ ID NO: 1797 - protein, 28 aa, Artificial Sequence
  Description of Artificial Sequence: Synthetic peptide
KEEEIRTTNPVATEQYGSVSTNLQSGNR

SEQ ID NO: 1798 - protein, 29 aa, Artificial Sequence
  Description of Artificial Sequence: Synthetic peptide
DEYEIRTTNPVATEQYGSVSTNLQRWGNR

SEQ ID NO: 1799 - protein, 30 aa, Artificial Sequence
  Description of Artificial Sequence: Synthetic polypeptide
DEEEIRTTNPVATEQYGSVSTNPLQRNGNR

SEQ ID NO: 1800 - protein, 29 aa, Artificial Sequence
  Description of Artificial Sequence: Synthetic peptide
DEEEIRTTNPVATEQYGSMVWTNLQRGNR

SEQ ID NO: 1801 - protein, 28 aa, Artificial Sequence
  Description of Artificial Sequence: Synthetic peptide
DEEEIRTTNPDATEQYGSVWTNLQRGNR

SEQ ID NO: 1802 - protein, 29 aa, Artificial Sequence
  Description of Artificial Sequence: Synthetic peptide
DEEEIRTTNPVATEQYGSVISTNLQEGNR

SEQ ID NO: 1803 - protein, 29 aa, Artificial Sequence
  Description of Artificial Sequence: Synthetic peptide
DEEEIRTTNPVATEQYGSVSTMNLQNGNR

SEQ ID NO: 1804 - protein, 28 aa, Artificial Sequence
  Description of Artificial Sequence: Synthetic peptide
DEEEIRTTNPVATEQYGSVSTNLQAGND

SEQ ID NO: 1805 - protein, 28 aa, Artificial Sequence
  Description of Artificial Sequence: Synthetic peptide
SEEEIRPTNPVATEQYGSVSTNLQRGNR

SEQ ID NO: 1806 - protein, 28 aa, Artificial Sequence
  Description of Artificial Sequence: Synthetic peptide
DEQEIRTTNPVATEQYGSVSTNLQRGPR

SEQ ID NO: 1807 - protein, 28 aa, Artificial Sequence
  Description of Artificial Sequence: Synthetic peptide
DDEEIRTTNPVATEQYGSVSENLQRGNR

SEQ ID NO: 1808 - protein, 30 aa, Artificial Sequence
  Description of Artificial Sequence: Synthetic polypeptide
DEEEIRTTNPVATEQYGSVSTGNLQRGVNR

SEQ ID NO: 1809 - protein, 29 aa, Artificial Sequence
  Description of Artificial Sequence: Synthetic peptide
DEEEIRTTNPVATEQYGSCVSTGLQRGNR

SEQ ID NO: 1810 - protein, 29 aa, Artificial Sequence
  Description of Artificial Sequence: Synthetic peptide
DEEEIRTTNPVATEQYGSVSTANLQRGNE

SEQ ID NO: 1811 - protein, 30 aa, Artificial Sequence
  Description of Artificial Sequence: Synthetic polypeptide
DEEEIRTTNPVATEQYGSVSTTNLQRGANR

SEQ ID NO: 1812 - protein, 28 aa, Artificial Sequence
  Description of Artificial Sequence: Synthetic peptide
DEEEIRTTNPVATEQYGNVSTNLQRGTR

SEQ ID NO: 1813 - protein, 28 aa, Artificial Sequence
  Description of Artificial Sequence: Synthetic peptide
DEEEIRTTNPVATEQYGWVSTNLQWGNR

SEQ ID NO: 1814 - protein, 29 aa, Artificial Sequence
  Description of Artificial Sequence: Synthetic peptide
DEEEIRTTNPVATEQYGDVSTNLQCRGNR

SEQ ID NO: 1815 - protein, 29 aa, Artificial Sequence
  Description of Artificial Sequence: Synthetic peptide
DEEEIRTTNPVATEQYGSVSTELQRGNYR

SEQ ID NO: 1816 - protein, 28 aa, Artificial Sequence
  Description of Artificial Sequence: Synthetic peptide
DEEEIRTTNPVATEQYGSVSTNLARGDR

SEQ ID NO: 1817 - protein, 28 aa, Artificial Sequence
  Description of Artificial Sequence: Synthetic peptide
DEEEIRTTNPVATEQYGSVSTNLQLGNI

SEQ ID NO: 1818 - protein, 28 aa, Artificial Sequence
  Description of Artificial Sequence: Synthetic peptide
DEEEIRTTNPVATEQYWSVSHNLQRGNR

SEQ ID NO: 1819 - protein, 29 aa, Artificial Sequence
  Description of Artificial Sequence: Synthetic peptide
DEEEIRTTNPVATEQYGSVSENLQREGNR

SEQ ID NO: 1820 - protein, 28 aa, Artificial Sequence
  Description of Artificial Sequence: Synthetic peptide
DEQEIRTTNPVATEQYGSVSTNLDRGNR

SEQ ID NO: 1821 - protein, 28 aa, Artificial Sequence
  Description of Artificial Sequence: Synthetic peptide
DEEEIKTTNPVATEQWGSVSTNLQRGNR

SEQ ID NO: 1822 - protein, 28 aa, Artificial Sequence
  Description of Artificial Sequence: Synthetic peptide
DEEEIRTTNPVATEQYGSVSTDLDRGNR

SEQ ID NO: 1823 - protein, 29 aa, Artificial Sequence
  Description of Artificial Sequence: Synthetic peptide
DEEEIRTTNPVATEVYGSVSCTNLQRGNR

SEQ ID NO: 1824 - protein, 28 aa, Artificial Sequence
  Description of Artificial Sequence: Synthetic peptide
DEQEIRTTNPVATEQYGSVSTNLQRGNF

SEQ ID NO: 1825 - protein, 29 aa, Artificial Sequence
  Description of Artificial Sequence: Synthetic peptide
DEEEIRTTNPVATEQYGSVSTNEQIRGNR

SEQ ID NO: 1826 - protein, 30 aa, Artificial Sequence
  Description of Artificial Sequence: Synthetic polypeptide
DEEEIRTTNPVATEQYGSVSTNLQERGNTR

SEQ ID NO: 1827 - protein, 28 aa, Artificial Sequence
  Description of Artificial Sequence: Synthetic peptide
DEEEIRTTNPVATEQYGYFSTNLQRGNR

SEQ ID NO: 1828 - protein, 28 aa, Artificial Sequence
  Description of Artificial Sequence: Synthetic peptide
DEEEIRTTNPVATEKYGSVSTNEQRGNR

SEQ ID NO: 1829 - protein, 28 aa, Artificial Sequence
  Description of Artificial Sequence: Synthetic peptide
DEEEIRTTNPVATEQYGSVSTNLHAGNR

SEQ ID NO: 1830 - protein, 29 aa, Artificial Sequence
  Description of Artificial Sequence: Synthetic peptide
DEEEIRTTNPVACEQYGSVSTNLQPRGNR

SEQ ID NO: 1831 - protein, 28 aa, Artificial Sequence
  Description of Artificial Sequence: Synthetic peptide
DEEEIRTTNPVATEQYGSVSTNPQPGNR

SEQ ID NO: 1832 - protein, 28 aa, Artificial Sequence
  Description of Artificial Sequence: Synthetic peptide
DEEEIRTTNPVATEQYGSYSTNLQRGNA

SEQ ID NO: 1833 - protein, 29 aa, Artificial Sequence
  Description of Artificial Sequence: Synthetic peptide
DEEEIRATNPVATEQYGSVSTDNLQRGNR

SEQ ID NO: 1834 - protein, 29 aa, Artificial Sequence
  Description of Artificial Sequence: Synthetic peptide
DEEEIRTTNPVATEQYGSVSWNWLQRGNR

SEQ ID NO: 1835 - protein, 29 aa, Artificial Sequence
  Description of Artificial Sequence: Synthetic peptide
DEEEIRTTNPVATEQYGSVSTNEQRDGNR

SEQ ID NO: 1836 - protein, 28 aa, Artificial Sequence
  Description of Artificial Sequence: Synthetic peptide
DEEEIRTCNPVATEQYGSVSTNLQQGNR

SEQ ID NO: 1837 - protein, 28 aa, Artificial Sequence
  Description of Artificial Sequence: Synthetic peptide
AEEEIRTTNPVATEQYGSVSTNLQRLNR

SEQ ID NO: 1838 - protein, 28 aa, Artificial Sequence
  Description of Artificial Sequence: Synthetic peptide
DEEEIRQTNPVATENYGSVSTNLQRGNR

SEQ ID NO: 1839 - protein, 29 aa, Artificial Sequence
  Description of Artificial Sequence: Synthetic peptide
DEEEIRTTNPVATEQYGSVSTNLQRGDDR

SEQ ID NO: 1840 - protein, 28 aa, Artificial Sequence
  Description of Artificial Sequence: Synthetic peptide
DEEEIRTTNPVATEQYGSVSTNLFRGER

SEQ ID NO: 1841 - protein, 28 aa, Artificial Sequence
  Description of Artificial Sequence: Synthetic peptide
DEEEIRTTNPVATEQYGSVSTELQRGNS

SEQ ID NO: 1842 - protein, 28 aa, Artificial Sequence
  Description of Artificial Sequence: Synthetic peptide
DEEEIRTTNPVATEQYGSVSTNLQRGLG

SEQ ID NO: 1843 - protein, 28 aa, Artificial Sequence
  Description of Artificial Sequence: Synthetic peptide
DEEEIRTVNPVAVEQYGSVSTNLQRGNR

SEQ ID NO: 1844 - protein, 28 aa, Artificial Sequence
  Description of Artificial Sequence: Synthetic peptide
DEEEIRCTNPVATEQYGSVSTNVQRGNR

SEQ ID NO: 1845 - protein, 30 aa, Artificial Sequence
  Description of Artificial Sequence: Synthetic polypeptide
DEEEIRTTNPVATEQYGSVSTTNLQRGNDR

SEQ ID NO: 1846 - protein, 28 aa, Artificial Sequence
  Description of Artificial Sequence: Synthetic peptide
DEGEIATTNPVATEQYGSVSTNLQRGNR

SEQ ID NO: 1847 - protein, 29 aa, Artificial Sequence
  Description of Artificial Sequence: Synthetic peptide
DEEEIRTTNPYATEQYGSVSTNLQRDGNR

SEQ ID NO: 1848 - protein, 30 aa, Artificial Sequence
  Description of Artificial Sequence: Synthetic polypeptide
DEEEIRTTNPVATEQYGSVSATDNLQRGNR

SEQ ID NO: 1849 - protein, 28 aa, Artificial Sequence
  Description of Artificial Sequence: Synthetic peptide
DETEIRTTNPIATEQYGSVSTNLQRGNR

SEQ ID NO: 1850 - protein, 28 aa, Artificial Sequence
  Description of Artificial Sequence: Synthetic peptide
DEEEIRTTNPVATEQYGSVSTDLQGGNR

SEQ ID NO: 1851 - protein, 29 aa, Artificial Sequence
  Description of Artificial Sequence: Synthetic peptide
DEEEIRTTNPVATEQYGGVISTNLQRGNR

SEQ ID NO: 1852 - protein, 28 aa, Artificial Sequence
  Description of Artificial Sequence: Synthetic peptide
DEEEIRTTNPVATEVYGSVSTNLQRGTR

SEQ ID NO: 1853 - protein, 28 aa, Artificial Sequence
  Description of Artificial Sequence: Synthetic peptide
DEAEIRTTNPVATEQYGSVSENLQRGNR

SEQ ID NO: 1854 - protein, 29 aa, Artificial Sequence
  Description of Artificial Sequence: Synthetic peptide
DEEEIRTTNPVATEQYGSVSTNLQRKGNQ

SEQ ID NO: 1855 - protein, 30 aa, Artificial Sequence
  Description of Artificial Sequence: Synthetic polypeptide
DEEEIRTTNPVATEQYGSVSTNLDQRGDNR

SEQ ID NO: 1856 - protein, 28 aa, Artificial Sequence
  Description of Artificial Sequence: Synthetic peptide
DEEEISTTNPVATEQYGSVPTNLQRGNR

SEQ ID NO: 1857 - protein, 28 aa, Artificial Sequence
  Description of Artificial Sequence: Synthetic peptide
DEEEIRTTNPVATEQYGSVSTCLQHGNR

SEQ ID NO: 1858 - protein, 28 aa, Artificial Sequence
  Description of Artificial Sequence: Synthetic peptide
DEEEIRTTNPVATEQYGSVSCNLQRMNR

SEQ ID NO: 1859 - protein, 28 aa, Artificial Sequence
  Description of Artificial Sequence: Synthetic peptide
DCEEIRTTNPVSTEQYGSVSTNLQRGNR

SEQ ID NO: 1860 - protein, 30 aa, Artificial Sequence
  Description of Artificial Sequence: Synthetic polypeptide
DEEEIRTTNPVATEQYGSVSTNLVQERGNR

SEQ ID NO: 1861 - protein, 28 aa, Artificial Sequence
  Description of Artificial Sequence: Synthetic peptide
DETEIRTTNPVATEIYGSVSTNLQRGNR

SEQ ID NO: 1862 - protein, 29 aa, Artificial Sequence
  Description of Artificial Sequence: Synthetic peptide
DEEEIVTTNPVATEQYGSVSITNLQRGNR

SEQ ID NO: 1863 - protein, 28 aa, Artificial Sequence
  Description of Artificial Sequence: Synthetic peptide
SEEEIRTTNPVATEQYGVVSTNLQRGNR

SEQ ID NO: 1864 - protein, 28 aa, Artificial Sequence
  Description of Artificial Sequence: Synthetic peptide
DEDEIRTTNPVATEQYGSVSTILQRGNR

SEQ ID NO: 1865 - protein, 28 aa, Artificial Sequence
  Description of Artificial Sequence: Synthetic peptide
DEEEIRTTNPVATEQYGSVSTNLEHGNR

SEQ ID NO: 1866 - protein, 29 aa, Artificial Sequence
  Description of Artificial Sequence: Synthetic peptide
DEEEIRTTNPVATEQYGSVSTNLQMGNDR

SEQ ID NO: 1867 - protein, 29 aa, Artificial Sequence
  Description of Artificial Sequence: Synthetic peptide
DEEEIRTTNPVATEQYGSVSTNEQRGNWR

SEQ ID NO: 1868 - protein, 29 aa, Artificial Sequence
  Description of Artificial Sequence: Synthetic peptide
DEEEIRTTNPVATENYGSVSTLNLQRGNR

SEQ ID NO: 1869 - protein, 28 aa, Artificial Sequence
  Description of Artificial Sequence: Synthetic peptide
DEEEIRTTNPVATAQYGSVSTNPQRGNR

SEQ ID NO: 1870 - protein, 29 aa, Artificial Sequence
  Description of Artificial Sequence: Synthetic peptide
DEEEIRTTNPVATEQYGSVSDTDLQRGNR

SEQ ID NO: 1871 - protein, 29 aa, Artificial Sequence
  Description of Artificial Sequence: Synthetic peptide
DEEEIRTTNPVATEQYGESVSTNLERGNR

SEQ ID NO: 1872 - protein, 28 aa, Artificial Sequence
  Description of Artificial Sequence: Synthetic peptide
DEEEIRTVNPVATEQYGVVSTNLQRGNR

SEQ ID NO: 1873 - protein, 28 aa, Artificial Sequence
  Description of Artificial Sequence: Synthetic peptide
DEEEIRTTNPDATEQYGSVSTNLQHGNR

SEQ ID NO: 1874 - protein, 29 aa, Artificial Sequence
  Description of Artificial Sequence: Synthetic peptide
KEEEIRTTNPVATEQYGSVSTNLQRQGNR

SEQ ID NO: 1875 - protein, 28 aa, Artificial Sequence
  Description of Artificial Sequence: Synthetic peptide
DEEEIRTTNPVATEQYGSVSTNLDRGNF

SEQ ID NO: 1876 - protein, 28 aa, Artificial Sequence
  Description of Artificial Sequence: Synthetic peptide
DEEEIATTNPVATEQYGWVSTNLQRGNR

SEQ ID NO: 1877 - protein, 28 aa, Artificial Sequence
  Description of Artificial Sequence: Synthetic peptide
DEEEIRSTNPCATEQYGSVSTNLQRGNR

SEQ ID NO: 1878 - protein, 28 aa, Artificial Sequence
  Description of Artificial Sequence: Synthetic peptide
DEEEISTTNPVATEQYGSASTNLQRGNR

SEQ ID NO: 1879 - protein, 28 aa, Artificial Sequence
  Description of Artificial Sequence: Synthetic peptide
NEEEVRTTNPVATEQYGSVSTNLQRGNR

SEQ ID NO: 1880 - protein, 28 aa, Artificial Sequence
  Description of Artificial Sequence: Synthetic peptide
DENEIRQTNPVATEQYGSVSTNLQRGNR

SEQ ID NO: 1881 - protein, 28 aa, Artificial Sequence
  Description of Artificial Sequence: Synthetic peptide
QEEEIRTTNPVATEQYGSVATNLQRGNR

SEQ ID NO: 1882 - protein, 28 aa, Artificial Sequence
  Description of Artificial Sequence: Synthetic peptide
DEEEIRTTNPVATEQYGSVSTNLQMGNH

SEQ ID NO: 1883 - protein, 28 aa, Artificial Sequence
  Description of Artificial Sequence: Synthetic peptide
DEEEIYTTNPVATEQYGSVSENLQRGNR

SEQ ID NO: 1884 - protein, 29 aa, Artificial Sequence
  Description of Artificial Sequence: Synthetic peptide
DEEEIRTTNPVATEQYGSYSTNLQRAGNR

SEQ ID NO: 1885 - protein, 28 aa, Artificial Sequence
  Description of Artificial Sequence: Synthetic peptide
DEEEIRTTNPVATEQYGSVSTNLCRGNQ

SEQ ID NO: 1886 - protein, 29 aa, Artificial Sequence
  Description of Artificial Sequence: Synthetic peptide
KEEEIRTTNPVATEQYGSVSCTNLQRGNR

SEQ ID NO: 1887 - protein, 29 aa, Artificial Sequence
  Description of Artificial Sequence: Synthetic peptide
DEEEIRTTNPVATEQYGSVSTNLQERGNS

SEQ ID NO: 1888 - protein, 28 aa, Artificial Sequence
  Description of Artificial Sequence: Synthetic peptide
DEEEIRTTNPVATEQYGAVSTNIQRGNR

SEQ ID NO: 1889 - protein, 28 aa, Artificial Sequence
  Description of Artificial Sequence: Synthetic peptide
DEEEIYTTNPVATEQYGSVSDNLQRGNR

SEQ ID NO: 1890 - protein, 28 aa, Artificial Sequence
  Description of Artificial Sequence: Synthetic peptide
FEEEIRTTNPVATEQYGSVSTNLQFGNR

SEQ ID NO: 1891 - protein, 29 aa, Artificial Sequence
  Description of Artificial Sequence: Synthetic peptide
DEEEIRTTNPVATEQYGSCSTNLTQRGNR

SEQ ID NO: 1892 - protein, 28 aa, Artificial Sequence
  Description of Artificial Sequence: Synthetic peptide
DEQEIRTTNPVATEQYGSVSTNLQRGNL

SEQ ID NO: 1893 - protein, 28 aa, Artificial Sequence
  Description of Artificial Sequence: Synthetic peptide
DEEEIRTTNPVATEQYGSVDTNLQGGNR

SEQ ID NO: 1894 - protein, 29 aa, Artificial Sequence
  Description of Artificial Sequence: Synthetic peptide
DEEEIRTTNPVATEQYGSVSTELQVRGNR

SEQ ID NO: 1895 - protein, 29 aa, Artificial Sequence
  Description of Artificial Sequence: Synthetic peptide
DEEEIRTTNPVATEQYGSVSDTNDQRGNR

SEQ ID NO: 1896 - protein, 28 aa, Artificial Sequence
  Description of Artificial Sequence: Synthetic peptide
REEEIRTTNPCATEQYGSVSTNLQRGNR

SEQ ID NO: 1897 - protein, 28 aa, Artificial Sequence
  Description of Artificial Sequence: Synthetic peptide
DEEEIRTTNPVATEQYGSVSTNLQEGNF

SEQ ID NO: 1898 - protein, 28 aa, Artificial Sequence
  Description of Artificial Sequence: Synthetic peptide
DEEEIRTTNPVATEQYGSVFTNLQRFNR

SEQ ID NO: 1899 - protein, 29 aa, Artificial Sequence
  Description of Artificial Sequence: Synthetic peptide
DEEEIRTTNPVATEQYGSVSTNLQERGNY

SEQ ID NO: 1900 - protein, 30 aa, Artificial Sequence
  Description of Artificial Sequence: Synthetic polypeptide
DEEEIRTTNPVATEQYGSVSTNLQCRGDNR

SEQ ID NO: 1901 - protein, 28 aa, Artificial Sequence
  Description of Artificial Sequence: Synthetic peptide
QEEEIRTTNPVATECYGSVSTNLQRGNR

SEQ ID NO: 1902 - protein, 28 aa, Artificial Sequence
  Description of Artificial Sequence: Synthetic peptide
DEEEIRTTNPVATEQYGSVSTGLQRGNM

SEQ ID NO: 1903 - protein, 28 aa, Artificial Sequence
  Description of Artificial Sequence: Synthetic peptide
DEEEIRATNPVATEQYGVVSTNLQRGNR

SEQ ID NO: 1904 - protein, 28 aa, Artificial Sequence
  Description of Artificial Sequence: Synthetic peptide
DEEEIRSTNPVATEIYGSVSTNLQRGNR

SEQ ID NO: 1905 - protein, 28 aa, Artificial Sequence
  Description of Artificial Sequence: Synthetic peptide
DEEEIRTTNCVATEQYGSVSTNQQRGNR

SEQ ID NO: 1906 - protein, 30 aa, Artificial Sequence
  Description of Artificial Sequence: Synthetic polypeptide
DEEEIRTTNPVATEQYGSVSCTNLQRGSNR

SEQ ID NO: 1907 - protein, 28 aa, Artificial Sequence
  Description of Artificial Sequence: Synthetic peptide
DEYEIRTTNPVATEQYGSTSTNLQRGNR

SEQ ID NO: 1908 - protein, 29 aa, Artificial Sequence
  Description of Artificial Sequence: Synthetic peptide
DCEEIRTTNPVATEQYGSVSTNLQRGDNR

SEQ ID NO: 1909 - protein, 28 aa, Artificial Sequence
  Description of Artificial Sequence: Synthetic peptide
DETEIVTTNPVATEQYGSVSTNLQRGNR

SEQ ID NO: 1910 - protein, 29 aa, Artificial Sequence
  Description of Artificial Sequence: Synthetic peptide
DEEEIRTTNPVATEQYGSVSTNLQRGQAR

SEQ ID NO: 1911 - protein, 29 aa, Artificial Sequence
  Description of Artificial Sequence: Synthetic peptide
DEEEIRTTNPVATEQYGSVSCTNYQRGNR

SEQ ID NO: 1912 - protein, 28 aa, Artificial Sequence
  Description of Artificial Sequence: Synthetic peptide
DEEEIRCTNPVATEQYGTVSTNLQRGNR

SEQ ID NO: 1913 - protein, 28 aa, Artificial Sequence
  Description of Artificial Sequence: Synthetic peptide
DEAEIRTTNPVATENYGSVSTNLQRGNR

SEQ ID NO: 1914 - protein, 28 aa, Artificial Sequence
  Description of Artificial Sequence: Synthetic peptide
DEQEIRTTNPVATEQYGSVSTNLMRGNR

SEQ ID NO: 1915 - protein, 29 aa, Artificial Sequence
  Description of Artificial Sequence: Synthetic peptide
DEEEIRTTNPVATEQYGSVSITNLQRGNN

SEQ ID NO: 1916 - protein, 28 aa, Artificial Sequence
  Description of Artificial Sequence: Synthetic peptide
DEEEIRTTNPVATEQYGSVSTPLQRGNM

SEQ ID NO: 1917 - protein, 30 aa, Artificial Sequence
  Description of Artificial Sequence: Synthetic polypeptide
DEEEIRTTNPVATEQYGSVSTNLVQRGTNR

SEQ ID NO: 1918 - protein, 28 aa, Artificial Sequence
  Description of Artificial Sequence: Synthetic peptide
DEEEIRTVNPVATEQYGSASTNLQRGNR

SEQ ID NO: 1919 - protein, 28 aa, Artificial Sequence
  Description of Artificial Sequence: Synthetic peptide
DEEEIATTNPVANEQYGSVSTNLQRGNR

SEQ ID NO: 1920 - protein, 28 aa, Artificial Sequence
  Description of Artificial Sequence: Synthetic peptide
DEQEIRTTNPVSTEQYGSVSTNLQRGNR

SEQ ID NO: 1921 - protein, 28 aa, Artificial Sequence
  Description of Artificial Sequence: Synthetic peptide
DEEEIRTTNPVATEQYGSVSTNLEEGNR

SEQ ID NO: 1922 - protein, 29 aa, Artificial Sequence
  Description of Artificial Sequence: Synthetic peptide
DEEEIRTTNPVATEQYGSVSSNLQRAGNR

SEQ ID NO: 1923 - protein, 30 aa, Artificial Sequence
  Description of Artificial Sequence: Synthetic polypeptide
DEEEIRTTNPVATEQYGSVESTNLVQRGNR

SEQ ID NO: 1924 - protein, 29 aa, Artificial Sequence
  Description of Artificial Sequence: Synthetic peptide
DEEEIRTTNPVATEQYGSVSTMNLQTGNR

SEQ ID NO: 1925 - protein, 29 aa, Artificial Sequence
  Description of Artificial Sequence: Synthetic peptide
DEEEIRTTNPVATEQCGSVSTNLQRLGNR

SEQ ID NO: 1926 - protein, 28 aa, Artificial Sequence
  Description of Artificial Sequence: Synthetic peptide
DEEEIRTTNPVATQQYGSVSTNLQRGNG

SEQ ID NO: 1927 - protein, 28 aa, Artificial Sequence
  Description of Artificial Sequence: Synthetic peptide
DEQEIATTNPVATEQYGSVSTNLQRGNR

SEQ ID NO: 1928 - protein, 28 aa, Artificial Sequence
  Description of Artificial Sequence: Synthetic peptide
MEQEIRTTNPVATEQYGSVSTNLQRGNR

SEQ ID NO: 1929 - protein, 28 aa, Artificial Sequence
  Description of Artificial Sequence: Synthetic peptide
DEEEIRTTNPVATEQYGSVPTNLQRENR

SEQ ID NO: 1930 - protein, 29 aa, Artificial Sequence
  Description of Artificial Sequence: Synthetic peptide
DEEEIRTTNPVATEQYGSVSTNLQIRGNA

SEQ ID NO: 1931 - protein, 28 aa, Artificial Sequence
  Description of Artificial Sequence: Synthetic peptide
DEEEIRTTNPVATEQYGSVSTNLQSGER

SEQ ID NO: 1932 - protein, 29 aa, Artificial Sequence
  Description of Artificial Sequence: Synthetic peptide
DEEEIRTTNPVATEQYGSVSTNLQVGNER

SEQ ID NO: 1933 - protein, 29 aa, Artificial Sequence
  Description of Artificial Sequence: Synthetic peptide
DEEEIRTTNPVATEQFYGSVSTNLQNGNR

SEQ ID NO: 1934 - protein, 28 aa, Artificial Sequence
  Description of Artificial Sequence: Synthetic peptide
DEEQIRTTNPVATEQYGSVDTNLQRGNR

SEQ ID NO: 1935 - protein, 28 aa, Artificial Sequence
  Description of Artificial Sequence: Synthetic peptide
MEEEIRTTNPVATEQYGSVSLNLQRGNR

SEQ ID NO: 1936 - protein, 29 aa, Artificial Sequence
  Description of Artificial Sequence: Synthetic peptide
DEEEIRTTNPVATEQYGSVSTNLQEAGNR

SEQ ID NO: 1937 - protein, 30 aa, Artificial Sequence
  Description of Artificial Sequence: Synthetic polypeptide
DEEEIRTTNPVATEQYGSVSTMNLDQRGNR

SEQ ID NO: 1938 - protein, 28 aa, Artificial Sequence
  Description of Artificial Sequence: Synthetic peptide
DEEEIRTTNPAATEQYGEVSTNLQRGNR

SEQ ID NO: 1939 - protein, 29 aa, Artificial Sequence
  Description of Artificial Sequence: Synthetic peptide
DEEEIRTTNPDATEQYGSVSTNPLQRGNR

SEQ ID NO: 1940 - protein, 28 aa, Artificial Sequence
  Description of Artificial Sequence: Synthetic peptide
DEEEIRTTNPVATLQYGSVSTNLQRGND

SEQ ID NO: 1941 - protein, 28 aa, Artificial Sequence
  Description of Artificial Sequence: Synthetic peptide
DEEEIRTTNPVATEQYGSVSTNLQRLNQ

SEQ ID NO: 1942 - protein, 28 aa, Artificial Sequence
  Description of Artificial Sequence: Synthetic peptide
DEEEIETTNPVATEQYGSVSTNLQTGNR

SEQ ID NO: 1943 - protein, 29 aa, Artificial Sequence
  Description of Artificial Sequence: Synthetic peptide
DEEEIRTTNPVATEQYGSVSTNPLDRGNR

SEQ ID NO: 1944 - protein, 29 aa, Artificial Sequence
  Description of Artificial Sequence: Synthetic peptide
DEEEIRTTNPVATEQYGSVSTPLVQRGNR

SEQ ID NO: 1945 - protein, 28 aa, Artificial Sequence
  Description of Artificial Sequence: Synthetic peptide
DEEEIRTTNPVATEQYGSVSTNLQAGNL

SEQ ID NO: 1946 - protein, 28 aa, Artificial Sequence
  Description of Artificial Sequence: Synthetic peptide
DEEEIRTTNPEATEQYGSVSTNLQQGNR

SEQ ID NO: 1947 - protein, 28 aa, Artificial Sequence
  Description of Artificial Sequence: Synthetic peptide
DEEEIRTTNPVATEQYGSVSTVLQRGGR

SEQ ID NO: 1948 - protein, 29 aa, Artificial Sequence
  Description of Artificial Sequence: Synthetic peptide
DEEEIRTTNPVATEQYGSVDTNGLQRGNR

SEQ ID NO: 1949 - protein, 28 aa, Artificial Sequence
  Description of Artificial Sequence: Synthetic peptide
DEAEIATTNPVATEQYGSVSTNLQRGNR

SEQ ID NO: 1950 - protein, 28 aa, Artificial Sequence
  Description of Artificial Sequence: Synthetic peptide
DEEEIRTTNPVATEHYGVVSTNLQRGNR

SEQ ID NO: 1951 - protein, 28 aa, Artificial Sequence
  Description of Artificial Sequence: Synthetic peptide
DEEEIRTTNPVSTEQYGCVSTNLQRGNR

SEQ ID NO: 1952 - protein, 29 aa, Artificial Sequence
  Description of Artificial Sequence: Synthetic peptide
DEEEIRTTNPVATEQYGSVSDTNDQRGNR

SEQ ID NO: 1953 - protein, 28 aa, Artificial Sequence
  Description of Artificial Sequence: Synthetic peptide
DEMEIRTTNPVATEQYGSVSTNLQRMNR

SEQ ID NO: 1954 - protein, 28 aa, Artificial Sequence
  Description of Artificial Sequence: Synthetic peptide
DEEEIRTTNPVATEIYGSVSTNLQRGNG

SEQ ID NO: 1955 - protein, 29 aa, Artificial Sequence
  Description of Artificial Sequence: Synthetic peptide
DEEEIRTTNPVATEQYGSVSTNLQERGNQ

SEQ ID NO: 1956 - protein, 28 aa, Artificial Sequence
  Description of Artificial Sequence: Synthetic peptide
DEEEICTTNPTATEQYGSVSTNLQRGNR

SEQ ID NO: 1957 - protein, 28 aa, Artificial Sequence
  Description of Artificial Sequence: Synthetic peptide
DEEEIRTTNPVATEQYGSVSTNLQLGNE

SEQ ID NO: 1958 - protein, 28 aa, Artificial Sequence
  Description of Artificial Sequence: Synthetic peptide
DEEEIRTTNVVATEQYGSVSTNLQRGNW

SEQ ID NO: 1959 - protein, 28 aa, Artificial Sequence
  Description of Artificial Sequence: Synthetic peptide
DEEEIRSTNPFATEQYGSVSTNLQRGNR

SEQ ID NO: 1960 - protein, 28 aa, Artificial Sequence
  Description of Artificial Sequence: Synthetic peptide
DEEEIRTTNPVATEQYGSVSTNLQNGNF

SEQ ID NO: 1961 - protein, 28 aa, Artificial Sequence
  Description of Artificial Sequence: Synthetic peptide
DEEEIRTTNPVATEQYGDVSTNEQRGNR

SEQ ID NO: 1962 - protein, 28 aa, Artificial Sequence
  Description of Artificial Sequence: Synthetic peptide
DEEEIRTTNPVATEQYGSVSTNFQRFNR

SEQ ID NO: 1963 - protein, 30 aa, Artificial Sequence
  Description of Artificial Sequence: Synthetic polypeptide
DEEEIRTTNPVATEQYGSVSTCNLQRGTNR

SEQ ID NO: 1964 - protein, 28 aa, Artificial Sequence
  Description of Artificial Sequence: Synthetic peptide
DEEEIRTTNPVCTEQYGSVSTNEQRGNR

SEQ ID NO: 1965 - protein, 29 aa, Artificial Sequence
  Description of Artificial Sequence: Synthetic peptide
DEEEIRTTNPVATEQYGSYVSTNLQRGNE

SEQ ID NO: 1966 - protein, 29 aa, Artificial Sequence
  Description of Artificial Sequence: Synthetic peptide
DEEEIRTTNPVATEQYGSVSTNLQDYGNR

SEQ ID NO: 1967 - protein, 29 aa, Artificial Sequence
  Description of Artificial Sequence: Synthetic peptide
DEEEIRTTNPVATEQYGGVSTNLQRGDNR

SEQ ID NO: 1968 - protein, 29 aa, Artificial Sequence
  Description of Artificial Sequence: Synthetic peptide
DEEEIRTTNPVATEQYGSVSTNPLQRGNF

SEQ ID NO: 1969 - protein, 28 aa, Artificial Sequence
  Description of Artificial Sequence: Synthetic peptide
DEEEIRTTNPVATEQYGSMSTNLQRGLR

SEQ ID NO: 1970 - protein, 29 aa, Artificial Sequence
  Description of Artificial Sequence: Synthetic peptide
DEEEIRTTNPVATEQYGSVSETNLQRGNS

SEQ ID NO: 1971 - protein, 28 aa, Artificial Sequence
  Description of Artificial Sequence: Synthetic peptide
DEEEIRTTNPVATEQYGSVSMNLQRGDR

SEQ ID NO: 1972 - protein, 28 aa, Artificial Sequence
  Description of Artificial Sequence: Synthetic peptide
DEEEIRTTNPVATEQYGSVSTNLQYGNQ

SEQ ID NO: 1973 - protein, 28 aa, Artificial Sequence
  Description of Artificial Sequence: Synthetic peptide
DEEEIRTTNPVATEQYGSVSTNLQPGQR

SEQ ID NO: 1974 - protein, 30 aa, Artificial Sequence
  Description of Artificial Sequence: Synthetic polypeptide
DEEEIRTTNPVATEQYGSVSTGNLQYRGNR

SEQ ID NO: 1975 - protein, 29 aa, Artificial Sequence
  Description of Artificial Sequence: Synthetic peptide
DENEIRTTNPVATEQYGSVSTNLQREGNR

SEQ ID NO: 1976 - protein, 29 aa, Artificial Sequence
  Description of Artificial Sequence: Synthetic peptide
DEEEIRTTNPVATEQYGSVSTNLQTGNDR

SEQ ID NO: 1977 - protein, 28 aa, Artificial Sequence
  Description of Artificial Sequence: Synthetic peptide
DEEEIRTTNPVATEQYGSVSTNLQRDNI

SEQ ID NO: 1978 - protein, 29 aa, Artificial Sequence
  Description of Artificial Sequence: Synthetic peptide
DEEEIRTTNPVATEQYGSVSITNLQRGNI

SEQ ID NO: 1979 - protein, 30 aa, Artificial Sequence
  Description of Artificial Sequence: Synthetic polypeptide
DEEEIRTTNPVATEQYGYSVSTNMLQRGNR

SEQ ID NO: 1980 - protein, 30 aa, Artificial Sequence
  Description of Artificial Sequence: Synthetic polypeptide
DEEEIRTTNPVATEQYGSVSATNLQVRGNR

SEQ ID NO: 1981 - protein, 30 aa, Artificial Sequence
  Description of Artificial Sequence: Synthetic polypeptide
DEEEIRTTNPVATEQYGSVSTNLQDREGNR

SEQ ID NO: 1982 - protein, 29 aa, Artificial Sequence
  Description of Artificial Sequence: Synthetic peptide
DEEEIRTTNPVATEWYGSVSTNLQNRGNR

SEQ ID NO: 1983 - protein, 28 aa, Artificial Sequence
  Description of Artificial Sequence: Synthetic peptide
DENEIRTTNPVATEQYGSVSTNLTRGNR

SEQ ID NO: 1984 - protein, 29 aa, Artificial Sequence
  Description of Artificial Sequence: Synthetic peptide
DEEEIRTTNPVATEQYGSVSTNPQRGDNR

SEQ ID NO: 1985 - protein, 28 aa, Artificial Sequence
  Description of Artificial Sequence: Synthetic peptide
DEEEIRTTNPVATEQYGSVSTDLERGNR

SEQ ID NO: 1986 - protein, 28 aa, Artificial Sequence
  Description of Artificial Sequence: Synthetic peptide
DEEEIRTTNPVATEQYGSVSTNPQRGND

SEQ ID NO: 1987 - protein, 28 aa, Artificial Sequence
  Description of Artificial Sequence: Synthetic peptide
DEEEIRTTNPVATEQYGSVSTNHWRGNR

SEQ ID NO: 1988 - protein, 30 aa, Artificial Sequence
  Description of Artificial Sequence: Synthetic polypeptide
DEEEIRTTNPVATEQYGVSVSTNLQRGENR

SEQ ID NO: 1989 - protein, 28 aa, Artificial Sequence
  Description of Artificial Sequence: Synthetic peptide
DDEEIRTTNPVATEQYGSVSTNLQRGGR

SEQ ID NO: 1990 - protein, 28 aa, Artificial Sequence
  Description of Artificial Sequence: Synthetic peptide
YEEEIRTTNPCATEQYGSVSTNLQRGNR

SEQ ID NO: 1991 - protein, 28 aa, Artificial Sequence
  Description of Artificial Sequence: Synthetic peptide
DDEEIRTTNPVATEQYGCVSTNLQRGNR

SEQ ID NO: 1992 - protein, 28 aa, Artificial Sequence
  Description of Artificial Sequence: Synthetic peptide
DEQEIRTTNPVATEQYGSVSTNLQRGNC

SEQ ID NO: 1993 - protein, 28 aa, Artificial Sequence
  Description of Artificial Sequence: Synthetic peptide
DEEEIRTTNPVATAQYGSVSTNLQRGNG

SEQ ID NO: 1994 - protein, 28 aa, Artificial Sequence
  Description of Artificial Sequence: Synthetic peptide
DENEIRGTNPVATEQYGSVSTNLQRGNR

SEQ ID NO: 1995 - protein, 28 aa, Artificial Sequence
  Description of Artificial Sequence: Synthetic peptide
DEEEIRTTNPVATEQYGSVSTNEQRGNA

SEQ ID NO: 1996 - protein, 29 aa, Artificial Sequence
  Description of Artificial Sequence: Synthetic peptide
DEEEIRTTNPVATEQYGSVSTGGLQRGNR

SEQ ID NO: 1997 - protein, 28 aa, Artificial Sequence
  Description of Artificial Sequence: Synthetic peptide
DEEEIHTTNPVATEQYGSVSTNPQRGNR

SEQ ID NO: 1998 - protein, 28 aa, Artificial Sequence
  Description of Artificial Sequence: Synthetic peptide
DEEEIRTTNPCATEQYGTVSTNLQRGNR

SEQ ID NO: 1999 - protein, 29 aa, Artificial Sequence
  Description of Artificial Sequence: Synthetic peptide
DEEEIRTTNPVATEQYGGVSTNLQLRGNR

SEQ ID NO: 2000 - protein, 30 aa, Artificial Sequence
  Description of Artificial Sequence: Synthetic polypeptide
DEEEIRTTNPVATEQYGSVPSTNDLQRGNR

SEQ ID NO: 2001 - protein, 28 aa, Artificial Sequence
  Description of Artificial Sequence: Synthetic peptide
DEEEIRTTNPTATEQYGSVSMNLQRGNR

SEQ ID NO: 2002 - protein, 29 aa, Artificial Sequence
  Description of Artificial Sequence: Synthetic peptide
DEEEIRTTNPVATEQYGYVDSTNLQRGNR

SEQ ID NO: 2003 - protein, 28 aa, Artificial Sequence
  Description of Artificial Sequence: Synthetic peptide
DENEIRTTNPVATEQYGSVSTNLQIGNR

SEQ ID NO: 2004 - protein, 28 aa, Artificial Sequence
  Description of Artificial Sequence: Synthetic peptide
DEEEIRTTNPVATEQYGSVSTNLDRGNL

SEQ ID NO: 2005 - protein, 28 aa, Artificial Sequence
  Description of Artificial Sequence: Synthetic peptide
DPEEIRTTNPVATEQYGSVSTNLIRGNR

SEQ ID NO: 2006 - protein, 28 aa, Artificial Sequence
  Description of Artificial Sequence: Synthetic peptide
DEVEIRTTNPTATEQYGSVSTNLQRGNR

SEQ ID NO: 2007 - protein, 30 aa, Artificial Sequence
  Description of Artificial Sequence: Synthetic polypeptide
DEEEIRTTNPVATEQYGSVSTLNLQREGNR

SEQ ID NO: 2008 - protein, 28 aa, Artificial Sequence
  Description of Artificial Sequence: Synthetic peptide
VEEEIRTTNPVATEQYGSVSTNLQRGDR

SEQ ID NO: 2009 - protein, 28 aa, Artificial Sequence
  Description of Artificial Sequence: Synthetic peptide
DEEEIRTVNPVATEQYGSVATNLQRGNR

SEQ ID NO: 2010 - protein, 30 aa, Artificial Sequence
  Description of Artificial Sequence: Synthetic polypeptide
DEEEIRTTNPVATEQYGSVTSTNLQVRGNR

SEQ ID NO: 2011 - protein, 28 aa, Artificial Sequence
  Description of Artificial Sequence: Synthetic peptide
DEEEIRTTNPVAEEQYGSVSTNLQRVNR

SEQ ID NO: 2012 - protein, 28 aa, Artificial Sequence
  Description of Artificial Sequence: Synthetic peptide
DEEEIRTTNPVATEQYGSVSTNDQNGNR

SEQ ID NO: 2013 - protein, 29 aa, Artificial Sequence
  Description of Artificial Sequence: Synthetic peptide
DEEEIRTVNPVATEQYGSVSTNLQRGDNR

SEQ ID NO: 2014 - protein, 28 aa, Artificial Sequence
  Description of Artificial Sequence: Synthetic peptide
NDEEIRTTNPVATEQYGSVSTNLQRGNR

SEQ ID NO: 2015 - protein, 28 aa, Artificial Sequence
  Description of Artificial Sequence: Synthetic peptide
MEEEIRTTNPVATEQYGSVSTNLQRGNT

SEQ ID NO: 2016 - protein, 30 aa, Artificial Sequence
  Description of Artificial Sequence: Synthetic polypeptide
DEEEIRTTNPVATEQYGSVSTNLQRMGENR

SEQ ID NO: 2017 - protein, 28 aa, Artificial Sequence
  Description of Artificial Sequence: Synthetic peptide
DEEEIRTTNPVATEQYGSVSTNQQPGNR

SEQ ID NO: 2018 - protein, 29 aa, Artificial Sequence
  Description of Artificial Sequence: Synthetic peptide
DEEEIRTTNPVATEQYGSVSTNLQDRGNV

SEQ ID NO: 2019 - protein, 29 aa, Artificial Sequence
  Description of Artificial Sequence: Synthetic peptide
DEEEIRTTNPVATEQYGSVSTINLQHGNR

SEQ ID NO: 2020 - protein, 29 aa, Artificial Sequence
  Description of Artificial Sequence: Synthetic peptide
DEEEIRTTNPCATEQYGSVSTNLQRGENR

SEQ ID NO: 2021 - protein, 28 aa, Artificial Sequence
  Description of Artificial Sequence: Synthetic peptide
DDQEIRTTNPVATEQYGSVSTNLQRGNR

SEQ ID NO: 2022 - protein, 30 aa, Artificial Sequence
  Description of Artificial Sequence: Synthetic polypeptide
DEEEIRTTNPVATEQYGSVSTNGLQLRGNR

SEQ ID NO: 2023 - protein, 28 aa, Artificial Sequence
  Description of Artificial Sequence: Synthetic peptide
DEEEIRCTNPVATEQYGCVSTNLQRGNR

SEQ ID NO: 2024 - protein, 29 aa, Artificial Sequence
  Description of Artificial Sequence: Synthetic peptide
DEEEIRTTNPVATEQYGSVSTNLQERGNW

SEQ ID NO: 2025 - protein, 30 aa, Artificial Sequence
  Description of Artificial Sequence: Synthetic polypeptide
DEEEIRTTNPVATEQYGSVSTDNLQRGNER

SEQ ID NO: 2026 - protein, 28 aa, Artificial Sequence
  Description of Artificial Sequence: Synthetic peptide
DEEEIRTTNPFATEQYGSVSTPLQRGNR

SEQ ID NO: 2027 - protein, 28 aa, Artificial Sequence
  Description of Artificial Sequence: Synthetic peptide
DEEEIRTTNPVATEQYGSVSENLKRGNR

SEQ ID NO: 2028 - protein, 28 aa, Artificial Sequence
  Description of Artificial Sequence: Synthetic peptide
DEEEIRTTNPVATEQYGSVSTNDQRGTR

SEQ ID NO: 2029 - protein, 30 aa, Artificial Sequence
  Description of Artificial Sequence: Synthetic polypeptide
DEEEIRTTNPVATEQYGNSVSTNLMQRGNR

SEQ ID NO: 2030 - protein, 29 aa, Artificial Sequence
  Description of Artificial Sequence: Synthetic peptide
DEEEIRTTNPVATEQYGSVDSTNLQRGNI

SEQ ID NO: 2031 - protein, 28 aa, Artificial Sequence
  Description of Artificial Sequence: Synthetic peptide
DEEEIRTTNPVATEQYGSVSTNPQQGNR

SEQ ID NO: 2032 - protein, 28 aa, Artificial Sequence
  Description of Artificial Sequence: Synthetic peptide
DEEEIRTTNPVATEQYGSVSTNLQHGDR

SEQ ID NO: 2033 - protein, 30 aa, Artificial Sequence
  Description of Artificial Sequence: Synthetic polypeptide
DEEEIRTTNPVATEQYGSVSTDNLQRGVNR

SEQ ID NO: 2034 - protein, 30 aa, Artificial Sequence
  Description of Artificial Sequence: Synthetic polypeptide
DEEEIRTTNPVATEQYGSVSTNGLPQRGNR

SEQ ID NO: 2035 - protein, 28 aa, Artificial Sequence
  Description of Artificial Sequence: Synthetic peptide
DEEEICTTNPVATEQYGWVSTNLQRGNR

SEQ ID NO: 2036 - protein, 29 aa, Artificial Sequence
  Description of Artificial Sequence: Synthetic peptide
DEEEIRTTNPVATEQYGSVLTENLQRGNR

SEQ ID NO: 2037 - protein, 29 aa, Artificial Sequence
  Description of Artificial Sequence: Synthetic peptide
DEEEIRTTNPVATEQYGSVSTNLQERGNA

SEQ ID NO: 2038 - protein, 28 aa, Artificial Sequence
  Description of Artificial Sequence: Synthetic peptide
DEEEIRTTNPVATEQYGSVDTNLQTGNR

SEQ ID NO: 2039 - protein, 28 aa, Artificial Sequence
  Description of Artificial Sequence: Synthetic peptide
DEEEIRTTNPVATEQYGSYSTNEQRGNR

SEQ ID NO: 2040 - protein, 29 aa, Artificial Sequence
  Description of Artificial Sequence: Synthetic peptide
DEEEIRTTNPVATEQYGSVSTNLQRDENR

SEQ ID NO: 2041 - protein, 28 aa, Artificial Sequence
  Description of Artificial Sequence: Synthetic peptide
DEEEIRTTNPVATEQYGWVTTNLQRGNR

SEQ ID NO: 2042 - protein, 29 aa, Artificial Sequence
  Description of Artificial Sequence: Synthetic peptide
DEEEIRTTNPVATEQYGVVSTNLQLRGNR

SEQ ID NO: 2043 - protein, 28 aa, Artificial Sequence
  Description of Artificial Sequence: Synthetic peptide
DEEEIRTTNPVATEQYGSVSTMLQRGGR

SEQ ID NO: 2044 - protein, 28 aa, Artificial Sequence
  Description of Artificial Sequence: Synthetic peptide
DEEEIRTTNPVATEQYGSVETNEQRGNR

SEQ ID NO: 2045 - protein, 28 aa, Artificial Sequence
  Description of Artificial Sequence: Synthetic peptide
DDEEVRTTNPVATEQYGSVSTNLQRGNR

SEQ ID NO: 2046 - protein, 28 aa, Artificial Sequence
  Description of Artificial Sequence: Synthetic peptide
DEEEIRTTNPVATEQYGSVSTNLERLNR

SEQ ID NO: 2047 - protein, 29 aa, Artificial Sequence
  Description of Artificial Sequence: Synthetic peptide
DEEEIRPTNPVATEQYGSVASTNLQRGNR

SEQ ID NO: 2048 - protein, 28 aa, Artificial Sequence
  Description of Artificial Sequence: Synthetic peptide
DEEEIRTTNPVATEQYGSVSTNLERGNQ

SEQ ID NO: 2049 - protein, 28 aa, Artificial Sequence
  Description of Artificial Sequence: Synthetic peptide
DEEEIRTTNPVATYQYGSVCTNLQRGNR

SEQ ID NO: 2050 - protein, 28 aa, Artificial Sequence
  Description of Artificial Sequence: Synthetic peptide
DEEEIRTTNPVATEQYGSVSTNLQSGNQ

SEQ ID NO: 2051 - protein, 29 aa, Artificial Sequence
  Description of Artificial Sequence: Synthetic peptide
DEEEIRTTNPVATEQYGSWSTNLQRGINR

SEQ ID NO: 2052 - protein, 28 aa, Artificial Sequence
  Description of Artificial Sequence: Synthetic peptide
DEEEIRTTNPVATEQYGSVSTNLQLGNS

SEQ ID NO: 2053 - protein, 28 aa, Artificial Sequence
  Description of Artificial Sequence: Synthetic peptide
DEEEIRSTNPVATEMYGSVSTNLQRGNR

SEQ ID NO: 2054 - protein, 29 aa, Artificial Sequence
  Description of Artificial Sequence: Synthetic peptide
DEEEIRTTNPVATEQYGSVSTNLQRGENP

SEQ ID NO: 2055 - protein, 28 aa, Artificial Sequence
  Description of Artificial Sequence: Synthetic peptide
GEEEIRTTNPVATEQYGCVSTNLQRGNR

SEQ ID NO: 2056 - protein, 28 aa, Artificial Sequence
  Description of Artificial Sequence: Synthetic peptide
DEEEIATTNPVATEQYGSVSTNLQRGNG

SEQ ID NO: 2057 - protein, 28 aa, Artificial Sequence
  Description of Artificial Sequence: Synthetic peptide
YEEEIRTTNPVATEQYGSVSTNLQRGNV

SEQ ID NO: 2058 - protein, 29 aa, Artificial Sequence
  Description of Artificial Sequence: Synthetic peptide
DEEEIRTTNPVATEQYGSVSTNLQIDGNR

SEQ ID NO: 2059 - protein, 28 aa, Artificial Sequence
  Description of Artificial Sequence: Synthetic peptide
DEEEIVTTNPVATEQYGSVATNLQRGNR

SEQ ID NO: 2060 - protein, 29 aa, Artificial Sequence
  Description of Artificial Sequence: Synthetic peptide
DEEEIRTTNPVATEQYGSVSFNLIQRGNR

SEQ ID NO: 2061 - protein, 28 aa, Artificial Sequence
  Description of Artificial Sequence: Synthetic peptide
DEEEIRTTNPVCTEQYGSVSTNLQRGNE

SEQ ID NO: 2062 - protein, 28 aa, Artificial Sequence
  Description of Artificial Sequence: Synthetic peptide
DEEEIRTTNPVATEQYGSVSTNLHRGER

SEQ ID NO: 2063 - protein, 28 aa, Artificial Sequence
  Description of Artificial Sequence: Synthetic peptide
KEEEIRTTNPVATEQYGSVSENLQRGNR

SEQ ID NO: 2064 - protein, 28 aa, Artificial Sequence
  Description of Artificial Sequence: Synthetic peptide
DEEEIRTTNPVATEQYGSVSDNLQRGNG

SEQ ID NO: 2065 - protein, 28 aa, Artificial Sequence
  Description of Artificial Sequence: Synthetic peptide
MEEEIRTTNPVATEQYGWVSTNLQRGNR

SEQ ID NO: 2066 - protein, 28 aa, Artificial Sequence
  Description of Artificial Sequence: Synthetic peptide
DEEEIRTVNPVATEQYGSVSTNLQRDNR

SEQ ID NO: 2067 - protein, 28 aa, Artificial Sequence
  Description of Artificial Sequence: Synthetic peptide
DEEEIRTTNPVATEQYGSVSTNLHPGNR

SEQ ID NO: 2068 - protein, 28 aa, Artificial Sequence
  Description of Artificial Sequence: Synthetic peptide
DEEEIRTTNPVATEQYGSVSTNLDQGNR

SEQ ID NO: 2069 - protein, 28 aa, Artificial Sequence
  Description of Artificial Sequence: Synthetic peptide
DEEEIVTTNPVATEQYGSVSTNLERGNR

SEQ ID NO: 2070 - protein, 28 aa, Artificial Sequence
  Description of Artificial Sequence: Synthetic peptide
DEEEIRTTNPVATEQYGSVDTNLQRGND

SEQ ID NO: 2071 - protein, 28 aa, Artificial Sequence
  Description of Artificial Sequence: Synthetic peptide
DEEEIRTTNPVATEQWGSVSTNLQRGDR

SEQ ID NO: 2072 - protein, 29 aa, Artificial Sequence
  Description of Artificial Sequence: Synthetic peptide
DEEEIRTTNPVATEQYGSVSTNPLQEGNR

SEQ ID NO: 2073 - protein, 28 aa, Artificial Sequence
  Description of Artificial Sequence: Synthetic peptide
NEEEIRTTNPVATEQYGSVSENLQRGNR

SEQ ID NO: 2074 - protein, 29 aa, Artificial Sequence
  Description of Artificial Sequence: Synthetic peptide
DEEEIRTTNPVATEQYGSVSTNLQSGNDR

SEQ ID NO: 2075 - protein, 28 aa, Artificial Sequence
  Description of Artificial Sequence: Synthetic peptide
DEEEIRTTNPVATEQYGSVSTNLQRGDI

SEQ ID NO: 2076 - protein, 30 aa, Artificial Sequence
  Description of Artificial Sequence: Synthetic polypeptide
DEEEIRTTNPVATEQYGSVSTNLQDRGNDR

SEQ ID NO: 2077 - protein, 28 aa, Artificial Sequence
  Description of Artificial Sequence: Synthetic peptide
DEEEIRQTNPVASEQYGSVSTNLQRGNR

SEQ ID NO: 2078 - protein, 28 aa, Artificial Sequence
  Description of Artificial Sequence: Synthetic peptide
DEEEIRTTNPVATEQYGMVSTNLQIGNR

SEQ ID NO: 2079 - protein, 28 aa, Artificial Sequence
  Description of Artificial Sequence: Synthetic peptide
DEEEIRTTNPVATEQYGSVSTNLQIGNW

SEQ ID NO: 2080 - protein, 29 aa, Artificial Sequence
  Description of Artificial Sequence: Synthetic peptide
DEGEIRTTNPVATEQYGSVSTNLQRGNTR

SEQ ID NO: 2081 - protein, 28 aa, Artificial Sequence
  Description of Artificial Sequence: Synthetic peptide
DEEEIRTTNPVATEQYGSVSTNLQPGNA

SEQ ID NO: 2082 - protein, 28 aa, Artificial Sequence
  Description of Artificial Sequence: Synthetic peptide
DEEELRTTNPVATEQYGCVSTNLQRGNR

SEQ ID NO: 2083 - protein, 29 aa, Artificial Sequence
  Description of Artificial Sequence: Synthetic peptide
DEEEIRTTNPVATEQWGSVCSTNLQRGNR

SEQ ID NO: 2084 - protein, 28 aa, Artificial Sequence
  Description of Artificial Sequence: Synthetic peptide
DDNEIRTTNPVATEQYGSVSTNLQRGNR

SEQ ID NO: 2085 - protein, 30 aa, Artificial Sequence
  Description of Artificial Sequence: Synthetic polypeptide
DEEEIRTTNPVATEQYGSVSTPNLQERGNR

SEQ ID NO: 2086 - protein, 28 aa, Artificial Sequence
  Description of Artificial Sequence: Synthetic peptide
QEEEIRTTNPVATELYGSVSTNLQRGNR

SEQ ID NO: 2087 - protein, 29 aa, Artificial Sequence
  Description of Artificial Sequence: Synthetic peptide
DEYEIRTTNPVATEQYGSVSTNLQRGNTR

SEQ ID NO: 2088 - protein, 28 aa, Artificial Sequence
  Description of Artificial Sequence: Synthetic peptide
DEEEIRTVNPVASEQYGSVSTNLQRGNR

SEQ ID NO: 2089 - protein, 28 aa, Artificial Sequence
  Description of Artificial Sequence: Synthetic peptide
DEEEIRATNPEATEQYGSVSTNLQRGNR

SEQ ID NO: 2090 - protein, 28 aa, Artificial Sequence
  Description of Artificial Sequence: Synthetic peptide
DEEEIRTTNPVATEQYGSVSTNLQQGNC

SEQ ID NO: 2091 - protein, 28 aa, Artificial Sequence
  Description of Artificial Sequence: Synthetic peptide
DEEEIRTTNPVATWQYGSVSTNLQRGVR

SEQ ID NO: 2092 - protein, 28 aa, Artificial Sequence
  Description of Artificial Sequence: Synthetic peptide
DEQEICTTNPVATEQYGSVSTNLQRGNR

SEQ ID NO: 2093 - protein, 28 aa, Artificial Sequence
  Description of Artificial Sequence: Synthetic peptide
DEEEIRTTNPVATECYGSVSTNLLRGNR

SEQ ID NO: 2094 - protein, 29 aa, Artificial Sequence
  Description of Artificial Sequence: Synthetic peptide
DEEEIRTTNPVATEQYGSVSTNLQRGDNG

SEQ ID NO: 2095 - protein, 28 aa, Artificial Sequence
  Description of Artificial Sequence: Synthetic peptide
DEEEIRTTNPVATEQYGSVSTNLQFGNM

SEQ ID NO: 2096 - protein, 28 aa, Artificial Sequence
  Description of Artificial Sequence: Synthetic peptide
DEEEIRTTNPVATEQYGIVATNLQRGNR

SEQ ID NO: 2097 - protein, 28 aa, Artificial Sequence
  Description of Artificial Sequence: Synthetic peptide
DEEEIRTTNPVATEQYGSVSTNPYRGNR

SEQ ID NO: 2098 - protein, 28 aa, Artificial Sequence
  Description of Artificial Sequence: Synthetic peptide
DEEEIATTNPVATEQYGSVSTNLERGNR

SEQ ID NO: 2099 - protein, 28 aa, Artificial Sequence
  Description of Artificial Sequence: Synthetic peptide
DEEEIRTTNPVATEQYGSVSTNLQTGNS

SEQ ID NO: 2100 - protein, 28 aa, Artificial Sequence
  Description of Artificial Sequence: Synthetic peptide
DEEEIRCTNPVATEQYGSVSTNWQRGNR

SEQ ID NO: 2101 - protein, 28 aa, Artificial Sequence
  Description of Artificial Sequence: Synthetic peptide
DEEEIRTTNPVATEQYGSVSTNLQPENR

SEQ ID NO: 2102 - protein, 28 aa, Artificial Sequence
  Description of Artificial Sequence: Synthetic peptide
AEEEIRTTNPVATEQYGSVSTNLIRGNR

SEQ ID NO: 2103 - protein, 28 aa, Artificial Sequence
  Description of Artificial Sequence: Synthetic peptide
DEEEIKTTNPVATEQYGDVSTNLQRGNR

SEQ ID NO: 2104 - protein, 28 aa, Artificial Sequence
  Description of Artificial Sequence: Synthetic peptide
DEEEIRSTNPVATEQYGSVSTNEQRGNR

SEQ ID NO: 2105 - protein, 29 aa, Artificial Sequence
  Description of Artificial Sequence: Synthetic peptide
DEEEIRTTNPVATEQYGWVSTNLQRGDNR

SEQ ID NO: 2106 - protein, 28 aa, Artificial Sequence
  Description of Artificial Sequence: Synthetic peptide
DEEEIRTTNPVATEQYGSVSTDLQRGNV

SEQ ID NO: 2107 - protein, 28 aa, Artificial Sequence
  Description of Artificial Sequence: Synthetic peptide
DEAEIRTTNPVATETYGSVSTNLQRGNR

SEQ ID NO: 2108 - protein, 29 aa, Artificial Sequence
  Description of Artificial Sequence: Synthetic peptide
DEEEIRTTNPFATEQYGSVSTNLQRGNHR

SEQ ID NO: 2109 - protein, 28 aa, Artificial Sequence
  Description of Artificial Sequence: Synthetic peptide
DEEEIRTTNPVATEQYGSVSTNLDRGNQ

SEQ ID NO: 2110 - protein, 28 aa, Artificial Sequence
  Description of Artificial Sequence: Synthetic peptide
DEEEIRTTNPVATEQYGAVSTNLQHGNR

SEQ ID NO: 2111 - protein, 29 aa, Artificial Sequence
  Description of Artificial Sequence: Synthetic peptide
DEEEIRTTNPVATQQYGSVSTNLQRDGNR

SEQ ID NO: 2112 - protein, 28 aa, Artificial Sequence
  Description of Artificial Sequence: Synthetic peptide
DEEEIRTTNPVATDQYGSVSTCLQRGNR

SEQ ID NO: 2113 - protein, 28 aa, Artificial Sequence
  Description of Artificial Sequence: Synthetic peptide
DEEEIRTTNPVATFQYGSVSTNMQRGNR

SEQ ID NO: 2114 - protein, 29 aa, Artificial Sequence
  Description of Artificial Sequence: Synthetic peptide
DEEEIRTTNPVATEQYGSVSVTNLQQGNR

SEQ ID NO: 2115 - protein, 28 aa, Artificial Sequence
  Description of Artificial Sequence: Synthetic peptide
DEEEIRTTNPVATEQYGSVSTNDFRGNR

SEQ ID NO: 2116 - protein, 28 aa, Artificial Sequence
  Description of Artificial Sequence: Synthetic peptide
DEEEIRTTNPVATEQYGSVSTPLQRGNA

SEQ ID NO: 2117 - protein, 28 aa, Artificial Sequence
  Description of Artificial Sequence: Synthetic peptide
DEEEIRTTNPVATQIYGSVSTNLQRGNR

SEQ ID NO: 2118 - protein, 29 aa, Artificial Sequence
  Description of Artificial Sequence: Synthetic peptide
DEEEIRTTNPVATEQYGSVSTNLQRGELR

SEQ ID NO: 2119 - protein, 29 aa, Artificial Sequence
  Description of Artificial Sequence: Synthetic peptide
DEEEIRTTNPVATEQYGSVSCTNLCRGNR

SEQ ID NO: 2120 - protein, 30 aa, Artificial Sequence
  Description of Artificial Sequence: Synthetic polypeptide
DEEEIRTTNPVATEQYGSVSTPNLNQRGNR

SEQ ID NO: 2121 - protein, 29 aa, Artificial Sequence
  Description of Artificial Sequence: Synthetic peptide
DEEEIRTTNPVATEQYGSVSTNLQDGYNR

SEQ ID NO: 2122 - protein, 29 aa, Artificial Sequence
  Description of Artificial Sequence: Synthetic peptide
DEEEIRTTNPVATEQYGSVSTNLDRNGNR

SEQ ID NO: 2123 - protein, 28 aa, Artificial Sequence
  Description of Artificial Sequence: Synthetic peptide
DEEEIRTTNPVATEVYGSVSTGLQRGNR

SEQ ID NO: 2124 - protein, 28 aa, Artificial Sequence
  Description of Artificial Sequence: Synthetic peptide
DEFEIRTTNPVATEQFGSVSTNLQRGNR

SEQ ID NO: 2125 - protein, 28 aa, Artificial Sequence
  Description of Artificial Sequence: Synthetic peptide
SEEEIRTTNPVATEQYGMVSTNLQRGNR

SEQ ID NO: 2126 - protein, 29 aa, Artificial Sequence
  Description of Artificial Sequence: Synthetic peptide
AEEEIRTTNPVATEQYGSVSTNLQRGENR

SEQ ID NO: 2127 - protein, 29 aa, Artificial Sequence
  Description of Artificial Sequence: Synthetic peptide
DEEEIRTTNPVATEQYGSVPTNLQRAGNR

SEQ ID NO: 2128 - protein, 28 aa, Artificial Sequence
  Description of Artificial Sequence: Synthetic peptide
DEEEIRTTNPVCTEQYGSVSTNDQRGNR

SEQ ID NO: 2129 - protein, 29 aa, Artificial Sequence
  Description of Artificial Sequence: Synthetic peptide
DEEEIRTTNPVATEQYGSVSTNLQREGNT

SEQ ID NO: 2130 - protein, 28 aa, Artificial Sequence
  Description of Artificial Sequence: Synthetic peptide
DENEIRTTNPDATEQYGSVSTNLQRGNR

SEQ ID NO: 2131 - protein, 28 aa, Artificial Sequence
  Description of Artificial Sequence: Synthetic peptide
DEEEIRTTNPVATEQYGSVSTCLQRGNN

SEQ ID NO: 2132 - protein, 29 aa, Artificial Sequence
  Description of Artificial Sequence: Synthetic peptide
DEEEIRTTNPVATECYGSVSATNLQRGNR

SEQ ID NO: 2133 - protein, 28 aa, Artificial Sequence
  Description of Artificial Sequence: Synthetic peptide
DEEEIRTTNPVATEQYGSVSTPLQEGNR

SEQ ID NO: 2134 - protein, 29 aa, Artificial Sequence
  Description of Artificial Sequence: Synthetic peptide
AEEEIRTTNPVATEQYGSVSTNLQDRGNR

SEQ ID NO: 2135 - protein, 28 aa, Artificial Sequence
  Description of Artificial Sequence: Synthetic peptide
HEEEIRTTNPVSTEQYGSVSTNLQRGNR

SEQ ID NO: 2136 - protein, 28 aa, Artificial Sequence
  Description of Artificial Sequence: Synthetic peptide
DEEEICTTNPVATEQYGAVSTNLQRGNR

SEQ ID NO: 2137 - protein, 28 aa, Artificial Sequence
  Description of Artificial Sequence: Synthetic peptide
DEEEIRTTNPYATEQYGSVSTNGQRGNR

SEQ ID NO: 2138 - protein, 28 aa, Artificial Sequence
  Description of Artificial Sequence: Synthetic peptide
DEEEIRTTNPVATEQYGSVPTNLQRINR

SEQ ID NO: 2139 - protein, 29 aa, Artificial Sequence
  Description of Artificial Sequence: Synthetic peptide
DEEEIRTTNPVATEQYGSVSTTNLQRGNE

SEQ ID NO: 2140 - protein, 29 aa, Artificial Sequence
  Description of Artificial Sequence: Synthetic peptide
DEEEIRTTNPFATEQYGSVSTNLQLRGNR

SEQ ID NO: 2141 - protein, 30 aa, Artificial Sequence
  Description of Artificial Sequence: Synthetic polypeptide
DEEEIRTTNPVATEQYGSVSDTDNLQRGNR

SEQ ID NO: 2142 - protein, 28 aa, Artificial Sequence
  Description of Artificial Sequence: Synthetic peptide
DEEEIRTTNPVASEQYGAVSTNLQRGNR

SEQ ID NO: 2143 - protein, 28 aa, Artificial Sequence
  Description of Artificial Sequence: Synthetic peptide
DELEIRTTNPVATEQYGSVSTNLQFGNR

SEQ ID NO: 2144 - protein, 28 aa, Artificial Sequence
  Description of Artificial Sequence: Synthetic peptide
DEEEIRTTNPVATEDYGSVSTYLQRGNR

SEQ ID NO: 2145 - protein, 28 aa, Artificial Sequence
  Description of Artificial Sequence: Synthetic peptide
DEEEIRTTNPVATEQYGEDSTNLQRGNR

SEQ ID NO: 2146 - protein, 30 aa, Artificial Sequence
  Description of Artificial Sequence: Synthetic polypeptide
DEEEIRTTNPVATEQYGSVSTNPLQRDGNR

SEQ ID NO: 2147 - protein, 28 aa, Artificial Sequence
  Description of Artificial Sequence: Synthetic peptide
DEEEIRTVNPVATEQYGAVSTNLQRGNR

SEQ ID NO: 2148 - protein, 28 aa, Artificial Sequence
  Description of Artificial Sequence: Synthetic peptide
DEEEIRTTNPEATEQYGSVSTNLQHGNR

SEQ ID NO: 2149 - protein, 30 aa, Artificial Sequence
  Description of Artificial Sequence: Synthetic polypeptide
DEEEIRTTNPVATEQYGSVSCTNLQDRGNR

SEQ ID NO: 2150 - protein, 28 aa, Artificial Sequence
  Description of Artificial Sequence: Synthetic peptide
DEEEIRTTNPVATEQYGSVSTNLQFGNP

SEQ ID NO: 2151 - protein, 28 aa, Artificial Sequence
  Description of Artificial Sequence: Synthetic peptide
REEEIRTTNPVATEQYGSVATNLQRGNR

SEQ ID NO: 2152 - protein, 29 aa, Artificial Sequence
  Description of Artificial Sequence: Synthetic peptide
DEEEIRTTNPVATEQYGDVSTNLQRGNDR

SEQ ID NO: 2153 - protein, 29 aa, Artificial Sequence
  Description of Artificial Sequence: Synthetic peptide
DEEEIRTTNPVATEQYGSVSTNLQERGNN

SEQ ID NO: 2154 - protein, 28 aa, Artificial Sequence
  Description of Artificial Sequence: Synthetic peptide
SEEEIRTTNPVATEQYGGVSTNLQRGNR

SEQ ID NO: 2155 - protein, 28 aa, Artificial Sequence
  Description of Artificial Sequence: Synthetic peptide
DEEEIRTTNPVATEQYGYVSTNLQVGNR

SEQ ID NO: 2156 - protein, 29 aa, Artificial Sequence
  Description of Artificial Sequence: Synthetic peptide
DEEEIRTTNPVATEQYGSVSTDNLQRFNR

SEQ ID NO: 2157 - protein, 28 aa, Artificial Sequence
  Description of Artificial Sequence: Synthetic peptide
DEEEIRTTNPVATEQYGSMSTNLQRGNQ

SEQ ID NO: 2158 - protein, 28 aa, Artificial Sequence
  Description of Artificial Sequence: Synthetic peptide
DEEEIRTTNPVATLQYGSVSTNLQDGNR

SEQ ID NO: 2159 - protein, 28 aa, Artificial Sequence
  Description of Artificial Sequence: Synthetic peptide
DEEEIRTTNPEATEQYGSVSTNLQFGNR

SEQ ID NO: 2160 - protein, 28 aa, Artificial Sequence
  Description of Artificial Sequence: Synthetic peptide
DEEEIRTTNPVATEQYGSVSSNLQAGNR

SEQ ID NO: 2161 - protein, 28 aa, Artificial Sequence
  Description of Artificial Sequence: Synthetic peptide
DEEEIRTTNPVATEQYGSVSTNDNRGNR

SEQ ID NO: 2162 - protein, 28 aa, Artificial Sequence
  Description of Artificial Sequence: Synthetic peptide
DEQEIRTTNPVATEQYGCVSTNLQRGNR

SEQ ID NO: 2163 - protein, 28 aa, Artificial Sequence
  Description of Artificial Sequence: Synthetic peptide
DAEEIRTTNPVATEQYGSVSTNLQRGND

SEQ ID NO: 2164 - protein, 29 aa, Artificial Sequence
  Description of Artificial Sequence: Synthetic peptide
DEEEIRTTNPVATEQYGSVSATNLQHGNR

SEQ ID NO: 2165 - protein, 28 aa, Artificial Sequence
  Description of Artificial Sequence: Synthetic peptide
DEGEIRTTNPVATEGYGSVSTNLQRGNR

SEQ ID NO: 2166 - protein, 28 aa, Artificial Sequence
  Description of Artificial Sequence: Synthetic peptide
DEGEIRTTNPVATEQYGNVSTNLQRGNR

SEQ ID NO: 2167 - protein, 30 aa, Artificial Sequence
  Description of Artificial Sequence: Synthetic polypeptide
DEEEIRTTNPVATEQYGSVSTTNLQLRGNR

SEQ ID NO: 2168 - protein, 28 aa, Artificial Sequence
  Description of Artificial Sequence: Synthetic peptide
DEEEIRTTNPVATEYYGSVSTNLQRGVR

SEQ ID NO: 2169 - protein, 28 aa, Artificial Sequence
  Description of Artificial Sequence: Synthetic peptide
DEEEIRTTNPVATEQYGSVSTELQRGNN

SEQ ID NO: 2170 - protein, 28 aa, Artificial Sequence
  Description of Artificial Sequence: Synthetic peptide
DEEEIRTTNPVATEQYGSVDTNLQRGTR

SEQ ID NO: 2171 - protein, 28 aa, Artificial Sequence
  Description of Artificial Sequence: Synthetic peptide
DEEEIRTTNPVATEQYGSWSTNLQRGNT

SEQ ID NO: 2172 - protein, 28 aa, Artificial Sequence
  Description of Artificial Sequence: Synthetic peptide
DEEEIRTTNPVATEQYGSVPTNVQRGNR

SEQ ID NO: 2173 - protein, 28 aa, Artificial Sequence
  Description of Artificial Sequence: Synthetic peptide
DEEEIRTTNPVSTEQYGGVSTNLQRGNR

SEQ ID NO: 2174 - protein, 28 aa, Artificial Sequence
  Description of Artificial Sequence: Synthetic peptide
YEEEIRCTNPVATEQYGSVSTNLQRGNR

SEQ ID NO: 2175 - protein, 28 aa, Artificial Sequence
  Description of Artificial Sequence: Synthetic peptide
DEEEIRTTNPVATEQVGSVSTNLQRGNY

SEQ ID NO: 2176 - protein, 28 aa, Artificial Sequence
  Description of Artificial Sequence: Synthetic peptide
DEEEIRTTNPVASEQYGSVSTNLQRNNR

SEQ ID NO: 2177 - protein, 28 aa, Artificial Sequence
  Description of Artificial Sequence: Synthetic peptide
NEVEIRTTNPVATEQYGSVSTNLQRGNR

SEQ ID NO: 2178 - protein, 30 aa, Artificial Sequence
  Description of Artificial Sequence: Synthetic polypeptide
DEEEIRTTNPVATEQYGSVSTNLQRNGDNR

SEQ ID NO: 2179 - protein, 28 aa, Artificial Sequence
  Description of Artificial Sequence: Synthetic peptide
DEEEIRTTNPVATEQYGSVSTELQAGNR

SEQ ID NO: 2180 - protein, 28 aa, Artificial Sequence
  Description of Artificial Sequence: Synthetic peptide
DEEEIRTTNPVATEQYWSVSTNLQRENR

SEQ ID NO: 2181 - protein, 28 aa, Artificial Sequence
  Description of Artificial Sequence: Synthetic peptide
QEEEIRTVNPVATEQYGSVSTNLQRGNR

SEQ ID NO: 2182 - protein, 28 aa, Artificial Sequence
  Description of Artificial Sequence: Synthetic peptide
DEEEIRTTNPVATELYGSVSTNEQRGNR

SEQ ID NO: 2183 - protein, 28 aa, Artificial Sequence
  Description of Artificial Sequence: Synthetic peptide
DEEEIRTTNPVATEQYGSVSTNPQLGNR

SEQ ID NO: 2184 - protein, 28 aa, Artificial Sequence
  Description of Artificial Sequence: Synthetic peptide
DEEEIRTTNPVATEQYGWVSTNEQRGNR

SEQ ID NO: 2185 - protein, 28 aa, Artificial Sequence
  Description of Artificial Sequence: Synthetic peptide
DEEEIRTTNPVATEQYGSVSTNLQVGND

SEQ ID NO: 2186 - protein, 29 aa, Artificial Sequence
  Description of Artificial Sequence: Synthetic peptide
DEEEIRTTNPVATEQYGSVPTNLQRGFNR

SEQ ID NO: 2187 - protein, 29 aa, Artificial Sequence
  Description of Artificial Sequence: Synthetic peptide
DEEEIRTTNPVATEQYGSTSTGNLQRGNR

SEQ ID NO: 2188 - protein, 29 aa, Artificial Sequence
  Description of Artificial Sequence: Synthetic peptide
DEEEIRTTNPVATEQYGSVESTNLQRGNM

SEQ ID NO: 2189 - protein, 30 aa, Artificial Sequence
  Description of Artificial Sequence: Synthetic polypeptide
DEEEIRTTNPVATEQYGSVSTVNLQRGNFR

SEQ ID NO: 2190 - protein, 29 aa, Artificial Sequence
  Description of Artificial Sequence: Synthetic peptide
DEEEIRTTNPVATEQYGSVSTYPLQRGNR

SEQ ID NO: 2191 - protein, 28 aa, Artificial Sequence
  Description of Artificial Sequence: Synthetic peptide
DEEEIRTTNPVATEQYGSVSTNLERGNF

SEQ ID NO: 2192 - protein, 28 aa, Artificial Sequence
  Description of Artificial Sequence: Synthetic peptide
DEEEIRTTNPVATEQYGSVSTGLQRGNN

SEQ ID NO: 2193 - protein, 29 aa, Artificial Sequence
  Description of Artificial Sequence: Synthetic peptide
DEETIRTTNPVATEQYGSVSTTNLQRGNR

SEQ ID NO: 2194 - protein, 30 aa, Artificial Sequence
  Description of Artificial Sequence: Synthetic polypeptide
DEEEIRTTNPVATEQYGMSVSQTNLQRGNR

SEQ ID NO: 2195 - protein, 28 aa, Artificial Sequence
  Description of Artificial Sequence: Synthetic peptide
DEEEIRTTNPVATEGYGSVSTNLQRGER

SEQ ID NO: 2196 - protein, 28 aa, Artificial Sequence
  Description of Artificial Sequence: Synthetic peptide
DEEEIRTTNPVATEQYGSVGTNLQRGTR

SEQ ID NO: 2197 - protein, 28 aa, Artificial Sequence
  Description of Artificial Sequence: Synthetic peptide
DEEEIRTTNPVATEQYGSVSYNYQRGNR

SEQ ID NO: 2198 - protein, 29 aa, Artificial Sequence
  Description of Artificial Sequence: Synthetic peptide
DEEEIRTTNPVAFEQYGSVSTMNLQRGNR

SEQ ID NO: 2199 - protein, 28 aa, Artificial Sequence
  Description of Artificial Sequence: Synthetic peptide
DEEEIRTTNPDATEQYGSVSTNLQRGNW

SEQ ID NO: 2200 - protein, 28 aa, Artificial Sequence
  Description of Artificial Sequence: Synthetic peptide
DEEEIRTTNPVATEQYGSVSTNLQEGNQ

SEQ ID NO: 2201 - protein, 29 aa, Artificial Sequence
  Description of Artificial Sequence: Synthetic peptide
DEEEIRTTNPVATEIYGSVSTNLQRAGNR

SEQ ID NO: 2202 - protein, 28 aa, Artificial Sequence
  Description of Artificial Sequence: Synthetic peptide
DEEEIRTTNPVATEQYGSVSTNLQDGNV

SEQ ID NO: 2203 - protein, 28 aa, Artificial Sequence
  Description of Artificial Sequence: Synthetic peptide
DEEEIRTTNPVATEQYGEVDTNLQRGNR

SEQ ID NO: 2204 - protein, 28 aa, Artificial Sequence
  Description of Artificial Sequence: Synthetic peptide
DEEEIRTTNPVATEQWGSVSTNLQRGTR

SEQ ID NO: 2205 - protein, 28 aa, Artificial Sequence
  Description of Artificial Sequence: Synthetic peptide
DENEIRTTNPVATEIYGSVSTNLQRGNR

SEQ ID NO: 2206 - protein, 28 aa, Artificial Sequence
  Description of Artificial Sequence: Synthetic peptide
DEEEIRTTNPVATEQYGSVSAALQRGNR

SEQ ID NO: 2207 - protein, 29 aa, Artificial Sequence
  Description of Artificial Sequence: Synthetic peptide
DEEEIRTTNPVATEQYGSVSTNLQRGNPV

SEQ ID NO: 2208 - protein, 28 aa, Artificial Sequence
  Description of Artificial Sequence: Synthetic peptide
AEEEIRTTNPVATEQYGSVSTNLQFGNR

SEQ ID NO: 2209 - protein, 28 aa, Artificial Sequence
  Description of Artificial Sequence: Synthetic peptide
DDEEIRTTNPVATEQYGSVSTNLDRGNR

SEQ ID NO: 2210 - protein, 28 aa, Artificial Sequence
  Description of Artificial Sequence: Synthetic peptide
DEEEIRTTNPVATEQYGSVSTNLQSGNE

SEQ ID NO: 2211 - protein, 28 aa, Artificial Sequence
  Description of Artificial Sequence: Synthetic peptide
DEQEIRTTNPVATEQYGSVSTNLQKGNR

SEQ ID NO: 2212 - protein, 29 aa, Artificial Sequence
  Description of Artificial Sequence: Synthetic peptide
DEEEIATTNPVATEQYGSVSTNLQREGNR

SEQ ID NO: 2213 - protein, 28 aa, Artificial Sequence
  Description of Artificial Sequence: Synthetic peptide
DEEEIRTTNPVATEQYGSVSTNLFIGNR

SEQ ID NO: 2214 - protein, 28 aa, Artificial Sequence
  Description of Artificial Sequence: Synthetic peptide
DEIEIRTTNPVATEQYGIVSTNLQRGNR

SEQ ID NO: 2215 - protein, 28 aa, Artificial Sequence
  Description of Artificial Sequence: Synthetic peptide
DEEEIRTTNPVATEQYGIYSTNLQRGNR

SEQ ID NO: 2216 - protein, 29 aa, Artificial Sequence
  Description of Artificial Sequence: Synthetic peptide
DEEEITTTNPVATEQYGSVSATNLQRGNR

SEQ ID NO: 2217 - protein, 28 aa, Artificial Sequence
  Description of Artificial Sequence: Synthetic peptide
AEEEIRTTNPVATEQYGSVSTNLQRGNY

SEQ ID NO: 2218 - protein, 28 aa, Artificial Sequence
  Description of Artificial Sequence: Synthetic peptide
DEEEIRSTNPVATEQYGSVSTNQQRGNR

SEQ ID NO: 2219 - protein, 28 aa, Artificial Sequence
  Description of Artificial Sequence: Synthetic peptide
DEEEIRTTNPVATEQYGSVSTNLQVGER

SEQ ID NO: 2220 - protein, 29 aa, Artificial Sequence
  Description of Artificial Sequence: Synthetic peptide
DEEEIRTTNPVATEQYWGSVSHNLQRGNR

SEQ ID NO: 2221 - protein, 28 aa, Artificial Sequence
  Description of Artificial Sequence: Synthetic peptide
DEEEIRTTNGVATEQYGSVSDNLQRGNR

SEQ ID NO: 2222 - protein, 30 aa, Artificial Sequence
  Description of Artificial Sequence: Synthetic polypeptide
DEEEIRTTNPVATEQYGSYVCSTNLQRGNR

SEQ ID NO: 2223 - protein, 28 aa, Artificial Sequence
  Description of Artificial Sequence: Synthetic peptide
DEEEIRTTNPVATEQYGSWSTNLQGGNR

SEQ ID NO: 2224 - protein, 28 aa, Artificial Sequence
  Description of Artificial Sequence: Synthetic peptide
DEEEIRTTNPVATEQYGSVSTNLQRGYF

SEQ ID NO: 2225 - protein, 28 aa, Artificial Sequence
  Description of Artificial Sequence: Synthetic peptide
DEEEIRCTNPVATEHYGSVSTNLQRGNR

SEQ ID NO: 2226 - protein, 28 aa, Artificial Sequence
  Description of Artificial Sequence: Synthetic peptide
DEEEIRTTNPAATEQYGSVSTNLARGNR

SEQ ID NO: 2227 - protein, 28 aa, Artificial Sequence
  Description of Artificial Sequence: Synthetic peptide
DEEGIRTTNPVATEQYGSVETNLQRGNR

SEQ ID NO: 2228 - protein, 29 aa, Artificial Sequence
  Description of Artificial Sequence: Synthetic peptide
DEEEIRTTNPVATEQYGSVSTNLQRGENA

SEQ ID NO: 2229 - protein, 28 aa, Artificial Sequence
  Description of Artificial Sequence: Synthetic peptide
DDEEIRTTNPVATEQYGSVSTNLQRFNR

SEQ ID NO: 2230 - protein, 28 aa, Artificial Sequence
  Description of Artificial Sequence: Synthetic peptide
DEEEIRTTNPVATEQYGSVSANLQRGNA

SEQ ID NO: 2231 - protein, 29 aa, Artificial Sequence
  Description of Artificial Sequence: Synthetic peptide
DEEEIRTTNPVATDQYGSVSTNLWQRGNR

SEQ ID NO: 2232 - protein, 29 aa, Artificial Sequence
  Description of Artificial Sequence: Synthetic peptide
DEEEIRTTNPVATEQYGSVSTNLQDNGNR

SEQ ID NO: 2233 - protein, 29 aa, Artificial Sequence
  Description of Artificial Sequence: Synthetic peptide
DEEEIRCTNPVATEQYGCSVSTNLQRGNR

SEQ ID NO: 2234 - protein, 29 aa, Artificial Sequence
  Description of Artificial Sequence: Synthetic peptide
DEEEIRTTNPVATEQYGSVSETNLQEGNR

SEQ ID NO: 2235 - protein, 28 aa, Artificial Sequence
  Description of Artificial Sequence: Synthetic peptide
NEEEIRTTNGVATEQYGSVSTNLQRGNR

SEQ ID NO: 2236 - protein, 28 aa, Artificial Sequence
  Description of Artificial Sequence: Synthetic peptide
DEEEIRTTNPVATEQYGSVSTHEQRGNR

SEQ ID NO: 2237 - protein, 28 aa, Artificial Sequence
  Description of Artificial Sequence: Synthetic peptide
DMEEIRTTNPVATEQYGQVSTNLQRGNR

SEQ ID NO: 2238 - protein, 30 aa, Artificial Sequence
  Description of Artificial Sequence: Synthetic polypeptide
DEEEIRTTNPVATEQYGSVSTNLQVRGNER

SEQ ID NO: 2239 - protein, 29 aa, Artificial Sequence
  Description of Artificial Sequence: Synthetic peptide
DEEEIRTTNPVATEQYGSVSTNPQRGVNR

SEQ ID NO: 2240 - protein, 29 aa, Artificial Sequence
  Description of Artificial Sequence: Synthetic peptide
DEEEIRTTNPVATEQYGSVSTDLQRGDNR

SEQ ID NO: 2241 - protein, 28 aa, Artificial Sequence
  Description of Artificial Sequence: Synthetic peptide
DEEEIRTTNPVSTETYGSVSTNLQRGNR

SEQ ID NO: 2242 - protein, 28 aa, Artificial Sequence
  Description of Artificial Sequence: Synthetic peptide
DEEEIRCTNPVATEQYGSVATNLQRGNR

SEQ ID NO: 2243 - protein, 29 aa, Artificial Sequence
  Description of Artificial Sequence: Synthetic peptide
KEEEIRTTNPVATEQYGSVSTNLQRMGNR

SEQ ID NO: 2244 - protein, 29 aa, Artificial Sequence
  Description of Artificial Sequence: Synthetic peptide
DEEEIRTTNPVATEQYGSVSTNLMDRGNR

SEQ ID NO: 2245 - protein, 30 aa, Artificial Sequence
  Description of Artificial Sequence: Synthetic polypeptide
DEEEIRTTNPVATEQYGSVSTNLQRDGNPR

SEQ ID NO: 2246 - protein, 28 aa, Artificial Sequence
  Description of Artificial Sequence: Synthetic peptide
DEEEIRGTNPVATEQYGSVSTNLQRMNR

SEQ ID NO: 2247 - protein, 30 aa, Artificial Sequence
  Description of Artificial Sequence: Synthetic polypeptide
DEEEIRTTNPVATEQYGSVSTPNLQRDGNR

SEQ ID NO: 2248 - protein, 28 aa, Artificial Sequence
  Description of Artificial Sequence: Synthetic peptide
DEEEVRTTNPVATEQYGSVSTNLQRGNQ

SEQ ID NO: 2249 - protein, 28 aa, Artificial Sequence
  Description of Artificial Sequence: Synthetic peptide
DEEEIRTVNPVATEQYGIVSTNLQRGNR

SEQ ID NO: 2250 - protein, 30 aa, Artificial Sequence
  Description of Artificial Sequence: Synthetic polypeptide
DEEEIRTTNPVATEQYGSVSTTNLQRGDNR

SEQ ID NO: 2251 - protein, 29 aa, Artificial Sequence
  Description of Artificial Sequence: Synthetic peptide
DEEEIRTTNPVATEQYGSVSTGNLERGNR

SEQ ID NO: 2252 - protein, 28 aa, Artificial Sequence
  Description of Artificial Sequence: Synthetic peptide
DEEVIRTTNPFATEQYGSVSTNLQRGNR

SEQ ID NO: 2253 - protein, 28 aa, Artificial Sequence
  Description of Artificial Sequence: Synthetic peptide
DEEEIRTTNPVATEQYGSMSTNLQRGNM

SEQ ID NO: 2254 - protein, 29 aa, Artificial Sequence
  Description of Artificial Sequence: Synthetic peptide
DEEEIRTTNPVATEQYGSVSDDNLQRGNR

SEQ ID NO: 2255 - protein, 28 aa, Artificial Sequence
  Description of Artificial Sequence: Synthetic peptide
DEEEIRTTNPVATECYGSVSTCLQRGNR

SEQ ID NO: 2256 - protein, 28 aa, Artificial Sequence
  Description of Artificial Sequence: Synthetic peptide
DEVEIRTTNPVATEQYGSVSTNLQHGNR

SEQ ID NO: 2257 - protein, 29 aa, Artificial Sequence
  Description of Artificial Sequence: Synthetic peptide
DEEEIRTTNPVATEQYGSVSSENLQRGNR

SEQ ID NO: 2258 - protein, 28 aa, Artificial Sequence
  Description of Artificial Sequence: Synthetic peptide
DEEEIRTTNPMATEQYGSISTNLQRGNR

SEQ ID NO: 2259 - protein, 28 aa, Artificial Sequence
  Description of Artificial Sequence: Synthetic peptide
DEEEIRTTNPYATEQYGSVSTNDQRGNR

SEQ ID NO: 2260 - protein, 28 aa, Artificial Sequence
  Description of Artificial Sequence: Synthetic peptide
DEEEICTTNPVATEQYGSVSTNLQRENR

SEQ ID NO: 2261 - protein, 28 aa, Artificial Sequence
  Description of Artificial Sequence: Synthetic peptide
DEEEIATTNPVATEQYGGVSTNLQRGNR

SEQ ID NO: 2262 - protein, 29 aa, Artificial Sequence
  Description of Artificial Sequence: Synthetic peptide
DEEEIRTTNPVATEQYGSVSTNLQRGENL

SEQ ID NO: 2263 - protein, 29 aa, Artificial Sequence
  Description of Artificial Sequence: Synthetic peptide
DEEEIRTTNPVATEQYGSVSTNLQERGNI

SEQ ID NO: 2264 - protein, 29 aa, Artificial Sequence
  Description of Artificial Sequence: Synthetic peptide
NEEEIRTTNPVATEQYGSVSDTNLQRGNR

SEQ ID NO: 2265 - protein, 30 aa, Artificial Sequence
  Description of Artificial Sequence: Synthetic polypeptide
DEEEIRTTNPVATEQYGSVSTANLQRGDNR

SEQ ID NO: 2266 - protein, 28 aa, Artificial Sequence
  Description of Artificial Sequence: Synthetic peptide
DEEEIATTNPVATEQYGSVFTNLQRGNR

SEQ ID NO: 2267 - protein, 29 aa, Artificial Sequence
  Description of Artificial Sequence: Synthetic peptide
DEEEIRTTNPVATEQYGFVSTWNLQRGNR

SEQ ID NO: 2268 - protein, 29 aa, Artificial Sequence
  Description of Artificial Sequence: Synthetic peptide
DEEEIRTTNPVATEQYGSVSTMNEQRGNR

SEQ ID NO: 2269 - protein, 28 aa, Artificial Sequence
  Description of Artificial Sequence: Synthetic peptide
DEEEIRTTNPVATEIYGSVSTNEQRGNR

SEQ ID NO: 2270 - protein, 28 aa, Artificial Sequence
  Description of Artificial Sequence: Synthetic peptide
DEEEIRTTNPVATEQYGSVSTNLQRENF

SEQ ID NO: 2271 - protein, 29 aa, Artificial Sequence
  Description of Artificial Sequence: Synthetic peptide
DEEEIRTTNPVATEQYGSVSTNLDIRGNR

SEQ ID NO: 2272 - protein, 28 aa, Artificial Sequence
  Description of Artificial Sequence: Synthetic peptide
DEEEIRTTNPVATEIYGSVSMNLQRGNR

SEQ ID NO: 2273 - protein, 28 aa, Artificial Sequence
  Description of Artificial Sequence: Synthetic peptide
DAEEIRTTNPVATEQYGSVSTNLSRGNR

SEQ ID NO: 2274 - protein, 28 aa, Artificial Sequence
  Description of Artificial Sequence: Synthetic peptide
DEEEIRTTNPVATEQYGSVSTALQRGDR

SEQ ID NO: 2275 - protein, 28 aa, Artificial Sequence
  Description of Artificial Sequence: Synthetic peptide
DEEEIRTTNPEATEQYGSVSTNLQTGNR

SEQ ID NO: 2276 - protein, 28 aa, Artificial Sequence
  Description of Artificial Sequence: Synthetic peptide
DEEEIRTTNPVAMEQYGSVSTNGQRGNR

SEQ ID NO: 2277 - protein, 29 aa, Artificial Sequence
  Description of Artificial Sequence: Synthetic peptide
DEEEIRTTNPVATEQYGSVSTSNLTRGNR

SEQ ID NO: 2278 - protein, 28 aa, Artificial Sequence
  Description of Artificial Sequence: Synthetic peptide
MEEEIRTTNPVATEQYGSVATNLQRGNR

SEQ ID NO: 2279 - protein, 28 aa, Artificial Sequence
  Description of Artificial Sequence: Synthetic peptide
DEEEIGTTNPVATEQYGSVSTDLQRGNR

SEQ ID NO: 2280 - protein, 28 aa, Artificial Sequence
  Description of Artificial Sequence: Synthetic peptide
DEEEIRTTNPVATTQYGSVSTNLQPGNR

SEQ ID NO: 2281 - protein, 28 aa, Artificial Sequence
  Description of Artificial Sequence: Synthetic peptide
DEEEIITTNPVATEQYGSVSINLQRGNR

SEQ ID NO: 2282 - protein, 30 aa, Artificial Sequence
  Description of Artificial Sequence: Synthetic polypeptide
DEEEIRTTNPVATEQYGSVSTDNLQVRGNR

SEQ ID NO: 2283 - protein, 28 aa, Artificial Sequence
  Description of Artificial Sequence: Synthetic peptide
DEEEIRTTNPVATEQYGSVSTNLQRGDE

SEQ ID NO: 2284 - protein, 30 aa, Artificial Sequence
  Description of Artificial Sequence: Synthetic polypeptide
DEEEIRTTNPVATEQYGSVSTENLQDRGNR

SEQ ID NO: 2285 - protein, 28 aa, Artificial Sequence
  Description of Artificial Sequence: Synthetic peptide
DEEEIRTTNPVATCQYGSVSTNLQRGTR

SEQ ID NO: 2286 - protein, 28 aa, Artificial Sequence
  Description of Artificial Sequence: Synthetic peptide
GEEEIRTTNPSATEQYGSVSTNLQRGNR

SEQ ID NO: 2287 - protein, 28 aa, Artificial Sequence
  Description of Artificial Sequence: Synthetic peptide
DEQEIRSTNPVATEQYGSVSTNLQRGNR

SEQ ID NO: 2288 - protein, 28 aa, Artificial Sequence
  Description of Artificial Sequence: Synthetic peptide
DEREIRTTNPVSTEQYGSVSTNLQRGNR

SEQ ID NO: 2289 - protein, 28 aa, Artificial Sequence
  Description of Artificial Sequence: Synthetic peptide
DEYEIRTTNPVATEQYGSESTNLQRGNR

SEQ ID NO: 2290 - protein, 28 aa, Artificial Sequence
  Description of Artificial Sequence: Synthetic peptide
DEEEIRTTNPVATEQYGSVSTPLQRGNN

SEQ ID NO: 2291 - protein, 28 aa, Artificial Sequence
  Description of Artificial Sequence: Synthetic peptide
DEEELRTTNPVATEQYGSVSTNFQRGNR

SEQ ID NO: 2292 - protein, 29 aa, Artificial Sequence
  Description of Artificial Sequence: Synthetic peptide
DEEEIRTTNPVATEQYGSVSTNLPQRGMR

SEQ ID NO: 2293 - protein, 28 aa, Artificial Sequence
  Description of Artificial Sequence: Synthetic peptide
DELEIRCTNPVATEQYGSVSTNLQRGNR

SEQ ID NO: 2294 - protein, 29 aa, Artificial Sequence
  Description of Artificial Sequence: Synthetic peptide
DEEEIRTTNPVATEQYGESVSTNLDRGNR

SEQ ID NO: 2295 - protein, 28 aa, Artificial Sequence
  Description of Artificial Sequence: Synthetic peptide
DEEEIRTTNPVATEQYGSVSTNLQEGNC

SEQ ID NO: 2296 - protein, 28 aa, Artificial Sequence
  Description of Artificial Sequence: Synthetic peptide
DEEEIRTTNPVATEQYGTVSTNLQRQNR

SEQ ID NO: 2297 - protein, 28 aa, Artificial Sequence
  Description of Artificial Sequence: Synthetic peptide
VEEEIRTTNPVATEQYGSVSTNLQRGNQ

SEQ ID NO: 2298 - protein, 28 aa, Artificial Sequence
  Description of Artificial Sequence: Synthetic peptide
DEEEIRATNPVATEVYGSVSTNLQRGNR

SEQ ID NO: 2299 - protein, 28 aa, Artificial Sequence
  Description of Artificial Sequence: Synthetic peptide
DEEEIRTTNPVATEQYGSVSTNDQRDNR

SEQ ID NO: 2300 - protein, 28 aa, Artificial Sequence
  Description of Artificial Sequence: Synthetic peptide
DEEEIRTTNPVATEQYGSVSTGLDRGNR

SEQ ID NO: 2301 - protein, 28 aa, Artificial Sequence
  Description of Artificial Sequence: Synthetic peptide
DEEEIRTTNPVATEQYGSVATNLERGNR

SEQ ID NO: 2302 - protein, 28 aa, Artificial Sequence
  Description of Artificial Sequence: Synthetic peptide
DEEEIRTTNPVATELYGGVSTNLQRGNR

SEQ ID NO: 2303 - protein, 28 aa, Artificial Sequence
  Description of Artificial Sequence: Synthetic peptide
DEEEIRTTNPVATEQYGSVSTCLQRGNG

SEQ ID NO: 2304 - protein, 29 aa, Artificial Sequence
  Description of Artificial Sequence: Synthetic peptide
DEEEIRTTNPVATEQYGSVSCTNLQHGNR

SEQ ID NO: 2305 - protein, 28 aa, Artificial Sequence
  Description of Artificial Sequence: Synthetic peptide
DEDEIRTTNPVATENYGSVSTNLQRGNR

SEQ ID NO: 2306 - protein, 28 aa, Artificial Sequence
  Description of Artificial Sequence: Synthetic peptide
DESEIRTTNPVATEQYGNVSTNLQRGNR

SEQ ID NO: 2307 - protein, 29 aa, Artificial Sequence
  Description of Artificial Sequence: Synthetic peptide
DEEEIRTTNPVCTEQYGSVSTNLQRGFNR

SEQ ID NO: 2308 - protein, 28 aa, Artificial Sequence
  Description of Artificial Sequence: Synthetic peptide
DEEEIETVNPVATEQYGSVSTNLQRGNR

SEQ ID NO: 2309 - protein, 28 aa, Artificial Sequence
  Description of Artificial Sequence: Synthetic peptide
DEEEIRTTNPVATELYGSASTNLQRGNR

SEQ ID NO: 2310 - protein, 28 aa, Artificial Sequence
  Description of Artificial Sequence: Synthetic peptide
DEEEIRTTNPVATEQYGSTSTPLQRGNR

SEQ ID NO: 2311 - protein, 28 aa, Artificial Sequence
  Description of Artificial Sequence: Synthetic peptide
DEEEVRTTNPVATEQYGSVSENLQRGNR

SEQ ID NO: 2312 - protein, 28 aa, Artificial Sequence
  Description of Artificial Sequence: Synthetic peptide
DEEEIRTTNIVATEQYGSVSTNLQRGNL

SEQ ID NO: 2313 - protein, 29 aa, Artificial Sequence
  Description of Artificial Sequence: Synthetic peptide
DEEEIRTTNPFATEQYGSVSTPNLQRGNR

SEQ ID NO: 2314 - protein, 28 aa, Artificial Sequence
  Description of Artificial Sequence: Synthetic peptide
DEEEIRTTNPVAYEQYGSVSTGLQRGNR

SEQ ID NO: 2315 - protein, 28 aa, Artificial Sequence
  Description of Artificial Sequence: Synthetic peptide
DEEEIRTTNPVATEQYGVVSTNLERGNR

SEQ ID NO: 2316 - protein, 30 aa, Artificial Sequence
  Description of Artificial Sequence: Synthetic polypeptide
DEEEIRTTNPVATEQYGSVSTNLQFRGNDR

SEQ ID NO: 2317 - protein, 28 aa, Artificial Sequence
  Description of Artificial Sequence: Synthetic peptide
DEEEIATTNPVATEMYGSVSTNLQRGNR

SEQ ID NO: 2318 - protein, 29 aa, Artificial Sequence
  Description of Artificial Sequence: Synthetic peptide
DEEEIRTTNPVAYEPQYGSVSTNLQRGNR

SEQ ID NO: 2319 - protein, 28 aa, Artificial Sequence
  Description of Artificial Sequence: Synthetic peptide
DEEEIRTTNPVATEQYGSVSTNLERGNY

SEQ ID NO: 2320 - protein, 28 aa, Artificial Sequence
  Description of Artificial Sequence: Synthetic peptide
DEEEIRTTNPVSTEQYGSVDTNLQRGNR

SEQ ID NO: 2321 - protein, 28 aa, Artificial Sequence
  Description of Artificial Sequence: Synthetic peptide
DEEEIRTTNPVATAQYGSVSTNLQPGNR

SEQ ID NO: 2322 - protein, 28 aa, Artificial Sequence
  Description of Artificial Sequence: Synthetic peptide
DEEEIRTTNPVASEQYGSVSTNLQMGNR

SEQ ID NO: 2323 - protein, 28 aa, Artificial Sequence
  Description of Artificial Sequence: Synthetic peptide
DEEEIRTTNPVATEQYGSVSTNDQTGNR

SEQ ID NO: 2324 - protein, 28 aa, Artificial Sequence
  Description of Artificial Sequence: Synthetic peptide
DEEEIATTNPVATEQYGSVSTNPQRGNR

SEQ ID NO: 2325 - protein, 29 aa, Artificial Sequence
  Description of Artificial Sequence: Synthetic peptide
DEEEIRTTNPVATEQYGSVSTNPLQDGNR

SEQ ID NO: 2326 - protein, 28 aa, Artificial Sequence
  Description of Artificial Sequence: Synthetic peptide
DEEEIRTTNTVATEQYGSVSTNLQHGNR

SEQ ID NO: 2327 - protein, 28 aa, Artificial Sequence
  Description of Artificial Sequence: Synthetic peptide
DEEEIRTTNPVATEQYGSHSTNLQRGNL

SEQ ID NO: 2328 - protein, 28 aa, Artificial Sequence
  Description of Artificial Sequence: Synthetic peptide
DEEEIRTTNIVATEQYGSVSTNLQHGNR

SEQ ID NO: 2329 - protein, 29 aa, Artificial Sequence
  Description of Artificial Sequence: Synthetic peptide
DEEELRTTNPVATEQYGSVSTNLQRGNDR

SEQ ID NO: 2330 - protein, 29 aa, Artificial Sequence
  Description of Artificial Sequence: Synthetic peptide
DEEEIRTTNPVATEQWGHSVSTNLQRGNR

SEQ ID NO: 2331 - protein, 28 aa, Artificial Sequence
  Description of Artificial Sequence: Synthetic peptide
DEHEIRTTNPVATEQYGSVSTNLQAGNR

SEQ ID NO: 2332 - protein, 28 aa, Artificial Sequence
  Description of Artificial Sequence: Synthetic peptide
DEEEIRTTNPVATEQYGSVSTNLQGGNM

SEQ ID NO: 2333 - protein, 29 aa, Artificial Sequence
  Description of Artificial Sequence: Synthetic peptide
DEEEIRTTNPVATEQYGSVSTNLQTGDNR

SEQ ID NO: 2334 - protein, 28 aa, Artificial Sequence
  Description of Artificial Sequence: Synthetic peptide
DEEEIRTTNPVATEQYGLVSTNLQRGGR

SEQ ID NO: 2335 - protein, 28 aa, Artificial Sequence
  Description of Artificial Sequence: Synthetic peptide
DEEEIRTTNIVATEQYGSVSTNLQRGNT

SEQ ID NO: 2336 - protein, 28 aa, Artificial Sequence
  Description of Artificial Sequence: Synthetic peptide
DEEEIRTTNPDATEQYGSVSTNLQRGLR

SEQ ID NO: 2337 - protein, 30 aa, Artificial Sequence
  Description of Artificial Sequence: Synthetic polypeptide
DEEEIRTTNPVATEQYGSVSTENLQRGENR

SEQ ID NO: 2338 - protein, 28 aa, Artificial Sequence
  Description of Artificial Sequence: Synthetic peptide
DEEEIRTTNPVATEQYGQVSTNLQEGNR

SEQ ID NO: 2339 - protein, 29 aa, Artificial Sequence
  Description of Artificial Sequence: Synthetic peptide
DEEEIRTTNPTATEQYGSVSTNLQRGVNR

SEQ ID NO: 2340 - protein, 29 aa, Artificial Sequence
  Description of Artificial Sequence: Synthetic peptide
DEEEITTTNPVATEQYGSVSTNLQREGNR

SEQ ID NO: 2341 - protein, 30 aa, Artificial Sequence
  Description of Artificial Sequence: Synthetic polypeptide
DEEEIRTTNPVATEQYGSVSTNLVQLRGNR

SEQ ID NO: 2342 - protein, 29 aa, Artificial Sequence
  Description of Artificial Sequence: Synthetic peptide
DEEEIRTTNPVATEQYGSVSPTNLQHGNR

SEQ ID NO: 2343 - protein, 28 aa, Artificial Sequence
  Description of Artificial Sequence: Synthetic peptide
HEEEIRTTNPVATEQYGSVSTNLQRGNF

SEQ ID NO: 2344 - protein, 28 aa, Artificial Sequence
  Description of Artificial Sequence: Synthetic peptide
DEEEIRTTNPEATEQYGSVSTNLDRGNR

SEQ ID NO: 2345 - protein, 28 aa, Artificial Sequence
  Description of Artificial Sequence: Synthetic peptide
DEDEIRTTNPVATEQYGSMSTNLQRGNR

SEQ ID NO: 2346 - protein, 29 aa, Artificial Sequence
  Description of Artificial Sequence: Synthetic peptide
DEEEIRTTNPVATEQYGSVVSTNLQRGNG

SEQ ID NO: 2347 - protein, 28 aa, Artificial Sequence
  Description of Artificial Sequence: Synthetic peptide
YEEEIRTTNPVATEQYGSVSTNLQRGND

SEQ ID NO: 2348 - protein, 29 aa, Artificial Sequence
  Description of Artificial Sequence: Synthetic peptide
DTEEIRTTNPVATEQYGMSVSTNLQRGNR

SEQ ID NO: 2349 - protein, 28 aa, Artificial Sequence
  Description of Artificial Sequence: Synthetic peptide
DEEEIRTTNIVATEQYGSVSTNLQRGNQ

SEQ ID NO: 2350 - protein, 29 aa, Artificial Sequence
  Description of Artificial Sequence: Synthetic peptide
DEEEIRTTNPVATEQYGCSVSTNDQRGNR

SEQ ID NO: 2351 - protein, 29 aa, Artificial Sequence
  Description of Artificial Sequence: Synthetic peptide
DEEEIRTTNPVATEQYGSVSTNLQRGDNF

SEQ ID NO: 2352 - protein, 28 aa, Artificial Sequence
  Description of Artificial Sequence: Synthetic peptide
DEEEIRTTNPVATEQYGSVSTNLDRGNP

SEQ ID NO: 2353 - protein, 29 aa, Artificial Sequence
  Description of Artificial Sequence: Synthetic peptide
DEEQIRTTNPVATEQYGSVSTNLQRGNER

SEQ ID NO: 2354 - protein, 28 aa, Artificial Sequence
  Description of Artificial Sequence: Synthetic peptide
DEEEIRTTNPFATEQYGSVSDNLQRGNR

SEQ ID NO: 2355 - protein, 28 aa, Artificial Sequence
  Description of Artificial Sequence: Synthetic peptide
DEEEIRTTNPVATEQYGGVGTNLQRGNR

SEQ ID NO: 2356 - protein, 28 aa, Artificial Sequence
  Description of Artificial Sequence: Synthetic peptide
AEEEIRTTNPVATEQYGAVSTNLQRGNR

SEQ ID NO: 2357 - protein, 28 aa, Artificial Sequence
  Description of Artificial Sequence: Synthetic peptide
DEEEIRTTNIVATEQYGSVSTNLQQGNR

SEQ ID NO: 2358 - protein, 28 aa, Artificial Sequence
  Description of Artificial Sequence: Synthetic peptide
DEEEIRTTNPVATEQYGSVHTGLQRGNR

SEQ ID NO: 2359 - protein, 28 aa, Artificial Sequence
  Description of Artificial Sequence: Synthetic peptide
DEEEIRTTNPVATEQYGSGSMNLQRGNR

SEQ ID NO: 2360 - protein, 30 aa, Artificial Sequence
  Description of Artificial Sequence: Synthetic polypeptide
DEEEIRTTNPVATEQYGSVSTNLQRNGENR

SEQ ID NO: 2361 - protein, 28 aa, Artificial Sequence
  Description of Artificial Sequence: Synthetic peptide
KEEEIRTTNPVATEQYGSVSDNLQRGNR

SEQ ID NO: 2362 - protein, 29 aa, Artificial Sequence
  Description of Artificial Sequence: Synthetic peptide
DEEEIRTTNPVATEQYGSVSTNLDRGNDR

SEQ ID NO: 2363 - protein, 28 aa, Artificial Sequence
  Description of Artificial Sequence: Synthetic peptide
DEEEIRTTNPVATEQYGSVSTNLQTGNF

SEQ ID NO: 2364 - protein, 29 aa, Artificial Sequence
  Description of Artificial Sequence: Synthetic peptide
DEVEIRTTNPVATEQYGSVSTNLQRGDNR

SEQ ID NO: 2365 - protein, 28 aa, Artificial Sequence
  Description of Artificial Sequence: Synthetic peptide
DEEEIRTTNPVATEQYGSVVTNLGRGNR

SEQ ID NO: 2366 - protein, 29 aa, Artificial Sequence
  Description of Artificial Sequence: Synthetic peptide
DEEEIRTTNPVATEQYGSVSTNGLQRGNA

SEQ ID NO: 2367 - protein, 28 aa, Artificial Sequence
  Description of Artificial Sequence: Synthetic peptide
DEEEIRTTNPVATMQYGSVSTGLQRGNR

SEQ ID NO: 2368 - protein, 29 aa, Artificial Sequence
  Description of Artificial Sequence: Synthetic peptide
DEEEIRTTNPVATEQYGSVSTNPQREGNR

SEQ ID NO: 2369 - protein, 29 aa, Artificial Sequence
  Description of Artificial Sequence: Synthetic peptide
SEEEIRTTNPVATEQYGSVISTNLQRGNR

SEQ ID NO: 2370 - protein, 28 aa, Artificial Sequence
  Description of Artificial Sequence: Synthetic peptide
DEEEIRTTNPVATEQYGSVSTNGIRGNR

SEQ ID NO: 2371 - protein, 28 aa, Artificial Sequence
  Description of Artificial Sequence: Synthetic peptide
DEEEIRTTNPVATEQWGSVSTNLQWGNR

SEQ ID NO: 2372 - protein, 28 aa, Artificial Sequence
  Description of Artificial Sequence: Synthetic peptide
DEEEIRTTNPAATEQYGSVSTNLQLGNR

SEQ ID NO: 2373 - protein, 28 aa, Artificial Sequence
  Description of Artificial Sequence: Synthetic peptide
DEVEIRTTNPVATEQYGIVSTNLQRGNR

SEQ ID NO: 2374 - protein, 28 aa, Artificial Sequence
  Description of Artificial Sequence: Synthetic peptide
DEEEIRPTNPVATEQYGSVSTNLQRGND

SEQ ID NO: 2375 - protein, 28 aa, Artificial Sequence
  Description of Artificial Sequence: Synthetic peptide
DEEEIRTTNPVATEQYGSVSTNLERGNP

SEQ ID NO: 2376 - protein, 28 aa, Artificial Sequence
  Description of Artificial Sequence: Synthetic peptide
DEEEIRTTNPVATEQYGSVSTNLDDGNR

SEQ ID NO: 2377 - protein, 28 aa, Artificial Sequence
  Description of Artificial Sequence: Synthetic peptide
DEEEIRTTNPVSSEQYGSVSTNLQRGNR

SEQ ID NO: 2378 - protein, 29 aa, Artificial Sequence
  Description of Artificial Sequence: Synthetic peptide
DMEEIRTTNPVATEQYGFSVSTNLQRGNR

SEQ ID NO: 2379 - protein, 28 aa, Artificial Sequence
  Description of Artificial Sequence: Synthetic peptide
GEEEIRTTNPVATEQYGVVSTNLQRGNR

SEQ ID NO: 2380 - protein, 29 aa, Artificial Sequence
  Description of Artificial Sequence: Synthetic peptide
DEEEIRTTNPVATEQYGLVSTNLQRGFNR

SEQ ID NO: 2381 - protein, 29 aa, Artificial Sequence
  Description of Artificial Sequence: Synthetic peptide
DEEEIRTTNPVATEQYGSVSTNLQRGVNS

SEQ ID NO: 2382 - protein, 28 aa, Artificial Sequence
  Description of Artificial Sequence: Synthetic peptide
DEEEIVTTNPVATEQYGSVSTNLQKGNR

SEQ ID NO: 2383 - protein, 29 aa, Artificial Sequence
  Description of Artificial Sequence: Synthetic peptide
DEEEIRTTNPVATEQYGSVSTNLQRGNDY

SEQ ID NO: 2384 - protein, 29 aa, Artificial Sequence
  Description of Artificial Sequence: Synthetic peptide
DEEEIRTTNPVATEQYGSVSTNLQPGENR

SEQ ID NO: 2385 - protein, 29 aa, Artificial Sequence
  Description of Artificial Sequence: Synthetic peptide
DEEEIRTTNPVATEQYGSVSTCNLQRGER

SEQ ID NO: 2386 - protein, 28 aa, Artificial Sequence
  Description of Artificial Sequence: Synthetic peptide
DEEEIRTTNPVATEQYGWVSTNVQRGNR

SEQ ID NO: 2387 - protein, 29 aa, Artificial Sequence
  Description of Artificial Sequence: Synthetic peptide
DEEEIRTTNPVATEQYGSVSTNLQREGNM

SEQ ID NO: 2388 - protein, 28 aa, Artificial Sequence
  Description of Artificial Sequence: Synthetic peptide
DEEEIRTTNPVATEQYGSVSTNLQMGNM

SEQ ID NO: 2389 - protein, 28 aa, Artificial Sequence
  Description of Artificial Sequence: Synthetic peptide
DEEEIDTTNPVATEQYGDVSTNLQRGNR

SEQ ID NO: 2390 - protein, 29 aa, Artificial Sequence
  Description of Artificial Sequence: Synthetic peptide
DEEEIRQTNPVATEQYGSVSTNLQRAGNR

SEQ ID NO: 2391 - protein, 28 aa, Artificial Sequence
  Description of Artificial Sequence: Synthetic peptide
DEEQIETTNPVATEQYGSVSTNLQRGNR

SEQ ID NO: 2392 - protein, 28 aa, Artificial Sequence
  Description of Artificial Sequence: Synthetic peptide
SEEEIRTTNPFATEQYGSVSTNLQRGNR

SEQ ID NO: 2393 - protein, 29 aa, Artificial Sequence
  Description of Artificial Sequence: Synthetic peptide
DEEEIRTTNPVATEQYGSVSTNLQIGNTR

SEQ ID NO: 2394 - protein, 28 aa, Artificial Sequence
  Description of Artificial Sequence: Synthetic peptide
DEEEIRTTNPVATEQYGSVSTNLVRGNP

SEQ ID NO: 2395 - protein, 29 aa, Artificial Sequence
  Description of Artificial Sequence: Synthetic peptide
DEEEIRTTNPVATFQYGSVSTTNLQRGNR

SEQ ID NO: 2396 - protein, 28 aa, Artificial Sequence
  Description of Artificial Sequence: Synthetic peptide
DEEEIATTNPVATEQYGSVSTDLQRGNR

SEQ ID NO: 2397 - protein, 29 aa, Artificial Sequence
  Description of Artificial Sequence: Synthetic peptide
DEEEIATTNPVATEQYGSVSTNLQRGDNR

SEQ ID NO: 2398 - protein, 29 aa, Artificial Sequence
  Description of Artificial Sequence: Synthetic peptide
DEEEIRTTNPVATEQYGVSVSTNDQRGNR

SEQ ID NO: 2399 - protein, 28 aa, Artificial Sequence
  Description of Artificial Sequence: Synthetic peptide
DEEEIRYTNPVATEQYGSVSENLQRGNR

SEQ ID NO: 2400 - protein, 29 aa, Artificial Sequence
  Description of Artificial Sequence: Synthetic peptide
DEEEIRTTNPVATEQYGSVSTNLQIGDNR

SEQ ID NO: 2401 - protein, 28 aa, Artificial Sequence
  Description of Artificial Sequence: Synthetic peptide
DEEEIRTTNPVATEQYGCVSTNLQPGNR

SEQ ID NO: 2402 - protein, 28 aa, Artificial Sequence
  Description of Artificial Sequence: Synthetic peptide
DEEEIRTTNPDATGQYGSVSTNLQRGNR

SEQ ID NO: 2403 - protein, 28 aa, Artificial Sequence
  Description of Artificial Sequence: Synthetic peptide
DEEEIRTTNPVATEQYGSVSTNLQDGNL

SEQ ID NO: 2404 - protein, 29 aa, Artificial Sequence
  Description of Artificial Sequence: Synthetic peptide
DEEESRTTNPVATEQYGSVSTNLQDRGNR

SEQ ID NO: 2405 - protein, 28 aa, Artificial Sequence
  Description of Artificial Sequence: Synthetic peptide
TEEEIRTTNPVATEQYGSVSENLQRGNR

SEQ ID NO: 2406 - protein, 28 aa, Artificial Sequence
  Description of Artificial Sequence: Synthetic peptide
DEEEIRTTNPVATEQYGSASTNLQRGNN

SEQ ID NO: 2407 - protein, 29 aa, Artificial Sequence
  Description of Artificial Sequence: Synthetic peptide
HEEEIRTTNPVATEQYGSVSTNLQRGENR

SEQ ID NO: 2408 - protein, 29 aa, Artificial Sequence
  Description of Artificial Sequence: Synthetic peptide
DEEQIRTTNPVATEQYGSVSTNLQRFGNR

SEQ ID NO: 2409 - protein, 28 aa, Artificial Sequence
  Description of Artificial Sequence: Synthetic peptide
DEEEIRTTNPVATEAYGSVSTNLQDGNR

SEQ ID NO: 2410 - protein, 28 aa, Artificial Sequence
  Description of Artificial Sequence: Synthetic peptide
DEEEIRTTNPVATEQYGSVGTNLQRGNI

SEQ ID NO: 2411 - protein, 29 aa, Artificial Sequence
  Description of Artificial Sequence: Synthetic peptide
DEEEIRTTNPVATEQYGSVSTNLSQRGNE

SEQ ID NO: 2412 - protein, 30 aa, Artificial Sequence
  Description of Artificial Sequence: Synthetic polypeptide
DEEEIRTTNPVATEQYGISVMSTNLQRGNR

SEQ ID NO: 2413 - protein, 28 aa, Artificial Sequence
  Description of Artificial Sequence: Synthetic peptide
DEEEIRTTNPVATEQYGCVSTNLERGNR

SEQ ID NO: 2414 - protein, 28 aa, Artificial Sequence
  Description of Artificial Sequence: Synthetic peptide
DEQEIRTTNPVATEQYGSVETNLQRGNR

SEQ ID NO: 2415 - protein, 28 aa, Artificial Sequence
  Description of Artificial Sequence: Synthetic peptide
DEEEIGTTNPVATEQYGSVSTNLQHGNR

SEQ ID NO: 2416 - protein, 28 aa, Artificial Sequence
  Description of Artificial Sequence: Synthetic peptide
DEEEIRTTNPVATEQYGSVSTNLEGGNR

SEQ ID NO: 2417 - protein, 28 aa, Artificial Sequence
  Description of Artificial Sequence: Synthetic peptide
DEEEIRTTNPVATECYGSASTNLQRGNR

SEQ ID NO: 2418 - protein, 28 aa, Artificial Sequence
  Description of Artificial Sequence: Synthetic peptide
DEEEIRCTNPVATEQYGSVSVNLQRGNR

SEQ ID NO: 2419 - protein, 28 aa, Artificial Sequence
  Description of Artificial Sequence: Synthetic peptide
DEEEIRTTNPVATELFGSVSTNLQRGNR

SEQ ID NO: 2420 - protein, 28 aa, Artificial Sequence
  Description of Artificial Sequence: Synthetic peptide
DEEEIRTTNPVATEQYGSVSTNDQLGNR

SEQ ID NO: 2421 - protein, 28 aa, Artificial Sequence
  Description of Artificial Sequence: Synthetic peptide
DEEEIRTTNPVATEQYGSVSTNLQDGNN

SEQ ID NO: 2422 - protein, 29 aa, Artificial Sequence
  Description of Artificial Sequence: Synthetic peptide
DEEEIRTTNPVATEQYGSVSCTNLQFGNR

SEQ ID NO: 2423 - protein, 29 aa, Artificial Sequence
  Description of Artificial Sequence: Synthetic peptide
DEEMIRTTNPVATEQYGSVSTNLQRGENR

SEQ ID NO: 2424 - protein, 28 aa, Artificial Sequence
  Description of Artificial Sequence: Synthetic peptide
DEEEIRTTNPVATEIYGSVGTNLQRGNR

SEQ ID NO: 2425 - protein, 29 aa, Artificial Sequence
  Description of Artificial Sequence: Synthetic peptide
DEYEIRTTNPVATEQYGSVSTNGLQRGNR

SEQ ID NO: 2426 - protein, 28 aa, Artificial Sequence
  Description of Artificial Sequence: Synthetic peptide
DEEEIRTTNPVATEQYGTVSTPLQRGNR

SEQ ID NO: 2427 - protein, 28 aa, Artificial Sequence
  Description of Artificial Sequence: Synthetic peptide
DEEEIRTTNPVATEQYGSVSTNLQDGNF

SEQ ID NO: 2428 - protein, 28 aa, Artificial Sequence
  Description of Artificial Sequence: Synthetic peptide
DEEEIRTTNPVATEQYGSASTNLQIGNR

SEQ ID NO: 2429 - protein, 29 aa, Artificial Sequence
  Description of Artificial Sequence: Synthetic peptide
DEEEIRTTNPVATEQYGSWSTNLQRGNER

SEQ ID NO: 2430 - protein, 28 aa, Artificial Sequence
  Description of Artificial Sequence: Synthetic peptide
DEEEIRTTNPVATEQYGSVSTNPQRENR

SEQ ID NO: 2431 - protein, 28 aa, Artificial Sequence
  Description of Artificial Sequence: Synthetic peptide
DEEEIRQTNPVATEQYGNVSTNLQRGNR

SEQ ID NO: 2432 - protein, 28 aa, Artificial Sequence
  Description of Artificial Sequence: Synthetic peptide
DDEEIRATNPVATEQYGSVSTNLQRGNR

SEQ ID NO: 2433 - protein, 28 aa, Artificial Sequence
  Description of Artificial Sequence: Synthetic peptide
DEEEIRTTNPAATEQYGSVSTNLQQGNR

SEQ ID NO: 2434 - protein, 28 aa, Artificial Sequence
  Description of Artificial Sequence: Synthetic peptide
DEEEIRTTNPVATECYGSVSTNLQRGNY

SEQ ID NO: 2435 - protein, 28 aa, Artificial Sequence
  Description of Artificial Sequence: Synthetic peptide
DEEEIRTTNPVASEQYGSVSTNLQDGNR

SEQ ID NO: 2436 - protein, 29 aa, Artificial Sequence
  Description of Artificial Sequence: Synthetic peptide
DEEEIRATNPVATEQYGSVSTNLQERGNR

SEQ ID NO: 2437 - protein, 28 aa, Artificial Sequence
  Description of Artificial Sequence: Synthetic peptide
DEEEIRTTNPVATEQYGSVSTDLQLGNR

SEQ ID NO: 2438 - protein, 28 aa, Artificial Sequence
  Description of Artificial Sequence: Synthetic peptide
DEEEIRTTNPVATEQYGSVDTNLQRGNL

SEQ ID NO: 2439 - protein, 28 aa, Artificial Sequence
  Description of Artificial Sequence: Synthetic peptide
DEEEIRTTNPVATEQYGSVSTNLQDGNW

SEQ ID NO: 2440 - protein, 29 aa, Artificial Sequence
  Description of Artificial Sequence: Synthetic peptide
DEEEIRTTNPVATEQYGSVSENLPQRGNR

SEQ ID NO: 2441 - protein, 28 aa, Artificial Sequence
  Description of Artificial Sequence: Synthetic peptide
DEEEIRTTNPVATEQYGSVSTNLQFGER

SEQ ID NO: 2442 - protein, 29 aa, Artificial Sequence
  Description of Artificial Sequence: Synthetic peptide
DEEEIRTTNPVATEQYGSVSDNLQRTGNR

SEQ ID NO: 2443 - protein, 28 aa, Artificial Sequence
  Description of Artificial Sequence: Synthetic peptide
DEEEIRTTNPVATEQYGSVCDNLQRGNR

SEQ ID NO: 2444 - protein, 30 aa, Artificial Sequence
  Description of Artificial Sequence: Synthetic polypeptide
DEEEIRTTNPVATEQYGSVSTNLQDRGNWR

SEQ ID NO: 2445 - protein, 28 aa, Artificial Sequence
  Description of Artificial Sequence: Synthetic peptide
DEEEIITTNPVATEQYGSVSNNLQRGNR

SEQ ID NO: 2446 - protein, 29 aa, Artificial Sequence
  Description of Artificial Sequence: Synthetic peptide
DEEEIRTTNPVATEQYGSVSTPLQVRGNR

SEQ ID NO: 2447 - protein, 28 aa, Artificial Sequence
  Description of Artificial Sequence: Synthetic peptide
DEEEIRTTNPGATEVYGSVSTNLQRGNR

SEQ ID NO: 2448 - protein, 28 aa, Artificial Sequence
  Description of Artificial Sequence: Synthetic peptide
AEEEIMTTNPVATEQYGSVSTNLQRGNR

SEQ ID NO: 2449 - protein, 30 aa, Artificial Sequence
  Description of Artificial Sequence: Synthetic polypeptide
DEEEIRTTNPVATEQYGSVSTNLQNRGLNR

SEQ ID NO: 2450 - protein, 28 aa, Artificial Sequence
  Description of Artificial Sequence: Synthetic peptide
DEEEIRTTNPVATEQYGSVSTNLQRDDR

SEQ ID NO: 2451 - protein, 28 aa, Artificial Sequence
  Description of Artificial Sequence: Synthetic peptide
DEEEIRTTNPAATEQYGSVSTNLQIGNR

SEQ ID NO: 2452 - protein, 28 aa, Artificial Sequence
  Description of Artificial Sequence: Synthetic peptide
DEEEIRTTNPVATEQYGSVSTNLQWGNV

SEQ ID NO: 2453 - protein, 29 aa, Artificial Sequence
  Description of Artificial Sequence: Synthetic peptide
DEEEIRATNPVATEQYGSVSTNLPQRGNR

SEQ ID NO: 2454 - protein, 28 aa, Artificial Sequence
  Description of Artificial Sequence: Synthetic peptide
DEEEIRTTNPVATEQYGSVSVNLERGNR

SEQ ID NO: 2455 - protein, 28 aa, Artificial Sequence
  Description of Artificial Sequence: Synthetic peptide
DEEEISTTNPVATEQYGTVSTNLQRGNR

SEQ ID NO: 2456 - protein, 28 aa, Artificial Sequence
  Description of Artificial Sequence: Synthetic peptide
DEEEIYTTNPVATEQYGSVSTNLQRGNE

SEQ ID NO: 2457 - protein, 28 aa, Artificial Sequence
  Description of Artificial Sequence: Synthetic peptide
DEEEIRTTNPVATEQYGSVATTLQRGNR

SEQ ID NO: 2458 - protein, 29 aa, Artificial Sequence
  Description of Artificial Sequence: Synthetic peptide
DEEEIRTTNPVATEQYGSVSTNLQTVGNR

SEQ ID NO: 2459 - protein, 28 aa, Artificial Sequence
  Description of Artificial Sequence: Synthetic peptide
DEEEIRCTNPVATEPYGSVSTNLQRGNR

SEQ ID NO: 2460 - protein, 29 aa, Artificial Sequence
  Description of Artificial Sequence: Synthetic peptide
DEEEIRTTNPVATEQYGSVSTLNLQGGNR

SEQ ID NO: 2461 - protein, 29 aa, Artificial Sequence
  Description of Artificial Sequence: Synthetic peptide
DEEEIRTTNPVATEQYGSVSTNPLQRGER

SEQ ID NO: 2462 - protein, 29 aa, Artificial Sequence
  Description of Artificial Sequence: Synthetic peptide
DEEEISTTNPVATEQYGSVSATNLQRGNR

SEQ ID NO: 2463 - protein, 29 aa, Artificial Sequence
  Description of Artificial Sequence: Synthetic peptide
DEEEIRTTNPVATEQYGSVASTNLQRGND

SEQ ID NO: 2464 - protein, 28 aa, Artificial Sequence
  Description of Artificial Sequence: Synthetic peptide
DEEEIRTTNPDAYEQYGSVSTNLQRGNR

SEQ ID NO: 2465 - protein, 28 aa, Artificial Sequence
  Description of Artificial Sequence: Synthetic peptide
DEEEIRTTNPVATEQYGQVSTGLQRGNR

SEQ ID NO: 2466 - protein, 28 aa, Artificial Sequence
  Description of Artificial Sequence: Synthetic peptide
DEEEIRTTNPVATEVWGSVSTNLQRGNR

SEQ ID NO: 2467 - protein, 28 aa, Artificial Sequence
  Description of Artificial Sequence: Synthetic peptide
DEEEIRTTNPVATEQYGSVSTNLQYGNS

SEQ ID NO: 2468 - protein, 28 aa, Artificial Sequence
  Description of Artificial Sequence: Synthetic peptide
DEEEIRTTNPVATEQYGSVSTNLMQGNR

SEQ ID NO: 2469 - protein, 28 aa, Artificial Sequence
  Description of Artificial Sequence: Synthetic peptide
DEEEIRTTNPVATELYGQVSTNLQRGNR

SEQ ID NO: 2470 - protein, 28 aa, Artificial Sequence
  Description of Artificial Sequence: Synthetic peptide
GEEEIRTTNPVATEQYGSMSTNLQRGNR

SEQ ID NO: 2471 - protein, 29 aa, Artificial Sequence
  Description of Artificial Sequence: Synthetic peptide
DEEEIRTTNPVATEQYGSVSTNGLQGGNR

SEQ ID NO: 2472 - protein, 28 aa, Artificial Sequence
  Description of Artificial Sequence: Synthetic peptide
GEEEIRTTNPVATEQYGSVSTNLQRGNC

SEQ ID NO: 2473 - protein, 28 aa, Artificial Sequence
  Description of Artificial Sequence: Synthetic peptide
DEEEIRTTNPVATEQYGDVSTQLQRGNR

SEQ ID NO: 2474 - protein, 29 aa, Artificial Sequence
  Description of Artificial Sequence: Synthetic peptide
TEEEIRTTNPVATEQYGSVSTNLQVRGNR

SEQ ID NO: 2475 - protein, 29 aa, Artificial Sequence
  Description of Artificial Sequence: Synthetic peptide
DEEEIRTTNPVATEQYGSVSTGNLQRGNA

SEQ ID NO: 2476 - protein, 28 aa, Artificial Sequence
  Description of Artificial Sequence: Synthetic peptide
DEEEIRTTNPVCTEQYGSVSTNIQRGNR

SEQ ID NO: 2477 - protein, 28 aa, Artificial Sequence
  Description of Artificial Sequence: Synthetic peptide
SEEEIRTTNPVATEQGGSVSTNLQRGNR

SEQ ID NO: 2478 - protein, 28 aa, Artificial Sequence
  Description of Artificial Sequence: Synthetic peptide
DEEEIRTTNPVATEQYGSHSTCLQRGNR

SEQ ID NO: 2479 - protein, 28 aa, Artificial Sequence
  Description of Artificial Sequence: Synthetic peptide
DEEEIRTTNPVATAQYGSVSTDLQRGNR

SEQ ID NO: 2480 - protein, 28 aa, Artificial Sequence
  Description of Artificial Sequence: Synthetic peptide
DEEEIRSTNPVATEQYGSVSTNLQRGER

SEQ ID NO: 2481 - protein, 29 aa, Artificial Sequence
  Description of Artificial Sequence: Synthetic peptide
DEEEIRTTNPVATEQYGSVSTNLQDNGNR

SEQ ID NO: 2482 - protein, 29 aa, Artificial Sequence
  Description of Artificial Sequence: Synthetic peptide
DEEEIRTTNPVATEQYGSVSTNLQERGND

SEQ ID NO: 2483 - protein, 29 aa, Artificial Sequence
  Description of Artificial Sequence: Synthetic peptide
DEEEIRTTNPVATEQYGSVDSTDLQRGNR

SEQ ID NO: 2484 - protein, 28 aa, Artificial Sequence
  Description of Artificial Sequence: Synthetic peptide
DEEEIRTTNPVATEIYGSVATNLQRGNR

SEQ ID NO: 2485 - protein, 28 aa, Artificial Sequence
  Description of Artificial Sequence: Synthetic peptide
DEEEIRTTNPVATENYGCVSTNLQRGNR

SEQ ID NO: 2486 - protein, 29 aa, Artificial Sequence
  Description of Artificial Sequence: Synthetic peptide
DEEEIRTTNPVATEQYGSVSTNLQRAGND

SEQ ID NO: 2487 - protein, 29 aa, Artificial Sequence
  Description of Artificial Sequence: Synthetic peptide
DEEEIRTTNPVATEQYGSVSETNLQRGNL

SEQ ID NO: 2488 - protein, 29 aa, Artificial Sequence
  Description of Artificial Sequence: Synthetic peptide
DEEEIRTTNPVATEQYGSVSTNLQLRGNF

SEQ ID NO: 2489 - protein, 30 aa, Artificial Sequence
  Description of Artificial Sequence: Synthetic polypeptide
DEEEIRTTNPVATEQYGSVSDTNLQRGNNR

SEQ ID NO: 2490 - protein, 29 aa, Artificial Sequence
  Description of Artificial Sequence: Synthetic peptide
DEEEIRTTNPVATEQYGSVSATNLERGNR

SEQ ID NO: 2491 - protein, 29 aa, Artificial Sequence
  Description of Artificial Sequence: Synthetic peptide
DEEEIRTTNPVATEQFGSVYSTNLQRGNR

SEQ ID NO: 2492 - protein, 28 aa, Artificial Sequence
  Description of Artificial Sequence: Synthetic peptide
DEEEIRTTNPVATEQYGSVETNLERGNR

SEQ ID NO: 2493 - protein, 29 aa, Artificial Sequence
  Description of Artificial Sequence: Synthetic peptide
DEEEIRTTNPVATEQYGSVSTNLARGDNR

SEQ ID NO: 2494 - protein, 30 aa, Artificial Sequence
  Description of Artificial Sequence: Synthetic polypeptide
DEEEIRTTNPVATEQYGSVDSTNLQRNGNR

SEQ ID NO: 2495 - protein, 28 aa, Artificial Sequence
  Description of Artificial Sequence: Synthetic peptide
DEEEIRTTNPVATEQYGSVSTALQWGNR

SEQ ID NO: 2496 - protein, 28 aa, Artificial Sequence
  Description of Artificial Sequence: Synthetic peptide
DEEEIRTTNIVATEQYGSVSTNLQRGDR

SEQ ID NO: 2497 - protein, 29 aa, Artificial Sequence
  Description of Artificial Sequence: Synthetic peptide
DEEEIRTTNPVATEQYGSVSANLQDRGNR

SEQ ID NO: 2498 - protein, 28 aa, Artificial Sequence
  Description of Artificial Sequence: Synthetic peptide
NEEEIRTTNPVSTEQYGSVSTNLQRGNR

SEQ ID NO: 2499 - protein, 28 aa, Artificial Sequence
  Description of Artificial Sequence: Synthetic peptide
DEDEIRTTNPVATEQYGSVSTNLQHGNR

SEQ ID NO: 2500 - protein, 28 aa, Artificial Sequence
  Description of Artificial Sequence: Synthetic peptide
DEEEIRTTNPVATEQYGVVSTNLQRSNR

SEQ ID NO: 2501 - protein, 29 aa, Artificial Sequence
  Description of Artificial Sequence: Synthetic peptide
DEEEIRTTNPVATEQYGSVESTNLQRGER

SEQ ID NO: 2502 - protein, 28 aa, Artificial Sequence
  Description of Artificial Sequence: Synthetic peptide
DEQEIRCTNPVATEQYGSVSTNLQRGNR

SEQ ID NO: 2503 - protein, 28 aa, Artificial Sequence
  Description of Artificial Sequence: Synthetic peptide
DEEEIRTTNPVATEQYGSVDTPLQRGNR

SEQ ID NO: 2504 - protein, 30 aa, Artificial Sequence
  Description of Artificial Sequence: Synthetic polypeptide
DEEEIRTTNPVATEQYGSVSTNLQRGENPR

SEQ ID NO: 2505 - protein, 28 aa, Artificial Sequence
  Description of Artificial Sequence: Synthetic peptide
DEEEIRTTNPVATEQYGSVSTNLDRGNY

SEQ ID NO: 2506 - protein, 28 aa, Artificial Sequence
  Description of Artificial Sequence: Synthetic peptide
DEEEIRTTNPVATEQYGSVSENLQQGNR

SEQ ID NO: 2507 - protein, 29 aa, Artificial Sequence
  Description of Artificial Sequence: Synthetic peptide
DEEEIRTTNPVATEQYGESVETNLQRGNR

SEQ ID NO: 2508 - protein, 28 aa, Artificial Sequence
  Description of Artificial Sequence: Synthetic peptide
DEREIRTTNPVATEQYGSVSDNLQRGNR

SEQ ID NO: 2509 - protein, 29 aa, Artificial Sequence
  Description of Artificial Sequence: Synthetic peptide
DEEEIRTTNPTATEQYGSVSTMNLQRGNR

SEQ ID NO: 2510 - protein, 29 aa, Artificial Sequence
  Description of Artificial Sequence: Synthetic peptide
DEEEIRTTNPVATEQYGSVSTNLQRGPNF

SEQ ID NO: 2511 - protein, 29 aa, Artificial Sequence
  Description of Artificial Sequence: Synthetic peptide
DEEEIRTTNPVATEQYGSVSTNLQRGENG

SEQ ID NO: 2512 - protein, 28 aa, Artificial Sequence
  Description of Artificial Sequence: Synthetic peptide
DEAEICTTNPVATEQYGSVSTNLQRGNR

SEQ ID NO: 2513 - protein, 28 aa, Artificial Sequence
  Description of Artificial Sequence: Synthetic peptide
DEEEIRTTNPVATEQYGSVSENLIRGNR

SEQ ID NO: 2514 - protein, 28 aa, Artificial Sequence
  Description of Artificial Sequence: Synthetic peptide
DEEEIYTTNPVATEQYGSVSTNLQRGNT

SEQ ID NO: 2515 - protein, 28 aa, Artificial Sequence
  Description of Artificial Sequence: Synthetic peptide
DEEEIRTTNPVANEQYGSVSTNLQRGNW

SEQ ID NO: 2516 - protein, 28 aa, Artificial Sequence
  Description of Artificial Sequence: Synthetic peptide
DEEEIATTNPVATEQYGSVSTNLQRDNR

SEQ ID NO: 2517 - protein, 29 aa, Artificial Sequence
  Description of Artificial Sequence: Synthetic peptide
DEEEIRTTNPVATEQYGCVSTNLQREGNR

SEQ ID NO: 2518 - protein, 29 aa, Artificial Sequence
  Description of Artificial Sequence: Synthetic peptide
DEEEIRTTNPVATEQYGSVSTNEQRGDNR

SEQ ID NO: 2519 - protein, 28 aa, Artificial Sequence
  Description of Artificial Sequence: Synthetic peptide
DEEEIRTTNPVATEQYGSVDTSLQRGNR

SEQ ID NO: 2520 - protein, 28 aa, Artificial Sequence
  Description of Artificial Sequence: Synthetic peptide
DEQEIRTVNPVATEQYGSVSTNLQRGNR

SEQ ID NO: 2521 - protein, 28 aa, Artificial Sequence
  Description of Artificial Sequence: Synthetic peptide
DLEEIRTTNPVATEQYGSVSTNLQRGNP

SEQ ID NO: 2522 - protein, 29 aa, Artificial Sequence
  Description of Artificial Sequence: Synthetic peptide
DEEEIRTTNPVCTEQYGSVSTNLQRNGNR

SEQ ID NO: 2523 - protein, 28 aa, Artificial Sequence
  Description of Artificial Sequence: Synthetic peptide
DEEEIRATNPVATEQYGSVSTNGQRGNR

SEQ ID NO: 2524 - protein, 28 aa, Artificial Sequence
  Description of Artificial Sequence: Synthetic peptide
DEEEIRTTNPVATECYGSVSTNLQPGNR

SEQ ID NO: 2525 - protein, 28 aa, Artificial Sequence
  Description of Artificial Sequence: Synthetic peptide
DEEEIRTTNPGATEQYGSVSTNLQRQNR

SEQ ID NO: 2526 - protein, 28 aa, Artificial Sequence
  Description of Artificial Sequence: Synthetic peptide
DEEEIRTTNPVATEWWGSVSTNLQRGNR

SEQ ID NO: 2527 - protein, 28 aa, Artificial Sequence
  Description of Artificial Sequence: Synthetic peptide
DEEEIRTTNPVATEQYGAVSTNFQRGNR

SEQ ID NO: 2528 - protein, 28 aa, Artificial Sequence
  Description of Artificial Sequence: Synthetic peptide
DETEIRTTNPVATEQYGVVSTNLQRGNR

SEQ ID NO: 2529 - protein, 28 aa, Artificial Sequence
  Description of Artificial Sequence: Synthetic peptide
DEEEIRPTNPVATEQYGSVDTNLQRGNR

SEQ ID NO: 2530 - protein, 28 aa, Artificial Sequence
  Description of Artificial Sequence: Synthetic peptide
DEEEIRTTNPVATEQYGSVSENQQRGNR

SEQ ID NO: 2531 - protein, 28 aa, Artificial Sequence
  Description of Artificial Sequence: Synthetic peptide
DEEEIRTTNPVATEQYGSVSTNLQAGNT

SEQ ID NO: 2532 - protein, 29 aa, Artificial Sequence
  Description of Artificial Sequence: Synthetic peptide
DEEEIRTTNPVATEQYGSVSDTPLQRGNR

SEQ ID NO: 2533 - protein, 28 aa, Artificial Sequence
  Description of Artificial Sequence: Synthetic peptide
DEEEIRTTNPVAFEQYGSVSTNLQRGNC

SEQ ID NO: 2534 - protein, 28 aa, Artificial Sequence
  Description of Artificial Sequence: Synthetic peptide
DEEEIRTTNPVATEQYGSVSTELQRGNH

SEQ ID NO: 2535 - protein, 28 aa, Artificial Sequence
  Description of Artificial Sequence: Synthetic peptide
DEEEIRTTNPVATEQYGSVSTNEQWGNR

SEQ ID NO: 2536 - protein, 28 aa, Artificial Sequence
  Description of Artificial Sequence: Synthetic peptide
DEEEIRTTNPVATEQYGSVDTNLQAGNR

SEQ ID NO: 2537 - protein, 29 aa, Artificial Sequence
  Description of Artificial Sequence: Synthetic peptide
DEEEIRTTNPVATEQYGVVSTNLQRGNDR

SEQ ID NO: 2538 - protein, 29 aa, Artificial Sequence
  Description of Artificial Sequence: Synthetic peptide
DEEEIRTTNPVATEQYGCVSTNLQRGDNR

SEQ ID NO: 2539 - protein, 28 aa, Artificial Sequence
  Description of Artificial Sequence: Synthetic peptide
DEEEIRTTNPVATEQYGSVSTQLQRGMR

SEQ ID NO: 2540 - protein, 28 aa, Artificial Sequence
  Description of Artificial Sequence: Synthetic peptide
DEEEIRTTNPVATEQYGSVSTNLQRNQR

SEQ ID NO: 2541 - protein, 28 aa, Artificial Sequence
  Description of Artificial Sequence: Synthetic peptide
DEEEIRTTNPVATEVYGVVSTNLQRGNR

SEQ ID NO: 2542 - protein, 28 aa, Artificial Sequence
  Description of Artificial Sequence: Synthetic peptide
DEEEIRCTNPVASEQYGSVSTNLQRGNR

SEQ ID NO: 2543 - protein, 28 aa, Artificial Sequence
  Description of Artificial Sequence: Synthetic peptide
DEEEIRTTNPCATEQYGSVSTNLERGNR

SEQ ID NO: 2544 - protein, 28 aa, Artificial Sequence
  Description of Artificial Sequence: Synthetic peptide
DEEEIRCTNPVATEQYGSVSTNLQRGNT

SEQ ID NO: 2545 - protein, 28 aa, Artificial Sequence
  Description of Artificial Sequence: Synthetic peptide
DEQEIRTTNPVATEPYGSVSTNLQRGNR

SEQ ID NO: 2546 - protein, 28 aa, Artificial Sequence
  Description of Artificial Sequence: Synthetic peptide
DEYEIRTTNPVATEQYGEVSTNLQRGNR

SEQ ID NO: 2547 - protein, 28 aa, Artificial Sequence
  Description of Artificial Sequence: Synthetic peptide
DTEEIRTTNPVATEQYGSVSTNLYRGNR

SEQ ID NO: 2548 - protein, 29 aa, Artificial Sequence
  Description of Artificial Sequence: Synthetic peptide
DENEIRTTNPVATEQYGSVSFTNLQRGNR

SEQ ID NO: 2549 - protein, 29 aa, Artificial Sequence
  Description of Artificial Sequence: Synthetic peptide
DEEEIRTTNPVATEQYGSVSCTPLQRGNR

SEQ ID NO: 2550 - protein, 30 aa, Artificial Sequence
  Description of Artificial Sequence: Synthetic polypeptide
DEEEIRTTNPVATEQYGVSVTSTNLQRGNR

SEQ ID NO: 2551 - protein, 28 aa, Artificial Sequence
  Description of Artificial Sequence: Synthetic peptide
DENEIRTTNPVATEQYGSVSTDLQRGNR

SEQ ID NO: 2552 - protein, 28 aa, Artificial Sequence
  Description of Artificial Sequence: Synthetic peptide
DEEEITTTNPVATECYGSVSTNLQRGNR

SEQ ID NO: 2553 - protein, 28 aa, Artificial Sequence
  Description of Artificial Sequence: Synthetic peptide
DEEEIVTTNPVATELYGSVSTNLQRGNR

SEQ ID NO: 2554 - protein, 28 aa, Artificial Sequence
  Description of Artificial Sequence: Synthetic peptide
DEEEIRATNPVATEQYGSVATNLQRGNR

SEQ ID NO: 2555 - protein, 28 aa, Artificial Sequence
  Description of Artificial Sequence: Synthetic peptide
DEEEIRTTNPTATEQYGSVSTLLQRGNR

SEQ ID NO: 2556 - protein, 29 aa, Artificial Sequence
  Description of Artificial Sequence: Synthetic peptide
DEEEIRTTNPVATEQYGSVSETNLQRLNR

SEQ ID NO: 2557 - protein, 28 aa, Artificial Sequence
  Description of Artificial Sequence: Synthetic peptide
DEEEIRTTNPVATEQYGSVSTNLQNGLR

SEQ ID NO: 2558 - protein, 28 aa, Artificial Sequence
  Description of Artificial Sequence: Synthetic peptide
DEEEIRTTNPVATEQYGSVSTNLEPGNR

SEQ ID NO: 2559 - protein, 29 aa, Artificial Sequence
  Description of Artificial Sequence: Synthetic peptide
DEEEIRTTNPVATEQYGSVSTNLVQRGNV

SEQ ID NO: 2560 - protein, 29 aa, Artificial Sequence
  Description of Artificial Sequence: Synthetic peptide
DEEEIRTTNPVATEQYGSVSENLQCRGNR

SEQ ID NO: 2561 - protein, 28 aa, Artificial Sequence
  Description of Artificial Sequence: Synthetic peptide
DESEIRTVNPVATEQYGSVSTNLQRGNR

SEQ ID NO: 2562 - protein, 28 aa, Artificial Sequence
  Description of Artificial Sequence: Synthetic peptide
DEEEIRTTNIVATEQYGSVSTNLQMGNR

SEQ ID NO: 2563 - protein, 29 aa, Artificial Sequence
  Description of Artificial Sequence: Synthetic peptide
DEEEIRTTNPVATEQYGSVSTNEQRGVNR

SEQ ID NO: 2564 - protein, 29 aa, Artificial Sequence
  Description of Artificial Sequence: Synthetic peptide
DEEEIRTTNPVATEQYGSVSEWNLQRGNR

SEQ ID NO: 2565 - protein, 28 aa, Artificial Sequence
  Description of Artificial Sequence: Synthetic peptide
DEEEICTTNPVATEQYGSVSTNLQRGNN

SEQ ID NO: 2566 - protein, 29 aa, Artificial Sequence
  Description of Artificial Sequence: Synthetic peptide
DEEEIRTTNPVATEQYGSVSTNLQEVGNR

SEQ ID NO: 2567 - protein, 28 aa, Artificial Sequence
  Description of Artificial Sequence: Synthetic peptide
DEEEIRTTNPVATEQYGSVSTLLQRGNF

SEQ ID NO: 2568 - protein, 28 aa, Artificial Sequence
  Description of Artificial Sequence: Synthetic peptide
DEEEIRTTNPVAWEQYGSVSTNPQRGNR

SEQ ID NO: 2569 - protein, 30 aa, Artificial Sequence
  Description of Artificial Sequence: Synthetic polypeptide
DEEEIRTTNPVATEQYGSVTSTNLQRGNDR

SEQ ID NO: 2570 - protein, 29 aa, Artificial Sequence
  Description of Artificial Sequence: Synthetic peptide
DEEEIRTTNPVATEQYGSVTTNLQRNGNR

SEQ ID NO: 2571 - protein, 28 aa, Artificial Sequence
  Description of Artificial Sequence: Synthetic peptide
DEEEIRTTNPVATEQYGVVSTPLQRGNR

SEQ ID NO: 2572 - protein, 28 aa, Artificial Sequence
  Description of Artificial Sequence: Synthetic peptide
DEEEIRTTNPVATEQYGTVSTNPQRGNR

SEQ ID NO: 2573 - protein, 29 aa, Artificial Sequence
  Description of Artificial Sequence: Synthetic peptide
DEQEIRTTNPVATEQYGSVSPTNLQRGNR

SEQ ID NO: 2574 - protein, 29 aa, Artificial Sequence
  Description of Artificial Sequence: Synthetic peptide
DEQEIRTTNPVATEQYGSVESTNLQRGNR

SEQ ID NO: 2575 - protein, 30 aa, Artificial Sequence
  Description of Artificial Sequence: Synthetic polypeptide
DEEEIRTTNPVATEQYGSVSVTNGLQRGNR

SEQ ID NO: 2576 - protein, 28 aa, Artificial Sequence
  Description of Artificial Sequence: Synthetic peptide
DEEEIRTTNPVATEQYGSVSTNPQRGNG

SEQ ID NO: 2577 - protein, 30 aa, Artificial Sequence
  Description of Artificial Sequence: Synthetic polypeptide
DEEEIRTTNPVATEQYGVSVISTNLQRGNR

SEQ ID NO: 2578 - protein, 29 aa, Artificial Sequence
  Description of Artificial Sequence: Synthetic peptide
DEEEIRTTNPVATEQYGSVSTNLQERGNL

SEQ ID NO: 2579 - protein, 29 aa, Artificial Sequence
  Description of Artificial Sequence: Synthetic peptide
SEEEIRTTNPVATEQYGSSVSTNLQRGNR

SEQ ID NO: 2580 - protein, 28 aa, Artificial Sequence
  Description of Artificial Sequence: Synthetic peptide
GEEEIRTTNPVATETYGSVSTNLQRGNR

SEQ ID NO: 2581 - protein, 28 aa, Artificial Sequence
  Description of Artificial Sequence: Synthetic peptide
DEEEIRTTNPVATEQYGSVSECLQRGNR

SEQ ID NO: 2582 - protein, 30 aa, Artificial Sequence
  Description of Artificial Sequence: Synthetic polypeptide
DEEEIRTTNPVATEQYGSVSCTNLQRGNDR

SEQ ID NO: 2583 - protein, 28 aa, Artificial Sequence
  Description of Artificial Sequence: Synthetic peptide
DEEEIRTTNPVATEQYGSVSTNLIRGER

SEQ ID NO: 2584 - protein, 28 aa, Artificial Sequence
  Description of Artificial Sequence: Synthetic peptide
DEVEIRTTNPVATEQYGSVSTNPQRGNR

SEQ ID NO: 2585 - protein, 28 aa, Artificial Sequence
  Description of Artificial Sequence: Synthetic peptide
DEEEIRTTNPVATEQYGSVSTALQVGNR

SEQ ID NO: 2586 - protein, 28 aa, Artificial Sequence
  Description of Artificial Sequence: Synthetic peptide
DEEEIRTTNPVATETYGGVSTNLQRGNR

SEQ ID NO: 2587 - protein, 28 aa, Artificial Sequence
  Description of Artificial Sequence: Synthetic peptide
DEHEIRTTNPVATEQYGSVSTELQRGNR

SEQ ID NO: 2588 - protein, 28 aa, Artificial Sequence
  Description of Artificial Sequence: Synthetic peptide
DEEEIRTTNPVAMEQYGSVSTGLQRGNR

SEQ ID NO: 2589 - protein, 28 aa, Artificial Sequence
  Description of Artificial Sequence: Synthetic peptide
DEEEIRTTNPVATQQYGSVSTPLQRGNR

SEQ ID NO: 2590 - protein, 28 aa, Artificial Sequence
  Description of Artificial Sequence: Synthetic peptide
SEEEIRTTNPVATEQYGSVSTNLQRGNC

SEQ ID NO: 2591 - protein, 28 aa, Artificial Sequence
  Description of Artificial Sequence: Synthetic peptide
DEEEIRTTNPVATEQYGSVSCNLQLGNR

SEQ ID NO: 2592 - protein, 28 aa, Artificial Sequence
  Description of Artificial Sequence: Synthetic peptide
DEEEIRTTNIVATEQYGSVSTNLQRDNR

SEQ ID NO: 2593 - protein, 28 aa, Artificial Sequence
  Description of Artificial Sequence: Synthetic peptide
DEEEIRTTNPVATEQYGSVSTNLQTGNY

SEQ ID NO: 2594 - protein, 28 aa, Artificial Sequence
  Description of Artificial Sequence: Synthetic peptide
DEEEIRCTNPVATEQYGSVSTNLQRGNQ

SEQ ID NO: 2595 - protein, 28 aa, Artificial Sequence
  Description of Artificial Sequence: Synthetic peptide
DEEEISTTNPVATEQYGSVSTNLQRGGR

SEQ ID NO: 2596 - protein, 28 aa, Artificial Sequence
  Description of Artificial Sequence: Synthetic peptide
DEEEIRTTNPVATEQYGSVATNLQRLNR

SEQ ID NO: 2597 - protein, 28 aa, Artificial Sequence
  Description of Artificial Sequence: Synthetic peptide
DEFEIRTTNPVATEQYGSVSENLQRGNR

SEQ ID NO: 2598 - protein, 28 aa, Artificial Sequence
  Description of Artificial Sequence: Synthetic peptide
DEEEIATTNPVATELYGSVSTNLQRGNR

SEQ ID NO: 2599 - protein, 28 aa, Artificial Sequence
  Description of Artificial Sequence: Synthetic peptide
DEEEIRTTNPVATQQYGSVSTGLQRGNR

SEQ ID NO: 2600 - protein, 29 aa, Artificial Sequence
  Description of Artificial Sequence: Synthetic peptide
DEEEIRTTNPVATEQYGSVSTNLQREGNS

SEQ ID NO: 2601 - protein, 28 aa, Artificial Sequence
  Description of Artificial Sequence: Synthetic peptide
DEEEIRTTNPVATQQYGSVSENLQRGNR

SEQ ID NO: 2602 - protein, 28 aa, Artificial Sequence
  Description of Artificial Sequence: Synthetic peptide
DEEEIRTTNPVATEQYGSVSTNLQEGNN

SEQ ID NO: 2603 - protein, 29 aa, Artificial Sequence
  Description of Artificial Sequence: Synthetic peptide
DEEEIRTTNPVATEQYGSVSTGNLQAGNR

SEQ ID NO: 2604 - protein, 29 aa, Artificial Sequence
  Description of Artificial Sequence: Synthetic peptide
DEEEIRTTNPVATEQYGSVSITNLQRGDR

SEQ ID NO: 2605 - protein, 28 aa, Artificial Sequence
  Description of Artificial Sequence: Synthetic peptide
DEEEIRTTNPVATEQYGAVATNLQRGNR

SEQ ID NO: 2606 - protein, 28 aa, Artificial Sequence
  Description of Artificial Sequence: Synthetic peptide
DEEEIRTTNPVATEQYGIVDTNLQRGNR

SEQ ID NO: 2607 - protein, 28 aa, Artificial Sequence
  Description of Artificial Sequence: Synthetic peptide
DEEEIRTTNPVATEQYGSWSTNLQHGNR

SEQ ID NO: 2608 - protein, 28 aa, Artificial Sequence
  Description of Artificial Sequence: Synthetic peptide
DEEEIRTTNPVSTECYGSVSTNLQRGNR

SEQ ID NO: 2609 - protein, 29 aa, Artificial Sequence
  Description of Artificial Sequence: Synthetic peptide
DEEEIRATNPVATEQYGSVSTNLQRGNTR

SEQ ID NO: 2610 - protein, 28 aa, Artificial Sequence
  Description of Artificial Sequence: Synthetic peptide
DEEEIRTTNPDATEQYGSVSTPLQRGNR

SEQ ID NO: 2611 - protein, 29 aa, Artificial Sequence
  Description of Artificial Sequence: Synthetic peptide
DEEEIRTTNPVATEQYGSVESTDLQRGNR

SEQ ID NO: 2612 - protein, 28 aa, Artificial Sequence
  Description of Artificial Sequence: Synthetic peptide
DEEEIRTTNPVATEQFGSVGTNLQRGNR

SEQ ID NO: 2613 - protein, 29 aa, Artificial Sequence
  Description of Artificial Sequence: Synthetic peptide
DEEEIRTTNPVATEQYGSVDTNLQERGNR

SEQ ID NO: 2614 - protein, 28 aa, Artificial Sequence
  Description of Artificial Sequence: Synthetic peptide
DEEEIRTTNPFATEQYGSVSTNLERGNR

SEQ ID NO: 2615 - protein, 28 aa, Artificial Sequence
  Description of Artificial Sequence: Synthetic peptide
DEEEIRTTNPVATELYGSVSTNLQRGND

SEQ ID NO: 2616 - protein, 28 aa, Artificial Sequence
  Description of Artificial Sequence: Synthetic peptide
DEEEIRTTNPVATEQYGSVSTNLERGNL

SEQ ID NO: 2617 - protein, 29 aa, Artificial Sequence
  Description of Artificial Sequence: Synthetic peptide
DEEEIRTTNPVATEQYGSVSTNLQQGENR

SEQ ID NO: 2618 - protein, 28 aa, Artificial Sequence
  Description of Artificial Sequence: Synthetic peptide
DEEEIRTTNPDATEQYGSVSTNLQDGNR

SEQ ID NO: 2619 - protein, 28 aa, Artificial Sequence
  Description of Artificial Sequence: Synthetic peptide
DEEEIRTTNPVATEQYGSVSTNLQRGEQ

SEQ ID NO: 2620 - protein, 28 aa, Artificial Sequence
  Description of Artificial Sequence: Synthetic peptide
DEEEIRTTNPVATEQYGSVSTLLQRGDR

SEQ ID NO: 2621 - protein, 28 aa, Artificial Sequence
  Description of Artificial Sequence: Synthetic peptide
VEEEIRTTNPVATEQYGSVSENLQRGNR

SEQ ID NO: 2622 - protein, 30 aa, Artificial Sequence
  Description of Artificial Sequence: Synthetic polypeptide
DEEEIRTTNPVATEQYGSVSTNNLIQRGNR

SEQ ID NO: 2623 - protein, 29 aa, Artificial Sequence
  Description of Artificial Sequence: Synthetic peptide
DEEEIRTTNPVATEQYGSVSTNLQEPGNR

SEQ ID NO: 2624 - protein, 28 aa, Artificial Sequence
  Description of Artificial Sequence: Synthetic peptide
DEEEIRTTNIVATEQYGSVSTNLQRGNM

SEQ ID NO: 2625 - protein, 30 aa, Artificial Sequence
  Description of Artificial Sequence: Synthetic polypeptide
DEEEIRTTNPVATEQYGSVSTNLQIRGDNR

SEQ ID NO: 2626 - protein, 28 aa, Artificial Sequence
  Description of Artificial Sequence: Synthetic peptide
DEEEIRTTNPVATFQYGSVSTNLQRGAR

SEQ ID NO: 2627 - protein, 28 aa, Artificial Sequence
  Description of Artificial Sequence: Synthetic peptide
DEEEIMTTNPVATEQYGSVSTNLQRGNF

SEQ ID NO: 2628 - protein, 28 aa, Artificial Sequence
  Description of Artificial Sequence: Synthetic peptide
DEHEIRTTNPVATEQYGSVSTNLQHGNR

SEQ ID NO: 2629 - protein, 29 aa, Artificial Sequence
  Description of Artificial Sequence: Synthetic peptide
DEEEIRTTNPVATEWYGSVSTNLQRGNDR

SEQ ID NO: 2630 - protein, 28 aa, Artificial Sequence
  Description of Artificial Sequence: Synthetic peptide
DEEEIRTTNPVASEQYGSVSTELQRGNR

SEQ ID NO: 2631 - protein, 29 aa, Artificial Sequence
  Description of Artificial Sequence: Synthetic peptide
DEEEIRTTNPVATEQYGSVSTNLQNGNDR

SEQ ID NO: 2632 - protein, 29 aa, Artificial Sequence
  Description of Artificial Sequence: Synthetic peptide
DEEEIRTTNPVATEQYGSVSENLQRGNDR

SEQ ID NO: 2633 - protein, 28 aa, Artificial Sequence
  Description of Artificial Sequence: Synthetic peptide
DEQEIRTTNPVATEQYGSVSTNLQRGNN

SEQ ID NO: 2634 - protein, 28 aa, Artificial Sequence
  Description of Artificial Sequence: Synthetic peptide
DEEEIRTTNPVATEQYGSVSTNSERGNR

SEQ ID NO: 2635 - protein, 28 aa, Artificial Sequence
  Description of Artificial Sequence: Synthetic peptide
DEEEIRTTNPIATEQYGSVSTNLQRGNY

SEQ ID NO: 2636 - protein, 28 aa, Artificial Sequence
  Description of Artificial Sequence: Synthetic peptide
DEEEIRTTNPVATEQYGSVSTNLQDGND

SEQ ID NO: 2637 - protein, 28 aa, Artificial Sequence
  Description of Artificial Sequence: Synthetic peptide
DEDEIRTTNPVATEQYGSVSTVLQRGNR

SEQ ID NO: 2638 - protein, 29 aa, Artificial Sequence
  Description of Artificial Sequence: Synthetic peptide
DEEEIRTTNPVATEQYGSVSTMDLQRGNR

SEQ ID NO: 2639 - protein, 28 aa, Artificial Sequence
  Description of Artificial Sequence: Synthetic peptide
DEEEIRTTNPVATEQYGSVSTNLQAGNQ

SEQ ID NO: 2640 - protein, 29 aa, Artificial Sequence
  Description of Artificial Sequence: Synthetic peptide
DEEEIRTTNPVATEQFGSVSTNLQRGVNR

SEQ ID NO: 2641 - protein, 30 aa, Artificial Sequence
  Description of Artificial Sequence: Synthetic polypeptide
DEEEIRTTNPVATEQYGSVSTNLQERGNDR

SEQ ID NO: 2642 - protein, 29 aa, Artificial Sequence
  Description of Artificial Sequence: Synthetic peptide
DEEEIRTTNPTATEQYGSVSTNLQRGNFR

SEQ ID NO: 2643 - protein, 29 aa, Artificial Sequence
  Description of Artificial Sequence: Synthetic peptide
DEEEIRTTNPVATEQYGMSVSTNLQRGNP

SEQ ID NO: 2644 - protein, 28 aa, Artificial Sequence
  Description of Artificial Sequence: Synthetic peptide
DEEEIRTTNPVATEQYGSASMNLQRGNR

SEQ ID NO: 2645 - protein, 29 aa, Artificial Sequence
  Description of Artificial Sequence: Synthetic peptide
DEEEIRTTNPVATEQYGSVCSTNLQRGQR

SEQ ID NO: 2646 - protein, 28 aa, Artificial Sequence
  Description of Artificial Sequence: Synthetic peptide
QEEEIRTTNPVATEQYGSVSTNLQRGGR

SEQ ID NO: 2647 - protein, 28 aa, Artificial Sequence
  Description of Artificial Sequence: Synthetic peptide
DEEEIRTTNPVATEWYGSVDTNLQRGNR

SEQ ID NO: 2648 - protein, 29 aa, Artificial Sequence
  Description of Artificial Sequence: Synthetic peptide
DEEEIRTTNPVATEQYGSVSTNLQLEGNR

SEQ ID NO: 2649 - protein, 28 aa, Artificial Sequence
  Description of Artificial Sequence: Synthetic peptide
DEEEIRTTNPFATEQYGSVSTDLQRGNR

SEQ ID NO: 2650 - protein, 28 aa, Artificial Sequence
  Description of Artificial Sequence: Synthetic peptide
DEAEIRTTNPVATEQYGSVSTTLQRGNR

SEQ ID NO: 2651 - protein, 29 aa, Artificial Sequence
  Description of Artificial Sequence: Synthetic peptide
HEEEIRTTNPVATEQYGSVSDTNLQRGNR

SEQ ID NO: 2652 - protein, 30 aa, Artificial Sequence
  Description of Artificial Sequence: Synthetic polypeptide
DEEEIRTTNPVATEQYGSVSQTNLNQRGNR

SEQ ID NO: 2653 - protein, 28 aa, Artificial Sequence
  Description of Artificial Sequence: Synthetic peptide
DEEEIVTTNPVATEQYGSVSTALQRGNR

SEQ ID NO: 2654 - protein, 29 aa, Artificial Sequence
  Description of Artificial Sequence: Synthetic peptide
DEEEIRTTNPVATEQYGSNSDTNLQRGNR

SEQ ID NO: 2655 - protein, 28 aa, Artificial Sequence
  Description of Artificial Sequence: Synthetic peptide
DDEEIRTTNPVATEQYGSVSTDLQRGNR

SEQ ID NO: 2656 - protein, 28 aa, Artificial Sequence
  Description of Artificial Sequence: Synthetic peptide
DEEEIRTTNPVATEQYGSVSNNLQRGNI

SEQ ID NO: 2657 - protein, 28 aa, Artificial Sequence
  Description of Artificial Sequence: Synthetic peptide
DEEEIRTTNPVATDQYGSVSTNLQRENR

SEQ ID NO: 2658 - protein, 28 aa, Artificial Sequence
  Description of Artificial Sequence: Synthetic peptide
SEEEIRTTNPVATEQWGSVSTNLQRGNR

SEQ ID NO: 2659 - protein, 29 aa, Artificial Sequence
  Description of Artificial Sequence: Synthetic peptide
DEKEIRTTNPVATEQYGSVSTPNLQRGNR

SEQ ID NO: 2660 - protein, 28 aa, Artificial Sequence
  Description of Artificial Sequence: Synthetic peptide
DEEEIRTTNPVATEQYGSVSTNLQIGNV

SEQ ID NO: 2661 - protein, 29 aa, Artificial Sequence
  Description of Artificial Sequence: Synthetic peptide
DEEEIRCTNPVATEQYGSVSTNNLQRGNR

SEQ ID NO: 2662 - protein, 29 aa, Artificial Sequence
  Description of Artificial Sequence: Synthetic peptide
DPEEIRTTNPVATEQYGSVSTNLQERGNR

SEQ ID NO: 2663 - protein, 29 aa, Artificial Sequence
  Description of Artificial Sequence: Synthetic peptide
DEEEIRTTNPVATEQYGSVSTPLQRNGNR

SEQ ID NO: 2664 - protein, 28 aa, Artificial Sequence
  Description of Artificial Sequence: Synthetic peptide
DEEEIRTTNPVATEMYGSVSTNLQRGNP

SEQ ID NO: 2665 - protein, 29 aa, Artificial Sequence
  Description of Artificial Sequence: Synthetic peptide
DEEEIRTTNPVSTEQYGSVSTMNLQRGNR

SEQ ID NO: 2666 - protein, 28 aa, Artificial Sequence
  Description of Artificial Sequence: Synthetic peptide
DEEEIRTTNPVATEQYGSVATNLQRGNE

SEQ ID NO: 2667 - protein, 29 aa, Artificial Sequence
  Description of Artificial Sequence: Synthetic peptide
DEFEIRTTNPVATEQYGSVSTNLQRAGNR

SEQ ID NO: 2668 - protein, 29 aa, Artificial Sequence
  Description of Artificial Sequence: Synthetic peptide
DEEEIRTTNPVATEQYGSYSTNLQMRGNR

SEQ ID NO: 2669 - protein, 28 aa, Artificial Sequence
  Description of Artificial Sequence: Synthetic peptide
DEEEIRTTNPTCTEQYGSVSTNLQRGNR

SEQ ID NO: 2670 - protein, 28 aa, Artificial Sequence
  Description of Artificial Sequence: Synthetic peptide
DEVEIRTTNPVATEQYGSVSTNLQVGNR

SEQ ID NO: 2671 - protein, 29 aa, Artificial Sequence
  Description of Artificial Sequence: Synthetic peptide
DEEEIRTTNPVATEQYGSVSTDLQRGSNR

SEQ ID NO: 2672 - protein, 29 aa, Artificial Sequence
  Description of Artificial Sequence: Synthetic peptide
DEEEIRTTNPVATEQYGSVSWDNLQRGNR

SEQ ID NO: 2673 - protein, 29 aa, Artificial Sequence
  Description of Artificial Sequence: Synthetic peptide
DEEEIRTTNPVATEQYGSVSTNLTQRTNR

SEQ ID NO: 2674 - protein, 28 aa, Artificial Sequence
  Description of Artificial Sequence: Synthetic peptide
DEEEIRTTNPVATEQYGSVSTNLQRGEY

SEQ ID NO: 2675 - protein, 28 aa, Artificial Sequence
  Description of Artificial Sequence: Synthetic peptide
DEEEIRCTNPVATEQYGSVSTNIQRGNR

SEQ ID NO: 2676 - protein, 29 aa, Artificial Sequence
  Description of Artificial Sequence: Synthetic peptide
DEEEIRTTNPVATEVYGSVSTNLQRNGNR

SEQ ID NO: 2677 - protein, 28 aa, Artificial Sequence
  Description of Artificial Sequence: Synthetic peptide
DEEEIRTTNPTATEVYGSVSTNLQRGNR

SEQ ID NO: 2678 - protein, 29 aa, Artificial Sequence
  Description of Artificial Sequence: Synthetic peptide
DDEEIRTTNPVATEQYGSVSTNLQREGNR

SEQ ID NO: 2679 - protein, 29 aa, Artificial Sequence
  Description of Artificial Sequence: Synthetic peptide
DDEEIRTTNPVATEQYGSVSTNLQRGNDR

SEQ ID NO: 2680 - protein, 28 aa, Artificial Sequence
  Description of Artificial Sequence: Synthetic peptide
DEEEIRTTNIVATEQYGSVSTNLQRGNA

SEQ ID NO: 2681 - protein, 28 aa, Artificial Sequence
  Description of Artificial Sequence: Synthetic peptide
DEEEIRTTNPVATEQYGSVGTNLERGNR

SEQ ID NO: 2682 - protein, 28 aa, Artificial Sequence
  Description of Artificial Sequence: Synthetic peptide
DEEEIRTTNPVATEQYGSVSTNLEQGNR

SEQ ID NO: 2683 - protein, 28 aa, Artificial Sequence
  Description of Artificial Sequence: Synthetic peptide
DEEEIRTTNPVATEQYGSVSTNLQFGNH

SEQ ID NO: 2684 - protein, 28 aa, Artificial Sequence
  Description of Artificial Sequence: Synthetic peptide
DEEEIRTTNPVATETYGSVSTNLQRGTR

SEQ ID NO: 2685 - protein, 28 aa, Artificial Sequence
  Description of Artificial Sequence: Synthetic peptide
DEEEIRTTNPCATEQYGAVSTNLQRGNR

SEQ ID NO: 2686 - protein, 29 aa, Artificial Sequence
  Description of Artificial Sequence: Synthetic peptide
DEEEIRTTNPVATEQYGSVSDTNLERGNR

SEQ ID NO: 2687 - protein, 30 aa, Artificial Sequence
  Description of Artificial Sequence: Synthetic polypeptide
DEEEIRTTNPVATEQYGSVSTGNLQQRGNR

SEQ ID NO: 2688 - protein, 28 aa, Artificial Sequence
  Description of Artificial Sequence: Synthetic peptide
DEEEIRTTNPVATEQYGSVSTNIQRGGR

SEQ ID NO: 2689 - protein, 30 aa, Artificial Sequence
  Description of Artificial Sequence: Synthetic polypeptide
DEEEIRTTNPVATEQYGSVSTNLQERGDNR

SEQ ID NO: 2690 - protein, 29 aa, Artificial Sequence
  Description of Artificial Sequence: Synthetic peptide
DEEEIRTTNPVATEQYGSVSTNLQRAENR

SEQ ID NO: 2691 - protein, 28 aa, Artificial Sequence
  Description of Artificial Sequence: Synthetic peptide
DEEEIRQTNPVATEQYGSVSTNLQNGNR

SEQ ID NO: 2692 - protein, 30 aa, Artificial Sequence
  Description of Artificial Sequence: Synthetic polypeptide
DEEEIRTTNPVATEQYGSVSTCNLQERGNR

SEQ ID NO: 2693 - protein, 28 aa, Artificial Sequence
  Description of Artificial Sequence: Synthetic peptide
DEEEIRTTNPVATEQYGSVSTNLQLGNM

SEQ ID NO: 2694 - protein, 28 aa, Artificial Sequence
  Description of Artificial Sequence: Synthetic peptide
DDEEIRTTNPVATEQYGSVSTNLLRGNR

SEQ ID NO: 2695 - protein, 28 aa, Artificial Sequence
  Description of Artificial Sequence: Synthetic peptide
DEEEIRTTNPVATEQYGTVETNLQRGNR

SEQ ID NO: 2696 - protein, 28 aa, Artificial Sequence
  Description of Artificial Sequence: Synthetic peptide
DEEEIRTTNPVATEVYGSVSTNDQRGNR

SEQ ID NO: 2697 - protein, 29 aa, Artificial Sequence
  Description of Artificial Sequence: Synthetic peptide
DEEEIRTVNPVATEQYGSVSTNLQNRGNR

SEQ ID NO: 2698 - protein, 28 aa, Artificial Sequence
  Description of Artificial Sequence: Synthetic peptide
DEEEIVTTNPVATEQYGSVSTNLQVGNR

SEQ ID NO: 2699 - protein, 30 aa, Artificial Sequence
  Description of Artificial Sequence: Synthetic polypeptide
DEEEIRTTNPVATEQYGSYVSTMNLQRGNR

SEQ ID NO: 2700 - protein, 29 aa, Artificial Sequence
  Description of Artificial Sequence: Synthetic peptide
DEEEIRTTNPVATEQYGSVSTMNLQRGPR

SEQ ID NO: 2701 - protein, 28 aa, Artificial Sequence
  Description of Artificial Sequence: Synthetic peptide
FEEEIRTTNPVATEQYGSVSTNLQRGND

SEQ ID NO: 2702 - protein, 28 aa, Artificial Sequence
  Description of Artificial Sequence: Synthetic peptide
DEEEIRTTNPVATEQYGSVSTDLQRGNT

SEQ ID NO: 2703 - protein, 28 aa, Artificial Sequence
  Description of Artificial Sequence: Synthetic peptide
FEEEIRTTNPVATEQYGSVSTPLQRGNR

SEQ ID NO: 2704 - protein, 28 aa, Artificial Sequence
  Description of Artificial Sequence: Synthetic peptide
DEEEIRTTNPVATEQYGSVSTGLQTGNR

SEQ ID NO: 2705 - protein, 28 aa, Artificial Sequence
  Description of Artificial Sequence: Synthetic peptide
DEEEIRTTNPVATEQWGSVSTNDQRGNR

SEQ ID NO: 2706 - protein, 29 aa, Artificial Sequence
  Description of Artificial Sequence: Synthetic peptide
SEEEIRTTNPVATEQYGSVSTNLQRGDNR

SEQ ID NO: 2707 - protein, 28 aa, Artificial Sequence
  Description of Artificial Sequence: Synthetic peptide
DEEEIRTTNPVATEQYGSVSTNLQIGNE

SEQ ID NO: 2708 - protein, 28 aa, Artificial Sequence
  Description of Artificial Sequence: Synthetic peptide
DEEEIRTTNPVATEQWGSVSTNEQRGNR

SEQ ID NO: 2709 - protein, 29 aa, Artificial Sequence
  Description of Artificial Sequence: Synthetic peptide
DEEEIRTTNPVATECYGSVSTNLQRGGNR

SEQ ID NO: 2710 - protein, 30 aa, Artificial Sequence
  Description of Artificial Sequence: Synthetic polypeptide
DEEEIRTTNPVATEQYGSVSTPNLQRGSNR

SEQ ID NO: 2711 - protein, 29 aa, Artificial Sequence
  Description of Artificial Sequence: Synthetic peptide
DEQEIRTTNPVATEQYGSVSTNLPQRGNR

SEQ ID NO: 2712 - protein, 28 aa, Artificial Sequence
  Description of Artificial Sequence: Synthetic peptide
DEEEIRTTNPTATEQYGSVSTNLQNGNR

SEQ ID NO: 2713 - protein, 29 aa, Artificial Sequence
  Description of Artificial Sequence: Synthetic peptide
DEEEIRTTNPVATEQYGSVWSTNLQAGNR

SEQ ID NO: 2714 - protein, 28 aa, Artificial Sequence
  Description of Artificial Sequence: Synthetic peptide
DEEELRTTNPVASEQYGSVSTNLQRGNR

SEQ ID NO: 2715 - protein, 28 aa, Artificial Sequence
  Description of Artificial Sequence: Synthetic peptide
DEEEIRTTNPVATEKYGSVSTNLQPGNR

SEQ ID NO: 2716 - protein, 28 aa, Artificial Sequence
  Description of Artificial Sequence: Synthetic peptide
DEEEIRTTNPAATEQYGSVSTNPQRGNR

SEQ ID NO: 2717 - protein, 29 aa, Artificial Sequence
  Description of Artificial Sequence: Synthetic peptide
DEEEIRTTNPVATEQYGSVSTNLQDGDNR

SEQ ID NO: 2718 - protein, 28 aa, Artificial Sequence
  Description of Artificial Sequence: Synthetic peptide
DEEEIRSTNPVATEQYGCVSTNLQRGNR

SEQ ID NO: 2719 - protein, 28 aa, Artificial Sequence
  Description of Artificial Sequence: Synthetic peptide
DEEEIRTTNPVATEQYGSVSTNLQLGNG

SEQ ID NO: 2720 - protein, 29 aa, Artificial Sequence
  Description of Artificial Sequence: Synthetic peptide
DEEEIRTTNPVATEIYGSVSTNLQRGDNR

SEQ ID NO: 2721 - protein, 28 aa, Artificial Sequence
  Description of Artificial Sequence: Synthetic peptide
VEEEIRPTNPVATEQYGSVSTNLQRGNR

SEQ ID NO: 2722 - protein, 28 aa, Artificial Sequence
  Description of Artificial Sequence: Synthetic peptide
DEEEIRTTNIVATEQYGSVSTNLQRGND

SEQ ID NO: 2723 - protein, 28 aa, Artificial Sequence
  Description of Artificial Sequence: Synthetic peptide
DEEEIRTTNPVATECYGSVSTNLQRLNR

SEQ ID NO: 2724 - protein, 28 aa, Artificial Sequence
  Description of Artificial Sequence: Synthetic peptide
DEEEIRTTNPVATEQYGSVSTDLQTGNR

SEQ ID NO: 2725 - protein, 30 aa, Artificial Sequence
  Description of Artificial Sequence: Synthetic polypeptide
DEEEIRTTNPVATEQYGESVSTNLQRGINR

SEQ ID NO: 2726 - protein, 28 aa, Artificial Sequence
  Description of Artificial Sequence: Synthetic peptide
MEEEIRTTNPVATEQYGSVSTNLQQGNR

SEQ ID NO: 2727 - protein, 28 aa, Artificial Sequence
  Description of Artificial Sequence: Synthetic peptide
DEEEIRTTNPIATEQYGSVSTNLQRENR

SEQ ID NO: 2728 - protein, 28 aa, Artificial Sequence
  Description of Artificial Sequence: Synthetic peptide
AEEEIRTTNPVATEQYGSVSTNQQRGNR

SEQ ID NO: 2729 - protein, 28 aa, Artificial Sequence
  Description of Artificial Sequence: Synthetic peptide
DEEEIRTTNPVATEQYGSVSTNLDGGNR

SEQ ID NO: 2730 - protein, 28 aa, Artificial Sequence
  Description of Artificial Sequence: Synthetic peptide
DEEEVRTTNPVSTEQYGSVSTNLQRGNR

SEQ ID NO: 2731 - protein, 28 aa, Artificial Sequence
  Description of Artificial Sequence: Synthetic peptide
DEEEIRTTNPVATLQYGSVSTTLQRGNR

SEQ ID NO: 2732 - protein, 28 aa, Artificial Sequence
  Description of Artificial Sequence: Synthetic peptide
DEEEIRTTNPVATEQYGSVSTPLQRGFR

SEQ ID NO: 2733 - protein, 29 aa, Artificial Sequence
  Description of Artificial Sequence: Synthetic peptide
DEEEIRTTNPVATEQYGSVSTDPLQRGNR

SEQ ID NO: 2734 - protein, 28 aa, Artificial Sequence
  Description of Artificial Sequence: Synthetic peptide
DEEEIRTTNPVATEQYGSVSTNLTPGNR

SEQ ID NO: 2735 - protein, 28 aa, Artificial Sequence
  Description of Artificial Sequence: Synthetic peptide
DEEEIRTTNPVATEQYGSVSTNLQDGNT

SEQ ID NO: 2736 - protein, 28 aa, Artificial Sequence
  Description of Artificial Sequence: Synthetic peptide
DEEEIRTVNPVATENYGSVSTNLQRGNR

SEQ ID NO: 2737 - protein, 28 aa, Artificial Sequence
  Description of Artificial Sequence: Synthetic peptide
DEEEIRTTNPQATEQYGSVSTNLQTGNR

SEQ ID NO: 2738 - protein, 29 aa, Artificial Sequence
  Description of Artificial Sequence: Synthetic peptide
DEEEIRTTNPVATEQYGSVSTPLQRAGNR

SEQ ID NO: 2739 - protein, 28 aa, Artificial Sequence
  Description of Artificial Sequence: Synthetic peptide
AEQEIRTTNPVATEQYGSVSTNLQRGNR

SEQ ID NO: 2740 - protein, 29 aa, Artificial Sequence
  Description of Artificial Sequence: Synthetic peptide
DEEEIRTTNPVATEQYGSVSTALQREGNR

SEQ ID NO: 2741 - protein, 28 aa, Artificial Sequence
  Description of Artificial Sequence: Synthetic peptide
DHEEIRTTNPVATEQYGSVSTGLQRGNR

SEQ ID NO: 2742 - protein, 29 aa, Artificial Sequence
  Description of Artificial Sequence: Synthetic peptide
DEEEIRTVNPVATEQYGSVSDTNLQRGNR

SEQ ID NO: 2743 - protein, 28 aa, Artificial Sequence
  Description of Artificial Sequence: Synthetic peptide
DEEEIRTTNPVSTEQYGSVSTNIQRGNR

SEQ ID NO: 2744 - protein, 29 aa, Artificial Sequence
  Description of Artificial Sequence: Synthetic peptide
DEEEIRTTNPVATEIYGSVSTNLQRNGNR

SEQ ID NO: 2745 - protein, 28 aa, Artificial Sequence
  Description of Artificial Sequence: Synthetic peptide
DEEEIRTTNPVATEQYGSMSTNLQMGNR

SEQ ID NO: 2746 - protein, 28 aa, Artificial Sequence
  Description of Artificial Sequence: Synthetic peptide
DENEIRTTNPVATEQYGSVSTNLMRGNR

SEQ ID NO: 2747 - protein, 28 aa, Artificial Sequence
  Description of Artificial Sequence: Synthetic peptide
DEEEIRTTNPVATEQYGSVSTNLQYGNE

SEQ ID NO: 2748 - protein, 28 aa, Artificial Sequence
  Description of Artificial Sequence: Synthetic peptide
DEEEIRTTNPVATEQYGSVDTNLQRGNY

SEQ ID NO: 2749 - protein, 28 aa, Artificial Sequence
  Description of Artificial Sequence: Synthetic peptide
DEEEIRTTNPVATEQYGSTNTNLQRGNR

SEQ ID NO: 2750 - protein, 28 aa, Artificial Sequence
  Description of Artificial Sequence: Synthetic peptide
DEEEIRTVNPIATEQYGSVSTNLQRGNR

SEQ ID NO: 2751 - protein, 28 aa, Artificial Sequence
  Description of Artificial Sequence: Synthetic peptide
DEEEIRTTNPVATEQYGSVSTNLQHGNN

SEQ ID NO: 2752 - protein, 29 aa, Artificial Sequence
  Description of Artificial Sequence: Synthetic peptide
DEEEIRTTNPVATEQYGSVSCENLQRGNR

SEQ ID NO: 2753 - protein, 29 aa, Artificial Sequence
  Description of Artificial Sequence: Synthetic peptide
DEEEIRTTNPVATEQYGSVSTNLQRGPNI

SEQ ID NO: 2754 - protein, 28 aa, Artificial Sequence
  Description of Artificial Sequence: Synthetic peptide
DEEEIRTTNPVATEQYGSWSTNLQRPNR

SEQ ID NO: 2755 - protein, 28 aa, Artificial Sequence
  Description of Artificial Sequence: Synthetic peptide
DEEEIRTTNPVATEQYGDVSTNLQRLNR

SEQ ID NO: 2756 - protein, 28 aa, Artificial Sequence
  Description of Artificial Sequence: Synthetic peptide
CEEEIRTTNPVATEQMGSVSTNLQRGNR

SEQ ID NO: 2757 - protein, 29 aa, Artificial Sequence
  Description of Artificial Sequence: Synthetic peptide
DEEEIRTTNPVATELYGSVSTNLQREGNR

SEQ ID NO: 2758 - protein, 28 aa, Artificial Sequence
  Description of Artificial Sequence: Synthetic peptide
DEEEIRTTNPVATEQYGSVSYNGQRGNR

SEQ ID NO: 2759 - protein, 28 aa, Artificial Sequence
  Description of Artificial Sequence: Synthetic peptide
DEEEIRTTNPVASEQYGSVSTNLQVGNR

SEQ ID NO: 2760 - protein, 29 aa, Artificial Sequence
  Description of Artificial Sequence: Synthetic peptide
DEEEIRTTNPVATEQYGSAVSTNLQRGNS

SEQ ID NO: 2761 - protein, 28 aa, Artificial Sequence
  Description of Artificial Sequence: Synthetic peptide
DEEEIRTTNPVAYEQYWSVSTNLQRGNR

SEQ ID NO: 2762 - protein, 28 aa, Artificial Sequence
  Description of Artificial Sequence: Synthetic peptide
DEEEIRTTNPVATEQYGSVDTNLFRGNR

SEQ ID NO: 2763 - protein, 28 aa, Artificial Sequence
  Description of Artificial Sequence: Synthetic peptide
DEEEIRTTNPVATEQYGSVETNLQEGNR

SEQ ID NO: 2764 - protein, 28 aa, Artificial Sequence
  Description of Artificial Sequence: Synthetic peptide
DEEEIRTTNPVATECYGSVSTNAQRGNR

SEQ ID NO: 2765 - protein, 28 aa, Artificial Sequence
  Description of Artificial Sequence: Synthetic peptide
DEEEIRTTNPVATEQYWSVSTNLQDGNR

SEQ ID NO: 2766 - protein, 28 aa, Artificial Sequence
  Description of Artificial Sequence: Synthetic peptide
DEEEIRTTNPVATEQYGSVSTNLQEGDR

SEQ ID NO: 2767 - protein, 29 aa, Artificial Sequence
  Description of Artificial Sequence: Synthetic peptide
DEEEIRTTNPVATEQYGSVDSTNLQRINR

SEQ ID NO: 2768 - protein, 29 aa, Artificial Sequence
  Description of Artificial Sequence: Synthetic peptide
DEEEIRTTNPVSTEQYGSVSTNLQRDGNR

SEQ ID NO: 2769 - protein, 28 aa, Artificial Sequence
  Description of Artificial Sequence: Synthetic peptide
DEDEIRATNPVATEQYGSVSTNLQRGNR

SEQ ID NO: 2770 - protein, 28 aa, Artificial Sequence
  Description of Artificial Sequence: Synthetic peptide
DEEEIRTTNPVATEQYGSVSTNLLRGNA

SEQ ID NO: 2771 - protein, 28 aa, Artificial Sequence
  Description of Artificial Sequence: Synthetic peptide
DEEEIRTTNPVATFQYGSVSTNLQPGNR

SEQ ID NO: 2772 - protein, 28 aa, Artificial Sequence
  Description of Artificial Sequence: Synthetic peptide
DEEEVRTTNPVASEQYGSVSTNLQRGNR

SEQ ID NO: 2773 - protein, 28 aa, Artificial Sequence
  Description of Artificial Sequence: Synthetic peptide
DEEEITTTNPVATEQYGSVSTDLQRGNR

SEQ ID NO: 2774 - protein, 28 aa, Artificial Sequence
  Description of Artificial Sequence: Synthetic peptide
DEEEIRTTNPVATEQYGSASTNLQRENR

SEQ ID NO: 2775 - protein, 28 aa, Artificial Sequence
  Description of Artificial Sequence: Synthetic peptide
DEEEIRTTNPVAAEQYGSVSTNLQRGPR

SEQ ID NO: 2776 - protein, 29 aa, Artificial Sequence
  Description of Artificial Sequence: Synthetic peptide
DEEEIRTTNPVATEQYGSVSTPLQRGNDR

SEQ ID NO: 2777 - protein, 28 aa, Artificial Sequence
  Description of Artificial Sequence: Synthetic peptide
DEEEVRSTNPVATEQYGSVSTNLQRGNR

SEQ ID NO: 2778 - protein, 28 aa, Artificial Sequence
  Description of Artificial Sequence: Synthetic peptide
DEEEIRTTNPVATEQYGSVSTNLQVGNI

SEQ ID NO: 2779 - protein, 28 aa, Artificial Sequence
  Description of Artificial Sequence: Synthetic peptide
DEEEIRTTNPVATEQYGSVSTGLQRGDR

SEQ ID NO: 2780 - protein, 28 aa, Artificial Sequence
  Description of Artificial Sequence: Synthetic peptide
DEEEIRTTNPAATEQYGSVSTNLQRGNF

SEQ ID NO: 2781 - protein, 28 aa, Artificial Sequence
  Description of Artificial Sequence: Synthetic peptide
DEEEIRTTNPVATEQYGAVSTNLQRGLR

SEQ ID NO: 2782 - protein, 28 aa, Artificial Sequence
  Description of Artificial Sequence: Synthetic peptide
DEEEIATTNPVATEQYGSVSTNLQQGNR

SEQ ID NO: 2783 - protein, 30 aa, Artificial Sequence
  Description of Artificial Sequence: Synthetic polypeptide
DEEEIRTTNPVATEQYGSVSTNLQREGNTR

SEQ ID NO: 2784 - protein, 28 aa, Artificial Sequence
  Description of Artificial Sequence: Synthetic peptide
DEEEIRTTNPVATEQYGSVSTNLELGNR

SEQ ID NO: 2785 - protein, 28 aa, Artificial Sequence
  Description of Artificial Sequence: Synthetic peptide
QEEEIRTTNPVATEQYGSVSTNLQQGNR

SEQ ID NO: 2786 - protein, 28 aa, Artificial Sequence
  Description of Artificial Sequence: Synthetic peptide
DEEEIRTTNPVATELYGSVSTNLQRGNA

SEQ ID NO: 2787 - protein, 28 aa, Artificial Sequence
  Description of Artificial Sequence: Synthetic peptide
DEEEIRTTNPVASEQYGCVSTNLQRGNR

SEQ ID NO: 2788 - protein, 28 aa, Artificial Sequence
  Description of Artificial Sequence: Synthetic peptide
DEEEIRTTNPVATEQYGWVATNLQRGNR

SEQ ID NO: 2789 - protein, 28 aa, Artificial Sequence
  Description of Artificial Sequence: Synthetic peptide
DEEEIRTTNPCAYEQYGSVSTNLQRGNR

SEQ ID NO: 2790 - protein, 30 aa, Artificial Sequence
  Description of Artificial Sequence: Synthetic polypeptide
DEEEIRTTNPVATEQYGSVISTNLQRGINR

SEQ ID NO: 2791 - protein, 28 aa, Artificial Sequence
  Description of Artificial Sequence: Synthetic peptide
DEEEIRTTNPVATEQYGSVSTNLQAGER

SEQ ID NO: 2792 - protein, 28 aa, Artificial Sequence
  Description of Artificial Sequence: Synthetic peptide
DEEEIRTTNPVATESYGSVYTNLQRGNR

SEQ ID NO: 2793 - protein, 28 aa, Artificial Sequence
  Description of Artificial Sequence: Synthetic peptide
DEEEIRTTNPTATEQYGSVSTNLQSGNR

SEQ ID NO: 2794 - protein, 28 aa, Artificial Sequence
  Description of Artificial Sequence: Synthetic peptide
DEEEIRTTNPVATEQYGSVSTNLQPGLR

SEQ ID NO: 2795 - protein, 28 aa, Artificial Sequence
  Description of Artificial Sequence: Synthetic peptide
DEEEIRTTNPVATEQWGWVSTNLQRGNR

SEQ ID NO: 2796 - protein, 28 aa, Artificial Sequence
  Description of Artificial Sequence: Synthetic peptide
DEEEIRTTNPVATCQYGDVSTNLQRGNR

SEQ ID NO: 2797 - protein, 28 aa, Artificial Sequence
  Description of Artificial Sequence: Synthetic peptide
DEEEIRTTNPVATEQYGSVDTNLQRGER

SEQ ID NO: 2798 - protein, 28 aa, Artificial Sequence
  Description of Artificial Sequence: Synthetic peptide
DEEEIRTTNPVATEQYGSVSTNLQLGNQ

SEQ ID NO: 2799 - protein, 29 aa, Artificial Sequence
  Description of Artificial Sequence: Synthetic peptide
DEEEIRTTNPVATEQYGSVSTNLQHEGNR

SEQ ID NO: 2800 - protein, 30 aa, Artificial Sequence
  Description of Artificial Sequence: Synthetic polypeptide
DEEEIRTTNPVATEQYGSVYSTNLQREGNR

SEQ ID NO: 2801 - protein, 28 aa, Artificial Sequence
  Description of Artificial Sequence: Synthetic peptide
DEEEIRTTNPVATEQYGFVSTNLQRMNR

SEQ ID NO: 2802 - protein, 29 aa, Artificial Sequence
  Description of Artificial Sequence: Synthetic peptide
DEEEIRTTNPVATEQYGSVNTNLQRGDNR

SEQ ID NO: 2803 - protein, 30 aa, Artificial Sequence
  Description of Artificial Sequence: Synthetic polypeptide
DEEEIRTTNPVATEQYGSVSITNLQRGDNR

SEQ ID NO: 2804 - protein, 28 aa, Artificial Sequence
  Description of Artificial Sequence: Synthetic peptide
VEEEIRTTNPVATEIYGSVSTNLQRGNR

SEQ ID NO: 2805 - protein, 29 aa, Artificial Sequence
  Description of Artificial Sequence: Synthetic peptide
DEEEIRTTNPVATEQYGSVSELNLQRGNR

SEQ ID NO: 2806 - protein, 28 aa, Artificial Sequence
  Description of Artificial Sequence: Synthetic peptide
DEEEIRTTNPVATEQYGSASTNLQHGNR

SEQ ID NO: 2807 - protein, 29 aa, Artificial Sequence
  Description of Artificial Sequence: Synthetic peptide
DEEEIRTTNPVATEQYGSVSTNLQEHGNR

SEQ ID NO: 2808 - protein, 30 aa, Artificial Sequence
  Description of Artificial Sequence: Synthetic polypeptide
DEEEIRTTNPVATEQYGSVSATNLVQRGNR

SEQ ID NO: 2809 - protein, 28 aa, Artificial Sequence
  Description of Artificial Sequence: Synthetic peptide
DEEEIRTTNPVATEQYGSVETNLQRGLR

SEQ ID NO: 2810 - protein, 28 aa, Artificial Sequence
  Description of Artificial Sequence: Synthetic peptide
DECEIRTTNPVATEQYGSVSTNLFRGNR

SEQ ID NO: 2811 - protein, 29 aa, Artificial Sequence
  Description of Artificial Sequence: Synthetic peptide
DEEEIRTTNPVATEQYGSTSTNLQLRGNR

SEQ ID NO: 2812 - protein, 28 aa, Artificial Sequence
  Description of Artificial Sequence: Synthetic peptide
DEEEIRTTNPEATEQYGSVSTNLTRGNR

SEQ ID NO: 2813 - protein, 28 aa, Artificial Sequence
  Description of Artificial Sequence: Synthetic peptide
DEEEIRGTNPVAWEQYGSVSTNLQRGNR

SEQ ID NO: 2814 - protein, 29 aa, Artificial Sequence
  Description of Artificial Sequence: Synthetic peptide
DEEEIRTTNPVATEQYGKSVSTNLQRGNL

SEQ ID NO: 2815 - protein, 28 aa, Artificial Sequence
  Description of Artificial Sequence: Synthetic peptide
DEEEIRTTNPVATEQYGSVSTNPQRGNT

SEQ ID NO: 2816 - protein, 28 aa, Artificial Sequence
  Description of Artificial Sequence: Synthetic peptide
DEEQIRTTNPVATEQYGSVSTNLQPGNR

SEQ ID NO: 2817 - protein, 28 aa, Artificial Sequence
  Description of Artificial Sequence: Synthetic peptide
DEQEISTTNPVATEQYGSVSTNLQRGNR

SEQ ID NO: 2818 - protein, 28 aa, Artificial Sequence
  Description of Artificial Sequence: Synthetic peptide
DEEEIRTTNPVATEQYGSYSTNLQLGNR

SEQ ID NO: 2819 - protein, 29 aa, Artificial Sequence
  Description of Artificial Sequence: Synthetic peptide
DEEEIRTTNPVATEQYGSVDSTGLQRGNR

SEQ ID NO: 2820 - protein, 28 aa, Artificial Sequence
  Description of Artificial Sequence: Synthetic peptide
DETEIRTTNPSATEQYGSVSTNLQRGNR

SEQ ID NO: 2821 - protein, 28 aa, Artificial Sequence
  Description of Artificial Sequence: Synthetic peptide
DEEEIRQTNPVATEQYGSVSANLQRGNR

SEQ ID NO: 2822 - protein, 30 aa, Artificial Sequence
  Description of Artificial Sequence: Synthetic polypeptide
DEEEIRTTNPVATEQYGSVSTGNLQRGFNR

SEQ ID NO: 2823 - protein, 28 aa, Artificial Sequence
  Description of Artificial Sequence: Synthetic peptide
DEEEIRTTNPVATEQYGSVGSNLQRGNR

SEQ ID NO: 2824 - protein, 28 aa, Artificial Sequence
  Description of Artificial Sequence: Synthetic peptide
DEEEIRTTNPVATEQYGVVSTNLQDGNR

SEQ ID NO: 2825 - protein, 28 aa, Artificial Sequence
  Description of Artificial Sequence: Synthetic peptide
DEEEIRTTNPVATEQYGSVSTNLQRGDD

SEQ ID NO: 2826 - protein, 29 aa, Artificial Sequence
  Description of Artificial Sequence: Synthetic peptide
DEEEIRTTNPVATEQYGSVSTNLQVRGNT

SEQ ID NO: 2827 - protein, 28 aa, Artificial Sequence
  Description of Artificial Sequence: Synthetic peptide
DEEEIRTTNPVSTEIYGSVSTNLQRGNR

SEQ ID NO: 2828 - protein, 28 aa, Artificial Sequence
  Description of Artificial Sequence: Synthetic peptide
DEEEIRQTNPVATEQYGSVSTNLQRGGR

SEQ ID NO: 2829 - protein, 29 aa, Artificial Sequence
  Description of Artificial Sequence: Synthetic peptide
DEEEIRTTNPVATEQYGSVSTNLQREGER

SEQ ID NO: 2830 - protein, 29 aa, Artificial Sequence
  Description of Artificial Sequence: Synthetic peptide
DEEEIRTTNPVATEQYGSVSITNLQRGNS

SEQ ID NO: 2831 - protein, 29 aa, Artificial Sequence
  Description of Artificial Sequence: Synthetic peptide
DEEEIRTTNPVATEQYGSVSTNPLQRPNR

SEQ ID NO: 2832 - protein, 29 aa, Artificial Sequence
  Description of Artificial Sequence: Synthetic peptide
DEEEIRTTNPVATEQYGSVSTNLQEEGNR

SEQ ID NO: 2833 - protein, 28 aa, Artificial Sequence
  Description of Artificial Sequence: Synthetic peptide
DEEEIRTTNPVAYEQYGSVSTNLERGNR

SEQ ID NO: 2834 - protein, 29 aa, Artificial Sequence
  Description of Artificial Sequence: Synthetic peptide
DEQEIRTTNPVATEQYGSVSETNLQRGNR

SEQ ID NO: 2835 - protein, 28 aa, Artificial Sequence
  Description of Artificial Sequence: Synthetic peptide
DEEELRTTNPCATEQYGSVSTNLQRGNR

SEQ ID NO: 2836 - protein, 28 aa, Artificial Sequence
  Description of Artificial Sequence: Synthetic peptide
DEEEIRTTNPVATEQYGTVSTNLQRGNC

SEQ ID NO: 2837 - protein, 28 aa, Artificial Sequence
  Description of Artificial Sequence: Synthetic peptide
DEEEIRTTNPVATEQYGSVEENLQRGNR

SEQ ID NO: 2838 - protein, 28 aa, Artificial Sequence
  Description of Artificial Sequence: Synthetic peptide
DEEEIRTTNPVATEQYGSVSTDLQRGER

SEQ ID NO: 2839 - protein, 28 aa, Artificial Sequence
  Description of Artificial Sequence: Synthetic peptide
DEEEIYTTNPVATEQYGSVSTNLQRGNF

SEQ ID NO: 2840 - protein, 28 aa, Artificial Sequence
  Description of Artificial Sequence: Synthetic peptide
DETEIRTTNPVATEQYGSVSTNLQRGND

SEQ ID NO: 2841 - protein, 29 aa, Artificial Sequence
  Description of Artificial Sequence: Synthetic peptide
DEEEIRTTNPVATEQYGSVSTNGLQRGNF

SEQ ID NO: 2842 - protein, 28 aa, Artificial Sequence
  Description of Artificial Sequence: Synthetic peptide
DEEEIRTTNSVATEQYGSVSTNLQRGNE

SEQ ID NO: 2843 - protein, 28 aa, Artificial Sequence
  Description of Artificial Sequence: Synthetic peptide
DENEIRTTNPVATEQYGWVSTNLQRGNR

SEQ ID NO: 2844 - protein, 29 aa, Artificial Sequence
  Description of Artificial Sequence: Synthetic peptide
DEEEIRTTNPVATEQYGSVSTNLPQRGNV

SEQ ID NO: 2845 - protein, 28 aa, Artificial Sequence
  Description of Artificial Sequence: Synthetic peptide
DEEEIRPTNPVATEQYGVVSTNLQRGNR

SEQ ID NO: 2846 - protein, 29 aa, Artificial Sequence
  Description of Artificial Sequence: Synthetic peptide
DEEEIRTTNPVATEQFGSVSTNLQRGNTR

SEQ ID NO: 2847 - protein, 28 aa, Artificial Sequence
  Description of Artificial Sequence: Synthetic peptide
DEEEIRTTNPVATEQYGTVSTNLQRGNT

SEQ ID NO: 2848 - protein, 29 aa, Artificial Sequence
  Description of Artificial Sequence: Synthetic peptide
DEEEIRTTNPVATEQYGSVSTNLQERGNM

SEQ ID NO: 2849 - protein, 28 aa, Artificial Sequence
  Description of Artificial Sequence: Synthetic peptide
DEEEIRTTNPVATEQYGSVSTNLQNGNY

SEQ ID NO: 2850 - protein, 28 aa, Artificial Sequence
  Description of Artificial Sequence: Synthetic peptide
DEEEIRTTNPVATEQYGSVSTNGTRGNR

SEQ ID NO: 2851 - protein, 29 aa, Artificial Sequence
  Description of Artificial Sequence: Synthetic peptide
DEEEIRTTNPVATEQYGSVSTNLQQKGNR

SEQ ID NO: 2852 - protein, 28 aa, Artificial Sequence
  Description of Artificial Sequence: Synthetic peptide
NEEEIRTTNPVATEQYGSVSTNLQRGNH

SEQ ID NO: 2853 - protein, 30 aa, Artificial Sequence
  Description of Artificial Sequence: Synthetic polypeptide
DEEEIRTTNPVATEQYGSVSTNLQDRGNTR

SEQ ID NO: 2854 - protein, 29 aa, Artificial Sequence
  Description of Artificial Sequence: Synthetic peptide
DEEEIRTTNPVATEQYGSVDTNLQRDGNR

SEQ ID NO: 2855 - protein, 28 aa, Artificial Sequence
  Description of Artificial Sequence: Synthetic peptide
DEQEIRTTNPVATEQYGSVSTNLQSGNR

SEQ ID NO: 2856 - protein, 28 aa, Artificial Sequence
  Description of Artificial Sequence: Synthetic peptide
DEEEIATTNPVATEQYGSVSTNLQRGND

SEQ ID NO: 2857 - protein, 29 aa, Artificial Sequence
  Description of Artificial Sequence: Synthetic peptide
DEEEIRTTNPVASEQYGSVSTNLQRNGNR

SEQ ID NO: 2858 - protein, 28 aa, Artificial Sequence
  Description of Artificial Sequence: Synthetic peptide
QEEEIRTTNPVATEQYGSVSTNLERGNR

SEQ ID NO: 2859 - protein, 28 aa, Artificial Sequence
  Description of Artificial Sequence: Synthetic peptide
DEEEIRTTNPVAFEQYGSVSTNLQRENR

SEQ ID NO: 2860 - protein, 28 aa, Artificial Sequence
  Description of Artificial Sequence: Synthetic peptide
DEEEIRGTNPVATEQYGSVSTNLQRGQR

SEQ ID NO: 2861 - protein, 28 aa, Artificial Sequence
  Description of Artificial Sequence: Synthetic peptide
DEEEIRTTNPVATEQYGDVSTCLQRGNR

SEQ ID NO: 2862 - protein, 28 aa, Artificial Sequence
  Description of Artificial Sequence: Synthetic peptide
DEEEIATTNPVATEQYGEVSTNLQRGNR

SEQ ID NO: 2863 - protein, 28 aa, Artificial Sequence
  Description of Artificial Sequence: Synthetic peptide
QEEEIRTTNPVATEQYGSVSTQLQRGNR

SEQ ID NO: 2864 - protein, 28 aa, Artificial Sequence
  Description of Artificial Sequence: Synthetic peptide
DEEEIRTTNPVATEQYGSVSTNLDPGNR

SEQ ID NO: 2865 - protein, 29 aa, Artificial Sequence
  Description of Artificial Sequence: Synthetic peptide
DEEEIRTTNPVATEQYGSVSTNLQGEGNR

SEQ ID NO: 2866 - protein, 29 aa, Artificial Sequence
  Description of Artificial Sequence: Synthetic peptide
DEEEIRSTNPVATEQYGSVSWTNLQRGNR

SEQ ID NO: 2867 - protein, 30 aa, Artificial Sequence
  Description of Artificial Sequence: Synthetic polypeptide
DEEEIRTTNPVATEQYGSVDSTGNLQRGNR

SEQ ID NO: 2868 - protein, 30 aa, Artificial Sequence
  Description of Artificial Sequence: Synthetic polypeptide
DEEEIRTTNPVATEQYGMSVSTNLVQRGNR

SEQ ID NO: 2869 - protein, 28 aa, Artificial Sequence
  Description of Artificial Sequence: Synthetic peptide
DEEEIRTTNPVATEQYGSVSTNLMRGNF

SEQ ID NO: 2870 - protein, 28 aa, Artificial Sequence
  Description of Artificial Sequence: Synthetic peptide
DEEEIRTTNPVATEQYGSVSTNLMRGPR

SEQ ID NO: 2871 - protein, 29 aa, Artificial Sequence
  Description of Artificial Sequence: Synthetic peptide
DEEEIRTTNPVATEQYGSVSTGALQRGNR

SEQ ID NO: 2872 - protein, 29 aa, Artificial Sequence
  Description of Artificial Sequence: Synthetic peptide
DEEEIRTTNPHATEQYGSVSITNLQRGNR

SEQ ID NO: 2873 - protein, 29 aa, Artificial Sequence
  Description of Artificial Sequence: Synthetic peptide
DEEEIRTTNPVATEQYGSVSTNLVDRGNR

SEQ ID NO: 2874 - protein, 28 aa, Artificial Sequence
  Description of Artificial Sequence: Synthetic peptide
DEEEIRTTNPVATEQWGSVSTNLQRGNW

SEQ ID NO: 2875 - protein, 29 aa, Artificial Sequence
  Description of Artificial Sequence: Synthetic peptide
DEEEIRTTNPVATEQYGSVSTNLEDRGNR

SEQ ID NO: 2876 - protein, 28 aa, Artificial Sequence
  Description of Artificial Sequence: Synthetic peptide
DEEEIRTTNPVATEQYGSVSTNLQRDNE

SEQ ID NO: 2877 - protein, 28 aa, Artificial Sequence
  Description of Artificial Sequence: Synthetic peptide
DEEEIRTTNPVATEQWGSVSTNLYRGNR

SEQ ID NO: 2878 - protein, 28 aa, Artificial Sequence
  Description of Artificial Sequence: Synthetic peptide
DEEEIRTTNPVATEQYGSVSTNLQDGER

SEQ ID NO: 2879 - protein, 28 aa, Artificial Sequence
  Description of Artificial Sequence: Synthetic peptide
DEEEIRTTNPVATEQYGSVSTNLQRGSD

SEQ ID NO: 2880 - protein, 29 aa, Artificial Sequence
  Description of Artificial Sequence: Synthetic peptide
DEEEIRTTNPVATECYGSVSTNLQRGDNR

SEQ ID NO: 2881 - protein, 28 aa, Artificial Sequence
  Description of Artificial Sequence: Synthetic peptide
DEEEIRTTNPVATEQYGSVSTCLCRGNR

SEQ ID NO: 2882 - protein, 28 aa, Artificial Sequence
  Description of Artificial Sequence: Synthetic peptide
DEEEIWTTNPVATEQYGDVSTNLQRGNR

SEQ ID NO: 2883 - protein, 29 aa, Artificial Sequence
  Description of Artificial Sequence: Synthetic peptide
DEEEIRTTNPVATEQYGSVSTNLQRGNDT

SEQ ID NO: 2884 - protein, 29 aa, Artificial Sequence
  Description of Artificial Sequence: Synthetic peptide
DEEEIATTNPVATEQYGSVSTMNLQRGNR

SEQ ID NO: 2885 - protein, 28 aa, Artificial Sequence
  Description of Artificial Sequence: Synthetic peptide
DEEEIRTTNPVATEQWGSYSTNLQRGNR

SEQ ID NO: 2886 - protein, 29 aa, Artificial Sequence
  Description of Artificial Sequence: Synthetic peptide
SEEEIRTTNPVATEQYGSVSTNLNQRGNR

SEQ ID NO: 2887 - protein, 28 aa, Artificial Sequence
  Description of Artificial Sequence: Synthetic peptide
SENEIRTTNPVATEQYGSVSTNLQRGNR

SEQ ID NO: 2888 - protein, 28 aa, Artificial Sequence
  Description of Artificial Sequence: Synthetic peptide
DEEELHTTNPVATEQYGSVSTNLQRGNR

SEQ ID NO: 2889 - protein, 29 aa, Artificial Sequence
  Description of Artificial Sequence: Synthetic peptide
DEEEIRTTNPVATEQYGSVSTALQRGINR

SEQ ID NO: 2890 - protein, 28 aa, Artificial Sequence
  Description of Artificial Sequence: Synthetic peptide
DEEEIRTTNGVATEQYGSVSTNLQRGNQ

SEQ ID NO: 2891 - protein, 29 aa, Artificial Sequence
  Description of Artificial Sequence: Synthetic peptide
DEEEIRTTNPVATEQYGSVSTMNLQRGNM

SEQ ID NO: 2892 - protein, 28 aa, Artificial Sequence
  Description of Artificial Sequence: Synthetic peptide
DEEEIRCTNPVATEQYGSVSTNLQSGNR

SEQ ID NO: 2893 - protein, 28 aa, Artificial Sequence
  Description of Artificial Sequence: Synthetic peptide
DETEITTTNPVATEQYGSVSTNLQRGNR

SEQ ID NO: 2894 - protein, 28 aa, Artificial Sequence
  Description of Artificial Sequence: Synthetic peptide
DEEEIRTTNPVATEQYGSVSTNLQYGDR

SEQ ID NO: 2895 - protein, 28 aa, Artificial Sequence
  Description of Artificial Sequence: Synthetic peptide
DEEEIRATNPVATEQYGSVNTNLQRGNR

SEQ ID NO: 2896 - protein, 28 aa, Artificial Sequence
  Description of Artificial Sequence: Synthetic peptide
DEEEIRTTNPVATEQYGEVSTNPQRGNR

SEQ ID NO: 2897 - protein, 29 aa, Artificial Sequence
  Description of Artificial Sequence: Synthetic peptide
DEEEIRTTNPVATEQYWSYVSTNLQRGNR

SEQ ID NO: 2898 - protein, 28 aa, Artificial Sequence
  Description of Artificial Sequence: Synthetic peptide
DEEEIRTVNPVATEQYGSVSTNLQRENR

SEQ ID NO: 2899 - protein, 28 aa, Artificial Sequence
  Description of Artificial Sequence: Synthetic peptide
DEEEIRTTNPVATEQYGSVSTNLQTGER

SEQ ID NO: 2900 - protein, 29 aa, Artificial Sequence
  Description of Artificial Sequence: Synthetic peptide
DEEEIRTTNPVATEQYGSVSTNLLRGFNR

SEQ ID NO: 2901 - protein, 29 aa, Artificial Sequence
  Description of Artificial Sequence: Synthetic peptide
DEEEIRTTNPVATEQYGSVSTNLQIVGNR

SEQ ID NO: 2902 - protein, 30 aa, Artificial Sequence
  Description of Artificial Sequence: Synthetic polypeptide
DEEEIRTTNPVATEQYGSVDSATNLQRGNR

SEQ ID NO: 2903 - protein, 28 aa, Artificial Sequence
  Description of Artificial Sequence: Synthetic peptide
DEEEIRTVNPVATEQYGSVSNNLQRGNR

SEQ ID NO: 2904 - protein, 30 aa, Artificial Sequence
  Description of Artificial Sequence: Synthetic polypeptide
DEEEIRTTNPVATEQYGSVISTNLQRGNFR

SEQ ID NO: 2905 - protein, 28 aa, Artificial Sequence
  Description of Artificial Sequence: Synthetic peptide
AEEEIRTTNPVATEQYGSVSMNLQRGNR

SEQ ID NO: 2906 - protein, 28 aa, Artificial Sequence
  Description of Artificial Sequence: Synthetic peptide
AEEEIRTTNPVATEQYGSVSTNLQRGGR

SEQ ID NO: 2907 - protein, 29 aa, Artificial Sequence
  Description of Artificial Sequence: Synthetic peptide
DEEEIRTTNPVATEQYGSVSTNLQRGNWL

SEQ ID NO: 2908 - protein, 28 aa, Artificial Sequence
  Description of Artificial Sequence: Synthetic peptide
DEEEIRTTNPVATEQYGSVSTPLQRGNP

SEQ ID NO: 2909 - protein, 29 aa, Artificial Sequence
  Description of Artificial Sequence: Synthetic peptide
DEEEIRTTNPVAGEQYGSVSITNLQRGNR

SEQ ID NO: 2910 - protein, 28 aa, Artificial Sequence
  Description of Artificial Sequence: Synthetic peptide
DEEEIRTTNPVATEQYGSVSANLQRGNF

SEQ ID NO: 2911 - protein, 28 aa, Artificial Sequence
  Description of Artificial Sequence: Synthetic peptide
DEEEIRTTNPAATEQYGSVSTALQRGNR

SEQ ID NO: 2912 - protein, 28 aa, Artificial Sequence
  Description of Artificial Sequence: Synthetic peptide
DEEEIRTTNPDATEYYGSVSTNLQRGNR

SEQ ID NO: 2913 - protein, 29 aa, Artificial Sequence
  Description of Artificial Sequence: Synthetic peptide
DEEEIRTTNPVATEQYGSVSTNNLQHGNR

SEQ ID NO: 2914 - protein, 29 aa, Artificial Sequence
  Description of Artificial Sequence: Synthetic peptide
DEHEIRTTNPVATEQYGSVSTNLQRGNDR

SEQ ID NO: 2915 - protein, 29 aa, Artificial Sequence
  Description of Artificial Sequence: Synthetic peptide
DEEEIRTTNPVATEQYGCVSATNLQRGNR

SEQ ID NO: 2916 - protein, 29 aa, Artificial Sequence
  Description of Artificial Sequence: Synthetic peptide
DEEEIRTTNPVATEQYGSVSTGLQRTGNR

SEQ ID NO: 2917 - protein, 30 aa, Artificial Sequence
  Description of Artificial Sequence: Synthetic polypeptide
DEEEIRTTNPVATEQYGSVGSTNLTQRGNR

SEQ ID NO: 2918 - protein, 28 aa, Artificial Sequence
  Description of Artificial Sequence: Synthetic peptide
DEQEIRTTNPVATEQYGSVSTNLQRGNW

SEQ ID NO: 2919 - protein, 28 aa, Artificial Sequence
  Description of Artificial Sequence: Synthetic peptide
DEEEIRTTNPVATEQYGSVSTNLERENR

SEQ ID NO: 2920 - protein, 28 aa, Artificial Sequence
  Description of Artificial Sequence: Synthetic peptide
DEEEIHTTNPVATEQYGSVSLNLQRGNR

SEQ ID NO: 2921 - protein, 29 aa, Artificial Sequence
  Description of Artificial Sequence: Synthetic peptide
DEEELRTTNPVATEQYGSVSTNLQQRGNR

SEQ ID NO: 2922 - protein, 28 aa, Artificial Sequence
  Description of Artificial Sequence: Synthetic peptide
DEEEIRTTNPVATEQYGNVSMNLQRGNR

SEQ ID NO: 2923 - protein, 30 aa, Artificial Sequence
  Description of Artificial Sequence: Synthetic polypeptide
DEEEIRTTNPVATEQYGSVSTENLQRNGNR

SEQ ID NO: 2924 - protein, 28 aa, Artificial Sequence
  Description of Artificial Sequence: Synthetic peptide
DEEEIRTTNPVATEQYGSVSTNLQNGNT

SEQ ID NO: 2925 - protein, 28 aa, Artificial Sequence
  Description of Artificial Sequence: Synthetic peptide
SEEEIRTTNPVATECYGSVSTNLQRGNR

SEQ ID NO: 2926 - protein, 28 aa, Artificial Sequence
  Description of Artificial Sequence: Synthetic peptide
DEEEIRTTNPEATEQYGSVSENLQRGNR

SEQ ID NO: 2927 - protein, 28 aa, Artificial Sequence
  Description of Artificial Sequence: Synthetic peptide
DEEEIRTTNPVATEVYGSVSTDLQRGNR

SEQ ID NO: 2928 - protein, 28 aa, Artificial Sequence
  Description of Artificial Sequence: Synthetic peptide
DEEEIHTTNPVATEQYGDVSTNLQRGNR

SEQ ID NO: 2929 - protein, 28 aa, Artificial Sequence
  Description of Artificial Sequence: Synthetic peptide
DEEEIATTNPVCTEQYGSVSTNLQRGNR

SEQ ID NO: 2930 - protein, 28 aa, Artificial Sequence
  Description of Artificial Sequence: Synthetic peptide
GEEEIRTTNPVATEQYGWVSTNLQRGNR

SEQ ID NO: 2931 - protein, 29 aa, Artificial Sequence
  Description of Artificial Sequence: Synthetic peptide
DEEEIRTTNPVATEQYGSVSTNNLQRGND

SEQ ID NO: 2932 - protein, 28 aa, Artificial Sequence
  Description of Artificial Sequence: Synthetic peptide
DEEEIRTTNPVATECYGSVSTNLQRGNC

SEQ ID NO: 2933 - protein, 29 aa, Artificial Sequence
  Description of Artificial Sequence: Synthetic peptide
DEEEIRTTNPVATEQYGSVSTNNLQRGNG

SEQ ID NO: 2934 - protein, 28 aa, Artificial Sequence
  Description of Artificial Sequence: Synthetic peptide
DEEEIRTVNPVATEQYGSVSTNLQRGNL

SEQ ID NO: 2935 - protein, 29 aa, Artificial Sequence
  Description of Artificial Sequence: Synthetic peptide
DEEEIRTTNPVATEQYGSVSTNLERGNDR

SEQ ID NO: 2936 - protein, 28 aa, Artificial Sequence
  Description of Artificial Sequence: Synthetic peptide
DEEEIRTTNPVATEPCGSVSTNLQRGNR

SEQ ID NO: 2937 - protein, 28 aa, Artificial Sequence
  Description of Artificial Sequence: Synthetic peptide
DEEEIRTTNPVATEIYGSVSTNLQPGNR

SEQ ID NO: 2938 - protein, 29 aa, Artificial Sequence
  Description of Artificial Sequence: Synthetic peptide
DEEEIRTTNPVATEQYGSVSTNLQRGDER

SEQ ID NO: 2939 - protein, 28 aa, Artificial Sequence
  Description of Artificial Sequence: Synthetic peptide
DEEEIRTTNPVATECYGSVPTNLQRGNR

SEQ ID NO: 2940 - protein, 28 aa, Artificial Sequence
  Description of Artificial Sequence: Synthetic peptide
DEEEIATTNPVATEQYGSVITNLQRGNR

SEQ ID NO: 2941 - protein, 29 aa, Artificial Sequence
  Description of Artificial Sequence: Synthetic peptide
DEEEIRTTNPVATEQYGSVSTALQYRGNR

SEQ ID NO: 2942 - protein, 30 aa, Artificial Sequence
  Description of Artificial Sequence: Synthetic polypeptide
DEEEIRTTNPVATEQYGSVSITNLQRYGNR

SEQ ID NO: 2943 - protein, 28 aa, Artificial Sequence
  Description of Artificial Sequence: Synthetic peptide
LEEEIRTTNPVATEQYGSVSENLQRGNR

SEQ ID NO: 2944 - protein, 30 aa, Artificial Sequence
  Description of Artificial Sequence: Synthetic polypeptide
DEEEIRTTNPVATEQYGSVSTLNLQERGNR

SEQ ID NO: 2945 - protein, 28 aa, Artificial Sequence
  Description of Artificial Sequence: Synthetic peptide
DEEEICTTNPVATEQYGSVSTNLFRGNR

SEQ ID NO: 2946 - protein, 28 aa, Artificial Sequence
  Description of Artificial Sequence: Synthetic peptide
DEEEIVTTNPVATEQYGSVSTNLWRGNR

SEQ ID NO: 2947 - protein, 28 aa, Artificial Sequence
  Description of Artificial Sequence: Synthetic peptide
DEEEIRTTNPVATELYGSVSANLQRGNR

SEQ ID NO: 2948 - protein, 29 aa, Artificial Sequence
  Description of Artificial Sequence: Synthetic peptide
DEEEIRTTNPVATEQYGSVSDTNLQRGNI

SEQ ID NO: 2949 - protein, 29 aa, Artificial Sequence
  Description of Artificial Sequence: Synthetic peptide
DEEEIRTTNPVATEQYGSVSTNLQSDGNR

SEQ ID NO: 2950 - protein, 28 aa, Artificial Sequence
  Description of Artificial Sequence: Synthetic peptide
DEDEIRTTNPVATEMYGSVSTNLQRGNR

SEQ ID NO: 2951 - protein, 29 aa, Artificial Sequence
  Description of Artificial Sequence: Synthetic peptide
DEEEIRTTNPVATEQYGSVSTNPLQRGNP

SEQ ID NO: 2952 - protein, 28 aa, Artificial Sequence
  Description of Artificial Sequence: Synthetic peptide
DEFEICTTNPVATEQYGSVSTNLQRGNR

SEQ ID NO: 2953 - protein, 30 aa, Artificial Sequence
  Description of Artificial Sequence: Synthetic polypeptide
DEEEIRTTNPVATEQYGSVSTMNLQREGNR

SEQ ID NO: 2954 - protein, 28 aa, Artificial Sequence
  Description of Artificial Sequence: Synthetic peptide
DEEEIRTTNPFATEQYGSVSTNLLRGNR

SEQ ID NO: 2955 - protein, 29 aa, Artificial Sequence
  Description of Artificial Sequence: Synthetic peptide
DEEEIRTTNPVATEIYGSVSTNLQREGNR

SEQ ID NO: 2956 - protein, 28 aa, Artificial Sequence
  Description of Artificial Sequence: Synthetic peptide
DEEEIRTTNPAATEQYGSVSVNLQRGNR

SEQ ID NO: 2957 - protein, 28 aa, Artificial Sequence
  Description of Artificial Sequence: Synthetic peptide
DEEEIRTTNPVATEQYGSVSTNLNRGNG

SEQ ID NO: 2958 - protein, 28 aa, Artificial Sequence
  Description of Artificial Sequence: Synthetic peptide
DEQEIRTTNPVATEIYGSVSTNLQRGNR

SEQ ID NO: 2959 - protein, 28 aa, Artificial Sequence
  Description of Artificial Sequence: Synthetic peptide
DEEEIRCTNPVATEQYGSVGTNLQRGNR

SEQ ID NO: 2960 - protein, 28 aa, Artificial Sequence
  Description of Artificial Sequence: Synthetic peptide
DEEEIRTTNPVATEVYGSVSTNLQRVNR

SEQ ID NO: 2961 - protein, 28 aa, Artificial Sequence
  Description of Artificial Sequence: Synthetic peptide
DEEEIRATNPVATEQYGSVSTNLQIGNR

SEQ ID NO: 2962 - protein, 28 aa, Artificial Sequence
  Description of Artificial Sequence: Synthetic peptide
DEEEIRTTNPVATEQYGSWSTNLQRGNL

SEQ ID NO: 2963 - protein, 28 aa, Artificial Sequence
  Description of Artificial Sequence: Synthetic peptide
DEEEIRTTNPVATEQYGSVSTNLERGNH

SEQ ID NO: 2964 - protein, 29 aa, Artificial Sequence
  Description of Artificial Sequence: Synthetic peptide
DEEEIRTTNPVATEQYGSVHTNLQRDGNR

SEQ ID NO: 2965 - protein, 28 aa, Artificial Sequence
  Description of Artificial Sequence: Synthetic peptide
DEEEIRTTNPDATEQYGSVSTNLQGGNR

SEQ ID NO: 2966 - protein, 28 aa, Artificial Sequence
  Description of Artificial Sequence: Synthetic peptide
DEEEIRTTNPVATEQYGSYSTNLQQGNR

SEQ ID NO: 2967 - protein, 30 aa, Artificial Sequence
  Description of Artificial Sequence: Synthetic polypeptide
DEEEIRTTNPVATEQYGSVSTNLPQDRGNR

SEQ ID NO: 2968 - protein, 28 aa, Artificial Sequence
  Description of Artificial Sequence: Synthetic peptide
DEEEIRCTNPVACEQYGSVSTNLQRGNR

SEQ ID NO: 2969 - protein, 28 aa, Artificial Sequence
  Description of Artificial Sequence: Synthetic peptide
YEEEIRTTNPVATEQYGSVSTNLQRGTR

SEQ ID NO: 2970 - protein, 28 aa, Artificial Sequence
  Description of Artificial Sequence: Synthetic peptide
DEEEIRTTNPVATEQYGSVSTNLQPGNT

SEQ ID NO: 2971 - protein, 28 aa, Artificial Sequence
  Description of Artificial Sequence: Synthetic peptide
KEEEIRTTNPVATEQYGSVSTNLQRGER

SEQ ID NO: 2972 - protein, 28 aa, Artificial Sequence
  Description of Artificial Sequence: Synthetic peptide
DEEEIRTVNPVATEQYGSVSTNLQFGNR

SEQ ID NO: 2973 - protein, 28 aa, Artificial Sequence
  Description of Artificial Sequence: Synthetic peptide
QEEEIRTTNPVATEQYGEVSTNLQRGNR

SEQ ID NO: 2974 - protein, 28 aa, Artificial Sequence
  Description of Artificial Sequence: Synthetic peptide
DEMEIRTTNPVATEQYGSVSTNTQRGNR

SEQ ID NO: 2975 - protein, 28 aa, Artificial Sequence
  Description of Artificial Sequence: Synthetic peptide
DEEEIRTTNPVATEQYGSVETNLQAGNR

SEQ ID NO: 2976 - protein, 28 aa, Artificial Sequence
  Description of Artificial Sequence: Synthetic peptide
DEEEIITTNPVATEQYGDVSTNLQRGNR

SEQ ID NO: 2977 - protein, 28 aa, Artificial Sequence
  Description of Artificial Sequence: Synthetic peptide
DEEEIRTTNPVATEQYGSVSTNLQRGDL

SEQ ID NO: 2978 - protein, 28 aa, Artificial Sequence
  Description of Artificial Sequence: Synthetic peptide
DEEEIRTTNPVATEQYGSVSTGLQRGNP

SEQ ID NO: 2979 - protein, 28 aa, Artificial Sequence
  Description of Artificial Sequence: Synthetic peptide
DEEEIRATNPVATEIYGSVSTNLQRGNR

SEQ ID NO: 2980 - protein, 29 aa, Artificial Sequence
  Description of Artificial Sequence: Synthetic peptide
QEEEIRTTNPVATEQYGSVSTNLQRNGNR

SEQ ID NO: 2981 - protein, 29 aa, Artificial Sequence
  Description of Artificial Sequence: Synthetic peptide
HEEEIRTTNPVATEQYGSVSTNLQLRGNR

SEQ ID NO: 2982 - protein, 29 aa, Artificial Sequence
  Description of Artificial Sequence: Synthetic peptide
DEEEIRTTNPVATEQYGSVSTNPQLRGNR

SEQ ID NO: 2983 - protein, 28 aa, Artificial Sequence
  Description of Artificial Sequence: Synthetic peptide
DEEEIRTTNIVATEQYGSVSTNLQSGNR

SEQ ID NO: 2984 - protein, 28 aa, Artificial Sequence
  Description of Artificial Sequence: Synthetic peptide
DEEEIRTTNPVATEQYGSVSTNGARGNR

SEQ ID NO: 2985 - protein, 28 aa, Artificial Sequence
  Description of Artificial Sequence: Synthetic peptide
DEEEVRATNPVATEQYGSVSTNLQRGNR

SEQ ID NO: 2986 - protein, 28 aa, Artificial Sequence
  Description of Artificial Sequence: Synthetic peptide
DEEEINTTNPVATEQYGSVSTNLQRGNL

SEQ ID NO: 2987 - protein, 29 aa, Artificial Sequence
  Description of Artificial Sequence: Synthetic peptide
DEEEIRTTNPVATEQYGSVSTNLQCSGNR

SEQ ID NO: 2988 - protein, 28 aa, Artificial Sequence
  Description of Artificial Sequence: Synthetic peptide
DEEEIRTTNPVATEQYGSVIYNLQRGNR

SEQ ID NO: 2989 - protein, 28 aa, Artificial Sequence
  Description of Artificial Sequence: Synthetic peptide
DNEEIRTTNPVATEQYGSVSTNLQPGNR

SEQ ID NO: 2990 - protein, 29 aa, Artificial Sequence
  Description of Artificial Sequence: Synthetic peptide
DEEEIRTTNPVATEQYGSVSTTNLQRGND

SEQ ID NO: 2991 - protein, 28 aa, Artificial Sequence
  Description of Artificial Sequence: Synthetic peptide
DEEEIRTTNIVATEQYGSVSTNLQGGNR

SEQ ID NO: 2992 - protein, 29 aa, Artificial Sequence
  Description of Artificial Sequence: Synthetic peptide
DEEEIRTTNPVATEQYGSQFSTNLQRGNR

SEQ ID NO: 2993 - protein, 28 aa, Artificial Sequence
  Description of Artificial Sequence: Synthetic peptide
DEEEIRTTNPVATEQYGSVSTNLQRGGF

SEQ ID NO: 2994 - protein, 28 aa, Artificial Sequence
  Description of Artificial Sequence: Synthetic peptide
DEEEIRTTNPVATEQYGSVDTNLQYGNR

SEQ ID NO: 2995 - protein, 28 aa, Artificial Sequence
  Description of Artificial Sequence: Synthetic peptide
DEEEIRTTNPCATEQYGSASTNLQRGNR

SEQ ID NO: 2996 - protein, 28 aa, Artificial Sequence
  Description of Artificial Sequence: Synthetic peptide
DEEEIRTTNPVATEQYGSVSTNTQRGER

SEQ ID NO: 2997 - protein, 28 aa, Artificial Sequence
  Description of Artificial Sequence: Synthetic peptide
DEEEIRTTNPTATEQYGSVSTNLQRGNK

SEQ ID NO: 2998 - protein, 28 aa, Artificial Sequence
  Description of Artificial Sequence: Synthetic peptide
DEEEIRTTNPVATEQYGSVSENLQNGNR

SEQ ID NO: 2999 - protein, 29 aa, Artificial Sequence
  Description of Artificial Sequence: Synthetic peptide
DEEEIRTTNPVATEQYGSVSGNLQTRGNR

SEQ ID NO: 3000 - protein, 28 aa, Artificial Sequence
  Description of Artificial Sequence: Synthetic peptide
DEEEIRTTNIVATEQYGSVSTNLQRGNI

SEQ ID NO: 3001 - protein, 28 aa, Artificial Sequence
  Description of Artificial Sequence: Synthetic peptide
DEEEIRTTNPDATEQYGFVSTNLQRGNR

SEQ ID NO: 3002 - protein, 30 aa, Artificial Sequence
  Description of Artificial Sequence: Synthetic polypeptide
DEEEIRTTNPVATEQYGSVSTNLQRGFNSR

SEQ ID NO: 3003 - protein, 28 aa, Artificial Sequence
  Description of Artificial Sequence: Synthetic peptide
DEEEIRTTNIVATEQYGSVSTNLQAGNR

SEQ ID NO: 3004 - protein, 28 aa, Artificial Sequence
  Description of Artificial Sequence: Synthetic peptide
DEEEIRTTNPVATEQYGSVSTNLQRGDA

SEQ ID NO: 3005 - protein, 28 aa, Artificial Sequence
  Description of Artificial Sequence: Synthetic peptide
DPEEIRTTNPVATEQYGSVSTNLQRGNI

SEQ ID NO: 3006 - protein, 28 aa, Artificial Sequence
  Description of Artificial Sequence: Synthetic peptide
DEEEIRTTNIVATEQYGSVSTNLQEGNR

SEQ ID NO: 3007 - protein, 28 aa, Artificial Sequence
  Description of Artificial Sequence: Synthetic peptide
DEEEIRSTNPVATECYGSVSTNLQRGNR

SEQ ID NO: 3008 - protein, 29 aa, Artificial Sequence
  Description of Artificial Sequence: Synthetic peptide
DEEEIRTTNPVATETYGSVSTNLQRGNTR

SEQ ID NO: 3009 - protein, 28 aa, Artificial Sequence
  Description of Artificial Sequence: Synthetic peptide
DEEEIRTTNPVATEQYGSVSTNLQPGNQ

SEQ ID NO: 3010 - protein, 28 aa, Artificial Sequence
  Description of Artificial Sequence: Synthetic peptide
DEQEIRTTNPVATEQYGSVSTNLQNGNR

SEQ ID NO: 3011 - protein, 30 aa, Artificial Sequence
  Description of Artificial Sequence: Synthetic polypeptide
DEEEIRTTNPVATEQYGSYVSTNLQRGNYR

SEQ ID NO: 3012 - protein, 28 aa, Artificial Sequence
  Description of Artificial Sequence: Synthetic peptide
DEEEIRTTNPVATMQYGSVSTNLQYGNR

SEQ ID NO: 3013 - protein, 28 aa, Artificial Sequence
  Description of Artificial Sequence: Synthetic peptide
DEEEIRTTNPVATEQYGSVSTELQIGNR

SEQ ID NO: 3014 - protein, 29 aa, Artificial Sequence
  Description of Artificial Sequence: Synthetic peptide
DEEEIRTTNPIATEQYGSVSTNLQREGNR

SEQ ID NO: 3015 - protein, 29 aa, Artificial Sequence
  Description of Artificial Sequence: Synthetic peptide
DEEEIRTTNPVATEQWGSVSTNLQWRGNR

SEQ ID NO: 3016 - protein, 28 aa, Artificial Sequence
  Description of Artificial Sequence: Synthetic peptide
DDEEIRTTNPVATEQYGSVSTNLQRLNR

SEQ ID NO: 3017 - protein, 30 aa, Artificial Sequence
  Description of Artificial Sequence: Synthetic polypeptide
DEEEIRTTNPVATEQYGSTVSTENLQRGNR

SEQ ID NO: 3018 - protein, 30 aa, Artificial Sequence
  Description of Artificial Sequence: Synthetic polypeptide
DEEEIRTTNPVATEQYGSVSGTNILQRGNR

SEQ ID NO: 3019 - protein, 29 aa, Artificial Sequence
  Description of Artificial Sequence: Synthetic peptide
DEEEIRTTNPVATEQYGSVSNNLQRGNSR

SEQ ID NO: 3020 - protein, 28 aa, Artificial Sequence
  Description of Artificial Sequence: Synthetic peptide
DEEEIRTTNPVATEQYGSVSTELQRGNM

SEQ ID NO: 3021 - protein, 30 aa, Artificial Sequence
  Description of Artificial Sequence: Synthetic polypeptide
DEEEIRTTNPVATEQYGSVSTPNLQRGNPR

SEQ ID NO: 3022 - protein, 30 aa, Artificial Sequence
  Description of Artificial Sequence: Synthetic polypeptide
DEEEIRTTNPVATEQYGSVSTNLQHRQGNR

SEQ ID NO: 3023 - protein, 28 aa, Artificial Sequence
  Description of Artificial Sequence: Synthetic peptide
VEEEIRTTNPVASEQYGSVSTNLQRGNR

SEQ ID NO: 3024 - protein, 28 aa, Artificial Sequence
  Description of Artificial Sequence: Synthetic peptide
DEEEIRTTNPVCTEQYGSVSTNLQRGLR

SEQ ID NO: 3025 - protein, 29 aa, Artificial Sequence
  Description of Artificial Sequence: Synthetic peptide
DEEEIRTTNPVATEQYGSVQETNLQRGNR

SEQ ID NO: 3026 - protein, 28 aa, Artificial Sequence
  Description of Artificial Sequence: Synthetic peptide
DEEEIRTVNPVATEQYGSVSTNLERGNR

SEQ ID NO: 3027 - protein, 29 aa, Artificial Sequence
  Description of Artificial Sequence: Synthetic peptide
DEEEIRTTNPVATEQYGSVSTNLMNRGNR

SEQ ID NO: 3028 - protein, 29 aa, Artificial Sequence
  Description of Artificial Sequence: Synthetic peptide
DEEEIRTTNPTATEQYGSVISTNLQRGNR

SEQ ID NO: 3029 - protein, 28 aa, Artificial Sequence
  Description of Artificial Sequence: Synthetic peptide
DEAEIRTTNPVATEQYGSASTNLQRGNR

SEQ ID NO: 3030 - protein, 28 aa, Artificial Sequence
  Description of Artificial Sequence: Synthetic peptide
DEEEIRTTNPVATEQYGSVSTGLQRGNQ

SEQ ID NO: 3031 - protein, 30 aa, Artificial Sequence
  Description of Artificial Sequence: Synthetic polypeptide
DEEEIRTTNPVATEQYGSVSTNLQVRGDNR

SEQ ID NO: 3032 - protein, 28 aa, Artificial Sequence
  Description of Artificial Sequence: Synthetic peptide
DEEEIRTTNPVASEQYGTVSTNLQRGNR

SEQ ID NO: 3033 - protein, 28 aa, Artificial Sequence
  Description of Artificial Sequence: Synthetic peptide
DEQEIRTTNPVATEQYGSVSTNLQRGNK

SEQ ID NO: 3034 - protein, 28 aa, Artificial Sequence
  Description of Artificial Sequence: Synthetic peptide
DIEEIRTTNPVATEQYGSVSTNLQRGNG

SEQ ID NO: 3035 - protein, 30 aa, Artificial Sequence
  Description of Artificial Sequence: Synthetic polypeptide
DEEEIRTTNPVATEQYGSVSTNPLPQRGNR

SEQ ID NO: 3036 - protein, 28 aa, Artificial Sequence
  Description of Artificial Sequence: Synthetic peptide
DEEEIRTTNPVATEQYGSVSTNDQRGNA

SEQ ID NO: 3037 - protein, 28 aa, Artificial Sequence
  Description of Artificial Sequence: Synthetic peptide
DEEEIRTTNPVATELYGSVSTNLQRGQR

SEQ ID NO: 3038 - protein, 28 aa, Artificial Sequence
  Description of Artificial Sequence: Synthetic peptide
DLEEIRTTNPVATEQYGSVSTNLDRGNR

SEQ ID NO: 3039 - protein, 28 aa, Artificial Sequence
  Description of Artificial Sequence: Synthetic peptide
SEEEIATTNPVATEQYGSVSTNLQRGNR

SEQ ID NO: 3040 - protein, 29 aa, Artificial Sequence
  Description of Artificial Sequence: Synthetic peptide
DEEEIRTTNPVATEQYGSVSTNLQNHGNR

SEQ ID NO: 3041 - protein, 28 aa, Artificial Sequence
  Description of Artificial Sequence: Synthetic peptide
DEEEIRTTNIVATEQYGSVSTNLQTGNR

SEQ ID NO: 3042 - protein, 28 aa, Artificial Sequence
  Description of Artificial Sequence: Synthetic peptide
DEEEIRTTNPVATECYGGVSTNLQRGNR

SEQ ID NO: 3043 - protein, 29 aa, Artificial Sequence
  Description of Artificial Sequence: Synthetic peptide
DEEEINTTNPVATEQYGSSVSTNLQRGNR

SEQ ID NO: 3044 - protein, 28 aa, Artificial Sequence
  Description of Artificial Sequence: Synthetic peptide
DEEEIRTTNPYATEQYGSVSTNLQRGNA

SEQ ID NO: 3045 - protein, 29 aa, Artificial Sequence
  Description of Artificial Sequence: Synthetic peptide
AEEEIRTTNPVATEQYGSVSTNLQRGDNR

SEQ ID NO: 3046 - protein, 28 aa, Artificial Sequence
  Description of Artificial Sequence: Synthetic peptide
DEEEISTTNPVATEQYGSVSTNLQRGNQ

SEQ ID NO: 3047 - protein, 30 aa, Artificial Sequence
  Description of Artificial Sequence: Synthetic polypeptide
DEEEIRTTNPVATEQYGSVESTNLQRGENR

SEQ ID NO: 3048 - protein, 28 aa, Artificial Sequence
  Description of Artificial Sequence: Synthetic peptide
DEEEIRTTNPVATEQYGSVHTNLQRGNP

SEQ ID NO: 3049 - protein, 29 aa, Artificial Sequence
  Description of Artificial Sequence: Synthetic peptide
DEEEIRTTNPVATEQYGSYVFTNLQRGNR

SEQ ID NO: 3050 - protein, 28 aa, Artificial Sequence
  Description of Artificial Sequence: Synthetic peptide
DEEEIRTTNPVATEQYGSVSTNGQRPNR

SEQ ID NO: 3051 - protein, 28 aa, Artificial Sequence
  Description of Artificial Sequence: Synthetic peptide
DEEEIRTTNPVATEQYGWVSTNLQRGER

SEQ ID NO: 3052 - protein, 28 aa, Artificial Sequence
  Description of Artificial Sequence: Synthetic peptide
DEEEIRCTNPVSTEQYGSVSTNLQRGNR

SEQ ID NO: 3053 - protein, 29 aa, Artificial Sequence
  Description of Artificial Sequence: Synthetic peptide
DEEEIRTTNPVATEQYGSVESTNLQPGNR

SEQ ID NO: 3054 - protein, 28 aa, Artificial Sequence
  Description of Artificial Sequence: Synthetic peptide
MEEEIRTTNPVATEQYGSVSTNLQRGER

SEQ ID NO: 3055 - protein, 28 aa, Artificial Sequence
  Description of Artificial Sequence: Synthetic peptide
DEEEIRTTNPVATEQYGSVSTNWQHGNR

SEQ ID NO: 3056 - protein, 30 aa, Artificial Sequence
  Description of Artificial Sequence: Synthetic polypeptide
DEEEIRTTNPVATEQYGSCVSTNLQRDGNR

SEQ ID NO: 3057 - protein, 29 aa, Artificial Sequence
  Description of Artificial Sequence: Synthetic peptide
DEEEIRTTNPVATELYGSVSTNLQNRGNR

SEQ ID NO: 3058 - protein, 28 aa, Artificial Sequence
  Description of Artificial Sequence: Synthetic peptide
DEEEIGTTNPVATEQYGSVSTNLQRGER

SEQ ID NO: 3059 - protein, 29 aa, Artificial Sequence
  Description of Artificial Sequence: Synthetic peptide
DEEEIRTTNPVATEQYGSVSTNWQRFGNR

SEQ ID NO: 3060 - protein, 29 aa, Artificial Sequence
  Description of Artificial Sequence: Synthetic peptide
DEEEIRTTNPVATEQYGSVSTNLQQGNDR

SEQ ID NO: 3061 - protein, 29 aa, Artificial Sequence
  Description of Artificial Sequence: Synthetic peptide
DEQEIRTTNPVATEQYGSYVSTNLQRGNR

SEQ ID NO: 3062 - protein, 28 aa, Artificial Sequence
  Description of Artificial Sequence: Synthetic peptide
DEEEIRTTNPVATEQYGSVSTNQQTGNR

SEQ ID NO: 3063 - protein, 28 aa, Artificial Sequence
  Description of Artificial Sequence: Synthetic peptide
DENEIRTTNPVATEQYGSVSTNLQHGNR

SEQ ID NO: 3064 - protein, 28 aa, Artificial Sequence
  Description of Artificial Sequence: Synthetic peptide
CEEEIRTTNPVATEQYGSCSTNLQRGNR

SEQ ID NO: 3065 - protein, 28 aa, Artificial Sequence
  Description of Artificial Sequence: Synthetic peptide
DEEEIRTTNPVATEQYGSASTNLQRGGR

SEQ ID NO: 3066 - protein, 28 aa, Artificial Sequence
  Description of Artificial Sequence: Synthetic peptide
DEWEIRTTNPVATEQYGSVSTNEQRGNR

SEQ ID NO: 3067 - protein, 28 aa, Artificial Sequence
  Description of Artificial Sequence: Synthetic peptide
MEEEIRTTNPVATEQYGSVSTDLQRGNR

SEQ ID NO: 3068 - protein, 28 aa, Artificial Sequence
  Description of Artificial Sequence: Synthetic peptide
DEEEIRTTNPVATEVYGSVATNLQRGNR

SEQ ID NO: 3069 - protein, 28 aa, Artificial Sequence
  Description of Artificial Sequence: Synthetic peptide
DDEEIRTTNPVATEQYGSVSSNLQRGNR

SEQ ID NO: 3070 - protein, 28 aa, Artificial Sequence
  Description of Artificial Sequence: Synthetic peptide
DEEEIRTTNPVATEQYGSLSTNLQRGVR

SEQ ID NO: 3071 - protein, 29 aa, Artificial Sequence
  Description of Artificial Sequence: Synthetic peptide
DEEEIRTTNPVATEQYGSVPATNLQRGNR

SEQ ID NO: 3072 - protein, 28 aa, Artificial Sequence
  Description of Artificial Sequence: Synthetic peptide
AEEEIRSTNPVATEQYGSVSTNLQRGNR

SEQ ID NO: 3073 - protein, 30 aa, Artificial Sequence
  Description of Artificial Sequence: Synthetic polypeptide
DEEEIRTTNPVATEQYGSVSTNLQERQGNR

SEQ ID NO: 3074 - protein, 28 aa, Artificial Sequence
  Description of Artificial Sequence: Synthetic peptide
DEQEIRTTNPVATEMYGSVSTNLQRGNR

SEQ ID NO: 3075 - protein, 28 aa, Artificial Sequence
  Description of Artificial Sequence: Synthetic peptide
DAEEIRTTNPDATEQYGSVSTNLQRGNR

SEQ ID NO: 3076 - protein, 28 aa, Artificial Sequence
  Description of Artificial Sequence: Synthetic peptide
DEEEISTVNPVATEQYGSVSTNLQRGNR

SEQ ID NO: 3077 - protein, 29 aa, Artificial Sequence
  Description of Artificial Sequence: Synthetic peptide
DEEEIRTTNPVATEQYGSVITNLLQRGNR

SEQ ID NO: 3078 - protein, 28 aa, Artificial Sequence
  Description of Artificial Sequence: Synthetic peptide
DEEEIRTTNPVATEQWGSVPTNLQRGNR

SEQ ID NO: 3079 - protein, 30 aa, Artificial Sequence
  Description of Artificial Sequence: Synthetic polypeptide
DEEEIRTTNPVATEQYGSVSTDNLQRGNDR

SEQ ID NO: 3080 - protein, 28 aa, Artificial Sequence
  Description of Artificial Sequence: Synthetic peptide
DEEEIRATNPVATEQYGSVDTNLQRGNR

SEQ ID NO: 3081 - protein, 29 aa, Artificial Sequence
  Description of Artificial Sequence: Synthetic peptide
DEEEIRTTNPVATEQYGSVSTNNLQRENR

SEQ ID NO: 3082 - protein, 28 aa, Artificial Sequence
  Description of Artificial Sequence: Synthetic peptide
DEEEIRTTNPVATEQYGSVSTNLYQGNR

SEQ ID NO: 3083 - protein, 28 aa, Artificial Sequence
  Description of Artificial Sequence: Synthetic peptide
DEEEIRTTNPVATEQYGSVSTNLQNGNE

SEQ ID NO: 3084 - protein, 29 aa, Artificial Sequence
  Description of Artificial Sequence: Synthetic peptide
DEEEIRTTNPVATEQYGSVSCTNLQAGNR

SEQ ID NO: 3085 - protein, 28 aa, Artificial Sequence
  Description of Artificial Sequence: Synthetic peptide
DEEETRTTNPVATEQYGSVSTNLERGNR

SEQ ID NO: 3086 - protein, 28 aa, Artificial Sequence
  Description of Artificial Sequence: Synthetic peptide
DEECIRTTNPVATEQYGSVSTPLQRGNR

SEQ ID NO: 3087 - protein, 28 aa, Artificial Sequence
  Description of Artificial Sequence: Synthetic peptide
DEMEIRTTNPVATEQYGSVDTNLQRGNR

SEQ ID NO: 3088 - protein, 29 aa, Artificial Sequence
  Description of Artificial Sequence: Synthetic peptide
DEEEIRTTNPVATEQYGSVSTNLQVRGNE

SEQ ID NO: 3089 - protein, 28 aa, Artificial Sequence
  Description of Artificial Sequence: Synthetic peptide
DEHEIRTTNPVATEQYGSVSDNLQRGNR

SEQ ID NO: 3090 - protein, 28 aa, Artificial Sequence
  Description of Artificial Sequence: Synthetic peptide
DEEEIRTTNPVATEQYGSVSTNLQGGNP

SEQ ID NO: 3091 - protein, 28 aa, Artificial Sequence
  Description of Artificial Sequence: Synthetic peptide
DEEEIRTTNPVATEQYGSVSTNGQRGER

SEQ ID NO: 3092 - protein, 29 aa, Artificial Sequence
  Description of Artificial Sequence: Synthetic peptide
DEEEIRTTNPVATEQYGSVISTNLQRGNF

SEQ ID NO: 3093 - protein, 29 aa, Artificial Sequence
  Description of Artificial Sequence: Synthetic peptide
DEEEIRTTNPVATEQYGSVSSTNLQRGND

SEQ ID NO: 3094 - protein, 30 aa, Artificial Sequence
  Description of Artificial Sequence: Synthetic polypeptide
DEEEIRTTNPVATEQYGSYVSTNLQRNGNR

SEQ ID NO: 3095 - protein, 28 aa, Artificial Sequence
  Description of Artificial Sequence: Synthetic peptide
DEEEIRTTNPVATEQYGSVSTGLQRGHR

SEQ ID NO: 3096 - protein, 28 aa, Artificial Sequence
  Description of Artificial Sequence: Synthetic peptide
DEEEIRTTNPVSTEQYGVVSTNLQRGNR

SEQ ID NO: 3097 - protein, 28 aa, Artificial Sequence
  Description of Artificial Sequence: Synthetic peptide
DEEEIRTTNPVATEQYGSVSDNLDRGNR

SEQ ID NO: 3098 - protein, 28 aa, Artificial Sequence
  Description of Artificial Sequence: Synthetic peptide
DEEEIRTTNPVAYEQYGSVFTNLQRGNR

SEQ ID NO: 3099 - protein, 28 aa, Artificial Sequence
  Description of Artificial Sequence: Synthetic peptide
DEEEIRTTNPVATEQFGSVSTNPQRGNR

SEQ ID NO: 3100 - protein, 28 aa, Artificial Sequence
  Description of Artificial Sequence: Synthetic peptide
DEEEIRTTNPVATEQYGSVSTNEQRGND

SEQ ID NO: 3101 - protein, 29 aa, Artificial Sequence
  Description of Artificial Sequence: Synthetic peptide
DEEEIRTTNPVATEQYGSVSDTNLQQGNR

SEQ ID NO: 3102 - protein, 28 aa, Artificial Sequence
  Description of Artificial Sequence: Synthetic peptide
DEEEIRTTNIVATEQYGSVSTNLQRGNE

SEQ ID NO: 3103 - protein, 30 aa, Artificial Sequence
  Description of Artificial Sequence: Synthetic polypeptide
DEEEIRTTNPVATEQYGSVSTNLQRGVNDR

SEQ ID NO: 3104 - protein, 30 aa, Artificial Sequence
  Description of Artificial Sequence: Synthetic polypeptide
DEEEIRTTNPVATEQYGSVASTNLQRGNDR

SEQ ID NO: 3105 - protein, 28 aa, Artificial Sequence
  Description of Artificial Sequence: Synthetic peptide
DEEQIRTTNPVATEQYGSWSTNLQRGNR

SEQ ID NO: 3106 - protein, 29 aa, Artificial Sequence
  Description of Artificial Sequence: Synthetic peptide
DEEEIRTTNPVAGEQYGSVSTNLQRGNPR

SEQ ID NO: 3107 - protein, 28 aa, Artificial Sequence
  Description of Artificial Sequence: Synthetic peptide
CEEEIRTTNPVATEQYGSVSWNLQRGNR

SEQ ID NO: 3108 - protein, 28 aa, Artificial Sequence
  Description of Artificial Sequence: Synthetic peptide
DEEEIRCTNPVATEQYGSVSTNLQLGNR

SEQ ID NO: 3109 - protein, 28 aa, Artificial Sequence
  Description of Artificial Sequence: Synthetic peptide
DEEEIRATNPVATEQYGSVSMNLQRGNR

SEQ ID NO: 3110 - protein, 28 aa, Artificial Sequence
  Description of Artificial Sequence: Synthetic peptide
DEEEIRQTNPVATEQYGSVSTNLQQGNR

SEQ ID NO: 3111 - protein, 29 aa, Artificial Sequence
  Description of Artificial Sequence: Synthetic peptide
DEEEIRTTNPVATEQYGSVSTNLQRGNED

SEQ ID NO: 3112 - protein, 28 aa, Artificial Sequence
  Description of Artificial Sequence: Synthetic peptide
NEEEIRTTNPVATEQYGSVSTNLLRGNR

SEQ ID NO: 3113 - protein, 28 aa, Artificial Sequence
  Description of Artificial Sequence: Synthetic peptide
DEEEIRTTNPVATEQYGSVSTNLQRMAR

SEQ ID NO: 3114 - protein, 28 aa, Artificial Sequence
  Description of Artificial Sequence: Synthetic peptide
DEEEIRTTNPVATEQYGSVSTNLDLGNR

SEQ ID NO: 3115 - protein, 28 aa, Artificial Sequence
  Description of Artificial Sequence: Synthetic peptide
DEEEIRTTNPVATEIYGTVSTNLQRGNR

SEQ ID NO: 3116 - protein, 28 aa, Artificial Sequence
  Description of Artificial Sequence: Synthetic peptide
DEEEIRTTNPVSTEQYGSVSTNLMRGNR

SEQ ID NO: 3117 - protein, 28 aa, Artificial Sequence
  Description of Artificial Sequence: Synthetic peptide
DEEEIRSTNPVATEVYGSVSTNLQRGNR

SEQ ID NO: 3118 - protein, 28 aa, Artificial Sequence
  Description of Artificial Sequence: Synthetic peptide
DEEEIRTTNPVATEQYGSVSTNLQVGNM

SEQ ID NO: 3119 - protein, 28 aa, Artificial Sequence
  Description of Artificial Sequence: Synthetic peptide
VEEEIRTTNPVATEQYGSVSTNLQRGNM

SEQ ID NO: 3120 - protein, 29 aa, Artificial Sequence
  Description of Artificial Sequence: Synthetic peptide
DEEEIRTTNPVATELYGSVGSTNLQRGNR

SEQ ID NO: 3121 - protein, 28 aa, Artificial Sequence
  Description of Artificial Sequence: Synthetic peptide
DEEEIRTTNPEATEQYGSVSTNLERGNR

SEQ ID NO: 3122 - protein, 29 aa, Artificial Sequence
  Description of Artificial Sequence: Synthetic peptide
DEEEIRTTNPVATEQYGSVSTVNLQRGNT

SEQ ID NO: 3123 - protein, 28 aa, Artificial Sequence
  Description of Artificial Sequence: Synthetic peptide
DEEEIRTTNPVATECYGSVSTNPQRGNR

SEQ ID NO: 3124 - protein, 28 aa, Artificial Sequence
  Description of Artificial Sequence: Synthetic peptide
DEEEIRTTNIVATEQYGSVSTNLQNGNR

SEQ ID NO: 3125 - protein, 28 aa, Artificial Sequence
  Description of Artificial Sequence: Synthetic peptide
DEEEIRTTNPVATEQYGSVSENLQRGNF

SEQ ID NO: 3126 - protein, 28 aa, Artificial Sequence
  Description of Artificial Sequence: Synthetic peptide
DEEEIRTTNPVATEQYGSVSTNLLAGNR

SEQ ID NO: 3127 - protein, 29 aa, Artificial Sequence
  Description of Artificial Sequence: Synthetic peptide
DEEEIRTTNPVATEQYGSVSTDLQRNGNR

SEQ ID NO: 3128 - protein, 28 aa, Artificial Sequence
  Description of Artificial Sequence: Synthetic peptide
DEEEIRTTNPVATEQYGSVSTNLQAGNA

SEQ ID NO: 3129 - protein, 28 aa, Artificial Sequence
  Description of Artificial Sequence: Synthetic peptide
DEEEIRTTNPVATEQYGSVSTNLQDGNS

SEQ ID NO: 3130 - protein, 29 aa, Artificial Sequence
  Description of Artificial Sequence: Synthetic peptide
DEEEIRTTNPVATEQYGSWTSTNLQRGNR

SEQ ID NO: 3131 - protein, 29 aa, Artificial Sequence
  Description of Artificial Sequence: Synthetic peptide
DEEEIRTTNPVATEQYGSVSTANLQRGNF

SEQ ID NO: 3132 - protein, 28 aa, Artificial Sequence
  Description of Artificial Sequence: Synthetic peptide
DEDEIRTTNCVATEQYGSVSTNLQRGNR

SEQ ID NO: 3133 - protein, 29 aa, Artificial Sequence
  Description of Artificial Sequence: Synthetic peptide
DEEEIRTTNPVATEQYGSVSTNLQFGNTR

SEQ ID NO: 3134 - protein, 28 aa, Artificial Sequence
  Description of Artificial Sequence: Synthetic peptide
DEVEIRTTNPCATEQYGSVSTNLQRGNR

SEQ ID NO: 3135 - protein, 30 aa, Artificial Sequence
  Description of Artificial Sequence: Synthetic polypeptide
DEEEIRTTNPVATEQYGSVDSTNLQRGNER

SEQ ID NO: 3136 - protein, 28 aa, Artificial Sequence
  Description of Artificial Sequence: Synthetic peptide
DEEEIRTVNPVATEQYGNVSTNLQRGNR

SEQ ID NO: 3137 - protein, 29 aa, Artificial Sequence
  Description of Artificial Sequence: Synthetic peptide
DEEEIRTTNPVATEQYWSVSTNLQRGDNR

SEQ ID NO: 3138 - protein, 28 aa, Artificial Sequence
  Description of Artificial Sequence: Synthetic peptide
DEQEIRTTNPVATEQYGSVSTNLQRENR

SEQ ID NO: 3139 - protein, 29 aa, Artificial Sequence
  Description of Artificial Sequence: Synthetic peptide
DEEEIRTTNPCATEQYGSVDSTNLQRGNR

SEQ ID NO: 3140 - protein, 29 aa, Artificial Sequence
  Description of Artificial Sequence: Synthetic peptide
DEEEIRTTNPVATEQYGSVSTNLVQRGNA

SEQ ID NO: 3141 - protein, 28 aa, Artificial Sequence
  Description of Artificial Sequence: Synthetic peptide
DEEEIRTTNPVATEQYGSVSTNLQNGNT

SEQ ID NO: 3142 - protein, 28 aa, Artificial Sequence
  Description of Artificial Sequence: Synthetic peptide
DEEEIRTTNPVATEQYGSCSTNLQNGNR

SEQ ID NO: 3143 - protein, 28 aa, Artificial Sequence
  Description of Artificial Sequence: Synthetic peptide
DDEEIRTTNPVATEQYGDVSTNLQRGNR

SEQ ID NO: 3144 - protein, 28 aa, Artificial Sequence
  Description of Artificial Sequence: Synthetic peptide
QEEEIRTTNPVATEQYGSVSTNDQRGNR

SEQ ID NO: 3145 - protein, 28 aa, Artificial Sequence
  Description of Artificial Sequence: Synthetic peptide
DEQEIRTTNPVATEQYGSVSTNLQRGNT

SEQ ID NO: 3146 - protein, 28 aa, Artificial Sequence
  Description of Artificial Sequence: Synthetic peptide
DEEEIRTTNPVATEQYGSVSTNLQRLND

SEQ ID NO: 3147 - protein, 28 aa, Artificial Sequence
  Description of Artificial Sequence: Synthetic peptide
DEEEIRTTNPVATEQYGSVSTNLDRGNS

SEQ ID NO: 3148 - protein, 30 aa, Artificial Sequence
  Description of Artificial Sequence: Synthetic polypeptide
DEEEIRTTNPVATEQYGSVSTNGLQREGNR

SEQ ID NO: 3149 - protein, 28 aa, Artificial Sequence
  Description of Artificial Sequence: Synthetic peptide
DEEEIRTVNPVATEQYGSMSTNLQRGNR

SEQ ID NO: 3150 - protein, 29 aa, Artificial Sequence
  Description of Artificial Sequence: Synthetic peptide
DEEEIRTTNPVATEQYGSVSTNLQREGNN

SEQ ID NO: 3151 - protein, 28 aa, Artificial Sequence
  Description of Artificial Sequence: Synthetic peptide
DEQEIRTTNPVATEQYGSVSTNLQRPNR

SEQ ID NO: 3152 - protein, 29 aa, Artificial Sequence
  Description of Artificial Sequence: Synthetic peptide
DEEEIRTTNPVATEQYGSEVSTNLQTGNR

SEQ ID NO: 3153 - protein, 29 aa, Artificial Sequence
  Description of Artificial Sequence: Synthetic peptide
DEEEIRTTNPVATEQYGSVSTNLQETGNR

SEQ ID NO: 3154 - protein, 29 aa, Artificial Sequence
  Description of Artificial Sequence: Synthetic peptide
DEEEIRTTNPVATEQYGSVSTNLQREGNY

SEQ ID NO: 3155 - protein, 29 aa, Artificial Sequence
  Description of Artificial Sequence: Synthetic peptide
DEEEIRTTNPVATEQYGSVSTGNPQRGNR

SEQ ID NO: 3156 - protein, 28 aa, Artificial Sequence
  Description of Artificial Sequence: Synthetic peptide
DEEEIRTTNPVATEQYGSVSENLQRGNS

SEQ ID NO: 3157 - protein, 28 aa, Artificial Sequence
  Description of Artificial Sequence: Synthetic peptide
DEEEIRTTNPVATEQYGSVSTNLQQGNW

SEQ ID NO: 3158 - protein, 29 aa, Artificial Sequence
  Description of Artificial Sequence: Synthetic peptide
DEEEIRTTNPVATEQYGSVETMNLQRGNR

SEQ ID NO: 3159 - protein, 28 aa, Artificial Sequence
  Description of Artificial Sequence: Synthetic peptide
DEEELRTTNPVATEQYGSVGTNLQRGNR

SEQ ID NO: 3160 - protein, 28 aa, Artificial Sequence
  Description of Artificial Sequence: Synthetic peptide
DEEEIRTTNPTATEQFGSVSTNLQRGNR

SEQ ID NO: 3161 - protein, 28 aa, Artificial Sequence
  Description of Artificial Sequence: Synthetic peptide
DEEEIRTTNPVATEIYGSVSTNLQRGNQ

SEQ ID NO: 3162 - protein, 28 aa, Artificial Sequence
  Description of Artificial Sequence: Synthetic peptide
DEEEIATTNPVATYQYGSVSTNLQRGNR

SEQ ID NO: 3163 - protein, 29 aa, Artificial Sequence
  Description of Artificial Sequence: Synthetic peptide
DEEEIRATNPVATEQYGSVSTNLIQRGNR

SEQ ID NO: 3164 - protein, 28 aa, Artificial Sequence
  Description of Artificial Sequence: Synthetic peptide
KEEEIRTTNPVATEQYGSVSTNLQRGNS

SEQ ID NO: 3165 - protein, 28 aa, Artificial Sequence
  Description of Artificial Sequence: Synthetic peptide
DEEEIRTTNPVATEQYGSVSTLLQHGNR

SEQ ID NO: 3166 - protein, 28 aa, Artificial Sequence
  Description of Artificial Sequence: Synthetic peptide
DEPEISTTNPVATEQYGSVSTNLQRGNR

SEQ ID NO: 3167 - protein, 28 aa, Artificial Sequence
  Description of Artificial Sequence: Synthetic peptide
DELEIRTTNPVATEQYGSVSTNLQRGQR

SEQ ID NO: 3168 - protein, 29 aa, Artificial Sequence
  Description of Artificial Sequence: Synthetic peptide
DEEEIRTTNPVATEQYGSVDSTNLQRGNV

SEQ ID NO: 3169 - protein, 29 aa, Artificial Sequence
  Description of Artificial Sequence: Synthetic peptide
DEEEIRTTNPVATEQYGSVSTNLQSRGNA

SEQ ID NO: 3170 - protein, 28 aa, Artificial Sequence
  Description of Artificial Sequence: Synthetic peptide
DEEEIRTTNPVATEQYGVVSTNLQRGNS

SEQ ID NO: 3171 - protein, 28 aa, Artificial Sequence
  Description of Artificial Sequence: Synthetic peptide
DEEEIRTTNPEATEQYGSVSTNLQRGER

SEQ ID NO: 3172 - protein, 28 aa, Artificial Sequence
  Description of Artificial Sequence: Synthetic peptide
DEEEIATTNCVATEQYGSVSTNLQRGNR

SEQ ID NO: 3173 - protein, 28 aa, Artificial Sequence
  Description of Artificial Sequence: Synthetic peptide
DEEEIRTTNPVATEQYGSVSENLQRANR

SEQ ID NO: 3174 - protein, 29 aa, Artificial Sequence
  Description of Artificial Sequence: Synthetic peptide
DEEEIRTVNPVATEQYGSVSTNLQDRGNR

SEQ ID NO: 3175 - protein, 29 aa, Artificial Sequence
  Description of Artificial Sequence: Synthetic peptide
DEEEIRTTNPVATEQYGSVSTNLIVRGNR

SEQ ID NO: 3176 - protein, 28 aa, Artificial Sequence
  Description of Artificial Sequence: Synthetic peptide
DEEEIRCTNPVCTEQYGSVSTNLQRGNR

SEQ ID NO: 3177 - protein, 30 aa, Artificial Sequence
  Description of Artificial Sequence: Synthetic polypeptide
DEEEIRTTNPVATEQYGSVDSDTNLQRGNR

SEQ ID NO: 3178 - protein, 29 aa, Artificial Sequence
  Description of Artificial Sequence: Synthetic peptide
YEEEIRTTNPVATEQYGSVSTNLQRGNDR

SEQ ID NO: 3179 - protein, 30 aa, Artificial Sequence
  Description of Artificial Sequence: Synthetic polypeptide
DEEEIRTTNPVATEQYGESVSVTNLQRGNR

SEQ ID NO: 3180 - protein, 28 aa, Artificial Sequence
  Description of Artificial Sequence: Synthetic peptide
DEEEIRQTNPVATEQYGSVSTNLQRGND

SEQ ID NO: 3181 - protein, 28 aa, Artificial Sequence
  Description of Artificial Sequence: Synthetic peptide
DEMEIRTTNPVSTEQYGSVSTNLQRGNR

SEQ ID NO: 3182 - protein, 28 aa, Artificial Sequence
  Description of Artificial Sequence: Synthetic peptide
DEEEIRTTNPMATEQYGSVSTNCQRGNR

SEQ ID NO: 3183 - protein, 28 aa, Artificial Sequence
  Description of Artificial Sequence: Synthetic peptide
DEEEIRTTNPVATEQYGSVSTLLQRGNP

SEQ ID NO: 3184 - protein, 28 aa, Artificial Sequence
  Description of Artificial Sequence: Synthetic peptide
DEEEIRTTNPVATEQYGSVATNLQRGNQ

SEQ ID NO: 3185 - protein, 28 aa, Artificial Sequence
  Description of Artificial Sequence: Synthetic peptide
DEEEIRSTNPVASEQYGSVSTNLQRGNR

SEQ ID NO: 3186 - protein, 28 aa, Artificial Sequence
  Description of Artificial Sequence: Synthetic peptide
KEEEIRTTNPVATEQYGSVSTNLQRGNF

SEQ ID NO: 3187 - protein, 29 aa, Artificial Sequence
  Description of Artificial Sequence: Synthetic peptide
DEEEIRTTNPVATEQYGSVSTNLPQRGNF

SEQ ID NO: 3188 - protein, 28 aa, Artificial Sequence
  Description of Artificial Sequence: Synthetic peptide
DEEEIRTTNPVATEQYGSVSTNLQYGNF

SEQ ID NO: 3189 - protein, 28 aa, Artificial Sequence
  Description of Artificial Sequence: Synthetic peptide
DEEEIRTTNPVADEQYGSVPTNLQRGNR

SEQ ID NO: 3190 - protein, 30 aa, Artificial Sequence
  Description of Artificial Sequence: Synthetic polypeptide
DEEEIRTTNPVATEQYGSVSTNLQERGENR

SEQ ID NO: 3191 - protein, 28 aa, Artificial Sequence
  Description of Artificial Sequence: Synthetic peptide
DEEEIATTNPVATEQYGSVCTNLQRGNR

SEQ ID NO: 3192 - protein, 29 aa, Artificial Sequence
  Description of Artificial Sequence: Synthetic peptide
DEEEIRTTNPVATEQYGSVSTNEQWRGNR

SEQ ID NO: 3193 - protein, 28 aa, Artificial Sequence
  Description of Artificial Sequence: Synthetic peptide
DEEEIRTTNPVATEQYGSVSMDLQRGNR

SEQ ID NO: 3194 - protein, 28 aa, Artificial Sequence
  Description of Artificial Sequence: Synthetic peptide
DEEEIRTTNPVATEQYGTVSMNLQRGNR

SEQ ID NO: 3195 - protein, 28 aa, Artificial Sequence
  Description of Artificial Sequence: Synthetic peptide
DEEEIRTTNPDATEQYGSVSTGLQRGNR

SEQ ID NO: 3196 - protein, 28 aa, Artificial Sequence
  Description of Artificial Sequence: Synthetic peptide
NEEEIRTTNPVATEQYGSVGTNLQRGNR

SEQ ID NO: 3197 - protein, 28 aa, Artificial Sequence
  Description of Artificial Sequence: Synthetic peptide
DHEEIRTTNPVATEQYGSVSTNDQRGNR

SEQ ID NO: 3198 - protein, 28 aa, Artificial Sequence
  Description of Artificial Sequence: Synthetic peptide
DEEELATTNPVATEQYGSVSTNLQRGNR

SEQ ID NO: 3199 - protein, 28 aa, Artificial Sequence
  Description of Artificial Sequence: Synthetic peptide
DEEEITTTNIVATEQYGSVSTNLQRGNR

SEQ ID NO: 3200 - protein, 28 aa, Artificial Sequence
  Description of Artificial Sequence: Synthetic peptide
DEEEIRTVNPVATECYGSVSTNLQRGNR

SEQ ID NO: 3201 - protein, 28 aa, Artificial Sequence
  Description of Artificial Sequence: Synthetic peptide
DEEEIRTTNPVATEQYGSVSTNDQRGNM

SEQ ID NO: 3202 - protein, 29 aa, Artificial Sequence
  Description of Artificial Sequence: Synthetic peptide
DEEEIRTTNPVATEQYGSVSDNLQRYGNR

SEQ ID NO: 3203 - protein, 29 aa, Artificial Sequence
  Description of Artificial Sequence: Synthetic peptide
DEEEIRTTNPVATEQYGSVDTNLQNRGNR

SEQ ID NO: 3204 - protein, 28 aa, Artificial Sequence
  Description of Artificial Sequence: Synthetic peptide
DENEIRTTNPVATEQYGSVSTNLQRGNW

SEQ ID NO: 3205 - protein, 30 aa, Artificial Sequence
  Description of Artificial Sequence: Synthetic polypeptide
DEEEIRTTNPVATEQYGSVASTNNLQRGNR

SEQ ID NO: 3206 - protein, 28 aa, Artificial Sequence
  Description of Artificial Sequence: Synthetic peptide
DEEEISTTNPVATEQYGSVSTNLARGNR

SEQ ID NO: 3207 - protein, 29 aa, Artificial Sequence
  Description of Artificial Sequence: Synthetic peptide
DEEEIRTTNPVATEQYGSVSCTNLQRGNS

SEQ ID NO: 3208 - protein, 28 aa, Artificial Sequence
  Description of Artificial Sequence: Synthetic peptide
DEEEIRTTNPVSTEQYGSVSTNLQGGNR

SEQ ID NO: 3209 - protein, 28 aa, Artificial Sequence
  Description of Artificial Sequence: Synthetic peptide
DEEEIRTTNPVATEQYGSVSDNLQSGNR

SEQ ID NO: 3210 - protein, 28 aa, Artificial Sequence
  Description of Artificial Sequence: Synthetic peptide
DEEEIRTTNPIATEFYGSVSTNLQRGNR

SEQ ID NO: 3211 - protein, 28 aa, Artificial Sequence
  Description of Artificial Sequence: Synthetic peptide
DEEEIRTTNPVATEQYGSVSTNLQHGNE

SEQ ID NO: 3212 - protein, 28 aa, Artificial Sequence
  Description of Artificial Sequence: Synthetic peptide
DEEEIRGTNPVATEQYGWVSTNLQRGNR

SEQ ID NO: 3213 - protein, 29 aa, Artificial Sequence
  Description of Artificial Sequence: Synthetic peptide
DEEEIRTTNPVATEQYGSVSTNPLQRGIR

SEQ ID NO: 3214 - protein, 28 aa, Artificial Sequence
  Description of Artificial Sequence: Synthetic peptide
DEEEIRTTNPVATEQYGTVSTNLQNGNR

SEQ ID NO: 3215 - protein, 28 aa, Artificial Sequence
  Description of Artificial Sequence: Synthetic peptide
DEEEIRTTNPVATEVYGSVSTILQRGNR

SEQ ID NO: 3216 - protein, 28 aa, Artificial Sequence
  Description of Artificial Sequence: Synthetic peptide
IEEEIRTTNPVATEQYGSTSTNLQRGNR

SEQ ID NO: 3217 - protein, 30 aa, Artificial Sequence
  Description of Artificial Sequence: Synthetic polypeptide
DEEEIRTTNPVATEQYGSVESTDNLQRGNR

SEQ ID NO: 3218 - protein, 28 aa, Artificial Sequence
  Description of Artificial Sequence: Synthetic peptide
DEEEIRTTNPVATEQYGSVSYNLQHGNR

SEQ ID NO: 3219 - protein, 28 aa, Artificial Sequence
  Description of Artificial Sequence: Synthetic peptide
DEEEIEPTNPVATEQYGSVSTNLQRGNR

SEQ ID NO: 3220 - protein, 30 aa, Artificial Sequence
  Description of Artificial Sequence: Synthetic polypeptide
DEEEIRTTNPVATEQYGCSVSTNLQRNGNR

SEQ ID NO: 3221 - protein, 28 aa, Artificial Sequence
  Description of Artificial Sequence: Synthetic peptide
DEEEIRTTNPVATEQYGSVDTNLQRGNG

SEQ ID NO: 3222 - protein, 28 aa, Artificial Sequence
  Description of Artificial Sequence: Synthetic peptide
DEEEIRTTNPVSTEQYGSYSTNLQRGNR

SEQ ID NO: 3223 - protein, 28 aa, Artificial Sequence
  Description of Artificial Sequence: Synthetic peptide
DEEEIRTTNPVATEQYGSVSTNLQRGTQ

SEQ ID NO: 3224 - protein, 28 aa, Artificial Sequence
  Description of Artificial Sequence: Synthetic peptide
DEEEIRCTNPVATEQYGSVSTNDQRGNR

SEQ ID NO: 3225 - protein, 28 aa, Artificial Sequence
  Description of Artificial Sequence: Synthetic peptide
DEEEIRTTNPVATEQYGSVSTNDQHGNR

SEQ ID NO: 3226 - protein, 28 aa, Artificial Sequence
  Description of Artificial Sequence: Synthetic peptide
DEEEIRTTNPVATEQYGSISTSLQRGNR

SEQ ID NO: 3227 - protein, 29 aa, Artificial Sequence
  Description of Artificial Sequence: Synthetic peptide
DEEEIRTTNPVATEQYGEMVSTNLQRGNR

SEQ ID NO: 3228 - protein, 28 aa, Artificial Sequence
  Description of Artificial Sequence: Synthetic peptide
DEEEINTTNPVATEQYGSVSTNWQRGNR

SEQ ID NO: 3229 - protein, 28 aa, Artificial Sequence
  Description of Artificial Sequence: Synthetic peptide
DEEEIHTTNPVATEQYGSVSTYLQRGNR

SEQ ID NO: 3230 - protein, 28 aa, Artificial Sequence
  Description of Artificial Sequence: Synthetic peptide
DEEEIRTTNPVATEQYGSVSMNLQRGNL

SEQ ID NO: 3231 - protein, 28 aa, Artificial Sequence
  Description of Artificial Sequence: Synthetic peptide
DEQELRTTNPVATEQYGSVSTNLQRGNR

SEQ ID NO: 3232 - protein, 29 aa, Artificial Sequence
  Description of Artificial Sequence: Synthetic peptide
DEEEIRTTNPVATEQYGSVSTNLERDGNR

SEQ ID NO: 3233 - protein, 28 aa, Artificial Sequence
  Description of Artificial Sequence: Synthetic peptide
DEEEIRTTNPVATEQYGSVSENEQRGNR

SEQ ID NO: 3234 - protein, 28 aa, Artificial Sequence
  Description of Artificial Sequence: Synthetic peptide
DEEEIRTTNPVATEQYGSVITNLQIGNR

SEQ ID NO: 3235 - protein, 28 aa, Artificial Sequence
  Description of Artificial Sequence: Synthetic peptide
DEEEIRCTNPVATEQYGSVSTNLQRGNI

SEQ ID NO: 3236 - protein, 28 aa, Artificial Sequence
  Description of Artificial Sequence: Synthetic peptide
SEEEIRTTNPVATEQYGSVSTNLQQGNR

SEQ ID NO: 3237 - protein, 28 aa, Artificial Sequence
  Description of Artificial Sequence: Synthetic peptide
DEEEIRTTNPVATEQYGSVSTNLLRGNV

SEQ ID NO: 3238 - protein, 28 aa, Artificial Sequence
  Description of Artificial Sequence: Synthetic peptide
DEEEIRTTNPMSTEQYGSVSTNLQRGNR

SEQ ID NO: 3239 - protein, 28 aa, Artificial Sequence
  Description of Artificial Sequence: Synthetic peptide
DEEEIRTVNPVATEQYGSVSTNLQRGTR

SEQ ID NO: 3240 - protein, 28 aa, Artificial Sequence
  Description of Artificial Sequence: Synthetic peptide
DEEEIRTTNPVATEQYGSVGTNLQRGNT

SEQ ID NO: 3241 - protein, 28 aa, Artificial Sequence
  Description of Artificial Sequence: Synthetic peptide
DEEEIRTTNPVATEQYGSVSENLQRGNK

SEQ ID NO: 3242 - protein, 28 aa, Artificial Sequence
  Description of Artificial Sequence: Synthetic peptide
DEEEIRTTNPVATEQYGSVSTNYQQGNR

SEQ ID NO: 3243 - protein, 28 aa, Artificial Sequence
  Description of Artificial Sequence: Synthetic peptide
DEEEIRTTNPVATEQYGVVSTNLQRGNN

SEQ ID NO: 3244 - protein, 28 aa, Artificial Sequence
  Description of Artificial Sequence: Synthetic peptide
DEEEIRTTNPDATEQYGSVSTNLQRGND

SEQ ID NO: 3245 - protein, 28 aa, Artificial Sequence
  Description of Artificial Sequence: Synthetic peptide
DEEEIRTTNPTATEQYGSVSTNLQIGNR

SEQ ID NO: 3246 - protein, 29 aa, Artificial Sequence
  Description of Artificial Sequence: Synthetic peptide
DEEEIRTTNPVATEQYGSVESENLQRGNR

SEQ ID NO: 3247 - protein, 30 aa, Artificial Sequence
  Description of Artificial Sequence: Synthetic polypeptide
DEEEIRTTNPVATEQYGSVSTNLQREGDNR

SEQ ID NO: 3248 - protein, 28 aa, Artificial Sequence
  Description of Artificial Sequence: Synthetic peptide
DEEEIRTTNPVATENYGSVSTNLQRGNT

SEQ ID NO: 3249 - protein, 28 aa, Artificial Sequence
  Description of Artificial Sequence: Synthetic peptide
DEEEIRTTNPIATEQYGSVSTNLQNGNR

SEQ ID NO: 3250 - protein, 28 aa, Artificial Sequence
  Description of Artificial Sequence: Synthetic peptide
DEEEIRTTNPVATEQYGNVSTNLQNGNR

SEQ ID NO: 3251 - protein, 28 aa, Artificial Sequence
  Description of Artificial Sequence: Synthetic peptide
DEEEIRTTNPVATEQYGSVGNNLQRGNR

SEQ ID NO: 3252 - protein, 29 aa, Artificial Sequence
  Description of Artificial Sequence: Synthetic peptide
DEEEIRTTNPVATECYGSVSETNLQRGNR

SEQ ID NO: 3253 - protein, 28 aa, Artificial Sequence
  Description of Artificial Sequence: Synthetic peptide
DEEEIRTTNPVATEQYGDVSTNLQRGMR

SEQ ID NO: 3254 - protein, 28 aa, Artificial Sequence
  Description of Artificial Sequence: Synthetic peptide
DEEEIRTTNPVATEQYGSVSTNLQQGLR

SEQ ID NO: 3255 - protein, 29 aa, Artificial Sequence
  Description of Artificial Sequence: Synthetic peptide
DEEEIRTTNPVATEQYGSVSTNLQNKGNR

SEQ ID NO: 3256 - protein, 29 aa, Artificial Sequence
  Description of Artificial Sequence: Synthetic peptide
DEEEIRTTNPVATEQYGSVSTNLQRGENY

SEQ ID NO: 3257 - protein, 29 aa, Artificial Sequence
  Description of Artificial Sequence: Synthetic peptide
DEEEIRTTNPVAYEQYGSVSTNLQRGNPR

SEQ ID NO: 3258 - protein, 28 aa, Artificial Sequence
  Description of Artificial Sequence: Synthetic peptide
DEEEIRTTNPVATEQYGSVATNGQRGNR

SEQ ID NO: 3259 - protein, 28 aa, Artificial Sequence
  Description of Artificial Sequence: Synthetic peptide
DEEEIRTTNPVATEQYGSVSTNLQVGNY

SEQ ID NO: 3260 - protein, 28 aa, Artificial Sequence
  Description of Artificial Sequence: Synthetic peptide
DEEEIRTTNPAATEQYGSVSTNLQVGNR

SEQ ID NO: 3261 - protein, 28 aa, Artificial Sequence
  Description of Artificial Sequence: Synthetic peptide
DEEEIRTTNPVATEQYGSVSTDLQYGNR

SEQ ID NO: 3262 - protein, 28 aa, Artificial Sequence
  Description of Artificial Sequence: Synthetic peptide
DEGEIRTTNPVATELYGSVSTNLQRGNR

SEQ ID NO: 3263 - protein, 29 aa, Artificial Sequence
  Description of Artificial Sequence: Synthetic peptide
DEEEIRTTNPVATEQYGSVSTPNLQPGNR

SEQ ID NO: 3264 - protein, 29 aa, Artificial Sequence
  Description of Artificial Sequence: Synthetic peptide
DEEEIRTTNPVATEQYGNSVSENLQRGNR

SEQ ID NO: 3265 - protein, 28 aa, Artificial Sequence
  Description of Artificial Sequence: Synthetic peptide
DEEEIRTTNPVATEQWGIVSTNLQRGNR

SEQ ID NO: 3266 - protein, 29 aa, Artificial Sequence
  Description of Artificial Sequence: Synthetic peptide
DEEEIRTTNPDATEQYGSVSTGNLQRGNR

SEQ ID NO: 3267 - protein, 28 aa, Artificial Sequence
  Description of Artificial Sequence: Synthetic peptide
DEEEIRTTNPVATEQYGSVSTNPQRGER

SEQ ID NO: 3268 - protein, 28 aa, Artificial Sequence
  Description of Artificial Sequence: Synthetic peptide
DEDEISTTNPVATEQYGSVSTNLQRGNR

SEQ ID NO: 3269 - protein, 28 aa, Artificial Sequence
  Description of Artificial Sequence: Synthetic peptide
DEEEIRATNPVATEQYGSVSTNWQRGNR

SEQ ID NO: 3270 - protein, 29 aa, Artificial Sequence
  Description of Artificial Sequence: Synthetic peptide
DEEEIRTTNPVATEQYGSVSTNLQRGNDW

SEQ ID NO: 3271 - protein, 28 aa, Artificial Sequence
  Description of Artificial Sequence: Synthetic peptide
DEGEIRTTNPVATEQYGSVSTNLQQGNR

SEQ ID NO: 3272 - protein, 28 aa, Artificial Sequence
  Description of Artificial Sequence: Synthetic peptide
DEEEIRTTNPVATEQYGSVETNLQRGER

SEQ ID NO: 3273 - protein, 30 aa, Artificial Sequence
  Description of Artificial Sequence: Synthetic polypeptide
DEEEIRTTNPVATEQYGMSVSTNLQLRGNR

SEQ ID NO: 3274 - protein, 29 aa, Artificial Sequence
  Description of Artificial Sequence: Synthetic peptide
DEEEIRTTNPVATEQYGSVSTNLQFNGNR

SEQ ID NO: 3275 - protein, 28 aa, Artificial Sequence
  Description of Artificial Sequence: Synthetic peptide
DEEEIRTTNPVATEQYGSVSTNLQAGNH

SEQ ID NO: 3276 - protein, 28 aa, Artificial Sequence
  Description of Artificial Sequence: Synthetic peptide
AEEEIRTTNPGATEQYGSVSTNLQRGNR

SEQ ID NO: 3277 - protein, 28 aa, Artificial Sequence
  Description of Artificial Sequence: Synthetic peptide
DEEEIRTTNIVATEQYGSTSTNLQRGNR

SEQ ID NO: 3278 - protein, 29 aa, Artificial Sequence
  Description of Artificial Sequence: Synthetic peptide
DEEEIRTTNPVATEQYGSVSTNLQRGNWV

SEQ ID NO: 3279 - protein, 28 aa, Artificial Sequence
  Description of Artificial Sequence: Synthetic peptide
DEEEIRTTNPVATEQYWSVSTNLERGNR

SEQ ID NO: 3280 - protein, 28 aa, Artificial Sequence
  Description of Artificial Sequence: Synthetic peptide
SEEEIRTTNPVATEQYGSVSENLQRGNR

SEQ ID NO: 3281 - protein, 28 aa, Artificial Sequence
  Description of Artificial Sequence: Synthetic peptide
DEEEIRTTNPVATEQYGSVSTALQHGNR

SEQ ID NO: 3282 - protein, 30 aa, Artificial Sequence
  Description of Artificial Sequence: Synthetic polypeptide
DEEEIRTTNPVATEQYGSVSCTNLQRGNER

SEQ ID NO: 3283 - protein, 29 aa, Artificial Sequence
  Description of Artificial Sequence: Synthetic peptide
DEEEIRTTNPVASEQYGSVSTNLQREGNR

SEQ ID NO: 3284 - protein, 28 aa, Artificial Sequence
  Description of Artificial Sequence: Synthetic peptide
DEEEVRTTNPVATEQYGSVSTNLQQGNR

SEQ ID NO: 3285 - protein, 28 aa, Artificial Sequence
  Description of Artificial Sequence: Synthetic peptide
DEEEIGTTNPVATEQWGSVSTNLQRGNR

SEQ ID NO: 3286 - protein, 28 aa, Artificial Sequence
  Description of Artificial Sequence: Synthetic peptide
DEEEIRTTNPVATEQYGSVSTNLQLGNT

SEQ ID NO: 3287 - protein, 28 aa, Artificial Sequence
  Description of Artificial Sequence: Synthetic peptide
DEEEIRTTNPVAFEQYGSVSTGLQRGNR

SEQ ID NO: 3288 - protein, 28 aa, Artificial Sequence
  Description of Artificial Sequence: Synthetic peptide
DESEIRTTNPVATEQYGSVSTNIQRGNR

SEQ ID NO: 3289 - protein, 28 aa, Artificial Sequence
  Description of Artificial Sequence: Synthetic peptide
DEEEIRTTNPVATEQYGSVSTNEMRGNR

SEQ ID NO: 3290 - protein, 28 aa, Artificial Sequence
  Description of Artificial Sequence: Synthetic peptide
DEEEIRTTNPTATEQYGSVSTNLQRGTR

SEQ ID NO: 3291 - protein, 29 aa, Artificial Sequence
  Description of Artificial Sequence: Synthetic peptide
DEEEIRTTNPVATEQYGSVSTGLQRNGNR

SEQ ID NO: 3292 - protein, 28 aa, Artificial Sequence
  Description of Artificial Sequence: Synthetic peptide
DENEIRTTNPVATEQYGSVSTNLQRGNM

SEQ ID NO: 3293 - protein, 29 aa, Artificial Sequence
  Description of Artificial Sequence: Synthetic peptide
DEEEIRQTNPVATEQYGSVSTNLQRGNPR

SEQ ID NO: 3294 - protein, 28 aa, Artificial Sequence
  Description of Artificial Sequence: Synthetic peptide
DEEEIRTTNPVATGQYGSVSTNLQRGNF

SEQ ID NO: 3295 - protein, 29 aa, Artificial Sequence
  Description of Artificial Sequence: Synthetic peptide
DEEEIRTTNPDATEQYGSVSTNLQRGNPR

SEQ ID NO: 3296 - protein, 28 aa, Artificial Sequence
  Description of Artificial Sequence: Synthetic peptide
NEEEIRTTNPVATENYGSVSTNLQRGNR

SEQ ID NO: 3297 - protein, 30 aa, Artificial Sequence
  Description of Artificial Sequence: Synthetic polypeptide
DEEEIRTTNPVATEQYGSVESTNLQRNGNR

SEQ ID NO: 3298 - protein, 29 aa, Artificial Sequence
  Description of Artificial Sequence: Synthetic peptide
DEEEIRTTNPVATEQFGSVSATNLQRGNR

SEQ ID NO: 3299 - protein, 29 aa, Artificial Sequence
  Description of Artificial Sequence: Synthetic peptide
DEEEIRTTNPVATEQYGSVSTNLQRNGNN

SEQ ID NO: 3300 - protein, 28 aa, Artificial Sequence
  Description of Artificial Sequence: Synthetic peptide
DDEEIRTTNPVATEVYGSVSTNLQRGNR

SEQ ID NO: 3301 - protein, 28 aa, Artificial Sequence
  Description of Artificial Sequence: Synthetic peptide
DEEEIRTTNPVATEQYGDVSTFLQRGNR

SEQ ID NO: 3302 - protein, 28 aa, Artificial Sequence
  Description of Artificial Sequence: Synthetic peptide
DEEEIRQTNPVATEQYGEVSTNLQRGNR

SEQ ID NO: 3303 - protein, 28 aa, Artificial Sequence
  Description of Artificial Sequence: Synthetic peptide
DEEEIRTTNCVATEQYGSVSTNVQRGNR

SEQ ID NO: 3304 - protein, 28 aa, Artificial Sequence
  Description of Artificial Sequence: Synthetic peptide
DEEEIRTTNPAATEQYGSVSTNLQRGND

SEQ ID NO: 3305 - protein, 28 aa, Artificial Sequence
  Description of Artificial Sequence: Synthetic peptide
DEEEIRTTNPVATENYGSVSTLLQRGNR

SEQ ID NO: 3306 - protein, 28 aa, Artificial Sequence
  Description of Artificial Sequence: Synthetic peptide
DEEEIRTTNPIATEQYGVVSTNLQRGNR

SEQ ID NO: 3307 - protein, 30 aa, Artificial Sequence
  Description of Artificial Sequence: Synthetic polypeptide
DEEEIRTTNPVATEQYGSVSTLNLQRGDNR

SEQ ID NO: 3308 - protein, 28 aa, Artificial Sequence
  Description of Artificial Sequence: Synthetic peptide
DEEEIRTTNPVATEQYGSVSTNLQVGNF

SEQ ID NO: 3309 - protein, 28 aa, Artificial Sequence
  Description of Artificial Sequence: Synthetic peptide
DEEEIRTTNPVATEQYGSVSTNPQRGDR

SEQ ID NO: 3310 - protein, 28 aa, Artificial Sequence
  Description of Artificial Sequence: Synthetic peptide
DEEEIRTTNPVATEHYGSCSTNLQRGNR

SEQ ID NO: 3311 - protein, 28 aa, Artificial Sequence
  Description of Artificial Sequence: Synthetic peptide
DEEEIRTVNPVATEQYGSVSTNLQRGNE

SEQ ID NO: 3312 - protein, 28 aa, Artificial Sequence
  Description of Artificial Sequence: Synthetic peptide
AEEEIRTTNPVACEQYGSVSTNLQRGNR

SEQ ID NO: 3313 - protein, 28 aa, Artificial Sequence
  Description of Artificial Sequence: Synthetic peptide
DEEEIRTTNPVATEQYGSVSTNEQRGNN

SEQ ID NO: 3314 - protein, 28 aa, Artificial Sequence
  Description of Artificial Sequence: Synthetic peptide
DEEEIRTTNPVATEQYGSVSENLQRLNR

SEQ ID NO: 3315 - protein, 28 aa, Artificial Sequence
  Description of Artificial Sequence: Synthetic peptide
DEVEIRTTNPVATEQYGSVSTNLQRGNA

SEQ ID NO: 3316 - protein, 30 aa, Artificial Sequence
  Description of Artificial Sequence: Synthetic polypeptide
DEEEIRTTNPVATEQYGSVSTENLQVRGNR

SEQ ID NO: 3317 - protein, 28 aa, Artificial Sequence
  Description of Artificial Sequence: Synthetic peptide
DEEEIRTTNPVATEQYGSVSTNLQFGNF

SEQ ID NO: 3318 - protein, 28 aa, Artificial Sequence
  Description of Artificial Sequence: Synthetic peptide
DEEEIRTTNPVATEQYGSWSTNLQRGNP

SEQ ID NO: 3319 - protein, 28 aa, Artificial Sequence
  Description of Artificial Sequence: Synthetic peptide
DEEEIRTTNPVATEQYGEVSTNLQWGNR

SEQ ID NO: 3320 - protein, 29 aa, Artificial Sequence
  Description of Artificial Sequence: Synthetic peptide
DEEEIRTTNPVATEQYGSVSTNEQRGENR

SEQ ID NO: 3321 - protein, 28 aa, Artificial Sequence
  Description of Artificial Sequence: Synthetic peptide
DEEEIRTTNPVATEQYGSVSTALQRGNQ

SEQ ID NO: 3322 - protein, 29 aa, Artificial Sequence
  Description of Artificial Sequence: Synthetic peptide
DEEEIRTTNPVATEQYGSVSTNLQRGVNF

SEQ ID NO: 3323 - protein, 28 aa, Artificial Sequence
  Description of Artificial Sequence: Synthetic peptide
DEEEIRTTNPVATEQYGSVSTALQRGNF

SEQ ID NO: 3324 - protein, 28 aa, Artificial Sequence
  Description of Artificial Sequence: Synthetic peptide
DEEEIRTTNPVATEQYGTVSTNLQRGNA

SEQ ID NO: 3325 - protein, 28 aa, Artificial Sequence
  Description of Artificial Sequence: Synthetic peptide
DEEEIRCTNPVATEQYGSTSTNLQRGNR

SEQ ID NO: 3326 - protein, 28 aa, Artificial Sequence
  Description of Artificial Sequence: Synthetic peptide
DEEEIRTTNPVATEQYGSGSTALQRGNR

SEQ ID NO: 3327 - protein, 28 aa, Artificial Sequence
  Description of Artificial Sequence: Synthetic peptide
DEEEIWTTNPVATEQYGSVSTNLDRGNR

SEQ ID NO: 3328 - protein, 28 aa, Artificial Sequence
  Description of Artificial Sequence: Synthetic peptide
DEEEIRTTNPVATEQYGDVSTVLQRGNR

SEQ ID NO: 3329 - protein, 28 aa, Artificial Sequence
  Description of Artificial Sequence: Synthetic peptide
DEEEIRTTNPVATEQYGVVGTNLQRGNR

SEQ ID NO: 3330 - protein, 29 aa, Artificial Sequence
  Description of Artificial Sequence: Synthetic peptide
DEEEIRTTNPVATEQYGSVSENPLQRGNR

SEQ ID NO: 3331 - protein, 29 aa, Artificial Sequence
  Description of Artificial Sequence: Synthetic peptide
DEEEIRTTNPVATEQYGSVSTMNLQRGNA

SEQ ID NO: 3332 - protein, 29 aa, Artificial Sequence
  Description of Artificial Sequence: Synthetic peptide
DEEEIRTTNPVATEQYGSVSTNLVQIGNR

SEQ ID NO: 3333 - protein, 28 aa, Artificial Sequence
  Description of Artificial Sequence: Synthetic peptide
DEEEIRTTNPVATETYGSVSTNLQRGNI

SEQ ID NO: 3334 - protein, 28 aa, Artificial Sequence
  Description of Artificial Sequence: Synthetic peptide
DEEEIMTTNPVATEQYGSVSDNLQRGNR

SEQ ID NO: 3335 - protein, 28 aa, Artificial Sequence
  Description of Artificial Sequence: Synthetic peptide
DEEEIRTTNPVATEQYGDVSTNYQRGNR

SEQ ID NO: 3336 - protein, 29 aa, Artificial Sequence
  Description of Artificial Sequence: Synthetic peptide
DEEEIRTTNPVATEQYGSVSTMNPQRGNR

SEQ ID NO: 3337 - protein, 28 aa, Artificial Sequence
  Description of Artificial Sequence: Synthetic peptide
SEEEIRTTNPVATEMYGSVSTNLQRGNR

SEQ ID NO: 3338 - protein, 28 aa, Artificial Sequence
  Description of Artificial Sequence: Synthetic peptide
DEEEIATTNPVATEQYGSVSTNLQRENR

SEQ ID NO: 3339 - protein, 29 aa, Artificial Sequence
  Description of Artificial Sequence: Synthetic peptide
DEEEIRTTNPVATEQYGSVISTNLQNGNR

SEQ ID NO: 3340 - protein, 28 aa, Artificial Sequence
  Description of Artificial Sequence: Synthetic peptide
DEEEIRTTNPVATEQYGSVSENLLRGNR

SEQ ID NO: 3341 - protein, 28 aa, Artificial Sequence
  Description of Artificial Sequence: Synthetic peptide
DEEEIRTTNPVATEQYGSVSDVLQRGNR

SEQ ID NO: 3342 - protein, 29 aa, Artificial Sequence
  Description of Artificial Sequence: Synthetic peptide
DEEEIRTTNPVATEQYGSVSTNLQNEGNR

SEQ ID NO: 3343 - protein, 29 aa, Artificial Sequence
  Description of Artificial Sequence: Synthetic peptide
DETEIRTTNPVATEQYGSVSTNLQCRGNR

SEQ ID NO: 3344 - protein, 30 aa, Artificial Sequence
  Description of Artificial Sequence: Synthetic polypeptide
DEEEIRTTNPVATEQYGSVSTDNLQDRGNR

SEQ ID NO: 3345 - protein, 29 aa, Artificial Sequence
  Description of Artificial Sequence: Synthetic peptide
DEEEIRTTNPVATEQYGSVESTNLQAGNR

SEQ ID NO: 3346 - protein, 29 aa, Artificial Sequence
  Description of Artificial Sequence: Synthetic peptide
DEEEIRTTNPVATEQYGSVSTNDQVRGNR

SEQ ID NO: 3347 - protein, 28 aa, Artificial Sequence
  Description of Artificial Sequence: Synthetic peptide
DEEEIRTTNPVATEQYGSVSTNLQDGNQ

SEQ ID NO: 3348 - protein, 29 aa, Artificial Sequence
  Description of Artificial Sequence: Synthetic peptide
DEEEIRTTNPVATEQYGSVSTNLQTAGNR

SEQ ID NO: 3349 - protein, 28 aa, Artificial Sequence
  Description of Artificial Sequence: Synthetic peptide
DEEEIATTNPVATEQYGSVSTNLMRGNR

SEQ ID NO: 3350 - protein, 28 aa, Artificial Sequence
  Description of Artificial Sequence: Synthetic peptide
DEEEIRTTNPVATEQYGSVSENLQRGNV

SEQ ID NO: 3351 - protein, 29 aa, Artificial Sequence
  Description of Artificial Sequence: Synthetic peptide
DEQEIRTTNPVATEQYGSVSTENLQRGNR

SEQ ID NO: 3352 - protein, 29 aa, Artificial Sequence
  Description of Artificial Sequence: Synthetic peptide
DEEEIRTTNPVATEQYGSVSTNLQNRGNQ

SEQ ID NO: 3353 - protein, 28 aa, Artificial Sequence
  Description of Artificial Sequence: Synthetic peptide
DEEEIRTTNPVATEQYGSVSDNLQRGGR

SEQ ID NO: 3354 - protein, 28 aa, Artificial Sequence
  Description of Artificial Sequence: Synthetic peptide
DEEEIRTTNPVATEQYGSVGTNLQVGNR

SEQ ID NO: 3355 - protein, 28 aa, Artificial Sequence
  Description of Artificial Sequence: Synthetic peptide
DEREIRTVNPVATEQYGSVSTNLQRGNR

SEQ ID NO: 3356 - protein, 29 aa, Artificial Sequence
  Description of Artificial Sequence: Synthetic peptide
DEEEIRTTNPVATEMYGSVSTNLQREGNR

SEQ ID NO: 3357 - protein, 28 aa, Artificial Sequence
  Description of Artificial Sequence: Synthetic peptide
DEEEIRTTNPVATEQYGSVSTNLQSGNS

SEQ ID NO: 3358 - protein, 28 aa, Artificial Sequence
  Description of Artificial Sequence: Synthetic peptide
DEQEIVTTNPVATEQYGSVSTNLQRGNR

SEQ ID NO: 3359 - protein, 29 aa, Artificial Sequence
  Description of Artificial Sequence: Synthetic peptide
DEEEIRTTNPVATEQYGSVSTNQLQRPNR

SEQ ID NO: 3360 - protein, 28 aa, Artificial Sequence
  Description of Artificial Sequence: Synthetic peptide
DEEEIRCTNPVATEQYGSVSTDLQRGNR

SEQ ID NO: 3361 - protein, 28 aa, Artificial Sequence
  Description of Artificial Sequence: Synthetic peptide
DEDEIRTTNPVATEQYGSVGTNLQRGNR

SEQ ID NO: 3362 - protein, 29 aa, Artificial Sequence
  Description of Artificial Sequence: Synthetic peptide
DTEEIRTTNPVATEQYGSVSTNLQRDGNR

SEQ ID NO: 3363 - protein, 28 aa, Artificial Sequence
  Description of Artificial Sequence: Synthetic peptide
DEEEIRTTNPVATEQYGSVWTNLQRFNR

SEQ ID NO: 3364 - protein, 28 aa, Artificial Sequence
  Description of Artificial Sequence: Synthetic peptide
DEEEIRTTNPVATEQYGEVSTNLQRGND

SEQ ID NO: 3365 - protein, 28 aa, Artificial Sequence
  Description of Artificial Sequence: Synthetic peptide
DEEEIRATNPVATEQYGSVSTNLQHGNR

SEQ ID NO: 3366 - protein, 29 aa, Artificial Sequence
  Description of Artificial Sequence: Synthetic peptide
DEEEIRTTNPVATEQYGSVSTNLQLRGNA

SEQ ID NO: 3367 - protein, 30 aa, Artificial Sequence
  Description of Artificial Sequence: Synthetic polypeptide
DEEEIRTTNPVATEQYGSVSTNILQWRGNR

SEQ ID NO: 3368 - protein, 28 aa, Artificial Sequence
  Description of Artificial Sequence: Synthetic peptide
DEEEIRTTNPVATEQYGSVSTNLQRGVT

SEQ ID NO: 3369 - protein, 28 aa, Artificial Sequence
  Description of Artificial Sequence: Synthetic peptide
DEEEIRCTNPVATECYGSVSTNLQRGNR

SEQ ID NO: 3370 - protein, 29 aa, Artificial Sequence
  Description of Artificial Sequence: Synthetic peptide
GEEEIRTTNPVATEQYGSVSTNGLQRGNR

SEQ ID NO: 3371 - protein, 28 aa, Artificial Sequence
  Description of Artificial Sequence: Synthetic peptide
DEEEIRTTNPVATEQYGSVSTNLQRGPQ

SEQ ID NO: 3372 - protein, 28 aa, Artificial Sequence
  Description of Artificial Sequence: Synthetic peptide
DNEEIRQTNPVATEQYGSVSTNLQRGNR

SEQ ID NO: 3373 - protein, 29 aa, Artificial Sequence
  Description of Artificial Sequence: Synthetic peptide
DDEEIRTTNPVATEQYGSVSTNLQRGSNR

SEQ ID NO: 3374 - protein, 28 aa, Artificial Sequence
  Description of Artificial Sequence: Synthetic peptide
DEEEIRTTNPVATEQYGSVSENLQVGNR

SEQ ID NO: 3375 - protein, 28 aa, Artificial Sequence
  Description of Artificial Sequence: Synthetic peptide
DEEEIRATNPVATEQYGSVSTNEQRGNR

SEQ ID NO: 3376 - protein, 30 aa, Artificial Sequence
  Description of Artificial Sequence: Synthetic polypeptide
DEEEIRTTNPVATEQYGSVDSTNLQVRGNR

SEQ ID NO: 3377 - protein, 28 aa, Artificial Sequence
  Description of Artificial Sequence: Synthetic peptide
DEEEIRTTNPVATEQYGSVSTNLQVGNH

SEQ ID NO: 3378 - protein, 28 aa, Artificial Sequence
  Description of Artificial Sequence: Synthetic peptide
DEEEIGTTNPVATEQYGDVSTNLQRGNR

SEQ ID NO: 3379 - protein, 28 aa, Artificial Sequence
  Description of Artificial Sequence: Synthetic peptide
DEEEIRTTNPVATEQYGSVSTEDQRGNR

SEQ ID NO: 3380 - protein, 30 aa, Artificial Sequence
  Description of Artificial Sequence: Synthetic polypeptide
DEEEIRTTNPVATEQYGSVSTNPLQREGNR

SEQ ID NO: 3381 - protein, 28 aa, Artificial Sequence
  Description of Artificial Sequence: Synthetic peptide
DEEEIRTTNPVATEIYGSVSTNLQRGDR

SEQ ID NO: 3382 - protein, 28 aa, Artificial Sequence
  Description of Artificial Sequence: Synthetic peptide
DEEEIRATNPVATEQYGSVSTNLQRGNF

SEQ ID NO: 3383 - protein, 28 aa, Artificial Sequence
  Description of Artificial Sequence: Synthetic peptide
DEEEIRATNPVATEQYGSVSTNLQRGNQ

SEQ ID NO: 3384 - protein, 29 aa, Artificial Sequence
  Description of Artificial Sequence: Synthetic peptide
DEEMIRTTNPVATEQYGSVSTNLQIRGNR

SEQ ID NO: 3385 - protein, 28 aa, Artificial Sequence
  Description of Artificial Sequence: Synthetic peptide
DEEEIRTTNPVATELYGSVSTNLQRGNN

SEQ ID NO: 3386 - protein, 28 aa, Artificial Sequence
  Description of Artificial Sequence: Synthetic peptide
DEEEIRTTNIVATEQYGGVSTNLQRGNR

SEQ ID NO: 3387 - protein, 28 aa, Artificial Sequence
  Description of Artificial Sequence: Synthetic peptide
DEEEIRTTNPVATEQYGSVSTNEQVGNR

SEQ ID NO: 3388 - protein, 28 aa, Artificial Sequence
  Description of Artificial Sequence: Synthetic peptide
DDEEIRTTNIVATEQYGSVSTNLQRGNR

SEQ ID NO: 3389 - protein, 28 aa, Artificial Sequence
  Description of Artificial Sequence: Synthetic peptide
DEEEIRTTNPVATEQYGDVSDNLQRGNR

SEQ ID NO: 3390 - protein, 28 aa, Artificial Sequence
  Description of Artificial Sequence: Synthetic peptide
DEEEIRTTNPVATEQYGSVSTNLVEGNR

SEQ ID NO: 3391 - protein, 30 aa, Artificial Sequence
  Description of Artificial Sequence: Synthetic polypeptide
DEEEIRTTNPVATEQYGSVTSTMNLQRGNR

SEQ ID NO: 3392 - protein, 28 aa, Artificial Sequence
  Description of Artificial Sequence: Synthetic peptide
DEEEIRTTNIVATEQYGSVSTNVQRGNR

SEQ ID NO: 3393 - protein, 28 aa, Artificial Sequence
  Description of Artificial Sequence: Synthetic peptide
DEEEIRCTNPVATEQYGSVSTELQRGNR

SEQ ID NO: 3394 - protein, 28 aa, Artificial Sequence
  Description of Artificial Sequence: Synthetic peptide
DEEEIRTTNPVATEQYGYVSDNLQRGNR

SEQ ID NO: 3395 - protein, 28 aa, Artificial Sequence
  Description of Artificial Sequence: Synthetic peptide
DEEEIRTTNPVATEQYGSVSTELQRGNI

SEQ ID NO: 3396 - protein, 28 aa, Artificial Sequence
  Description of Artificial Sequence: Synthetic peptide
DEEEIRTTNPVATEQYGSYSENLQRGNR

SEQ ID NO: 3397 - protein, 29 aa, Artificial Sequence
  Description of Artificial Sequence: Synthetic peptide
DEEEIRTTNPVATEQYGSVSTNLQRAGNQ

SEQ ID NO: 3398 - protein, 28 aa, Artificial Sequence
  Description of Artificial Sequence: Synthetic peptide
DEEEIRCTNPVATEQYGSVSTNLQRGNA

SEQ ID NO: 3399 - protein, 28 aa, Artificial Sequence
  Description of Artificial Sequence: Synthetic peptide
DEEEIRTTNPVATEQYGSVSFNLQQGNR

SEQ ID NO: 3400 - protein, 28 aa, Artificial Sequence
  Description of Artificial Sequence: Synthetic peptide
NEEEIRTTNPVATEQYGSVSTNLQRGNL

SEQ ID NO: 3401 - protein, 28 aa, Artificial Sequence
  Description of Artificial Sequence: Synthetic peptide
DEEEIRTTNPVATEQYGSVSEGLQRGNR

SEQ ID NO: 3402 - protein, 28 aa, Artificial Sequence
  Description of Artificial Sequence: Synthetic peptide
DEEEIVTTNPVATEQYGSVSTNLQRGAR

SEQ ID NO: 3403 - protein, 30 aa, Artificial Sequence
  Description of Artificial Sequence: Synthetic polypeptide
DEEEIRTTNPVATEQYGSVSCTMNLQRGNR

SEQ ID NO: 3404 - protein, 28 aa, Artificial Sequence
  Description of Artificial Sequence: Synthetic peptide
DEEEIRTTNPVATEQYGSVSTALQRGNV

SEQ ID NO: 3405 - protein, 29 aa, Artificial Sequence
  Description of Artificial Sequence: Synthetic peptide
DEEEIRTTNPVATEQYGSVSTLNLQRGNM

SEQ ID NO: 3406 - protein, 28 aa, Artificial Sequence
  Description of Artificial Sequence: Synthetic peptide
DEEEIRTTNPVATEQYGSVETNLQFGNR

SEQ ID NO: 3407 - protein, 28 aa, Artificial Sequence
  Description of Artificial Sequence: Synthetic peptide
DEEEIRTTNPVATEQYGSVSTNLCRGNC

SEQ ID NO: 3408 - protein, 28 aa, Artificial Sequence
  Description of Artificial Sequence: Synthetic peptide
DEEEIRTTNPVATQQYGSVSTNDQRGNR

SEQ ID NO: 3409 - protein, 29 aa, Artificial Sequence
  Description of Artificial Sequence: Synthetic peptide
DEEEIRTTNPYATEQYGSVSTNLQRAGNR

SEQ ID NO: 3410 - protein, 28 aa, Artificial Sequence
  Description of Artificial Sequence: Synthetic peptide
DEEEIRTTNPVCTEQYGSVSTNQQRGNR

SEQ ID NO: 3411 - protein, 29 aa, Artificial Sequence
  Description of Artificial Sequence: Synthetic peptide
DEEEIRTTNPVATEQYGSVSTMNLQRGER

SEQ ID NO: 3412 - protein, 28 aa, Artificial Sequence
  Description of Artificial Sequence: Synthetic peptide
DEEEIATTNPVATEQYGSVSTNLQRGNL

SEQ ID NO: 3413 - protein, 28 aa, Artificial Sequence
  Description of Artificial Sequence: Synthetic peptide
DPEEIRTTNPVATEQYGSVSTNLQRGNE

SEQ ID NO: 3414 - protein, 28 aa, Artificial Sequence
  Description of Artificial Sequence: Synthetic peptide
GEEEIRTTNPVATEQYGSVSTNLERGNR

SEQ ID NO: 3415 - protein, 28 aa, Artificial Sequence
  Description of Artificial Sequence: Synthetic peptide
DEEEIRCTNPVATEQYGSVSTNLQRVNR

SEQ ID NO: 3416 - protein, 28 aa, Artificial Sequence
  Description of Artificial Sequence: Synthetic peptide
DEEEIRTTNPVATEQYGSWSTGLQRGNR

SEQ ID NO: 3417 - protein, 28 aa, Artificial Sequence
  Description of Artificial Sequence: Synthetic peptide
DEEEIATCNPVATEQYGSVSTNLQRGNR

SEQ ID NO: 3418 - protein, 28 aa, Artificial Sequence
  Description of Artificial Sequence: Synthetic peptide
DEDEIRTTNIVATEQYGSVSTNLQRGNR

SEQ ID NO: 3419 - protein, 28 aa, Artificial Sequence
  Description of Artificial Sequence: Synthetic peptide
DEEEIRTTNIVASEQYGSVSTNLQRGNR

SEQ ID NO: 3420 - protein, 29 aa, Artificial Sequence
  Description of Artificial Sequence: Synthetic peptide
DEEEIRTTNPVATEQYGSVSTNLERGENR

SEQ ID NO: 3421 - protein, 28 aa, Artificial Sequence
  Description of Artificial Sequence: Synthetic peptide
DEEEISTTNPVATEQYGDVSTNLQRGNR

SEQ ID NO: 3422 - protein, 29 aa, Artificial Sequence
  Description of Artificial Sequence: Synthetic peptide
DEEEIRTTNPVATEQYGSVSTNLQSGVNR

SEQ ID NO: 3423 - protein, 28 aa, Artificial Sequence
  Description of Artificial Sequence: Synthetic peptide
DEEEIRTTNPVATEQYGCVSTNDQRGNR

SEQ ID NO: 3424 - protein, 30 aa, Artificial Sequence
  Description of Artificial Sequence: Synthetic polypeptide
DEEEIRTTNPVATEQYGSVSTLNLQPRGNR

SEQ ID NO: 3425 - protein, 28 aa, Artificial Sequence
  Description of Artificial Sequence: Synthetic peptide
DDEEIRTTNPVATEQYGSVSDNLQRGNR

SEQ ID NO: 3426 - protein, 28 aa, Artificial Sequence
  Description of Artificial Sequence: Synthetic peptide
DEEEIRTTNPVATEQYGSASTNLQRGNK

SEQ ID NO: 3427 - protein, 28 aa, Artificial Sequence
  Description of Artificial Sequence: Synthetic peptide
DEEEIRTTNPVATEQYGSVSTNQQRGNA

SEQ ID NO: 3428 - protein, 28 aa, Artificial Sequence
  Description of Artificial Sequence: Synthetic peptide
NEEEIITTNPVATEQYGSVSTNLQRGNR

SEQ ID NO: 3429 - protein, 28 aa, Artificial Sequence
  Description of Artificial Sequence: Synthetic peptide
DEEEIRTTNPVATMQYGSVSTNLQRVNR

SEQ ID NO: 3430 - protein, 28 aa, Artificial Sequence
  Description of Artificial Sequence: Synthetic peptide
DEEEIRTVNPVATEQYGSVSTNLQRGNV

SEQ ID NO: 3431 - protein, 28 aa, Artificial Sequence
  Description of Artificial Sequence: Synthetic peptide
DEEEICTTNPVATEQYGSVSDNLQRGNR

SEQ ID NO: 3432 - protein, 29 aa, Artificial Sequence
  Description of Artificial Sequence: Synthetic peptide
DEEEIRTTNPVATEQYGSVSTNLQTRGER

SEQ ID NO: 3433 - protein, 29 aa, Artificial Sequence
  Description of Artificial Sequence: Synthetic peptide
DEEEIRTTNPVATEQYGSVSTNVQRVGNR

SEQ ID NO: 3434 - protein, 29 aa, Artificial Sequence
  Description of Artificial Sequence: Synthetic peptide
DEEEIRTTNPVATEQYGSVSTNLQDRGNS

SEQ ID NO: 3435 - protein, 29 aa, Artificial Sequence
  Description of Artificial Sequence: Synthetic peptide
DEEEIKTTNPVATEQYGSVSTQNLQRGNR

SEQ ID NO: 3436 - protein, 28 aa, Artificial Sequence
  Description of Artificial Sequence: Synthetic peptide
DEEEIRTTNPVATECYGSVSTNLQTGNR

SEQ ID NO: 3437 - protein, 28 aa, Artificial Sequence
  Description of Artificial Sequence: Synthetic peptide
DEEEIRTTNPVATEQYGSVSEILQRGNR

SEQ ID NO: 3438 - protein, 28 aa, Artificial Sequence
  Description of Artificial Sequence: Synthetic peptide
DEEEIRATNPVATEQYGGVSTNLQRGNR

SEQ ID NO: 3439 - protein, 28 aa, Artificial Sequence
  Description of Artificial Sequence: Synthetic peptide
DEEEIRTTNPVATEQYGSVPENLQRGNR

SEQ ID NO: 3440 - protein, 28 aa, Artificial Sequence
  Description of Artificial Sequence: Synthetic peptide
NEEEIRTTNPVATEQYGSVSTNLQRGLR

SEQ ID NO: 3441 - protein, 29 aa, Artificial Sequence
  Description of Artificial Sequence: Synthetic peptide
DEEEIRTTNPVATEQYGSVSTNLQRGDDR

SEQ ID NO: 3442 - protein, 29 aa, Artificial Sequence
  Description of Artificial Sequence: Synthetic peptide
DEEEIRTTNPVATEQYGSVSTPNLQRGPR

SEQ ID NO: 3443 - protein, 28 aa, Artificial Sequence
  Description of Artificial Sequence: Synthetic peptide
DEEEIRTTNPVATEQYGVVATNLQRGNR

SEQ ID NO: 3444 - protein, 28 aa, Artificial Sequence
  Description of Artificial Sequence: Synthetic peptide
DEEEIRTTNPVATEWYGSVSTNLQRGNQ

SEQ ID NO: 3445 - protein, 29 aa, Artificial Sequence
  Description of Artificial Sequence: Synthetic peptide
DEEEIRTTNPVATEQYGSVSITNLQRGNP

SEQ ID NO: 3446 - protein, 28 aa, Artificial Sequence
  Description of Artificial Sequence: Synthetic peptide
DEEEIRCTNPVATEQYGSVSDNLQRGNR

SEQ ID NO: 3447 - protein, 28 aa, Artificial Sequence
  Description of Artificial Sequence: Synthetic peptide
DEEEIRTTNPVATEQYGSVSTNQQRGNI

SEQ ID NO: 3448 - protein, 28 aa, Artificial Sequence
  Description of Artificial Sequence: Synthetic peptide
FEEEIRTTNPVATEQYGSCSTNLQRGNR

SEQ ID NO: 3449 - protein, 28 aa, Artificial Sequence
  Description of Artificial Sequence: Synthetic peptide
DESEIRTTNPVATEQYGSVSTNLQRGNQ

SEQ ID NO: 3450 - protein, 29 aa, Artificial Sequence
  Description of Artificial Sequence: Synthetic peptide
DEEEIRTTNPVATEQYGSVSTNLQQRGNA

SEQ ID NO: 3451 - protein, 30 aa, Artificial Sequence
  Description of Artificial Sequence: Synthetic polypeptide
DEEEIRTTNPVATEQYGSVSDTQNLQRGNR

SEQ ID NO: 3452 - protein, 28 aa, Artificial Sequence
  Description of Artificial Sequence: Synthetic peptide
DEEEIRTTNPVATECYGSVSTNLQRGNH

SEQ ID NO: 3453 - protein, 28 aa, Artificial Sequence
  Description of Artificial Sequence: Synthetic peptide
DEEEIATTNPVATEQYGSVSTNLQAGNR

SEQ ID NO: 3454 - protein, 30 aa, Artificial Sequence
  Description of Artificial Sequence: Synthetic polypeptide
DEEEIRTTNPVATEQYWGSVSTNLQRDGNR

SEQ ID NO: 3455 - protein, 29 aa, Artificial Sequence
  Description of Artificial Sequence: Synthetic peptide
DEEEIRTTNPVATEQYGSVSTNLQQRGNH

SEQ ID NO: 3456 - protein, 28 aa, Artificial Sequence
  Description of Artificial Sequence: Synthetic peptide
DEEEIRTTNPVATEQYGSVGTNLQQGNR

SEQ ID NO: 3457 - protein, 28 aa, Artificial Sequence
  Description of Artificial Sequence: Synthetic peptide
DEEEIRTTNPVATEQFGSVSTNLQRGNV

SEQ ID NO: 3458 - protein, 28 aa, Artificial Sequence
  Description of Artificial Sequence: Synthetic peptide
DEEEIRTTNPVATEQYGSVSTNLQLGNF

SEQ ID NO: 3459 - protein, 29 aa, Artificial Sequence
  Description of Artificial Sequence: Synthetic peptide
DEEEIRTTNPVATEQYGSVSTGLVQRGNR

SEQ ID NO: 3460 - protein, 28 aa, Artificial Sequence
  Description of Artificial Sequence: Synthetic peptide
DEEEIRTTNPVATEQYGSVSTNEQRGNY

SEQ ID NO: 3461 - protein, 28 aa, Artificial Sequence
  Description of Artificial Sequence: Synthetic peptide
DEEEIRTTNIVATEQYGSVSCNLQRGNR

SEQ ID NO: 3462 - protein, 28 aa, Artificial Sequence
  Description of Artificial Sequence: Synthetic peptide
DEEEIRTTNPVATEQYGSVGTNLQRGMR

SEQ ID NO: 3463 - protein, 28 aa, Artificial Sequence
  Description of Artificial Sequence: Synthetic peptide
DEEEIRTTNPVATEQYGSVSENLQRMNR

SEQ ID NO: 3464 - protein, 28 aa, Artificial Sequence
  Description of Artificial Sequence: Synthetic peptide
DEEEIRTTNPVATENYGSVSTVLQRGNR

SEQ ID NO: 3465 - protein, 28 aa, Artificial Sequence
  Description of Artificial Sequence: Synthetic peptide
DEEEIRTTNPVATEQYGFVSTNLQQGNR

SEQ ID NO: 3466 - protein, 28 aa, Artificial Sequence
  Description of Artificial Sequence: Synthetic peptide
KEEEIRTTNPVATEQYGSVSTNLQHGNR

SEQ ID NO: 3467 - protein, 28 aa, Artificial Sequence
  Description of Artificial Sequence: Synthetic peptide
EEEEIRTTNPVATEQYGSASTNLQRGNR

SEQ ID NO: 3468 - protein, 28 aa, Artificial Sequence
  Description of Artificial Sequence: Synthetic peptide
DEEEICTTNPVATEQYGSVSTNLQRGNL

SEQ ID NO: 3469 - protein, 28 aa, Artificial Sequence
  Description of Artificial Sequence: Synthetic peptide
DEEEIRTTNPVATEQYGTASTNLQRGNR

SEQ ID NO: 3470 - protein, 28 aa, Artificial Sequence
  Description of Artificial Sequence: Synthetic peptide
DEEEIRTTNPTATEQYGSVSTNEQRGNR

SEQ ID NO: 3471 - protein, 29 aa, Artificial Sequence
  Description of Artificial Sequence: Synthetic peptide
DEEEIRTTNPVATEQYGSVSTNLQMGNIR

SEQ ID NO: 3472 - protein, 28 aa, Artificial Sequence
  Description of Artificial Sequence: Synthetic peptide
DEEEIRTTNPVATEQYGSVSTNLQIGNL

SEQ ID NO: 3473 - protein, 28 aa, Artificial Sequence
  Description of Artificial Sequence: Synthetic peptide
DEEEIRTCNPVATEQYGSVSTNLQRDNR

SEQ ID NO: 3474 - protein, 28 aa, Artificial Sequence
  Description of Artificial Sequence: Synthetic peptide
DEEEIRTTNPVATEQYGAVSTNLQRGNA

SEQ ID NO: 3475 - protein, 28 aa, Artificial Sequence
  Description of Artificial Sequence: Synthetic peptide
DEEEIRTTNPVATEQYGSVSTALFRGNR

SEQ ID NO: 3476 - protein, 29 aa, Artificial Sequence
  Description of Artificial Sequence: Synthetic peptide
DEEEIRTTNPVATEQYGSVSMNLQQRGNR

SEQ ID NO: 3477 - protein, 28 aa, Artificial Sequence
  Description of Artificial Sequence: Synthetic peptide
DEEEIRTTNPVATEIYGSVSTNLQRLNR

SEQ ID NO: 3478 - protein, 28 aa, Artificial Sequence
  Description of Artificial Sequence: Synthetic peptide
DEEEIRTTNPVATEQYGSVSTNLDHGNR

SEQ ID NO: 3479 - protein, 28 aa, Artificial Sequence
  Description of Artificial Sequence: Synthetic peptide
DEEEIRTTNPVATDQYGSVSTNLLRGNR

SEQ ID NO: 3480 - protein, 28 aa, Artificial Sequence
  Description of Artificial Sequence: Synthetic peptide
DEEEIATTNPVATEQYGSVSTNLQRGPR

SEQ ID NO: 3481 - protein, 28 aa, Artificial Sequence
  Description of Artificial Sequence: Synthetic peptide
DEEEIRTTNPFATEQYGTVSTNLQRGNR

SEQ ID NO: 3482 - protein, 28 aa, Artificial Sequence
  Description of Artificial Sequence: Synthetic peptide
DEEEIRTTNPVATEQYGEVSTNLQRGMR

SEQ ID NO: 3483 - protein, 29 aa, Artificial Sequence
  Description of Artificial Sequence: Synthetic peptide
DEEEIRTTNPVATEQYGSVSTNLQPDGNR

SEQ ID NO: 3484 - protein, 28 aa, Artificial Sequence
  Description of Artificial Sequence: Synthetic peptide
DEEEIRSTNPVATEQYGSASTNLQRGNR

SEQ ID NO: 3485 - protein, 28 aa, Artificial Sequence
  Description of Artificial Sequence: Synthetic peptide
DEEEIRTTNPVATEQYGSVDTNLDRGNR

SEQ ID NO: 3486 - protein, 29 aa, Artificial Sequence
  Description of Artificial Sequence: Synthetic peptide
DEEEIRSTNPVATEQYGSVSTNLQRGNPR

SEQ ID NO: 3487 - protein, 28 aa, Artificial Sequence
  Description of Artificial Sequence: Synthetic peptide
HEEEIRTTNPVATECYGSVSTNLQRGNR

SEQ ID NO: 3488 - protein, 28 aa, Artificial Sequence
  Description of Artificial Sequence: Synthetic peptide
KEEEIRTTNPVATEQYGSVSTNLQNGNR

SEQ ID NO: 3489 - protein, 29 aa, Artificial Sequence
  Description of Artificial Sequence: Synthetic peptide
DEEEIRTTNPVATEQYGMVSTMNLQRGNR

SEQ ID NO: 3490 - protein, 28 aa, Artificial Sequence
  Description of Artificial Sequence: Synthetic peptide
NEEEIRTTNPVATEQYGDVSTNLQRGNR

SEQ ID NO: 3491 - protein, 28 aa, Artificial Sequence
  Description of Artificial Sequence: Synthetic peptide
DEEEIRTTNPVATEVYGCVSTNLQRGNR

SEQ ID NO: 3492 - protein, 28 aa, Artificial Sequence
  Description of Artificial Sequence: Synthetic peptide
DEEEIRTTNPVATEQYGDVSTELQRGNR

SEQ ID NO: 3493 - protein, 28 aa, Artificial Sequence
  Description of Artificial Sequence: Synthetic peptide
QEEEIRTTNPVATEGYGSVSTNLQRGNR

SEQ ID NO: 3494 - protein, 28 aa, Artificial Sequence
  Description of Artificial Sequence: Synthetic peptide
DEEEITTTNPVATEQYGSVSTNLQRGNG

SEQ ID NO: 3495 - protein, 29 aa, Artificial Sequence
  Description of Artificial Sequence: Synthetic peptide
DEEEIRTTNPVATEQYGSVSCTNLQRGNV

SEQ ID NO: 3496 - protein, 28 aa, Artificial Sequence
  Description of Artificial Sequence: Synthetic peptide
SEEEIRTTNPVATEQYGSVSTNLQRGNP

SEQ ID NO: 3497 - protein, 28 aa, Artificial Sequence
  Description of Artificial Sequence: Synthetic peptide
DEEEIRTVNPVATEIYGSVSTNLQRGNR

SEQ ID NO: 3498 - protein, 29 aa, Artificial Sequence
  Description of Artificial Sequence: Synthetic peptide
DEEEIRTTNPVSTEQYGSVSVTNLQRGNR

SEQ ID NO: 3499 - protein, 29 aa, Artificial Sequence
  Description of Artificial Sequence: Synthetic peptide
DEEEIRTTNPVATEQYGSVSANLPQRGNR

SEQ ID NO: 3500 - protein, 28 aa, Artificial Sequence
  Description of Artificial Sequence: Synthetic peptide
DEEEIRTTNPVATEQYGSVSTHLQRGNS

SEQ ID NO: 3501 - protein, 28 aa, Artificial Sequence
  Description of Artificial Sequence: Synthetic peptide
DEEEIRTTNPVATEQYGSVPTNLQRGNL

SEQ ID NO: 3502 - protein, 28 aa, Artificial Sequence
  Description of Artificial Sequence: Synthetic peptide
DEEEIATTNPVSTEQYGSVSTNLQRGNR

SEQ ID NO: 3503 - protein, 29 aa, Artificial Sequence
  Description of Artificial Sequence: Synthetic peptide
DEEEIRTTNPVATECYGSVSTNLQDRGNR

SEQ ID NO: 3504 - protein, 30 aa, Artificial Sequence
  Description of Artificial Sequence: Synthetic polypeptide
DEEEIRTTNPVATEQYGSVSDTNLQLRGNR

SEQ ID NO: 3505 - protein, 28 aa, Artificial Sequence
  Description of Artificial Sequence: Synthetic peptide
DEEEIRTTNPVATEQYGSVSENLQRGNM

SEQ ID NO: 3506 - protein, 29 aa, Artificial Sequence
  Description of Artificial Sequence: Synthetic peptide
DEEEIRTTNPVATEQYGSVSTNLQNRGNM

SEQ ID NO: 3507 - protein, 29 aa, Artificial Sequence
  Description of Artificial Sequence: Synthetic peptide
DEEEIRTTNPVATEQYGSVSTNLQDKGNR

SEQ ID NO: 3508 - protein, 28 aa, Artificial Sequence
  Description of Artificial Sequence: Synthetic peptide
DEEEIATTNPVATEIYGSVSTNLQRGNR

SEQ ID NO: 3509 - protein, 29 aa, Artificial Sequence
  Description of Artificial Sequence: Synthetic peptide
DEEEIRTVNPVATEQYGSVSTNLQRAGNR

SEQ ID NO: 3510 - protein, 28 aa, Artificial Sequence
  Description of Artificial Sequence: Synthetic peptide
DEEEIRTTNPVATEQYGSVSTNWQRGNF

SEQ ID NO: 3511 - protein, 28 aa, Artificial Sequence
  Description of Artificial Sequence: Synthetic peptide
DEEEVRCTNPVATEQYGSVSTNLQRGNR

SEQ ID NO: 3512 - protein, 28 aa, Artificial Sequence
  Description of Artificial Sequence: Synthetic peptide
DEEEIRTTNPVATEQFGSVSTDLQRGNR

SEQ ID NO: 3513 - protein, 28 aa, Artificial Sequence
  Description of Artificial Sequence: Synthetic peptide
DEEEIRTTNPVATEQYGQVSTNLQRGNL

SEQ ID NO: 3514 - protein, 28 aa, Artificial Sequence
  Description of Artificial Sequence: Synthetic peptide
DEEEIGTTNPVATEQFGSVSTNLQRGNR

SEQ ID NO: 3515 - protein, 28 aa, Artificial Sequence
  Description of Artificial Sequence: Synthetic peptide
DEEEIRTTNPVATEQYGSVSTELQLGNR

SEQ ID NO: 3516 - protein, 28 aa, Artificial Sequence
  Description of Artificial Sequence: Synthetic peptide
DEEEIRTTNIVATEQYGSVSTALQRGNR

SEQ ID NO: 3517 - protein, 30 aa, Artificial Sequence
  Description of Artificial Sequence: Synthetic polypeptide
DEEEIRTTNPVATEQYGESVSTNLQVRGNR

SEQ ID NO: 3518 - protein, 29 aa, Artificial Sequence
  Description of Artificial Sequence: Synthetic peptide
DEEEIRTTNPVATEQYGSVSTMLQRGNNR

SEQ ID NO: 3519 - protein, 29 aa, Artificial Sequence
  Description of Artificial Sequence: Synthetic peptide
DEEEIRTTNPVATEQYGSVSDTNEQRGNR

SEQ ID NO: 3520 - protein, 29 aa, Artificial Sequence
  Description of Artificial Sequence: Synthetic peptide
DEEEIRTTNPVATEQYGSVSTTPLQRGNR

SEQ ID NO: 3521 - protein, 28 aa, Artificial Sequence
  Description of Artificial Sequence: Synthetic peptide
DEEEIRTTNPVCTEQYGNVSTNLQRGNR

SEQ ID NO: 3522 - protein, 29 aa, Artificial Sequence
  Description of Artificial Sequence: Synthetic peptide
DEEEIRTTNPVATEQYGSVSTNQQLRGNR

SEQ ID NO: 3523 - protein, 28 aa, Artificial Sequence
  Description of Artificial Sequence: Synthetic peptide
DEEEIRSTNPVATEHYGSVSTNLQRGNR

SEQ ID NO: 3524 - protein, 29 aa, Artificial Sequence
  Description of Artificial Sequence: Synthetic peptide
DEEEIRTTNPVATEQYGSVDSTNLQDGNR

SEQ ID NO: 3525 - protein, 28 aa, Artificial Sequence
  Description of Artificial Sequence: Synthetic peptide
DEEEITTTNPVATEQYGSASTNLQRGNR

SEQ ID NO: 3526 - protein, 28 aa, Artificial Sequence
  Description of Artificial Sequence: Synthetic peptide
DEAEIRTTNPVATEQYGSVSTNLQRGER

SEQ ID NO: 3527 - protein, 28 aa, Artificial Sequence
  Description of Artificial Sequence: Synthetic peptide
DEEEIRTTNPVATEQYGSVETNLQRGSR

SEQ ID NO: 3528 - protein, 28 aa, Artificial Sequence
  Description of Artificial Sequence: Synthetic peptide
DEEEIRTTNPVATEQYGSVSTNLDYGNR

SEQ ID NO: 3529 - protein, 28 aa, Artificial Sequence
  Description of Artificial Sequence: Synthetic peptide
DEEEIVTTNPVATEQYGSVSDNLQRGNR

SEQ ID NO: 3530 - protein, 28 aa, Artificial Sequence
  Description of Artificial Sequence: Synthetic peptide
DEEEIRTTNPVATEQYGSVSTNDQPGNR

SEQ ID NO: 3531 - protein, 28 aa, Artificial Sequence
  Description of Artificial Sequence: Synthetic peptide
DEEEIRTTNPVASEQYGSCSTNLQRGNR

SEQ ID NO: 3532 - protein, 28 aa, Artificial Sequence
  Description of Artificial Sequence: Synthetic peptide
DEEEIRTTNPVATEQYGSVSGNLQRGQR

SEQ ID NO: 3533 - protein, 28 aa, Artificial Sequence
  Description of Artificial Sequence: Synthetic peptide
DENEIRTTNPVATEQYGSVSTNLQRGNF

SEQ ID NO: 3534 - protein, 30 aa, Artificial Sequence
  Description of Artificial Sequence: Synthetic polypeptide
DEEEIRTTNPVATEQYGSVSTCNLQRGENR

SEQ ID NO: 3535 - protein, 28 aa, Artificial Sequence
  Description of Artificial Sequence: Synthetic peptide
DEEEIRTTNPVATEQYGSVSNNLQRGND

SEQ ID NO: 3536 - protein, 28 aa, Artificial Sequence
  Description of Artificial Sequence: Synthetic peptide
DEEEIRTTNPVATEQYGSVTDNLQRGNR

SEQ ID NO: 3537 - protein, 29 aa, Artificial Sequence
  Description of Artificial Sequence: Synthetic peptide
DEEEIRTTNPVATEQYGSVSTNLQFRGND

SEQ ID NO: 3538 - protein, 28 aa, Artificial Sequence
  Description of Artificial Sequence: Synthetic peptide
DEEEIRTTNPVGTEQYGSVSENLQRGNR

SEQ ID NO: 3539 - protein, 28 aa, Artificial Sequence
  Description of Artificial Sequence: Synthetic peptide
DPEEIRTTNPVATEQYGSVSTNLQPGNR

SEQ ID NO: 3540 - protein, 28 aa, Artificial Sequence
  Description of Artificial Sequence: Synthetic peptide
DEEEIRTTNPVGTEQYGSVSTNLQRGTR

SEQ ID NO: 3541 - protein, 28 aa, Artificial Sequence
  Description of Artificial Sequence: Synthetic peptide
DEEEIRTTNPVATEQYGSVSTNLNRGDR

SEQ ID NO: 3542 - protein, 29 aa, Artificial Sequence
  Description of Artificial Sequence: Synthetic peptide
DEEEIRTTNPVATEQYGSVSTDLQVRGNR

SEQ ID NO: 3543 - protein, 29 aa, Artificial Sequence
  Description of Artificial Sequence: Synthetic peptide
DEEEIRTTNPVATEQYGSVDTMNLQRGNR

SEQ ID NO: 3544 - protein, 29 aa, Artificial Sequence
  Description of Artificial Sequence: Synthetic peptide
DEEEIRTTNPVATEQYGSVSETNWQRGNR

SEQ ID NO: 3545 - protein, 29 aa, Artificial Sequence
  Description of Artificial Sequence: Synthetic peptide
DEEEIRTTNPVATEQYGSLVSTNLERGNR

SEQ ID NO: 3546 - protein, 28 aa, Artificial Sequence
  Description of Artificial Sequence: Synthetic peptide
DEEEIRTTNPVAVEQYGSVSTNLQNGNR

SEQ ID NO: 3547 - protein, 28 aa, Artificial Sequence
  Description of Artificial Sequence: Synthetic peptide
KEEEIRTTNPVATEQYGSASTNLQRGNR

SEQ ID NO: 3548 - protein, 28 aa, Artificial Sequence
  Description of Artificial Sequence: Synthetic peptide
DEEEIRQTNPVATEQYGIVSTNLQRGNR

SEQ ID NO: 3549 - protein, 28 aa, Artificial Sequence
  Description of Artificial Sequence: Synthetic peptide
DEEEIRTTNPVATEQYGSVPDNLQRGNR

SEQ ID NO: 3550 - protein, 28 aa, Artificial Sequence
  Description of Artificial Sequence: Synthetic peptide
VEEEIRATNPVATEQYGSVSTNLQRGNR

SEQ ID NO: 3551 - protein, 30 aa, Artificial Sequence
  Description of Artificial Sequence: Synthetic polypeptide
DEEEIRTTNPVATEQYGSVSTNGLQRGPNR

SEQ ID NO: 3552 - protein, 30 aa, Artificial Sequence
  Description of Artificial Sequence: Synthetic polypeptide
DEEEIRTTNPVATEQYGSYVSTNPLQRGNR

SEQ ID NO: 3553 - protein, 29 aa, Artificial Sequence
  Description of Artificial Sequence: Synthetic peptide
DEEEIRTTNPVATEQYGSVSTNLLREGNR

SEQ ID NO: 3554 - protein, 28 aa, Artificial Sequence
  Description of Artificial Sequence: Synthetic peptide
DEEEIRTTNPVATEQYGSVSTPLQRGNE

SEQ ID NO: 3555 - protein, 28 aa, Artificial Sequence
  Description of Artificial Sequence: Synthetic peptide
DEEEIRTTNPVCTEQYGSVSTNLQRGNQ

SEQ ID NO: 3556 - protein, 28 aa, Artificial Sequence
  Description of Artificial Sequence: Synthetic peptide
DEEEIRTTNPVATEQYGSVQTNLDRGNR

SEQ ID NO: 3557 - protein, 28 aa, Artificial Sequence
  Description of Artificial Sequence: Synthetic peptide
DEEEIRTTNPDATEQYGSVSTNLQRGNF

SEQ ID NO: 3558 - protein, 28 aa, Artificial Sequence
  Description of Artificial Sequence: Synthetic peptide
DEEEINTTNPVATEQYGEVSTNLQRGNR

SEQ ID NO: 3559 - protein, 28 aa, Artificial Sequence
  Description of Artificial Sequence: Synthetic peptide
DEEEIRTTNPVATEQYGSVSENLQRGNC

SEQ ID NO: 3560 - protein, 28 aa, Artificial Sequence
  Description of Artificial Sequence: Synthetic peptide
DEEEIRTTNPVATEQYGSVSTNLQIGNA

SEQ ID NO: 3561 - protein, 28 aa, Artificial Sequence
  Description of Artificial Sequence: Synthetic peptide
DEEEIRTVNPVATEQYGSVWTNLQRGNR

SEQ ID NO: 3562 - protein, 28 aa, Artificial Sequence
  Description of Artificial Sequence: Synthetic peptide
DEEEIRTTNPVATEQYGSVSTCLQIGNR

SEQ ID NO: 3563 - protein, 28 aa, Artificial Sequence
  Description of Artificial Sequence: Synthetic peptide
DEEEIRTTNPVATEQWGSVSTNIQRGNR

SEQ ID NO: 3564 - protein, 28 aa, Artificial Sequence
  Description of Artificial Sequence: Synthetic peptide
DEEEIRTTNPVATEQYGSVSTNLMIGNR

SEQ ID NO: 3565 - protein, 28 aa, Artificial Sequence
  Description of Artificial Sequence: Synthetic peptide
DEEEIRTTNPVATQQYGSVSTNLQRGER

SEQ ID NO: 3566 - protein, 28 aa, Artificial Sequence
  Description of Artificial Sequence: Synthetic peptide
DEEEIRTTNPVATEQYGSVSTGLQVGNR

SEQ ID NO: 3567 - protein, 28 aa, Artificial Sequence
  Description of Artificial Sequence: Synthetic peptide
DEEEIRTTNPVATEQWGSVSTNLQGGNR

SEQ ID NO: 3568 - protein, 28 aa, Artificial Sequence
  Description of Artificial Sequence: Synthetic peptide
DEEEIKTTNPVATEQYGTVSTNLQRGNR

SEQ ID NO: 3569 - protein, 28 aa, Artificial Sequence
  Description of Artificial Sequence: Synthetic peptide
DEEEIRTTNPVATEQYGSVSTNLQRSER

SEQ ID NO: 3570 - protein, 28 aa, Artificial Sequence
  Description of Artificial Sequence: Synthetic peptide
DEEEIATTNPFATEQYGSVSTNLQRGNR

SEQ ID NO: 3571 - protein, 28 aa, Artificial Sequence
  Description of Artificial Sequence: Synthetic peptide
DEEEIRQTNPVATEQYGSVSTNLQTGNR

SEQ ID NO: 3572 - protein, 28 aa, Artificial Sequence
  Description of Artificial Sequence: Synthetic peptide
DEEEIRTTNPVATEQYGSVSANLQNGNR

SEQ ID NO: 3573 - protein, 29 aa, Artificial Sequence
  Description of Artificial Sequence: Synthetic peptide
DEEEIRTTNPTATEQYGSVSTNLPQRGNR

SEQ ID NO: 3574 - protein, 28 aa, Artificial Sequence
  Description of Artificial Sequence: Synthetic peptide
DEEEIATTNPVATEQYGSVSTNLQRGNF

SEQ ID NO: 3575 - protein, 30 aa, Artificial Sequence
  Description of Artificial Sequence: Synthetic polypeptide
DEEEIRTTNPVATEQYGSVSVTNLQFRGNR

SEQ ID NO: 3576 - protein, 30 aa, Artificial Sequence
  Description of Artificial Sequence: Synthetic polypeptide
DEEEIRTTNPVATEQYGSVSITNPLQRGNR

SEQ ID NO: 3577 - protein, 29 aa, Artificial Sequence
  Description of Artificial Sequence: Synthetic peptide
DEEEIRTTNPDATEQYGSVSTNLQRGDNR

SEQ ID NO: 3578 - protein, 28 aa, Artificial Sequence
  Description of Artificial Sequence: Synthetic peptide
DEEEIRTVNPVATEQYGSVSENLQRGNR

SEQ ID NO: 3579 - protein, 29 aa, Artificial Sequence
  Description of Artificial Sequence: Synthetic peptide
DEEEIRTTNPVATEQYGSMVSTNLQDGNR

SEQ ID NO: 3580 - protein, 28 aa, Artificial Sequence
  Description of Artificial Sequence: Synthetic peptide
QEEEIRTTNPVATEQYGSVSTNLQNGNR

SEQ ID NO: 3581 - protein, 29 aa, Artificial Sequence
  Description of Artificial Sequence: Synthetic peptide
DEEEIRTTNPVATEQYGSVSTNLQREDNR

SEQ ID NO: 3582 - protein, 28 aa, Artificial Sequence
  Description of Artificial Sequence: Synthetic peptide
DEEEIRTTNPVATEQYGSVSTPDQRGNR

SEQ ID NO: 3583 - protein, 28 aa, Artificial Sequence
  Description of Artificial Sequence: Synthetic peptide
DEEEIRTTNPVATECYGSVSTNLQRGNV

SEQ ID NO: 3584 - protein, 28 aa, Artificial Sequence
  Description of Artificial Sequence: Synthetic peptide
DEEEIRTTNPVATEQYGSVADNLQRGNR

SEQ ID NO: 3585 - protein, 29 aa, Artificial Sequence
  Description of Artificial Sequence: Synthetic peptide
DEEEIRTTNPVATEQYGSVSTNLQEGGNR

SEQ ID NO: 3586 - protein, 28 aa, Artificial Sequence
  Description of Artificial Sequence: Synthetic peptide
DEEEIRTTNPDATEQYGSVSTNDQRGNR

SEQ ID NO: 3587 - protein, 28 aa, Artificial Sequence
  Description of Artificial Sequence: Synthetic peptide
DEEEIRTTNPVATEQYGSVSTNLMRGNQ

SEQ ID NO: 3588 - protein, 28 aa, Artificial Sequence
  Description of Artificial Sequence: Synthetic peptide
DEEEIRTTNPDATEQYGSVSTNLQLGNR

SEQ ID NO: 3589 - protein, 29 aa, Artificial Sequence
  Description of Artificial Sequence: Synthetic peptide
DEEEIRTTNPVATEQYGSVSQTNLQRGNP

SEQ ID NO: 3590 - protein, 29 aa, Artificial Sequence
  Description of Artificial Sequence: Synthetic peptide
DEEEIRTTNPVATEQYGSVSTNLPQRGNP

SEQ ID NO: 3591 - protein, 29 aa, Artificial Sequence
  Description of Artificial Sequence: Synthetic peptide
DEEEIRTTNPVATEQYGSVSTNLQRGQHR

SEQ ID NO: 3592 - protein, 29 aa, Artificial Sequence
  Description of Artificial Sequence: Synthetic peptide
DEEEIRTTNPVATEQYGWVSTNLQERGNR

SEQ ID NO: 3593 - protein, 28 aa, Artificial Sequence
  Description of Artificial Sequence: Synthetic peptide
DEEEIRTTNPLSTEQYGSVSTNLQRGNR

SEQ ID NO: 3594 - protein, 28 aa, Artificial Sequence
  Description of Artificial Sequence: Synthetic peptide
DEEEIRTTNPVATEQYGSVSETLQRGNR

SEQ ID NO: 3595 - protein, 29 aa, Artificial Sequence
  Description of Artificial Sequence: Synthetic peptide
DEEEIATTNPVATEQYGSVSTNLQLRGNR

SEQ ID NO: 3596 - protein, 28 aa, Artificial Sequence
  Description of Artificial Sequence: Synthetic peptide
DEEEITTTNPVATEQYGSVSTNLQRGNQ

SEQ ID NO: 3597 - protein, 28 aa, Artificial Sequence
  Description of Artificial Sequence: Synthetic peptide
DSEEIQTTNPVATEQYGSVSTNLQRGNR

SEQ ID NO: 3598 - protein, 28 aa, Artificial Sequence
  Description of Artificial Sequence: Synthetic peptide
DEEEIRTTNPVATEMYGSVSENLQRGNR

SEQ ID NO: 3599 - protein, 28 aa, Artificial Sequence
  Description of Artificial Sequence: Synthetic peptide
DEEEIRTTNPHATEQYGSVSTGLQRGNR

SEQ ID NO: 3600 - protein, 28 aa, Artificial Sequence
  Description of Artificial Sequence: Synthetic peptide
DEEEIRTTNPVATEQYGSVSTNLIRGND

SEQ ID NO: 3601 - protein, 28 aa, Artificial Sequence
  Description of Artificial Sequence: Synthetic peptide
DEEEICTTNPVATEQYGSVSTNLQRGNH

SEQ ID NO: 3602 - protein, 28 aa, Artificial Sequence
  Description of Artificial Sequence: Synthetic peptide
DEEEIRTTNPVCTEQYGSVSTNLQAGNR

SEQ ID NO: 3603 - protein, 29 aa, Artificial Sequence
  Description of Artificial Sequence: Synthetic peptide
DEEEIRTTNPVATEQYGSASTNLQQRGNR

SEQ ID NO: 3604 - protein, 29 aa, Artificial Sequence
  Description of Artificial Sequence: Synthetic peptide
DEEEIRTTNPVATEQYGSVSTNLQRGNTQ

SEQ ID NO: 3605 - protein, 29 aa, Artificial Sequence
  Description of Artificial Sequence: Synthetic peptide
DEEEIRTTNPVATEQYGSYVSTPLQRGNR

SEQ ID NO: 3606 - protein, 29 aa, Artificial Sequence
  Description of Artificial Sequence: Synthetic peptide
DEEEIRTTNPVATEQYGSVSCTNLQRGNQ

SEQ ID NO: 3607 - protein, 29 aa, Artificial Sequence
  Description of Artificial Sequence: Synthetic peptide
DEEEIRTTNPDATEQYGSVSTNGLQRGNR

SEQ ID NO: 3608 - protein, 29 aa, Artificial Sequence
  Description of Artificial Sequence: Synthetic peptide
DEEEIRTTNPVATEQYGGVSTNLQRGNDR

SEQ ID NO: 3609 - protein, 29 aa, Artificial Sequence
  Description of Artificial Sequence: Synthetic peptide
DEEEIRTTNPVCTEQYGSVSCTNLQRGNR

SEQ ID NO: 3610 - protein, 28 aa, Artificial Sequence
  Description of Artificial Sequence: Synthetic peptide
DDEEIRTTNPVATEQYGSVSTNLQRGNQ

SEQ ID NO: 3611 - protein, 28 aa, Artificial Sequence
  Description of Artificial Sequence: Synthetic peptide
DEEEIRTTNPVAGECYGSVSTNLQRGNR

SEQ ID NO: 3612 - protein, 28 aa, Artificial Sequence
  Description of Artificial Sequence: Synthetic peptide
DEEEIRTTNPVATEQYGSVSANLQRGNY

SEQ ID NO: 3613 - protein, 28 aa, Artificial Sequence
  Description of Artificial Sequence: Synthetic peptide
DENEIRTTNPVATEQYGSVDTNLQRGNR

SEQ ID NO: 3614 - protein, 29 aa, Artificial Sequence
  Description of Artificial Sequence: Synthetic peptide
DEEEIRTTNPVATEQWGSVSITNLQRGNR

SEQ ID NO: 3615 - protein, 28 aa, Artificial Sequence
  Description of Artificial Sequence: Synthetic peptide
DEEEIRTTNPVATEQYGSVSTNLCRGNE

SEQ ID NO: 3616 - protein, 29 aa, Artificial Sequence
  Description of Artificial Sequence: Synthetic peptide
DEEEIRTTNPVATEQYGSVSTNLQHAGNR

SEQ ID NO: 3617 - protein, 28 aa, Artificial Sequence
  Description of Artificial Sequence: Synthetic peptide
DEEEIRTTNPVATEQYGSVSTNEQFGNR

SEQ ID NO: 3618 - protein, 28 aa, Artificial Sequence
  Description of Artificial Sequence: Synthetic peptide
DEEEIVTTNPVATECYGSVSTNLQRGNR

SEQ ID NO: 3619 - protein, 28 aa, Artificial Sequence
  Description of Artificial Sequence: Synthetic peptide
DENEIVTTNPVATEQYGSVSTNLQRGNR

SEQ ID NO: 3620 - protein, 28 aa, Artificial Sequence
  Description of Artificial Sequence: Synthetic peptide
DEEEIRSTNPVATEQYGSVSTDLQRGNR

SEQ ID NO: 3621 - protein, 28 aa, Artificial Sequence
  Description of Artificial Sequence: Synthetic peptide
DEVEIRTTNPVATETYGSVSTNLQRGNR

SEQ ID NO: 3622 - protein, 28 aa, Artificial Sequence
  Description of Artificial Sequence: Synthetic peptide
DEEEISTTNPVATEQYGSVSTNLQQGNR

SEQ ID NO: 3623 - protein, 29 aa, Artificial Sequence
  Description of Artificial Sequence: Synthetic peptide
DEEEIRTTNPVCTEQYGSVFSTNLQRGNR

SEQ ID NO: 3624 - protein, 28 aa, Artificial Sequence
  Description of Artificial Sequence: Synthetic peptide
DEEEIRTTNPVAWELYGSVSTNLQRGNR

SEQ ID NO: 3625 - protein, 28 aa, Artificial Sequence
  Description of Artificial Sequence: Synthetic peptide
DEEEIRGTNPVATEQYGSVSDNLQRGNR

SEQ ID NO: 3626 - protein, 28 aa, Artificial Sequence
  Description of Artificial Sequence: Synthetic peptide
DEEEIRTTNPEATEQYGSVSTNLQVGNR

SEQ ID NO: 3627 - protein, 28 aa, Artificial Sequence
  Description of Artificial Sequence: Synthetic peptide
DECEIMTTNPVATEQYGSVSTNLQRGNR

SEQ ID NO: 3628 - protein, 28 aa, Artificial Sequence
  Description of Artificial Sequence: Synthetic peptide
DEEEIRTTNPVATEQYGSVSTALQRGNI

SEQ ID NO: 3629 - protein, 30 aa, Artificial Sequence
  Description of Artificial Sequence: Synthetic polypeptide
DEEEIRTTNPVATEQYGSVSTNLQRNGNDR

SEQ ID NO: 3630 - protein, 28 aa, Artificial Sequence
  Description of Artificial Sequence: Synthetic peptide
DEEEIRTTNPVATEQYGSVSSNLQGGNR

SEQ ID NO: 3631 - protein, 28 aa, Artificial Sequence
  Description of Artificial Sequence: Synthetic peptide
DEEEIRTTNPVATEQYGSVSTNLQFGNI

SEQ ID NO: 3632 - protein, 28 aa, Artificial Sequence
  Description of Artificial Sequence: Synthetic peptide
DEEEIRTTNPVATEQYGWVSTNLERGNR

SEQ ID NO: 3633 - protein, 28 aa, Artificial Sequence
  Description of Artificial Sequence: Synthetic peptide
DEEEIRTTNPVATEQYGSVSTNDLRGNR

SEQ ID NO: 3634 - protein, 28 aa, Artificial Sequence
  Description of Artificial Sequence: Synthetic peptide
DEEEIRTTNPVATEQYGSVQTNLQEGNR

SEQ ID NO: 3635 - protein, 28 aa, Artificial Sequence
  Description of Artificial Sequence: Synthetic peptide
DEEEIRTTNPVATEQYGSVSTQLQGGNR

SEQ ID NO: 3636 - protein, 28 aa, Artificial Sequence
  Description of Artificial Sequence: Synthetic peptide
DEEEIRTTNPEATEQYGSVSTELQRGNR

SEQ ID NO: 3637 - protein, 29 aa, Artificial Sequence
  Description of Artificial Sequence: Synthetic peptide
DEQEIRTTNPVATEQYGSVSCTNLQRGNR

SEQ ID NO: 3638 - protein, 28 aa, Artificial Sequence
  Description of Artificial Sequence: Synthetic peptide
DEEEIRTTNPVATEQYGTVSTNLQGGNR

SEQ ID NO: 3639 - protein, 29 aa, Artificial Sequence
  Description of Artificial Sequence: Synthetic peptide
DEEEIRTTNPVATEQYGSCVSTNLQSGNR

SEQ ID NO: 3640 - protein, 28 aa, Artificial Sequence
  Description of Artificial Sequence: Synthetic peptide
DEEEIRTTNPVATEQYGSVSDNLQRGNN

SEQ ID NO: 3641 - protein, 28 aa, Artificial Sequence
  Description of Artificial Sequence: Synthetic peptide
DEEELRTTNPVATEQYGSVSTNLQRGNF

SEQ ID NO: 3642 - protein, 28 aa, Artificial Sequence
  Description of Artificial Sequence: Synthetic peptide
DECEIRTTNPVATEQYGSVSTNDQRGNR

SEQ ID NO: 3643 - protein, 28 aa, Artificial Sequence
  Description of Artificial Sequence: Synthetic peptide
DEEEIRTTNPVATEKYGSVSTNLQRGNM

SEQ ID NO: 3644 - protein, 29 aa, Artificial Sequence
  Description of Artificial Sequence: Synthetic peptide
DEEEIRTTNPVATEQYGSVSTNPLSRGNR

SEQ ID NO: 3645 - protein, 30 aa, Artificial Sequence
  Description of Artificial Sequence: Synthetic polypeptide
DEEEIRTTNPVATEQYGSVNSTNLQRYGNR

SEQ ID NO: 3646 - protein, 28 aa, Artificial Sequence
  Description of Artificial Sequence: Synthetic peptide
DEETIRTTNPVATEQYGSVSTNLDRGNR

SEQ ID NO: 3647 - protein, 29 aa, Artificial Sequence
  Description of Artificial Sequence: Synthetic peptide
DEEEIRTTNPVATEQYGSVSVNLQRGNLR

SEQ ID NO: 3648 - protein, 28 aa, Artificial Sequence
  Description of Artificial Sequence: Synthetic peptide
DEEEIVTTNPVATEQYGSVSTDLQRGNR

SEQ ID NO: 3649 - protein, 28 aa, Artificial Sequence
  Description of Artificial Sequence: Synthetic peptide
DEEEIRTTNPVATECYGSVSTNLQQGNR

SEQ ID NO: 3650 - protein, 29 aa, Artificial Sequence
  Description of Artificial Sequence: Synthetic peptide
DEEEIRTTNPVATEQYGSVSTNLQIRGNL

SEQ ID NO: 3651 - protein, 28 aa, Artificial Sequence
  Description of Artificial Sequence: Synthetic peptide
DEEEIRTTNPVATEQYGSVSMNLQVGNR

SEQ ID NO: 3652 - protein, 28 aa, Artificial Sequence
  Description of Artificial Sequence: Synthetic peptide
DEEEIRTTNPVATEQYGSVSTNPQGGNR

SEQ ID NO: 3653 - protein, 28 aa, Artificial Sequence
  Description of Artificial Sequence: Synthetic peptide
YEEEIRTTNPMATEQYGSVSTNLQRGNR

SEQ ID NO: 3654 - protein, 28 aa, Artificial Sequence
  Description of Artificial Sequence: Synthetic peptide
DEEEIRTTNPVATEQYGSVSEDLQRGNR

SEQ ID NO: 3655 - protein, 30 aa, Artificial Sequence
  Description of Artificial Sequence: Synthetic polypeptide
DEEEIRTTNPVATEQYGSIVSTNLQRGNPR

SEQ ID NO: 3656 - protein, 30 aa, Artificial Sequence
  Description of Artificial Sequence: Synthetic polypeptide
DEEEIRTTNPVATEQYGSVSTNLTQRGNPR

SEQ ID NO: 3657 - protein, 28 aa, Artificial Sequence
  Description of Artificial Sequence: Synthetic peptide
DEEEIRTTNPVATECYGSVSTNLQRGDR

SEQ ID NO: 3658 - protein, 28 aa, Artificial Sequence
  Description of Artificial Sequence: Synthetic peptide
DEEEIRTTNPVASEQYGSVSTNLQRGNY

SEQ ID NO: 3659 - protein, 28 aa, Artificial Sequence
  Description of Artificial Sequence: Synthetic peptide
DEEEIRTTNPVATEQYGSVDTNQQRGNR

SEQ ID NO: 3660 - protein, 28 aa, Artificial Sequence
  Description of Artificial Sequence: Synthetic peptide
DEEEIRTTNPVATEQYGDVSTNLQRGPR

SEQ ID NO: 3661 - protein, 29 aa, Artificial Sequence
  Description of Artificial Sequence: Synthetic peptide
DEEEIRTTNPVATEQYGSQSTGNLQRGNR

SEQ ID NO: 3662 - protein, 28 aa, Artificial Sequence
  Description of Artificial Sequence: Synthetic peptide
DEEEIRTTNPVSTEQYGSVSTNLQHGNR

SEQ ID NO: 3663 - protein, 28 aa, Artificial Sequence
  Description of Artificial Sequence: Synthetic peptide
DEEEIRTTNVVATEQYGSVSTNLQRANR

SEQ ID NO: 3664 - protein, 29 aa, Artificial Sequence
  Description of Artificial Sequence: Synthetic peptide
DEEEIRTTNPVATEQYGSVSTMNLQRGND

SEQ ID NO: 3665 - protein, 28 aa, Artificial Sequence
  Description of Artificial Sequence: Synthetic peptide
DEEEIRQTNPVATEQYGSVSTNPQRGNR

SEQ ID NO: 3666 - protein, 28 aa, Artificial Sequence
  Description of Artificial Sequence: Synthetic peptide
DEEEIRTTNPVATEQYGSVDTNLERGNR

SEQ ID NO: 3667 - protein, 28 aa, Artificial Sequence
  Description of Artificial Sequence: Synthetic peptide
DEEEIRTTNPVATEQYGSVSTNDQRENR

SEQ ID NO: 3668 - protein, 29 aa, Artificial Sequence
  Description of Artificial Sequence: Synthetic peptide
DEEEIRTTNPVATEQYGSVSENGLQRGNR

SEQ ID NO: 3669 - protein, 28 aa, Artificial Sequence
  Description of Artificial Sequence: Synthetic peptide
DEQEIRTTNPVATEQYGGVSTNLQRGNR

SEQ ID NO: 3670 - protein, 29 aa, Artificial Sequence
  Description of Artificial Sequence: Synthetic peptide
SEEEIRTTNPVATEQYGSVSTNLQDRGNR

SEQ ID NO: 3671 - protein, 28 aa, Artificial Sequence
  Description of Artificial Sequence: Synthetic peptide
DHEEIRTTNPVATEQYGSVSTNLQRGNP

SEQ ID NO: 3672 - protein, 29 aa, Artificial Sequence
  Description of Artificial Sequence: Synthetic peptide
DEEEIRTTNPVATEQYGSVSTNLQRGNEN

SEQ ID NO: 3673 - protein, 28 aa, Artificial Sequence
  Description of Artificial Sequence: Synthetic peptide
DEEEIRTTNPVATEQYGSVSTNLQRGGT

SEQ ID NO: 3674 - protein, 28 aa, Artificial Sequence
  Description of Artificial Sequence: Synthetic peptide
DEEEIRTTNPVATEQYGAVSTNLQWGNR

SEQ ID NO: 3675 - protein, 29 aa, Artificial Sequence
  Description of Artificial Sequence: Synthetic peptide
DEEEIRTTNPVATEQYGSVSTNLVQDGNR

SEQ ID NO: 3676 - protein, 28 aa, Artificial Sequence
  Description of Artificial Sequence: Synthetic peptide
DEEEIRTTNPVATEQGGSVSTNLQRGNF

SEQ ID NO: 3677 - protein, 28 aa, Artificial Sequence
  Description of Artificial Sequence: Synthetic peptide
DEEEIRTTNPVATECYGSVSTNLQRGNT

SEQ ID NO: 3678 - protein, 28 aa, Artificial Sequence
  Description of Artificial Sequence: Synthetic peptide
DEEEIRTTNPVATEQYGSVSTNPQRGNF

SEQ ID NO: 3679 - protein, 29 aa, Artificial Sequence
  Description of Artificial Sequence: Synthetic peptide
DEEEIRTTNPVATEQYGSVSTNLQRGNTG

SEQ ID NO: 3680 - protein, 28 aa, Artificial Sequence
  Description of Artificial Sequence: Synthetic peptide
DEEEIRTTNPVATEQYGGVSTNLQRGNF

SEQ ID NO: 3681 - protein, 28 aa, Artificial Sequence
  Description of Artificial Sequence: Synthetic peptide
SEEEIRTTNPVATEQYGSVSTNLQRGNE

SEQ ID NO: 3682 - protein, 28 aa, Artificial Sequence
  Description of Artificial Sequence: Synthetic peptide
DEEEIRTTNPIATEIYGSVSTNLQRGNR

SEQ ID NO: 3683 - protein, 29 aa, Artificial Sequence
  Description of Artificial Sequence: Synthetic peptide
DEEEIRTTNPVATEQYGSVSTNLQVNGNR

SEQ ID NO: 3684 - protein, 30 aa, Artificial Sequence; identical to SEQ ID NO: 1845
  Description of Artificial Sequence: Synthetic polypeptide

SEQ ID NO: 3685 - protein, 28 aa, Artificial Sequence
  Description of Artificial Sequence: Synthetic peptide
DEEEIRTTNPVATEQYGSVSTNLQIGNQ

SEQ ID NO: 3686 - protein, 28 aa, Artificial Sequence
  Description of Artificial Sequence: Synthetic peptide
AEEEIRTTNPVATEQYGSVSTNLQRGNS

SEQ ID NO: 3687 - protein, 29 aa, Artificial Sequence
  Description of Artificial Sequence: Synthetic peptide
DEEEIRTTNPVATEQYGSVSTNLQSKGNR

SEQ ID NO: 3688 - protein, 28 aa, Artificial Sequence
  Description of Artificial Sequence: Synthetic peptide
DEDEIRTTNPVATEQYGSVSTNLQRGND

SEQ ID NO: 3689 - protein, 29 aa, Artificial Sequence
  Description of Artificial Sequence: Synthetic peptide
DEEEIRTTNPVATEQYGSVSVANLQRGNR

SEQ ID NO: 3690 - protein, 28 aa, Artificial Sequence
  Description of Artificial Sequence: Synthetic peptide
DEEEVRTTNPVATEQFGSVSTNLQRGNR

SEQ ID NO: 3691 - protein, 28 aa, Artificial Sequence
  Description of Artificial Sequence: Synthetic peptide
DEEEIRTTNPVATEQYGDVSTNLQSGNR

SEQ ID NO: 3692 - protein, 28 aa, Artificial Sequence
  Description of Artificial Sequence: Synthetic peptide
DEMEIRTVNPVATEQYGSVSTNLQRGNR

SEQ ID NO: 3693 - protein, 30 aa, Artificial Sequence
  Description of Artificial Sequence: Synthetic polypeptide
DEEEIRTTNPVATEQYGSVSTNLQRNGVNR

SEQ ID NO: 3694 - protein, 28 aa, Artificial Sequence
  Description of Artificial Sequence: Synthetic peptide
DEQEIRTTNPVATEQYGEVSTNLQRGNR

SEQ ID NO: 3695 - protein, 29 aa, Artificial Sequence
  Description of Artificial Sequence: Synthetic peptide
DEEEIRTTNPVATEQYGSVSMNLIQRGNR

SEQ ID NO: 3696 - protein, 29 aa, Artificial Sequence
  Description of Artificial Sequence: Synthetic peptide
DEEEIRTTNPVATEQYGSVSTINLQRGNM

SEQ ID NO: 3697 - protein, 29 aa, Artificial Sequence
  Description of Artificial Sequence: Synthetic peptide
VEEEIRTTNPVATEQYGSVSTNLQRGMNR

SEQ ID NO: 3698 - protein, 29 aa, Artificial Sequence
  Description of Artificial Sequence: Synthetic peptide
DEEEIRTTNPVATQQYGSVSTNLPQRGNR

SEQ ID NO: 3699 - protein, 28 aa, Artificial Sequence
  Description of Artificial Sequence: Synthetic peptide
DEEEIRTTNPVATEVYGSVSTNLQVGNR

SEQ ID NO: 3700 - protein, 28 aa, Artificial Sequence
  Description of Artificial Sequence: Synthetic peptide
DEEEIRTTNPVATEQYGWVSTNLPRGNR

SEQ ID NO: 3701 - protein, 28 aa, Artificial Sequence
  Description of Artificial Sequence: Synthetic peptide
DEEEIRTTNPVATEQYGSVSDNLQRENR

SEQ ID NO: 3702 - protein, 29 aa, Artificial Sequence
  Description of Artificial Sequence: Synthetic peptide
DEEEIRTTNPVATELYGSVSTNLQMRGNR

SEQ ID NO: 3703 - protein, 28 aa, Artificial Sequence
  Description of Artificial Sequence: Synthetic peptide
DEEEIRTTNPVATEQYGSVSTNGLRGNR

SEQ ID NO: 3704 - protein, 28 aa, Artificial Sequence
  Description of Artificial Sequence: Synthetic peptide
DEEEIRTTNPCATEQYGSVSENLQRGNR

SEQ ID NO: 3705 - protein, 28 aa, Artificial Sequence
  Description of Artificial Sequence: Synthetic peptide
DEEMIRTTNPVATEQYGSVSTNLQRENR

SEQ ID NO: 3706 - protein, 28 aa, Artificial Sequence
  Description of Artificial Sequence: Synthetic peptide
DEEEIRTTNPIATEQYGSVSTNLQRQNR

SEQ ID NO: 3707 - protein, 28 aa, Artificial Sequence
  Description of Artificial Sequence: Synthetic peptide
DEEEIRTTNPVAGEQYGSVSTNLQRMNR

SEQ ID NO: 3708 - protein, 28 aa, Artificial Sequence
  Description of Artificial Sequence: Synthetic peptide
DEEEIRTTNPVATECYGSVSTNEQRGNR

SEQ ID NO: 3709 - protein, 28 aa, Artificial Sequence
  Description of Artificial Sequence: Synthetic peptide
DEEEIRTTNPTATEQYGSVSTNLQRGNT

SEQ ID NO: 3710 - protein, 28 aa, Artificial Sequence
  Description of Artificial Sequence: Synthetic peptide
DEEEIRTTNPVATEQYGSVSDNLQRGNT

SEQ ID NO: 3711 - protein, 29 aa, Artificial Sequence
  Description of Artificial Sequence: Synthetic peptide
DEECIRTTNPVATEQYGSVSTNLQRGDNR

SEQ ID NO: 3712 - protein, 28 aa, Artificial Sequence
  Description of Artificial Sequence: Synthetic peptide
DEEEIRTTNPVATEQYGEVSTNLQRGNQ

SEQ ID NO: 3713 - protein, 28 aa, Artificial Sequence
  Description of Artificial Sequence: Synthetic peptide
DEEEIRTTNPVATEQYGSVSTNQQRGNP

SEQ ID NO: 3714 - protein, 28 aa, Artificial Sequence
  Description of Artificial Sequence: Synthetic peptide
DEEEIRTVNPVATEQYGSVSTNLQRGNH

SEQ ID NO: 3715 - protein, 28 aa, Artificial Sequence
  Description of Artificial Sequence: Synthetic peptide
DEEEIRTTNPCATEQYGSTSTNLQRGNR

SEQ ID NO: 3716 - protein, 28 aa, Artificial Sequence
  Description of Artificial Sequence: Synthetic peptide
DEEEIRTTNPVATEQYGSVSTNLQLGTR

SEQ ID NO: 3717 - protein, 28 aa, Artificial Sequence
  Description of Artificial Sequence: Synthetic peptide
DEEEIRTTNIVATEDYGSVSTNLQRGNR

SEQ ID NO: 3718 - protein, 28 aa, Artificial Sequence
  Description of Artificial Sequence: Synthetic peptide
DEEEIRTTNPVATEQYGSVSTDLQRGNI

SEQ ID NO: 3719 - protein, 30 aa, Artificial Sequence
  Description of Artificial Sequence: Synthetic polypeptide
DEEEIRTTNPVATEQYGSVISTNLLQRGNR

SEQ ID NO: 3720 - protein, 29 aa, Artificial Sequence
  Description of Artificial Sequence: Synthetic peptide
DEEEIRTTNPVATEQYGSVQTANLQRGNR

SEQ ID NO: 3721 - protein, 28 aa, Artificial Sequence
  Description of Artificial Sequence: Synthetic peptide
DEEEIRTTNPVATEQYGSVSDNLQMGNR

SEQ ID NO: 3722 - protein, 29 aa, Artificial Sequence
  Description of Artificial Sequence: Synthetic peptide
DEEEIRTTNPVATEQYGSVSTNLQRTGNQ

SEQ ID NO: 3723 - protein, 28 aa, Artificial Sequence
  Description of Artificial Sequence: Synthetic peptide
DEEEIRTTNPVATEVYGSVDTNLQRGNR

SEQ ID NO: 3724 - protein, 28 aa, Artificial Sequence
  Description of Artificial Sequence: Synthetic peptide
DEEEIRTTNPVATEQYGSVCTNLQQGNR

SEQ ID NO: 3725 - protein, 28 aa, Artificial Sequence
  Description of Artificial Sequence: Synthetic peptide
DEEEIRATNPVATEQYGEVSTNLQRGNR

SEQ ID NO: 3726 - protein, 28 aa, Artificial Sequence
  Description of Artificial Sequence: Synthetic peptide
DEEEIRTTNPVATEQYGSVSTNLQRGDS

SEQ ID NO: 3727 - protein, 29 aa, Artificial Sequence
  Description of Artificial Sequence: Synthetic peptide
DEEEIRTTNPVATEQYGSVSTNGLQTGNR

SEQ ID NO: 3728 - protein, 28 aa, Artificial Sequence
  Description of Artificial Sequence: Synthetic peptide
DEEEIRTTNPVATEQYGSVSNNLQFGNR

SEQ ID NO: 3729 - protein, 28 aa, Artificial Sequence
  Description of Artificial Sequence: Synthetic peptide
DEEEIRTTNPVATEIYGWVSTNLQRGNR

SEQ ID NO: 3730 - protein, 29 aa, Artificial Sequence
  Description of Artificial Sequence: Synthetic peptide
DEEEIATTNPVATEQYGSVSTNLQERGNR

SEQ ID NO: 3731 - protein, 28 aa, Artificial Sequence
  Description of Artificial Sequence: Synthetic peptide
DEEEIRTTNPVATEQYGSVSTNLQHGNS

SEQ ID NO: 3732 - protein, 28 aa, Artificial Sequence
  Description of Artificial Sequence: Synthetic peptide
DEEEIRTTNPLATEQYGSVSTNLQRGNP

SEQ ID NO: 3733 - protein, 30 aa, Artificial Sequence
  Description of Artificial Sequence: Synthetic polypeptide
DEEEIRTTNPVATEQYGSVSITNLQIRGNR

SEQ ID NO: 3734 - protein, 29 aa, Artificial Sequence
  Description of Artificial Sequence: Synthetic peptide
DEEEIRTTNPVATEQYGSVSTPLQRGDNR

SEQ ID NO: 3735 - protein, 28 aa, Artificial Sequence
  Description of Artificial Sequence: Synthetic peptide
DEEEIRTTNPVATEQYGSVSTNPQHGNR

SEQ ID NO: 3736 - protein, 28 aa, Artificial Sequence
  Description of Artificial Sequence: Synthetic peptide
DEEEIATTNPVATEQYGSVSDNLQRGNR

SEQ ID NO: 3737 - protein, 28 aa, Artificial Sequence
  Description of Artificial Sequence: Synthetic peptide
DEEEIRTTNPVATEQYGDVSTNLQWGNR

SEQ ID NO: 3738 - protein, 28 aa, Artificial Sequence
  Description of Artificial Sequence: Synthetic peptide
DEEEIRTTNPVATEQYGDVSTILQRGNR

SEQ ID NO: 3739 - protein, 28 aa, Artificial Sequence
  Description of Artificial Sequence: Synthetic peptide
QEEEIRTTNPVATEQYGSVSENLQRGNR

SEQ ID NO: 3740 - protein, 28 aa, Artificial Sequence
  Description of Artificial Sequence: Synthetic peptide
DEEEIRTTNPVSTEQYGSVSTNLQRGND

SEQ ID NO: 3741 - protein, 28 aa, Artificial Sequence
  Description of Artificial Sequence: Synthetic peptide
DEDEIRTTNPVATEIYGSVSTNLQRGNR

SEQ ID NO: 3742 - protein, 28 aa, Artificial Sequence
  Description of Artificial Sequence: Synthetic peptide
DEVEINTTNPVATEQYGSVSTNLQRGNR

SEQ ID NO: 3743 - protein, 28 aa, Artificial Sequence
  Description of Artificial Sequence: Synthetic peptide
DEEEIRTTNPVATEQYGIVSTNLMRGNR

SEQ ID NO: 3744 - protein, 28 aa, Artificial Sequence
  Description of Artificial Sequence: Synthetic peptide
DEEEIRTTNPVATEQYGSVSTADQRGNR

SEQ ID NO: 3745 - protein, 28 aa, Artificial Sequence
  Description of Artificial Sequence: Synthetic peptide
DEEEIRTTNPVATEQYGSVSTNPQRGNQ

SEQ ID NO: 3746 - protein, 28 aa, Artificial Sequence
  Description of Artificial Sequence: Synthetic peptide
DEEEIRTTNPVATEQYGSVSTNLQDGNM

SEQ ID NO: 3747 - protein, 28 aa, Artificial Sequence
  Description of Artificial Sequence: Synthetic peptide
DEEEICTTNPVATEQYGTVSTNLQRGNR

SEQ ID NO: 3748 - protein, 28 aa, Artificial Sequence
  Description of Artificial Sequence: Synthetic peptide
DEEEIVTTNPVATEQYGSVSTNLQNGNR

SEQ ID NO: 3749 - protein, 28 aa, Artificial Sequence
  Description of Artificial Sequence: Synthetic peptide
DEEEIRTTNIVATEQYGSVATNLQRGNR

SEQ ID NO: 3750 - protein, 28 aa, Artificial Sequence
  Description of Artificial Sequence: Synthetic peptide
SEEEIRTTNPVATEQYGSVSTNLQRGER

SEQ ID NO: 3751 - protein, 29 aa, Artificial Sequence
  Description of Artificial Sequence: Synthetic peptide
DEEEIRTTNPVATEQYGSVSTINLQRGER

SEQ ID NO: 3752 - protein, 29 aa, Artificial Sequence
  Description of Artificial Sequence: Synthetic peptide
DEEEIRTTNPVATEQFGSVSTNLQREGNR

SEQ ID NO: 3753 - protein, 29 aa, Artificial Sequence
  Description of Artificial Sequence: Synthetic peptide
DEEEIRTTNPVATEQYGSVDSTNLQQGNR

SEQ ID NO: 3754 - protein, 28 aa, Artificial Sequence
  Description of Artificial Sequence: Synthetic peptide
YEEEIRTTNPVATEQYGSVSTNLQFGNR

SEQ ID NO: 3755 - protein, 28 aa, Artificial Sequence
  Description of Artificial Sequence: Synthetic peptide
DEEEIRTTNPVATEQYGSVSTWLFRGNR

SEQ ID NO: 3756 - protein, 28 aa, Artificial Sequence
  Description of Artificial Sequence: Synthetic peptide
DPEEIRTTNPVATEQYGSVSTNLQAGNR

SEQ ID NO: 3757 - protein, 30 aa, Artificial Sequence
  Description of Artificial Sequence: Synthetic polypeptide
DEEEIRTTNPVATEQYGESVSTDNLQRGNR

SEQ ID NO: 3758 - protein, 29 aa, Artificial Sequence
  Description of Artificial Sequence: Synthetic peptide
DEVEIRTTNPVATEQYGSVSTNLQDRGNR

SEQ ID NO: 3759 - protein, 28 aa, Artificial Sequence
  Description of Artificial Sequence: Synthetic peptide
DEEEIRTTNPVAWEQYGSVSTNDQRGNR

SEQ ID NO: 3760 - protein, 28 aa, Artificial Sequence
  Description of Artificial Sequence: Synthetic peptide
DEEEIRTTNPVATEQYGSVSTDLQQGNR

SEQ ID NO: 3761 - protein, 28 aa, Artificial Sequence
  Description of Artificial Sequence: Synthetic peptide
DEEEIRCTNPVATENYGSVSTNLQRGNR

SEQ ID NO: 3762 - protein, 28 aa, Artificial Sequence
  Description of Artificial Sequence: Synthetic peptide
DEEEIRTTNIVATEQYGSVETNLQRGNR

SEQ ID NO: 3763 - protein, 28 aa, Artificial Sequence
  Description of Artificial Sequence: Synthetic peptide
DEEEIRTTNPVATSQYGSVSTNLQIGNR

SEQ ID NO: 3764 - protein, 28 aa, Artificial Sequence
  Description of Artificial Sequence: Synthetic peptide
DEGEIRTTNPVATEQYGSVETNLQRGNR

SEQ ID NO: 3765 - protein, 30 aa, Artificial Sequence
  Description of Artificial Sequence: Synthetic polypeptide
DEEEIRTTNPVATEQYGSNVSTNYLQRGNR

SEQ ID NO: 3766 - protein, 28 aa, Artificial Sequence
  Description of Artificial Sequence: Synthetic peptide
DEEEIRTTNPVATEQYGWVSTNLQTGNR

SEQ ID NO: 3767 - protein, 28 aa, Artificial Sequence
  Description of Artificial Sequence: Synthetic peptide
DEEEIRTTNPVATEQYGSVSNNLERGNR

SEQ ID NO: 3768 - protein, 28 aa, Artificial Sequence
  Description of Artificial Sequence: Synthetic peptide
DEEEIRTTNPVATEQYGSVSTNLQWGNN

SEQ ID NO: 3769 - protein, 28 aa, Artificial Sequence
  Description of Artificial Sequence: Synthetic peptide
DEEEIRTTNPVATEQYGSVSTNDQDGNR

SEQ ID NO: 3770 - protein, 28 aa, Artificial Sequence
  Description of Artificial Sequence: Synthetic peptide
NEEEIRTTNPVATEQYGSVSTNLQRGNA

SEQ ID NO: 3771 - protein, 28 aa, Artificial Sequence
  Description of Artificial Sequence: Synthetic peptide
DEEEIRTTNPVATEQYGSVHTNLQAGNR

SEQ ID NO: 3772 - protein, 28 aa, Artificial Sequence
  Description of Artificial Sequence: Synthetic peptide
DEREIRTTNPVATEQYGSVSTTLQRGNR

SEQ ID NO: 3773 - protein, 29 aa, Artificial Sequence
  Description of Artificial Sequence: Synthetic peptide
DEEEISTTNPVATEQYGSVSTNLQRGNDR

SEQ ID NO: 3774 - protein, 28 aa, Artificial Sequence
  Description of Artificial Sequence: Synthetic peptide
DEEEIRTTNPVATEQYGSVSDNLQRGNC

SEQ ID NO: 3775 - protein, 30 aa, Artificial Sequence
  Description of Artificial Sequence: Synthetic polypeptide
DEEEIRTTNPVATEQYGSVSTINLQIRGNR

SEQ ID NO: 3776 - protein, 28 aa, Artificial Sequence
  Description of Artificial Sequence: Synthetic peptide
DESEIRSTNPVATEQYGSVSTNLQRGNR

SEQ ID NO: 3777 - protein, 28 aa, Artificial Sequence
  Description of Artificial Sequence: Synthetic peptide
DEEEIATTNPVATEQYGSVSTNLQIGNR

SEQ ID NO: 3778 - protein, 28 aa, Artificial Sequence
  Description of Artificial Sequence: Synthetic peptide
DEAEIRTTNPVATEQYGSVSTNLQRGNA

SEQ ID NO: 3779 - protein, 28 aa, Artificial Sequence
  Description of Artificial Sequence: Synthetic peptide
DEEEIRTTNPVATEQYGSVDTNLQRGNQ

SEQ ID NO: 3780 - protein, 28 aa, Artificial Sequence
  Description of Artificial Sequence: Synthetic peptide
DEEEIRTTNIVADEQYGSVSTNLQRGNR

SEQ ID NO: 3781 - protein, 29 aa, Artificial Sequence
  Description of Artificial Sequence: Synthetic peptide
DEVEIRTTNPVATEQYGSVSTMNLQRGNR

SEQ ID NO: 3782 - protein, 28 aa, Artificial Sequence
  Description of Artificial Sequence: Synthetic peptide
DEEEIRTTNPDATEQYGSVSTNLQRGNY

SEQ ID NO: 3783 - protein, 28 aa, Artificial Sequence
  Description of Artificial Sequence: Synthetic peptide
MEEEIRGTNPVATEQYGSVSTNLQRGNR

SEQ ID NO: 3784 - protein, 29 aa, Artificial Sequence
  Description of Artificial Sequence: Synthetic peptide
DEEEIRTTNPVAIEQYGSVDSTNLQRGNR

SEQ ID NO: 3785 - protein, 29 aa, Artificial Sequence
  Description of Artificial Sequence: Synthetic peptide
DEEEIRTTNPVATEQYGCVSTNLQRGENR

SEQ ID NO: 3786 - protein, 28 aa, Artificial Sequence
  Description of Artificial Sequence: Synthetic peptide
DEEEIRTTNPVATETYGCVSTNLQRGNR

SEQ ID NO: 3787 - protein, 28 aa, Artificial Sequence
  Description of Artificial Sequence: Synthetic peptide
DEEEIRTTNPVATEQYGSVSTNEQRGTR

SEQ ID NO: 3788 - protein, 28 aa, Artificial Sequence
  Description of Artificial Sequence: Synthetic peptide
DEEEIRTTNPVATEQYGSVSTALQRGTR

SEQ ID NO: 3789 - protein, 29 aa, Artificial Sequence
  Description of Artificial Sequence: Synthetic peptide
DEEEIRTTNPVATEQYGSVSTNLQPGNDR

SEQ ID NO: 3790 - protein, 30 aa, Artificial Sequence
  Description of Artificial Sequence: Synthetic polypeptide
DEEEIRTTNPVATEQYGSVSTNLQRKGDNR

SEQ ID NO: 3791 - protein, 29 aa, Artificial Sequence
  Description of Artificial Sequence: Synthetic peptide
DEEEIRTTNPVATEQYGSVATNLQRGDNR

SEQ ID NO: 3792 - protein, 28 aa, Artificial Sequence
  Description of Artificial Sequence: Synthetic peptide
DEEEIRTTNPVAWEQCGSVSTNLQRGNR

SEQ ID NO: 3793 - protein, 28 aa, Artificial Sequence
  Description of Artificial Sequence: Synthetic peptide
DEEEIRTTNPVATEQYGSWSTNLQRGER

SEQ ID NO: 3794 - protein, 28 aa, Artificial Sequence
  Description of Artificial Sequence: Synthetic peptide
DEEEIRTTNIVATEQLGSVSTNLQRGNR

SEQ ID NO: 3795 - protein, 29 aa, Artificial Sequence
  Description of Artificial Sequence: Synthetic peptide
DEEEIRTTNPVATEQYGSVSTNLQRDGER

SEQ ID NO: 3796 - protein, 28 aa, Artificial Sequence
  Description of Artificial Sequence: Synthetic peptide
DEEEVRTTNPVATEQYGSVSTNLQSGNR

SEQ ID NO: 3797 - protein, 28 aa, Artificial Sequence
  Description of Artificial Sequence: Synthetic peptide
KEEEIRSTNPVATEQYGSVSTNLQRGNR

SEQ ID NO: 3798 - protein, 28 aa, Artificial Sequence
  Description of Artificial Sequence: Synthetic peptide
DEQEIRTTNPVATEQYGSVSTNLQRGNI

SEQ ID NO: 3799 - protein, 28 aa, Artificial Sequence
  Description of Artificial Sequence: Synthetic peptide
DEEEIRTTNIVATEQYGSVSTNLQRNNR

SEQ ID NO: 3800 - protein, 28 aa, Artificial Sequence
  Description of Artificial Sequence: Synthetic peptide
DEEEIRTTNPVATEQYGSVSTNLQGGNS

SEQ ID NO: 3801 - protein, 28 aa, Artificial Sequence
  Description of Artificial Sequence: Synthetic peptide
DEEEIRTTNPVATEPYGSVGTNLQRGNR

SEQ ID NO: 3802 - protein, 29 aa, Artificial Sequence
  Description of Artificial Sequence: Synthetic peptide
DEEEIRTTNPVATEQYGSVSTNLQIHGNR

SEQ ID NO: 3803 - protein, 28 aa, Artificial Sequence
  Description of Artificial Sequence: Synthetic peptide
DEEEIRTTNPVATEWYGSVSTNLQRGNA

SEQ ID NO: 3804 - protein, 29 aa, Artificial Sequence
  Description of Artificial Sequence: Synthetic peptide
DEEEIRTTNPVATEQYGSVSTNDQRGENR

SEQ ID NO: 3805 - protein, 28 aa, Artificial Sequence
  Description of Artificial Sequence: Synthetic peptide
DEEEIRTTNIVATEQYGTVSTNLQRGNR

SEQ ID NO: 3806 - protein, 28 aa, Artificial Sequence
  Description of Artificial Sequence: Synthetic peptide
DEEEIRTTNPEATEQYGSVGTNLQRGNR

SEQ ID NO: 3807 - protein, 29 aa, Artificial Sequence
  Description of Artificial Sequence: Synthetic peptide
DEEEIRTTNPVATEQYGSVSTANEQRGNR

SEQ ID NO: 3808 - protein, 30 aa, Artificial Sequence
  Description of Artificial Sequence: Synthetic polypeptide
DEEEIRTTNPVATEQYGSVSTGNLQRGDNR

SEQ ID NO: 3809 - protein, 28 aa, Artificial Sequence
  Description of Artificial Sequence: Synthetic peptide
DEIEIRTTNPVATEQYGEVSTNLQRGNR

SEQ ID NO: 3810 - protein, 29 aa, Artificial Sequence
  Description of Artificial Sequence: Synthetic peptide
DEEEIRTTNPVATEQYGSVETNLQRGENR

SEQ ID NO: 3811 - protein, 28 aa, Artificial Sequence
  Description of Artificial Sequence: Synthetic peptide
DEEEIRTTNPVATEQYGEVSTNLQFGNR

SEQ ID NO: 3812 - protein, 28 aa, Artificial Sequence
  Description of Artificial Sequence: Synthetic peptide
DEEEIRTTNPVATEQYGSVSTNLQNGDR

SEQ ID NO: 3813 - protein, 29 aa, Artificial Sequence
  Description of Artificial Sequence: Synthetic peptide
DEEGIRTTNPVATEQYGSVSSTNLQRGNR

SEQ ID NO: 3814 - protein, 28 aa, Artificial Sequence
  Description of Artificial Sequence: Synthetic peptide
DEEEIRTTNPVATEQYGSVSDCLQRGNR

SEQ ID NO: 3815 - protein, 30 aa, Artificial Sequence
  Description of Artificial Sequence: Synthetic polypeptide
DEEEIRTTNPVATEQYGSVSTENLQRVGNR

SEQ ID NO: 3816 - protein, 28 aa, Artificial Sequence
  Description of Artificial Sequence: Synthetic peptide
DEEEIRCTNPVATEVYGSVSTNLQRGNR

SEQ ID NO: 3817 - protein, 28 aa, Artificial Sequence
  Description of Artificial Sequence: Synthetic peptide
DEEEIRTTNPVATEQYGLVSTNLQHGNR

SEQ ID NO: 3818 - protein, 28 aa, Artificial Sequence
  Description of Artificial Sequence: Synthetic peptide
DEEEIRTTNPVATEQYGSVSTNLQIGNM

SEQ ID NO: 3819 - protein, 28 aa, Artificial Sequence
  Description of Artificial Sequence: Synthetic peptide
DEEEIRTTNPVATEQYGSASTNLQRGNL

SEQ ID NO: 3820 - protein, 28 aa, Artificial Sequence
  Description of Artificial Sequence: Synthetic peptide
DEEEIRTTNPVATELYGSVSTNLQRGNQ

SEQ ID NO: 3821 - protein, 28 aa, Artificial Sequence
  Description of Artificial Sequence: Synthetic peptide
DLEEIRTTNPVATEQYGSVSTNLQNGNR

SEQ ID NO: 3822 - protein, 28 aa, Artificial Sequence
  Description of Artificial Sequence: Synthetic peptide
DEHEIRTTNPVATEQYGSVSENLQRGNR

SEQ ID NO: 3823 - protein, 28 aa, Artificial Sequence
  Description of Artificial Sequence: Synthetic peptide
DEEEIRTTNPVATAQYGSVSTGLQRGNR

SEQ ID NO: 3824 - protein, 28 aa, Artificial Sequence
  Description of Artificial Sequence: Synthetic peptide
DEEEIRTTNPVATEQYGSVSTNLMRGNL

SEQ ID NO: 3825 - protein, 28 aa, Artificial Sequence
  Description of Artificial Sequence: Synthetic peptide
DEEEIRTTNPVATETYGVVSTNLQRGNR

SEQ ID NO: 3826 - protein, 28 aa, Artificial Sequence
  Description of Artificial Sequence: Synthetic peptide
DENEIRTTNPVATEQYGSVSTNLQMGNR

SEQ ID NO: 3827 - protein, 28 aa, Artificial Sequence
  Description of Artificial Sequence: Synthetic peptide
DEEEIRTTNPVATEQYGSVSENLQIGNR

SEQ ID NO: 3828 - protein, 28 aa, Artificial Sequence
  Description of Artificial Sequence: Synthetic peptide
DEEEIRTTNPVATEQYGSVSTNLQHGGR

SEQ ID NO: 3829 - protein, 29 aa, Artificial Sequence
  Description of Artificial Sequence: Synthetic peptide
DEEEIRTTNPVATEQYGSYVSTNLQGGNR

SEQ ID NO: 3830 - protein, 29 aa, Artificial Sequence
  Description of Artificial Sequence: Synthetic peptide
DEEEIRTTNPVATEQYGSVSTNLPQRGLR

SEQ ID NO: 3831 - protein, 29 aa, Artificial Sequence
  Description of Artificial Sequence: Synthetic peptide
DEEEIRTTNPTATEQYGSVSTNLQREGNR

SEQ ID NO: 3832 - protein, 28 aa, Artificial Sequence
  Description of Artificial Sequence: Synthetic peptide
DEEEIKTTNPVATEQYGSVSDNLQRGNR

SEQ ID NO: 3833 - protein, 28 aa, Artificial Sequence
  Description of Artificial Sequence: Synthetic peptide
DEEEIRTTNPVATEQYGSASTELQRGNR

SEQ ID NO: 3834 - protein, 28 aa, Artificial Sequence
  Description of Artificial Sequence: Synthetic peptide
SEEEIRTTNIVATEQYGSVSTNLQRGNR

SEQ ID NO: 3835 - protein, 28 aa, Artificial Sequence
  Description of Artificial Sequence: Synthetic peptide
DEEEIRTTNPEATEQYGSVSTNLQRGDR

SEQ ID NO: 3836 - protein, 29 aa, Artificial Sequence
  Description of Artificial Sequence: Synthetic peptide
DEEEIRTTNPVATEQYGSVSTVNLQRGNQ

SEQ ID NO: 3837 - protein, 28 aa, Artificial Sequence
  Description of Artificial Sequence: Synthetic peptide
DEEEIRCTNPVATEQYGSVSTNLQRGNL

SEQ ID NO: 3838 - protein, 28 aa, Artificial Sequence
  Description of Artificial Sequence: Synthetic peptide
DEEEIRTTNPVATEGYGSVSTNLQRGNS

SEQ ID NO: 3839 - protein, 28 aa, Artificial Sequence
  Description of Artificial Sequence: Synthetic peptide
DEEELRTTNPVATEQYGSCSTNLQRGNR

SEQ ID NO: 3840 - protein, 28 aa, Artificial Sequence
  Description of Artificial Sequence: Synthetic peptide
DEEEIRTTNIVATEQIGSVSTNLQRGNR

SEQ ID NO: 3841 - protein, 28 aa, Artificial Sequence
  Description of Artificial Sequence: Synthetic peptide
DEEEIRTTNPVASEQYGSVSDNLQRGNR

SEQ ID NO: 3842 - protein, 30 aa, Artificial Sequence
  Description of Artificial Sequence: Synthetic polypeptide
DEEEIRTTNPVATEQYGMSVSTNLQIRGNR

SEQ ID NO: 3843 - protein, 28 aa, Artificial Sequence
  Description of Artificial Sequence: Synthetic peptide
DEEEIRTTNPVATEQYGSVSTNLQMGNT

SEQ ID NO: 3844 - protein, 28 aa, Artificial Sequence
  Description of Artificial Sequence: Synthetic peptide
DEEEIRTTNPVATYQYGSTSTNLQRGNR

SEQ ID NO: 3845 - protein, 30 aa, Artificial Sequence
  Description of Artificial Sequence: Synthetic polypeptide
DEEEIRTTNPVATEQYGSVSTNLQRKGNDR

SEQ ID NO: 3846 - protein, 28 aa, Artificial Sequence
  Description of Artificial Sequence: Synthetic peptide
DEEEIRTTNPVATEQYGSVSTNLQRGEV

SEQ ID NO: 3847 - protein, 29 aa, Artificial Sequence
  Description of Artificial Sequence: Synthetic peptide
DEEEIRTVNPVATEQYGSVSTNPLQRGNR

SEQ ID NO: 3848 - protein, 28 aa, Artificial Sequence
  Description of Artificial Sequence: Synthetic peptide
DEEEIRTTNPVATEQYGSVSTNLQTGNM

SEQ ID NO: 3849 - protein, 28 aa, Artificial Sequence
  Description of Artificial Sequence: Synthetic peptide
DEEEIRTTNICATEQYGSVSTNLQRGNR

SEQ ID NO: 3850 - protein, 28 aa, Artificial Sequence
  Description of Artificial Sequence: Synthetic peptide
DEEEIRTTNPEATEQYGSVSTNLQRGNY

SEQ ID NO: 3851 - protein, 28 aa, Artificial Sequence
  Description of Artificial Sequence: Synthetic peptide
DENEIRTTNPVATEQYGSVSTNDQRGNR

SEQ ID NO: 3852 - protein, 29 aa, Artificial Sequence
  Description of Artificial Sequence: Synthetic peptide
DEEEIRTTNPVATEQYGSVSTNLQRGPNK

SEQ ID NO: 3853 - protein, 29 aa, Artificial Sequence
  Description of Artificial Sequence: Synthetic peptide
DEEEIRTTNPVATEQYGTVSTNLQERGNR

SEQ ID NO: 3854 - protein, 29 aa, Artificial Sequence
  Description of Artificial Sequence: Synthetic peptide
DEEEIRTTNPVATEQYGSVSTNNLERGNR

SEQ ID NO: 3855 - protein, 29 aa, Artificial Sequence
  Description of Artificial Sequence: Synthetic peptide
DEEEIRTTNPVATEQYGSVSTNLQHGNTR

SEQ ID NO: 3856 - protein, 28 aa, Artificial Sequence
  Description of Artificial Sequence: Synthetic peptide
DEEEIRTTNPVATEQYGSVSTNLIRGNY

SEQ ID NO: 3857 - protein, 30 aa, Artificial Sequence
  Description of Artificial Sequence: Synthetic polypeptide
DEEEIRTTNPVATEQYGSVSTNLQRAGNDR

SEQ ID NO: 3858 - protein, 28 aa, Artificial Sequence
  Description of Artificial Sequence: Synthetic peptide
DEEEIRTTNPVATEQYGSVSTNLQAGNV

SEQ ID NO: 3859 - protein, 28 aa, Artificial Sequence
  Description of Artificial Sequence: Synthetic peptide
DEEEIVTTNPVATEIYGSVSTNLQRGNR

SEQ ID NO: 3860 - protein, 28 aa, Artificial Sequence
  Description of Artificial Sequence: Synthetic peptide
DEEEIRTTNPVATEQYGSVGENLQRGNR

SEQ ID NO: 3861 - protein, 29 aa, Artificial Sequence
  Description of Artificial Sequence: Synthetic peptide
DEEEIRTTNPVATEQYGSVSAENLQRGNR

SEQ ID NO: 3862 - protein, 28 aa, Artificial Sequence
  Description of Artificial Sequence: Synthetic peptide
DEEEIRTTNPVATEQYGEVSTTLQRGNR

SEQ ID NO: 3863 - protein, 29 aa, Artificial Sequence
  Description of Artificial Sequence: Synthetic peptide
DEEEIRTTNPVATENYGSVSTNLVQRGNR

SEQ ID NO: 3864 - protein, 28 aa, Artificial Sequence
  Description of Artificial Sequence: Synthetic peptide
DEEEIRTTNPVATENYGTVSTNLQRGNR

SEQ ID NO: 3865 - protein, 28 aa, Artificial Sequence
  Description of Artificial Sequence: Synthetic peptide
DEEEIRTTNPVATENYGSVSTNLQPGNR

SEQ ID NO: 3866 - protein, 28 aa, Artificial Sequence
  Description of Artificial Sequence: Synthetic peptide
DEEEIRTTNPVATEQYGTVSTNLQRGTR

SEQ ID NO: 3867 - protein, 28 aa, Artificial Sequence
  Description of Artificial Sequence: Synthetic peptide
HEEEIRTTNPVATEQYGSASTNLQRGNR

SEQ ID NO: 3868 - protein, 28 aa, Artificial Sequence
  Description of Artificial Sequence: Synthetic peptide
DEEEIRTTNPVATEQYGSVSTNLQIGNG

SEQ ID NO: 3869 - protein, 28 aa, Artificial Sequence
  Description of Artificial Sequence: Synthetic peptide
DEEEIVTTNPVATEQYGSVSTNLQRGNL

SEQ ID NO: 3870 - protein, 28 aa, Artificial Sequence
  Description of Artificial Sequence: Synthetic peptide
DEEEIRTTNPVATEQYGSVSTNDQRGND

SEQ ID NO: 3871 - protein, 28 aa, Artificial Sequence
  Description of Artificial Sequence: Synthetic peptide
DEEEIRATNPVATEQYGSVSTNLQRGDR

SEQ ID NO: 3872 - protein, 29 aa, Artificial Sequence
  Description of Artificial Sequence: Synthetic peptide
DEEEIRTTNPVATEQYGAVSTNLQRGENR

SEQ ID NO: 3873 - protein, 28 aa, Artificial Sequence
  Description of Artificial Sequence: Synthetic peptide
DEEEIRTTNPVATEQYGSVSENLQLGNR

SEQ ID NO: 3874 - protein, 28 aa, Artificial Sequence
  Description of Artificial Sequence: Synthetic peptide
DEQEIRTTNPVATEQYGSVSTNLQRGNH

SEQ ID NO: 3875 - protein, 28 aa, Artificial Sequence
  Description of Artificial Sequence: Synthetic peptide
DEEEIRTTNPVATEQYGSVSTWLQRPNR

SEQ ID NO: 3876 - protein, 28 aa, Artificial Sequence
  Description of Artificial Sequence: Synthetic peptide
DEEEIRTTNPVATEKYGSVSTNLQRGDR

SEQ ID NO: 3877 - protein, 28 aa, Artificial Sequence
  Description of Artificial Sequence: Synthetic peptide
DEEEIRTTNPVATEQYGSVSELLQRGNR

SEQ ID NO: 3878 - protein, 28 aa, Artificial Sequence
  Description of Artificial Sequence: Synthetic peptide
DEEEIRTTNPVATQQYGSVSTNLQRGNQ

SEQ ID NO: 3879 - protein, 28 aa, Artificial Sequence
  Description of Artificial Sequence: Synthetic peptide
DEEEIMTTNPVATEQYGSVSTNLQQGNR

SEQ ID NO: 3880 - protein, 28 aa, Artificial Sequence
  Description of Artificial Sequence: Synthetic peptide
DEEEIRTTNPVATEQYGSVSTPLQHGNR

SEQ ID NO: 3881 - protein, 28 aa, Artificial Sequence
  Description of Artificial Sequence: Synthetic peptide
DEEEIRTTNPVSTEQYGSVSDNLQRGNR

SEQ ID NO: 3882 - protein, 28 aa, Artificial Sequence
  Description of Artificial Sequence: Synthetic peptide
DEEEIRTTNIVATEQYGSASTNLQRGNR

SEQ ID NO: 3883 - protein, 28 aa, Artificial Sequence
  Description of Artificial Sequence: Synthetic peptide
DEEEIRTTNPVAYEQYGSVETNLQRGNR

SEQ ID NO: 3884 - protein, 28 aa, Artificial Sequence
  Description of Artificial Sequence: Synthetic peptide
FEEEIRTTNPVATEQYGSVSENLQRGNR

SEQ ID NO: 3885 - protein, 28 aa, Artificial Sequence
  Description of Artificial Sequence: Synthetic peptide
DPEEIRTTNPVATEQYGSVSTNLDRGNR

SEQ ID NO: 3886 - protein, 28 aa, Artificial Sequence
  Description of Artificial Sequence: Synthetic peptide
DEEEIRTTNPVATEVYGSVSTNLQRLNR

SEQ ID NO: 3887 - protein, 30 aa, Artificial Sequence
  Description of Artificial Sequence: Synthetic polypeptide
DEEEIRTTNPVATEQYGESVSTNLVQRGNR

SEQ ID NO: 3888 - protein, 28 aa, Artificial Sequence
  Description of Artificial Sequence: Synthetic peptide
DEEEISTTNIVATEQYGSVSTNLQRGNR

SEQ ID NO: 3889 - protein, 28 aa, Artificial Sequence
  Description of Artificial Sequence: Synthetic peptide
DEEEITTTNPVATEQYGSVSSNLQRGNR

SEQ ID NO: 3890 - protein, 28 aa, Artificial Sequence
  Description of Artificial Sequence: Synthetic peptide
DEEEITTTNPVATEQYGSVGTNLQRGNR

SEQ ID NO: 3891 - protein, 29 aa, Artificial Sequence
  Description of Artificial Sequence: Synthetic peptide
DEEEIRTTNPVATEQYGSVSTNPDQRGNR

SEQ ID NO: 3892 - protein, 28 aa, Artificial Sequence
  Description of Artificial Sequence: Synthetic peptide
DEEEIVTTNPVATEQYGSVSTNLQHGNR

SEQ ID NO: 3893 - protein, 28 aa, Artificial Sequence
  Description of Artificial Sequence: Synthetic peptide
DEEEIRTTNPVATEQYGSVSTPLQRGND

SEQ ID NO: 3894 - protein, 28 aa, Artificial Sequence
  Description of Artificial Sequence: Synthetic peptide
DEEEIKTTNPVATEQYGEVSTNLQRGNR

SEQ ID NO: 3895 - protein, 29 aa, Artificial Sequence
  Description of Artificial Sequence: Synthetic peptide
DEEEIRTTNPVATEQYGSVSTNLLRDGNR

SEQ ID NO: 3896 - protein, 29 aa, Artificial Sequence
  Description of Artificial Sequence: Synthetic peptide
DEEEIRTTNPVATEQYGSVSRTNLQTGNR

SEQ ID NO: 3897 - protein, 28 aa, Artificial Sequence
  Description of Artificial Sequence: Synthetic peptide
DEEEIRTTNPCATEQYGSVSTNLQNGNR

SEQ ID NO: 3898 - protein, 28 aa, Artificial Sequence
  Description of Artificial Sequence: Synthetic peptide
DEEEIRTTNPIATEQYGSVSTALQRGNR

SEQ ID NO: 3899 - protein, 29 aa, Artificial Sequence
  Description of Artificial Sequence: Synthetic peptide
DEEEIRTTNPVATECYGSVSTNLQERGNR

SEQ ID NO: 3900 - protein, 28 aa, Artificial Sequence
  Description of Artificial Sequence: Synthetic peptide
DEEEIRTTNPVATEQYGSASENLQRGNR

SEQ ID NO: 3901 - protein, 28 aa, Artificial Sequence
  Description of Artificial Sequence: Synthetic peptide
DEEEIRTTNPVATEQYGSVSTNLQRENL

SEQ ID NO: 3902 - protein, 28 aa, Artificial Sequence
  Description of Artificial Sequence: Synthetic peptide
DEEEIRTTNPVATEQYGSVSTNLQTGND

SEQ ID NO: 3903 - protein, 29 aa, Artificial Sequence
  Description of Artificial Sequence: Synthetic peptide
DEEEIRTTNPVATEQYGSVSDNLQRNGNR

SEQ ID NO: 3904 - protein, 28 aa, Artificial Sequence
  Description of Artificial Sequence: Synthetic peptide
DEEEIATTNPVATEQYGSVSTILQRGNR

SEQ ID NO: 3905 - protein, 28 aa, Artificial Sequence
  Description of Artificial Sequence: Synthetic peptide
DEEEIRTTNPVATEQYGSVSTNLQHGNI

SEQ ID NO: 3906 - protein, 28 aa, Artificial Sequence
  Description of Artificial Sequence: Synthetic peptide
DEEEIRTTNPVATEQYGSVSMNLTRGNR

SEQ ID NO: 3907 - protein, 28 aa, Artificial Sequence
  Description of Artificial Sequence: Synthetic peptide
DEEEIRTTNPVATEQYGSVSTNLQRGMM

SEQ ID NO: 3908 - protein, 28 aa, Artificial Sequence
  Description of Artificial Sequence: Synthetic peptide
DEEEIRTTNPVAAEQYGSVSTELQRGNR

SEQ ID NO: 3909 - protein, 28 aa, Artificial Sequence
  Description of Artificial Sequence: Synthetic peptide
DEEEIRTTNPVATEQYGSVSTNLQQGNA

SEQ ID NO: 3910 - protein, 28 aa, Artificial Sequence
  Description of Artificial Sequence: Synthetic peptide
DEEEIRTTNPVATEQYGSVSTNLQVGNA

SEQ ID NO: 3911 - protein, 29 aa, Artificial Sequence
  Description of Artificial Sequence: Synthetic peptide
DEEEIRTTNPVAYEQYGSVSSTNLQRGNR

SEQ ID NO: 3912 - protein, 28 aa, Artificial Sequence
  Description of Artificial Sequence: Synthetic peptide
DEEEIRTTNPVATEQYGSVSTNLQTGNN

SEQ ID NO: 3913 - protein, 28 aa, Artificial Sequence
  Description of Artificial Sequence: Synthetic peptide
DEEEIRTTNPCATEQYGSVSYNLQRGNR

SEQ ID NO: 3914 - protein, 29 aa, Artificial Sequence
  Description of Artificial Sequence: Synthetic peptide
DEEEIRTTNPVATEQYGSVSTNLQLRGNV

SEQ ID NO: 3915 - protein, 28 aa, Artificial Sequence
  Description of Artificial Sequence: Synthetic peptide
DEEEIRTTNPVATECYGSVSTNLQRGER

SEQ ID NO: 3916 - protein, 28 aa, Artificial Sequence
  Description of Artificial Sequence: Synthetic peptide
DEEEIRTTNPVATEQYGDVSTNLQAGNR

SEQ ID NO: 3917 - protein, 28 aa, Artificial Sequence
  Description of Artificial Sequence: Synthetic peptide
DEEEIRTTNPVSTEQYGNVSTNLQRGNR

SEQ ID NO: 3918 - protein, 29 aa, Artificial Sequence
  Description of Artificial Sequence: Synthetic peptide
DEEEIRTTNPFATEQYGSVSTLNLQRGNR

SEQ ID NO: 3919 - protein, 28 aa, Artificial Sequence
  Description of Artificial Sequence: Synthetic peptide
DEEEIGTTNPVATEQYGSVSTNLQRGGR

SEQ ID NO: 3920 - protein, 28 aa, Artificial Sequence
  Description of Artificial Sequence: Synthetic peptide
DEEEIRTTNPVATEQYGSVSTNCQRGNK

SEQ ID NO: 3921 - protein, 28 aa, Artificial Sequence
  Description of Artificial Sequence: Synthetic peptide
DEEEIRTTNPVATEQYGSVSTNLQYGND

SEQ ID NO: 3922 - protein, 28 aa, Artificial Sequence
  Description of Artificial Sequence: Synthetic peptide
DEEEIRCTNPIATEQYGSVSTNLQRGNR

SEQ ID NO: 3923 - protein, 29 aa, Artificial Sequence
  Description of Artificial Sequence: Synthetic peptide
DEEEIRTTNPVATEHYGSVSTNLQNRGNR

SEQ ID NO: 3924 - protein, 28 aa, Artificial Sequence
  Description of Artificial Sequence: Synthetic peptide
DEEEIRCTNPVATEQYGSVSMNLQRGNR

SEQ ID NO: 3925 - protein, 28 aa, Artificial Sequence
  Description of Artificial Sequence: Synthetic peptide
DEEEIRTTNPVATEQYGSVATNLMRGNR

SEQ ID NO: 3926 - protein, 29 aa, Artificial Sequence
  Description of Artificial Sequence: Synthetic peptide
DEEEIRTTNPVATEQYGSVSTNPLQRGNT

SEQ ID NO: 3927 - protein, 28 aa, Artificial Sequence
  Description of Artificial Sequence: Synthetic peptide
DEEEIRTTNPVATEQYGSVSTNLQVGNQ

SEQ ID NO: 3928 - protein, 28 aa, Artificial Sequence
  Description of Artificial Sequence: Synthetic peptide
DEEEIRTTNPVATEQYGSVATNLQRGGR

SEQ ID NO: 3929 - protein, 28 aa, Artificial Sequence
  Description of Artificial Sequence: Synthetic peptide
MEEEIRTTNPVATEQYGSVSTNLQGGNR

SEQ ID NO: 3930 - protein, 28 aa, Artificial Sequence
  Description of Artificial Sequence: Synthetic peptide
DEEEIRTTNPVATEQYGSVSTNLQAGNC

SEQ ID NO: 3931 - protein, 28 aa, Artificial Sequence
  Description of Artificial Sequence: Synthetic peptide
DEEEIRTTNPVATEQFGSVSTNLQIGNR

SEQ ID NO: 3932 - protein, 28 aa, Artificial Sequence
  Description of Artificial Sequence: Synthetic peptide
DEEEIRCTNPVATEQYGAVSTNLQRGNR

SEQ ID NO: 3933 - protein, 28 aa, Artificial Sequence
  Description of Artificial Sequence: Synthetic peptide
DEEEIRTTNPVATEMYGVVSTNLQRGNR

SEQ ID NO: 3934 - protein, 28 aa, Artificial Sequence
  Description of Artificial Sequence: Synthetic peptide
DECEIRTTNPVATEQYGSVSTNLQRGNA

SEQ ID NO: 3935 - protein, 29 aa, Artificial Sequence
  Description of Artificial Sequence: Synthetic peptide
DEEEITTTNPVATEQYGSVSTNLQCRGNR

SEQ ID NO: 3936 - protein, 28 aa, Artificial Sequence
  Description of Artificial Sequence: Synthetic peptide
DEEEIRATNPVATEQYGSVSTNLQRGNH

SEQ ID NO: 3937 - protein, 28 aa, Artificial Sequence
  Description of Artificial Sequence: Synthetic peptide
DEEEIRTTNPVATEQYGSVSTPLQDGNR

SEQ ID NO: 3938 - protein, 28 aa, Artificial Sequence
  Description of Artificial Sequence: Synthetic peptide
DEEEIRATNPVATEQYGSVSTNLQRGNV

SEQ ID NO: 3939 - protein, 29 aa, Artificial Sequence
  Description of Artificial Sequence: Synthetic peptide
DEEEIRTTNPVATELYGSVSCTNLQRGNR

SEQ ID NO: 3940 - protein, 30 aa, Artificial Sequence
  Description of Artificial Sequence: Synthetic polypeptide
DEEEIRTTNPVATEQYGSVCSTGNLQRGNR

SEQ ID NO: 3941 - protein, 30 aa, Artificial Sequence
  Description of Artificial Sequence: Synthetic polypeptide
DEEEIRTTNPVATEQYGSVSTNGLVQRGNR

SEQ ID NO: 3942 - protein, 28 aa, Artificial Sequence
  Description of Artificial Sequence: Synthetic peptide
DEEEIRATNPVATEMYGSVSTNLQRGNR

SEQ ID NO: 3943 - protein, 28 aa, Artificial Sequence
  Description of Artificial Sequence: Synthetic peptide
DEEEIATTNPVATEQYGSVSTNLQHGNR

SEQ ID NO: 3944 - protein, 29 aa, Artificial Sequence
  Description of Artificial Sequence: Synthetic peptide
DEEEIRTTNPVATEQYGSVSTNLQEDGNR

SEQ ID NO: 3945 - protein, 29 aa, Artificial Sequence
  Description of Artificial Sequence: Synthetic peptide
DEEEIRTTNPVATEQYGSVPSTNLQYGNR

SEQ ID NO: 3946 - protein, 28 aa, Artificial Sequence
  Description of Artificial Sequence: Synthetic peptide
DEEEIRTTNIVATEQYGCVSTNLQRGNR

SEQ ID NO: 3947 - protein, 28 aa, Artificial Sequence
  Description of Artificial Sequence: Synthetic peptide
DEEEIRTTNPVATEQYGSVSTDLQRGNW

SEQ ID NO: 3948 - protein, 28 aa, Artificial Sequence
  Description of Artificial Sequence: Synthetic peptide
DEEMIRTTNPVATEQYGSVSTNDQRGNR

SEQ ID NO: 3949 - protein, 28 aa, Artificial Sequence
  Description of Artificial Sequence: Synthetic peptide
DEEEIRTTNPVATEQYGSVSDNLMRGNR

SEQ ID NO: 3950 - protein, 29 aa, Artificial Sequence
  Description of Artificial Sequence: Synthetic peptide
DEEEIRTTNPVATEQYGSVSTNLQRGENE

SEQ ID NO: 3951 - protein, 29 aa, Artificial Sequence
  Description of Artificial Sequence: Synthetic peptide
DEEEIRTTNPVATEQYGDVSTNLQQRGNR

SEQ ID NO: 3952 - protein, 28 aa, Artificial Sequence
  Description of Artificial Sequence: Synthetic peptide
DEPEIRTTNPVATEQYGSVSTNLLRGNR

SEQ ID NO: 3953 - protein, 29 aa, Artificial Sequence
  Description of Artificial Sequence: Synthetic peptide
DEEEIRTTNPVATEQYGSVVSTQLQRGNR

SEQ ID NO: 3954 - protein, 28 aa, Artificial Sequence
  Description of Artificial Sequence: Synthetic peptide
DEEEIRQTNPVATEQYGSVSTNLERGNR

SEQ ID NO: 3955 - protein, 28 aa, Artificial Sequence
  Description of Artificial Sequence: Synthetic peptide
DEEEIRTTNPVATEQYGSVSTNPQVGNR

SEQ ID NO: 3956 - protein, 28 aa, Artificial Sequence
  Description of Artificial Sequence: Synthetic peptide
DEEEIRTTNPVATEQYGVVSTNLQRGNY

SEQ ID NO: 3957 - protein, 28 aa, Artificial Sequence
  Description of Artificial Sequence: Synthetic peptide
DEEEIRTTNPVATEQYGDVCTNLQRGNR

SEQ ID NO: 3958 - protein, 28 aa, Artificial Sequence
  Description of Artificial Sequence: Synthetic peptide
DEEEIRTTNPVATEQYGSVSTNLQQGTR

SEQ ID NO: 3959 - protein, 28 aa, Artificial Sequence
  Description of Artificial Sequence: Synthetic peptide
DEEEIRTTNPVAYEQYGSVSTNLQRGLR

SEQ ID NO: 3960 - protein, 28 aa, Artificial Sequence
  Description of Artificial Sequence: Synthetic peptide
DEEEIRTTNPVATEQYGSVSTNLQIGNF

SEQ ID NO: 3961 - protein, 28 aa, Artificial Sequence
  Description of Artificial Sequence: Synthetic peptide
DEGEIRTTNPVATEQYGSVATNLQRGNR

SEQ ID NO: 3962 - protein, 28 aa, Artificial Sequence
  Description of Artificial Sequence: Synthetic peptide
DEEEIRTTNPFATEQYGSVSTNLQRGNN

SEQ ID NO: 3963 - protein, 29 aa, Artificial Sequence
  Description of Artificial Sequence: Synthetic peptide
DEEEIVTTNPVATEQYGSVSTNLQSRGNR

SEQ ID NO: 3964 - protein, 28 aa, Artificial Sequence
  Description of Artificial Sequence: Synthetic peptide
VEEEIRTTNPVATEQYGVVSTNLQRGNR

SEQ ID NO: 3965 - protein, 28 aa, Artificial Sequence
  Description of Artificial Sequence: Synthetic peptide
DEEEIRTTNPVATEQYGSVSTEPQRGNR

SEQ ID NO: 3966 - protein, 28 aa, Artificial Sequence
  Description of Artificial Sequence: Synthetic peptide
DEEEIRTTNPVATEQYGGVSCNLQRGNR

SEQ ID NO: 3967 - protein, 28 aa, Artificial Sequence
  Description of Artificial Sequence: Synthetic peptide
DEEEIRTVNPVATEQYGSVSTNLQQGNR

SEQ ID NO: 3968 - protein, 28 aa, Artificial Sequence
  Description of Artificial Sequence: Synthetic peptide
DEEEIAQTNPVATEQYGSVSTNLQRGNR

SEQ ID NO: 3969 - protein, 28 aa, Artificial Sequence
  Description of Artificial Sequence: Synthetic peptide
DEEEIRTTNPVATEQYGSVSTDLQRGDR

SEQ ID NO: 3970 - protein, 28 aa, Artificial Sequence
  Description of Artificial Sequence: Synthetic peptide
DEEEIRTTNPVATEQYGSASTNLQRGDR

SEQ ID NO: 3971 - protein, 28 aa, Artificial Sequence
  Description of Artificial Sequence: Synthetic peptide
DEEEIRTTNPVSTEQYGSVPTNLQRGNR

SEQ ID NO: 3972 - protein, 29 aa, Artificial Sequence
  Description of Artificial Sequence: Synthetic peptide
DEEEIRTTNPVATEQYGSVSTNLQFSGNR

SEQ ID NO: 3973 - protein, 28 aa, Artificial Sequence
  Description of Artificial Sequence: Synthetic peptide
DAEEIRTTNPVATEQYGSVSTNLPRGNR

SEQ ID NO: 3974 - protein, 28 aa, Artificial Sequence
  Description of Artificial Sequence: Synthetic peptide
SEEEIRTTNPVATEQYGSVSTNLQRGNH

SEQ ID NO: 3975 - protein, 29 aa, Artificial Sequence
  Description of Artificial Sequence: Synthetic peptide
DEEEIRTTNPVATECYGSVSTNLQREGNR

SEQ ID NO: 3976 - protein, 28 aa, Artificial Sequence
  Description of Artificial Sequence: Synthetic peptide
DEEEIRTTNPFATEQYGSVSTNLIRGNR

SEQ ID NO: 3977 - protein, 28 aa, Artificial Sequence
  Description of Artificial Sequence: Synthetic peptide
DENEIRTTNPVATEQYGSVGTNLQRGNR

SEQ ID NO: 3978 - protein, 28 aa, Artificial Sequence
  Description of Artificial Sequence: Synthetic peptide
DEEEIRTTNPVATEQYGSVAENLQRGNR

SEQ ID NO: 3979 - protein, 29 aa, Artificial Sequence
  Description of Artificial Sequence: Synthetic peptide
DEEEIRTTNPVATEQYGSVSTNLDLRGNR

SEQ ID NO: 3980 - protein, 28 aa, Artificial Sequence
  Description of Artificial Sequence: Synthetic peptide
DEEEIATTNPVATEQYGAVSTNLQRGNR

SEQ ID NO: 3981 - protein, 28 aa, Artificial Sequence
  Description of Artificial Sequence: Synthetic peptide
DEEEIRTTNPVATEQYGSVSTNLQGGNW

SEQ ID NO: 3982 - protein, 29 aa, Artificial Sequence
  Description of Artificial Sequence: Synthetic peptide
DEEEIRTTNPVATEQYGSVSTNEQRGNTR

SEQ ID NO: 3983 - protein, 28 aa, Artificial Sequence
  Description of Artificial Sequence: Synthetic peptide
DEEEIRTTNPVATEQYGSVSTNLDRGMR

SEQ ID NO: 3984 - protein, 28 aa, Artificial Sequence
  Description of Artificial Sequence: Synthetic peptide
DEEEIRTTNPVATECYGSVSTNLQRGNM

SEQ ID NO: 3985 - protein, 28 aa, Artificial Sequence
  Description of Artificial Sequence: Synthetic peptide
DEEEIRATNPVATEQYGSVSTNLQNGNR

SEQ ID NO: 3986 - protein, 28 aa, Artificial Sequence
  Description of Artificial Sequence: Synthetic peptide
DEEEIRTVNPVATEQYGSVSTNLQRGNM

SEQ ID NO: 3987 - protein, 28 aa, Artificial Sequence
  Description of Artificial Sequence: Synthetic peptide
DEEEIRTTNPVATEQYGSVSTNLQDENR

SEQ ID NO: 3988 - protein, 29 aa, Artificial Sequence
  Description of Artificial Sequence: Synthetic peptide
DEEEIVTTNPVATEQYGSVSATNLQRGNR

SEQ ID NO: 3989 - protein, 30 aa, Artificial Sequence
  Description of Artificial Sequence: Synthetic polypeptide
DEEEIRTTNPVATEQYGSVSSTNLNQRGNR

SEQ ID NO: 3990 - protein, 28 aa, Artificial Sequence
  Description of Artificial Sequence: Synthetic peptide
DEEEIACTNPVATEQYGSVSTNLQRGNR

SEQ ID NO: 3991 - protein, 28 aa, Artificial Sequence
  Description of Artificial Sequence: Synthetic peptide
DEEEIRTTNPVATEQYGSVSTGLQRGNT

SEQ ID NO: 3992 - protein, 28 aa, Artificial Sequence
  Description of Artificial Sequence: Synthetic peptide
DEEEIRTTNPVATEQYGSVSTNQQRGNH

SEQ ID NO: 3993 - protein, 28 aa, Artificial Sequence
  Description of Artificial Sequence: Synthetic peptide
DEEEIRTTNIVATEQYGSVSTNLQRGGR

SEQ ID NO: 3994 - protein, 28 aa, Artificial Sequence
  Description of Artificial Sequence: Synthetic peptide
DEEEIRTTNPVATEQYGSVSTNDQRGNP

SEQ ID NO: 3995 - protein, 28 aa, Artificial Sequence
  Description of Artificial Sequence: Synthetic peptide
DEEEIRTTNPVATEQYGSVGTNLQRGNA

SEQ ID NO: 3996 - protein, 28 aa, Artificial Sequence
  Description of Artificial Sequence: Synthetic peptide
DEEEIRTTNPVATEQYGSVFTNLQPGNR

SEQ ID NO: 3997 - protein, 28 aa, Artificial Sequence
  Description of Artificial Sequence: Synthetic peptide
DEEEIRTTNPVATEQYGSASTNLQEGNR

SEQ ID NO: 3998 - protein, 28 aa, Artificial Sequence
  Description of Artificial Sequence: Synthetic peptide
DEEEIRTTNPVATEQYGSVSTNLEAGNR

SEQ ID NO: 3999 - protein, 29 aa, Artificial Sequence
  Description of Artificial Sequence: Synthetic peptide
DEEEIRTTNPVSTEQYGSVSTNLQRGNER

SEQ ID NO: 4000 - protein, 28 aa, Artificial Sequence
  Description of Artificial Sequence: Synthetic peptide
DEQEIRTTNPVATEQYGWVSTNLQRGNR

SEQ ID NO: 4001 - protein, 28 aa, Artificial Sequence
  Description of Artificial Sequence: Synthetic peptide
DEEEIRTTNPVASEQYGSVSENLQRGNR

SEQ ID NO: 4002 - protein, 28 aa, Artificial Sequence
  Description of Artificial Sequence: Synthetic peptide
DEEEIRTTNPVATEQYGSVSTNPQAGNR

SEQ ID NO: 4003 - protein, 29 aa, Artificial Sequence
  Description of Artificial Sequence: Synthetic peptide
DEEEIRTTNPVATEQYGSVSTNLENRGNR

SEQ ID NO: 4004 - protein, 28 aa, Artificial Sequence
  Description of Artificial Sequence: Synthetic peptide
DEVEIRTTNPVATEQYGSVSTNLQTGNR

SEQ ID NO: 4005 - protein, 29 aa, Artificial Sequence
  Description of Artificial Sequence: Synthetic peptide
DEEEIRTTNPVATEQYGSVSTNLQCYGNR

SEQ ID NO: 4006 - protein, 28 aa, Artificial Sequence
  Description of Artificial Sequence: Synthetic peptide
DEEEIRTTNPVATEQYGSVSTGLERGNR

SEQ ID NO: 4007 - protein, 28 aa, Artificial Sequence
  Description of Artificial Sequence: Synthetic peptide
DEEEIRTTNPVATEQFGWVSTNLQRGNR

SEQ ID NO: 4008 - protein, 29 aa, Artificial Sequence
  Description of Artificial Sequence: Synthetic peptide
DEEEIRTTNPVATEQYGSVSATNLQRLNR

SEQ ID NO: 4009 - protein, 28 aa, Artificial Sequence
  Description of Artificial Sequence: Synthetic peptide
DEEEIRTTNPVATEQYGSVSTELQFGNR

SEQ ID NO: 4010 - protein, 28 aa, Artificial Sequence
  Description of Artificial Sequence: Synthetic peptide
DEEEIRTTNPVATEQYGSVSDNLQKGNR

SEQ ID NO: 4011 - protein, 28 aa, Artificial Sequence
  Description of Artificial Sequence: Synthetic peptide
DEEEIRTTNPVATEQYGCVSTNLQRGNF

SEQ ID NO: 4012 - protein, 28 aa, Artificial Sequence
  Description of Artificial Sequence: Synthetic peptide
DEEEIRTTNPVATEQYGSVSENLQRGQR

SEQ ID NO: 4013 - protein, 28 aa, Artificial Sequence
  Description of Artificial Sequence: Synthetic peptide
DEEEIRTTNPVATEQYGSHSTNLQRGER

SEQ ID NO: 4014 - protein, 28 aa, Artificial Sequence
  Description of Artificial Sequence: Synthetic peptide
DEEEIRTTNPVATEQYGSVSTNLQREDR

SEQ ID NO: 4015 - protein, 29 aa, Artificial Sequence
  Description of Artificial Sequence: Synthetic peptide
DEEEIRTTNPVATEQYGSVSTNIQRAGNR

SEQ ID NO: 4016 - protein, 28 aa, Artificial Sequence
  Description of Artificial Sequence: Synthetic peptide
DEEEIRTTNPVATEQYGDVSTNLQRGNT

SEQ ID NO: 4017 - protein, 29 aa, Artificial Sequence
  Description of Artificial Sequence: Synthetic peptide
DEEEIRTTNPVATEQYGSVSENLQVRGNR

SEQ ID NO: 4018 - protein, 28 aa, Artificial Sequence
  Description of Artificial Sequence: Synthetic peptide
DEEEIVTTNPVATEQYGEVSTNLQRGNR

SEQ ID NO: 4019 - protein, 28 aa, Artificial Sequence
  Description of Artificial Sequence: Synthetic peptide
DEEEIRTTNPVATEIYGEVSTNLQRGNR

SEQ ID NO: 4020 - protein, 28 aa, Artificial Sequence
  Description of Artificial Sequence: Synthetic peptide
DEEEIRTTNPVATEIYGSVSTNLQRPNR

SEQ ID NO: 4021 - protein, 28 aa, Artificial Sequence
  Description of Artificial Sequence: Synthetic peptide
DEEEIRTTSIVATEQYGSVSTNLQRGNR

SEQ ID NO: 4022 - protein, 28 aa, Artificial Sequence
  Description of Artificial Sequence: Synthetic peptide
DEEELRTTNPVATEQYGSVSENLQRGNR

SEQ ID NO: 4023 - protein, 28 aa, Artificial Sequence
  Description of Artificial Sequence: Synthetic peptide
DEEEIRTTNPVATEQYGSVSTNLQRGTT

SEQ ID NO: 4024 - protein, 28 aa, Artificial Sequence
  Description of Artificial Sequence: Synthetic peptide
DEEEIRTTNPCATEVYGSVSTNLQRGNR

SEQ ID NO: 4025 - protein, 30 aa, Artificial Sequence
  Description of Artificial Sequence: Synthetic polypeptide
DEEEIRTTNPVATEQYGSVSDTNLQRDGNR

SEQ ID NO: 4026 - protein, 29 aa, Artificial Sequence
  Description of Artificial Sequence: Synthetic peptide
DEEEIRTTNPVATEQYGSVSTENLQRGNF

SEQ ID NO: 4027 - protein, 28 aa, Artificial Sequence
  Description of Artificial Sequence: Synthetic peptide
DEEEIRTTNPVATEQYGSVSTNLQAGNM

SEQ ID NO: 4028 - protein, 28 aa, Artificial Sequence
  Description of Artificial Sequence: Synthetic peptide
DEEEIRTTNPVATENYGSVSTNLQRGNS

SEQ ID NO: 4029 - protein, 29 aa, Artificial Sequence
  Description of Artificial Sequence: Synthetic peptide
DEEEIRTTNPVATEQYGSVSTTNLQRGSR

SEQ ID NO: 4030 - protein, 28 aa, Artificial Sequence
  Description of Artificial Sequence: Synthetic peptide
DEEEIRTTNPVATEQYGMVSTNVQRGNR

SEQ ID NO: 4031 - protein, 28 aa, Artificial Sequence
  Description of Artificial Sequence: Synthetic peptide
DEEEIRTTNPVATEVYGSVSTNLQAGNR

SEQ ID NO: 4032 - protein, 28 aa, Artificial Sequence
  Description of Artificial Sequence: Synthetic peptide
DEEEIVTTNPVATEQYGSVSENLQRGNR

SEQ ID NO: 4033 - protein, 28 aa, Artificial Sequence
  Description of Artificial Sequence: Synthetic peptide
DEEEIRTTNPVATEQYGSWSTNDQRGNR

SEQ ID NO: 4034 - protein, 29 aa, Artificial Sequence
  Description of Artificial Sequence: Synthetic peptide
DEEEIRTTNPVATEQYGSVSCTNLARGNR

SEQ ID NO: 4035 - protein, 29 aa, Artificial Sequence
  Description of Artificial Sequence: Synthetic peptide
DEEEIRTTNPVATEQYGSVSENLQRSGNR

SEQ ID NO: 4036 - protein, 28 aa, Artificial Sequence
  Description of Artificial Sequence: Synthetic peptide
DEEEIRTTNPVATENYGSVSTNLQRGNF

SEQ ID NO: 4037 - protein, 28 aa, Artificial Sequence
  Description of Artificial Sequence: Synthetic peptide
GENEIRTTNPVATEQYGSVSTNLQRGNR

SEQ ID NO: 4038 - protein, 29 aa, Artificial Sequence
  Description of Artificial Sequence: Synthetic peptide
DEEEIRTTNPVATEQYGSVSTNLQNQGNR

SEQ ID NO: 4039 - protein, 30 aa, Artificial Sequence
  Description of Artificial Sequence: Synthetic polypeptide
DEEEIRTTNPVATEQYGSIVSTNLQSRGNR

SEQ ID NO: 4040 - protein, 28 aa, Artificial Sequence
  Description of Artificial Sequence: Synthetic peptide
DEEEIRTTNPVATEQYGSVPTNCQRGNR

SEQ ID NO: 4041 - protein, 29 aa, Artificial Sequence
  Description of Artificial Sequence: Synthetic peptide
DEEEIRTTNPVATEQYGSVSDNLQFRGNR

SEQ ID NO: 4042 - protein, 28 aa, Artificial Sequence
  Description of Artificial Sequence: Synthetic peptide
DEEEIRTTNITATEQYGSVSTNLQRGNR

SEQ ID NO: 4043 - protein, 28 aa, Artificial Sequence
  Description of Artificial Sequence: Synthetic peptide
MEEEIRTTNPVATEQYGSVSTNLQRGNE

SEQ ID NO: 4044 - protein, 28 aa, Artificial Sequence
  Description of Artificial Sequence: Synthetic peptide
DEEEIRTTNPVATEQYGDVSTNLQRGTR

SEQ ID NO: 4045 - protein, 28 aa, Artificial Sequence
  Description of Artificial Sequence: Synthetic peptide
QEEEIRTTNPVSTEQYGSVSTNLQRGNR

SEQ ID NO: 4046 - protein, 28 aa, Artificial Sequence
  Description of Artificial Sequence: Synthetic peptide
DEEEIRTTNPVATEQYGSVCENLQRGNR

SEQ ID NO: 4047 - protein, 28 aa, Artificial Sequence
  Description of Artificial Sequence: Synthetic peptide
DEDEIRTTNPVATEQYGSVSTNLQRGNF

SEQ ID NO: 4048 - protein, 29 aa, Artificial Sequence
  Description of Artificial Sequence: Synthetic peptide
DEEEIRTTNPVATEQYGSVSDNLQRAGNR

SEQ ID NO: 4049 - protein, 28 aa, Artificial Sequence
  Description of Artificial Sequence: Synthetic peptide
DAEEIRTTNPVATEQYGSVSTALQRGNR

SEQ ID NO: 4050 - protein, 29 aa, Artificial Sequence
  Description of Artificial Sequence: Synthetic peptide
DEEEIRTTNPVATEQYGSVDTNLQRGINR

SEQ ID NO: 4051 - protein, 28 aa, Artificial Sequence
  Description of Artificial Sequence: Synthetic peptide
DEEEIRTTNIVATECYGSVSTNLQRGNR

SEQ ID NO: 4052 - protein, 28 aa, Artificial Sequence
  Description of Artificial Sequence: Synthetic peptide
DEEEIRTTNPVATETYGSVSTNLQRGNF

SEQ ID NO: 4053 - protein, 28 aa, Artificial Sequence
  Description of Artificial Sequence: Synthetic peptide
DEEEIRTTNPVATEQYGDVSTNLQRGNI

SEQ ID NO: 4054 - protein, 28 aa, Artificial Sequence
  Description of Artificial Sequence: Synthetic peptide
DEEEIRTTNPVATEQYGSVSTNLCNGNR

SEQ ID NO: 4055 - protein, 30 aa, Artificial Sequence
  Description of Artificial Sequence: Synthetic polypeptide
DEEEIRTTNPVATEQYGSVSWTNLQRGPNR

SEQ ID NO: 4056 - protein, 28 aa, Artificial Sequence
  Description of Artificial Sequence: Synthetic peptide
DEEEIRTTNPVATEQYGSVSENLQRGLR

SEQ ID NO: 4057 - protein, 28 aa, Artificial Sequence
  Description of Artificial Sequence: Synthetic peptide
DEEEIRPTNPVATEQYGSVSTNLQRGNP

SEQ ID NO: 4058 - protein, 28 aa, Artificial Sequence
  Description of Artificial Sequence: Synthetic peptide
DEEEIRTTNPVATEQYGNVSTNLQRGNY

SEQ ID NO: 4059 - protein, 28 aa, Artificial Sequence
  Description of Artificial Sequence: Synthetic peptide
IEEEIRTTNPVSTEQYGSVSTNLQRGNR

SEQ ID NO: 4060 - protein, 29 aa, Artificial Sequence
  Description of Artificial Sequence: Synthetic peptide
DEEEIRTTNPVATEQYGSVSTNLQTHGNR

SEQ ID NO: 4061 - protein, 29 aa, Artificial Sequence
  Description of Artificial Sequence: Synthetic peptide
DEEEIRTTNPVATEQYGSVSTNLERKGNR

SEQ ID NO: 4062 - protein, 29 aa, Artificial Sequence
  Description of Artificial Sequence: Synthetic peptide
DEEEIRTTNPVATEQYGWVSATNLQRGNR

SEQ ID NO: 4063 - protein, 28 aa, Artificial Sequence
  Description of Artificial Sequence: Synthetic peptide
DEEEIRTTNPVATEQYGSVSSNLQRGNI

SEQ ID NO: 4064 - protein, 28 aa, Artificial Sequence
  Description of Artificial Sequence: Synthetic peptide
DEEEIRTTNPVATEQYGSASTNLQRGMR

SEQ ID NO: 4065 - protein, 28 aa, Artificial Sequence
  Description of Artificial Sequence: Synthetic peptide
DEEEIRTTNPFATEQYGSVSTNLFRGNR

SEQ ID NO: 4066 - protein, 28 aa, Artificial Sequence
  Description of Artificial Sequence: Synthetic peptide
DEEEIRTTNTVATEQYGSVSTNLQIGNR

SEQ ID NO: 4067 - protein, 28 aa, Artificial Sequence
  Description of Artificial Sequence: Synthetic peptide
DEEEIRATNPVATEQYGSVSTNLDRGNR

SEQ ID NO: 4068 - protein, 28 aa, Artificial Sequence
  Description of Artificial Sequence: Synthetic peptide
DEEEIRTTNPVATEQYGSVSTNDDRGNR

SEQ ID NO: 4069 - protein, 28 aa, Artificial Sequence
  Description of Artificial Sequence: Synthetic peptide
DEEEIRTTNPVATEQYGAVSTNLPRGNR

SEQ ID NO: 4070 - protein, 28 aa, Artificial Sequence
  Description of Artificial Sequence: Synthetic peptide
DEEEIRTTNPVATEQYGSVTTNLQRGLR

SEQ ID NO: 4071 - protein, 29 aa, Artificial Sequence
  Description of Artificial Sequence: Synthetic peptide
DEEEIRTTNPVATEQYGSVSTNWQRGVNR

SEQ ID NO: 4072 - protein, 28 aa, Artificial Sequence
  Description of Artificial Sequence: Synthetic peptide
DEEEIRTTNPVATEQYGSVSTNLQAGNY

SEQ ID NO: 4073 - protein, 28 aa, Artificial Sequence
  Description of Artificial Sequence: Synthetic peptide
DEEEIRTTNPVATEQYGEVSDNLQRGNR

SEQ ID NO: 4074 - protein, 29 aa, Artificial Sequence
  Description of Artificial Sequence: Synthetic peptide
DEEEIRTTNPVAAEQYGSVSTNLQRGDNR

SEQ ID NO: 4075 - protein, 28 aa, Artificial Sequence
  Description of Artificial Sequence: Synthetic peptide
DEEEIRTTNPVATEQYGEVSTNLQRFNR

SEQ ID NO: 4076 - protein, 28 aa, Artificial Sequence
  Description of Artificial Sequence: Synthetic peptide
DEEEIRTTNPDATEQYGSVSTNLQRGNS

SEQ ID NO: 4077 - protein, 28 aa, Artificial Sequence
  Description of Artificial Sequence: Synthetic peptide
DEEEIATTNPVATEQYGSVSTNLQRGMR

SEQ ID NO: 4078 - protein, 28 aa, Artificial Sequence
  Description of Artificial Sequence: Synthetic peptide
DEEEIRTTNPVATEQYGSVSTNLQIGDR

SEQ ID NO: 4079 - protein, 28 aa, Artificial Sequence
  Description of Artificial Sequence: Synthetic peptide
DEEEIRQTNPVATEQYGSVSTNLQRGNG

SEQ ID NO: 4080 - protein, 28 aa, Artificial Sequence
  Description of Artificial Sequence: Synthetic peptide
DEEEIRTTNPVATEQYGSVSTNLQQGPR

SEQ ID NO: 4081 - protein, 28 aa, Artificial Sequence
  Description of Artificial Sequence: Synthetic peptide
DDVEIRTTNPVATEQYGSVSTNLQRGNR

SEQ ID NO: 4082 - protein, 30 aa, Artificial Sequence
  Description of Artificial Sequence: Synthetic polypeptide
DEEEIRTTNPVATEQYGSVSETNLQDRGNR

SEQ ID NO: 4083 - protein, 29 aa, Artificial Sequence
  Description of Artificial Sequence: Synthetic peptide
DEEEIRTTNPVATEQYGSVEITNLQRGNR

SEQ ID NO: 4084 - protein, 28 aa, Artificial Sequence
  Description of Artificial Sequence: Synthetic peptide
DEEEIRTTNPVATEQYGSVSEALQRGNR

SEQ ID NO: 4085 - protein, 28 aa, Artificial Sequence
  Description of Artificial Sequence: Synthetic peptide
DEEEIRTTNPVATEQYGSVSTNLERGNV

SEQ ID NO: 4086 - protein, 28 aa, Artificial Sequence
  Description of Artificial Sequence: Synthetic peptide
DEEEIRTTNPVATELYGSVSTNPQRGNR

SEQ ID NO: 4087 - protein, 29 aa, Artificial Sequence
  Description of Artificial Sequence: Synthetic peptide
DEEEIRTTNPVATEQYGSVSCTNLQYGNR

SEQ ID NO: 4088 - protein, 30 aa, Artificial Sequence
  Description of Artificial Sequence: Synthetic polypeptide
DEEEIRTTNPVATEQYGSVSTANWLQRGNR

SEQ ID NO: 4089 - protein, 28 aa, Artificial Sequence
  Description of Artificial Sequence: Synthetic peptide
DEEEIMTTNPVATEQYGVVSTNLQRGNR

SEQ ID NO: 4090 - protein, 28 aa, Artificial Sequence
  Description of Artificial Sequence: Synthetic peptide
DEEEIRTTNPVSTEGYGSVSTNLQRGNR

SEQ ID NO: 4091 - protein, 28 aa, Artificial Sequence
  Description of Artificial Sequence: Synthetic peptide
DEEEIRTTNPVATEIYGSVSNNLQRGNR

SEQ ID NO: 4092 - protein, 28 aa, Artificial Sequence
  Description of Artificial Sequence: Synthetic peptide
DEEEIRTTNPVATEQYGEVSTNLQRGGR

SEQ ID NO: 4093 - protein, 28 aa, Artificial Sequence
  Description of Artificial Sequence: Synthetic peptide
DEEEIRTTNPVATEQYGSVSTPLQRGNL

SEQ ID NO: 4094 - protein, 29 aa, Artificial Sequence
  Description of Artificial Sequence: Synthetic peptide
DEEEIRTTNPVATEQYGSVSATNLQRGND

SEQ ID NO: 4095 - protein, 29 aa, Artificial Sequence
  Description of Artificial Sequence: Synthetic peptide
DEEEIRTTNPVATEQYGSVSTTALQRGNR

SEQ ID NO: 4096 - protein, 29 aa, Artificial Sequence
  Description of Artificial Sequence: Synthetic peptide
DEEEIRTTNPVATECYGSVQSTNLQRGNR

SEQ ID NO: 4097 - protein, 28 aa, Artificial Sequence
  Description of Artificial Sequence: Synthetic peptide
DEEEIRTTNPVATEQYGDVSTNLQQGNR

SEQ ID NO: 4098 - protein, 29 aa, Artificial Sequence
  Description of Artificial Sequence: Synthetic peptide
DEEEIRTTNPVATEQYGSVSTNLQVRGNL

SEQ ID NO: 4099 - protein, 29 aa, Artificial Sequence
  Description of Artificial Sequence: Synthetic peptide
DEEEIRTTNPVATEQYGSVSTINLQRGNS

SEQ ID NO: 4100 - protein, 28 aa, Artificial Sequence
  Description of Artificial Sequence: Synthetic peptide
DEEEIVATNPVATEQYGSVSTNLQRGNR

SEQ ID NO: 4101 - protein, 29 aa, Artificial Sequence
  Description of Artificial Sequence: Synthetic peptide
DEEEIRTTNPVATEQYGSVSTNLTRGLNR

SEQ ID NO: 4102 - protein, 28 aa, Artificial Sequence
  Description of Artificial Sequence: Synthetic peptide
DEEEIRTTNPVATEQYGSVSTNPERGNR

SEQ ID NO: 4103 - protein, 30 aa, Artificial Sequence
  Description of Artificial Sequence: Synthetic polypeptide
DEEEIRTTNPVATEQYGSVSTENLQRTGNR

SEQ ID NO: 4104 - protein, 28 aa, Artificial Sequence
  Description of Artificial Sequence: Synthetic peptide
DEEEIRTTNPVATEQYGSVSTGLFRGNR

SEQ ID NO: 4105 - protein, 28 aa, Artificial Sequence
  Description of Artificial Sequence: Synthetic peptide
DEEEIRTTNPVATEQYGSVSTNLERGNG

SEQ ID NO: 4106 - protein, 28 aa, Artificial Sequence
  Description of Artificial Sequence: Synthetic peptide
DEEEIRTTNPVATEQYGSVSTNIQAGNR

SEQ ID NO: 4107 - protein, 28 aa, Artificial Sequence
  Description of Artificial Sequence: Synthetic peptide
DEEEICTTNPVATEQYGSVSTNLQNGNR

SEQ ID NO: 4108 - protein, 28 aa, Artificial Sequence
  Description of Artificial Sequence: Synthetic peptide
DEEEIRTTNPVATEQYGSVSTNLQGGNK

SEQ ID NO: 4109 - protein, 29 aa, Artificial Sequence
  Description of Artificial Sequence: Synthetic peptide
DEEEIRTTNPVATEQYGSVEDTNLQRGNR

SEQ ID NO: 4110 - protein, 28 aa, Artificial Sequence
  Description of Artificial Sequence: Synthetic peptide
DEEEIRTTNPVATEQYGSVSTALQGGNR

SEQ ID NO: 4111 - protein, 29 aa, Artificial Sequence
  Description of Artificial Sequence: Synthetic peptide
DEEEIRTTNPVATEQYGSVSTNLQQFGNR

SEQ ID NO: 4112 - protein, 28 aa, Artificial Sequence
  Description of Artificial Sequence: Synthetic peptide
DEEEIRGTNPVATEQYGSVSTNLQRGNF

SEQ ID NO: 4113 - protein, 30 aa, Artificial Sequence
  Description of Artificial Sequence: Synthetic polypeptide
DEEEIRTTNPVATEQYGSVSTNPLQLRGNR

SEQ ID NO: 4114 - protein, 29 aa, Artificial Sequence
  Description of Artificial Sequence: Synthetic peptide
DEEEIRTTNPVATEQYGSVDTNLQFRGNR

SEQ ID NO: 4115 - protein, 28 aa, Artificial Sequence
  Description of Artificial Sequence: Synthetic peptide
DEEEITTTNPVATEQYGSVSTNLQNGNR

SEQ ID NO: 4116 - protein, 28 aa, Artificial Sequence
  Description of Artificial Sequence: Synthetic peptide
DEEEIRTTNPVATEQYGSVSDNLQRGQR

SEQ ID NO: 4117 - protein, 28 aa, Artificial Sequence
  Description of Artificial Sequence: Synthetic peptide
DEEEIRTTNPVATEQYGSVSTNLQRGEA

SEQ ID NO: 4118 - protein, 28 aa, Artificial Sequence
  Description of Artificial Sequence: Synthetic peptide
DEEEIRTTNPVATEQYGCVSTNLQRGDR

SEQ ID NO: 4119 - protein, 28 aa, Artificial Sequence
  Description of Artificial Sequence: Synthetic peptide
DEEEIRTTNPVATEQYGSVSTNLQAGNE

SEQ ID NO: 4120 - protein, 28 aa, Artificial Sequence
  Description of Artificial Sequence: Synthetic peptide
DEEEIRTTNPVATEQYGSVSTNLQRGDY

SEQ ID NO: 4121 - protein, 28 aa, Artificial Sequence
  Description of Artificial Sequence: Synthetic peptide
DEEEIRTTNPVATEQYGSVSEELQRGNR

SEQ ID NO: 4122 - protein, 28 aa, Artificial Sequence
  Description of Artificial Sequence: Synthetic peptide
DEEEIRTTNPVATETYGSVDTNLQRGNR

SEQ ID NO: 4123 - protein, 28 aa, Artificial Sequence
  Description of Artificial Sequence: Synthetic peptide
KEEEIRTTNPVATEQYGSVSTNLQRGNT

SEQ ID NO: 4124 - protein, 28 aa, Artificial Sequence
  Description of Artificial Sequence: Synthetic peptide
DEEEIRTTNPVATEQFGSVSTNLQLGNR

SEQ ID NO: 4125 - protein, 29 aa, Artificial Sequence
  Description of Artificial Sequence: Synthetic peptide
DEEEIRTTNPVATEQYGSVYPTNLQRGNR

SEQ ID NO: 4126 - protein, 28 aa, Artificial Sequence
  Description of Artificial Sequence: Synthetic peptide
SEEEIRATNPVATEQYGSVSTNLQRGNR

SEQ ID NO: 4127 - protein, 29 aa, Artificial Sequence
  Description of Artificial Sequence: Synthetic peptide
DEEEIRTTNPVATEQYGSHVSTNLQPGNR

SEQ ID NO: 4128 - protein, 28 aa, Artificial Sequence
  Description of Artificial Sequence: Synthetic peptide
DEEEIRTTNPVATEHYGSVSTNLQRGNG

SEQ ID NO: 4129 - protein, 29 aa, Artificial Sequence
  Description of Artificial Sequence: Synthetic peptide
DENEIRTTNPVATEQYGSVSATNLQRGNR

SEQ ID NO: 4130 - protein, 28 aa, Artificial Sequence
  Description of Artificial Sequence: Synthetic peptide
DEEEIRTTNPVATEIYGSVATNLQRGNR

SEQ ID NO: 4131 - protein, 28 aa, Artificial Sequence
  Description of Artificial Sequence: Synthetic peptide
DEEEIRTTNPVATEQYGSVSTALQRGNE

SEQ ID NO: 4132 - protein, 28 aa, Artificial Sequence
  Description of Artificial Sequence: Synthetic peptide
DEEEIRTTNPVATEQYGIVSTNLQRGPR

SEQ ID NO: 4133 - protein, 28 aa, Artificial Sequence
  Description of Artificial Sequence: Synthetic peptide
DEEEIRTTNPVATFQYGSVSTLLQRGNR

SEQ ID NO: 4134 - protein, 28 aa, Artificial Sequence
  Description of Artificial Sequence: Synthetic peptide
DEEEIRTTNPCATEQYGSVSTNLQRGNK

SEQ ID NO: 4135 - protein, 29 aa, Artificial Sequence
  Description of Artificial Sequence: Synthetic peptide
DEEEIRTTNPVATEQYGSVDSTNLQRGNL

SEQ ID NO: 4136 - protein, 28 aa, Artificial Sequence
  Description of Artificial Sequence: Synthetic peptide
DEEEIRTTNPVATEQYGSVSTNLQRGPN

SEQ ID NO: 4137 - protein, 28 aa, Artificial Sequence
  Description of Artificial Sequence: Synthetic peptide
DEEEIRTTNPFATEQYGSVSTNLQIGNR

SEQ ID NO: 4138 - protein, 28 aa, Artificial Sequence
  Description of Artificial Sequence: Synthetic peptide
DEEEIRTTNPVATEQYGCVSTNLQRGTR

SEQ ID NO: 4139 - protein, 28 aa, Artificial Sequence
  Description of Artificial Sequence: Synthetic peptide
DEEEIRTTNPVATEQYGSVSTDLQAGNR

SEQ ID NO: 4140 - protein, 28 aa, Artificial Sequence
  Description of Artificial Sequence: Synthetic peptide
DEEEIRTTNPVATEQYGIVSTNLQRGNA

SEQ ID NO: 4141 - protein, 28 aa, Artificial Sequence
  Description of Artificial Sequence: Synthetic peptide
DEEEIRTVNPVATEQYGSVSTNLQRGNQ

SEQ ID NO: 4142 - protein, 28 aa, Artificial Sequence
  Description of Artificial Sequence: Synthetic peptide
DEWEIRTTNPVATEQYGSVSTNLQRGNI

SEQ ID NO: 4143 - protein, 28 aa, Artificial Sequence
  Description of Artificial Sequence: Synthetic peptide
DEEEIRTTNCVATEQYGSVSTNLQQGNR

SEQ ID NO: 4144 - protein, 28 aa, Artificial Sequence
  Description of Artificial Sequence: Synthetic peptide
DEEEIRTVNPVATEQYGSVSTNLQNGNR

SEQ ID NO: 4145 - protein, 29 aa, Artificial Sequence
  Description of Artificial Sequence: Synthetic peptide
DEEEIRTVNPVATEQYGSVSTNLQERGNR

SEQ ID NO: 4146 - protein, 28 aa, Artificial Sequence
  Description of Artificial Sequence: Synthetic peptide
DEEEIRTTNPVATEQYGSVSTNLERGNT

SEQ ID NO: 4147 - protein, 30 aa, Artificial Sequence
  Description of Artificial Sequence: Synthetic polypeptide
DEEEIRTTNPVATEQYGSVTSTTNLQRGNR

SEQ ID NO: 4148 - protein, 30 aa, Artificial Sequence
  Description of Artificial Sequence: Synthetic polypeptide
DEEEIRTTNPVATEQYGMSVSCTNLQRGNR

SEQ ID NO: 4149 - protein, 28 aa, Artificial Sequence
  Description of Artificial Sequence: Synthetic peptide
DEEEIRTTNPVATEQYGAVSENLQRGNR

SEQ ID NO: 4150 - protein, 28 aa, Artificial Sequence
  Description of Artificial Sequence: Synthetic peptide
DEEEITTTNPVATEQYGSVSTNLQRGMR

SEQ ID NO: 4151 - protein, 28 aa, Artificial Sequence
  Description of Artificial Sequence: Synthetic peptide
DEDEIRTTNPVATEQYGSVSTNLQAGNR

SEQ ID NO: 4152 - protein, 28 aa, Artificial Sequence
  Description of Artificial Sequence: Synthetic peptide
DEEEIRTTNPCATEQYGSVSTNLQWGNR

SEQ ID NO: 4153 - protein, 28 aa, Artificial Sequence
  Description of Artificial Sequence: Synthetic peptide
DEEEIRATNPVATEQYGSVSTNLNRGNR

SEQ ID NO: 4154 - protein, 28 aa, Artificial Sequence
  Description of Artificial Sequence: Synthetic peptide
DEEEIRTTNPVATEVYGSVSTNLQRENR

SEQ ID NO: 4155 - protein, 28 aa, Artificial Sequence
  Description of Artificial Sequence: Synthetic peptide
DECEIRTTNPVATEQYGSVSTNLQRGNS

SEQ ID NO: 4156 - protein, 28 aa, Artificial Sequence
  Description of Artificial Sequence: Synthetic peptide
DEEEIRTTNPVATEIYGSVSENLQRGNR

SEQ ID NO: 4157 - protein, 28 aa, Artificial Sequence
  Description of Artificial Sequence: Synthetic peptide
DESEIGTTNPVATEQYGSVSTNLQRGNR

SEQ ID NO: 4158 - protein, 29 aa, Artificial Sequence
  Description of Artificial Sequence: Synthetic peptide
DEEEIRTTNPVATEQYGDVSTNLQSRGNR

SEQ ID NO: 4159 - protein, 29 aa, Artificial Sequence
  Description of Artificial Sequence: Synthetic peptide
DEEEIRTTNPVATEQYGSVSTNLQPNGNR

SEQ ID NO: 4160 - protein, 29 aa, Artificial Sequence
  Description of Artificial Sequence: Synthetic peptide
DEEEIRTTNPVATEQYGSVSTNLQIAGNR

SEQ ID NO: 4161 - protein, 28 aa, Artificial Sequence
  Description of Artificial Sequence: Synthetic peptide
DEEEIRTTNPVATEQYGSVSTNLQSGNV

SEQ ID NO: 4162 - protein, 28 aa, Artificial Sequence
  Description of Artificial Sequence: Synthetic peptide
DEEEIRTTNPVATEQYGDVSTNLQLGNR

SEQ ID NO: 4163 - protein, 28 aa, Artificial Sequence
  Description of Artificial Sequence: Synthetic peptide
DEEEIRTTNIVATEQYGSVSTNLLRGNR

SEQ ID NO: 4164 - protein, 28 aa, Artificial Sequence
  Description of Artificial Sequence: Synthetic peptide
DEEEIRTTNPVATEQYWSVSTNLQPGNR

SEQ ID NO: 4165 - protein, 28 aa, Artificial Sequence
  Description of Artificial Sequence: Synthetic peptide
DEEEIRTTNPVATEQYGSVSNNLQRGTR

SEQ ID NO: 4166 - protein, 28 aa, Artificial Sequence
  Description of Artificial Sequence: Synthetic peptide
DEEEIRTTNPVATEQYGSVSENLQRGNY

SEQ ID NO: 4167 - protein, 28 aa, Artificial Sequence
  Description of Artificial Sequence: Synthetic peptide
DEEEIATTNPVATEQYGSVSTNLQRGNS

SEQ ID NO: 4168 - protein, 28 aa, Artificial Sequence
  Description of Artificial Sequence: Synthetic peptide
DEEEIRTTNPVATEQYGSVSTELQMGNR

SEQ ID NO: 4169 - protein, 28 aa, Artificial Sequence
  Description of Artificial Sequence: Synthetic peptide
DEEEIRTTNPVATEVYGSVSENLQRGNR

SEQ ID NO: 4170 - protein, 28 aa, Artificial Sequence
  Description of Artificial Sequence: Synthetic peptide
KEEEIRTTNPVATEQYGSVSTNLQRGNL

SEQ ID NO: 4171 - protein, 28 aa, Artificial Sequence
  Description of Artificial Sequence: Synthetic peptide
DEEEIRATNIVATEQYGSVSTNLQRGNR

SEQ ID NO: 4172 - protein, 29 aa, Artificial Sequence
  Description of Artificial Sequence: Synthetic peptide
DEEEIRTTNPVATEQYGSVSTNLQRGNVH

SEQ ID NO: 4173 - protein, 28 aa, Artificial Sequence
  Description of Artificial Sequence: Synthetic peptide
DEEEIRTTNPEATEQYGSVSTNLQRGNG

SEQ ID NO: 4174 - protein, 28 aa, Artificial Sequence
  Description of Artificial Sequence: Synthetic peptide
DEEEIRTTNPVATEQYGVVSTNLQHGNR

SEQ ID NO: 4175 - protein, 29 aa, Artificial Sequence
  Description of Artificial Sequence: Synthetic peptide
DEEEIRTTNPVATEQYGDVSTNLQRDGNR

SEQ ID NO: 4176 - protein, 28 aa, Artificial Sequence
  Description of Artificial Sequence: Synthetic peptide
DEEEIRTTNPVATEQYGSVSENLQEGNR

SEQ ID NO: 4177 - protein, 28 aa, Artificial Sequence
  Description of Artificial Sequence: Synthetic peptide
DEEEIRTVNPVATEQYGEVSTNLQRGNR

SEQ ID NO: 4178 - protein, 28 aa, Artificial Sequence
  Description of Artificial Sequence: Synthetic peptide
DEEELRTTNPVATEQYGSVSTNLQRGNL

SEQ ID NO: 4179 - protein, 29 aa, Artificial Sequence
  Description of Artificial Sequence: Synthetic peptide
DEEEIRTTNPVATEQYGSVSTDLQERGNR

SEQ ID NO: 4180 - protein, 29 aa, Artificial Sequence
  Description of Artificial Sequence: Synthetic peptide
KEEEIRTTNPVATEQYGSVSTNLQREGNR

SEQ ID NO: 4181 - protein, 28 aa, Artificial Sequence
  Description of Artificial Sequence: Synthetic peptide
DEEEIWTTNPVATEQYGSVSTNLQRGGR

SEQ ID NO: 4182 - protein, 28 aa, Artificial Sequence
  Description of Artificial Sequence: Synthetic peptide
DEEEIRTTNPVATEQYGSVSTNLQYGNM

SEQ ID NO: 4183 - protein, 28 aa, Artificial Sequence
  Description of Artificial Sequence: Synthetic peptide
DEEEIRTTNPVATEQYGSVSENIQRGNR

SEQ ID NO: 4184 - protein, 28 aa, Artificial Sequence
  Description of Artificial Sequence: Synthetic peptide
DEEEIRTTNPVATEQYGIVSTNLQRGTR

SEQ ID NO: 4185 - protein, 28 aa, Artificial Sequence
  Description of Artificial Sequence: Synthetic peptide
DEEEIRTTNPVATEQYGAVSTNLQRGNQ

SEQ ID NO: 4186 - protein, 28 aa, Artificial Sequence
  Description of Artificial Sequence: Synthetic peptide
DENEIRTTNIVATEQYGSVSTNLQRGNR

SEQ ID NO: 4187 - protein, 29 aa, Artificial Sequence
  Description of Artificial Sequence: Synthetic peptide
DEEEIRTTNPVATYQYGSVSTNLQRGNNR

SEQ ID NO: 4188 - protein, 28 aa, Artificial Sequence
  Description of Artificial Sequence: Synthetic peptide
DEEEIRTTNPVATEQYGSVSENLQRGNN

SEQ ID NO: 4189 - protein, 28 aa, Artificial Sequence
  Description of Artificial Sequence: Synthetic peptide
DEEEIRTTNPVATEQYGSVSTNGQRENR

SEQ ID NO: 4190 - protein, 28 aa, Artificial Sequence
  Description of Artificial Sequence: Synthetic peptide
DEEEIRTTNPVACYQYGSVSTNLQRGNR

SEQ ID NO: 4191 - protein, 28 aa, Artificial Sequence
  Description of Artificial Sequence: Synthetic peptide
CEEEIRTTNPVATEQYGDVSTNLQRGNR

SEQ ID NO: 4192 - protein, 28 aa, Artificial Sequence
  Description of Artificial Sequence: Synthetic peptide
DEEEIRTTNPVATEQYGSVTTNLQRMNR

SEQ ID NO: 4193 - protein, 28 aa, Artificial Sequence
  Description of Artificial Sequence: Synthetic peptide
DEEEIRTTNPVATEQYGEASTNLQRGNR

SEQ ID NO: 4194 - protein, 28 aa, Artificial Sequence
  Description of Artificial Sequence: Synthetic peptide
DEEEIRTTNPVATEIFGSVSTNLQRGNR

SEQ ID NO: 4195 - protein, 28 aa, Artificial Sequence
  Description of Artificial Sequence: Synthetic peptide
DEEEIRTTNPVATEQYGGVSTNLQRGNS

SEQ ID NO: 4196 - protein, 30 aa, Artificial Sequence
  Description of Artificial Sequence: Synthetic polypeptide
DEEEIRTTNPVATEQYGSVSTGNLQRGENR

SEQ ID NO: 4197 - protein, 28 aa, Artificial Sequence
  Description of Artificial Sequence: Synthetic peptide
DEEEIRTTNPVATFQYGVVSTNLQRGNR

SEQ ID NO: 4198 - protein, 28 aa, Artificial Sequence
  Description of Artificial Sequence: Synthetic peptide
DEEEIRTTNPVATEQYGDVSTNLQDGNR

SEQ ID NO: 4199 - protein, 29 aa, Artificial Sequence
  Description of Artificial Sequence: Synthetic peptide
DEEEIRCTNPVATEQYGSVSTNLQRAGNR

SEQ ID NO: 4200 - protein, 28 aa, Artificial Sequence
  Description of Artificial Sequence: Synthetic peptide
DEEEIRTTNIVATEQYGSVSTNLQRTNR

SEQ ID NO: 4201 - protein, 28 aa, Artificial Sequence
  Description of Artificial Sequence: Synthetic peptide
DEEEIRATNPVATELYGSVSTNLQRGNR

SEQ ID NO: 4202 - protein, 28 aa, Artificial Sequence
  Description of Artificial Sequence: Synthetic peptide
DEEEIRTTNPDATEQYGSVSTNLQRGNL

SEQ ID NO: 4203 - protein, 28 aa, Artificial Sequence
  Description of Artificial Sequence: Synthetic peptide
DEEEIRTTNPVATEQYGTVSTNLQRLNR

SEQ ID NO: 4204 - protein, 28 aa, Artificial Sequence
  Description of Artificial Sequence: Synthetic peptide
SEEEIRTTNPVATEGYGSVSTNLQRGNR

SEQ ID NO: 4205 - protein, 28 aa, Artificial Sequence
  Description of Artificial Sequence: Synthetic peptide
DEEEIRTTNPVATQQYGSVSTNLQRGNP

SEQ ID NO: 4206 - protein, 28 aa, Artificial Sequence
  Description of Artificial Sequence: Synthetic peptide
DEEEIRTTNPVATEQYGIVSENLQRGNR

SEQ ID NO: 4207 - protein, 28 aa, Artificial Sequence
  Description of Artificial Sequence: Synthetic peptide
DEEEIRTTNPVATEQFGSVSTNLQNGNR

SEQ ID NO: 4208 - protein, 28 aa, Artificial Sequence
  Description of Artificial Sequence: Synthetic peptide
DEEEIRTTNPVATEIYGSVSTNLQYGNR

SEQ ID NO: 4209 - protein, 28 aa, Artificial Sequence
  Description of Artificial Sequence: Synthetic peptide
KEEEIRTTNPVATEQYGSVSTNLQRGNA

SEQ ID NO: 4210 - protein, 28 aa, Artificial Sequence
  Description of Artificial Sequence: Synthetic peptide
DEEEIRTTNPVATEQYGSVSTNPDRGNR

SEQ ID NO: 4211 - protein, 30 aa, Artificial Sequence
  Description of Artificial Sequence: Synthetic polypeptide
DEEEIRTTNPVATEQYGSVSSATNLQRGNR

SEQ ID NO: 4212 - protein, 28 aa, Artificial Sequence
  Description of Artificial Sequence: Synthetic peptide
DEEEVRTTNPVATEQYGSVSTNLQPGNR

SEQ ID NO: 4213 - protein, 30 aa, Artificial Sequence
  Description of Artificial Sequence: Synthetic polypeptide
DEEEIRTTNPVATEQYGSVSTNLVQRGDNR

SEQ ID NO: 4214 - protein, 28 aa, Artificial Sequence
  Description of Artificial Sequence: Synthetic peptide
DEEEIRTTNPVATEQYGSVSTNLASGNR

SEQ ID NO: 4215 - protein, 28 aa, Artificial Sequence
  Description of Artificial Sequence: Synthetic peptide
DEEEIRTTNPVATEQYGSASTNLQRGER

SEQ ID NO: 4216 - protein, 28 aa, Artificial Sequence
  Description of Artificial Sequence: Synthetic peptide
DEEEIRQTNPVATEQYGSVSTNLLRGNR

SEQ ID NO: 4217 - protein, 28 aa, Artificial Sequence
  Description of Artificial Sequence: Synthetic peptide
DEEEIRTTNPVATEQYGAVSTNLQVGNR

SEQ ID NO: 4218 - protein, 29 aa, Artificial Sequence
  Description of Artificial Sequence: Synthetic peptide
DEEEIRTTNPVADEQYGSVSTNLQRGNDR

SEQ ID NO: 4219 - protein, 29 aa, Artificial Sequence
  Description of Artificial Sequence: Synthetic peptide
DEEEIRTTNPVATEQYGSVNSTNAQRGNR

SEQ ID NO: 4220 - protein, 28 aa, Artificial Sequence
  Description of Artificial Sequence: Synthetic peptide
QEEEIRTTNPVATEQYGSVSDNLQRGNR

SEQ ID NO: 4221 - protein, 28 aa, Artificial Sequence
  Description of Artificial Sequence: Synthetic peptide
DEEEIRTTNPVATEQYGSVSTDLQPGNR

SEQ ID NO: 4222 - protein, 28 aa, Artificial Sequence
  Description of Artificial Sequence: Synthetic peptide
DEEEIRTTNPVATEQYGSVSTNLQLGER

SEQ ID NO: 4223 - protein, 28 aa, Artificial Sequence
  Description of Artificial Sequence: Synthetic peptide
DEEEIRQTNPVATEQYGSVSTVLQRGNR

SEQ ID NO: 4224 - protein, 29 aa, Artificial Sequence
  Description of Artificial Sequence: Synthetic peptide
DEEEIRTTNPVATEQYGDVSTNLQRAGNR

SEQ ID NO: 4225 - protein, 28 aa, Artificial Sequence
  Description of Artificial Sequence: Synthetic peptide
DEEEIKTTNPVATEQYGSVSTNLTRGNR

SEQ ID NO: 4226 - protein, 28 aa, Artificial Sequence
  Description of Artificial Sequence: Synthetic peptide
DEEEIRTTNPVATEWYGSVSTNLQQGNR

SEQ ID NO: 4227 - protein, 28 aa, Artificial Sequence
  Description of Artificial Sequence: Synthetic peptide
DEEEIRTTNPVATEQYGSVSTNLQRDNG

SEQ ID NO: 4228 - protein, 30 aa, Artificial Sequence
  Description of Artificial Sequence: Synthetic polypeptide
DEEEIRTTNPVATEQYGSVSDTNLQRGENR

SEQ ID NO: 4229 - protein, 29 aa, Artificial Sequence
  Description of Artificial Sequence: Synthetic peptide
DEEEIRTTNPVATEQWGSVSTNLQNRGNR

SEQ ID NO: 4230 - protein, 30 aa, Artificial Sequence
  Description of Artificial Sequence: Synthetic polypeptide
DEEEIRTTNPVATEQYGSVSTVNLQRGENR

SEQ ID NO: 4231 - protein, 28 aa, Artificial Sequence
  Description of Artificial Sequence: Synthetic peptide
DEEEIRTTNPVATEQYGSVSENLQTGNR

SEQ ID NO: 4232 - protein, 28 aa, Artificial Sequence
  Description of Artificial Sequence: Synthetic peptide
DEEEIRTTNPVATEQYGSVSTNPQRGNY

SEQ ID NO: 4233 - protein, 28 aa, Artificial Sequence
  Description of Artificial Sequence: Synthetic peptide
DEEEIRTTNPVATEQYGDVSTNLQRGNF

SEQ ID NO: 4234 - protein, 28 aa, Artificial Sequence
  Description of Artificial Sequence: Synthetic peptide
DEEEIRCTNPVATEQYGEVSTNLQRGNR

SEQ ID NO: 4235 - protein, 28 aa, Artificial Sequence
  Description of Artificial Sequence: Synthetic peptide
DEEEIRTTNPVATEQYGSVSDNLQTGNR

SEQ ID NO: 4236 - protein, 28 aa, Artificial Sequence
  Description of Artificial Sequence: Synthetic peptide
DEEEIRTTNPTATEQYGSVSTNLQRGNL

SEQ ID NO: 4237 - protein, 28 aa, Artificial Sequence
  Description of Artificial Sequence: Synthetic peptide
DEEEIRTTNPVATEQYGSVDTNPQRGNR

SEQ ID NO: 4238 - protein, 28 aa, Artificial Sequence
  Description of Artificial Sequence: Synthetic peptide
DEEEIRTTNPVATEQYGVVSTELQRGNR

SEQ ID NO: 4239 - protein, 28 aa, Artificial Sequence
  Description of Artificial Sequence: Synthetic peptide
DEEEIRTTNPVATEQYGSVSSNLQHGNR

SEQ ID NO: 4240 - protein, 28 aa, Artificial Sequence
  Description of Artificial Sequence: Synthetic peptide
KEEEIRTTNPVATEQYGSVSTNLQRGNM

SEQ ID NO: 4241 - protein, 28 aa, Artificial Sequence
  Description of Artificial Sequence: Synthetic peptide
DEEEIRTTNPVATEQYGDFSTNLQRGNR

SEQ ID NO: 4242 - protein, 28 aa, Artificial Sequence
  Description of Artificial Sequence: Synthetic peptide
DEEEIRTTNPVATEQYGSVSTNWQRGNS

SEQ ID NO: 4243 - protein, 28 aa, Artificial Sequence
  Description of Artificial Sequence: Synthetic peptide
DEEEIRTTNPVATELYGSVSTNLQRPNR

SEQ ID NO: 4244 - protein, 28 aa, Artificial Sequence
  Description of Artificial Sequence: Synthetic peptide
DEEEIRTTNPVATEQYGVVSTNLQRGNH

SEQ ID NO: 4245 - protein, 29 aa, Artificial Sequence
  Description of Artificial Sequence: Synthetic peptide
DEEEIRQTNPVATEQYGSVSTNGLQRGNR

SEQ ID NO: 4246 - protein, 29 aa, Artificial Sequence
  Description of Artificial Sequence: Synthetic peptide
DEEEIRTTNPVATEQYGSVSTNLQRAGGR

SEQ ID NO: 4247 - protein, 30 aa, Artificial Sequence
  Description of Artificial Sequence: Synthetic polypeptide
DEEEIRTTNPVATEQYGSVSTINLQRDGNR

SEQ ID NO: 4248 - protein, 28 aa, Artificial Sequence
  Description of Artificial Sequence: Synthetic peptide
DEEEIRTTNPVATEQYGSVSDNGQRGNR

SEQ ID NO: 4249 - protein, 28 aa, Artificial Sequence
  Description of Artificial Sequence: Synthetic peptide
DEEEIRTTNPVATEIYGSVSTNLQLGNR

SEQ ID NO: 4250 - protein, 28 aa, Artificial Sequence
  Description of Artificial Sequence: Synthetic peptide
DEEEIRTTNPVATEQYWSVSTNEQRGNR

SEQ ID NO: 4251 - protein, 28 aa, Artificial Sequence
  Description of Artificial Sequence: Synthetic peptide
DEEEIRTTNPVATESYGSVSTNLQHGNR

SEQ ID NO: 4252 - protein, 28 aa, Artificial Sequence
  Description of Artificial Sequence: Synthetic peptide
DEEEIRTTNPVATEQYGSVSDNLQHGNR

SEQ ID NO: 4253 - protein, 28 aa, Artificial Sequence
  Description of Artificial Sequence: Synthetic peptide
DEEEIRTTNPVATEMYGTVSTNLQRGNR

SEQ ID NO: 4254 - protein, 28 aa, Artificial Sequence
  Description of Artificial Sequence: Synthetic peptide
DEEEIATTNPVATEQYGSVSTNLQRGNQ

SEQ ID NO: 4255 - protein, 28 aa, Artificial Sequence
  Description of Artificial Sequence: Synthetic peptide
DEEEIRTTNPVATEQYGEVSTNLQRPNR

SEQ ID NO: 4256 - protein, 28 aa, Artificial Sequence
  Description of Artificial Sequence: Synthetic peptide
DEEEIRTTNPFATEQYGSVSTNLQRGNG

SEQ ID NO: 4257 - protein, 28 aa, Artificial Sequence
  Description of Artificial Sequence: Synthetic peptide
DEEEIRTTNPVATEQYGSNSTNEQRGNR

SEQ ID NO: 4258 - protein, 28 aa, Artificial Sequence
  Description of Artificial Sequence: Synthetic peptide
DEEEIRTTNPVASEQYGSVATNLQRGNR

SEQ ID NO: 4259 - protein, 28 aa, Artificial Sequence
  Description of Artificial Sequence: Synthetic peptide
DESEIATTNPVATEQYGSVSTNLQRGNR

SEQ ID NO: 4260 - protein, 29 aa, Artificial Sequence
  Description of Artificial Sequence: Synthetic peptide
DEEEIRTTNPVATEQYGSVSTNLQRALNR

SEQ ID NO: 4261 - protein, 28 aa, Artificial Sequence
  Description of Artificial Sequence: Synthetic peptide
DEEEIRTTNPVSTEQFGSVSTNLQRGNR

SEQ ID NO: 4262 - protein, 28 aa, Artificial Sequence
  Description of Artificial Sequence: Synthetic peptide
DEEEIRTTNPVATEQYGSVDTNLQRGNN

SEQ ID NO: 4263 - protein, 30 aa, Artificial Sequence
  Description of Artificial Sequence: Synthetic polypeptide
DEEEIRTTNPVATEQYGSVSQTNLQRGLNR

SEQ ID NO: 4264 - protein, 29 aa, Artificial Sequence
  Description of Artificial Sequence: Synthetic peptide
DEEEIRTTNPVATEQYGSVYSTNLQQGNR

SEQ ID NO: 4265 - protein, 29 aa, Artificial Sequence
  Description of Artificial Sequence: Synthetic peptide
DEEEIRTTNPVSTEQYGSVDSTNLQRGNR

SEQ ID NO: 4266 - protein, 29 aa, Artificial Sequence
  Description of Artificial Sequence: Synthetic peptide
DEEEIRTTNPVATEQYGDVSTNLQARGNR

SEQ ID NO: 4267 - protein, 29 aa, Artificial Sequence
  Description of Artificial Sequence: Synthetic peptide
DEEEIRTTNPVATEQYGSSVSTNLQRGND

SEQ ID NO: 4268 - protein, 28 aa, Artificial Sequence
  Description of Artificial Sequence: Synthetic peptide
DEEEIRTTNPVATEQYGEVSTNLQRGNA

SEQ ID NO: 4269 - protein, 28 aa, Artificial Sequence
  Description of Artificial Sequence: Synthetic peptide
DEEEIRTTNPVATEQYGEVSTNLQHGNR

SEQ ID NO: 4270 - protein, 28 aa, Artificial Sequence
  Description of Artificial Sequence: Synthetic peptide
DEEEIRTTNPVATEQYGEVSTVLQRGNR

SEQ ID NO: 4271 - protein, 28 aa, Artificial Sequence
  Description of Artificial Sequence: Synthetic peptide
DEEEIRCTNPVATEQYGSVSTNLQRGMR

SEQ ID NO: 4272 - protein, 28 aa, Artificial Sequence
  Description of Artificial Sequence: Synthetic peptide
DEEEIRTTNPVATEQYGSVSTNHQRGNA

SEQ ID NO: 4273 - protein, 28 aa, Artificial Sequence
  Description of Artificial Sequence: Synthetic peptide
DEECIRTTNPDATEQYGSVSTNLQRGNR

SEQ ID NO: 4274 - protein, 29 aa, Artificial Sequence
  Description of Artificial Sequence: Synthetic peptide
DEEEIRTTNPVATEQYGSVSTGNLQRGTR

SEQ ID NO: 4275 - protein, 28 aa, Artificial Sequence
  Description of Artificial Sequence: Synthetic peptide
DNEEIRTTNPVATEQYGSVSTNLQRGER

SEQ ID NO: 4276 - protein, 29 aa, Artificial Sequence
  Description of Artificial Sequence: Synthetic peptide
DEEEIRTTNPVATEQYGSVDCTNLQRGNR

SEQ ID NO: 4277 - protein, 28 aa, Artificial Sequence
  Description of Artificial Sequence: Synthetic peptide
DEEEIRTTNPVATEQYGDVSTNLQRGQR

SEQ ID NO: 4278 - protein, 28 aa, Artificial Sequence
  Description of Artificial Sequence: Synthetic peptide
DEEEIRTTNPVATEMYGNVSTNLQRGNR

SEQ ID NO: 4279 - protein, 28 aa, Artificial Sequence
  Description of Artificial Sequence: Synthetic peptide
DEEELRTTNPVATEQYGEVSTNLQRGNR

SEQ ID NO: 4280 - protein, 29 aa, Artificial Sequence
  Description of Artificial Sequence: Synthetic peptide
DEEEIRTTNPVATEQYGSVSTNLQRGDNS

SEQ ID NO: 4281 - protein, 29 aa, Artificial Sequence
  Description of Artificial Sequence: Synthetic peptide
DEEEIRTTNPVATEQYGSVSTELQRKGNR

SEQ ID NO: 4282 - protein, 28 aa, Artificial Sequence
  Description of Artificial Sequence: Synthetic peptide
DEEELRTTNPVATEQYGTVSTNLQRGNR

SEQ ID NO: 4283 - protein, 28 aa, Artificial Sequence
  Description of Artificial Sequence: Synthetic peptide
DEEEIRTTNPVATEQYGVVSDNLQRGNR

SEQ ID NO: 4284 - protein, 28 aa, Artificial Sequence
  Description of Artificial Sequence: Synthetic peptide
DEEEIRTTNPVATEQYGEVSTNLQRGNS

SEQ ID NO: 4285 - protein, 28 aa, Artificial Sequence
  Description of Artificial Sequence: Synthetic peptide
DEEEIRTTNPVATEQYGSVSTNEQRGNM

SEQ ID NO: 4286 - protein, 28 aa, Artificial Sequence
  Description of Artificial Sequence: Synthetic peptide
DEEEIRTTNPVATEQYGDVSENLQRGNR

SEQ ID NO: 4287 - protein, 28 aa, Artificial Sequence
  Description of Artificial Sequence: Synthetic peptide
DEQEIRTTNPVATELYGSVSTNLQRGNR

SEQ ID NO: 4288 - protein, 28 aa, Artificial Sequence
  Description of Artificial Sequence: Synthetic peptide
DEEEIRTTNPVATEQYGEVSTNLQQGNR

SEQ ID NO: 4289 - protein, 30 aa, Artificial Sequence
  Description of Artificial Sequence: Synthetic polypeptide
DEEEIRTTNPVATEQYGSVSLTNLVQRGNR

SEQ ID NO: 4290 - protein, 29 aa, Artificial Sequence
  Description of Artificial Sequence: Synthetic peptide
DEEEIRTTNPVATEQYGSVSTNYQRPGNR

SEQ ID NO: 4291 - protein, 28 aa, Artificial Sequence
  Description of Artificial Sequence: Synthetic peptide
DEEELRTTNPVATEQYGSVSTNLQRGTR

SEQ ID NO: 4292 - protein, 28 aa, Artificial Sequence
  Description of Artificial Sequence: Synthetic peptide
DEEEIRTTNPVATETYGEVSTNLQRGNR

SEQ ID NO: 4293 - protein, 28 aa, Artificial Sequence
  Description of Artificial Sequence: Synthetic peptide
DEEEIRTTNPVATECYGSVSTNLQRGNL

SEQ ID NO: 4294 - protein, 28 aa, Artificial Sequence
  Description of Artificial Sequence: Synthetic peptide
DEEEIRTTNPVATEQYGEVSTNLQRENR

SEQ ID NO: 4295 - protein, 28 aa, Artificial Sequence
  Description of Artificial Sequence: Synthetic peptide
DEEEIRTTNPVATENYGSVSENLQRGNR

SEQ ID NO: 4296 - protein, 28 aa, Artificial Sequence
  Description of Artificial Sequence: Synthetic peptide
DEEEIRTTNPVATEQWGSVSENLQRGNR

SEQ ID NO: 4297 - protein, 28 aa, Artificial Sequence
  Description of Artificial Sequence: Synthetic peptide
DEVEIRTTNPVATEQYGSVSTNLQRGNS

SEQ ID NO: 4298 - protein, 28 aa, Artificial Sequence
  Description of Artificial Sequence: Synthetic peptide
DEEEIRCTNPVATEQYGSVSENLQRGNR

SEQ ID NO: 4299 - protein, 29 aa, Artificial Sequence
  Description of Artificial Sequence: Synthetic peptide
DEEEIRTTNPVATEQYGSVSENLQMRGNR

SEQ ID NO: 4300 - protein, 29 aa, Artificial Sequence
  Description of Artificial Sequence: Synthetic peptide
DEEEIRTTNPVATEQYGSVSTNLQMRGNI

SEQ ID NO: 4301 - protein, 28 aa, Artificial Sequence
  Description of Artificial Sequence: Synthetic peptide
DEEEIRTTNPVATEGYGSVSTNLQRGMR

SEQ ID NO: 4302 - protein, 28 aa, Artificial Sequence
  Description of Artificial Sequence: Synthetic peptide
DEEEIRTTNPVATEQYGSVSTNLQNGER

SEQ ID NO: 4303 - protein, 28 aa, Artificial Sequence
  Description of Artificial Sequence: Synthetic peptide
DEEEIRTTNPVATEGYGEVSTNLQRGNR

SEQ ID NO: 4304 - protein, 28 aa, Artificial Sequence
  Description of Artificial Sequence: Synthetic peptide
DEEEIRTTNPVATEQYGSVSENLQRNNR

SEQ ID NO: 4305 - protein, 28 aa, Artificial Sequence
  Description of Artificial Sequence: Synthetic peptide
DEEEIRTTNPVATEQFGSVSENLQRGNR

SEQ ID NO: 4306 - protein, 28 aa, Artificial Sequence
  Description of Artificial Sequence: Synthetic peptide
DEEEIYTTNPVATEQYGEVSTNLQRGNR

SEQ ID NO: 4307 - protein, 30 aa, Artificial Sequence
  Description of Artificial Sequence: Synthetic polypeptide
DEEEIRTTNPVATEQYGSVSTNNLLQRGNR

SEQ ID NO: 4308 - protein, 28 aa, Artificial Sequence
  Description of Artificial Sequence: Synthetic peptide
DEEEIRTTNPVATEGYGSVSTNLQRGNQ

SEQ ID NO: 4309 - protein, 28 aa, Artificial Sequence
  Description of Artificial Sequence: Synthetic peptide
DEEEIATTNPVATEQYGEVSTNLQRGNR

SEQ ID NO: 4310 - protein, 28 aa, Artificial Sequence
  Description of Artificial Sequence: Synthetic peptide
DEEEIRTTNPVATEQYGEVPTNLQRGNR

SEQ ID NO: 4311 - protein, 28 aa, Artificial Sequence
  Description of Artificial Sequence: Synthetic peptide
NEEEIRTTNPVATEQYGEVSTNLQRGNR

SEQ ID NO: 4312 - protein, 28 aa, Artificial Sequence
  Description of Artificial Sequence: Synthetic peptide
DEEEIRTTNPVATEQYGSVSTNLQVPNR

SEQ ID NO: 4313 - protein, 28 aa, Artificial Sequence
  Description of Artificial Sequence: Synthetic peptide
DEEEITTTNPVASEQYGSVSTNLQRGNR

SEQ ID NO: 4314 - protein, 28 aa, Artificial Sequence
  Description of Artificial Sequence: Synthetic peptide
DEEEIRTTNPVATEHYGSVSENLQRGNR

SEQ ID NO: 4315 - protein, 29 aa, Artificial Sequence
  Description of Artificial Sequence: Synthetic peptide
DEEEIRTTNPVATEQYGSHVSTNLQQGNR

SEQ ID NO: 4316 - protein, 28 aa, Artificial Sequence
  Description of Artificial Sequence: Synthetic peptide
DEEEIRTTNPVATEIYGSVSDNLQRGNR

SEQ ID NO: 4317 - protein, 28 aa, Artificial Sequence
  Description of Artificial Sequence: Synthetic peptide
DEEEIRTTNPVATEQYGCVSTNLQRGNQ

SEQ ID NO: 4318 - protein, 29 aa, Artificial Sequence
  Description of Artificial Sequence: Synthetic peptide
DEEEIRTTNPVATEQYGSVSENLQRAGNR

SEQ ID NO: 4319 - protein, 28 aa, Artificial Sequence
  Description of Artificial Sequence: Synthetic peptide
DEEEIRTTNPVCTEQYGHVSTNLQRGNR

SEQ ID NO: 4320 - protein, 28 aa, Artificial Sequence
  Description of Artificial Sequence: Synthetic peptide
DEEEIRTTNPVATEQYGEVATNLQRGNR

SEQ ID NO: 4321 - protein, 28 aa, Artificial Sequence
  Description of Artificial Sequence: Synthetic peptide
DEEEIRTTNPVATEQYGSVSDNIQRGNR

SEQ ID NO: 4322 - protein, 28 aa, Artificial Sequence
  Description of Artificial Sequence: Synthetic peptide
DEEEIRTTNPVATEQYGSVSENLQRSNR

SEQ ID NO: 4323 - protein, 28 aa, Artificial Sequence
  Description of Artificial Sequence: Synthetic peptide
DEEELRTVNPVATEQYGSVSTNLQRGNR

SEQ ID NO: 4324 - protein, 28 aa, Artificial Sequence
  Description of Artificial Sequence: Synthetic peptide
DEEEIRTTNPVATEQYGSVSMNLQRGNI

SEQ ID NO: 4325 - protein, 28 aa, Artificial Sequence
  Description of Artificial Sequence: Synthetic peptide
DESEIRTTNPVATEQYGSVSENLQRGNR

SEQ ID NO: 4326 - protein, 28 aa, Artificial Sequence
  Description of Artificial Sequence: Synthetic peptide
AEEEIRTTNPSATEQYGSVSTNLQRGNR

SEQ ID NO: 4327 - protein, 28 aa, Artificial Sequence
  Description of Artificial Sequence: Synthetic peptide
DEEEIRTTNPVATEQYGTVSTNLQRGLR

SEQ ID NO: 4328 - protein, 28 aa, Artificial Sequence
  Description of Artificial Sequence: Synthetic peptide
DEEEIRQTNPVATEMYGSVSTNLQRGNR

SEQ ID NO: 4329 - protein, 30 aa, Artificial Sequence
  Description of Artificial Sequence: Synthetic polypeptide
DEEEIRTTNPVATEQYGSVSTNLQRGANPR

SEQ ID NO: 4330 - protein, 28 aa, Artificial Sequence
  Description of Artificial Sequence: Synthetic peptide
DEEEIRTTNPVATECYGSVSTNLQYGNR

SEQ ID NO: 4331 - protein, 28 aa, Artificial Sequence
  Description of Artificial Sequence: Synthetic peptide
DEEEIRTTNPVATEQYGSVSENLQRGNI

SEQ ID NO: 4332 - protein, 28 aa, Artificial Sequence
  Description of Artificial Sequence: Synthetic peptide
DEEEIRTTNPVATEQYGFVSTNLQTGNR

SEQ ID NO: 4333 - protein, 28 aa, Artificial Sequence
  Description of Artificial Sequence: Synthetic peptide
DEEEIRTTNPVATEVYGDVSTNLQRGNR

SEQ ID NO: 4334 - protein, 29 aa, Artificial Sequence
  Description of Artificial Sequence: Synthetic peptide
DEEEIRTTNPVATEQFGSVSTNLPQRGNR

SEQ ID NO: 4335 - protein, 28 aa, Artificial Sequence
  Description of Artificial Sequence: Synthetic peptide
DEEEIRTTNPVATEQYGDVSTNLQRGNY

SEQ ID NO: 4336 - protein, 28 aa, Artificial Sequence
  Description of Artificial Sequence: Synthetic peptide
DEEEIRTTNPVAYEQYGSVSTNDQRGNR

SEQ ID NO: 4337 - protein, 28 aa, Artificial Sequence
  Description of Artificial Sequence: Synthetic peptide
DEEEIRTTNPVATEQYGSVSTNLQRGTA

SEQ ID NO: 4338 - protein, 28 aa, Artificial Sequence
  Description of Artificial Sequence: Synthetic peptide
DEEEIRTTNPVATEQYGSVSDNLQRFNR

SEQ ID NO: 4339 - protein, 28 aa, Artificial Sequence
  Description of Artificial Sequence: Synthetic peptide
DEEEIRSTNPVATEQYGSVSDNLQRGNR

SEQ ID NO: 4340 - protein, 28 aa, Artificial Sequence
  Description of Artificial Sequence: Synthetic peptide
DEEEIRTTNPVATEQYGDVSANLQRGNR

SEQ ID NO: 4341 - protein, 28 aa, Artificial Sequence
  Description of Artificial Sequence: Synthetic peptide
DEEEVRTTNPVATEQYGSVSTNPQRGNR

SEQ ID NO: 4342 - protein, 28 aa, Artificial Sequence
  Description of Artificial Sequence: Synthetic peptide
SEEEIRTTNPVATEQYGEVSTNLQRGNR

SEQ ID NO: 4343 - protein, 28 aa, Artificial Sequence
  Description of Artificial Sequence: Synthetic peptide
DEEEIRTTNPVCTETYGSVSTNLQRGNR

SEQ ID NO: 4344 - protein, 28 aa, Artificial Sequence
  Description of Artificial Sequence: Synthetic peptide
DEEEIRTTNPFATEQYGSVSTGLQRGNR

SEQ ID NO: 4345 - protein, 28 aa, Artificial Sequence
  Description of Artificial Sequence: Synthetic peptide
AEEEIRTTNPVATEQYGSVSENLQRGNR

SEQ ID NO: 4346 - protein, 28 aa, Artificial Sequence
  Description of Artificial Sequence: Synthetic peptide
DESEIRTTNPVATEQYGDVSTNLQRGNR

SEQ ID NO: 4347 - protein, 28 aa, Artificial Sequence
  Description of Artificial Sequence: Synthetic peptide
DEDEIRTTNPVATEQYGSVSENLQRGNR

SEQ ID NO: 4348 - protein, 29 aa, Artificial Sequence
  Description of Artificial Sequence: Synthetic peptide
DEEEIRTTNPVATEQYGCVSTNLQVRGNR

SEQ ID NO: 4349 - protein, 28 aa, Artificial Sequence
  Description of Artificial Sequence: Synthetic peptide
DEEEIRTTNIVATEQFGSVSTNLQRGNR

SEQ ID NO: 4350 - protein, 29 aa, Artificial Sequence
  Description of Artificial Sequence: Synthetic peptide
DEEEIRTTNPTATEQYGSVSTNGLQRGNR

SEQ ID NO: 4351 - protein, 28 aa, Artificial Sequence
  Description of Artificial Sequence: Synthetic peptide
DEEEIRTTNPVATEQYGDVSTNLQRGNV

SEQ ID NO: 4352 - protein, 28 aa, Artificial Sequence
  Description of Artificial Sequence: Synthetic peptide
DEEEIWTTNPVATEVYGSVSTNLQRGNR

SEQ ID NO: 4353 - protein, 28 aa, Artificial Sequence
  Description of Artificial Sequence: Synthetic peptide
DEEEIRTTNPFATEQYGSVSTNLQRGNF

SEQ ID NO: 4354 - protein, 28 aa, Artificial Sequence
  Description of Artificial Sequence: Synthetic peptide
DEEEIRTTNPVATEQYGSVSTNLQRGTL

SEQ ID NO: 4355 - protein, 29 aa, Artificial Sequence
  Description of Artificial Sequence: Synthetic peptide
DEEEIRTTNPVATEQYGSVSENLQRVGNR

SEQ ID NO: 4356 - protein, 29 aa, Artificial Sequence
  Description of Artificial Sequence: Synthetic peptide
DEEEIRTTNPVATEQYGSVDSTELQRGNR

SEQ ID NO: 4357 - protein, 28 aa, Artificial Sequence
  Description of Artificial Sequence: Synthetic peptide
DEEEIYTTNPVATEQYGSVSTDLQRGNR

SEQ ID NO: 4358 - protein, 30 aa, Artificial Sequence
  Description of Artificial Sequence: Synthetic polypeptide
DEEEIRTTNPVATEQYGSVESTNLQRGDNR

SEQ ID NO: 4359 - protein, 28 aa, Artificial Sequence
  Description of Artificial Sequence: Synthetic peptide
DENEIRATNPVATEQYGSVSTNLQRGNR

SEQ ID NO: 4360 - protein, 28 aa, Artificial Sequence
  Description of Artificial Sequence: Synthetic peptide
DEEEIRTTNPVATEQYGSVSTRLQRGER

SEQ ID NO: 4361 - protein, 28 aa, Artificial Sequence
  Description of Artificial Sequence: Synthetic peptide
DEEEIRTTNPVATEQYGSVSENLDRGNR

SEQ ID NO: 4362 - protein, 28 aa, Artificial Sequence
  Description of Artificial Sequence: Synthetic peptide
DEEEIRTTNPVATEQYGSVSDALQRGNR

SEQ ID NO: 4363 - protein, 29 aa, Artificial Sequence
  Description of Artificial Sequence: Synthetic peptide
DEQEIRTTNPVATEQYGSVSTNLQRGNPR

SEQ ID NO: 4364 - protein, 29 aa, Artificial Sequence
  Description of Artificial Sequence: Synthetic peptide
DEEEIRTTNPVATEQYGSVESHNLQRGNR

SEQ ID NO: 4365 - protein, 28 aa, Artificial Sequence
  Description of Artificial Sequence: Synthetic peptide
DEEEIRTTNPVATEQYGSVSTNFQIGNR

SEQ ID NO: 4366 - protein, 28 aa, Artificial Sequence
  Description of Artificial Sequence: Synthetic peptide
DEEEIRTTNPVATEQYGSVSENLQRQNR

SEQ ID NO: 4367 - protein, 28 aa, Artificial Sequence
  Description of Artificial Sequence: Synthetic peptide
DEEEIRTTNPVATEQWGSVSTNLQLGNR

SEQ ID NO: 4368 - protein, 29 aa, Artificial Sequence
  Description of Artificial Sequence: Synthetic peptide
DEEEIRTTNPVATEQYGSVSTNLEREGNR

SEQ ID NO: 4369 - protein, 28 aa, Artificial Sequence
  Description of Artificial Sequence: Synthetic peptide
DEEEIRCTNPVATEQFGSVSTNLQRGNR

SEQ ID NO: 4370 - protein, 28 aa, Artificial Sequence
  Description of Artificial Sequence: Synthetic peptide
DEEEIRTTNPVATEQFGSVSTNLQQGNR

SEQ ID NO: 4371 - protein, 28 aa, Artificial Sequence
  Description of Artificial Sequence: Synthetic peptide
DEEEIRTTNPVATEQYGSVSENAQRGNR

SEQ ID NO: 4372 - protein, 28 aa, Artificial Sequence
  Description of Artificial Sequence: Synthetic peptide
DEEEIRTTNPVATECYGSVSTNLQIGNR

SEQ ID NO: 4373 - protein, 28 aa, Artificial Sequence
  Description of Artificial Sequence: Synthetic peptide
DEEEIRTTNPVATEQYGCVSTNLQRGNN

SEQ ID NO: 4374 - protein, 28 aa, Artificial Sequence
  Description of Artificial Sequence: Synthetic peptide
DEEEIRTTNPVATEQYGVVSENLQRGNR

SEQ ID NO: 4375 - protein, 28 aa, Artificial Sequence
  Description of Artificial Sequence: Synthetic peptide
DEEEIRTTNPVATEQYGSVDTNLQRGDR

SEQ ID NO: 4376 - protein, 28 aa, Artificial Sequence
  Description of Artificial Sequence: Synthetic peptide
DEEEIETTNPVATEQYGWVSTNLQRGNR

SEQ ID NO: 4377 - protein, 28 aa, Artificial Sequence
  Description of Artificial Sequence: Synthetic peptide
DEEEIRTTNPVATEQYGSMSTNLQTGNR

SEQ ID NO: 4378 - protein, 29 aa, Artificial Sequence
  Description of Artificial Sequence: Synthetic peptide
DEEEIRTTNPVATEQYGSVSCTNLQRGNW

SEQ ID NO: 4379 - protein, 28 aa, Artificial Sequence
  Description of Artificial Sequence: Synthetic peptide
DEEEITTTNPVATEQYGSVSTNLQRGNF

SEQ ID NO: 4380 - protein, 28 aa, Artificial Sequence
  Description of Artificial Sequence: Synthetic peptide
DEEEIRTTNPCATEQYGEVSTNLQRGNR

SEQ ID NO: 4381 - protein, 28 aa, Artificial Sequence
  Description of Artificial Sequence: Synthetic peptide
DEEEIRTTNPVATEQYGEVSTNLQRGNE

SEQ ID NO: 4382 - protein, 29 aa, Artificial Sequence
  Description of Artificial Sequence: Synthetic peptide
DEEEIRTTNPVATEQYGSVSTMNLQHGNR

SEQ ID NO: 4383 - protein, 28 aa, Artificial Sequence
  Description of Artificial Sequence: Synthetic peptide
DEEEIVTTNPCATEQYGSVSTNLQRGNR

SEQ ID NO: 4384 - protein, 28 aa, Artificial Sequence
  Description of Artificial Sequence: Synthetic peptide
DEEEIRTTNPVATEQYGEVSENLQRGNR

SEQ ID NO: 4385 - protein, 28 aa, Artificial Sequence
  Description of Artificial Sequence: Synthetic peptide
DDEEIRTTNPVATEQYGSVSTNVQRGNR

SEQ ID NO: 4386 - protein, 28 aa, Artificial Sequence
  Description of Artificial Sequence: Synthetic peptide
DEEEIRTTNPVATEQYGCVSTDLQRGNR

SEQ ID NO: 4387 - protein, 30 aa, Artificial Sequence
  Description of Artificial Sequence: Synthetic polypeptide
DEEEIRTTNPVATEQYGSVSTNGLQRGENR

SEQ ID NO: 4388 - protein, 28 aa, Artificial Sequence
  Description of Artificial Sequence: Synthetic peptide
DEEEIRTTNPVATEQYGSVATNLQRGNS

SEQ ID NO: 4389 - protein, 28 aa, Artificial Sequence
  Description of Artificial Sequence: Synthetic peptide
DEEEIRTTNPVATECYGSVSDNLQRGNR

SEQ ID NO: 4390 - protein, 30 aa, Artificial Sequence
  Description of Artificial Sequence: Synthetic polypeptide
DEEEIRTTNPVATEQYGSYVSTNLQRDGNR

SEQ ID NO: 4391 - protein, 30 aa, Artificial Sequence
  Description of Artificial Sequence: Synthetic polypeptide
DEEEIRTTNPVATEQYGSVSTDNGLQRGNR

SEQ ID NO: 4392 - protein, 28 aa, Artificial Sequence
  Description of Artificial Sequence: Synthetic peptide
DEEEIRTTNPVATEQYGSVSDNMQRGNR

SEQ ID NO: 4393 - protein, 28 aa, Artificial Sequence
  Description of Artificial Sequence: Synthetic peptide
SEDEIRTTNPVATEQYGSVSTNLQRGNR

SEQ ID NO: 4394 - protein, 29 aa, Artificial Sequence
  Description of Artificial Sequence: Synthetic peptide
DEEEIRTTNPVATEQYGSVSTNLQWRGNQ

SEQ ID NO: 4395 - protein, 28 aa, Artificial Sequence
  Description of Artificial Sequence: Synthetic peptide
DEEEIRTTNPVATEQYGSVPTNLLRGNR

SEQ ID NO: 4396 - protein, 29 aa, Artificial Sequence
  Description of Artificial Sequence: Synthetic peptide
DEEEIRTTNPVATEQWGSVSTNGLQRGNR

SEQ ID NO: 4397 - protein, 28 aa, Artificial Sequence
  Description of Artificial Sequence: Synthetic peptide
DEEEIRTTNPVATEQYGSVSTNIQIGNR

SEQ ID NO: 4398 - protein, 28 aa, Artificial Sequence
  Description of Artificial Sequence: Synthetic peptide
DEEEIRTTNIIATEQYGSVSTNLQRGNR

SEQ ID NO: 4399 - protein, 28 aa, Artificial Sequence
  Description of Artificial Sequence: Synthetic peptide
DDEEIRTTNPVATEQYGSVSTNLQAGNR

SEQ ID NO: 4400 - protein, 28 aa, Artificial Sequence
  Description of Artificial Sequence: Synthetic peptide
DEEEIRTTNPVATEQYGSVSYNLQYGNR

SEQ ID NO: 4401 - protein, 29 aa, Artificial Sequence
  Description of Artificial Sequence: Synthetic peptide
DEEEIRTTNPVATEQYGSVSTNPLQRGDR

SEQ ID NO: 4402 - protein, 28 aa, Artificial Sequence
  Description of Artificial Sequence: Synthetic peptide
DEEEIRTTNPVATEQYGWVSENLQRGNR

SEQ ID NO: 4403 - protein, 29 aa, Artificial Sequence
  Description of Artificial Sequence: Synthetic peptide
DEEEIRTTNPEATEQYGSVSTNLQLRGNR

SEQ ID NO: 4404 - protein, 28 aa, Artificial Sequence
  Description of Artificial Sequence: Synthetic peptide
DENEIRTTNPVATEQYGSVSTNLQRGNN

SEQ ID NO: 4405 - protein, 28 aa, Artificial Sequence
  Description of Artificial Sequence: Synthetic peptide
DEEEIRTTNPVATEQYGSVSEQLQRGNR

SEQ ID NO: 4406 - protein, 28 aa, Artificial Sequence
  Description of Artificial Sequence: Synthetic peptide
DEEEIRTTNPVATEHYGSVSTNLQRGNA

SEQ ID NO: 4407 - protein, 28 aa, Artificial Sequence
  Description of Artificial Sequence: Synthetic peptide
DEEEVRTTNPVATEQYGAVSTNLQRGNR

SEQ ID NO: 4408 - protein, 28 aa, Artificial Sequence
  Description of Artificial Sequence: Synthetic peptide
DEEEIRTTNPVATEQYGEVSTNLQRGQR

SEQ ID NO: 4409 - protein, 28 aa, Artificial Sequence
  Description of Artificial Sequence: Synthetic peptide
DEEEIRTTNPVATEQFGSVSTNLQVGNR

SEQ ID NO: 4410 - protein, 28 aa, Artificial Sequence
  Description of Artificial Sequence: Synthetic peptide
DEEEIRTVNPVATEQYGSVSTNLQRGQR

SEQ ID NO: 4411 - protein, 28 aa, Artificial Sequence
  Description of Artificial Sequence: Synthetic peptide
DEEEIRQTNIVATEQYGSVSTNLQRGNR

SEQ ID NO: 4412 - protein, 28 aa, Artificial Sequence
  Description of Artificial Sequence: Synthetic peptide
DEEEIRTTNPVATEQYGSVSENLQHGNR

SEQ ID NO: 4413 - protein, 28 aa, Artificial Sequence
  Description of Artificial Sequence: Synthetic peptide
DIEEIRTTNPVATEQYGSVSTNLQHGNR

SEQ ID NO: 4414 - protein, 28 aa, Artificial Sequence
  Description of Artificial Sequence: Synthetic peptide
DEEEIRTTNPVATEQYGSVSENLQRENR

SEQ ID NO: 4415 - protein, 28 aa, Artificial Sequence
  Description of Artificial Sequence: Synthetic peptide
DECEIRTTNPVATEQYGSVSENLQRGNR

SEQ ID NO: 4416 - protein, 28 aa, Artificial Sequence
  Description of Artificial Sequence: Synthetic peptide
DEEIIRTTNPVATEQYGSVSTNVQRGNR

SEQ ID NO: 4417 - protein, 28 aa, Artificial Sequence
  Description of Artificial Sequence: Synthetic peptide
DEEEICTTNPVATECYGSVSTNLQRGNR

SEQ ID NO: 4418 - protein, 28 aa, Artificial Sequence
  Description of Artificial Sequence: Synthetic peptide
DEEEIRTTNPVATEWYGDVSTNLQRGNR

SEQ ID NO: 4419 - protein, 28 aa, Artificial Sequence
  Description of Artificial Sequence: Synthetic peptide
DEEEIRTTNPVATECYGSVSENLQRGNR

SEQ ID NO: 4420 - protein, 28 aa, Artificial Sequence
  Description of Artificial Sequence: Synthetic peptide
DEEEIRTTNPVATEQYGSVSDNLQQGNR

SEQ ID NO: 4421 - protein, 29 aa, Artificial Sequence
  Description of Artificial Sequence: Synthetic peptide
DEEEIRTTNPVATEQYGVVSTTNLQRGNR

SEQ ID NO: 4422 - protein, 28 aa, Artificial Sequence
  Description of Artificial Sequence: Synthetic peptide
DEEEIRTTNPVATEQYGSVSTDDQRGNR

SEQ ID NO: 4423 - protein, 30 aa, Artificial Sequence
  Description of Artificial Sequence: Synthetic polypeptide
DEEEIRTTNPVATEQYGSVSTNLQDRNGNR

SEQ ID NO: 4424 - protein, 28 aa, Artificial Sequence
  Description of Artificial Sequence: Synthetic peptide
DEEEIRTTNIVATEQYGSVSANLQRGNR

SEQ ID NO: 4425 - protein, 28 aa, Artificial Sequence
  Description of Artificial Sequence: Synthetic peptide
DEEEIRTTNPVATESYGSVSENLQRGNR

SEQ ID NO: 4426 - protein, 28 aa, Artificial Sequence
  Description of Artificial Sequence: Synthetic peptide
DEEEIRTTNPVATEQYGSVSTNEQRGNH

SEQ ID NO: 4427 - protein, 28 aa, Artificial Sequence
  Description of Artificial Sequence: Synthetic peptide
NEEEIRTTNPVATEQYGSVSTNDQRGNR

SEQ ID NO: 4428 - protein, 28 aa, Artificial Sequence
  Description of Artificial Sequence: Synthetic peptide
DEEEIRTTNPVATEQYGSVSTDLQRGER

SEQ ID NO: 4429 - protein, 28 aa, Artificial Sequence
  Description of Artificial Sequence: Synthetic peptide
AEEEIRTTNPVATEQYGEVSTNLQRGNR

SEQ ID NO: 4430 - protein, 28 aa, Artificial Sequence
  Description of Artificial Sequence: Synthetic peptide
DEDEIVTTNPVATEQYGSVSTNLQRGNR

SEQ ID NO: 4431 - protein, 29 aa, Artificial Sequence
  Description of Artificial Sequence: Synthetic peptide
DEEEIRTTNPVATEQYGESVSTNLQRGDR

SEQ ID NO: 4432 - protein, 29 aa, Artificial Sequence
  Description of Artificial Sequence: Synthetic peptide
DEEEIRTTNPVATEQYGSVETNLQRGNDR

SEQ ID NO: 4433 - protein, 28 aa, Artificial Sequence
  Description of Artificial Sequence: Synthetic peptide
DEEEIRTVNPVATEQYGSVSTDLQRGNR

SEQ ID NO: 4434 - protein, 28 aa, Artificial Sequence
  Description of Artificial Sequence: Synthetic peptide
DEEEIRTTNPVATEQYGHVFTNLQRGNR

SEQ ID NO: 4435 - protein, 28 aa, Artificial Sequence
  Description of Artificial Sequence: Synthetic peptide
DEEEIRTTNPVATENYGEVSTNLQRGNR

SEQ ID NO: 4436 - protein, 28 aa, Artificial Sequence
  Description of Artificial Sequence: Synthetic peptide
DEEEISTTNPVATEQYGSVSDNLQRGNR

SEQ ID NO: 4437 - protein, 28 aa, Artificial Sequence
  Description of Artificial Sequence: Synthetic peptide
DEIEIRTTNPVATEGYGSVSTNLQRGNR

SEQ ID NO: 4438 - protein, 28 aa, Artificial Sequence
  Description of Artificial Sequence: Synthetic peptide
DEEEIRTTNPVATEQYGSVSTNLQDGNC

SEQ ID NO: 4439 - protein, 28 aa, Artificial Sequence
  Description of Artificial Sequence: Synthetic peptide
DEEEIRTTNPVATEQYGSVSTNLQRLNA

SEQ ID NO: 4440 - protein, 29 aa, Artificial Sequence
  Description of Artificial Sequence: Synthetic peptide
DEEEIRTTNPVATEQYGSVDTNLPQRGNR

SEQ ID NO: 4441 - protein, 28 aa, Artificial Sequence
  Description of Artificial Sequence: Synthetic peptide
DEEEIRTTNPVATEMYGSVSTNLQAGNR

SEQ ID NO: 4442 - protein, 28 aa, Artificial Sequence
  Description of Artificial Sequence: Synthetic peptide
YEEEIRTTNPVATDQYGSVSTNLQRGNR

SEQ ID NO: 4443 - protein, 28 aa, Artificial Sequence
  Description of Artificial Sequence: Synthetic peptide
DEEEIRTTNPVATEQYGDVSTNLQYGNR

SEQ ID NO: 4444 - protein, 28 aa, Artificial Sequence
  Description of Artificial Sequence: Synthetic peptide
DIEEIRTTNPVATEQYGSVSTNLQRGNS

SEQ ID NO: 4445 - protein, 28 aa, Artificial Sequence
  Description of Artificial Sequence: Synthetic peptide
DEEEIRQTNPVATEQYGSVSTDLQRGNR

SEQ ID NO: 4446 - protein, 28 aa, Artificial Sequence
  Description of Artificial Sequence: Synthetic peptide
DEEEIVTTNPVATEQYGDVSTNLQRGNR

SEQ ID NO: 4447 - protein, 28 aa, Artificial Sequence
  Description of Artificial Sequence: Synthetic peptide
DEEEIRSTNIVATEQYGSVSTNLQRGNR

SEQ ID NO: 4448 - protein, 28 aa, Artificial Sequence
  Description of Artificial Sequence: Synthetic peptide
DEEEIRTTNIVSTEQYGSVSTNLQRGNR

SEQ ID NO: 4449 - protein, 28 aa, Artificial Sequence
  Description of Artificial Sequence: Synthetic peptide
DEEEIRTTNIVATEGYGSVSTNLQRGNR

SEQ ID NO: 4450 - protein, 28 aa, Artificial Sequence
  Description of Artificial Sequence: Synthetic peptide
DEEEIRTTNPVATEQYGSYSTNLQRGNF

SEQ ID NO: 4451 - protein, 28 aa, Artificial Sequence
  Description of Artificial Sequence: Synthetic peptide
DEEEIRTTNPVCTEQYGSVSTNLQHGNR

SEQ ID NO: 4452 - protein, 28 aa, Artificial Sequence
  Description of Artificial Sequence: Synthetic peptide
DEEEIRTTNPVAYEQYGGVSTNLQRGNR

SEQ ID NO: 4453 - protein, 28 aa, Artificial Sequence
  Description of Artificial Sequence: Synthetic peptide
DEEEIRTTNPVATEQYGSVSTNLQTGNT

SEQ ID NO: 4454 - protein, 28 aa, Artificial Sequence
  Description of Artificial Sequence: Synthetic peptide
GEEEIRTTNPVATEQYGSVSTNDQRGNR

SEQ ID NO: 4455 - protein, 29 aa, Artificial Sequence
  Description of Artificial Sequence: Synthetic peptide
DEEEIRTTNPVATEQYGESVSTILQRGNR

SEQ ID NO: 4456 - protein, 28 aa, Artificial Sequence
  Description of Artificial Sequence: Synthetic peptide
DDEEIRTTNPVATEQYGEVSTNLQRGNR

SEQ ID NO: 4457 - protein, 28 aa, Artificial Sequence
  Description of Artificial Sequence: Synthetic peptide
DEEEIRTTNPVATEQYGSVSTNLQRGDG

SEQ ID NO: 4458 - protein, 28 aa, Artificial Sequence
  Description of Artificial Sequence: Synthetic peptide
QEEEIRTTNPVATEQYGSVSTNLQHGNR

SEQ ID NO: 4459 - protein, 28 aa, Artificial Sequence
  Description of Artificial Sequence: Synthetic peptide
DEEEIRTTNPVATEQYGVVSTNLQQGNR

SEQ ID NO: 4460 - protein, 29 aa, Artificial Sequence
  Description of Artificial Sequence: Synthetic peptide
DEEEIRTTNPVATEQYGSVDSTNLLRGNR

SEQ ID NO: 4461 - protein, 28 aa, Artificial Sequence
  Description of Artificial Sequence: Synthetic peptide
DEEEIRTTNPVATEQYGSVSTNVQRGNF

SEQ ID NO: 4462 - protein, 28 aa, Artificial Sequence
  Description of Artificial Sequence: Synthetic peptide
DEEEIRTTNPVATEQYGSVSTDLQRGNL

SEQ ID NO: 4463 - protein, 29 aa, Artificial Sequence
  Description of Artificial Sequence: Synthetic peptide
DEEEIRTTNPVATEQYGSVSTNLQMRGNA

SEQ ID NO: 4464 - protein, 28 aa, Artificial Sequence
  Description of Artificial Sequence: Synthetic peptide
DEGEIRTTNPVSTEQYGSVSTNLQRGNR

SEQ ID NO: 4465 - protein, 29 aa, Artificial Sequence
  Description of Artificial Sequence: Synthetic peptide
DEEEIRTTNPVATEQYGSVSTNEQVRGNR

SEQ ID NO: 4466 - protein, 28 aa, Artificial Sequence
  Description of Artificial Sequence: Synthetic peptide
DEEEVRTTNPVATEQYGSTSTNLQRGNR

SEQ ID NO: 4467 - protein, 28 aa, Artificial Sequence
  Description of Artificial Sequence: Synthetic peptide
DEEEIRTTNPVATEQYGVVSTNLQRGNA

SEQ ID NO: 4468 - protein, 28 aa, Artificial Sequence
  Description of Artificial Sequence: Synthetic peptide
DEEEIRTTNPVATEQYGEVSTNLQRLNR

SEQ ID NO: 4469 - protein, 30 aa, Artificial Sequence
  Description of Artificial Sequence: Synthetic polypeptide
DEEEIRTTNPVATEQYGSVSTNLVQREGNR

SEQ ID NO: 4470 - protein, 28 aa, Artificial Sequence
  Description of Artificial Sequence: Synthetic peptide
DETEIRTTNPVATEVYGSVSTNLQRGNR

SEQ ID NO: 4471 - protein, 29 aa, Artificial Sequence
  Description of Artificial Sequence: Synthetic peptide
DEEEIRTTNPVATEQYGSVSTNLQRENER

SEQ ID NO: 4472 - protein, 28 aa, Artificial Sequence
  Description of Artificial Sequence: Synthetic peptide
DEEEIRTTNPVATEWYGSVSTNLQRGNL

SEQ ID NO: 4473 - protein, 28 aa, Artificial Sequence
  Description of Artificial Sequence: Synthetic peptide
DEEEIRTTNPVATEQYGSVSENLQRGVR

SEQ ID NO: 4474 - protein, 28 aa, Artificial Sequence
  Description of Artificial Sequence: Synthetic peptide
DEEEIRTTNPVATEQYGGVSTNLQRGNI

SEQ ID NO: 4475 - protein, 28 aa, Artificial Sequence
  Description of Artificial Sequence: Synthetic peptide
DEEEIRTTNPVCTEQYGSVSTNLQRGNM

SEQ ID NO: 4476 - protein, 28 aa, Artificial Sequence
  Description of Artificial Sequence: Synthetic peptide
DEEEIRTTNPVATEQYGSVSTELQRGNL

SEQ ID NO: 4477 - protein, 28 aa, Artificial Sequence
  Description of Artificial Sequence: Synthetic peptide
DEEEIRTTNPVATEPYGSVSTNLQRGNL

SEQ ID NO: 4478 - protein, 29 aa, Artificial Sequence
  Description of Artificial Sequence: Synthetic peptide
DEEEIRTTNPVATEQYGSVESTNDQRGNR

SEQ ID NO: 4479 - protein, 28 aa, Artificial Sequence
  Description of Artificial Sequence: Synthetic peptide
DEEEIRTTNPVASEHYGSVSTNLQRGNR

SEQ ID NO: 4480 - protein, 29 aa, Artificial Sequence
  Description of Artificial Sequence: Synthetic peptide
DEEEIRTTNPVATEQYGDVCSTNLQRGNR

SEQ ID NO: 4481 - protein, 29 aa, Artificial Sequence
  Description of Artificial Sequence: Synthetic peptide
DEEEIRTTNPVATEQYGSVSTNLQWGGNR

SEQ ID NO: 4482 - protein, 28 aa, Artificial Sequence
  Description of Artificial Sequence: Synthetic peptide
DEEEIRTTNPVATEQYGSVSTDEQRGNR

SEQ ID NO: 4483 - protein, 28 aa, Artificial Sequence
  Description of Artificial Sequence: Synthetic peptide
DEEEIRATNPVATEQYGSVSTALQRGNR

SEQ ID NO: 4484 - protein, 28 aa, Artificial Sequence
  Description of Artificial Sequence: Synthetic peptide
DEEEIRTTNPVATEQYGSVSTNWQVGNR

SEQ ID NO: 4485 - protein, 29 aa, Artificial Sequence
  Description of Artificial Sequence: Synthetic peptide
SEEEIRTTNPVATEQYGSVSTNLPQRGNR

SEQ ID NO: 4486 - protein, 28 aa, Artificial Sequence
  Description of Artificial Sequence: Synthetic peptide
DEEEIRTTNPVATEQYGSASDNLQRGNR

SEQ ID NO: 4487 - protein, 28 aa, Artificial Sequence
  Description of Artificial Sequence: Synthetic peptide
DEEEIRTTNIAATEQYGSVSTNLQRGNR

SEQ ID NO: 4488 - protein, 29 aa, Artificial Sequence
  Description of Artificial Sequence: Synthetic peptide
SEEEIRTTNPVATEQYGSVSTNLQERGNR

SEQ ID NO: 4489 - protein, 28 aa, Artificial Sequence
  Description of Artificial Sequence: Synthetic peptide
DEEEIRTTNPVATEQYGGVSTNLQGGNR

SEQ ID NO: 4490 - protein, 29 aa, Artificial Sequence
  Description of Artificial Sequence: Synthetic peptide
DEEELRTTNPVATEQYGSVSTNLQRGNER

SEQ ID NO: 4491 - protein, 28 aa, Artificial Sequence
  Description of Artificial Sequence: Synthetic peptide
DEEEIRTTNPVATEQYGSVSTNQQRGNS

SEQ ID NO: 4492 - protein, 28 aa, Artificial Sequence
  Description of Artificial Sequence: Synthetic peptide
DEEEIRTTNPVATEQYGSVSENLQRGPR

SEQ ID NO: 4493 - protein, 28 aa, Artificial Sequence
  Description of Artificial Sequence: Synthetic peptide
DEEEIRTTNPVATEQYGDVSTNLQTGNR

SEQ ID NO: 4494 - protein, 29 aa, Artificial Sequence
  Description of Artificial Sequence: Synthetic peptide
DEEEIRTTNPVATEQYGSVSTNPLQRGNQ

SEQ ID NO: 4495 - protein, 28 aa, Artificial Sequence
  Description of Artificial Sequence: Synthetic peptide
DEEEIRTTNPVATEQYGSVSTNLIEGNR

SEQ ID NO: 4496 - protein, 29 aa, Artificial Sequence
  Description of Artificial Sequence: Synthetic peptide
DEEEIATTNPVATEQYGSVSATNLQRGNR

SEQ ID NO: 4497 - protein, 28 aa, Artificial Sequence
  Description of Artificial Sequence: Synthetic peptide
DEEEVRTTNPVATEQYGSVSTNLERGNR

SEQ ID NO: 4498 - protein, 29 aa, Artificial Sequence
  Description of Artificial Sequence: Synthetic peptide
DEEEIRTTNPVATEQYGSMSTNLQRGNDR

SEQ ID NO: 4499 - protein, 29 aa, Artificial Sequence
  Description of Artificial Sequence: Synthetic peptide
DEEEIRTTNPVATEQYGSVSTELQQRGNR

SEQ ID NO: 4500 - protein, 28 aa, Artificial Sequence
  Description of Artificial Sequence: Synthetic peptide
DEEEIRTTNPVATEQYGSVSDNLQDGNR

SEQ ID NO: 4501 - protein, 28 aa, Artificial Sequence
  Description of Artificial Sequence: Synthetic peptide
DEEEIRTTNPVATECYGSVSTNLQVGNR

SEQ ID NO: 4502 - protein, 28 aa, Artificial Sequence
  Description of Artificial Sequence: Synthetic peptide
DEEEIRTTNPVATEQYGSVSEVLQRGNR

SEQ ID NO: 4503 - protein, 29 aa, Artificial Sequence
  Description of Artificial Sequence: Synthetic peptide
DEEEIRTTNPVATEFYGSVSTNLQRGDNR

SEQ ID NO: 4504 - protein, 28 aa, Artificial Sequence
  Description of Artificial Sequence: Synthetic peptide
DEEEIATTNPVATEQYGSVSTNLQRGNM

SEQ ID NO: 4505 - protein, 28 aa, Artificial Sequence
  Description of Artificial Sequence: Synthetic peptide
DEEEIRSTNPVATELYGSVSTNLQRGNR

SEQ ID NO: 4506 - protein, 29 aa, Artificial Sequence
  Description of Artificial Sequence: Synthetic peptide
DEEEIRTTNPVATEQYGEVSTNLQRSGNR

SEQ ID NO: 4507 - protein, 29 aa, Artificial Sequence
  Description of Artificial Sequence: Synthetic peptide
DEEEIRTTNPVATEQYGSVSTENLQRENR

SEQ ID NO: 4508 - protein, 30 aa, Artificial Sequence
  Description of Artificial Sequence: Synthetic polypeptide
DEEEIRTTNPVATEQYGSVSNTNLQREGNR

SEQ ID NO: 4509 - protein, 29 aa, Artificial Sequence
  Description of Artificial Sequence: Synthetic peptide
SEEEIRTTNPVATEQYGSVSITNLQRGNR

SEQ ID NO: 4510 - protein, 28 aa, Artificial Sequence
  Description of Artificial Sequence: Synthetic peptide
DEEEIRTTNPVATEQYGSVSTNLQHGLR

SEQ ID NO: 4511 - protein, 28 aa, Artificial Sequence
  Description of Artificial Sequence: Synthetic peptide
DEEEIRQTNPVATEVYGSVSTNLQRGNR

SEQ ID NO: 4512 - protein, 28 aa, Artificial Sequence
  Description of Artificial Sequence: Synthetic peptide
DEEEIATTNPVATEQYGSVPTNLQRGNR

SEQ ID NO: 4513 - protein, 28 aa, Artificial Sequence
  Description of Artificial Sequence: Synthetic peptide
DEEEIRCTNPVATEQYGDVSTNLQRGNR

SEQ ID NO: 4514 - protein, 28 aa, Artificial Sequence
  Description of Artificial Sequence: Synthetic peptide
DEEEIRTTNPVASEQYGSVSTNLQRGNL

SEQ ID NO: 4515 - protein, 28 aa, Artificial Sequence
  Description of Artificial Sequence: Synthetic peptide
DEEEIATTNPVATEVYGSVSTNLQRGNR

SEQ ID NO: 4516 - protein, 28 aa, Artificial Sequence
  Description of Artificial Sequence: Synthetic peptide
DEEEIRTTNPVATEQYGSVSTELQRGNF

SEQ ID NO: 4517 - protein, 29 aa, Artificial Sequence
  Description of Artificial Sequence: Synthetic peptide
DENEIRTTNPVATEQYGSVSTTNLQRGNR

SEQ ID NO: 4518 - protein, 29 aa, Artificial Sequence
  Description of Artificial Sequence: Synthetic peptide
DEEELRTTNPVATEQYGSVSTNLNQRGNR

SEQ ID NO: 4519 - protein, 28 aa, Artificial Sequence
  Description of Artificial Sequence: Synthetic peptide
DEEEIRTTNPVATEQYGSVYTGLQRGNR

SEQ ID NO: 4520 - protein, 30 aa, Artificial Sequence
  Description of Artificial Sequence: Synthetic polypeptide
DEEEIRTTNPVATEQYGSVSTNLPQERGNR

SEQ ID NO: 4521 - protein, 28 aa, Artificial Sequence
  Description of Artificial Sequence: Synthetic peptide
GEEEIRTTNPVATEQYGSVSTNLQRGNA

SEQ ID NO: 4522 - protein, 29 aa, Artificial Sequence
  Description of Artificial Sequence: Synthetic peptide
DEEEIRTTNPVATEQYGWVSTNLQRNGNR

SEQ ID NO: 4523 - protein, 28 aa, Artificial Sequence
  Description of Artificial Sequence: Synthetic peptide
DEEEICTTNPVATEQYGSVSENLQRGNR

SEQ ID NO: 4524 - protein, 28 aa, Artificial Sequence
  Description of Artificial Sequence: Synthetic peptide
DEEEIRTTNIFATEQYGSVSTNLQRGNR

SEQ ID NO: 4525 - protein, 28 aa, Artificial Sequence
  Description of Artificial Sequence: Synthetic peptide
DEEEIRTTNPVATHQYGSVSTNLDRGNR

SEQ ID NO: 4526 - protein, 28 aa, Artificial Sequence
  Description of Artificial Sequence: Synthetic peptide
DEECIRTTNPVATEQYGSVSTNLQGGNR

SEQ ID NO: 4527 - protein, 28 aa, Artificial Sequence
  Description of Artificial Sequence: Synthetic peptide
DEEEIRTTNPVATEQYGSVETNLQRGNP

SEQ ID NO: 4528 - protein, 28 aa, Artificial Sequence
  Description of Artificial Sequence: Synthetic peptide
DEEEIRTTNPVATEQYGDVSTNLQRGNS

SEQ ID NO: 4529 - protein, 30 aa, Artificial Sequence
  Description of Artificial Sequence: Synthetic polypeptide
DEEEIRTTNPVATEQYGSVSTNLQYRGNSR

SEQ ID NO: 4530 - protein, 29 aa, Artificial Sequence
  Description of Artificial Sequence: Synthetic peptide
DEEEIRTTNPVATEQYGSVSTNLQRGPNQ

SEQ ID NO: 4531 - protein, 28 aa, Artificial Sequence
  Description of Artificial Sequence: Synthetic peptide
DEEEIRTTNPVATEQYGSVSTNEQIGNR

SEQ ID NO: 4532 - protein, 29 aa, Artificial Sequence
  Description of Artificial Sequence: Synthetic peptide
DEEEIRTTNPVATEQYGSVSTNLQVRGNF

SEQ ID NO: 4533 - protein, 28 aa, Artificial Sequence
  Description of Artificial Sequence: Synthetic peptide
SEEEIRTTNPVATEQYGSVSTNLQRGNF

SEQ ID NO: 4534 - protein, 28 aa, Artificial Sequence
  Description of Artificial Sequence: Synthetic peptide
DEEEIVTTNPVATEQYGSVSTNVQRGNR

SEQ ID NO: 4535 - protein, 28 aa, Artificial Sequence
  Description of Artificial Sequence: Synthetic peptide
DEEEIRTTNPVATEQYGDVSTNLQHGNR

SEQ ID NO: 4536 - protein, 28 aa, Artificial Sequence
  Description of Artificial Sequence: Synthetic peptide
DEEEIHTTNPVATEQYGSVSTNLQRGND

SEQ ID NO: 4537 - protein, 29 aa, Artificial Sequence
  Description of Artificial Sequence: Synthetic peptide
DEEEIRTTNPVATEQYGSVSTELQERGNR

SEQ ID NO: 4538 - protein, 28 aa, Artificial Sequence
  Description of Artificial Sequence: Synthetic peptide
DEEEIRTTNPVATEQFGSVETNLQRGNR

SEQ ID NO: 4539 - protein, 28 aa, Artificial Sequence
  Description of Artificial Sequence: Synthetic peptide
DEEEIRTTNPVATEQYGSASTNLQRGNA

SEQ ID NO: 4540 - protein, 28 aa, Artificial Sequence
  Description of Artificial Sequence: Synthetic peptide
DEECIRTTNPVATEQYGSVSTNLQRGER

SEQ ID NO: 4541 - protein, 28 aa, Artificial Sequence
  Description of Artificial Sequence: Synthetic peptide
DEEEVRTTNPVATEQYGSVSTNLQRGNI

SEQ ID NO: 4542 - protein, 28 aa, Artificial Sequence
  Description of Artificial Sequence: Synthetic peptide
DEEEIRTTNPVATEQYGSVSDDLQRGNR

SEQ ID NO: 4543 - protein, 28 aa, Artificial Sequence
  Description of Artificial Sequence: Synthetic peptide
DEEEIRTTNPVATEQYGSVETDLQRGNR

SEQ ID NO: 4544 - protein, 28 aa, Artificial Sequence
  Description of Artificial Sequence: Synthetic peptide
DEEEIRTTNPFATEQYGSVSTNLQYGNR

SEQ ID NO: 4545 - protein, 28 aa, Artificial Sequence
  Description of Artificial Sequence: Synthetic peptide
DEEEIRTTNPVATEQYGSVSTNLQTGNP

SEQ ID NO: 4546 - protein, 28 aa, Artificial Sequence
  Description of Artificial Sequence: Synthetic peptide
DEEEIRTTNPVATEQYGSVSTNIQRGTR

SEQ ID NO: 4547 - protein, 30 aa, Artificial Sequence
  Description of Artificial Sequence: Synthetic polypeptide
DEEEIRTTNPVATEQYGSVSTGNLVQRGNR

SEQ ID NO: 4548 - protein, 28 aa, Artificial Sequence
  Description of Artificial Sequence: Synthetic peptide
DEEEIRSTNPVATEQYGEVSTNLQRGNR

SEQ ID NO: 4549 - protein, 29 aa, Artificial Sequence
  Description of Artificial Sequence: Synthetic peptide
DEEEIRTTNPVATEQYGSVSTNLQRGNFQ

SEQ ID NO: 4550 - protein, 28 aa, Artificial Sequence
  Description of Artificial Sequence: Synthetic peptide
DEEEIRTTNPVATEQYGSVSTELQRGNQ

SEQ ID NO: 4551 - protein, 28 aa, Artificial Sequence
  Description of Artificial Sequence: Synthetic peptide
DEEEIRTTNIVCTEQYGSVSTNLQRGNR

SEQ ID NO: 4552 - protein, 28 aa, Artificial Sequence
  Description of Artificial Sequence: Synthetic peptide
DEEEIRTTNPVGTEQYGSVPTNLQRGNR

SEQ ID NO: 4553 - protein, 29 aa, Artificial Sequence
  Description of Artificial Sequence: Synthetic peptide
DEEEIRTTNPVATEQYGSVSTNLDREGNR

SEQ ID NO: 4554 - protein, 28 aa, Artificial Sequence
  Description of Artificial Sequence: Synthetic peptide
DEEEIRQTNPVATEQYGSVSTNLQRGNL

SEQ ID NO: 4555 - protein, 28 aa, Artificial Sequence
  Description of Artificial Sequence: Synthetic peptide
DEEEIRTTNPVATEQYGSVETNLQPGNR

SEQ ID NO: 4556 - protein, 28 aa, Artificial Sequence
  Description of Artificial Sequence: Synthetic peptide
DEEEIRTTNPVATEQYGSVSTNLARGAR

SEQ ID NO: 4557 - protein, 29 aa, Artificial Sequence
  Description of Artificial Sequence: Synthetic peptide
DEEEIRTTNPVATEQYGSVSYTNLQRGVR

SEQ ID NO: 4558 - protein, 28 aa, Artificial Sequence
  Description of Artificial Sequence: Synthetic peptide
DEEEIRTTNPVATEQYGSVSENLQYGNR

SEQ ID NO: 4559 - protein, 28 aa, Artificial Sequence
  Description of Artificial Sequence: Synthetic peptide
DEEEIRTTNPVATEVYGSVSTNIQRGNR

SEQ ID NO: 4560 - protein, 29 aa, Artificial Sequence
  Description of Artificial Sequence: Synthetic peptide
DEEEIRTTNPVATEQYGSASTNLQRAGNR

SEQ ID NO: 4561 - protein, 28 aa, Artificial Sequence
  Description of Artificial Sequence: Synthetic peptide
DEEEIRTTNPVATEIYGSVSTNLQVGNR

SEQ ID NO: 4562 - protein, 28 aa, Artificial Sequence
  Description of Artificial Sequence: Synthetic peptide
DEEHIRTTNPVATEQYGSVSTNLQDGNR

SEQ ID NO: 4563 - protein, 28 aa, Artificial Sequence
  Description of Artificial Sequence: Synthetic peptide
DEEEIRTTNPVATEQYGSVSENLQWGNR

SEQ ID NO: 4564 - protein, 28 aa, Artificial Sequence
  Description of Artificial Sequence: Synthetic peptide
DEEEIRTTNPVATEQYGVVSTNLQSGNR

SEQ ID NO: 4565 - protein, 29 aa, Artificial Sequence
  Description of Artificial Sequence: Synthetic peptide
AEEEIRTTNPVATEQYGSVSETNLQRGNR

SEQ ID NO: 4566 - protein, 28 aa, Artificial Sequence
  Description of Artificial Sequence: Synthetic peptide
DENEIRTVNPVATEQYGSVSTNLQRGNR

SEQ ID NO: 4567 - protein, 30 aa, Artificial Sequence
  Description of Artificial Sequence: Synthetic polypeptide
DEEEIRTTNPVATEQYGSVSTNLQRGENLR

SEQ ID NO: 4568 - protein, 28 aa, Artificial Sequence
  Description of Artificial Sequence: Synthetic peptide
DEEEIVCTNPVATEQYGSVSTNLQRGNR

SEQ ID NO: 4569 - protein, 28 aa, Artificial Sequence
  Description of Artificial Sequence: Synthetic peptide
GDEEIRTTNPVATEQYGSVSTNLQRGNR

SEQ ID NO: 4570 - protein, 28 aa, Artificial Sequence
  Description of Artificial Sequence: Synthetic peptide
DEEEIRTTNPVATFQYGSVSTNLQRGNP

SEQ ID NO: 4571 - protein, 29 aa, Artificial Sequence
  Description of Artificial Sequence: Synthetic peptide
DEEEIRTTNPVATEQYGSVDSTNDQRGNR

SEQ ID NO: 4572 - protein, 28 aa, Artificial Sequence
  Description of Artificial Sequence: Synthetic peptide
DEEEIRTTNPVATEQYGSVSTNLQIGLR

SEQ ID NO: 4573 - protein, 28 aa, Artificial Sequence
  Description of Artificial Sequence: Synthetic peptide
DEEEIATTNPVATEQYGSVSTNLQRGER

SEQ ID NO: 4574 - protein, 28 aa, Artificial Sequence
  Description of Artificial Sequence: Synthetic peptide
DEEEIRTTNPVATEQYGSASTNLQRGNQ

SEQ ID NO: 4575 - protein, 28 aa, Artificial Sequence
  Description of Artificial Sequence: Synthetic peptide
DEEEIVTTNPVATEQYGSVSANLQRGNR

SEQ ID NO: 4576 - protein, 28 aa, Artificial Sequence
  Description of Artificial Sequence: Synthetic peptide
DEEEIRTTNPVATEQYGSVSTNLQRGIT

SEQ ID NO: 4577 - protein, 28 aa, Artificial Sequence
  Description of Artificial Sequence: Synthetic peptide
DEEEIRTTNIVATEQYGSVSTNLQRGQR

SEQ ID NO: 4578 - protein, 28 aa, Artificial Sequence
  Description of Artificial Sequence: Synthetic peptide
DEEEIRTTNPVATEQYGSVSTDLQRGNQ

SEQ ID NO: 4579 - protein, 28 aa, Artificial Sequence
  Description of Artificial Sequence: Synthetic peptide
DEEEIRTTNPVATELYGSVSTNLQRGDR

SEQ ID NO: 4580 - protein, 28 aa, Artificial Sequence
  Description of Artificial Sequence: Synthetic peptide
DEEEIRTTNPVATEQYGVASTNLQRGNR

SEQ ID NO: 4581 - protein, 28 aa, Artificial Sequence
  Description of Artificial Sequence: Synthetic peptide
DEEEIRTTNPVATEQYWSVSTNLQRGNP

SEQ ID NO: 4582 - protein, 30 aa, Artificial Sequence
  Description of Artificial Sequence: Synthetic polypeptide
DEEEIRTTNPVATEQYGESVSETNLQRGNR

SEQ ID NO: 4583 - protein, 28 aa, Artificial Sequence
  Description of Artificial Sequence: Synthetic peptide
DEEEIRTTNPVATEQYGSVSTNLQRNAR

SEQ ID NO: 4584 - protein, 28 aa, Artificial Sequence
  Description of Artificial Sequence: Synthetic peptide
DEGEIRTTNPVCTEQYGSVSTNLQRGNR

SEQ ID NO: 4585 - protein, 28 aa, Artificial Sequence
  Description of Artificial Sequence: Synthetic peptide
DEEEIRTTNPVATEQYGDVSTNLQRGNM

SEQ ID NO: 4586 - protein, 28 aa, Artificial Sequence
  Description of Artificial Sequence: Synthetic peptide
DEEEIRTTNPVATEQYGSVSTNDQGGNR

SEQ ID NO: 4587 - protein, 28 aa, Artificial Sequence
  Description of Artificial Sequence: Synthetic peptide
DEEEIRTTNPVATEMYGSVSTNLQRINR

SEQ ID NO: 4588 - protein, 28 aa, Artificial Sequence
  Description of Artificial Sequence: Synthetic peptide
DEEEIRCTNPVATEQYGSVSTNLQRGNY

SEQ ID NO: 4589 - protein, 28 aa, Artificial Sequence
  Description of Artificial Sequence: Synthetic peptide
DPEEIRTTNPVATEQYGSVSTNLQRGND

SEQ ID NO: 4590 - protein, 30 aa, Artificial Sequence
  Description of Artificial Sequence: Synthetic polypeptide
DEEEIRTTNPVATEQYGSVLSTANLQRGNR

SEQ ID NO: 4591 - protein, 28 aa, Artificial Sequence
  Description of Artificial Sequence: Synthetic peptide
DEEEIRTTNPVATEQYGSVSTNQQRGND

SEQ ID NO: 4592 - protein, 28 aa, Artificial Sequence
  Description of Artificial Sequence: Synthetic peptide
DEEEIRTTNPVATEQYGSVSTNLQRGDN

SEQ ID NO: 4593 - protein, 28 aa, Artificial Sequence
  Description of Artificial Sequence: Synthetic peptide
DEEEIATTNPVATEQYGSVSTNLQRGNY

SEQ ID NO: 4594 - protein, 28 aa, Artificial Sequence
  Description of Artificial Sequence: Synthetic peptide
DEEEIRTTNPVATEQYGSVSDNLQRGNV

SEQ ID NO: 4595 - protein, 28 aa, Artificial Sequence
  Description of Artificial Sequence: Synthetic peptide
DEEEIRTTNPVATEQYGSVDTNLMRGNR

SEQ ID NO: 4596 - protein, 28 aa, Artificial Sequence
  Description of Artificial Sequence: Synthetic peptide
DEEEIRTTNPAATEQYGSVSTNLQRGNQ

SEQ ID NO: 4597 - protein, 28 aa, Artificial Sequence
  Description of Artificial Sequence: Synthetic peptide
DEEEIRTTNPVATEQYGSVSTNPQRGNI

SEQ ID NO: 4598 - protein, 28 aa, Artificial Sequence
  Description of Artificial Sequence: Synthetic peptide
DEEEIRTTNPVAYEQYGSVSSNLQRGNR

SEQ ID NO: 4599 - protein, 29 aa, Artificial Sequence
  Description of Artificial Sequence: Synthetic peptide
DEEEIRTTNPVATEQYGSNVSTNLQYGNR

SEQ ID NO: 4600 - protein, 28 aa, Artificial Sequence
  Description of Artificial Sequence: Synthetic peptide
DEEEIRTTNPCATEQYGSVSTNLQMGNR

SEQ ID NO: 4601 - protein, 28 aa, Artificial Sequence
  Description of Artificial Sequence: Synthetic peptide
DEEEIRTTNPVATECYGSVSTDLQRGNR

SEQ ID NO: 4602 - protein, 28 aa, Artificial Sequence
  Description of Artificial Sequence: Synthetic peptide
DEEEIRTTNPVATEQYGDVSTNLQRGNL

SEQ ID NO: 4603 - protein, 28 aa, Artificial Sequence
  Description of Artificial Sequence: Synthetic peptide
DEEEIRTTNPVATEQWGSVSTNLQRGNS

SEQ ID NO: 4604 - protein, 28 aa, Artificial Sequence
  Description of Artificial Sequence: Synthetic peptide
DEEEIRTTNPVATEQYGSVSTNLQRGEI

SEQ ID NO: 4605 - protein, 28 aa, Artificial Sequence
  Description of Artificial Sequence: Synthetic peptide
DEEEIRTTNPVATEQYGSVSCNLQRGNQ

SEQ ID NO: 4606 - protein, 30 aa, Artificial Sequence
  Description of Artificial Sequence: Synthetic polypeptide
DEEEIRTTNPVATEQYGSVSDTNLQRGNVR

SEQ ID NO: 4607 - protein, 29 aa, Artificial Sequence
  Description of Artificial Sequence: Synthetic peptide
DEEEIRTTNPVATEQYGSVSTNLFRGDNR

SEQ ID NO: 4608 - protein, 28 aa, Artificial Sequence
  Description of Artificial Sequence: Synthetic peptide
DEEEIRTTNPVATEQYGSASTNLQRGNM

SEQ ID NO: 4609 - protein, 28 aa, Artificial Sequence
  Description of Artificial Sequence: Synthetic peptide
DEEEIVTTNPVATEQYGSVSTNLQRGNT

SEQ ID NO: 4610 - protein, 30 aa, Artificial Sequence
  Description of Artificial Sequence: Synthetic polypeptide
DEEEIRTTNPVATEQYGSVSTNLPQRGINR

SEQ ID NO: 4611 - protein, 28 aa, Artificial Sequence
  Description of Artificial Sequence: Synthetic peptide
DEEEIRTTNPVATEQYGEVSTNLARGNR

SEQ ID NO: 4612 - protein, 28 aa, Artificial Sequence
  Description of Artificial Sequence: Synthetic peptide
DEEEIRTTNPVATEAYGSVSTNLQRDNR

SEQ ID NO: 4613 - protein, 28 aa, Artificial Sequence
  Description of Artificial Sequence: Synthetic peptide
DEEEIRTTNPVATEQYGSVSTNLQQGNN

SEQ ID NO: 4614 - protein, 29 aa, Artificial Sequence
  Description of Artificial Sequence: Synthetic peptide
DEEEIRTTNPVATEQYGSVSTNLQEIGNR

SEQ ID NO: 4615 - protein, 28 aa, Artificial Sequence
  Description of Artificial Sequence: Synthetic peptide
DEEEIRTTNPVATEQYGSVSTNLQMGNL

SEQ ID NO: 4616 - protein, 28 aa, Artificial Sequence
  Description of Artificial Sequence: Synthetic peptide
DEEEIRCTNPVATELYGSVSTNLQRGNR

SEQ ID NO: 4617 - protein, 28 aa, Artificial Sequence
  Description of Artificial Sequence: Synthetic peptide
DEEEIRTTNPVATEAYGSVSTGLQRGNR

SEQ ID NO: 4618 - protein, 28 aa, Artificial Sequence
  Description of Artificial Sequence: Synthetic peptide
DEEEIRTTNPVATEQYGSVSENWQRGNR

SEQ ID NO: 4619 - protein, 28 aa, Artificial Sequence
  Description of Artificial Sequence: Synthetic peptide
DEEEIRTVNPVATEQYGSVSDNLQRGNR

SEQ ID NO: 4620 - protein, 28 aa, Artificial Sequence
  Description of Artificial Sequence: Synthetic peptide
HEEEIRTTNPVATEQYGSVSTNLQRENR

SEQ ID NO: 4621 - protein, 28 aa, Artificial Sequence
  Description of Artificial Sequence: Synthetic peptide
DEEEIRTTNPVATEQYGGVSTNLQRGNL

SEQ ID NO: 4622 - protein, 28 aa, Artificial Sequence
  Description of Artificial Sequence: Synthetic peptide
DEEEIRHTNPVATEQYGSVSTNLQRGNH

SEQ ID NO: 4623 - protein, 28 aa, Artificial Sequence
  Description of Artificial Sequence: Synthetic peptide
DEEEIRTTNPVATEQYGAVSTNLQPGNR

SEQ ID NO: 4624 - protein, 29 aa, Artificial Sequence
  Description of Artificial Sequence: Synthetic peptide
EEEEIRTTNPVATEQYGSVSTNLQRGPNR

SEQ ID NO: 4625 - protein, 28 aa, Artificial Sequence
  Description of Artificial Sequence: Synthetic peptide
DEEEIRTTNPVATEMYGSVSTVLQRGNR

SEQ ID NO: 4626 - protein, 28 aa, Artificial Sequence
  Description of Artificial Sequence: Synthetic peptide
DEEEIRTTNPVATEQYGSWSTNLQRGNQ

SEQ ID NO: 4627 - protein, 28 aa, Artificial Sequence
  Description of Artificial Sequence: Synthetic peptide
DEEEIRTTNPVATEQYGSVSTNDQRGNV

SEQ ID NO: 4628 - protein, 28 aa, Artificial Sequence
  Description of Artificial Sequence: Synthetic peptide
DEEEIRTTNPVATENYGVVSTNLQRGNR

SEQ ID NO: 4629 - protein, 28 aa, Artificial Sequence
  Description of Artificial Sequence: Synthetic peptide
DEEEIRTTNPVATESYGSVSTNLQRGLR

SEQ ID NO: 4630 - protein, 28 aa, Artificial Sequence
  Description of Artificial Sequence: Synthetic peptide
DEEEIRTTNPTATEQYGSVSTNLQRGNA

SEQ ID NO: 4631 - protein, 28 aa, Artificial Sequence
  Description of Artificial Sequence: Synthetic peptide
DEEEIRTTNPVATEQYGSVSEFLQRGNR

SEQ ID NO: 4632 - protein, 28 aa, Artificial Sequence
  Description of Artificial Sequence: Synthetic peptide
DEEEIRTTNPVATEQYGWVSDNLQRGNR

SEQ ID NO: 4633 - protein, 28 aa, Artificial Sequence
  Description of Artificial Sequence: Synthetic peptide
DEEEIRTTNPVATEQYGSVSTNLQRGEP

SEQ ID NO: 4634 - protein, 30 aa, Artificial Sequence
  Description of Artificial Sequence: Synthetic polypeptide
DEEEIRTTNPVATEQYGSVSTNLQERNGNR

SEQ ID NO: 4635 - protein, 29 aa, Artificial Sequence
  Description of Artificial Sequence: Synthetic peptide
DEEEIRTTNPVATEQYGSVSTNLQVRGNQ

SEQ ID NO: 4636 - protein, 29 aa, Artificial Sequence
  Description of Artificial Sequence: Synthetic peptide
DEEEIRTTNPVATEQYGSVSTLNLQRGGR

SEQ ID NO: 4637 - protein, 28 aa, Artificial Sequence
  Description of Artificial Sequence: Synthetic peptide
DEEEIITTNIVATEQYGSVSTNLQRGNR

SEQ ID NO: 4638 - protein, 28 aa, Artificial Sequence
  Description of Artificial Sequence: Synthetic peptide
DEEEIRTTNPVSTELYGSVSTNLQRGNR

SEQ ID NO: 4639 - protein, 28 aa, Artificial Sequence
  Description of Artificial Sequence: Synthetic peptide
DEEEIRTTNPVGTEQYGSVSTNLQRGNS

SEQ ID NO: 4640 - protein, 28 aa, Artificial Sequence
  Description of Artificial Sequence: Synthetic peptide
DEEEIRTTNPVATEVYGSVSTNLQQGNR

SEQ ID NO: 4641 - protein, 29 aa, Artificial Sequence
  Description of Artificial Sequence: Synthetic peptide
DEQEIRTTNPVATEQYGSVSTNLQERGNR

SEQ ID NO: 4642 - protein, 28 aa, Artificial Sequence
  Description of Artificial Sequence: Synthetic peptide
DEEEIRTVNPVATEQYGSVGTNLQRGNR

SEQ ID NO: 4643 - protein, 28 aa, Artificial Sequence
  Description of Artificial Sequence: Synthetic peptide
DEEEIRTTNPVATEQYGSVSTNGQQGNR

SEQ ID NO: 4644 - protein, 28 aa, Artificial Sequence
  Description of Artificial Sequence: Synthetic peptide
DEEEIRTTNPVATEQYGSVSMALQRGNR

SEQ ID NO: 4645 - protein, 28 aa, Artificial Sequence
  Description of Artificial Sequence: Synthetic peptide
DEEEIRTTNPTATEQYGSVSENLQRGNR

SEQ ID NO: 4646 - protein, 28 aa, Artificial Sequence
  Description of Artificial Sequence: Synthetic peptide
DEEEIRSTNPVATEQYGSVGTNLQRGNR

SEQ ID NO: 4647 - protein, 29 aa, Artificial Sequence
  Description of Artificial Sequence: Synthetic peptide
DEEEIRTTNPVATEQYGSVDTNLQRGNPR

SEQ ID NO: 4648 - protein, 28 aa, Artificial Sequence
  Description of Artificial Sequence: Synthetic peptide
DEEEIRTTNPVATEVYGSVSTNLQRGGR

SEQ ID NO: 4649 - protein, 28 aa, Artificial Sequence
  Description of Artificial Sequence: Synthetic peptide
DEEEIRTTNPVATECYGSVSTNLQGGNR

SEQ ID NO: 4650 - protein, 28 aa, Artificial Sequence
  Description of Artificial Sequence: Synthetic peptide
DEEEIRTTNPVATEQYGCVSTNLQRGIR

SEQ ID NO: 4651 - protein, 28 aa, Artificial Sequence
  Description of Artificial Sequence: Synthetic peptide
DEEEIRTTNPVSTEQYGSVSENLQRGNR

SEQ ID NO: 4652 - protein, 29 aa, Artificial Sequence
  Description of Artificial Sequence: Synthetic peptide
DEEEIRTTNPVATEQYGSVPTNLQRGVNR

SEQ ID NO: 4653 - protein, 28 aa, Artificial Sequence
  Description of Artificial Sequence: Synthetic peptide
DEEEIRTTNPVATEQYGSWSTNLERGNR

SEQ ID NO: 4654 - protein, 28 aa, Artificial Sequence
  Description of Artificial Sequence: Synthetic peptide
DEEEIRTTNIVATEQYGSVSTNLQRGTR

SEQ ID NO: 4655 - protein, 28 aa, Artificial Sequence
  Description of Artificial Sequence: Synthetic peptide
DEEEIRTTNPVATEQYGDVSTNLQRGNH

SEQ ID NO: 4656 - protein, 28 aa, Artificial Sequence
  Description of Artificial Sequence: Synthetic peptide
DEEEIRTTNPVATEQYGSVSTNLDRGND

SEQ ID NO: 4657 - protein, 28 aa, Artificial Sequence
  Description of Artificial Sequence: Synthetic peptide
DEEEIRTTNPVATEQYGGVSDNLQRGNR

SEQ ID NO: 4658 - protein, 28 aa, Artificial Sequence
  Description of Artificial Sequence: Synthetic peptide
DEEEIATTNPVATEQYGSVSTPLQRGNR

SEQ ID NO: 4659 - protein, 28 aa, Artificial Sequence
  Description of Artificial Sequence: Synthetic peptide
DEEEIRTTNPVATEVYGSVSTNLQRGNH

SEQ ID NO: 4660 - protein, 29 aa, Artificial Sequence
  Description of Artificial Sequence: Synthetic peptide
DEEEIYTTNPVATEQYGSVSTNLQVRGNR

SEQ ID NO: 4661 - protein, 29 aa, Artificial Sequence
  Description of Artificial Sequence: Synthetic peptide
DEEEIRTTNPVATEQYGSVSTNLQNGVNR

SEQ ID NO: 4662 - protein, 29 aa, Artificial Sequence
  Description of Artificial Sequence: Synthetic peptide
DEEEIRTTNPVATEQYGSVSENLQNRGNR

SEQ ID NO: 4663 - protein, 29 aa, Artificial Sequence
  Description of Artificial Sequence: Synthetic peptide
DEEEIRTTNPVATEQYGSVSTNDTQRGNR

SEQ ID NO: 4664 - protein, 28 aa, Artificial Sequence
  Description of Artificial Sequence: Synthetic peptide
DEEEIRTTNPVATEQYGSVSTTLQRGNL

SEQ ID NO: 4665 - protein, 28 aa, Artificial Sequence
  Description of Artificial Sequence: Synthetic peptide
DECEIRTTNPVATEQYGSVSTDLQRGNR

SEQ ID NO: 4666 - protein, 29 aa, Artificial Sequence
  Description of Artificial Sequence: Synthetic peptide
DEEEIRTTNPVATEQYGSVSTNLQQGDNR

SEQ ID NO: 4667 - protein, 28 aa, Artificial Sequence
  Description of Artificial Sequence: Synthetic peptide
DEEEIRTTNPVATEQYGSVSENLQMGNR

SEQ ID NO: 4668 - protein, 29 aa, Artificial Sequence
  Description of Artificial Sequence: Synthetic peptide
DEEEIRTTNPVATEQYGSVSTTNLQRGER

SEQ ID NO: 4669 - protein, 28 aa, Artificial Sequence
  Description of Artificial Sequence: Synthetic peptide
DEEEIRTTNPVATEQYGSVSDNEQRGNR

SEQ ID NO: 4670 - protein, 29 aa, Artificial Sequence
  Description of Artificial Sequence: Synthetic peptide
DEEEIRTTNPVATEQYGSVSTNLQQRGNF

SEQ ID NO: 4671 - protein, 29 aa, Artificial Sequence
  Description of Artificial Sequence: Synthetic peptide
DEEEIRTTNPEATEQYGSVSTGNLQRGNR

SEQ ID NO: 4672 - protein, 29 aa, Artificial Sequence
  Description of Artificial Sequence: Synthetic peptide
DEEEIRTTNPVATEQYGSVSTNLQMRSNR

SEQ ID NO: 4673 - protein, 28 aa, Artificial Sequence
  Description of Artificial Sequence: Synthetic peptide
DEEEIRTTNPVATEQYGSVSTNLQLGNC

SEQ ID NO: 4674 - protein, 28 aa, Artificial Sequence
  Description of Artificial Sequence: Synthetic peptide
DEETIRTTNPVATEQYGSVSTGLQRGNR

SEQ ID NO: 4675 - protein, 28 aa, Artificial Sequence
  Description of Artificial Sequence: Synthetic peptide
NEEEIRTTNPVATEQYGSVSTALQRGNR

SEQ ID NO: 4676 - protein, 28 aa, Artificial Sequence
  Description of Artificial Sequence: Synthetic peptide
MEEEIRTTNPVATEQYGSVSTNLQRGNA

SEQ ID NO: 4677 - protein, 28 aa, Artificial Sequence
  Description of Artificial Sequence: Synthetic peptide
DEEEIRTTNPVATEQYGSVSMNLQRGND

SEQ ID NO: 4678 - protein, 29 aa, Artificial Sequence
  Description of Artificial Sequence: Synthetic peptide
DEEEIRTTNPVATEQYGSVSTNLQRAGTR

SEQ ID NO: 4679 - protein, 30 aa, Artificial Sequence
  Description of Artificial Sequence: Synthetic polypeptide
DEEEIRTTNPVATEQYGSVSTNLQTRGNDR

SEQ ID NO: 4680 - protein, 29 aa, Artificial Sequence
  Description of Artificial Sequence: Synthetic peptide
DEEEIRTTNPVATEHYGSVSTNLVQRGNR

SEQ ID NO: 4681 - protein, 28 aa, Artificial Sequence
  Description of Artificial Sequence: Synthetic peptide
DENEIRTTNPVATEQYGSVSDNLQRGNR

SEQ ID NO: 4682 - protein, 28 aa, Artificial Sequence
  Description of Artificial Sequence: Synthetic peptide
DEEEIRTTNPVATELYGSVSTNLQRGNI

SEQ ID NO: 4683 - protein, 28 aa, Artificial Sequence
  Description of Artificial Sequence: Synthetic peptide
DEEEIKTTNPVATEQYGSVSENLQRGNR

SEQ ID NO: 4684 - protein, 28 aa, Artificial Sequence
  Description of Artificial Sequence: Synthetic peptide
DEEEIRTTNPVATEQYGSVSTDWQRGNR

SEQ ID NO: 4685 - protein, 28 aa, Artificial Sequence
  Description of Artificial Sequence: Synthetic peptide
DEEEIRCTNIVATEQYGSVSTNLQRGNR

SEQ ID NO: 4686 - protein, 28 aa, Artificial Sequence
  Description of Artificial Sequence: Synthetic peptide
DEEEIRTTNPVATEQYGSVSTNDQRGGR

SEQ ID NO: 4687 - protein, 28 aa, Artificial Sequence
  Description of Artificial Sequence: Synthetic peptide
DEDEIATTNPVATEQYGSVSTNLQRGNR

SEQ ID NO: 4688 - protein, 29 aa, Artificial Sequence
  Description of Artificial Sequence: Synthetic peptide
DEEEIRCTNPVATEQYGSVSCTNLQRGNR

SEQ ID NO: 4689 - protein, 28 aa, Artificial Sequence
  Description of Artificial Sequence: Synthetic peptide
DEECIRTTNPVATEQYGSVSTNLQPGNR

SEQ ID NO: 4690 - protein, 28 aa, Artificial Sequence
  Description of Artificial Sequence: Synthetic peptide
DEEEIRTTNPVATEQYGSVSYNLQRGNL

SEQ ID NO: 4691 - protein, 29 aa, Artificial Sequence
  Description of Artificial Sequence: Synthetic peptide
DEEEIRTTNPVATEQYGSVSTNLQMQGNR

SEQ ID NO: 4692 - protein, 28 aa, Artificial Sequence
  Description of Artificial Sequence: Synthetic peptide
DEEEIRTTNIVATEQYGSVSTQLQRGNR

SEQ ID NO: 4693 - protein, 29 aa, Artificial Sequence
  Description of Artificial Sequence: Synthetic peptide
DEEEIRTTNPVATEQYGSVESTNLQRGND

SEQ ID NO: 4694 - protein, 29 aa, Artificial Sequence
  Description of Artificial Sequence: Synthetic peptide
DEEEIRTTNPVATEQYGSVSTNLQQHGNR

SEQ ID NO: 4695 - protein, 28 aa, Artificial Sequence
  Description of Artificial Sequence: Synthetic peptide
DEEEIRTTNPVATEQYGSVSTNLQPLNR

SEQ ID NO: 4696 - protein, 28 aa, Artificial Sequence
  Description of Artificial Sequence: Synthetic peptide
DEEEIRTTNPVATECFGSVSTNLQRGNR

SEQ ID NO: 4697 - protein, 28 aa, Artificial Sequence
  Description of Artificial Sequence: Synthetic peptide
DEEEIRTTNPVATEQYGVVSTNLQRGNF

SEQ ID NO: 4698 - protein, 29 aa, Artificial Sequence
  Description of Artificial Sequence: Synthetic peptide
DEEEIATTNPVATEQYGSVSTPNLQRGNR

SEQ ID NO: 4699 - protein, 28 aa, Artificial Sequence
  Description of Artificial Sequence: Synthetic peptide
DPEEIRTTNPVATEQYGSVSTNLQRGER

SEQ ID NO: 4700 - protein, 28 aa, Artificial Sequence
  Description of Artificial Sequence: Synthetic peptide
DEEEIRTTNPAATEQYGGVSTNLQRGNR

SEQ ID NO: 4701 - protein, 28 aa, Artificial Sequence
  Description of Artificial Sequence: Synthetic peptide
DEEEIRTTNPVATEQYGSVSTSLQQGNR

SEQ ID NO: 4702 - protein, 30 aa, Artificial Sequence
  Description of Artificial Sequence: Synthetic polypeptide
DEEEIRTTNPVATEQYGSVSTLNLQRGNDR

SEQ ID NO: 4703 - protein, 28 aa, Artificial Sequence
  Description of Artificial Sequence: Synthetic peptide
DEEEIRTTNPVATEQWGSVSTNLQRGNA

SEQ ID NO: 4704 - protein, 28 aa, Artificial Sequence
  Description of Artificial Sequence: Synthetic peptide
DEEEIRGTNPVATEQYGEVSTNLQRGNR

SEQ ID NO: 4705 - protein, 28 aa, Artificial Sequence
  Description of Artificial Sequence: Synthetic peptide
DEEEIRTTNPVATEQYGSVSTNLQSGNY

SEQ ID NO: 4706 - protein, 28 aa, Artificial Sequence
  Description of Artificial Sequence: Synthetic peptide
DEEEIATTNPVATEQYGDVSTNLQRGNR

SEQ ID NO: 4707 - protein, 29 aa, Artificial Sequence
  Description of Artificial Sequence: Synthetic peptide
DEEEIRTTNPCATEQYGSVCSTNLQRGNR

SEQ ID NO: 4708 - protein, 28 aa, Artificial Sequence
  Description of Artificial Sequence: Synthetic peptide
DEEEIRTTNPVATEQYGSVSTNLQRGEE

SEQ ID NO: 4709 - protein, 28 aa, Artificial Sequence
  Description of Artificial Sequence: Synthetic peptide
DEEEIRTTNPVATETYGDVSTNLQRGNR

SEQ ID NO: 4710 - protein, 29 aa, Artificial Sequence
  Description of Artificial Sequence: Synthetic peptide
IEEEIRTTNPVATEQYGSVSTPNLQRGNR

SEQ ID NO: 4711 - protein, 28 aa, Artificial Sequence
  Description of Artificial Sequence: Synthetic peptide
DEEEIRTTNPVATELYGSVSENLQRGNR

SEQ ID NO: 4712 - protein, 28 aa, Artificial Sequence
  Description of Artificial Sequence: Synthetic peptide
DEEEIRTTNIVATEQYGVVSTNLQRGNR

SEQ ID NO: 4713 - protein, 28 aa, Artificial Sequence
  Description of Artificial Sequence: Synthetic peptide
DEEEIATTNPVATEQYGSVSENLQRGNR

SEQ ID NO: 4714 - protein, 28 aa, Artificial Sequence
  Description of Artificial Sequence: Synthetic peptide
DEEEIRTTNPVATEQYGSVATNLQRGNM

SEQ ID NO: 4715 - protein, 28 aa, Artificial Sequence
  Description of Artificial Sequence: Synthetic peptide
DEEEIRTTNPCATEQYGSVSTNLQRGNF

SEQ ID NO: 4716 - protein, 28 aa, Artificial Sequence
  Description of Artificial Sequence: Synthetic peptide
DEEEIRTTNPVATEQYGSVSTNLDRGNE

SEQ ID NO: 4717 - protein, 28 aa, Artificial Sequence
  Description of Artificial Sequence: Synthetic peptide
DEEEIRYTNPVATEQYGSVSTNLQDGNR

SEQ ID NO: 4718 - protein, 28 aa, Artificial Sequence
  Description of Artificial Sequence: Synthetic peptide
DEEEIRTTNPIASEQYGSVSTNLQRGNR

SEQ ID NO: 4719 - protein, 28 aa, Artificial Sequence
  Description of Artificial Sequence: Synthetic peptide
DEEEIRTVNPVATEQYGSVSTGLQRGNR

SEQ ID NO: 4720 - protein, 28 aa, Artificial Sequence
  Description of Artificial Sequence: Synthetic peptide
DEEEIRTTNPVATEQYGSVNENLQRGNR

SEQ ID NO: 4721 - protein, 28 aa, Artificial Sequence
  Description of Artificial Sequence: Synthetic peptide
DEEEITTTNPVATEQYGSVSTNLQRGNV

SEQ ID NO: 4722 - protein, 29 aa, Artificial Sequence
  Description of Artificial Sequence: Synthetic peptide
DDEEIRTTNPVATEQYGSVWSTNLQRGNR

SEQ ID NO: 4723 - protein, 28 aa, Artificial Sequence
  Description of Artificial Sequence: Synthetic peptide
DEEEIRTTNPVCTEQYGSVSTNLQRGNI

SEQ ID NO: 4724 - protein, 28 aa, Artificial Sequence
  Description of Artificial Sequence: Synthetic peptide
DEEEICTTNPVATEQYGSVSCNLQRGNR

SEQ ID NO: 4725 - protein, 28 aa, Artificial Sequence
  Description of Artificial Sequence: Synthetic peptide
DEEEIRTTNPIATEQYGSVSTNLQIGNR

SEQ ID NO: 4726 - protein, 29 aa, Artificial Sequence
  Description of Artificial Sequence: Synthetic peptide
DEEEIRTTNPVATEQYGSVSNNLQQRGNR

SEQ ID NO: 4727 - protein, 28 aa, Artificial Sequence
  Description of Artificial Sequence: Synthetic peptide
DEEEIRCTNPVATEQYGSVSTNLQRGNF

SEQ ID NO: 4728 - protein, 28 aa, Artificial Sequence
  Description of Artificial Sequence: Synthetic peptide
DEEEIRTTNPEATEQYGSVSTNDQRGNR

SEQ ID NO: 4729 - protein, 28 aa, Artificial Sequence
  Description of Artificial Sequence: Synthetic peptide
DEEEIRTTNPVATEQYGSVHTNLQPGNR

SEQ ID NO: 4730 - protein, 29 aa, Artificial Sequence
  Description of Artificial Sequence: Synthetic peptide
DEEEIRTTNPVATEQYGSVSTNLQDRGND

SEQ ID NO: 4731 - protein, 29 aa, Artificial Sequence
  Description of Artificial Sequence: Synthetic peptide
DESEIRTTNPVATEQYGSVSATNLQRGNR

SEQ ID NO: 4732 - protein, 28 aa, Artificial Sequence
  Description of Artificial Sequence: Synthetic peptide
DEMEIRTTNPVATEQYGSVSTVLQRGNR

SEQ ID NO: 4733 - protein, 28 aa, Artificial Sequence
  Description of Artificial Sequence: Synthetic peptide
DEEEIRSTNPVATEQYGSVSTNLQRGPR

SEQ ID NO: 4734 - protein, 29 aa, Artificial Sequence
  Description of Artificial Sequence: Synthetic peptide
DEEEIRTTNPVATEQYGSVQSTNLIRGNR

SEQ ID NO: 4735 - protein, 28 aa, Artificial Sequence
  Description of Artificial Sequence: Synthetic peptide
DEEEIRTTNPVSTEQYGSASTNLQRGNR

SEQ ID NO: 4736 - protein, 28 aa, Artificial Sequence
  Description of Artificial Sequence: Synthetic peptide
DESEIRTTNPVSTEQYGSVSTNLQRGNR

SEQ ID NO: 4737 - protein, 29 aa, Artificial Sequence
  Description of Artificial Sequence: Synthetic peptide
DEEELRTTNPVATEQYGSVSTNLQYRGNR

SEQ ID NO: 4738 - protein, 30 aa, Artificial Sequence
  Description of Artificial Sequence: Synthetic polypeptide
DEEEIRTTNPVATEQYGSVSTSNLQRGFNR

SEQ ID NO: 4739 - protein, 28 aa, Artificial Sequence
  Description of Artificial Sequence: Synthetic peptide
DEEEIRTTNPVATEQYGSVSTNLQWGNE

SEQ ID NO: 4740 - protein, 28 aa, Artificial Sequence
  Description of Artificial Sequence: Synthetic peptide
DEEEIRTVNPVATEQYGSVSTNLQRGNT

SEQ ID NO: 4741 - protein, 28 aa, Artificial Sequence
  Description of Artificial Sequence: Synthetic peptide
DEEEIRTVNPVATEQFGSVSTNLQRGNR

SEQ ID NO: 4742 - protein, 28 aa, Artificial Sequence
  Description of Artificial Sequence: Synthetic peptide
AEEEIRTTNPVATEQYGTVSTNLQRGNR

SEQ ID NO: 4743 - protein, 28 aa, Artificial Sequence
  Description of Artificial Sequence: Synthetic peptide
DEEEIRTTNPVATEQFGSVSTNAQRGNR

SEQ ID NO: 4744 - protein, 29 aa, Artificial Sequence
  Description of Artificial Sequence: Synthetic peptide
DEEEIATTNPVATEQYGSVSCTNLQRGNR

SEQ ID NO: 4745 - protein, 29 aa, Artificial Sequence
  Description of Artificial Sequence: Synthetic peptide
DEEEIRTTNPVATEQYGSVSTLNLQRGNW

SEQ ID NO: 4746 - protein, 28 aa, Artificial Sequence
  Description of Artificial Sequence: Synthetic peptide
DEEEIRTTNPVATEQYGSVSTNQQRGNT

SEQ ID NO: 4747 - protein, 28 aa, Artificial Sequence
  Description of Artificial Sequence: Synthetic peptide
DEEEIRTTNPVATEQYGVVSTNLQLGNR

SEQ ID NO: 4748 - protein, 28 aa, Artificial Sequence
  Description of Artificial Sequence: Synthetic peptide
DEEEVRTTNPVATEQYGSVSMNLQRGNR

SEQ ID NO: 4749 - protein, 28 aa, Artificial Sequence
  Description of Artificial Sequence: Synthetic peptide
SEEEIRTTNPVATEQYGSVSTNEQRGNR

SEQ ID NO: 4750 - protein, 28 aa, Artificial Sequence
  Description of Artificial Sequence: Synthetic peptide
DEEEIRTTNPVATEQYGSVSTALERGNR

SEQ ID NO: 4751 - protein, 28 aa, Artificial Sequence
  Description of Artificial Sequence: Synthetic peptide
DEEEIRTTNPVATEQYGDVSTNLQRGNA

SEQ ID NO: 4752 - protein, 29 aa, Artificial Sequence
  Description of Artificial Sequence: Synthetic peptide
DEEEIRTTNPVATEQYGESVSTNLQDGNR

SEQ ID NO: 4753 - protein, 29 aa, Artificial Sequence
  Description of Artificial Sequence: Synthetic peptide
DEESIRTTNPVATEQFYGSVSTNLQRGNR

SEQ ID NO: 4754 - protein, 28 aa, Artificial Sequence
  Description of Artificial Sequence: Synthetic peptide
DEEEIRTTNPVATEQYGLVSTNLQRGNG

SEQ ID NO: 4755 - protein, 28 aa, Artificial Sequence
  Description of Artificial Sequence: Synthetic peptide
DEEEIRTTNPFATEQYGSVSTNLQHGNR

SEQ ID NO: 4756 - protein, 28 aa, Artificial Sequence
  Description of Artificial Sequence: Synthetic peptide
DEEEIRTTNPVATEQYGSVSTNLQRGQA

SEQ ID NO: 4757 - protein, 30 aa, Artificial Sequence
  Description of Artificial Sequence: Synthetic polypeptide
DEEEIRTTNPVATEQYGSVSDTNLQREGNR

SEQ ID NO: 4758 - protein, 29 aa, Artificial Sequence
  Description of Artificial Sequence: Synthetic peptide
DEEEIRTTNPVATEQYGSVSTNLQRGLNA

SEQ ID NO: 4759 - protein, 28 aa, Artificial Sequence
  Description of Artificial Sequence: Synthetic peptide
DEQEIRTTNPVATEQYGSVSTNLQRGNQ

SEQ ID NO: 4760 - protein, 28 aa, Artificial Sequence
  Description of Artificial Sequence: Synthetic peptide
DEEEIRTTNPVATEVYGEVSTNLQRGNR

SEQ ID NO: 4761 - protein, 28 aa, Artificial Sequence
  Description of Artificial Sequence: Synthetic peptide
DEEEIRTTNPVATEQYGCVSTNLQSGNR

SEQ ID NO: 4762 - protein, 28 aa, Artificial Sequence
  Description of Artificial Sequence: Synthetic peptide
EEEEIRTTNPVATEQYGQVSTNLQRGNR

SEQ ID NO: 4763 - protein, 28 aa, Artificial Sequence
  Description of Artificial Sequence: Synthetic peptide
DEEEIRTTNPVATEQYGSVSTVLQRGMR

SEQ ID NO: 4764 - protein, 28 aa, Artificial Sequence
  Description of Artificial Sequence: Synthetic peptide
DEEEIRTTNPVATEQYGSVSTNLQTGNA

SEQ ID NO: 4765 - protein, 28 aa, Artificial Sequence
  Description of Artificial Sequence: Synthetic peptide
DEEEIRTTNPVATEQYGSVSENLQRGMR

SEQ ID NO: 4766 - protein, 28 aa, Artificial Sequence
  Description of Artificial Sequence: Synthetic peptide
DEEEIRTTNPVAAEQYGSVSTNLQRSNR

SEQ ID NO: 4767 - protein, 29 aa, Artificial Sequence
  Description of Artificial Sequence: Synthetic peptide
DEEEIRTTNPVATEQYGSVSVNLQRGNIR

SEQ ID NO: 4768 - protein, 28 aa, Artificial Sequence
  Description of Artificial Sequence: Synthetic peptide
DEEEIRTTNPVATEQYGSVSENLQRGNL

SEQ ID NO: 4769 - protein, 28 aa, Artificial Sequence
  Description of Artificial Sequence: Synthetic peptide
DENEIRTTNPVATECYGSVSTNLQRGNR

SEQ ID NO: 4770 - protein, 28 aa, Artificial Sequence
  Description of Artificial Sequence: Synthetic peptide
DEEEIRTTNPVATEQYGSVSTNLLRGHR

SEQ ID NO: 4771 - protein, 29 aa, Artificial Sequence
  Description of Artificial Sequence: Synthetic peptide
DEEEIRTTNPVAFEQYGSVSDTNLQRGNR

SEQ ID NO: 4772 - protein, 28 aa, Artificial Sequence
  Description of Artificial Sequence: Synthetic peptide
DEEEIRTTNPVAGEQYGSVSTNLQRGNF

SEQ ID NO: 4773 - protein, 29 aa, Artificial Sequence
  Description of Artificial Sequence: Synthetic peptide
DEEEIRTTNPVATEQYGSVASTNDQRGNR

SEQ ID NO: 4774 - protein, 29 aa, Artificial Sequence
  Description of Artificial Sequence: Synthetic peptide
DEEEIRTTNPVATEQYGSVSTMNLQRGNQ

SEQ ID NO: 4775 - protein, 28 aa, Artificial Sequence
  Description of Artificial Sequence: Synthetic peptide
DEEEIRTTNPCATEQYGSVSTNLQSGNR

SEQ ID NO: 4776 - protein, 29 aa, Artificial Sequence
  Description of Artificial Sequence: Synthetic peptide
DEEEIRTTNPVATEQYGDVSTNLQNRGNR

SEQ ID NO: 4777 - protein, 30 aa, Artificial Sequence
  Description of Artificial Sequence: Synthetic polypeptide
DEEEIRTTNPVATEQYGSVSTMNLQDRGNR

SEQ ID NO: 4778 - protein, 29 aa, Artificial Sequence
  Description of Artificial Sequence: Synthetic peptide
DEEEIRTTNPVATEQYGSYVSTNLQRGNF

SEQ ID NO: 4779 - protein, 28 aa, Artificial Sequence
  Description of Artificial Sequence: Synthetic peptide
DEEEIRTTNIVATEQYGSVSNNLQRGNR

SEQ ID NO: 4780 - protein, 28 aa, Artificial Sequence
  Description of Artificial Sequence: Synthetic peptide
DEEEIRTTNPVATEQYGSVSTNGQRGNT

SEQ ID NO: 4781 - protein, 28 aa, Artificial Sequence
  Description of Artificial Sequence: Synthetic peptide
DEEEIRSTNNVATEQYGSVSTNLQRGNR

SEQ ID NO: 4782 - protein, 28 aa, Artificial Sequence
  Description of Artificial Sequence: Synthetic peptide
AEEEIRTTNPVATEQYGSVSTNLQRGDR

SEQ ID NO: 4783 - protein, 28 aa, Artificial Sequence
  Description of Artificial Sequence: Synthetic peptide
DEEEIRTTNPVATEQYGSVSTNLQRENQ

SEQ ID NO: 4784 - protein, 28 aa, Artificial Sequence
  Description of Artificial Sequence: Synthetic peptide
DEEEIRTTNPDATEQYGSVSTNLQRGNG

SEQ ID NO: 4785 - protein, 28 aa, Artificial Sequence
  Description of Artificial Sequence: Synthetic peptide
DSEEIRTTNIVATEQYGSVSTNLQRGNR

SEQ ID NO: 4786 - protein, 28 aa, Artificial Sequence
  Description of Artificial Sequence: Synthetic peptide
DEEEIRTTNPVATEQYGSVFTNLQRGNQ

SEQ ID NO: 4787 - protein, 29 aa, Artificial Sequence
  Description of Artificial Sequence: Synthetic peptide
DEEEIRTTNPVATEQYGSVSTNLQIGNDR

SEQ ID NO: 4788 - protein, 28 aa, Artificial Sequence
  Description of Artificial Sequence: Synthetic peptide
DEEEITTTNPVATEQYGSVSTNLQRGNA

SEQ ID NO: 4789 - protein, 29 aa, Artificial Sequence
  Description of Artificial Sequence: Synthetic peptide
DEEEIRTTNPVATEQYGAVSTNLTQRGNR

SEQ ID NO: 4790 - protein, 28 aa, Artificial Sequence
  Description of Artificial Sequence: Synthetic peptide
DEEETRTTNPVATEQYGSVSTNLQRPNR

SEQ ID NO: 4791 - protein, 28 aa, Artificial Sequence
  Description of Artificial Sequence: Synthetic peptide
DEEEIRTTNPCATEQYGSVSTNLQIGNR

SEQ ID NO: 4792 - protein, 29 aa, Artificial Sequence
  Description of Artificial Sequence: Synthetic peptide
DEEEIRTTNPVATEQFGSVSTNGLQRGNR

SEQ ID NO: 4793 - protein, 28 aa, Artificial Sequence
  Description of Artificial Sequence: Synthetic peptide
DEEEIRTTNPVCTEQYGDVSTNLQRGNR

SEQ ID NO: 4794 - protein, 28 aa, Artificial Sequence
  Description of Artificial Sequence: Synthetic peptide
DEEEIRTTNPVATEQYGSVSTPLQRENR

SEQ ID NO: 4795 - protein, 28 aa, Artificial Sequence
  Description of Artificial Sequence: Synthetic peptide
DEEEIRTTNPTATEQYGSVSTNLQRENR

SEQ ID NO: 4796 - protein, 28 aa, Artificial Sequence
  Description of Artificial Sequence: Synthetic peptide
DENEIRTTNPVATEQYGVVSTNLQRGNR

SEQ ID NO: 4797 - protein, 29 aa, Artificial Sequence
  Description of Artificial Sequence: Synthetic peptide
DEEEIRTTNPVATEQYGSVSENLQWRGNR

SEQ ID NO: 4798 - protein, 28 aa, Artificial Sequence
  Description of Artificial Sequence: Synthetic peptide
DEEEIRQTNPVATEQYGSVGTNLQRGNR

SEQ ID NO: 4799 - protein, 28 aa, Artificial Sequence
  Description of Artificial Sequence: Synthetic peptide
DEEEIRTTNPVATEQYGSVSTDLQRGNF

SEQ ID NO: 4800 - protein, 30 aa, Artificial Sequence
  Description of Artificial Sequence: Synthetic polypeptide
DEEEIRTTNPVATEQYGSVESTLNLQRGNR

SEQ ID NO: 4801 - protein, 28 aa, Artificial Sequence
  Description of Artificial Sequence: Synthetic peptide
NEEEIRTTNPVATEQYGSVSTNLQRGNQ

SEQ ID NO: 4802 - protein, 29 aa, Artificial Sequence
  Description of Artificial Sequence: Synthetic peptide
DEEEIRTTNPVATEQYGSVSTNLQDLGNR

SEQ ID NO: 4803 - protein, 28 aa, Artificial Sequence
  Description of Artificial Sequence: Synthetic peptide
DEEEIRTTNPVATEQFGSVSTNLQRGNF

SEQ ID NO: 4804 - protein, 28 aa, Artificial Sequence
  Description of Artificial Sequence: Synthetic peptide
DEEEIATTNPTATEQYGSVSTNLQRGNR

SEQ ID NO: 4805 - protein, 29 aa, Artificial Sequence
  Description of Artificial Sequence: Synthetic peptide
DEEEIRTTNPVATEQYGDVVSTNLQRGNR

SEQ ID NO: 4806 - protein, 28 aa, Artificial Sequence
  Description of Artificial Sequence: Synthetic peptide
DEEEVRTTNPVATEQYGSVSTNLQRGNN

SEQ ID NO: 4807 - protein, 28 aa, Artificial Sequence
  Description of Artificial Sequence: Synthetic peptide
DEEEIITTNPVATESYGSVSTNLQRGNR

SEQ ID NO: 4808 - protein, 28 aa, Artificial Sequence
  Description of Artificial Sequence: Synthetic peptide
DEEEIRTTNPCATEQYGSVSTNLMRGNR

SEQ ID NO: 4809 - protein, 28 aa, Artificial Sequence
  Description of Artificial Sequence: Synthetic peptide
DEEEIRTTNIVATEQYGSVSTNLQRVNR

SEQ ID NO: 4810 - protein, 28 aa, Artificial Sequence
  Description of Artificial Sequence: Synthetic peptide
DEEEIRTTNPVATEQYGSVSTNLQTGNI

SEQ ID NO: 4811 - protein, 28 aa, Artificial Sequence
  Description of Artificial Sequence: Synthetic peptide
DEEEIRTTNPVATEQYGSVSTNWQQGNR

SEQ ID NO: 4812 - protein, 28 aa, Artificial Sequence
  Description of Artificial Sequence: Synthetic peptide
DEEEIRCTNPVATEQYGGVSTNLQRGNR

SEQ ID NO: 4813 - protein, 28 aa, Artificial Sequence
  Description of Artificial Sequence: Synthetic peptide
NEEEIRTTNPVATEQYGSVWTNLQRGNR

SEQ ID NO: 4814 - protein, 28 aa, Artificial Sequence
  Description of Artificial Sequence: Synthetic peptide
DETEIRSTNPVATEQYGSVSTNLQRGNR

SEQ ID NO: 4815 - protein, 29 aa, Artificial Sequence
  Description of Artificial Sequence: Synthetic peptide
DEEEIRTTNPDATEQYGSVSTNLQRGNDR

SEQ ID NO: 4816 - protein, 30 aa, Artificial Sequence
  Description of Artificial Sequence: Synthetic polypeptide
DEEEIRTTNPVATEQYGSVISTNLQRGNTR

SEQ ID NO: 4817 - protein, 28 aa, Artificial Sequence
  Description of Artificial Sequence: Synthetic peptide
DEEEIRTTNPVATEQYGVVSMNLQRGNR

SEQ ID NO: 4818 - protein, 29 aa, Artificial Sequence
  Description of Artificial Sequence: Synthetic peptide
DELEIRTTNPVATEQYGSVSTNLQRGANR

SEQ ID NO: 4819 - protein, 28 aa, Artificial Sequence
  Description of Artificial Sequence: Synthetic peptide
DEEEIRTTNPVATEQYGSVSDNLQYGNR

SEQ ID NO: 4820 - protein, 28 aa, Artificial Sequence
  Description of Artificial Sequence: Synthetic peptide
SEEEIRTTNPTATEQYGSVSTNLQRGNR

SEQ ID NO: 4821 - protein, 28 aa, Artificial Sequence
  Description of Artificial Sequence: Synthetic peptide
DEEEIRTTNPVASEQYGVVSTNLQRGNR

SEQ ID NO: 4822 - protein, 29 aa, Artificial Sequence
  Description of Artificial Sequence: Synthetic peptide
DEEEIRTTNPVATEQYGSVDSTNLQRGNM

SEQ ID NO: 4823 - protein, 28 aa, Artificial Sequence
  Description of Artificial Sequence: Synthetic peptide
DEEEIRTTNPVATEQYGSVETNLDRGNR

SEQ ID NO: 4824 - protein, 28 aa, Artificial Sequence
  Description of Artificial Sequence: Synthetic peptide
DEEEIRTTNPVATEQYGWVSTNLQHGNR

SEQ ID NO: 4825 - protein, 28 aa, Artificial Sequence
  Description of Artificial Sequence: Synthetic peptide
DEQEIRTTNPVATEQYGSVGTNLQRGNR

SEQ ID NO: 4826 - protein, 28 aa, Artificial Sequence
  Description of Artificial Sequence: Synthetic peptide
DEEEIRTTNPVATEQYGSVSNNLQHGNR

SEQ ID NO: 4827 - protein, 29 aa, Artificial Sequence
  Description of Artificial Sequence: Synthetic peptide
DEEEIRTTNPVATEQYGSVSTNLQLRGNT

SEQ ID NO: 4828 - protein, 28 aa, Artificial Sequence
  Description of Artificial Sequence: Synthetic peptide
DEEEIRTTNPVATEQYGSCSTNLQRGNG

SEQ ID NO: 4829 - protein, 28 aa, Artificial Sequence
  Description of Artificial Sequence: Synthetic peptide
DEEEIATTNPVATEQYGSVSNNLQRGNR

SEQ ID NO: 4830 - protein, 28 aa, Artificial Sequence
  Description of Artificial Sequence: Synthetic peptide
DEEEIRTTNPVATEQYGWVSTNLQFGNR

SEQ ID NO: 4831 - protein, 28 aa, Artificial Sequence
  Description of Artificial Sequence: Synthetic peptide
DEEEIRTTNPVATEQYGSVSTNLQRGEN

SEQ ID NO: 4832 - protein, 29 aa, Artificial Sequence
  Description of Artificial Sequence: Synthetic peptide
DEEEIRTTNPEATEQYGSVSTNGLQRGNR

SEQ ID NO: 4833 - protein, 28 aa, Artificial Sequence
  Description of Artificial Sequence: Synthetic peptide
DEEEIRTTNPVATEQYGSVSTCGQRGNR

SEQ ID NO: 4834 - protein, 28 aa, Artificial Sequence
  Description of Artificial Sequence: Synthetic peptide
DEEEIRTTNPVATEQYGNVSTNLQRGNA

SEQ ID NO: 4835 - protein, 28 aa, Artificial Sequence
  Description of Artificial Sequence: Synthetic peptide
DEEEIRTTNPVATETYGSVSTNLQRGNL

SEQ ID NO: 4836 - protein, 28 aa, Artificial Sequence
  Description of Artificial Sequence: Synthetic peptide
DEVEIATTNPVATEQYGSVSTNLQRGNR

SEQ ID NO: 4837 - protein, 28 aa, Artificial Sequence
  Description of Artificial Sequence: Synthetic peptide
DEEEIRTTNPTATEQYGSVSTNLQRQNR

SEQ ID NO: 4838 - protein, 29 aa, Artificial Sequence
  Description of Artificial Sequence: Synthetic peptide
DEEEIRTTNPVATEQYGSVSTNEVQRGNR

SEQ ID NO: 4839 - protein, 28 aa, Artificial Sequence
  Description of Artificial Sequence: Synthetic peptide
VEEEIRTTNPVATEVYGSVSTNLQRGNR

SEQ ID NO: 4840 - protein, 28 aa, Artificial Sequence
  Description of Artificial Sequence: Synthetic peptide
DEECIRTTNPVATEQYGSVSTNLQRGNF

SEQ ID NO: 4841 - protein, 30 aa, Artificial Sequence
  Description of Artificial Sequence: Synthetic polypeptide
DEEEIRTTNPVATEQYGSVSTPNLQRSGNR

SEQ ID NO: 4842 - protein, 28 aa, Artificial Sequence
  Description of Artificial Sequence: Synthetic peptide
DEEEIRTTNPVATEQYGSVSTNLQHDNR

SEQ ID NO: 4843 - protein, 28 aa, Artificial Sequence
  Description of Artificial Sequence: Synthetic peptide
DEEEIRTTNPVATEQYGSVETNLQRGNE

SEQ ID NO: 4844 - protein, 28 aa, Artificial Sequence
  Description of Artificial Sequence: Synthetic peptide
DEEEIRTTNPVATEQYGSVSTNLQTGTR

SEQ ID NO: 4845 - protein, 28 aa, Artificial Sequence
  Description of Artificial Sequence: Synthetic peptide
DEEEIRTTNPEATEQYGSVSTNLQIGNR

SEQ ID NO: 4846 - protein, 29 aa, Artificial Sequence
  Description of Artificial Sequence: Synthetic peptide
DEEEIRPTNPVATEQYGSVSTNLVQRGNR

SEQ ID NO: 4847 - protein, 28 aa, Artificial Sequence
  Description of Artificial Sequence: Synthetic peptide
DEDEIRQTNPVATEQYGSVSTNLQRGNR

SEQ ID NO: 4848 - protein, 28 aa, Artificial Sequence
  Description of Artificial Sequence: Synthetic peptide
DEEEIRCTNPVATEQYGIVSTNLQRGNR

SEQ ID NO: 4849 - protein, 28 aa, Artificial Sequence
  Description of Artificial Sequence: Synthetic peptide
DEEEIRTTNPVATEQYGSVSTNLQNGNP

SEQ ID NO: 4850 - protein, 29 aa, Artificial Sequence
  Description of Artificial Sequence: Synthetic peptide
DEEEIRTTNPVATEQYGSVSTNPLQFGNR

SEQ ID NO: 4851 - protein, 28 aa, Artificial Sequence
  Description of Artificial Sequence: Synthetic peptide
DEEEIRTTNPVATEFYGSVSTNLQRGNA

SEQ ID NO: 4852 - protein, 29 aa, Artificial Sequence
  Description of Artificial Sequence: Synthetic peptide
DEEEIRTTNPVATEQYGSVSDNLQRGNYR

SEQ ID NO: 4853 - protein, 28 aa, Artificial Sequence
  Description of Artificial Sequence: Synthetic peptide
NEEEIRTTNPVATEQYGSVATNLQRGNR

SEQ ID NO: 4854 - protein, 28 aa, Artificial Sequence
  Description of Artificial Sequence: Synthetic peptide
DESEIRATNPVATEQYGSVSTNLQRGNR

SEQ ID NO: 4855 - protein, 30 aa, Artificial Sequence
  Description of Artificial Sequence: Synthetic polypeptide
DEEEIRTTNPVATEQYGSVDSTNGLQRGNR

SEQ ID NO: 4856 - protein, 29 aa, Artificial Sequence
  Description of Artificial Sequence: Synthetic peptide
DEEEIRTTNPVATEQYGSVSCTNLQRGNI

SEQ ID NO: 4857 - protein, 28 aa, Artificial Sequence
  Description of Artificial Sequence: Synthetic peptide
DEEEIRTTNPVATEQYGSVSTNEQRGNV

SEQ ID NO: 4858 - protein, 28 aa, Artificial Sequence
  Description of Artificial Sequence: Synthetic peptide
DEAEIRTTNPVATEQYGSVSTNLQSGNR

SEQ ID NO: 4859 - protein, 28 aa, Artificial Sequence
  Description of Artificial Sequence: Synthetic peptide
DEEEIRTTNPVATEQYGSVSTNLQQGND

SEQ ID NO: 4860 - protein, 30 aa, Artificial Sequence
  Description of Artificial Sequence: Synthetic polypeptide
DEEEIRTTNPVATEQYGSVSSTGNLQRGNR

SEQ ID NO: 4861 - protein, 30 aa, Artificial Sequence
  Description of Artificial Sequence: Synthetic polypeptide
DEEEIRTTNPVATEQYGSVESTNLQIRGNR

SEQ ID NO: 4862 - protein, 29 aa, Artificial Sequence
  Description of Artificial Sequence: Synthetic peptide
DEEEIRTTNPVATEQYGTVSTNPLQRGNR

SEQ ID NO: 4863 - protein, 29 aa, Artificial Sequence
  Description of Artificial Sequence: Synthetic peptide
DEEEIRTTNPVATEQYGSVSTALQLRGNR

SEQ ID NO: 4864 - protein, 29 aa, Artificial Sequence
  Description of Artificial Sequence: Synthetic peptide
DEEEIRTTNPVATEQYGSVETNLQRGNER

SEQ ID NO: 4865 - protein, 28 aa, Artificial Sequence
  Description of Artificial Sequence: Synthetic peptide
DDEEIRTTNPVATEQFGSVSTNLQRGNR

SEQ ID NO: 4866 - protein, 28 aa, Artificial Sequence
  Description of Artificial Sequence: Synthetic peptide
DEEEIRTTNPVATEQYGSVSTNLQYGNN

SEQ ID NO: 4867 - protein, 29 aa, Artificial Sequence
  Description of Artificial Sequence: Synthetic peptide
DEEEIRTTNPVATEQYGSVSTNLMRGNDR

SEQ ID NO: 4868 - protein, 28 aa, Artificial Sequence
  Description of Artificial Sequence: Synthetic peptide
DTEEIRTTNPVATEQYGSVSTNLQPGNR

SEQ ID NO: 4869 - protein, 28 aa, Artificial Sequence
  Description of Artificial Sequence: Synthetic peptide
DPEEIRTTNPVATEQYGSVSTDLQRGNR

SEQ ID NO: 4870 - protein, 28 aa, Artificial Sequence
  Description of Artificial Sequence: Synthetic peptide
DEEEIRTTNPVATEQYGSVSTNLQRENV

SEQ ID NO: 4871 - protein, 29 aa, Artificial Sequence
  Description of Artificial Sequence: Synthetic peptide
DEEEIRTTNPVATEQYGSVSHNLQFRGNR

SEQ ID NO: 4872 - protein, 29 aa, Artificial Sequence
  Description of Artificial Sequence: Synthetic peptide
DEEEIRTTNPVATEQYGSVSTNLTARGNR

SEQ ID NO: 4873 - protein, 29 aa, Artificial Sequence
  Description of Artificial Sequence: Synthetic peptide
DEEEIRTTNPVATEQYGSVSTNLQRGVER

SEQ ID NO: 4874 - protein, 28 aa, Artificial Sequence
  Description of Artificial Sequence: Synthetic peptide
QEEEIRTTNPVATEMYGSVSTNLQRGNR

SEQ ID NO: 4875 - protein, 30 aa, Artificial Sequence
  Description of Artificial Sequence: Synthetic polypeptide
DEEEIRTTNPVATEQYGSVSSTPNLQRGNR

SEQ ID NO: 4876 - protein, 28 aa, Artificial Sequence
  Description of Artificial Sequence: Synthetic peptide
DEEEIWTTNPVATEQYGSVSENLQRGNR

SEQ ID NO: 4877 - protein, 29 aa, Artificial Sequence
  Description of Artificial Sequence: Synthetic peptide
DEEEIRTTNPVATEQYGSVSTNLQRGFER

SEQ ID NO: 4878 - protein, 28 aa, Artificial Sequence
  Description of Artificial Sequence: Synthetic peptide
DEEEISTTNPVATEQYGSVSENLQRGNR

SEQ ID NO: 4879 - protein, 28 aa, Artificial Sequence
  Description of Artificial Sequence: Synthetic peptide
DEEEIRTTNPVATEMYGSASTNLQRGNR

SEQ ID NO: 4880 - protein, 28 aa, Artificial Sequence
  Description of Artificial Sequence: Synthetic peptide
DEEEIRTTNPVATEQYGSVSTNLLIGNR

SEQ ID NO: 4881 - protein, 28 aa, Artificial Sequence
  Description of Artificial Sequence: Synthetic peptide
DEQEIRTTNPVATEQYGSVSTNLQYGNR

SEQ ID NO: 4882 - protein, 28 aa, Artificial Sequence
  Description of Artificial Sequence: Synthetic peptide
DEQEIRQTNPVATEQYGSVSTNLQRGNR

SEQ ID NO: 4883 - protein, 28 aa, Artificial Sequence
  Description of Artificial Sequence: Synthetic peptide
DEEEIRTTNPVATEQYGSVSTNLQAGNN

SEQ ID NO: 4884 - protein, 28 aa, Artificial Sequence
  Description of Artificial Sequence: Synthetic peptide
DEEEIRTTNPCATEQYGSVSTNLQRGNH

SEQ ID NO: 4885 - protein, 28 aa, Artificial Sequence
  Description of Artificial Sequence: Synthetic peptide
DEEEIRTTNPVATEQYGSVSTNEQRGNW

SEQ ID NO: 4886 - protein, 28 aa, Artificial Sequence
  Description of Artificial Sequence: Synthetic peptide
DEEEIRTTNPVATEQYGSVSTNLQNGNS

SEQ ID NO: 4887 - protein, 28 aa, Artificial Sequence
  Description of Artificial Sequence: Synthetic peptide
DEEEIRTTNPVATEQYGSVSMCLQRGNR

SEQ ID NO: 4888 - protein, 28 aa, Artificial Sequence
  Description of Artificial Sequence: Synthetic peptide
DEEEIRTTNPVATEQYGSASTNLMRGNR

SEQ ID NO: 4889 - protein, 29 aa, Artificial Sequence
  Description of Artificial Sequence: Synthetic peptide
DEEEIRTTNPVATEQYGSVSTNLQYRGNA

SEQ ID NO: 4890 - protein, 29 aa, Artificial Sequence
  Description of Artificial Sequence: Synthetic peptide
DEEEIRTTNPVATEQYGSVSTNLQREGND

SEQ ID NO: 4891 - protein, 28 aa, Artificial Sequence
  Description of Artificial Sequence: Synthetic peptide
DEEEIRTTNPVATEQYGTVSTNLQHGNR

SEQ ID NO: 4892 - protein, 28 aa, Artificial Sequence
  Description of Artificial Sequence: Synthetic peptide
DEEEIRTTNPVATEQYGSVSTELQRGND

SEQ ID NO: 4893 - protein, 28 aa, Artificial Sequence
  Description of Artificial Sequence: Synthetic peptide
DEEEIRTTNPVATEQYGSVSTDLQRGNH

SEQ ID NO: 4894 - protein, 28 aa, Artificial Sequence
  Description of Artificial Sequence: Synthetic peptide
DEEEIRTTNPTATEQYGSVSTNLQPGNR

SEQ ID NO: 4895 - protein, 28 aa, Artificial Sequence
  Description of Artificial Sequence: Synthetic peptide
DEEEIRTTNPVATEQYGSVITNLFRGNR

SEQ ID NO: 4896 - protein, 28 aa, Artificial Sequence
  Description of Artificial Sequence: Synthetic peptide
DEEEIRATNPVATEQYGWVSTNLQRGNR

SEQ ID NO: 4897 - protein, 30 aa, Artificial Sequence
  Description of Artificial Sequence: Synthetic polypeptide
DEEEIRTTNPVATEQYGSVSTNLQQRGNDR

SEQ ID NO: 4898 - protein, 29 aa, Artificial Sequence
  Description of Artificial Sequence: Synthetic peptide
DEEEIRTTNPVATEQYGSVSTNLQQRGNE

SEQ ID NO: 4899 - protein, 28 aa, Artificial Sequence
  Description of Artificial Sequence: Synthetic peptide
DEEEIRTTNPVATEQYGSVSTNLQSGNF

SEQ ID NO: 4900 - protein, 28 aa, Artificial Sequence
  Description of Artificial Sequence: Synthetic peptide
DEEEIRTTNPVATEQFGSVSTNLQRGNQ

SEQ ID NO: 4901 - protein, 28 aa, Artificial Sequence
  Description of Artificial Sequence: Synthetic peptide
DEEEIRTTNPIATEQYGSVSTNLQRGNF

SEQ ID NO: 4902 - protein, 29 aa, Artificial Sequence
  Description of Artificial Sequence: Synthetic peptide
DEEEIRTTNPVATEQYGSVSTNAQIRGNR

SEQ ID NO: 4903 - protein, 29 aa, Artificial Sequence
  Description of Artificial Sequence: Synthetic peptide
DEEEIRTTNPVATEQYGSVDSTNEQRGNR

SEQ ID NO: 4904 - protein, 29 aa, Artificial Sequence
  Description of Artificial Sequence: Synthetic peptide
DEEEIRTTNPVATEQYGSVSTNLDRKGNR

SEQ ID NO: 4905 - protein, 28 aa, Artificial Sequence
  Description of Artificial Sequence: Synthetic peptide
DEEEIRTTNPVAYEQYGSVDTNLQRGNR

SEQ ID NO: 4906 - protein, 28 aa, Artificial Sequence
  Description of Artificial Sequence: Synthetic peptide
DEVEIRTTNPVATEQYGSVSENLQRGNR

SEQ ID NO: 4907 - protein, 28 aa, Artificial Sequence
  Description of Artificial Sequence: Synthetic peptide
DEEEIRTTNPAATEMYGSVSTNLQRGNR

SEQ ID NO: 4908 - protein, 29 aa, Artificial Sequence
  Description of Artificial Sequence: Synthetic peptide
DEEEIRTTNPVATEQYGSVSTVLQNRGNR

SEQ ID NO: 4909 - protein, 28 aa, Artificial Sequence
  Description of Artificial Sequence: Synthetic peptide
DEQEIRTTNPVATEQYGSVMTNLQRGNR

SEQ ID NO: 4910 - protein, 28 aa, Artificial Sequence
  Description of Artificial Sequence: Synthetic peptide
DEEEIRTTNPVATEQYGSVSTNEQRGNI

SEQ ID NO: 4911 - protein, 28 aa, Artificial Sequence
  Description of Artificial Sequence: Synthetic peptide
DEEEIRTTNPVATEQYGSVHENLQRGNR

SEQ ID NO: 4912 - protein, 28 aa, Artificial Sequence
  Description of Artificial Sequence: Synthetic peptide
DEEEIRTTNPVATESYGSVSTDLQRGNR

SEQ ID NO: 4913 - protein, 28 aa, Artificial Sequence
  Description of Artificial Sequence: Synthetic peptide
DEEEIRTTNPVATEQYGSVSTNLQQGNY

SEQ ID NO: 4914 - protein, 29 aa, Artificial Sequence
  Description of Artificial Sequence: Synthetic peptide
DEEEIRTTNPVATEQYGSVTSTNEQRGNR

SEQ ID NO: 4915 - protein, 28 aa, Artificial Sequence
  Description of Artificial Sequence: Synthetic peptide
DEEELRTTNPVATENYGSVSTNLQRGNR

SEQ ID NO: 4916 - protein, 29 aa, Artificial Sequence
  Description of Artificial Sequence: Synthetic peptide
DEEEIRTTNPVATEQYGSVSTNWVQRGNR

SEQ ID NO: 4917 - protein, 28 aa, Artificial Sequence
  Description of Artificial Sequence: Synthetic peptide
DTEEIRTTNPVATEQYGSVSTNLQRGDR

SEQ ID NO: 4918 - protein, 28 aa, Artificial Sequence
  Description of Artificial Sequence: Synthetic peptide
DEEEIRTTNPDATEQYGSVSTNLQRGNP

SEQ ID NO: 4919 - protein, 29 aa, Artificial Sequence
  Description of Artificial Sequence: Synthetic peptide
DEEEIRTTNPVATEQYGSVSTNLQRKGER

SEQ ID NO: 4920 - protein, 28 aa, Artificial Sequence
  Description of Artificial Sequence: Synthetic peptide
DEQEIRTTNPVATEQYGSVSTNLQRGDR

SEQ ID NO: 4921 - protein, 28 aa, Artificial Sequence
  Description of Artificial Sequence: Synthetic peptide
DEEEIRTTNPVATECYGSVSTNLERGNR

SEQ ID NO: 4922 - protein, 28 aa, Artificial Sequence
  Description of Artificial Sequence: Synthetic peptide
DEEEIRTTNPVATEQYGSVSTNLQHGNH

SEQ ID NO: 4923 - protein, 28 aa, Artificial Sequence
  Description of Artificial Sequence: Synthetic peptide
DEEEIRTTNPVATEQYGSVDTNLQRGNA

SEQ ID NO: 4924 - protein, 28 aa, Artificial Sequence
  Description of Artificial Sequence: Synthetic peptide
DEEEIRTTNPVATEQYGSVETNLNRGNR

SEQ ID NO: 4925 - protein, 28 aa, Artificial Sequence
  Description of Artificial Sequence: Synthetic peptide
GEEEIRTTNPVATEQYGSVSMNLQRGNR

SEQ ID NO: 4926 - protein, 28 aa, Artificial Sequence
  Description of Artificial Sequence: Synthetic peptide
DEEEIRTTNPVAYEQYGSVSTPLQRGNR

SEQ ID NO: 4927 - protein, 29 aa, Artificial Sequence
  Description of Artificial Sequence: Synthetic peptide
DEEELRTTNPVATEQYGSVGSTNLQRGNR

SEQ ID NO: 4928 - protein, 28 aa, Artificial Sequence
  Description of Artificial Sequence: Synthetic peptide
DEEEIRTTNPVATEQYGSVSTNLQRPPR

SEQ ID NO: 4929 - protein, 28 aa, Artificial Sequence
  Description of Artificial Sequence: Synthetic peptide
DEEEIRTTNPVATEQYGSVSTNLNNGNR

SEQ ID NO: 4930 - protein, 28 aa, Artificial Sequence
  Description of Artificial Sequence: Synthetic peptide
DEEEIRTTNPVATEQYGSVSTDLQRGNA

SEQ ID NO: 4931 - protein, 28 aa, Artificial Sequence
  Description of Artificial Sequence: Synthetic peptide
DEEEIRTTNPVATEQYGSVSTVLQRGER

SEQ ID NO: 4932 - protein, 28 aa, Artificial Sequence
  Description of Artificial Sequence: Synthetic peptide
DEEEIRTTNPVATEQYGSVSTELQRGNP

SEQ ID NO: 4933 - protein, 29 aa, Artificial Sequence
  Description of Artificial Sequence: Synthetic peptide
DEEEIRTTNPVATEQYGSMVSTNDQRGNR

SEQ ID NO: 4934 - protein, 28 aa, Artificial Sequence
  Description of Artificial Sequence: Synthetic peptide
DEEEVRTTNPVATECYGSVSTNLQRGNR

SEQ ID NO: 4935 - protein, 28 aa, Artificial Sequence
  Description of Artificial Sequence: Synthetic peptide
DEEEIRTTNPVATEQYGSVSDNLQRGER

SEQ ID NO: 4936 - protein, 28 aa, Artificial Sequence
  Description of Artificial Sequence: Synthetic peptide
DEEEIRTTNPVATEQWGSVSTNLQRGNP

SEQ ID NO: 4937 - protein, 28 aa, Artificial Sequence
  Description of Artificial Sequence: Synthetic peptide
QEEEIRTTNPVATEQYGSVSTNLQRGNM

SEQ ID NO: 4938 - protein, 29 aa, Artificial Sequence
  Description of Artificial Sequence: Synthetic peptide
DEEEIRTTNPVATEQYGSCVSTNLQGGNR

SEQ ID NO: 4939 - protein, 28 aa, Artificial Sequence
  Description of Artificial Sequence: Synthetic peptide
DEEEIRTTNPVATECWGSVSTNLQRGNR

SEQ ID NO: 4940 - protein, 28 aa, Artificial Sequence
  Description of Artificial Sequence: Synthetic peptide
DEEEIRTTNPVATEQYGSVSTYLQRGHR

SEQ ID NO: 4941 - protein, 28 aa, Artificial Sequence
  Description of Artificial Sequence: Synthetic peptide
GEEEIRTTNPVATEQYGTVSTNLQRGNR

SEQ ID NO: 4942 - protein, 29 aa, Artificial Sequence
  Description of Artificial Sequence: Synthetic peptide
DEEEIRTTNPVATEQYGSVSTNLQTRGNI

SEQ ID NO: 4943 - protein, 29 aa, Artificial Sequence
  Description of Artificial Sequence: Synthetic peptide
DEEEIRTTNPVATEQWGSVSQTNLQRGNR

SEQ ID NO: 4944 - protein, 28 aa, Artificial Sequence
  Description of Artificial Sequence: Synthetic peptide
DEEEIRQTNPVATEQYGSASTNLQRGNR

SEQ ID NO: 4945 - protein, 28 aa, Artificial Sequence
  Description of Artificial Sequence: Synthetic peptide
DENEIRTTNPVATEQYGSVSTNLQRGTR

SEQ ID NO: 4946 - protein, 28 aa, Artificial Sequence
  Description of Artificial Sequence: Synthetic peptide
DEEEIRTTNPVATEQYGTVSDNLQRGNR

SEQ ID NO: 4947 - protein, 28 aa, Artificial Sequence
  Description of Artificial Sequence: Synthetic peptide
DEEEIRTTNPVATEQYGSVSTILQRGQR

SEQ ID NO: 4948 - protein, 29 aa, Artificial Sequence
  Description of Artificial Sequence: Synthetic peptide
DEEEIRTTNPVATEQYGSVSTNLQDRGNF

SEQ ID NO: 4949 - protein, 28 aa, Artificial Sequence
  Description of Artificial Sequence: Synthetic peptide
DEEEIRTTNPDATEQYGSVSHNLQRGNR

SEQ ID NO: 4950 - protein, 28 aa, Artificial Sequence
  Description of Artificial Sequence: Synthetic peptide
DEEEIATTNPVATEQYGTVSTNLQRGNR

SEQ ID NO: 4951 - protein, 28 aa, Artificial Sequence
  Description of Artificial Sequence: Synthetic peptide
SEEEIRTTNPVCTEQYGSVSTNLQRGNR

SEQ ID NO: 4952 - protein, 29 aa, Artificial Sequence
  Description of Artificial Sequence: Synthetic peptide
DEEEIRTTNPVATEQYGSVSTNLQRGEER

SEQ ID NO: 4953 - protein, 28 aa, Artificial Sequence
  Description of Artificial Sequence: Synthetic peptide
DEVEICTTNPVATEQYGSVSTNLQRGNR

SEQ ID NO: 4954 - protein, 29 aa, Artificial Sequence
  Description of Artificial Sequence: Synthetic peptide
DEEEIRTTNPVATEQYGSVSMNLQRNGNR

SEQ ID NO: 4955 - protein, 30 aa, Artificial Sequence
  Description of Artificial Sequence: Synthetic polypeptide
DEEEIRTTNPVATEQYGSVSTANLQERGNR

SEQ ID NO: 4956 - protein, 28 aa, Artificial Sequence
  Description of Artificial Sequence: Synthetic peptide
DEEEIRTTNPVCTEQYGSVSTNLQQGNR

SEQ ID NO: 4957 - protein, 29 aa, Artificial Sequence
  Description of Artificial Sequence: Synthetic peptide
DEEEIRTTNPVATEQYGSVSTPNLQGGNR

SEQ ID NO: 4958 - protein, 29 aa, Artificial Sequence
  Description of Artificial Sequence: Synthetic peptide
DEEEIRATNPVATEQYGSVSTNLQRGNDR

SEQ ID NO: 4959 - protein, 29 aa, Artificial Sequence
  Description of Artificial Sequence: Synthetic peptide
DEEEIRTTNPVATEQYGSVSTNLQLQGNR

SEQ ID NO: 4960 - protein, 29 aa, Artificial Sequence
  Description of Artificial Sequence: Synthetic peptide
DEEEIRTCNPVATEQYGSVSTNLQRGGNR

SEQ ID NO: 4961 - protein, 29 aa, Artificial Sequence
  Description of Artificial Sequence: Synthetic peptide
DEEEIRTTNPVATEQYGSVSETNLQQGNR

SEQ ID NO: 4962 - protein, 28 aa, Artificial Sequence
  Description of Artificial Sequence: Synthetic peptide
DEEEIRCTNPVATEIYGSVSTNLQRGNR

SEQ ID NO: 4963 - protein, 28 aa, Artificial Sequence
  Description of Artificial Sequence: Synthetic peptide
DEEEIRTTNPVATEGYGDVSTNLQRGNR

SEQ ID NO: 4964 - protein, 29 aa, Artificial Sequence
  Description of Artificial Sequence: Synthetic peptide
DEEEIRQTNPVATEQYGSVSTNLQRDGNR

SEQ ID NO: 4965 - protein, 28 aa, Artificial Sequence
  Description of Artificial Sequence: Synthetic peptide
DEEEIRTTNPVATEQYGDVSTNLQRENR

SEQ ID NO: 4966 - protein, 30 aa, Artificial Sequence
  Description of Artificial Sequence: Synthetic polypeptide
DEEEIRTTNPVATEQYGSYVTSTNLQRGNR

SEQ ID NO: 4967 - protein, 28 aa, Artificial Sequence
  Description of Artificial Sequence: Synthetic peptide
DEEELRTTNPVATEQYGSVSTNLQRGSR

SEQ ID NO: 4968 - protein, 29 aa, Artificial Sequence
  Description of Artificial Sequence: Synthetic peptide
DEEEIRTTNPDATEQYGSVSCTNLQRGNR

SEQ ID NO: 4969 - protein, 28 aa, Artificial Sequence
  Description of Artificial Sequence: Synthetic peptide
DEEEIRTTNPVAVEQYGSVSENLQRGNR

SEQ ID NO: 4970 - protein, 28 aa, Artificial Sequence
  Description of Artificial Sequence: Synthetic peptide
DEEEIRTTNPEATEQYGSVSTNLQRGND

SEQ ID NO: 4971 - protein, 28 aa, Artificial Sequence
  Description of Artificial Sequence: Synthetic peptide
DEEEIRQTNPVATEQYGSVSTNLQHGNR

SEQ ID NO: 4972 - protein, 28 aa, Artificial Sequence
  Description of Artificial Sequence: Synthetic peptide
DEEEIRTTNPVATEQYGTVSTNLQRGMR

SEQ ID NO: 4973 - protein, 29 aa, Artificial Sequence
  Description of Artificial Sequence: Synthetic peptide
DEEEIRTTNPVATEQYGSVSTELQRGNDR

SEQ ID NO: 4974 - protein, 28 aa, Artificial Sequence
  Description of Artificial Sequence: Synthetic peptide
DEEEITTTNPAATEQYGSVSTNLQRGNR

SEQ ID NO: 4975 - protein, 30 aa, Artificial Sequence
  Description of Artificial Sequence: Synthetic polypeptide
DEEEIRTTNPVATEQYGSVSTNPLQRGDNR

SEQ ID NO: 4976 - protein, 28 aa, Artificial Sequence
  Description of Artificial Sequence: Synthetic peptide
DEEEIRTTNPVATEQYGSVSTNLQHGNM

SEQ ID NO: 4977 - protein, 28 aa, Artificial Sequence
  Description of Artificial Sequence: Synthetic peptide
DEQEIRTTNPVATEQYGSVSTNLQRGND

SEQ ID NO: 4978 - protein, 28 aa, Artificial Sequence
  Description of Artificial Sequence: Synthetic peptide
VEEEIRTTNPVAFEQYGSVSTNLQRGNR

SEQ ID NO: 4979 - protein, 29 aa, Artificial Sequence
  Description of Artificial Sequence: Synthetic peptide
DPEEIRTTNPVATEQYGSVSTNLQRGENR

SEQ ID NO: 4980 - protein, 28 aa, Artificial Sequence
  Description of Artificial Sequence: Synthetic peptide
HEEEIRTTNPVATEQYGSVSTNLQRGNN

SEQ ID NO: 4981 - protein, 28 aa, Artificial Sequence
  Description of Artificial Sequence: Synthetic peptide
DEEEIRTTNPVATEMYGSVSTNLQRGNM

SEQ ID NO: 4982 - protein, 29 aa, Artificial Sequence
  Description of Artificial Sequence: Synthetic peptide
DEEEIRTTNPVATEQYGSVSTNLQQSGNR

SEQ ID NO: 4983 - protein, 28 aa, Artificial Sequence
  Description of Artificial Sequence: Synthetic peptide
AEEEIATTNPVATEQYGSVSTNLQRGNR

SEQ ID NO: 4984 - protein, 29 aa, Artificial Sequence
  Description of Artificial Sequence: Synthetic peptide
DEEEIRTTNPVATEQYGSVLSTNLQEGNR

SEQ ID NO: 4985 - protein, 29 aa, Artificial Sequence
  Description of Artificial Sequence: Synthetic peptide
DEEEIRTTNPVATEQYGTVSTMNLQRGNR

SEQ ID NO: 4986 - protein, 29 aa, Artificial Sequence
  Description of Artificial Sequence: Synthetic peptide
DEEEIRTTNPVATEQYGSVSVNLQRGDNR

SEQ ID NO: 4987 - protein, 28 aa, Artificial Sequence
  Description of Artificial Sequence: Synthetic peptide
DEEEIKTTNPVATEQYGSVSTNLQRGNF

SEQ ID NO: 4988 - protein, 28 aa, Artificial Sequence
  Description of Artificial Sequence: Synthetic peptide
DEEEIRTTNPVATEQYGSVSDNLQRGNA

SEQ ID NO: 4989 - protein, 29 aa, Artificial Sequence
  Description of Artificial Sequence: Synthetic peptide
DEEEIRTTNPFATEQYGSVSTNLVQRGNR

SEQ ID NO: 4990 - protein, 28 aa, Artificial Sequence
  Description of Artificial Sequence: Synthetic peptide
DEEEIRTTNPVATEQYGSVSSNLQFGNR

SEQ ID NO: 4991 - protein, 28 aa, Artificial Sequence
  Description of Artificial Sequence: Synthetic peptide
YEEEIRTTNPVATEQYGDVSTNLQRGNR

SEQ ID NO: 4992 - protein, 29 aa, Artificial Sequence
  Description of Artificial Sequence: Synthetic peptide
DEEEIRTTNPVATEQYWSVSTNLQRDGNR

SEQ ID NO: 4993 - protein, 28 aa, Artificial Sequence
  Description of Artificial Sequence: Synthetic peptide
DEEEIRTTNPVATEQYGSVDTNEQRGNR

SEQ ID NO: 4994 - protein, 28 aa, Artificial Sequence
  Description of Artificial Sequence: Synthetic peptide
DEEEIRTTNPVATEQYGWVSTNLQRLNR

SEQ ID NO: 4995 - protein, 28 aa, Artificial Sequence
  Description of Artificial Sequence: Synthetic peptide
DEEEIRTTNPIATECYGSVSTNLQRGNR

SEQ ID NO: 4996 - protein, 28 aa, Artificial Sequence
  Description of Artificial Sequence: Synthetic peptide
DEEEIRATNPVATEQYGSVSDNLQRGNR

SEQ ID NO: 4997 - protein, 29 aa, Artificial Sequence
  Description of Artificial Sequence: Synthetic peptide
DEEEIRTTNPVATEQYGSVSTNLQDGENR

SEQ ID NO: 4998 - protein, 28 aa, Artificial Sequence
  Description of Artificial Sequence: Synthetic peptide
DEVEIRATNPVATEQYGSVSTNLQRGNR

SEQ ID NO: 4999 - protein, 28 aa, Artificial Sequence
  Description of Artificial Sequence: Synthetic peptide
DEEEIRTTNPVATEQYGSWSTNLNRGNR

SEQ ID NO: 5000 - protein, 28 aa, Artificial Sequence
  Description of Artificial Sequence: Synthetic peptide
QEEEIRTTNPVATEQYGVVSTNLQRGNR

SEQ ID NO: 5001 - protein, 28 aa, Artificial Sequence
  Description of Artificial Sequence: Synthetic peptide
DEEEIRQTNPVATEQYGSVSTNLQRGNQ

SEQ ID NO: 5002 - protein, 28 aa, Artificial Sequence
  Description of Artificial Sequence: Synthetic peptide
DEEEIRCTNPVATEQYGSVSTNLQCGNR

SEQ ID NO: 5003 - protein, 29 aa, Artificial Sequence
  Description of Artificial Sequence: Synthetic peptide
DEEEIRTTNPVATEQYGSHVSTNEQRGNR

SEQ ID NO: 5004 - protein, 28 aa, Artificial Sequence
  Description of Artificial Sequence: Synthetic peptide
DEEEIRTTNPVATEQYGSVSTNLQLGNY

SEQ ID NO: 5005 - protein, 29 aa, Artificial Sequence
  Description of Artificial Sequence: Synthetic peptide
DEEEIRPTNPVATEQYGSYVSTNLQRGNR

SEQ ID NO: 5006 - protein, 28 aa, Artificial Sequence
  Description of Artificial Sequence: Synthetic peptide
DEEEICTTNPVATEQYGSVSTNLQGGNR

SEQ ID NO: 5007 - protein, 29 aa, Artificial Sequence
  Description of Artificial Sequence: Synthetic peptide
SEEEIRTTNPVATEQYGSVSTNLQRSGNR

SEQ ID NO: 5008 - protein, 28 aa, Artificial Sequence
  Description of Artificial Sequence: Synthetic peptide
DEEEIRGTNPVATEQYGDVSTNLQRGNR

SEQ ID NO: 5009 - protein, 28 aa, Artificial Sequence
  Description of Artificial Sequence: Synthetic peptide
DEEEIVTTNPVATEQYGSVSTNLQDGNR

SEQ ID NO: 5010 - protein, 28 aa, Artificial Sequence
  Description of Artificial Sequence: Synthetic peptide
DEEEIRTTNPVATEQYGSVSDNLQRGNI

SEQ ID NO: 5011 - protein, 28 aa, Artificial Sequence
  Description of Artificial Sequence: Synthetic peptide
DEQEIRTTNPVATEQYGSVSTNLQHGNR

SEQ ID NO: 5012 - protein, 28 aa, Artificial Sequence
  Description of Artificial Sequence: Synthetic peptide
DDEEIRTTNPVATEQYGSVSTNLQHGNR

SEQ ID NO: 5013 - protein, 28 aa, Artificial Sequence
  Description of Artificial Sequence: Synthetic peptide
DEEEIRTTNPVATEQYGSASTILQRGNR

SEQ ID NO: 5014 - protein, 28 aa, Artificial Sequence
  Description of Artificial Sequence: Synthetic peptide
DEEEIRGTNPVATEQYGSVGTNLQRGNR

SEQ ID NO: 5015 - protein, 30 aa, Artificial Sequence
  Description of Artificial Sequence: Synthetic polypeptide
DEEEIRTTNPVATEQYGSVSDTINLQRGNR

SEQ ID NO: 5016 - protein, 28 aa, Artificial Sequence
  Description of Artificial Sequence: Synthetic peptide
DEEEIATTNPVATEQYGSTSTNLQRGNR

SEQ ID NO: 5017 - protein, 29 aa, Artificial Sequence
  Description of Artificial Sequence: Synthetic peptide
DEEEIRSTNPVATEQYGSVSTNLQRGINR

SEQ ID NO: 5018 - protein, 30 aa, Artificial Sequence
  Description of Artificial Sequence: Synthetic polypeptide
DEEEIRTTNPVATEQYGSVSTQNLQIRGNR

SEQ ID NO: 5019 - protein, 28 aa, Artificial Sequence
  Description of Artificial Sequence: Synthetic peptide
DEEEIRTTNPVATEQYGSVSTNLQNGNQ

SEQ ID NO: 5020 - protein, 28 aa, Artificial Sequence
  Description of Artificial Sequence: Synthetic peptide
VEEEIRTTNPVATEQYGSVSTNLQRGPR

SEQ ID NO: 5021 - protein, 28 aa, Artificial Sequence
  Description of Artificial Sequence: Synthetic peptide
DEEEIRTTNPTASEQYGSVSTNLQRGNR

SEQ ID NO: 5022 - protein, 28 aa, Artificial Sequence
  Description of Artificial Sequence: Synthetic peptide
DEEEIRTTNPVATEQYGSVSTALQRGNM

SEQ ID NO: 5023 - protein, 28 aa, Artificial Sequence
  Description of Artificial Sequence: Synthetic peptide
DEEEIRTTNPVATEQYGSVSTGLQDGNR

SEQ ID NO: 5024 - protein, 29 aa, Artificial Sequence
  Description of Artificial Sequence: Synthetic peptide
DEEEIRTTNPVATEQYGSSVSTNLQRGNI

SEQ ID NO: 5025 - protein, 29 aa, Artificial Sequence
  Description of Artificial Sequence: Synthetic peptide
DEEEIRTTNPVATEAYGSVDSTNLQRGNR

SEQ ID NO: 5026 - protein, 29 aa, Artificial Sequence
  Description of Artificial Sequence: Synthetic peptide
DEEELRTTNPVATEQYGSVSTNLQNRGNR

SEQ ID NO: 5027 - protein, 28 aa, Artificial Sequence
  Description of Artificial Sequence: Synthetic peptide
DEEEIRTTNPFATEQYGSVSTNLQRGND

SEQ ID NO: 5028 - protein, 29 aa, Artificial Sequence
  Description of Artificial Sequence: Synthetic peptide
DEEEIRTTNPVSTEQYGSVSTNLQNRGNR

SEQ ID NO: 5029 - protein, 29 aa, Artificial Sequence
  Description of Artificial Sequence: Synthetic peptide
DEEEIRTTNPCATEQYGSVSTNLQQRGNR

SEQ ID NO: 5030 - protein, 28 aa, Artificial Sequence
  Description of Artificial Sequence: Synthetic peptide
DEEEIRTTNPVATEQYGSVSTNPQRGNS

SEQ ID NO: 5031 - protein, 28 aa, Artificial Sequence
  Description of Artificial Sequence: Synthetic peptide
DEMEIRTTNPVATEQYGEVSTNLQRGNR

SEQ ID NO: 5032 - protein, 30 aa, Artificial Sequence
  Description of Artificial Sequence: Synthetic polypeptide
DEEEIRTTNPVATEQYGSVSTMNLQRGNDR

SEQ ID NO: 5033 - protein, 28 aa, Artificial Sequence
  Description of Artificial Sequence: Synthetic peptide
DEEETRTTNPVATEQYGSVSTDLQRGNR

SEQ ID NO: 5034 - protein, 28 aa, Artificial Sequence
  Description of Artificial Sequence: Synthetic peptide
DEEEIRTTNPVAYEQYGSVSTNLQRGNS

SEQ ID NO: 5035 - protein, 30 aa, Artificial Sequence
  Description of Artificial Sequence: Synthetic polypeptide
DEEEIRTTNPVATEQYGSSVCSTNLQRGNR

SEQ ID NO: 5036 - protein, 28 aa, Artificial Sequence
  Description of Artificial Sequence: Synthetic peptide
KEEEIRTTNPVATEQYGSVSTNLQRGNE

SEQ ID NO: 5037 - protein, 28 aa, Artificial Sequence
  Description of Artificial Sequence: Synthetic peptide
DENEIRSTNPVATEQYGSVSTNLQRGNR

SEQ ID NO: 5038 - protein, 28 aa, Artificial Sequence
  Description of Artificial Sequence: Synthetic peptide
DEEEIRTTNPVATEQYGCVSMNLQRGNR

SEQ ID NO: 5039 - protein, 29 aa, Artificial Sequence
  Description of Artificial Sequence: Synthetic peptide
DEEEIRTTNPTATEQYGSVSTNLQRGNER

SEQ ID NO: 5040 - protein, 28 aa, Artificial Sequence
  Description of Artificial Sequence: Synthetic peptide
DEEEIRTTNPVATEQYGSVSTELQRGNA

SEQ ID NO: 5041 - protein, 28 aa, Artificial Sequence
  Description of Artificial Sequence: Synthetic peptide
DEQEIRTTNPVATEQYGSVDTNLQRGNR

SEQ ID NO: 5042 - protein, 29 aa, Artificial Sequence
  Description of Artificial Sequence: Synthetic peptide
DEEHIRTTNPVATEQYGSVSTNLQLRGNR

SEQ ID NO: 5043 - protein, 28 aa, Artificial Sequence
  Description of Artificial Sequence: Synthetic peptide
DEHEIRTTNPVATEQYGSVSTNLQRGER

SEQ ID NO: 5044 - protein, 28 aa, Artificial Sequence
  Description of Artificial Sequence: Synthetic peptide
DEEEIRTTNPVATEQWGSVSTNLQQGNR

SEQ ID NO: 5045 - protein, 28 aa, Artificial Sequence
  Description of Artificial Sequence: Synthetic peptide
KEEEIRTTNPVATEQYGSVSTNLQTGNR

SEQ ID NO: 5046 - protein, 28 aa, Artificial Sequence
  Description of Artificial Sequence: Synthetic peptide
DEEEIRTTNPVATEQYGSVSTNLYRGNP

SEQ ID NO: 5047 - protein, 29 aa, Artificial Sequence
  Description of Artificial Sequence: Synthetic peptide
DEEEIRTTNPVATEQYGSVSTNLQDRGNQ

SEQ ID NO: 5048 - protein, 29 aa, Artificial Sequence
  Description of Artificial Sequence: Synthetic peptide
DEEEIRTTNPVCTEQYGSVSTMNLQRGNR

SEQ ID NO: 5049 - protein, 28 aa, Artificial Sequence
  Description of Artificial Sequence: Synthetic peptide
DEEEIRTTNPFATEQYGSVSTNLQVGNR

SEQ ID NO: 5050 - protein, 28 aa, Artificial Sequence
  Description of Artificial Sequence: Synthetic peptide
DEEEIRTTNPTATEQYGSVSTNLQRGNN

SEQ ID NO: 5051 - protein, 28 aa, Artificial Sequence
  Description of Artificial Sequence: Synthetic peptide
DEEEIRTTNPVATEQYGSVSTNLYRGNF

SEQ ID NO: 5052 - protein, 28 aa, Artificial Sequence
  Description of Artificial Sequence: Synthetic peptide
DEEEIRTTNPVATEQYGQVSTNLQRGNF

SEQ ID NO: 5053 - protein, 28 aa, Artificial Sequence
  Description of Artificial Sequence: Synthetic peptide
DEEQIRTTNPVATEQYGSVSTNLQRGNG

SEQ ID NO: 5054 - protein, 28 aa, Artificial Sequence
  Description of Artificial Sequence: Synthetic peptide
DEEEIRTTNPVATEQYGTVATNLQRGNR

SEQ ID NO: 5055 - protein, 28 aa, Artificial Sequence
  Description of Artificial Sequence: Synthetic peptide
DEEEIRTTNPVATEQYGWCSTNLQRGNR

SEQ ID NO: 5056 - protein, 29 aa, Artificial Sequence
  Description of Artificial Sequence: Synthetic peptide
DEEEIATTNPVATEQYGSVSTNLQDRGNR

SEQ ID NO: 5057 - protein, 29 aa, Artificial Sequence
  Description of Artificial Sequence: Synthetic peptide
DEEEIRTTNPVATEQYGSVSTNLQSGENR

SEQ ID NO: 5058 - protein, 28 aa, Artificial Sequence
  Description of Artificial Sequence: Synthetic peptide
DEEEIRTTNPVATEQYGSVHTNLQRMNR

SEQ ID NO: 5059 - protein, 28 aa, Artificial Sequence
  Description of Artificial Sequence: Synthetic peptide
DEEEIRTTNPVATEWYGSVSVNLQRGNR

SEQ ID NO: 5060 - protein, 28 aa, Artificial Sequence
  Description of Artificial Sequence: Synthetic peptide
DEEEIRTTNPVATELYGSVSTNLQTGNR

SEQ ID NO: 5061 - protein, 28 aa, Artificial Sequence
  Description of Artificial Sequence: Synthetic peptide
DEEEIRTTNPVATEQYGDYSTNLQRGNR

SEQ ID NO: 5062 - protein, 29 aa, Artificial Sequence
  Description of Artificial Sequence: Synthetic peptide
DEEEIRTTNPVATEQYGSVQSTNIQRGNR

SEQ ID NO: 5063 - protein, 28 aa, Artificial Sequence
  Description of Artificial Sequence: Synthetic peptide
DEEEIRTTNPVATQQYGSVSTNLDRGNR

SEQ ID NO: 5064 - protein, 28 aa, Artificial Sequence
  Description of Artificial Sequence: Synthetic peptide
DEEEIRTTNIVATEQYGSVSTNQQRGNR

SEQ ID NO: 5065 - protein, 29 aa, Artificial Sequence
  Description of Artificial Sequence: Synthetic peptide
DEEEIRTTNPVATEQYGSVSITDLQRGNR

SEQ ID NO: 5066 - protein, 30 aa, Artificial Sequence
  Description of Artificial Sequence: Synthetic polypeptide
DEEEIRTTNPVATEQYGSVSTNLQRNGNMR

SEQ ID NO: 5067 - protein, 29 aa, Artificial Sequence
  Description of Artificial Sequence: Synthetic peptide
DEEEIRTTNPVATEQYGSVSATNMQRGNR

SEQ ID NO: 5068 - protein, 28 aa, Artificial Sequence
  Description of Artificial Sequence: Synthetic peptide
DEEEIRTTNPVATEQYWSVSTNLQAGNR

SEQ ID NO: 5069 - protein, 28 aa, Artificial Sequence
  Description of Artificial Sequence: Synthetic peptide
DEEEIRTTNPVATEQYGSVSTALQRGNT

SEQ ID NO: 5070 - protein, 29 aa, Artificial Sequence
  Description of Artificial Sequence: Synthetic peptide
DEEEIRTTNPVATEQYGNVSTNLQRGENR

SEQ ID NO: 5071 - protein, 29 aa, Artificial Sequence
  Description of Artificial Sequence: Synthetic peptide
DEEEIRTTNPVATEQYGSVSTNLQPGNPR

SEQ ID NO: 5072 - protein, 28 aa, Artificial Sequence
  Description of Artificial Sequence: Synthetic peptide
DEEEIRTTNPVATECYGSVSTNLQLGNR

SEQ ID NO: 5073 - protein, 29 aa, Artificial Sequence
  Description of Artificial Sequence: Synthetic peptide
DEEEIRTTNPVATEQYGSVDDTNLQRGNR

SEQ ID NO: 5074 - protein, 28 aa, Artificial Sequence
  Description of Artificial Sequence: Synthetic peptide
DEQEIRTTNPVATEQYGSVSTNLQRGNM

SEQ ID NO: 5075 - protein, 29 aa, Artificial Sequence
  Description of Artificial Sequence: Synthetic peptide
DEEEIRTTNPVATEQYGSVSTNLQRGAFR

SEQ ID NO: 5076 - protein, 29 aa, Artificial Sequence
  Description of Artificial Sequence: Synthetic peptide
DEEEIRTTNPVATEQYGSVSTNLQNGNTR

SEQ ID NO: 5077 - protein, 28 aa, Artificial Sequence
  Description of Artificial Sequence: Synthetic peptide
DEEEIRTTNPVATEQYGSVSTNLMRGNK

SEQ ID NO: 5078 - protein, 28 aa, Artificial Sequence
  Description of Artificial Sequence: Synthetic peptide
DEEEIRTTNPVATEVYGSVSTNLQNGNR

SEQ ID NO: 5079 - protein, 30 aa, Artificial Sequence
  Description of Artificial Sequence: Synthetic polypeptide
DEEEIRTTNPVATEQYGSVSTNLQLRGLNR

SEQ ID NO: 5080 - protein, 28 aa, Artificial Sequence
  Description of Artificial Sequence: Synthetic peptide
DAEEIRTTNPVATEQYGSVSTNDQRGNR

SEQ ID NO: 5081 - protein, 28 aa, Artificial Sequence
  Description of Artificial Sequence: Synthetic peptide
DEEEIRTTNPVATEQYGSVSTKLQRGNV

SEQ ID NO: 5082 - protein, 28 aa, Artificial Sequence
  Description of Artificial Sequence: Synthetic peptide
DEETIRTTNPVATEQYGSVSYNLQRGNR

SEQ ID NO: 5083 - protein, 28 aa, Artificial Sequence
  Description of Artificial Sequence: Synthetic peptide
DEEEIRTTNPVATEQYGSVSTNLDRGIR

SEQ ID NO: 5084 - protein, 28 aa, Artificial Sequence
  Description of Artificial Sequence: Synthetic peptide
DEGEIRTTNPVATEQYGSVSTNLQRGNF

SEQ ID NO: 5085 - protein, 28 aa, Artificial Sequence
  Description of Artificial Sequence: Synthetic peptide
DEEEIHTTNPVATEQWGSVSTNLQRGNR

SEQ ID NO: 5086 - protein, 28 aa, Artificial Sequence
  Description of Artificial Sequence: Synthetic peptide
DEEEIRTTNPVATEQYGSVSENLQRGNA

SEQ ID NO: 5087 - protein, 28 aa, Artificial Sequence
  Description of Artificial Sequence: Synthetic peptide
DEEEIRTTNPVATEQYGDVSTNDQRGNR

SEQ ID NO: 5088 - protein, 29 aa, Artificial Sequence
  Description of Artificial Sequence: Synthetic peptide
DEEEIRTTNPVATEQYGSVSTPNLIRGNR

SEQ ID NO: 5089 - protein, 29 aa, Artificial Sequence
  Description of Artificial Sequence: Synthetic peptide
DEEEIRTTNPVATEQYGMVSTNLQRGNFR

SEQ ID NO: 5090 - protein, 30 aa, Artificial Sequence
  Description of Artificial Sequence: Synthetic polypeptide
DEEEIRTTNPVATEQYGSVDSTNLQREGNR

SEQ ID NO: 5091 - protein, 28 aa, Artificial Sequence
  Description of Artificial Sequence: Synthetic peptide
DEEEICTTNPVATEQYGSVSTNLQQGNR

SEQ ID NO: 5092 - protein, 29 aa, Artificial Sequence
  Description of Artificial Sequence: Synthetic peptide
DEEEIRTTNPVATEQYGSVSTNLQRGNDA

SEQ ID NO: 5093 - protein, 28 aa, Artificial Sequence
  Description of Artificial Sequence: Synthetic peptide
DEMEVRTTNPVATEQYGSVSTNLQRGNR

SEQ ID NO: 5094 - protein, 28 aa, Artificial Sequence
  Description of Artificial Sequence: Synthetic peptide
DEESIRTTNPVATEQYGSVSTNLYRGNR

SEQ ID NO: 5095 - protein, 28 aa, Artificial Sequence
  Description of Artificial Sequence: Synthetic peptide
DEEEIRTTNPVATEKYGSVSTELQRGNR

SEQ ID NO: 5096 - protein, 28 aa, Artificial Sequence
  Description of Artificial Sequence: Synthetic peptide
DEEMIVTTNPVATEQYGSVSTNLQRGNR

SEQ ID NO: 5097 - protein, 28 aa, Artificial Sequence
  Description of Artificial Sequence: Synthetic peptide
DEEEIRTTNPVATEQYGSVDTNMQRGNR

SEQ ID NO: 5098 - protein, 28 aa, Artificial Sequence
  Description of Artificial Sequence: Synthetic peptide
IEEEIRTTNPVATEQYGSVSTNLQPGNR

SEQ ID NO: 5099 - protein, 28 aa, Artificial Sequence
  Description of Artificial Sequence: Synthetic peptide
DEVEIRTTNPVATEQYGSVSTNLQRGND

SEQ ID NO: 5100 - protein, 29 aa, Artificial Sequence
  Description of Artificial Sequence: Synthetic peptide
DEQEIRTTNPVATEQYGSVSTNLQRGNDR

SEQ ID NO: 5101 - protein, 28 aa, Artificial Sequence
  Description of Artificial Sequence: Synthetic peptide
DEKEIRTTNPVATEQYGSVSTNLERGNR

SEQ ID NO: 5102 - protein, 29 aa, Artificial Sequence
  Description of Artificial Sequence: Synthetic peptide
NEEEIRTTNPVATEQYGSVSTGNLQRGNR

SEQ ID NO: 5103 - protein, 28 aa, Artificial Sequence
  Description of Artificial Sequence: Synthetic peptide
EEEEIRTTNPVATEQYGSVSTNLQRSNR

SEQ ID NO: 5104 - protein, 28 aa, Artificial Sequence
  Description of Artificial Sequence: Synthetic peptide
DEEEIRTTNPVATEQYGSVSTNLQHGNG

SEQ ID NO: 5105 - protein, 28 aa, Artificial Sequence
  Description of Artificial Sequence: Synthetic peptide
DETEIRTTNPVATEQYGSVSDNLQRGNR

SEQ ID NO: 5106 - protein, 28 aa, Artificial Sequence
  Description of Artificial Sequence: Synthetic peptide
DEEEIRTTNPVATEQYGSVSTNLDRGNH

SEQ ID NO: 5107 - protein, 28 aa, Artificial Sequence
  Description of Artificial Sequence: Synthetic peptide
DEEEIRTTNPVATEQYGSVSTNLEMGNR

SEQ ID NO: 5108 - protein, 29 aa, Artificial Sequence
  Description of Artificial Sequence: Synthetic peptide
DEEEIRTTNPVATEQYGSVSTNLQHGNDR

SEQ ID NO: 5109 - protein, 28 aa, Artificial Sequence
  Description of Artificial Sequence: Synthetic peptide
DEEEIVTTNPVATEQYGTVSTNLQRGNR

SEQ ID NO: 5110 - protein, 30 aa, Artificial Sequence
  Description of Artificial Sequence: Synthetic polypeptide
DEEEIRTTNPVATEQYGSVSITNGLQRGNR

SEQ ID NO: 5111 - protein, 28 aa, Artificial Sequence
  Description of Artificial Sequence: Synthetic peptide
DEEEIRTTNPVATEQYGSVDTNLQDGNR

SEQ ID NO: 5112 - protein, 29 aa, Artificial Sequence
  Description of Artificial Sequence: Synthetic peptide
DEEEIRTTNPVATEQYGSVSTANLQRGNV

SEQ ID NO: 5113 - protein, 28 aa, Artificial Sequence
  Description of Artificial Sequence: Synthetic peptide
DEIEIRTTNPVATEQFGSVSTNLQRGNR

SEQ ID NO: 5114 - protein, 28 aa, Artificial Sequence
  Description of Artificial Sequence: Synthetic peptide
DEEEIRTTNPVATEQYGSVSTNLQLGNA

SEQ ID NO: 5115 - protein, 28 aa, Artificial Sequence
  Description of Artificial Sequence: Synthetic peptide
DEEEIRTVNPVATEQYGSVSTNLDRGNR

SEQ ID NO: 5116 - protein, 29 aa, Artificial Sequence
  Description of Artificial Sequence: Synthetic peptide
DEEEIRTTNPVATEQYGSVSTNDQRGNDR

SEQ ID NO: 5117 - protein, 28 aa, Artificial Sequence
  Description of Artificial Sequence: Synthetic peptide
DEEEIRTTNPVATEVYGSVSTNLQRGNL

SEQ ID NO: 5118 - protein, 28 aa, Artificial Sequence
  Description of Artificial Sequence: Synthetic peptide
MEEEIRTTNPVATEQYGSVSTNLQRENR

SEQ ID NO: 5119 - protein, 28 aa, Artificial Sequence
  Description of Artificial Sequence: Synthetic peptide
DEEEIRTTNPVATEQYGSVYTNLQRGVR

SEQ ID NO: 5120 - protein, 28 aa, Artificial Sequence
  Description of Artificial Sequence: Synthetic peptide
DEEEIRTTNPVATEQYGSVSTNLMRGNS

SEQ ID NO: 5121 - protein, 28 aa, Artificial Sequence
  Description of Artificial Sequence: Synthetic peptide
DEEEIRTTNPVATELYGVVSTNLQRGNR

SEQ ID NO: 5122 - protein, 28 aa, Artificial Sequence
  Description of Artificial Sequence: Synthetic peptide
DEEEIRTTNPVATEWYGSVSTILQRGNR

SEQ ID NO: 5123 - protein, 28 aa, Artificial Sequence
  Description of Artificial Sequence: Synthetic peptide
DEEEIRTTNPVATAQYGSVSTNLQRGLR

SEQ ID NO: 5124 - protein, 28 aa, Artificial Sequence
  Description of Artificial Sequence: Synthetic peptide
DEFEIRTTNPVATEQYGDVSTNLQRGNR

SEQ ID NO: 5125 - protein, 29 aa, Artificial Sequence
  Description of Artificial Sequence: Synthetic peptide
DEEEIRTTNPVATEQYGSVSTNVQREGNR

SEQ ID NO: 5126 - protein, 29 aa, Artificial Sequence
  Description of Artificial Sequence: Synthetic peptide
DEEEIRTTNPVATEQYGSVSTNLQCRGNA

SEQ ID NO: 5127 - protein, 28 aa, Artificial Sequence
  Description of Artificial Sequence: Synthetic peptide
DEEEIRTTNPVATEQYGSVSTNLQMGNC

SEQ ID NO: 5128 - protein, 29 aa, Artificial Sequence
  Description of Artificial Sequence: Synthetic peptide
DEEEIRTTNPVATEQYGSVSTNLQNRGNA

SEQ ID NO: 5129 - protein, 29 aa, Artificial Sequence
  Description of Artificial Sequence: Synthetic peptide
DEEEIRTTNPVATEQYGSESTNLQRGGNR

SEQ ID NO: 5130 - protein, 29 aa, Artificial Sequence
  Description of Artificial Sequence: Synthetic peptide
DEEEIRTTNPVATECYGSVSCTNLQRGNR

SEQ ID NO: 5131 - protein, 28 aa, Artificial Sequence
  Description of Artificial Sequence: Synthetic peptide
DEEEITTTNPVATEQYGSVSTNLQRGDR

SEQ ID NO: 5132 - protein, 28 aa, Artificial Sequence
  Description of Artificial Sequence: Synthetic peptide
DEEEIRTTNPVATEQYGSASTNLQRGND

SEQ ID NO: 5133 - protein, 28 aa, Artificial Sequence
  Description of Artificial Sequence: Synthetic peptide
DEEEIHTTNPVATEQYGQVSTNLQRGNR

SEQ ID NO: 5134 - protein, 28 aa, Artificial Sequence
  Description of Artificial Sequence: Synthetic peptide
DEEEIATTNPCATEQYGSVSTNLQRGNR

SEQ ID NO: 5135 - protein, 28 aa, Artificial Sequence
  Description of Artificial Sequence: Synthetic peptide
DEEEIRTTNPVATDQYGSVSTNLQRGNN

SEQ ID NO: 5136 - protein, 29 aa, Artificial Sequence
  Description of Artificial Sequence: Synthetic peptide
DEEEIRTTNPVASEQYGSVSTNLQVRGNR

SEQ ID NO: 5137 - protein, 28 aa, Artificial Sequence
  Description of Artificial Sequence: Synthetic peptide
DEEEVRTTNPVATEQYGSVSTNLQRGMR

SEQ ID NO: 5138 - protein, 28 aa, Artificial Sequence
  Description of Artificial Sequence: Synthetic peptide
DEEEIRTTNPEATEQYGSVSTNLQEGNR

SEQ ID NO: 5139 - protein, 28 aa, Artificial Sequence
  Description of Artificial Sequence: Synthetic peptide
DEEEIRTTNPVATEQYGSVSENLQRGNG

SEQ ID NO: 5140 - protein, 28 aa, Artificial Sequence
  Description of Artificial Sequence: Synthetic peptide
NEEEIRTTNPVATEQYGSVSTNLQHGNR

SEQ ID NO: 5141 - protein, 28 aa, Artificial Sequence
  Description of Artificial Sequence: Synthetic peptide
DEEEIRTTNPVATEQYGSVSTNPQRGNL

SEQ ID NO: 5142 - protein, 28 aa, Artificial Sequence
  Description of Artificial Sequence: Synthetic peptide
DESEIRTTNPVATEQYGSVGTNLQRGNR

SEQ ID NO: 5143 - protein, 28 aa, Artificial Sequence
  Description of Artificial Sequence: Synthetic peptide
DEEEIRTTNPVATEQYGSVSTNLQFGNW

SEQ ID NO: 5144 - protein, 28 aa, Artificial Sequence
  Description of Artificial Sequence: Synthetic peptide
DEEEICTTNPVATEQYGSVSANLQRGNR

SEQ ID NO: 5145 - protein, 28 aa, Artificial Sequence
  Description of Artificial Sequence: Synthetic peptide
DDEEIRTTNPVATEQYGSVSTNLERGNR

SEQ ID NO: 5146 - protein, 28 aa, Artificial Sequence
  Description of Artificial Sequence: Synthetic peptide
DEEEIRTTNPVATEQYGSVSTNLQHGNY

SEQ ID NO: 5147 - protein, 28 aa, Artificial Sequence
  Description of Artificial Sequence: Synthetic peptide
DEEEIRTTNPVATEHYGSTSTNLQRGNR

SEQ ID NO: 5148 - protein, 28 aa, Artificial Sequence
  Description of Artificial Sequence: Synthetic peptide
DEEEIRTTNPVATEQYGIVSTNLQRGQR

SEQ ID NO: 5149 - protein, 28 aa, Artificial Sequence
  Description of Artificial Sequence: Synthetic peptide
DEEEIRTTNPVATAQYGSVSENLQRGNR

SEQ ID NO: 5150 - protein, 29 aa, Artificial Sequence
  Description of Artificial Sequence: Synthetic peptide
DEEEIRTTNPVATEQFGSVSTNLQLRGNR

SEQ ID NO: 5151 - protein, 29 aa, Artificial Sequence
  Description of Artificial Sequence: Synthetic peptide
DENEIRTTNPVATEQYGSVSETNLQRGNR

SEQ ID NO: 5152 - protein, 28 aa, Artificial Sequence
  Description of Artificial Sequence: Synthetic peptide
DEEEIRTTNPVATEQYGSVSTNPIRGNR

SEQ ID NO: 5153 - protein, 28 aa, Artificial Sequence
  Description of Artificial Sequence: Synthetic peptide
DEEEIRTTNPVSTEQYGSVSTNLQRGNI

SEQ ID NO: 5154 - protein, 28 aa, Artificial Sequence
  Description of Artificial Sequence: Synthetic peptide
DEEDIRTTNPVATEQYGSVSTNLQVGNR

SEQ ID NO: 5155 - protein, 28 aa, Artificial Sequence
  Description of Artificial Sequence: Synthetic peptide
DEEEIRTTNPVATEQWGSVSTNLIRGNR

SEQ ID NO: 5156 - protein, 30 aa, Artificial Sequence
  Description of Artificial Sequence: Synthetic polypeptide
DEEEIRTTNPVATEQYGSVSTMNLPQRGNR

SEQ ID NO: 5157 - protein, 29 aa, Artificial Sequence
  Description of Artificial Sequence: Synthetic peptide
DEEEIRTTNPVATQQYGSVSTNLQREGNR

SEQ ID NO: 5158 - protein, 28 aa, Artificial Sequence
  Description of Artificial Sequence: Synthetic peptide
DEEEISTTNPVATEQYGSVSTNLQRGNW

SEQ ID NO: 5159 - protein, 28 aa, Artificial Sequence
  Description of Artificial Sequence: Synthetic peptide
DEEEIRTTNPVATEQYGSVSTNLEIGNR

SEQ ID NO: 5160 - protein, 28 aa, Artificial Sequence
  Description of Artificial Sequence: Synthetic peptide
DEEEIRTTNPVATEQYGSVSTNLQPGER

SEQ ID NO: 5161 - protein, 29 aa, Artificial Sequence
  Description of Artificial Sequence: Synthetic peptide
DEEEIRTTNPEATEQYGSVSTNLQRGENR

SEQ ID NO: 5162 - protein, 28 aa, Artificial Sequence
  Description of Artificial Sequence: Synthetic peptide
DEEEIRTTNPVATEQYGIVSTNLQRGND

SEQ ID NO: 5163 - protein, 29 aa, Artificial Sequence
  Description of Artificial Sequence: Synthetic peptide
DEECIRTTNPVATEQYGSVSTNLVQRGNR

SEQ ID NO: 5164 - protein, 28 aa, Artificial Sequence
  Description of Artificial Sequence: Synthetic peptide
DEEEIRTTNPVATEMFGSVSTNLQRGNR

SEQ ID NO: 5165 - protein, 28 aa, Artificial Sequence
  Description of Artificial Sequence: Synthetic peptide
DEEEIRTTNPVATEQYGSVSTNDQVGNR

SEQ ID NO: 5166 - protein, 28 aa, Artificial Sequence
  Description of Artificial Sequence: Synthetic peptide
DEEEIRTTNPVATEQYGSTSTNLQRLNR

SEQ ID NO: 5167 - protein, 29 aa, Artificial Sequence
  Description of Artificial Sequence: Synthetic peptide
DEEEIRTTNPVATEPYGSVSTNLQREGNR

SEQ ID NO: 5168 - protein, 28 aa, Artificial Sequence
  Description of Artificial Sequence: Synthetic peptide
DEEEIRTTNPVATEVYGSVSTNLQRGNN

SEQ ID NO: 5169 - protein, 29 aa, Artificial Sequence
  Description of Artificial Sequence: Synthetic peptide
DEEEIRTTNPVATEQYGESWSTNLQRGNR

SEQ ID NO: 5170 - protein, 28 aa, Artificial Sequence
  Description of Artificial Sequence: Synthetic peptide
DENEIRTTNPVATEQYGSVSTNLQGGNR

SEQ ID NO: 5171 - protein, 28 aa, Artificial Sequence
  Description of Artificial Sequence: Synthetic peptide
DEEEIRTTNPVATEQYGSVSTELQRGNE

SEQ ID NO: 5172 - protein, 28 aa, Artificial Sequence
  Description of Artificial Sequence: Synthetic peptide
DEEEIRTTNPVATEQYGSVSTNLQRENP

SEQ ID NO: 5173 - protein, 28 aa, Artificial Sequence
  Description of Artificial Sequence: Synthetic peptide
DEWEIRTTNPVATEQYGSVSTNLDRGNR

SEQ ID NO: 5174 - protein, 28 aa, Artificial Sequence
  Description of Artificial Sequence: Synthetic peptide
DEEEIRTTNPVATEQYGSVSTNLQRGEH

SEQ ID NO: 5175 - protein, 28 aa, Artificial Sequence
  Description of Artificial Sequence: Synthetic peptide
DEEEIATTNPVATEQYGSVSCNLQRGNR

SEQ ID NO: 5176 - protein, 29 aa, Artificial Sequence
  Description of Artificial Sequence: Synthetic peptide
DEEEIRTTNPVATEQYGSVSTNLQELGNR

SEQ ID NO: 5177 - protein, 30 aa, Artificial Sequence
  Description of Artificial Sequence: Synthetic polypeptide
DEEEIRTTNPVATEQYGSVSTMNLQRGNIR

SEQ ID NO: 5178 - protein, 28 aa, Artificial Sequence
  Description of Artificial Sequence: Synthetic peptide
DEEEIRTTNPVATEQYGWVATNLQRGNR

SEQ ID NO: 5179 - protein, 29 aa, Artificial Sequence
  Description of Artificial Sequence: Synthetic peptide
DEEEIRTTNPVATELYGSVSTGNLQRGNR

SEQ ID NO: 5180 - protein, 29 aa, Artificial Sequence
  Description of Artificial Sequence: Synthetic peptide
DEEEIRTTNPVATEQYGSVSTMNLFRGNR

SEQ ID NO: 5181 - protein, 28 aa, Artificial Sequence
  Description of Artificial Sequence: Synthetic peptide
DEEEIRTTNPVATEQYGDVSTNLQRMNR

SEQ ID NO: 5182 - protein, 28 aa, Artificial Sequence
  Description of Artificial Sequence: Synthetic peptide
DEEEIRTTNPVSTEQYGSVSTNLQQGNR

SEQ ID NO: 5183 - protein, 28 aa, Artificial Sequence
  Description of Artificial Sequence: Synthetic peptide
DEEEIRTTNPVCTEQYGSVSTNLQRGTR

SEQ ID NO: 5184 - protein, 28 aa, Artificial Sequence
  Description of Artificial Sequence: Synthetic peptide
DEEEIRTTNPVATEQYGSVSTNLQNGGR

SEQ ID NO: 5185 - protein, 29 aa, Artificial Sequence
  Description of Artificial Sequence: Synthetic peptide
DEEEIRTTNPVATEQYGSVSTTNLNRGNR

SEQ ID NO: 5186 - protein, 28 aa, Artificial Sequence
  Description of Artificial Sequence: Synthetic peptide
DEEEIRTTNPVATEQYGSVSTNLMRGNW

SEQ ID NO: 5187 - protein, 28 aa, Artificial Sequence
  Description of Artificial Sequence: Synthetic peptide
DEEEIRTTNPVATEQYGSVSTNLQVENR

SEQ ID NO: 5188 - protein, 28 aa, Artificial Sequence
  Description of Artificial Sequence: Synthetic peptide
SEEEIRTTNPVATEQYGSVSTNQQRGNR

SEQ ID NO: 5189 - protein, 28 aa, Artificial Sequence
  Description of Artificial Sequence: Synthetic peptide
DEEEIRTTNPVHTEQYGSVSTNLQTGNR

SEQ ID NO: 5190 - protein, 28 aa, Artificial Sequence
  Description of Artificial Sequence: Synthetic peptide
DEEEIRTVNPVATEQYGSVSTNLLRGNR

SEQ ID NO: 5191 - protein, 30 aa, Artificial Sequence
  Description of Artificial Sequence: Synthetic polypeptide
DEEEIRTTNPVATEQYGSVSTFNLQRGNHR

SEQ ID NO: 5192 - protein, 29 aa, Artificial Sequence
  Description of Artificial Sequence: Synthetic peptide
DENEIRTTNPVATEQYGSVSTNLQERGNR

SEQ ID NO: 5193 - protein, 28 aa, Artificial Sequence
  Description of Artificial Sequence: Synthetic peptide
DEEEIATTNPVATEQYGSVSTELQRGNR

SEQ ID NO: 5194 - protein, 28 aa, Artificial Sequence
  Description of Artificial Sequence: Synthetic peptide
DEEEIRTTNPVATEQYGSVSTNLQEGNW

SEQ ID NO: 5195 - protein, 28 aa, Artificial Sequence
  Description of Artificial Sequence: Synthetic peptide
DEEEIRATNPVATEQYGSVSTDLQRGNR

SEQ ID NO: 5196 - protein, 28 aa, Artificial Sequence
  Description of Artificial Sequence: Synthetic peptide
DEEEIRTTNPVATEQYGSVSTNLQMGNN

SEQ ID NO: 5197 - protein, 28 aa, Artificial Sequence
  Description of Artificial Sequence: Synthetic peptide
DEEEIRTTNPVATEQYGSVSTNLQCGNF

SEQ ID NO: 5198 - protein, 29 aa, Artificial Sequence
  Description of Artificial Sequence: Synthetic peptide
DEEEIRTTNPVATEQYGSVSTILQNRGNR

SEQ ID NO: 5199 - protein, 28 aa, Artificial Sequence
  Description of Artificial Sequence: Synthetic peptide
DEEEIRTTNPVATEQWGSVSTNLQRGNM

SEQ ID NO: 5200 - protein, 28 aa, Artificial Sequence
  Description of Artificial Sequence: Synthetic peptide
DEEEIRTTNIVATEQYGSVSTNLQRGNW

SEQ ID NO: 5201 - protein, 28 aa, Artificial Sequence
  Description of Artificial Sequence: Synthetic peptide
DEEEIRTTNPVATETYGSVSTNLERGNR

SEQ ID NO: 5202 - protein, 30 aa, Artificial Sequence
  Description of Artificial Sequence: Synthetic polypeptide
DEEEIRTTNPVATEQYGSVTSTPNLQRGNR

SEQ ID NO: 5203 - protein, 28 aa, Artificial Sequence
  Description of Artificial Sequence: Synthetic peptide
DEEEIRTTNPVATEQYGSVSTNLQRGDF

SEQ ID NO: 5204 - protein, 29 aa, Artificial Sequence
  Description of Artificial Sequence: Synthetic peptide
DEEEIRTTNPVATEQYGSVSTNLQANGNR

SEQ ID NO: 5205 - protein, 30 aa, Artificial Sequence
  Description of Artificial Sequence: Synthetic polypeptide
DEEEIRTTNPVATEQYGSVSTNSLQRFGNR

SEQ ID NO: 5206 - protein, 28 aa, Artificial Sequence
  Description of Artificial Sequence: Synthetic peptide
DEEEIRTTNPVATEQYGSVSENLQRYNR

SEQ ID NO: 5207 - protein, 29 aa, Artificial Sequence
  Description of Artificial Sequence: Synthetic peptide
DEEEIRTTNPCATEQYGSVSATNLQRGNR

SEQ ID NO: 5208 - protein, 28 aa, Artificial Sequence
  Description of Artificial Sequence: Synthetic peptide
DEEEIRTTNPVATEQYGSVSTNLQAGNF

SEQ ID NO: 5209 - protein, 28 aa, Artificial Sequence
  Description of Artificial Sequence: Synthetic peptide
DEEEIRTTNPVATEQYGSVSTNEQNGNR

SEQ ID NO: 5210 - protein, 28 aa, Artificial Sequence
  Description of Artificial Sequence: Synthetic peptide
DEEEIRTTNPVATEQYGVVSNNLQRGNR

SEQ ID NO: 5211 - protein, 28 aa, Artificial Sequence
  Description of Artificial Sequence: Synthetic peptide
DEEEIRTTNPVATDQYGSVSTNLQRGNV

SEQ ID NO: 5212 - protein, 29 aa, Artificial Sequence
  Description of Artificial Sequence: Synthetic peptide
DEEEIRTTNPVATEQYGSVSMNLQRGNTR

SEQ ID NO: 5213 - protein, 28 aa, Artificial Sequence
  Description of Artificial Sequence: Synthetic peptide
DEEEIRTTNPVATEQYGSVSTNLGPGNR

SEQ ID NO: 5214 - protein, 29 aa, Artificial Sequence
  Description of Artificial Sequence: Synthetic peptide
DEEEIRATNPVATEQYGSVSTNLQARGNR

SEQ ID NO: 5215 - protein, 28 aa, Artificial Sequence
  Description of Artificial Sequence: Synthetic peptide
AEEEIRTTNPVATEQYGSVSTNLNRGNR

SEQ ID NO: 5216 - protein, 28 aa, Artificial Sequence
  Description of Artificial Sequence: Synthetic peptide
DEEEIRTTNPVATEQYGSVDTNLLRGNR

SEQ ID NO: 5217 - protein, 30 aa, Artificial Sequence
  Description of Artificial Sequence: Synthetic polypeptide
DEEEIRTTNPVATEQYGSVSTNLQDRGNPR

SEQ ID NO: 5218 - protein, 28 aa, Artificial Sequence
  Description of Artificial Sequence: Synthetic peptide
DEEEIRTTNPVATEQMGVVSTNLQRGNR

SEQ ID NO: 5219 - protein, 28 aa, Artificial Sequence
  Description of Artificial Sequence: Synthetic peptide
DENEIRTTNPVATEQYGSVSENLQRGNR

SEQ ID NO: 5220 - protein, 29 aa, Artificial Sequence
  Description of Artificial Sequence: Synthetic peptide
DEEEIRTTNPVATEQYGSNVSTNLQLGNR

SEQ ID NO: 5221 - protein, 28 aa, Artificial Sequence
  Description of Artificial Sequence: Synthetic peptide
KEEEIATTNPVATEQYGSVSTNLQRGNR

SEQ ID NO: 5222 - protein, 28 aa, Artificial Sequence
  Description of Artificial Sequence: Synthetic peptide
DEEEIRATNPVATEQYGSVSTNLQRGNL

SEQ ID NO: 5223 - protein, 28 aa, Artificial Sequence
  Description of Artificial Sequence: Synthetic peptide
DEEEIRTTNPVATECYWSVSTNLQRGNR

SEQ ID NO: 5224 - protein, 28 aa, Artificial Sequence
  Description of Artificial Sequence: Synthetic peptide
DEEMIRTTNPVATEQYGSVSTNLDRGNR

SEQ ID NO: 5225 - protein, 28 aa, Artificial Sequence
  Description of Artificial Sequence: Synthetic peptide
DEEEIRTTNPEATEQYGSVSTALQRGNR

SEQ ID NO: 5226 - protein, 29 aa, Artificial Sequence
  Description of Artificial Sequence: Synthetic peptide
DEEEIRTTNPVATEQYGSVSTEPLQRGNR

SEQ ID NO: 5227 - protein, 28 aa, Artificial Sequence
  Description of Artificial Sequence: Synthetic peptide
DEEEIRTTNPVATEQYGNVDTNLQRGNR

SEQ ID NO: 5228 - protein, 28 aa, Artificial Sequence
  Description of Artificial Sequence: Synthetic peptide
DEEEIRTTNPVATEQYGSVSTNLQRWNF

SEQ ID NO: 5229 - protein, 29 aa, Artificial Sequence
  Description of Artificial Sequence: Synthetic peptide
DEEEIRTTNPVATEQYGSVSTIPLQRGNR

SEQ ID NO: 5230 - protein, 28 aa, Artificial Sequence
  Description of Artificial Sequence: Synthetic peptide
DEEEIVTTNPVATEQYGLVSTNLQRGNR

SEQ ID NO: 5231 - protein, 28 aa, Artificial Sequence
  Description of Artificial Sequence: Synthetic peptide
DEEEIRTTNPVATEQYGDASTNLQRGNR

SEQ ID NO: 5232 - protein, 28 aa, Artificial Sequence
  Description of Artificial Sequence: Synthetic peptide
DQEEIRTTNPVATEQYGSVSTNLQRGNG

SEQ ID NO: 5233 - protein, 29 aa, Artificial Sequence
  Description of Artificial Sequence: Synthetic peptide
DEEEIRTTNPVATEQYGSVSTDNLQRGNL

SEQ ID NO: 5234 - protein, 28 aa, Artificial Sequence
  Description of Artificial Sequence: Synthetic peptide
DEQEIRTTNPVATEVYGSVSTNLQRGNR

SEQ ID NO: 5235 - protein, 28 aa, Artificial Sequence
  Description of Artificial Sequence: Synthetic peptide
DEEEIRTTNPVATEQYGSVSTTPQRGNR

SEQ ID NO: 5236 - protein, 28 aa, Artificial Sequence
  Description of Artificial Sequence: Synthetic peptide
DEEEIRTTNPVATEQYGSVATNLQRGTR

SEQ ID NO: 5237 - protein, 28 aa, Artificial Sequence
  Description of Artificial Sequence: Synthetic peptide
QEEEIRTTNPVATEQYGSVSTNLQRGER

SEQ ID NO: 5238 - protein, 29 aa, Artificial Sequence
  Description of Artificial Sequence: Synthetic peptide
MEEEIRTTNPVATEQYGSVSTNLQREGNR

SEQ ID NO: 5239 - protein, 28 aa, Artificial Sequence
  Description of Artificial Sequence: Synthetic peptide
DENEIRTTNPVATEQYGSVSTNEQRGNR

SEQ ID NO: 5240 - protein, 29 aa, Artificial Sequence
  Description of Artificial Sequence: Synthetic peptide
DEEEIRTTNPDATEQYGSVSTNLQRGENR

SEQ ID NO: 5241 - protein, 29 aa, Artificial Sequence
  Description of Artificial Sequence: Synthetic peptide
DEEEIRTTNPVATEGYGSVGSTNLQRGNR

SEQ ID NO: 5242 - protein, 28 aa, Artificial Sequence
  Description of Artificial Sequence: Synthetic peptide
DEEEIRTTNPVATEQYGSVFENLQRGNR

SEQ ID NO: 5243 - protein, 28 aa, Artificial Sequence
  Description of Artificial Sequence: Synthetic peptide
DEEEIRTTNPVATEQYGSVSTNLQIGNY

SEQ ID NO: 5244 - protein, 28 aa, Artificial Sequence
  Description of Artificial Sequence: Synthetic peptide
DEEEIRTTNPVATEQYGDVSTNLQRGNQ

SEQ ID NO: 5245 - protein, 29 aa, Artificial Sequence
  Description of Artificial Sequence: Synthetic peptide
DEEEIRTTNPVATEFYGSVSTLNLQRGNR

SEQ ID NO: 5246 - protein, 28 aa, Artificial Sequence
  Description of Artificial Sequence: Synthetic peptide
DEEEIRATNPVATEQYGSVSANLQRGNR

SEQ ID NO: 5247 - protein, 29 aa, Artificial Sequence
  Description of Artificial Sequence: Synthetic peptide
DEEEIRTTNPVATEQYGSVDTNLVQRGNR

SEQ ID NO: 5248 - protein, 30 aa, Artificial Sequence
  Description of Artificial Sequence: Synthetic polypeptide
DEEEIRTTNPVATEQYGSVSTNLVQRGENR

SEQ ID NO: 5249 - protein, 28 aa, Artificial Sequence
  Description of Artificial Sequence: Synthetic peptide
DEEEIRTVNPVATEQYGSVSTNLFRGNR

SEQ ID NO: 5250 - protein, 29 aa, Artificial Sequence
  Description of Artificial Sequence: Synthetic peptide
DEEEIRTTNPVATEQYGNVMSTNLQRGNR

SEQ ID NO: 5251 - protein, 29 aa, Artificial Sequence
  Description of Artificial Sequence: Synthetic peptide
DEEEIRTTNPVATEQYGSVSTNLQDRGNA

SEQ ID NO: 5252 - protein, 28 aa, Artificial Sequence
  Description of Artificial Sequence: Synthetic peptide
DEEEIRTTNPVATEVYGSVSTNLQRMNR

SEQ ID NO: 5253 - protein, 28 aa, Artificial Sequence
  Description of Artificial Sequence: Synthetic peptide
DEEEIRTTNPDATEQYGSVSTNLQRGNK

SEQ ID NO: 5254 - protein, 29 aa, Artificial Sequence
  Description of Artificial Sequence: Synthetic peptide
DEEEIRTTNPVATEQYGSVSTNLQRGLDR

SEQ ID NO: 5255 - protein, 28 aa, Artificial Sequence
  Description of Artificial Sequence: Synthetic peptide
DEEEIRTTNPVATEQYGHVSDNLQRGNR

SEQ ID NO: 5256 - protein, 29 aa, Artificial Sequence
  Description of Artificial Sequence: Synthetic peptide
DEEEIRTTNPEATEQYGSVSTNLIQRGNR

SEQ ID NO: 5257 - protein, 28 aa, Artificial Sequence
  Description of Artificial Sequence: Synthetic peptide
DEIEIRTTNPVATEQYGSVSTNLQRGNL

SEQ ID NO: 5258 - protein, 28 aa, Artificial Sequence
  Description of Artificial Sequence: Synthetic peptide
DGEEIRTTNPVATEQYGSVSTNLVRGNR

SEQ ID NO: 5259 - protein, 29 aa, Artificial Sequence
  Description of Artificial Sequence: Synthetic peptide
DEEEIRTTNPVATEQYGSVSTNLQVRGNM

SEQ ID NO: 5260 - protein, 28 aa, Artificial Sequence
  Description of Artificial Sequence: Synthetic peptide
DEEEIRTTNPVATEQYGAVSTNLQSGNR

SEQ ID NO: 5261 - protein, 29 aa, Artificial Sequence
  Description of Artificial Sequence: Synthetic peptide
DEEEIRTTNPVATEQYGSVSTNLQREGNQ

SEQ ID NO: 5262 - protein, 28 aa, Artificial Sequence
  Description of Artificial Sequence: Synthetic peptide
DGEEIRTTNPVATEQYGSVSTNLQRGNG

SEQ ID NO: 5263 - protein, 28 aa, Artificial Sequence
  Description of Artificial Sequence: Synthetic peptide
DEEEIRTTNPVATEQYGSVETPLQRGNR

SEQ ID NO: 5264 - protein, 28 aa, Artificial Sequence
  Description of Artificial Sequence: Synthetic peptide
DEEEIRTTNPVATEQYGSVSTNLQMENR

SEQ ID NO: 5265 - protein, 28 aa, Artificial Sequence
  Description of Artificial Sequence: Synthetic peptide
DEEEIRTTNPDATEQYGSVSTNLQPGNR

SEQ ID NO: 5266 - protein, 29 aa, Artificial Sequence
  Description of Artificial Sequence: Synthetic peptide
DEEEIRTTNPVATEQYGSVSTNLVQRGNL

SEQ ID NO: 5267 - protein, 28 aa, Artificial Sequence
  Description of Artificial Sequence: Synthetic peptide
VEEEIRTVNPVATEQYGSVSTNLQRGNR

SEQ ID NO: 5268 - protein, 28 aa, Artificial Sequence
  Description of Artificial Sequence: Synthetic peptide
DEEEICTTNPVATEQYGSVSTNLQRGNG

SEQ ID NO: 5269 - protein, 29 aa, Artificial Sequence
  Description of Artificial Sequence: Synthetic peptide
DEVEIRTTNPVATEQYGSVSTNLPQRGNR

SEQ ID NO: 5270 - protein, 28 aa, Artificial Sequence
  Description of Artificial Sequence: Synthetic peptide
AEEEIRTTNPVATEQYGSVPTNLQRGNR

SEQ ID NO: 5271 - protein, 28 aa, Artificial Sequence
  Description of Artificial Sequence: Synthetic peptide
DDEEIRTTNPVATEQYGSVSTNLQRMNR

SEQ ID NO: 5272 - protein, 28 aa, Artificial Sequence
  Description of Artificial Sequence: Synthetic peptide
DEEEIRTTNPVATEQYGSVETNLQRGND

SEQ ID NO: 5273 - protein, 29 aa, Artificial Sequence
  Description of Artificial Sequence: Synthetic peptide
DEEEIRTTNPVATEHYGSVSTNLQRDGNR

SEQ ID NO: 5274 - protein, 28 aa, Artificial Sequence
  Description of Artificial Sequence: Synthetic peptide
DEEEIRTTNIVATEQYGSVSTNLDRGNR

SEQ ID NO: 5275 - protein, 28 aa, Artificial Sequence
  Description of Artificial Sequence: Synthetic peptide
DEEEIRTTNPVATEQYGSVDTNLQRGNW

SEQ ID NO: 5276 - protein, 28 aa, Artificial Sequence
  Description of Artificial Sequence: Synthetic peptide
DEEEIRTTNPVATEQYGDVSTTLQRGNR

SEQ ID NO: 5277 - protein, 29 aa, Artificial Sequence
  Description of Artificial Sequence: Synthetic peptide
DEECIRTTNPVATEQYGSVSTNLTQRGNR

SEQ ID NO: 5278 - protein, 28 aa, Artificial Sequence
  Description of Artificial Sequence: Synthetic peptide
DEEEVRTTNPVATEQYGSVSTNLQRGNS

SEQ ID NO: 5279 - protein, 28 aa, Artificial Sequence
  Description of Artificial Sequence: Synthetic peptide
DEEEIRTTNPEATEQYGSVSTNLQRGNQ

SEQ ID NO: 5280 - protein, 29 aa, Artificial Sequence
  Description of Artificial Sequence: Synthetic peptide
DEEEIATTNPVATEQYGSVSTNLQSRGNR

SEQ ID NO: 5281 - protein, 28 aa, Artificial Sequence
  Description of Artificial Sequence: Synthetic peptide
CEEEIRTTNPVATEQYGSVSTNLLRGNR

SEQ ID NO: 5282 - protein, 28 aa, Artificial Sequence
  Description of Artificial Sequence: Synthetic peptide
DEEEIRTTNPVATEQYGSVSTNLQHGNW

SEQ ID NO: 5283 - protein, 29 aa, Artificial Sequence
  Description of Artificial Sequence: Synthetic peptide
DEEEIRTTNPVATEQYGSVSETDLQRGNR

SEQ ID NO: 5284 - protein, 28 aa, Artificial Sequence
  Description of Artificial Sequence: Synthetic peptide
GEEEIRTTNPVATEQYGSVGTNLQRGNR

SEQ ID NO: 5285 - protein, 28 aa, Artificial Sequence
  Description of Artificial Sequence: Synthetic peptide
DDEEIRTTNPVATEQYGSVSTNLQRGNF

SEQ ID NO: 5286 - protein, 28 aa, Artificial Sequence
  Description of Artificial Sequence: Synthetic peptide
DEEEIRTTNPVATEQYGSVSTPLQRDNR

SEQ ID NO: 5287 - protein, 28 aa, Artificial Sequence
  Description of Artificial Sequence: Synthetic peptide
MEEEIRTTNPVATEQYGSVSTNLQHGNR

SEQ ID NO: 5288 - protein, 29 aa, Artificial Sequence
  Description of Artificial Sequence: Synthetic peptide
DEEEIRTTNPVATEQYGSVSTMNLQRGNH

SEQ ID NO: 5289 - protein, 28 aa, Artificial Sequence
  Description of Artificial Sequence: Synthetic peptide
DEEEIRTTNPVSTEQYGSVSTNLQRGTR

SEQ ID NO: 5290 - protein, 28 aa, Artificial Sequence
  Description of Artificial Sequence: Synthetic peptide
DEEEIRTTNPVATENYGSVSTNGQRGNR

SEQ ID NO: 5291 - protein, 28 aa, Artificial Sequence
  Description of Artificial Sequence: Synthetic peptide
KEVEIRTTNPVATEQYGSVSTNLQRGNR

SEQ ID NO: 5292 - protein, 28 aa, Artificial Sequence
  Description of Artificial Sequence: Synthetic peptide
DEEEIRTVNPVATEQYGCVSTNLQRGNR

SEQ ID NO: 5293 - protein, 29 aa, Artificial Sequence
  Description of Artificial Sequence: Synthetic peptide
DEEEIRTTNPVATEQYGSVSTNLWQRGNN

SEQ ID NO: 5294 - protein, 30 aa, Artificial Sequence
  Description of Artificial Sequence: Synthetic polypeptide
DEEEIRTTNPVATEQYGSVSTENLQRGNDR

SEQ ID NO: 5295 - protein, 28 aa, Artificial Sequence
  Description of Artificial Sequence: Synthetic peptide
DEEEIRQTNPVATEQYGVVSTNLQRGNR

SEQ ID NO: 5296 - protein, 28 aa, Artificial Sequence
  Description of Artificial Sequence: Synthetic peptide
DEEEIRTTNPFATEQYGSVSTNLQRDNR

SEQ ID NO: 5297 - protein, 28 aa, Artificial Sequence
  Description of Artificial Sequence: Synthetic peptide
DEEEIRTTNPDATEQYGSVSTNLQRGNE

SEQ ID NO: 5298 - protein, 29 aa, Artificial Sequence
  Description of Artificial Sequence: Synthetic peptide
DEEEIRTTNPVATEQYGSVSTMNLDRGNR

SEQ ID NO: 5299 - protein, 28 aa, Artificial Sequence
  Description of Artificial Sequence: Synthetic peptide
DEEEIRGTNPVATEQYGSASTNLQRGNR

SEQ ID NO: 5300 - protein, 29 aa, Artificial Sequence
  Description of Artificial Sequence: Synthetic peptide
DEEEIRTTNPVATEQYGSVSTNLQTRGND

SEQ ID NO: 5301 - protein, 30 aa, Artificial Sequence
  Description of Artificial Sequence: Synthetic polypeptide
DEEEIRTTNPVATEQYGSVSTTNLQDRGNR

SEQ ID NO: 5302 - protein, 28 aa, Artificial Sequence
  Description of Artificial Sequence: Synthetic peptide
DEDEIRTTNPVATEQYGSVSTNLQRGDR

SEQ ID NO: 5303 - protein, 29 aa, Artificial Sequence
  Description of Artificial Sequence: Synthetic peptide
DEEEIRTTNPVATEQYGSVSTNLQEGDNR

SEQ ID NO: 5304 - protein, 28 aa, Artificial Sequence
  Description of Artificial Sequence: Synthetic peptide
DEEEIRTTNPVATEQYGSVSMNLQRLNR

SEQ ID NO: 5305 - protein, 28 aa, Artificial Sequence
  Description of Artificial Sequence: Synthetic peptide
DEEEIRQTNPVATEQYGSVSTNLQRGMR

SEQ ID NO: 5306 - protein, 28 aa, Artificial Sequence
  Description of Artificial Sequence: Synthetic peptide
DEEEIRTTNPVAFEQYGSVSTDLQRGNR

SEQ ID NO: 5307 - protein, 30 aa, Artificial Sequence
  Description of Artificial Sequence: Synthetic polypeptide
DEEEIRTTNPVATEQYGSVSTNLVQSRGNR

SEQ ID NO: 5308 - protein, 28 aa, Artificial Sequence
  Description of Artificial Sequence: Synthetic peptide
DEEEIITTNPVATEQYGTVSTNLQRGNR

SEQ ID NO: 5309 - protein, 28 aa, Artificial Sequence
  Description of Artificial Sequence: Synthetic peptide
DENEIRTTNPVATEQYGSVSTNLQYGNR

SEQ ID NO: 5310 - protein, 28 aa, Artificial Sequence
  Description of Artificial Sequence: Synthetic peptide
DEQEIRTTNPVATEQYGSVSTNLQMGNR

SEQ ID NO: 5311 - protein, 29 aa, Artificial Sequence
  Description of Artificial Sequence: Synthetic peptide
DEEEIRTTNPVATEQYGSVSTNLQRGDTR

SEQ ID NO: 5312 - protein, 28 aa, Artificial Sequence
  Description of Artificial Sequence: Synthetic peptide
DEEEIRTTNPVATEQYGSVSTLHQRGNR

SEQ ID NO: 5313 - protein, 30 aa, Artificial Sequence
  Description of Artificial Sequence: Synthetic polypeptide
DEEEIRTTNPVATEQYGSVTSTNGLQRGNR

SEQ ID NO: 5314 - protein, 30 aa, Artificial Sequence
  Description of Artificial Sequence: Synthetic polypeptide
DEEEIRTTNPVATEQYGSVSTNLFQRGSNR

SEQ ID NO: 5315 - protein, 29 aa, Artificial Sequence
  Description of Artificial Sequence: Synthetic peptide
DEEEIRTTNPVATEQYGSVSTNLQEQGNR

SEQ ID NO: 5316 - protein, 29 aa, Artificial Sequence
  Description of Artificial Sequence: Synthetic peptide
DEDEIRTTNPVATEQYGSVSTENLQRGNR

SEQ ID NO: 5317 - protein, 28 aa, Artificial Sequence
  Description of Artificial Sequence: Synthetic peptide
DEEEIRTTNPVATEQYGSVSTNLQYGNL

SEQ ID NO: 5318 - protein, 28 aa, Artificial Sequence
  Description of Artificial Sequence: Synthetic peptide
DEEEIRTTNPVATEQYGSVSTNLEDGNR

SEQ ID NO: 5319 - protein, 28 aa, Artificial Sequence
  Description of Artificial Sequence: Synthetic peptide
DEEEIRTTNPVATEQYGVVSTNLQRGNM

SEQ ID NO: 5320 - protein, 28 aa, Artificial Sequence
  Description of Artificial Sequence: Synthetic peptide
DEEEISTTNPVATEQYGSVSTNLQRGDR

SEQ ID NO: 5321 - protein, 29 aa, Artificial Sequence
  Description of Artificial Sequence: Synthetic peptide
DEEEIRTTNPVATEQYGSVETNLPQRGNR

SEQ ID NO: 5322 - protein, 28 aa, Artificial Sequence
  Description of Artificial Sequence: Synthetic peptide
AEEEIRTTNPVATEQYGSVSTNLQHGNR

SEQ ID NO: 5323 - protein, 28 aa, Artificial Sequence
  Description of Artificial Sequence: Synthetic peptide
DEEEITTTNPVATEQYGSVSTNLQRGNS

SEQ ID NO: 5324 - protein, 29 aa, Artificial Sequence
  Description of Artificial Sequence: Synthetic peptide
DEEEIRTTNPVATEQYGSVSCTELQRGNR

SEQ ID NO: 5325 - protein, 28 aa, Artificial Sequence
  Description of Artificial Sequence: Synthetic peptide
QEEEITTTNPVATEQYGSVSTNLQRGNR

SEQ ID NO: 5326 - protein, 29 aa, Artificial Sequence
  Description of Artificial Sequence: Synthetic peptide
SEEEIRTTNPVATEQYGSVASTNLQRGNR

SEQ ID NO: 5327 - protein, 29 aa, Artificial Sequence
  Description of Artificial Sequence: Synthetic peptide
DEEEIRTTNPVATEQYGSVSTENLDRGNR

SEQ ID NO: 5328 - protein, 28 aa, Artificial Sequence
  Description of Artificial Sequence: Synthetic peptide
DEQEIRTTNPVATEQYGSVSTNLQFGNR

SEQ ID NO: 5329 - protein, 28 aa, Artificial Sequence
  Description of Artificial Sequence: Synthetic peptide
DEEEIRTTNPVATEQYGSWSTNLQSGNR

SEQ ID NO: 5330 - protein, 28 aa, Artificial Sequence
  Description of Artificial Sequence: Synthetic peptide
IEEEIRTTNPVASEQYGSVSTNLQRGNR

SEQ ID NO: 5331 - protein, 29 aa, Artificial Sequence
  Description of Artificial Sequence: Synthetic peptide
SEEEIRTTNPVATEQYGSVSTNLQRGNTR

SEQ ID NO: 5332 - protein, 28 aa, Artificial Sequence
  Description of Artificial Sequence: Synthetic peptide
DEEEIRTTNPVASEQYGSVSTNLQRGNQ

SEQ ID NO: 5333 - protein, 29 aa, Artificial Sequence
  Description of Artificial Sequence: Synthetic peptide
DEEEIRTTNPVATEQYGSVSTNLERGNPR

SEQ ID NO: 5334 - protein, 29 aa, Artificial Sequence
  Description of Artificial Sequence: Synthetic peptide
DEEEIRTTNPVATEQYGSVSTNLQCRGNC

SEQ ID NO: 5335 - protein, 28 aa, Artificial Sequence
  Description of Artificial Sequence: Synthetic peptide
DEEEIRTTNPVATEQYGSVSTNLQHGNQ

SEQ ID NO: 5336 - protein, 28 aa, Artificial Sequence
  Description of Artificial Sequence: Synthetic peptide
DECEIRTTNPVATEQYGSVSSNLQRGNR

SEQ ID NO: 5337 - protein, 29 aa, Artificial Sequence
  Description of Artificial Sequence: Synthetic peptide
DEEEIRTTNPVATEQYGSVSITNLQFGNR

SEQ ID NO: 5338 - protein, 28 aa, Artificial Sequence
  Description of Artificial Sequence: Synthetic peptide
FEEEIRTTNPVATEQYGSVSTNLVRGNR

SEQ ID NO: 5339 - protein, 28 aa, Artificial Sequence
  Description of Artificial Sequence: Synthetic peptide
DEEEIRTTNPVATEQYGSMSTELQRGNR

SEQ ID NO: 5340 - protein, 28 aa, Artificial Sequence
  Description of Artificial Sequence: Synthetic peptide
SEEELRTTNPVATEQYGSVSTNLQRGNR

SEQ ID NO: 5341 - protein, 30 aa, Artificial Sequence
  Description of Artificial Sequence: Synthetic polypeptide
DEEEIRTTNPVATEQYGCSVSTFNLQRGNR

SEQ ID NO: 5342 - protein, 28 aa, Artificial Sequence
  Description of Artificial Sequence: Synthetic peptide
DEEEIRTTNPVATLQYGSVSTNLDRGNR

SEQ ID NO: 5343 - protein, 29 aa, Artificial Sequence
  Description of Artificial Sequence: Synthetic peptide
DEEEIRTTNPVATEQYGSVSTNLDRGVNR

SEQ ID NO: 5344 - protein, 28 aa, Artificial Sequence
  Description of Artificial Sequence: Synthetic peptide
DEEEIRTTNPVATEQYGSVSTPLQRGNG

SEQ ID NO: 5345 - protein, 28 aa, Artificial Sequence
  Description of Artificial Sequence: Synthetic peptide
DEHEIRTTNPVATEQYGSVSTNLQRGNQ

SEQ ID NO: 5346 - protein, 28 aa, Artificial Sequence
  Description of Artificial Sequence: Synthetic peptide
DEEEIRTTNPVATEQYGFVSTNDQRGNR

SEQ ID NO: 5347 - protein, 30 aa, Artificial Sequence
  Description of Artificial Sequence: Synthetic polypeptide
DEEEIRTTNPVATEQYGSYVSTNLQRGNPR

SEQ ID NO: 5348 - protein, 28 aa, Artificial Sequence
  Description of Artificial Sequence: Synthetic peptide
DEEEIRTTNPVATEQYGSVSTIEQRGNR

SEQ ID NO: 5349 - protein, 28 aa, Artificial Sequence
  Description of Artificial Sequence: Synthetic peptide
DEEEIRPTNPVATEQYGSVSTNLQPGNR

SEQ ID NO: 5350 - protein, 28 aa, Artificial Sequence
  Description of Artificial Sequence: Synthetic peptide
DEEEIRTTNPESTEQYGSVSTNLQRGNR

SEQ ID NO: 5351 - protein, 28 aa, Artificial Sequence
  Description of Artificial Sequence: Synthetic peptide
DIEEIRTTNPVATEQYGSVSTNLQGGNR

SEQ ID NO: 5352 - protein, 28 aa, Artificial Sequence
  Description of Artificial Sequence: Synthetic peptide
DEEEIRTTNPVATEQYGSVSTNLLRGER

SEQ ID NO: 5353 - protein, 28 aa, Artificial Sequence
  Description of Artificial Sequence: Synthetic peptide
DEEEIRTTNPVATEQYGSVSENLQFGNR

SEQ ID NO: 5354 - protein, 30 aa, Artificial Sequence
  Description of Artificial Sequence: Synthetic polypeptide
DEEEIRTTNPVATEQYGESVSTNGLQRGNR

SEQ ID NO: 5355 - protein, 28 aa, Artificial Sequence
  Description of Artificial Sequence: Synthetic peptide
DEEEIRTTNPVATEQYGSVSTNLQRRNS

SEQ ID NO: 5356 - protein, 28 aa, Artificial Sequence
  Description of Artificial Sequence: Synthetic peptide
DEEEIRTTNPVATEQFGSVSTNEQRGNR

SEQ ID NO: 5357 - protein, 29 aa, Artificial Sequence
  Description of Artificial Sequence: Synthetic peptide
DEEEIRTTNPVATEQYGSVSTNLQRMNGR

SEQ ID NO: 5358 - protein, 29 aa, Artificial Sequence
  Description of Artificial Sequence: Synthetic peptide
DEEEIRTTNPVATECYGSVSTNLQRNGNR

SEQ ID NO: 5359 - protein, 28 aa, Artificial Sequence
  Description of Artificial Sequence: Synthetic peptide
DEEEIRTTNPDATEQYGSVSTNLQRGNM

SEQ ID NO: 5360 - protein, 28 aa, Artificial Sequence
  Description of Artificial Sequence: Synthetic peptide
DEEEIATTNPVATEQYGSVSTNLQKGNR

SEQ ID NO: 5361 - protein, 28 aa, Artificial Sequence
  Description of Artificial Sequence: Synthetic peptide
DEEEIRTTNPVATEQYGSVSTNLDRGNG

SEQ ID NO: 5362 - protein, 28 aa, Artificial Sequence
  Description of Artificial Sequence: Synthetic peptide
DEEEITATNPVATEQYGSVSTNLQRGNR

SEQ ID NO: 5363 - protein, 28 aa, Artificial Sequence
  Description of Artificial Sequence: Synthetic peptide
DETEIRTTNPVATEQYGSVSTNDQRGNR

SEQ ID NO: 5364 - protein, 28 aa, Artificial Sequence
  Description of Artificial Sequence: Synthetic peptide
DEEDIWTTNPVATEQYGSVSTNLQRGNR

SEQ ID NO: 5365 - protein, 28 aa, Artificial Sequence
  Description of Artificial Sequence: Synthetic peptide
DEEEIRTTNPVATEQYGSVSENLERGNR

SEQ ID NO: 5366 - protein, 28 aa, Artificial Sequence
  Description of Artificial Sequence: Synthetic peptide
DEEEIRTTNPCATEQYGSVSTNLQRGNC

SEQ ID NO: 5367 - protein, 28 aa, Artificial Sequence
  Description of Artificial Sequence: Synthetic peptide
DEEEIRTTNPVATEQYGSVSPNLDRGNR

SEQ ID NO: 5368 - protein, 28 aa, Artificial Sequence
  Description of Artificial Sequence: Synthetic peptide
DEEEIRTTNPVATEQYGSVWTNLQRGNP

SEQ ID NO: 5369 - protein, 29 aa, Artificial Sequence
  Description of Artificial Sequence: Synthetic peptide
DEEEIRTTNPVATEQYGAVSTNLQRGNYR

SEQ ID NO: 5370 - protein, 28 aa, Artificial Sequence
  Description of Artificial Sequence: Synthetic peptide
DEEEIRSTNPVATEQYGVVSTNLQRGNR

SEQ ID NO: 5371 - protein, 28 aa, Artificial Sequence
  Description of Artificial Sequence: Synthetic peptide
DEEEIRTTNPVSTEHYGSVSTNLQRGNR

SEQ ID NO: 5372 - protein, 28 aa, Artificial Sequence
  Description of Artificial Sequence: Synthetic peptide
DESEIRTTNPVATEQYGSVSTDLQRGNR

SEQ ID NO: 5373 - protein, 28 aa, Artificial Sequence
  Description of Artificial Sequence: Synthetic peptide
DEEEIRTTNPVATEQYGSVSTNLQRGPH

SEQ ID NO: 5374 - protein, 28 aa, Artificial Sequence
  Description of Artificial Sequence: Synthetic peptide
SEEEIRTTNPVATEQYGCVSTNLQRGNR

SEQ ID NO: 5375 - protein, 28 aa, Artificial Sequence
  Description of Artificial Sequence: Synthetic peptide
DEEEIRTTNPVATEQYGSVSTNLVRGVR

SEQ ID NO: 5376 - protein, 29 aa, Artificial Sequence
  Description of Artificial Sequence: Synthetic peptide
DEEEIRTTNPVATEQYGSVSTNLQDMGNR

SEQ ID NO: 5377 - protein, 28 aa, Artificial Sequence
  Description of Artificial Sequence: Synthetic peptide
DEEEIRTTNPVAHEQYGVVSTNLQRGNR

SEQ ID NO: 5378 - protein, 30 aa, Artificial Sequence
  Description of Artificial Sequence: Synthetic polypeptide
DEEEIRTTNPVATEQYGSVSTNLPQRGFNR

SEQ ID NO: 5379 - protein, 29 aa, Artificial Sequence
  Description of Artificial Sequence: Synthetic peptide
DEEEIRTTNPVATEQYGSVSTNPLERGNR

SEQ ID NO: 5380 - protein, 29 aa, Artificial Sequence
  Description of Artificial Sequence: Synthetic peptide
DEEEIRTTNPVATDQYGSVSTNLQRAGNR

SEQ ID NO: 5381 - protein, 29 aa, Artificial Sequence
  Description of Artificial Sequence: Synthetic peptide
DEEEIRTTNPVATEQYGSVSTNLQRTGND

SEQ ID NO: 5382 - protein, 28 aa, Artificial Sequence
  Description of Artificial Sequence: Synthetic peptide
DEEEIRTTNPVATEMYGSVSTNLQRGTR

SEQ ID NO: 5383 - protein, 29 aa, Artificial Sequence
  Description of Artificial Sequence: Synthetic peptide
DEEEIRTTNPEATEQYGSVSTNLQRGNER

SEQ ID NO: 5384 - protein, 30 aa, Artificial Sequence
  Description of Artificial Sequence: Synthetic polypeptide
DEEEIRTTNPVATEQYGSVSTTNPLQRGNR

SEQ ID NO: 5385 - protein, 28 aa, Artificial Sequence
  Description of Artificial Sequence: Synthetic peptide
YEEEIRTTNPVATEQYGSVSTNLQRENR

SEQ ID NO: 5386 - protein, 29 aa, Artificial Sequence
  Description of Artificial Sequence: Synthetic peptide
DEEEIRTTNPVATEQYGSVSTNLQMRGNE

SEQ ID NO: 5387 - protein, 28 aa, Artificial Sequence
  Description of Artificial Sequence: Synthetic peptide
DEEEIMTTNPVATEQYGSVSTNLQNGNR

SEQ ID NO: 5388 - protein, 29 aa, Artificial Sequence
  Description of Artificial Sequence: Synthetic peptide
DEEEIRTTNPVATEQYGSVSTNLVLRGNR

SEQ ID NO: 5389 - protein, 30 aa, Artificial Sequence
  Description of Artificial Sequence: Synthetic polypeptide
DEEEIRTTNPVATEQYGSVSTNLRQDRGNR

SEQ ID NO: 5390 - protein, 29 aa, Artificial Sequence
  Description of Artificial Sequence: Synthetic peptide
SEEEIRTTNPVATEQYGSVSTNLQRQGNR

SEQ ID NO: 5391 - protein, 28 aa, Artificial Sequence
  Description of Artificial Sequence: Synthetic peptide
DEEEIRTTNPLATEQYGSVSTNLQPGNR

SEQ ID NO: 5392 - protein, 28 aa, Artificial Sequence
  Description of Artificial Sequence: Synthetic peptide
DEEEIRPTNPVSTEQYGSVSTNLQRGNR

SEQ ID NO: 5393 - protein, 28 aa, Artificial Sequence
  Description of Artificial Sequence: Synthetic peptide
DEEEIRTTNPVATEQYGSVSTNLQPGNP

SEQ ID NO: 5394 - protein, 29 aa, Artificial Sequence
  Description of Artificial Sequence: Synthetic peptide
DEEEIRTTNPVATEQYGSVSTNLQQAGNR

SEQ ID NO: 5395 - protein, 28 aa, Artificial Sequence
  Description of Artificial Sequence: Synthetic peptide
DEEEIRTTNPVATEQYGSVGTVLQRGNR

SEQ ID NO: 5396 - protein, 28 aa, Artificial Sequence
  Description of Artificial Sequence: Synthetic peptide
DENEIRTTNPVATEQYGSVSTNLQRGNT

SEQ ID NO: 5397 - protein, 28 aa, Artificial Sequence
  Description of Artificial Sequence: Synthetic peptide
DEEEIRTTNPVATEQYGSVSTGQQRGNR

SEQ ID NO: 5398 - protein, 28 aa, Artificial Sequence
  Description of Artificial Sequence: Synthetic peptide
DEEEIRTTNPVATEQYGSVFTPLQRGNR

SEQ ID NO: 5399 - protein, 28 aa, Artificial Sequence
  Description of Artificial Sequence: Synthetic peptide
DEEEIRPTNPDATEQYGSVSTNLQRGNR

SEQ ID NO: 5400 - protein, 29 aa, Artificial Sequence
  Description of Artificial Sequence: Synthetic peptide
DEEEIRTTNPVATEQWGSVSTNLQRGNDR

SEQ ID NO: 5401 - protein, 28 aa, Artificial Sequence
  Description of Artificial Sequence: Synthetic peptide
DEECIRTTNIVATEQYGSVSTNLQRGNR

SEQ ID NO: 5402 - protein, 29 aa, Artificial Sequence
  Description of Artificial Sequence: Synthetic peptide
DEQEIRTTNPVATEQYGSVSTNLQREGNR

SEQ ID NO: 5403 - protein, 28 aa, Artificial Sequence
  Description of Artificial Sequence: Synthetic peptide
DEEEIRTTNPVATEQYGSVSTNLEVGNR

SEQ ID NO: 5404 - protein, 29 aa, Artificial Sequence
  Description of Artificial Sequence: Synthetic peptide
DEEEIRTTNPVATEQYGSVSDNLQDRGNR

SEQ ID NO: 5405 - protein, 28 aa, Artificial Sequence
  Description of Artificial Sequence: Synthetic peptide
DEEEIRTTNPVATEQYGSVSTNLQPGNM

SEQ ID NO: 5406 - protein, 28 aa, Artificial Sequence
  Description of Artificial Sequence: Synthetic peptide
DEEEIRTTNPVATEQYGSVSDNLQLGNR

SEQ ID NO: 5407 - protein, 28 aa, Artificial Sequence
  Description of Artificial Sequence: Synthetic peptide
DEEEIRTTNPCASEQYGSVSTNLQRGNR

SEQ ID NO: 5408 - protein, 30 aa, Artificial Sequence
  Description of Artificial Sequence: Synthetic polypeptide
DEEEIRTTNPVATEQYGSVSTNLQDRDGNR

SEQ ID NO: 5409 - protein, 30 aa, Artificial Sequence
  Description of Artificial Sequence: Synthetic polypeptide
DEEEIRTTNPVATEQYGSVSTNGLQRNGNR

SEQ ID NO: 5410 - protein, 28 aa, Artificial Sequence
  Description of Artificial Sequence: Synthetic peptide
DEEEIRSVNPVATEQYGSVSTNLQRGNR

SEQ ID NO: 5411 - protein, 29 aa, Artificial Sequence
  Description of Artificial Sequence: Synthetic peptide
DEEEIRTTNPVATEQYGSVSTMNLQRGNF

SEQ ID NO: 5412 - protein, 28 aa, Artificial Sequence
  Description of Artificial Sequence: Synthetic peptide
DEEEIRTTNPVATEQYGSVSTNLQRGDQ

SEQ ID NO: 5413 - protein, 29 aa, Artificial Sequence
  Description of Artificial Sequence: Synthetic peptide
DEEEIRTTNPVATEQYGSVLSTNLQTGNR

SEQ ID NO: 5414 - protein, 28 aa, Artificial Sequence
  Description of Artificial Sequence: Synthetic peptide
DEEEIRTTNPVATEQYGAVGTNLQRGNR

SEQ ID NO: 5415 - protein, 29 aa, Artificial Sequence
  Description of Artificial Sequence: Synthetic peptide
DEEEIRTTNPVATEQYGSVSTANLQRGNQ

SEQ ID NO: 5416 - protein, 28 aa, Artificial Sequence
  Description of Artificial Sequence: Synthetic peptide
DEEEIRTTNPVATEQYGIVSTNLQTGNR

SEQ ID NO: 5417 - protein, 28 aa, Artificial Sequence
  Description of Artificial Sequence: Synthetic peptide
KEEEIRTTNPVATEQYGSVSTNLQRENR

SEQ ID NO: 5418 - protein, 28 aa, Artificial Sequence
  Description of Artificial Sequence: Synthetic peptide
SEEEIRTTNPVATEQFGSVSTNLQRGNR

SEQ ID NO: 5419 - protein, 28 aa, Artificial Sequence
  Description of Artificial Sequence: Synthetic peptide
AEEEIRTTNPVATEQYGSVSTNLQRGNF

SEQ ID NO: 5420 - protein, 28 aa, Artificial Sequence
  Description of Artificial Sequence: Synthetic peptide
DEEEIRTTNPDATEQYGSVSTNLDRGNR

SEQ ID NO: 5421 - protein, 29 aa, Artificial Sequence
  Description of Artificial Sequence: Synthetic peptide
DEEEIRTTNPVATEQYGSVSDNNLQRGNR

SEQ ID NO: 5422 - protein, 29 aa, Artificial Sequence
  Description of Artificial Sequence: Synthetic peptide
DEEEIRTTNPVATEQYGSVEETNLQRGNR

SEQ ID NO: 5423 - protein, 28 aa, Artificial Sequence
  Description of Artificial Sequence: Synthetic peptide
DEEEIRTTNIVATEQYGSVSTNLERGNR

SEQ ID NO: 5424 - protein, 30 aa, Artificial Sequence
  Description of Artificial Sequence: Synthetic polypeptide
DEEEIRTTNPVATEQYGSVSTNLQLRGDNR

SEQ ID NO: 5425 - protein, 28 aa, Artificial Sequence
  Description of Artificial Sequence: Synthetic peptide
DEEEIRTTNPVATEQYGSVSTNLESGNR

SEQ ID NO: 5426 - protein, 28 aa, Artificial Sequence
  Description of Artificial Sequence: Synthetic peptide
DEAEIRTTNPVATEQYGDVSTNLQRGNR

SEQ ID NO: 5427 - protein, 28 aa, Artificial Sequence
  Description of Artificial Sequence: Synthetic peptide
DEEEIRTTNPQATEQYGSVSTNEQRGNR

SEQ ID NO: 5428 - protein, 29 aa, Artificial Sequence
  Description of Artificial Sequence: Synthetic peptide
DEEEIRATNPVATEQYGSVSTNLQYRGNR

SEQ ID NO: 5429 - protein, 30 aa, Artificial Sequence
  Description of Artificial Sequence: Synthetic polypeptide
DEEEIRTTNPVATEQYGSVSITNLQRGENR

SEQ ID NO: 5430 - protein, 28 aa, Artificial Sequence
  Description of Artificial Sequence: Synthetic peptide
DEEEIRTTNPVATEQYGSVSTNLQRGEG

SEQ ID NO: 5431 - protein, 28 aa, Artificial Sequence
  Description of Artificial Sequence: Synthetic peptide
DEEEIRCTNPVATEQYGSVSTPLQRGNR

SEQ ID NO: 5432 - protein, 28 aa, Artificial Sequence
  Description of Artificial Sequence: Synthetic peptide
DEEEIRATNPVATCQYGSVSTNLQRGNR

SEQ ID NO: 5433 - protein, 29 aa, Artificial Sequence
  Description of Artificial Sequence: Synthetic peptide
DEEEIRTTNPVATEQYGSVSTNLQMRGNF

SEQ ID NO: 5434 - protein, 28 aa, Artificial Sequence
  Description of Artificial Sequence: Synthetic peptide
DECEIRTTNPVATEQSGSVSTNLQRGNR

SEQ ID NO: 5435 - protein, 30 aa, Artificial Sequence
  Description of Artificial Sequence: Synthetic polypeptide
DEEEIRTTNPVATEQYGSVSTNLQRGPNTR

SEQ ID NO: 5436 - protein, 28 aa, Artificial Sequence
  Description of Artificial Sequence: Synthetic peptide
DEEEIRTTNPVATEQYGWVSTNLIRGNR

SEQ ID NO: 5437 - protein, 28 aa, Artificial Sequence
  Description of Artificial Sequence: Synthetic peptide
DEEEICTTNPVATEQYGSVSTNLQRGTR

SEQ ID NO: 5438 - protein, 29 aa, Artificial Sequence
  Description of Artificial Sequence: Synthetic peptide
DEEEIRTTNPVATEQYGSVSVTNLQDGNR

SEQ ID NO: 5439 - protein, 28 aa, Artificial Sequence
  Description of Artificial Sequence: Synthetic peptide
DEEEIRTTNPVCTEQYGSVSTNLQRGNA

SEQ ID NO: 5440 - protein, 28 aa, Artificial Sequence
  Description of Artificial Sequence: Synthetic peptide
DEEEISTTNPVATEQYGSVSTNLQRGNG

SEQ ID NO: 5441 - protein, 28 aa, Artificial Sequence
  Description of Artificial Sequence: Synthetic peptide
DEEEIRTTNPVATEQYGSVANNLQRGNR

SEQ ID NO: 5442 - protein, 29 aa, Artificial Sequence
  Description of Artificial Sequence: Synthetic peptide
DEEEIRTTNPVATEQYGSVSSTNLQDGNR

SEQ ID NO: 5443 - protein, 29 aa, Artificial Sequence
  Description of Artificial Sequence: Synthetic peptide
DEEEIRTTNPVATEQYGSVSTNLNRGDNR

SEQ ID NO: 5444 - protein, 28 aa, Artificial Sequence
  Description of Artificial Sequence: Synthetic peptide
DEEEIRQTNPVATEQYGSVSTNLQVGNR

SEQ ID NO: 5445 - protein, 28 aa, Artificial Sequence
  Description of Artificial Sequence: Synthetic peptide
DEEEIATTNPVATEQYGSVSANLQRGNR

SEQ ID NO: 5446 - protein, 28 aa, Artificial Sequence
  Description of Artificial Sequence: Synthetic peptide
DEEEIRTTNPVATEQYGSVSTILQRQNR

SEQ ID NO: 5447 - protein, 28 aa, Artificial Sequence
  Description of Artificial Sequence: Synthetic peptide
DEEEIRTVNPVATEMYGSVSTNLQRGNR

SEQ ID NO: 5448 - protein, 28 aa, Artificial Sequence
  Description of Artificial Sequence: Synthetic peptide
DEEEIRTTNPVAAEQYGSVSTNLQRGNP

SEQ ID NO: 5449 - protein, 29 aa, Artificial Sequence
  Description of Artificial Sequence: Synthetic peptide
DEEEIRTTNPVATEQYGSVSNTNLQRGND

SEQ ID NO: 5450 - protein, 29 aa, Artificial Sequence
  Description of Artificial Sequence: Synthetic peptide
DEEEIRTTNPVATEQYGGVSTNLPQRGNR

SEQ ID NO: 5451 - protein, 29 aa, Artificial Sequence
  Description of Artificial Sequence: Synthetic peptide
DEEEIRTTNPVATEQYGSVETNLQRGDNR

SEQ ID NO: 5452 - protein, 28 aa, Artificial Sequence
  Description of Artificial Sequence: Synthetic peptide
DEEEIRTTNPVATEQYGVVSTNLQRLNR

SEQ ID NO: 5453 - protein, 29 aa, Artificial Sequence
  Description of Artificial Sequence: Synthetic peptide
DEEEIRTTNPVATEQYGSVSTNLQRGNNI

SEQ ID NO: 5454 - protein, 29 aa, Artificial Sequence
  Description of Artificial Sequence: Synthetic peptide
DEEEIRTTNPVATEQYGDVSTNLQERGNR

SEQ ID NO: 5455 - protein, 28 aa, Artificial Sequence
  Description of Artificial Sequence: Synthetic peptide
DEEEIRTTNPVAYEQYGSVSENLQRGNR

SEQ ID NO: 5456 - protein, 29 aa, Artificial Sequence
  Description of Artificial Sequence: Synthetic peptide
QEEEIRTTNPVATEQYGSVSTNLQRGENR

SEQ ID NO: 5457 - protein, 28 aa, Artificial Sequence
  Description of Artificial Sequence: Synthetic peptide
DENEIRTTNPVATEQYGSVSTNLQSGNR

SEQ ID NO: 5458 - protein, 29 aa, Artificial Sequence
  Description of Artificial Sequence: Synthetic peptide
DEEEIRTTNPVATEQYGSVSTNQQRGNDR

SEQ ID NO: 5459 - protein, 28 aa, Artificial Sequence
  Description of Artificial Sequence: Synthetic peptide
DEEEIRTTNPVATEQYGSVSTNLQDGNP

SEQ ID NO: 5460 - protein, 29 aa, Artificial Sequence
  Description of Artificial Sequence: Synthetic peptide
DEEEIRTTNPVATEQYGSYVSTNEQRGNR

SEQ ID NO: 5461 - protein, 29 aa, Artificial Sequence
  Description of Artificial Sequence: Synthetic peptide
DEENIRTTNPVATEQYGSVSTNLQRGDNR

SEQ ID NO: 5462 - protein, 28 aa, Artificial Sequence
  Description of Artificial Sequence: Synthetic peptide
DENEIRTTNPVATEQYGSVSTNLQRGNA

SEQ ID NO: 5463 - protein, 28 aa, Artificial Sequence
  Description of Artificial Sequence: Synthetic peptide
DEEEIRTTNPVATEQYGSVSTDLQRGNN

SEQ ID NO: 5464 - protein, 28 aa, Artificial Sequence
  Description of Artificial Sequence: Synthetic peptide
DPEEIRTTNPVATEQYGSVSTNGQRGNR

SEQ ID NO: 5465 - protein, 29 aa, Artificial Sequence
  Description of Artificial Sequence: Synthetic peptide
DEEEIATTNPVATEQYGSVSTNLQRGENR

SEQ ID NO: 5466 - protein, 28 aa, Artificial Sequence
  Description of Artificial Sequence: Synthetic peptide
DEEEIRTTNPVAYEQYGSVSTNLQRGQR

SEQ ID NO: 5467 - protein, 28 aa, Artificial Sequence
  Description of Artificial Sequence: Synthetic peptide
DEEEIRGTNPVATEQYGSVSTNTQRGNR

SEQ ID NO: 5468 - protein, 28 aa, Artificial Sequence
  Description of Artificial Sequence: Synthetic peptide
DEEEIRTTNPTATEMYGSVSTNLQRGNR

SEQ ID NO: 5469 - protein, 28 aa, Artificial Sequence
  Description of Artificial Sequence: Synthetic peptide
AEEEIRTTNPVATEQYGCVSTNLQRGNR

SEQ ID NO: 5470 - protein, 28 aa, Artificial Sequence
  Description of Artificial Sequence: Synthetic peptide
DEEEIRSTNPVATEQYGSVSTNLQGGNR

SEQ ID NO: 5471 - protein, 29 aa, Artificial Sequence
  Description of Artificial Sequence: Synthetic peptide
DEEEIRTTNPVATEQYGDSVSTNLQRGER

SEQ ID NO: 5472 - protein, 28 aa, Artificial Sequence
  Description of Artificial Sequence: Synthetic peptide
DEVEISTTNPVATEQYGSVSTNLQRGNR

SEQ ID NO: 5473 - protein, 28 aa, Artificial Sequence
  Description of Artificial Sequence: Synthetic peptide
IEEEIRTTNPVATEQYGSVSENLQRGNR

SEQ ID NO: 5474 - protein, 28 aa, Artificial Sequence
  Description of Artificial Sequence: Synthetic peptide
REEEIRTTNPVATEQYGSVSTNLERGNR

SEQ ID NO: 5475 - protein, 29 aa, Artificial Sequence
  Description of Artificial Sequence: Synthetic peptide
DEEEIRTTNPVATEQYGSVSTNLQYLGNR

SEQ ID NO: 5476 - protein, 28 aa, Artificial Sequence
  Description of Artificial Sequence: Synthetic peptide
DEEEIRPTNPVATEQYGSVSENLQRGNR

SEQ ID NO: 5477 - protein, 28 aa, Artificial Sequence
  Description of Artificial Sequence: Synthetic peptide
DEEEIRTTNPVATEQYGSVSTNPQRGNE

SEQ ID NO: 5478 - protein, 30 aa, Artificial Sequence
  Description of Artificial Sequence: Synthetic polypeptide
DEEEIRTTNPVATEQYGCSVSTINLQRGNR

SEQ ID NO: 5479 - protein, 29 aa, Artificial Sequence
  Description of Artificial Sequence: Synthetic peptide
DEEEIRTTNPTATEQYGSVSTGNLQRGNR

SEQ ID NO: 5480 - protein, 29 aa, Artificial Sequence
  Description of Artificial Sequence: Synthetic peptide
DEEEIRTTNPVATEQYGSVSTNLQNLGNR

SEQ ID NO: 5481 - protein, 28 aa, Artificial Sequence
  Description of Artificial Sequence: Synthetic peptide
DEEEIRTVNPVATEQYGSVSTNLQHGNR

SEQ ID NO: 5482 - protein, 28 aa, Artificial Sequence
  Description of Artificial Sequence: Synthetic peptide
DEEEIRTTNIVATEQYGSVSENLQRGNR

SEQ ID NO: 5483 - protein, 28 aa, Artificial Sequence
  Description of Artificial Sequence: Synthetic peptide
DLEEIRTTNPVAWEQYGSVSTNLQRGNR

SEQ ID NO: 5484 - protein, 28 aa, Artificial Sequence
  Description of Artificial Sequence: Synthetic peptide
DEEEIRTTNPVATEQYGSVSTNEQRENR

SEQ ID NO: 5485 - protein, 28 aa, Artificial Sequence
  Description of Artificial Sequence: Synthetic peptide
DEEEIRTTNPVATEQYGSVDTNLQRGNI

SEQ ID NO: 5486 - protein, 28 aa, Artificial Sequence
  Description of Artificial Sequence: Synthetic peptide
DEEEIYTTNPVATEQYGSVSTVLQRGNR

SEQ ID NO: 5487 - protein, 28 aa, Artificial Sequence
  Description of Artificial Sequence: Synthetic peptide
DEEEIRTTNPVATEVYGAVSTNLQRGNR

SEQ ID NO: 5488 - protein, 28 aa, Artificial Sequence
  Description of Artificial Sequence: Synthetic peptide
DEEEIRTTNPEATEQYGSVSTNLQRGNH

SEQ ID NO: 5489 - protein, 28 aa, Artificial Sequence
  Description of Artificial Sequence: Synthetic peptide
DEEEIRTTNIVATEQYGSVSDNLQRGNR

SEQ ID NO: 5490 - protein, 30 aa, Artificial Sequence
  Description of Artificial Sequence: Synthetic polypeptide
DEEEIRTTNPVATEQYGSVSSTNLQIRGNR

SEQ ID NO: 5491 - protein, 28 aa, Artificial Sequence
  Description of Artificial Sequence: Synthetic peptide
DEEEIRTTNPVATEQYGFVSTNLQRGNP

SEQ ID NO: 5492 - protein, 28 aa, Artificial Sequence
  Description of Artificial Sequence: Synthetic peptide
DEEEIRTTNPVATEQYGSVSVNLQRGER

SEQ ID NO: 5493 - protein, 29 aa, Artificial Sequence
  Description of Artificial Sequence: Synthetic peptide
DEEEIRTTNPVATEQYGSASTNPLQRGNR

SEQ ID NO: 5494 - protein, 29 aa, Artificial Sequence
  Description of Artificial Sequence: Synthetic peptide
DEEEIRTTNPVATEQYGSVESTNLQRGNY

SEQ ID NO: 5495 - protein, 28 aa, Artificial Sequence
  Description of Artificial Sequence: Synthetic peptide
DEEEIRTTNPVATEQYGSASTNLQVGNR

SEQ ID NO: 5496 - protein, 29 aa, Artificial Sequence
  Description of Artificial Sequence: Synthetic peptide
DEEEIRTTNPVATEQYGSVSTNLQCQGNR

SEQ ID NO: 5497 - protein, 28 aa, Artificial Sequence
  Description of Artificial Sequence: Synthetic peptide
DEHEIRTTNPVATEQYGSVSTNLQVGNR

SEQ ID NO: 5498 - protein, 29 aa, Artificial Sequence
  Description of Artificial Sequence: Synthetic peptide
DEEEIRTTNPVATEQYGIVASTNLQRGNR

SEQ ID NO: 5499 - protein, 28 aa, Artificial Sequence
  Description of Artificial Sequence: Synthetic peptide
DEEEIRTVNPVATEQYGSVSTNLQVGNR

SEQ ID NO: 5500 - protein, 28 aa, Artificial Sequence
  Description of Artificial Sequence: Synthetic peptide
DEEEIVTTNPVASEQYGSVSTNLQRGNR

SEQ ID NO: 5501 - protein, 28 aa, Artificial Sequence
  Description of Artificial Sequence: Synthetic peptide
DEEEIRTTNPVATEQFGSVSTNLQRGPR

SEQ ID NO: 5502 - protein, 28 aa, Artificial Sequence
  Description of Artificial Sequence: Synthetic peptide
DEEEIRTTNPVATFQYGSVSTNLQRGLR

SEQ ID NO: 5503 - protein, 28 aa, Artificial Sequence
  Description of Artificial Sequence: Synthetic peptide
DEEEIYTTNPVATEQYGSVSTNLDRGNR

SEQ ID NO: 5504 - protein, 28 aa, Artificial Sequence
  Description of Artificial Sequence: Synthetic peptide
DEEEIATTNPVATEQYGSVSTNLQTGNR

SEQ ID NO: 5505 - protein, 30 aa, Artificial Sequence
  Description of Artificial Sequence: Synthetic polypeptide
DEEEIRTTNPVATEQYGSVSTNPLQRGENR

SEQ ID NO: 5506 - protein, 28 aa, Artificial Sequence
  Description of Artificial Sequence: Synthetic peptide
DEEEIRTTNPVATEQYGDVSTNLQRGNW

SEQ ID NO: 5507 - protein, 28 aa, Artificial Sequence
  Description of Artificial Sequence: Synthetic peptide
DEDEIRTTNPVATEQYGVVSTNLQRGNR

SEQ ID NO: 5508 - protein, 29 aa, Artificial Sequence
  Description of Artificial Sequence: Synthetic peptide
DEEEIRTTNPVATEQYGSVSTNLQYGNDR

SEQ ID NO: 5509 - protein, 28 aa, Artificial Sequence
  Description of Artificial Sequence: Synthetic peptide
DEEEIRTTNPVATEQYGSVSTLLQRGQR

SEQ ID NO: 5510 - protein, 29 aa, Artificial Sequence
  Description of Artificial Sequence: Synthetic peptide
DEEEIRTTNPVATEQYGSVSTMNLQRGDR

SEQ ID NO: 5511 - protein, 28 aa, Artificial Sequence
  Description of Artificial Sequence: Synthetic peptide
DEEEIRTTNPVATEQYGSVSTNLQIGTR

SEQ ID NO: 5512 - protein, 28 aa, Artificial Sequence
  Description of Artificial Sequence: Synthetic peptide
DEEEIRTTNPVATEQYGSVSLNLQRGNT

SEQ ID NO: 5513 - protein, 29 aa, Artificial Sequence
  Description of Artificial Sequence: Synthetic peptide
DEEEIRCTNPVATEQYGSVSTMNLQRGNR

SEQ ID NO: 5514 - protein, 28 aa, Artificial Sequence
  Description of Artificial Sequence: Synthetic peptide
DEEEIRTTNPVAMEQYGSVSTNLQRGNP

SEQ ID NO: 5515 - protein, 29 aa, Artificial Sequence
  Description of Artificial Sequence: Synthetic peptide
DEEEIRTTNPVATEQYGSVSETNLERGNR

SEQ ID NO: 5516 - protein, 28 aa, Artificial Sequence
  Description of Artificial Sequence: Synthetic peptide
DESEIRTTNIVATEQYGSVSTNLQRGNR

SEQ ID NO: 5517 - protein, 29 aa, Artificial Sequence
  Description of Artificial Sequence: Synthetic peptide
DEEEIRTTNPVATEQYGSVSTNLQLSGNR

SEQ ID NO: 5518 - protein, 28 aa, Artificial Sequence
  Description of Artificial Sequence: Synthetic peptide
DEEEIRTTNPVATEQYGSVSTNQQLGNR

SEQ ID NO: 5519 - protein, 28 aa, Artificial Sequence
  Description of Artificial Sequence: Synthetic peptide
DEEEIRTTNPDATEQYGSVSTNLLRGNR

SEQ ID NO: 5520 - protein, 28 aa, Artificial Sequence
  Description of Artificial Sequence: Synthetic peptide
DEEEIRTTNPVATECYGSVSTNLQDGNR

SEQ ID NO: 5521 - protein, 28 aa, Artificial Sequence
  Description of Artificial Sequence: Synthetic peptide
DEEEIRTTNPVATEQYGDVSTGLQRGNR

SEQ ID NO: 5522 - protein, 29 aa, Artificial Sequence
  Description of Artificial Sequence: Synthetic peptide
DEEEIRTTNPFATEQYGSVSTNLQRGNDR

SEQ ID NO: 5523 - protein, 28 aa, Artificial Sequence
  Description of Artificial Sequence: Synthetic peptide
QEEEIRTTNPVATEQYGSVSTNLQRENR

SEQ ID NO: 5524 - protein, 28 aa, Artificial Sequence
  Description of Artificial Sequence: Synthetic peptide
DEEEIRTTNPVCTEQYGSVSTDLQRGNR

SEQ ID NO: 5525 - protein, 28 aa, Artificial Sequence
  Description of Artificial Sequence: Synthetic peptide
DEEEIRTTNPVCTEMYGSVSTNLQRGNR

SEQ ID NO: 5526 - protein, 29 aa, Artificial Sequence
  Description of Artificial Sequence: Synthetic peptide
DEEEIRTTNPVATEQYGSVSTNLQCRGNQ

SEQ ID NO: 5527 - protein, 28 aa, Artificial Sequence
  Description of Artificial Sequence: Synthetic peptide
DEEEIATTNPVATEQYGSVSTNLQRGNA

SEQ ID NO: 5528 - protein, 28 aa, Artificial Sequence
  Description of Artificial Sequence: Synthetic peptide
MEEEIRTTNPVATEQYGSVSTNLQRGTR

SEQ ID NO: 5529 - protein, 28 aa, Artificial Sequence
  Description of Artificial Sequence: Synthetic peptide
DEEEIRTTNPVATEQYGEVSTNLQLGNR

SEQ ID NO: 5530 - protein, 30 aa, Artificial Sequence
  Description of Artificial Sequence: Synthetic polypeptide
DEEEIRTTNPVATEQYGSVSTNLQFRGENR

SEQ ID NO: 5531 - protein, 28 aa, Artificial Sequence
  Description of Artificial Sequence: Synthetic peptide
DEEEIRTTNPVATEIYGSVSTELQRGNR

SEQ ID NO: 5532 - protein, 28 aa, Artificial Sequence
  Description of Artificial Sequence: Synthetic peptide
DEEYIRTTNPVATEQYGSVSTNLQRGNN

SEQ ID NO: 5533 - protein, 28 aa, Artificial Sequence
  Description of Artificial Sequence: Synthetic peptide
DEEEIRTTNPTATEQYGSVSTNLQRGNQ

SEQ ID NO: 5534 - protein, 28 aa, Artificial Sequence
  Description of Artificial Sequence: Synthetic peptide
DEEEIRTTNPCCTEQYGSVSTNLQRGNR

SEQ ID NO: 5535 - protein, 28 aa, Artificial Sequence
  Description of Artificial Sequence: Synthetic peptide
DEEEIRTTNPVATEQYGSVSTFLQRGNN

SEQ ID NO: 5536 - protein, 28 aa, Artificial Sequence
  Description of Artificial Sequence: Synthetic peptide
DEEEIRTTNPDATEQYGSVSENLQRGNR

SEQ ID NO: 5537 - protein, 28 aa, Artificial Sequence
  Description of Artificial Sequence: Synthetic peptide
DETEIRTTNPVATEQYGAVSTNLQRGNR

SEQ ID NO: 5538 - protein, 28 aa, Artificial Sequence
  Description of Artificial Sequence: Synthetic peptide
DEEEIRTTNPVSTEQWGSVSTNLQRGNR

SEQ ID NO: 5539 - protein, 30 aa, Artificial Sequence
  Description of Artificial Sequence: Synthetic polypeptide
DEEEIRTTNPVATEQYGSVTSTNLQLRGNR

SEQ ID NO: 5540 - protein, 28 aa, Artificial Sequence
  Description of Artificial Sequence: Synthetic peptide
DEEEIRTTNPVATEQYGEVSTNLQRGTR

SEQ ID NO: 5541 - protein, 28 aa, Artificial Sequence
  Description of Artificial Sequence: Synthetic peptide
GEEEIRTTNPVATEQYGDVSTNLQRGNR

SEQ ID NO: 5542 - protein, 28 aa, Artificial Sequence
  Description of Artificial Sequence: Synthetic peptide
DEEEIRTTNPVATELYGSVSNNLQRGNR

SEQ ID NO: 5543 - protein, 28 aa, Artificial Sequence
  Description of Artificial Sequence: Synthetic peptide
DEEEIRTTNPWATEQYGSVSTNHQRGNR

SEQ ID NO: 5544 - protein, 28 aa, Artificial Sequence
  Description of Artificial Sequence: Synthetic peptide
DEEEIRTTNPVATEQYGSVSENLQRGND

SEQ ID NO: 5545 - protein, 29 aa, Artificial Sequence
  Description of Artificial Sequence: Synthetic peptide
DEEEIRTTNPVATEQYGSVSTILQRGDNR

SEQ ID NO: 5546 - protein, 29 aa, Artificial Sequence
  Description of Artificial Sequence: Synthetic peptide
DEEEIRTTNPVATEQYGNVSTNLQRGDNR

SEQ ID NO: 5547 - protein, 29 aa, Artificial Sequence
  Description of Artificial Sequence: Synthetic peptide
DEEEIRTTNPVCTEQYGSVSTNLQQRGNR

SEQ ID NO: 5548 - protein, 28 aa, Artificial Sequence
  Description of Artificial Sequence: Synthetic peptide
DLEEIRTTNPVATEQYGSVSTNLQRGNG

SEQ ID NO: 5549 - protein, 28 aa, Artificial Sequence
  Description of Artificial Sequence: Synthetic peptide
DEEEIATTNPVATECYGSVSTNLQRGNR

SEQ ID NO: 5550 - protein, 28 aa, Artificial Sequence
  Description of Artificial Sequence: Synthetic peptide
DEEEIRTTNPVATEQYGEVSTNLQRGDR

SEQ ID NO: 5551 - protein, 28 aa, Artificial Sequence
  Description of Artificial Sequence: Synthetic peptide
DEEEIATTNPVATEQYGSCSTNLQRGNR

SEQ ID NO: 5552 - protein, 28 aa, Artificial Sequence
  Description of Artificial Sequence: Synthetic peptide
DEEEIRTTNPTATEQYGSVSTNLDRGNR

SEQ ID NO: 5553 - protein, 28 aa, Artificial Sequence
  Description of Artificial Sequence: Synthetic peptide
DEEEIRSTNPVATENYGSVSTNLQRGNR

SEQ ID NO: 5554 - protein, 28 aa, Artificial Sequence
  Description of Artificial Sequence: Synthetic peptide
DEEEIRTTNPVATEQYGSVSTLLMRGNR

SEQ ID NO: 5555 - protein, 28 aa, Artificial Sequence
  Description of Artificial Sequence: Synthetic peptide
DEEEIRTTNPVATEYYGSVSTNLQRGNA

SEQ ID NO: 5556 - protein, 28 aa, Artificial Sequence
  Description of Artificial Sequence: Synthetic peptide
REEEIRTTNPVATEQYGSVSYNLQRGNR

SEQ ID NO: 5557 - protein, 28 aa, Artificial Sequence
  Description of Artificial Sequence: Synthetic peptide
DEEEIRTTNPVATEQYGSVSENLQRGNH

SEQ ID NO: 5558 - protein, 30 aa, Artificial Sequence
  Description of Artificial Sequence: Synthetic polypeptide
DEEEIRTTNPVATEQYGASVSCTNLQRGNR

SEQ ID NO: 5559 - protein, 28 aa, Artificial Sequence
  Description of Artificial Sequence: Synthetic peptide
DEEEIRTTNPVATEQYGSVSTNLLRGND

SEQ ID NO: 5560 - protein, 28 aa, Artificial Sequence
  Description of Artificial Sequence: Synthetic peptide
DEEEIRTTNPVATLQYGSVSTNLQPGNR

SEQ ID NO: 5561 - protein, 29 aa, Artificial Sequence
  Description of Artificial Sequence: Synthetic peptide
DEEEIRTTNPVATEQYGSVSTNLQIEGNR

SEQ ID NO: 5562 - protein, 28 aa, Artificial Sequence
  Description of Artificial Sequence: Synthetic peptide
DEEEIRTTNPVATEQYGSVDENLQRGNR

SEQ ID NO: 5563 - protein, 29 aa, Artificial Sequence
  Description of Artificial Sequence: Synthetic peptide
YEEEIRTTNPVATEQYGSVSTNLQQRGNR

SEQ ID NO: 5564 - protein, 28 aa, Artificial Sequence
  Description of Artificial Sequence: Synthetic peptide
DEEEITTTNPVATEQYGSVSTNLQTGNR

SEQ ID NO: 5565 - protein, 29 aa, Artificial Sequence
  Description of Artificial Sequence: Synthetic peptide
DEEEIRTTNPVATEQYGSVSTGLTQRGNR

SEQ ID NO: 5566 - protein, 29 aa, Artificial Sequence
  Description of Artificial Sequence: Synthetic peptide
DEEEIRTTNPVATEQYGSVDTNLQIRGNR

SEQ ID NO: 5567 - protein, 28 aa, Artificial Sequence
  Description of Artificial Sequence: Synthetic peptide
DEEEIRTTNPVATEVYGSVSTNLQYGNR

SEQ ID NO: 5568 - protein, 29 aa, Artificial Sequence
  Description of Artificial Sequence: Synthetic peptide
DEEEIRTTNPVATEQYGSVSHNLQERGNR

SEQ ID NO: 5569 - protein, 28 aa, Artificial Sequence
  Description of Artificial Sequence: Synthetic peptide
LEEEICTTNPVATEQYGSVSTNLQRGNR

SEQ ID NO: 5570 - protein, 28 aa, Artificial Sequence
  Description of Artificial Sequence: Synthetic peptide
DESEIRTTNPVATEQYGSVSTNLQRGNM

SEQ ID NO: 5571 - protein, 28 aa, Artificial Sequence
  Description of Artificial Sequence: Synthetic peptide
DEEEIRTTNPVATEQYGSVSTNEQHGNR

SEQ ID NO: 5572 - protein, 28 aa, Artificial Sequence
  Description of Artificial Sequence: Synthetic peptide
DEEEIRTTNPVATECYGSVSTNLQRGNS

SEQ ID NO: 5573 - protein, 28 aa, Artificial Sequence
  Description of Artificial Sequence: Synthetic peptide
DENEIRTTNPVATEQYGSVSTNLERGNR

SEQ ID NO: 5574 - protein, 28 aa, Artificial Sequence
  Description of Artificial Sequence: Synthetic peptide
DEEEIRTVNPVATEQYGWVSTNLQRGNR

SEQ ID NO: 5575 - protein, 29 aa, Artificial Sequence
  Description of Artificial Sequence: Synthetic peptide
DEEEIRTTNPEATEQYGSVSTNLQRGDNR

SEQ ID NO: 5576 - protein, 28 aa, Artificial Sequence
  Description of Artificial Sequence: Synthetic peptide
DEEEIRTTNPTATEQYGSVSTNPQRGNR

SEQ ID NO: 5577 - protein, 28 aa, Artificial Sequence
  Description of Artificial Sequence: Synthetic peptide
DEMEICTTNPVATEQYGSVSTNLQRGNR

SEQ ID NO: 5578 - protein, 28 aa, Artificial Sequence
  Description of Artificial Sequence: Synthetic peptide
DEQEIRTTNPVASEQYGSVSTNLQRGNR

SEQ ID NO: 5579 - protein, 28 aa, Artificial Sequence
  Description of Artificial Sequence: Synthetic peptide
DEEEVRTTNPVATEQYGSASTNLQRGNR

SEQ ID NO: 5580 - protein, 28 aa, Artificial Sequence
  Description of Artificial Sequence: Synthetic peptide
DEEEIRTTNPVATEQYGSVSTNLQQGNV

SEQ ID NO: 5581 - protein, 30 aa, Artificial Sequence
  Description of Artificial Sequence: Synthetic polypeptide
DEEEIRTTNPVATEQYGSVSDTNLQRGNER

SEQ ID NO: 5582 - protein, 28 aa, Artificial Sequence
  Description of Artificial Sequence: Synthetic peptide
DEEEIRTTNPVATEQYGSVDTNLQRGNM

SEQ ID NO: 5583 - protein, 28 aa, Artificial Sequence
  Description of Artificial Sequence: Synthetic peptide
DEEEIRTTNPCATEQYGSVSTNLQRGNW

SEQ ID NO: 5584 - protein, 28 aa, Artificial Sequence
  Description of Artificial Sequence: Synthetic peptide
DEEEIRTTNPVATEQFGSVSTNLQRGTR

SEQ ID NO: 5585 - protein, 28 aa, Artificial Sequence
  Description of Artificial Sequence: Synthetic peptide
DEEEIRTTNPVATEQYGSVSTNLMRMNR

SEQ ID NO: 5586 - protein, 28 aa, Artificial Sequence
  Description of Artificial Sequence: Synthetic peptide
DEEEIRTTNPVATEQYGSVGTNLQRLNR

SEQ ID NO: 5587 - protein, 28 aa, Artificial Sequence
  Description of Artificial Sequence: Synthetic peptide
DEEEIRTTNPVATEQYGSVSTNLQTGNC

SEQ ID NO: 5588 - protein, 28 aa, Artificial Sequence
  Description of Artificial Sequence: Synthetic peptide
DEEEIRTTNPVATEQYGSVSTILQRGNA

SEQ ID NO: 5589 - protein, 28 aa, Artificial Sequence
  Description of Artificial Sequence: Synthetic peptide
DEEEIRTTNPVATEQYGSVSTNEQLGNR

SEQ ID NO: 5590 - protein, 28 aa, Artificial Sequence
  Description of Artificial Sequence: Synthetic peptide
DEEEIRTTNPEATEQYGSVSTNLQRGNF

SEQ ID NO: 5591 - protein, 28 aa, Artificial Sequence
  Description of Artificial Sequence: Synthetic peptide
KEEEIRTTNPVATEQYGSVSTNDQRGNR

SEQ ID NO: 5592 - protein, 29 aa, Artificial Sequence
  Description of Artificial Sequence: Synthetic peptide
DEEEIRTTNPVATEQYGSVSTNLQFGANR

SEQ ID NO: 5593 - protein, 28 aa, Artificial Sequence
  Description of Artificial Sequence: Synthetic peptide
DEEEIRTTNPVATEQYGSVSTELQTGNR

SEQ ID NO: 5594 - protein, 28 aa, Artificial Sequence
  Description of Artificial Sequence: Synthetic peptide
DEEEIRTTNPVATEQYNSVSTNLQQGNR

SEQ ID NO: 5595 - protein, 28 aa, Artificial Sequence
  Description of Artificial Sequence: Synthetic peptide
DEEEIRTTNPVATEVYGSVSTNLQHGNR

SEQ ID NO: 5596 - protein, 28 aa, Artificial Sequence
  Description of Artificial Sequence: Synthetic peptide
DEEEIRTTNPVATEQYGCVSTNLQAGNR

SEQ ID NO: 5597 - protein, 28 aa, Artificial Sequence
  Description of Artificial Sequence: Synthetic peptide
SEEEIRTTNPVATEQYGSVSTPLQRGNR

SEQ ID NO: 5598 - protein, 29 aa, Artificial Sequence
  Description of Artificial Sequence: Synthetic peptide
DEEEIRTTNPVATEQYGSVSTNLQIQGNR

SEQ ID NO: 5599 - protein, 30 aa, Artificial Sequence
  Description of Artificial Sequence: Synthetic polypeptide
DEEEIRTTNPVATEQYGSVSITNLQREGNR

SEQ ID NO: 5600 - protein, 28 aa, Artificial Sequence
  Description of Artificial Sequence: Synthetic peptide
KEEEIRTTNPVATEQYGSVSTNEQRGNR

SEQ ID NO: 5601 - protein, 28 aa, Artificial Sequence
  Description of Artificial Sequence: Synthetic peptide
DEEEIRTTNPTATEQYGSVSTNLQRGDR

SEQ ID NO: 5602 - protein, 28 aa, Artificial Sequence
  Description of Artificial Sequence: Synthetic peptide
DEEEIRTTNPVAYEQYGSVSTNLQDGNR

SEQ ID NO: 5603 - protein, 28 aa, Artificial Sequence
  Description of Artificial Sequence: Synthetic peptide
DEEEIRTTNPVCTECYGSVSTNLQRGNR

SEQ ID NO: 5604 - protein, 28 aa, Artificial Sequence
  Description of Artificial Sequence: Synthetic peptide
DEEEIRTTNPVATENYGSVSTNDQRGNR

SEQ ID NO: 5605 - protein, 30 aa, Artificial Sequence
  Description of Artificial Sequence: Synthetic polypeptide
DEEEIRTTNPVATEQYGSVSTNLQRGVNPR

SEQ ID NO: 5606 - protein, 28 aa, Artificial Sequence
  Description of Artificial Sequence: Synthetic peptide
DEEEITTTNPVATEQYGSVSTELQRGNR

SEQ ID NO: 5607 - protein, 28 aa, Artificial Sequence
  Description of Artificial Sequence: Synthetic peptide
DEEEIRTTNPVATEQYGSVSTDLQHGNR

SEQ ID NO: 5608 - protein, 28 aa, Artificial Sequence
  Description of Artificial Sequence: Synthetic peptide
DEEEICTTNPVATEQYGSVSTNLQRGNI

SEQ ID NO: 5609 - protein, 30 aa, Artificial Sequence
  Description of Artificial Sequence: Synthetic polypeptide
DEEEIRTTNPVATEQYGSVSDTNLQRGDNR

SEQ ID NO: 5610 - protein, 28 aa, Artificial Sequence
  Description of Artificial Sequence: Synthetic peptide
DEEEIRTTNPVATAQYGSVSTNLQIGNR

SEQ ID NO: 5611 - protein, 28 aa, Artificial Sequence
  Description of Artificial Sequence: Synthetic peptide
DEEEIRTTNPVATEQYGSVSTDLQRGND

SEQ ID NO: 5612 - protein, 29 aa, Artificial Sequence
  Description of Artificial Sequence: Synthetic peptide
DEEEIRTTNPVATEQYGSVSATNLQVGNR

SEQ ID NO: 5613 - protein, 29 aa, Artificial Sequence
  Description of Artificial Sequence: Synthetic peptide
DEEEIRCTNPVATEQYGSVSATNLQRGNR

SEQ ID NO: 5614 - protein, 28 aa, Artificial Sequence
  Description of Artificial Sequence: Synthetic peptide
DEEEIRTTNPVATEQYGSVSTNLQSGNW

SEQ ID NO: 5615 - protein, 28 aa, Artificial Sequence
  Description of Artificial Sequence: Synthetic peptide
DEEEISTTNPVATEQYGSVSTNLQRGNA

SEQ ID NO: 5616 - protein, 28 aa, Artificial Sequence
  Description of Artificial Sequence: Synthetic peptide
DEEEIRTTNPVATEQYGSVSTNLQIGNH

SEQ ID NO: 5617 - protein, 28 aa, Artificial Sequence
  Description of Artificial Sequence: Synthetic peptide
DEEEIRTTNPVATEMYGSVSTNLQHGNR

SEQ ID NO: 5618 - protein, 29 aa, Artificial Sequence
  Description of Artificial Sequence: Synthetic peptide
DEEELRTTNPVATEQYGSVSTNLQRMGNR

SEQ ID NO: 5619 - protein, 28 aa, Artificial Sequence
  Description of Artificial Sequence: Synthetic peptide
DEEEIRTTNPVATEQYGSVSDNLQRTNR

SEQ ID NO: 5620 - protein, 28 aa, Artificial Sequence
  Description of Artificial Sequence: Synthetic peptide
DEEEIRSTNPVATEQYGSVSENLQRGNR

SEQ ID NO: 5621 - protein, 28 aa, Artificial Sequence
  Description of Artificial Sequence: Synthetic peptide
ADEEIRTTNPVATEQYGSVSTNLQRGNR

SEQ ID NO: 5622 - protein, 28 aa, Artificial Sequence
  Description of Artificial Sequence: Synthetic peptide
DEEEIRTTNPVATEVYGWVSTNLQRGNR

SEQ ID NO: 5623 - protein, 30 aa, Artificial Sequence
  Description of Artificial Sequence: Synthetic polypeptide
DEEEIRTTNPVATEQYGSVFSITNLQRGNR

SEQ ID NO: 5624 - protein, 28 aa, Artificial Sequence
  Description of Artificial Sequence: Synthetic peptide
DEEEIRTTNPVATEQYGSVETNLQIGNR

SEQ ID NO: 5625 - protein, 28 aa, Artificial Sequence
  Description of Artificial Sequence: Synthetic peptide
DEEEIRTTNPVATEQYGSVSTNLQHGQR

SEQ ID NO: 5626 - protein, 28 aa, Artificial Sequence
  Description of Artificial Sequence: Synthetic peptide
GEEEIRTTNPVSTEQYGSVSTNLQRGNR

SEQ ID NO: 5627 - protein, 28 aa, Artificial Sequence
  Description of Artificial Sequence: Synthetic peptide
DEQEIRTTNPVATEQYGSVSTNLQRGNA

SEQ ID NO: 5628 - protein, 28 aa, Artificial Sequence
  Description of Artificial Sequence: Synthetic peptide
DEEEIRTTNPVATEQYGSVSTVLQRGNL

SEQ ID NO: 5629 - protein, 28 aa, Artificial Sequence
  Description of Artificial Sequence: Synthetic peptide
DEEEIVTTNPVATEPYGSVSTNLQRGNR

SEQ ID NO: 5630 - protein, 28 aa, Artificial Sequence
  Description of Artificial Sequence: Synthetic peptide
DEEEIRATNPVATEQYGSVSTNLQRGNT

SEQ ID NO: 5631 - protein, 29 aa, Artificial Sequence
  Description of Artificial Sequence: Synthetic peptide
DEEEIRTTNPVATEQYGSVSCTNDQRGNR

SEQ ID NO: 5632 - protein, 28 aa, Artificial Sequence
  Description of Artificial Sequence: Synthetic peptide
DEEEIRPTNPVATEQYGSVSTNLQGGNR

SEQ ID NO: 5633 - protein, 28 aa, Artificial Sequence
  Description of Artificial Sequence: Synthetic peptide
DEEEIRTTNPVATEQYGSVDTNLQRDNR

SEQ ID NO: 5634 - protein, 28 aa, Artificial Sequence
  Description of Artificial Sequence: Synthetic peptide
DEEEIRTTNPVATEQYGSVSENLQGGNR

SEQ ID NO: 5635 - protein, 28 aa, Artificial Sequence
  Description of Artificial Sequence: Synthetic peptide
DEEEIRTTNPVATEQYGSVPTNLQRGER

SEQ ID NO: 5636 - protein, 30 aa, Artificial Sequence
  Description of Artificial Sequence: Synthetic polypeptide
DEEEIRTTNPVATEQYGSVRSTNLEQRGNR

SEQ ID NO: 5637 - protein, 29 aa, Artificial Sequence
  Description of Artificial Sequence: Synthetic peptide
DEEEIRTTNPVATEQYGSVSTNLERNGNR

SEQ ID NO: 5638 - protein, 30 aa, Artificial Sequence
  Description of Artificial Sequence: Synthetic polypeptide
DEEEIRTTNPVATEQYGSAVSITNLQRGNR

SEQ ID NO: 5639 - protein, 29 aa, Artificial Sequence
  Description of Artificial Sequence: Synthetic peptide
DEEEIRTTNPVATEQYGSVSTNLQDRGNI

SEQ ID NO: 5640 - protein, 28 aa, Artificial Sequence
  Description of Artificial Sequence: Synthetic peptide
DEEEIRTTNPVATEQYGSVSTELQVGNR

SEQ ID NO: 5641 - protein, 28 aa, Artificial Sequence
  Description of Artificial Sequence: Synthetic peptide
DEEEIRTTNPVATEPYGSVSTNLQRGNT

SEQ ID NO: 5642 - protein, 28 aa, Artificial Sequence
  Description of Artificial Sequence: Synthetic peptide
DEEEIRTTNPVATEQYGSVSTNLMRENR

SEQ ID NO: 5643 - protein, 28 aa, Artificial Sequence
  Description of Artificial Sequence: Synthetic peptide
DEEEIRTTNPVACEQYGSCSTNLQRGNR

SEQ ID NO: 5644 - protein, 29 aa, Artificial Sequence
  Description of Artificial Sequence: Synthetic peptide
DEEEIRTTNPIATEQYGSVDSTNLQRGNR

SEQ ID NO: 5645 - protein, 30 aa, Artificial Sequence
  Description of Artificial Sequence: Synthetic polypeptide
DEEEIRTTNPVATEQYGSVESTNLQRGNDR

SEQ ID NO: 5646 - protein, 29 aa, Artificial Sequence
  Description of Artificial Sequence: Synthetic peptide
DEEEIRTTNPVATEQYGSVSTNLDRGGNR

SEQ ID NO: 5647 - protein, 29 aa, Artificial Sequence
  Description of Artificial Sequence: Synthetic peptide
DEEEIATTNPVATEQYGSVSTNLQRGNDR

SEQ ID NO: 5648 - protein, 28 aa, Artificial Sequence
  Description of Artificial Sequence: Synthetic peptide
DEEEIRTTNPVATEQYGSASTNLQRGQR

SEQ ID NO: 5649 - protein, 28 aa, Artificial Sequence
  Description of Artificial Sequence: Synthetic peptide
DEEEINTTNPVATEQYGSVSCNLQRGNR

SEQ ID NO: 5650 - protein, 28 aa, Artificial Sequence
  Description of Artificial Sequence: Synthetic peptide
DEEEIRTTNPVATEQYGSVSHNLDRGNR

SEQ ID NO: 5651 - protein, 28 aa, Artificial Sequence
  Description of Artificial Sequence: Synthetic peptide
DEQEIRTTNPVATEQYGSVSTNLERGNR

SEQ ID NO: 5652 - protein, 29 aa, Artificial Sequence
  Description of Artificial Sequence: Synthetic peptide
DEEEIRTTNPVATEQYGSVSTELPQRGNR

SEQ ID NO: 5653 - protein, 28 aa, Artificial Sequence
  Description of Artificial Sequence: Synthetic peptide
DEEEIRTTNPVATEQYWSVSTNLQRGER

SEQ ID NO: 5654 - protein, 30 aa, Artificial Sequence
  Description of Artificial Sequence: Synthetic polypeptide
DEEEIRTTNPVATEQYGMSVSTENLQRGNR

SEQ ID NO: 5655 - protein, 28 aa, Artificial Sequence
  Description of Artificial Sequence: Synthetic peptide
DEEEIRTTNIVATEQYGDVSTNLQRGNR

SEQ ID NO: 5656 - protein, 29 aa, Artificial Sequence
  Description of Artificial Sequence: Synthetic peptide
DEEEIRTTNPVATEQYGSVDTNLQLRGNR

SEQ ID NO: 5657 - protein, 28 aa, Artificial Sequence
  Description of Artificial Sequence: Synthetic peptide
DEEEIRTTNPVATEQYGSVSTNLQAGNG

SEQ ID NO: 5658 - protein, 29 aa, Artificial Sequence
  Description of Artificial Sequence: Synthetic peptide
DEEEIRTTNPVATEQYGSVSNNLQRSGNR

SEQ ID NO: 5659 - protein, 28 aa, Artificial Sequence
  Description of Artificial Sequence: Synthetic peptide
DEEEIETTNPVATEQYGSVSTLLQRGNR

SEQ ID NO: 5660 - protein, 28 aa, Artificial Sequence
  Description of Artificial Sequence: Synthetic peptide
DEEEILTTNPVATEQYGSVSTNLQTGNR

SEQ ID NO: 5661 - protein, 28 aa, Artificial Sequence
  Description of Artificial Sequence: Synthetic peptide
DEEEIRTTNPVATEQYGSVSTNLQFGNS

SEQ ID NO: 5662 - protein, 28 aa, Artificial Sequence
  Description of Artificial Sequence: Synthetic peptide
DEEEIRTTNPVCTEQYGSVSTNLQRGNF

SEQ ID NO: 5663 - protein, 28 aa, Artificial Sequence
  Description of Artificial Sequence: Synthetic peptide
DEEEIRTTNPVATEQYGSVSMNLQIGNR

SEQ ID NO: 5664 - protein, 29 aa, Artificial Sequence
  Description of Artificial Sequence: Synthetic peptide
DEEEIRTTNPVATEQYGSVSTNLQILGNR

SEQ ID NO: 5665 - protein, 28 aa, Artificial Sequence
  Description of Artificial Sequence: Synthetic peptide
DEEEIRTTNPVATEIYGCVSTNLQRGNR

SEQ ID NO: 5666 - protein, 28 aa, Artificial Sequence
  Description of Artificial Sequence: Synthetic peptide
DEEEIRTTNPVATETYGSVGTNLQRGNR

SEQ ID NO: 5667 - protein, 28 aa, Artificial Sequence
  Description of Artificial Sequence: Synthetic peptide
DEEEIRTTNPVATEQWGSVSTNLQRGNQ

SEQ ID NO: 5668 - protein, 28 aa, Artificial Sequence
  Description of Artificial Sequence: Synthetic peptide
DEEEIRTTNPVAWEQYGSVSTNLQPGNR

SEQ ID NO: 5669 - protein, 29 aa, Artificial Sequence
  Description of Artificial Sequence: Synthetic peptide
DEHEIRTTNPVATEQYGSVSTMNLQRGNR

SEQ ID NO: 5670 - protein, 28 aa, Artificial Sequence
  Description of Artificial Sequence: Synthetic peptide
DEEEITTTNPVATEQYGSVSENLQRGNR

SEQ ID NO: 5671 - protein, 28 aa, Artificial Sequence
  Description of Artificial Sequence: Synthetic peptide
DEEEIRTTNPDATEQYGSVSTDLQRGNR

SEQ ID NO: 5672 - protein, 29 aa, Artificial Sequence
  Description of Artificial Sequence: Synthetic peptide
DEEEIRTTNPVATEQYGSVSTNLQRGNDD

SEQ ID NO: 5673 - protein, 28 aa, Artificial Sequence
  Description of Artificial Sequence: Synthetic peptide
DEEEIRTTNIVATEQYGSVDTNLQRGNR

SEQ ID NO: 5674 - protein, 28 aa, Artificial Sequence
  Description of Artificial Sequence: Synthetic peptide
DEEEIRTTNPVATEQYGSVSTNLQMGDR

SEQ ID NO: 5675 - protein, 28 aa, Artificial Sequence
  Description of Artificial Sequence: Synthetic peptide
DEEEIATTNPVATEQYGSVDTNLQRGNR

SEQ ID NO: 5676 - protein, 28 aa, Artificial Sequence
  Description of Artificial Sequence: Synthetic peptide
DEEEIRTTNPVATEIYGSVSTALQRGNR

SEQ ID NO: 5677 - protein, 28 aa, Artificial Sequence
  Description of Artificial Sequence: Synthetic peptide
DEEEIRTTNPVATEQYGSVDTNLQRGNF

SEQ ID NO: 5678 - protein, 28 aa, Artificial Sequence
  Description of Artificial Sequence: Synthetic peptide
DEEEIRTTNCVATEQYGSVSTNLQRGLR

SEQ ID NO: 5679 - protein, 28 aa, Artificial Sequence
  Description of Artificial Sequence: Synthetic peptide
DEEEIRTTNPAATEQYGSVSENLQRGNR

SEQ ID NO: 5680 - protein, 28 aa, Artificial Sequence
  Description of Artificial Sequence: Synthetic peptide
DEEEIRTTNPVATEQYGSVGTELQRGNR

SEQ ID NO: 5681 - protein, 28 aa, Artificial Sequence
  Description of Artificial Sequence: Synthetic peptide
DEEEIRTTNPVATEQYGSVSTGLQIGNR

SEQ ID NO: 5682 - protein, 28 aa, Artificial Sequence
  Description of Artificial Sequence: Synthetic peptide
KEEEIRTTNPVATEQYGSVSTNLQQGNR

SEQ ID NO: 5683 - protein, 30 aa, Artificial Sequence
  Description of Artificial Sequence: Synthetic polypeptide
DEEEIRTTNPVATEQYGSVSTNLQRGVENR

SEQ ID NO: 5684 - protein, 28 aa, Artificial Sequence
  Description of Artificial Sequence: Synthetic peptide
DEEEIRTTNPVATEQYGSVSTNQQYGNR

SEQ ID NO: 5685 - protein, 28 aa, Artificial Sequence
  Description of Artificial Sequence: Synthetic peptide
DEDEIRTTNPVATEQYGSVSTNPQRGNR

SEQ ID NO: 5686 - protein, 28 aa, Artificial Sequence
  Description of Artificial Sequence: Synthetic peptide
DEEEIRTTNPVATECYGSVSTNLQRGNW

SEQ ID NO: 5687 - protein, 28 aa, Artificial Sequence
  Description of Artificial Sequence: Synthetic peptide
DEEEIVTTNPVATEQYGVVSTNLQRGNR

SEQ ID NO: 5688 - protein, 29 aa, Artificial Sequence
  Description of Artificial Sequence: Synthetic peptide
DEEEIRTTNPVATEQYGSVSTNGLQRLNR

SEQ ID NO: 5689 - protein, 28 aa, Artificial Sequence
  Description of Artificial Sequence: Synthetic peptide
DEEEIRTTNPVATEQYGSVSTNLQHGNC

SEQ ID NO: 5690 - protein, 28 aa, Artificial Sequence
  Description of Artificial Sequence: Synthetic peptide
DEEEIRTTNPVATEQYGSVSTNGQRGNM

SEQ ID NO: 5691 - protein, 28 aa, Artificial Sequence
  Description of Artificial Sequence: Synthetic peptide
DEEEVVTTNPVATEQYGSVSTNLQRGNR

SEQ ID NO: 5692 - protein, 28 aa, Artificial Sequence
  Description of Artificial Sequence: Synthetic peptide
DEEEIRTTNPVATEQYGSVSENLQAGNR

SEQ ID NO: 5693 - protein, 28 aa, Artificial Sequence
  Description of Artificial Sequence: Synthetic peptide
DEEEIRTTNPMATEMYGSVSTNLQRGNR

SEQ ID NO: 5694 - protein, 28 aa, Artificial Sequence
  Description of Artificial Sequence: Synthetic peptide
DEDEIRTTNPVATEQYGSVSTNLQVGNR

SEQ ID NO: 5695 - protein, 29 aa, Artificial Sequence
  Description of Artificial Sequence: Synthetic peptide
DEEEIRTTNPVSTEQYGSVSTNLQRGNDR

SEQ ID NO: 5696 - protein, 28 aa, Artificial Sequence
  Description of Artificial Sequence: Synthetic peptide
DEEEIRTTNPVATEQYGSVSTNLQPGND

SEQ ID NO: 5697 - protein, 29 aa, Artificial Sequence
  Description of Artificial Sequence: Synthetic peptide
DEEEIRTTNPVATEQYGSVSALNLQRGNR

SEQ ID NO: 5698 - protein, 28 aa, Artificial Sequence
  Description of Artificial Sequence: Synthetic peptide
DEEEIRTTNPVATEQYGSVDTNDQRGNR

SEQ ID NO: 5699 - protein, 29 aa, Artificial Sequence
  Description of Artificial Sequence: Synthetic peptide
DEEEIRSTNPVATEQYGSVSTTNLQRGNR

SEQ ID NO: 5700 - protein, 28 aa, Artificial Sequence
  Description of Artificial Sequence: Synthetic peptide
DEEEIRTTNPVATEQYGDVSTNLQRGER

SEQ ID NO: 5701 - protein, 28 aa, Artificial Sequence
  Description of Artificial Sequence: Synthetic peptide
DEEEIRTTNPVATEQYGVVSTNQQRGNR

SEQ ID NO: 5702 - protein, 29 aa, Artificial Sequence
  Description of Artificial Sequence: Synthetic peptide
DEEEIRTTNPVATEQYGSVSENNLQRGNR

SEQ ID NO: 5703 - protein, 29 aa, Artificial Sequence
  Description of Artificial Sequence: Synthetic peptide
DEEEIVTTNPVATEQYGSVSTNLPQRGNR

SEQ ID NO: 5704 - protein, 28 aa, Artificial Sequence
  Description of Artificial Sequence: Synthetic peptide
DEEEIRTTNPVATECYGSVSTELQRGNR

SEQ ID NO: 5705 - protein, 28 aa, Artificial Sequence
  Description of Artificial Sequence: Synthetic peptide
QEEEIRTTNPVATEQYGSVSTNLQRGMR

SEQ ID NO: 5706 - protein, 28 aa, Artificial Sequence
  Description of Artificial Sequence: Synthetic peptide
DEEEIRTTNPVATEQYGSVSTNLQNGNH

SEQ ID NO: 5707 - protein, 28 aa, Artificial Sequence
  Description of Artificial Sequence: Synthetic peptide
DEEEIRTTNPVATEQYGSVSDNPQRGNR

SEQ ID NO: 5708 - protein, 28 aa, Artificial Sequence
  Description of Artificial Sequence: Synthetic peptide
DEEEIRTTNPVATEQYGSVSTNLQTGNL

SEQ ID NO: 5709 - protein, 29 aa, Artificial Sequence
  Description of Artificial Sequence: Synthetic peptide
DEEEIRTTNPVATEQYGSVSCTDLQRGNR

SEQ ID NO: 5710 - protein, 29 aa, Artificial Sequence
  Description of Artificial Sequence: Synthetic peptide
DEEEIRTTNPVATEQYGSVSTMMLQRGNR

SEQ ID NO: 5711 - protein, 28 aa, Artificial Sequence
  Description of Artificial Sequence: Synthetic peptide
SEEEIRTTNPVATEQYGSVSTNLQRGTR

SEQ ID NO: 5712 - protein, 28 aa, Artificial Sequence
  Description of Artificial Sequence: Synthetic peptide
DEEEIRATNPVATEQYGSVSTNLQRGTR

SEQ ID NO: 5713 - protein, 28 aa, Artificial Sequence
  Description of Artificial Sequence: Synthetic peptide
DEEEIRTTNPVATEQYGVVSTNLQGGNR

SEQ ID NO: 5714 - protein, 28 aa, Artificial Sequence
  Description of Artificial Sequence: Synthetic peptide
DEEEIRTTNPVATEQYGDVSTNLERGNR

SEQ ID NO: 5715 - protein, 28 aa, Artificial Sequence
  Description of Artificial Sequence: Synthetic peptide
DEEEIRSTNPVATEQYGSVSTNLQVGNR

SEQ ID NO: 5716 - protein, 29 aa, Artificial Sequence
  Description of Artificial Sequence: Synthetic peptide
DEEEIRTTNPVATEQYGSVSTGNLQYGNR

SEQ ID NO: 5717 - protein, 28 aa, Artificial Sequence
  Description of Artificial Sequence: Synthetic peptide
DEEEIRTTNPVATEQYGSVATNLQRGQR

SEQ ID NO: 5718 - protein, 29 aa, Artificial Sequence
  Description of Artificial Sequence: Synthetic peptide
DEEEIRATNPVATEQYGSVSTNLQREGNR

SEQ ID NO: 5719 - protein, 30 aa, Artificial Sequence
  Description of Artificial Sequence: Synthetic polypeptide
DEEEIRTTNPVATEQYGSVESTNLQRGNER

SEQ ID NO: 5720 - protein, 28 aa, Artificial Sequence
  Description of Artificial Sequence: Synthetic peptide
DESEIRTTNPVATELYGSVSTNLQRGNR

SEQ ID NO: 5721 - protein, 28 aa, Artificial Sequence
  Description of Artificial Sequence: Synthetic peptide
DEEEIRTTNPVATEQYGSVSVALQRGNR

SEQ ID NO: 5722 - protein, 28 aa, Artificial Sequence
  Description of Artificial Sequence: Synthetic peptide
DEEEIRTTNPVATEQYGSTSMNLQRGNR

SEQ ID NO: 5723 - protein, 28 aa, Artificial Sequence
  Description of Artificial Sequence: Synthetic peptide
DEEEIRTTNPFATEQYGSVSTNLQQGNR

SEQ ID NO: 5724 - protein, 28 aa, Artificial Sequence
  Description of Artificial Sequence: Synthetic peptide
DEEEIRTTNPVATEQYGSVSTNLQQGNM

SEQ ID NO: 5725 - protein, 30 aa, Artificial Sequence
  Description of Artificial Sequence: Synthetic polypeptide
DEEEIRTTNPVATEQYGSYVSTNELQRGNR

SEQ ID NO: 5726 - protein, 29 aa, Artificial Sequence
  Description of Artificial Sequence: Synthetic peptide
DEEEIRTTNPVATEQYGSVSTMNLQYGNR

SEQ ID NO: 5727 - protein, 28 aa, Artificial Sequence
  Description of Artificial Sequence: Synthetic peptide
DDEEIRTTNPVATEIYGSVSTNLQRGNR

SEQ ID NO: 5728 - protein, 29 aa, Artificial Sequence
  Description of Artificial Sequence: Synthetic peptide
DEEEIRTTNPVATEQYGSVSTNLQPRGND

SEQ ID NO: 5729 - protein, 29 aa, Artificial Sequence
  Description of Artificial Sequence: Synthetic peptide
DEEEIRTTNPVATEQYGSVSTNLQQRGNQ

SEQ ID NO: 5730 - protein, 28 aa, Artificial Sequence
  Description of Artificial Sequence: Synthetic peptide
DEEEIRTTNPVATEVYGSVSTNEQRGNR

SEQ ID NO: 5731 - protein, 28 aa, Artificial Sequence
  Description of Artificial Sequence: Synthetic peptide
DEEEIRTTNPVATELYGSTSTNLQRGNR

SEQ ID NO: 5732 - protein, 28 aa, Artificial Sequence
  Description of Artificial Sequence: Synthetic peptide
DEEEIRTTNPVATEQYGSVSTNLQRENS

SEQ ID NO: 5733 - protein, 29 aa, Artificial Sequence
  Description of Artificial Sequence: Synthetic peptide
DEEEIRTTNPVATEQYGSVSTNLQAGNDR

SEQ ID NO: 5734 - protein, 29 aa, Artificial Sequence
  Description of Artificial Sequence: Synthetic peptide
DEEEIRTTNPVATEQYGSVSTVLQRLGNR

SEQ ID NO: 5735 - protein, 29 aa, Artificial Sequence
  Description of Artificial Sequence: Synthetic peptide
DEEEIRTTNPVATEQYGSVSTNLQRNGNF

SEQ ID NO: 5736 - protein, 28 aa, Artificial Sequence
  Description of Artificial Sequence: Synthetic peptide
DEEEIRTTNPVATEQYGSVSTNLCRGER

SEQ ID NO: 5737 - protein, 29 aa, Artificial Sequence
  Description of Artificial Sequence: Synthetic peptide
DEEEIRTTNPVATEQYGSVDTNLQTRGNR

SEQ ID NO: 5738 - protein, 28 aa, Artificial Sequence
  Description of Artificial Sequence: Synthetic peptide
DEEEIATTNPVATEQYGSVSTNLQRGNE

SEQ ID NO: 5739 - protein, 29 aa, Artificial Sequence
  Description of Artificial Sequence: Synthetic peptide
DEEEIRTTNPVACEQYGSVSTNGLQRGNR

SEQ ID NO: 5740 - protein, 28 aa, Artificial Sequence
  Description of Artificial Sequence: Synthetic peptide
DEEEIRCTNPVATEQYGSCSTNLQRGNR

SEQ ID NO: 5741 - protein, 28 aa, Artificial Sequence
  Description of Artificial Sequence: Synthetic peptide
DENEIRTTNPVATEQWGSVSTNLQRGNR

SEQ ID NO: 5742 - protein, 28 aa, Artificial Sequence
  Description of Artificial Sequence: Synthetic peptide
DEEEIRTTNPVATEQYGSVSTNDQIGNR

SEQ ID NO: 5743 - protein, 28 aa, Artificial Sequence
  Description of Artificial Sequence: Synthetic peptide
DEEEIRTTNPVATEQYGSISTNLQRGIR

SEQ ID NO: 5744 - protein, 28 aa, Artificial Sequence
  Description of Artificial Sequence: Synthetic peptide
DETEIRTTNPVATEQYGEVSTNLQRGNR

SEQ ID NO: 5745 - protein, 28 aa, Artificial Sequence
  Description of Artificial Sequence: Synthetic peptide
DEEEICTTNPVATETYGSVSTNLQRGNR

SEQ ID NO: 5746 - protein, 29 aa, Artificial Sequence
  Description of Artificial Sequence: Synthetic peptide
DEEEIRTTNPVATEMYGSVSTNLQRGNDR

SEQ ID NO: 5747 - protein, 29 aa, Artificial Sequence
  Description of Artificial Sequence: Synthetic peptide
DEEEIRTTNPVATEQYGSVETNPLQRGNR

SEQ ID NO: 5748 - protein, 28 aa, Artificial Sequence
  Description of Artificial Sequence: Synthetic peptide
DEEEIRQTNPVATEQYGSVSENLQRGNR

SEQ ID NO: 5749 - protein, 28 aa, Artificial Sequence
  Description of Artificial Sequence: Synthetic peptide
HEEEIYTTNPVATEQYGSVSTNLQRGNR

SEQ ID NO: 5750 - protein, 28 aa, Artificial Sequence
  Description of Artificial Sequence: Synthetic peptide
DESEIRTTNPVATEQYGSVSTNLQRGNF

SEQ ID NO: 5751 - protein, 28 aa, Artificial Sequence
  Description of Artificial Sequence: Synthetic peptide
DEEEIRTTNPVATEQYGSVSDNLQRDNR

SEQ ID NO: 5752 - protein, 28 aa, Artificial Sequence
  Description of Artificial Sequence: Synthetic peptide
DEEEIRTTNPVATEQYGFVSTNLWRGNR

SEQ ID NO: 5753 - protein, 28 aa, Artificial Sequence
  Description of Artificial Sequence: Synthetic peptide
DEQEIRTTNPVATEQYGSVSTNLQRGGR

SEQ ID NO: 5754 - protein, 29 aa, Artificial Sequence
  Description of Artificial Sequence: Synthetic peptide
DEEEIRTTNPVATEQYGSVSTNLQNRGNW

SEQ ID NO: 5755 - protein, 28 aa, Artificial Sequence
  Description of Artificial Sequence: Synthetic peptide
DEEEIVTTNPVATEQYGSVSTNLQYGNR

SEQ ID NO: 5756 - protein, 28 aa, Artificial Sequence
  Description of Artificial Sequence: Synthetic peptide
DEEEIRTTNPVATEQYGFVSSNLQRGNR

SEQ ID NO: 5757 - protein, 28 aa, Artificial Sequence
  Description of Artificial Sequence: Synthetic peptide
DEEELRTTNPVATEHYGSVSTNLQRGNR

SEQ ID NO: 5758 - protein, 28 aa, Artificial Sequence
  Description of Artificial Sequence: Synthetic peptide
DEEEIRTTNPVAWEQYGSVSTGLQRGNR

SEQ ID NO: 5759 - protein, 28 aa, Artificial Sequence
  Description of Artificial Sequence: Synthetic peptide
DEEEIATTNPVATEQYGSVSTNLQRGNI

SEQ ID NO: 5760 - protein, 29 aa, Artificial Sequence
  Description of Artificial Sequence: Synthetic peptide
DEEEIRTTNPVASEQYGSVSTNLQRGNDR

SEQ ID NO: 5761 - protein, 28 aa, Artificial Sequence
  Description of Artificial Sequence: Synthetic peptide
DEEEIRTTNPVATEIYGVVSTNLQRGNR

SEQ ID NO: 5762 - protein, 28 aa, Artificial Sequence
  Description of Artificial Sequence: Synthetic peptide
QEEEIRTTNPVATEQYGSVSTNLQRGDR

SEQ ID NO: 5763 - protein, 29 aa, Artificial Sequence
  Description of Artificial Sequence: Synthetic peptide
DEFEIRTTNPVATEQYGSVSTNLQRDGNR

SEQ ID NO: 5764 - protein, 29 aa, Artificial Sequence
  Description of Artificial Sequence: Synthetic peptide
DEEEIRTTNPVATEQYGSVSTNLQINGNR

SEQ ID NO: 5765 - protein, 28 aa, Artificial Sequence
  Description of Artificial Sequence: Synthetic peptide
DEEEIRTTNPVATEQYGSVSTVLQRANR

SEQ ID NO: 5766 - protein, 29 aa, Artificial Sequence
  Description of Artificial Sequence: Synthetic peptide
DEEEIRTTNPVATEQYGSWSTMNLQRGNR

SEQ ID NO: 5767 - protein, 28 aa, Artificial Sequence
  Description of Artificial Sequence: Synthetic peptide
DEEEMRTTNPVATEQYGSVSTNMQRGNR

SEQ ID NO: 5768 - protein, 28 aa, Artificial Sequence
  Description of Artificial Sequence: Synthetic peptide
DEEEIRTTNIVATEQWGSVSTNLQRGNR

SEQ ID NO: 5769 - protein, 29 aa, Artificial Sequence
  Description of Artificial Sequence: Synthetic peptide
DEEEIRTTNPVATEQYGSVSTNLMIRGNR

SEQ ID NO: 5770 - protein, 29 aa, Artificial Sequence
  Description of Artificial Sequence: Synthetic peptide
DEEEIRTTNPVATEQYGSVSTALQVRGNR

SEQ ID NO: 5771 - protein, 28 aa, Artificial Sequence
  Description of Artificial Sequence: Synthetic peptide
KEEEIRTTNPVATEQYGSVSTDLQRGNR

SEQ ID NO: 5772 - protein, 29 aa, Artificial Sequence
  Description of Artificial Sequence: Synthetic peptide
DEEEIRTTNPVATEQYGSVSTNLQERGNH

SEQ ID NO: 5773 - protein, 28 aa, Artificial Sequence
  Description of Artificial Sequence: Synthetic peptide
DEEEIRTTNPVATEQYGSVSSDLQRGNR

SEQ ID NO: 5774 - protein, 28 aa, Artificial Sequence
  Description of Artificial Sequence: Synthetic peptide
DEEEIRTTNPVATEQYGSVSTNLQDGDR

SEQ ID NO: 5775 - protein, 28 aa, Artificial Sequence
  Description of Artificial Sequence: Synthetic peptide
DEEEIRTTNPVATLQYGSVSDNLQRGNR

SEQ ID NO: 5776 - protein, 28 aa, Artificial Sequence
  Description of Artificial Sequence: Synthetic peptide
DEEEIRTTNPVATEQYGSVSNNLQRENR

SEQ ID NO: 5777 - protein, 28 aa, Artificial Sequence
  Description of Artificial Sequence: Synthetic peptide
DEEEIRTTNPVATEQYGSVSTNIERGNR

SEQ ID NO: 5778 - protein, 30 aa, Artificial Sequence
  Description of Artificial Sequence: Synthetic polypeptide
DEEEIRTTNPVATEQYGSVSITNLVQRGNR

SEQ ID NO: 5779 - protein, 29 aa, Artificial Sequence
  Description of Artificial Sequence: Synthetic peptide
DEEEIMTTNPVATEQYGSVSTNGLQRGNR

SEQ ID NO: 5780 - protein, 28 aa, Artificial Sequence
  Description of Artificial Sequence: Synthetic peptide
DEEEIRTTNPVATEQYGSVSTNDQRGNI

SEQ ID NO: 5781 - protein, 29 aa, Artificial Sequence
  Description of Artificial Sequence: Synthetic peptide
DEEEIRTTNPVATEQYGSVSCTNLQRGNC

SEQ ID NO: 5782 - protein, 28 aa, Artificial Sequence
  Description of Artificial Sequence: Synthetic peptide
DEEEIRTTNPVATECYGSVSTNLQHGNR

SEQ ID NO: 5783 - protein, 28 aa, Artificial Sequence
  Description of Artificial Sequence: Synthetic peptide
DEEEIRTTNPVATEQYGSVSTNDQRGNE

SEQ ID NO: 5784 - protein, 28 aa, Artificial Sequence
  Description of Artificial Sequence: Synthetic peptide
DEEEIRTTNPVATEQYGSVSTNLQYGNC

SEQ ID NO: 5785 - protein, 28 aa, Artificial Sequence
  Description of Artificial Sequence: Synthetic peptide
DEEEIRTTNPVGTEQYGSVSTNLQEGNR

SEQ ID NO: 5786 - protein, 28 aa, Artificial Sequence
  Description of Artificial Sequence: Synthetic peptide
DEQEIRTTNPVATEQYGSVSTNEQRGNR

SEQ ID NO: 5787 - protein, 29 aa, Artificial Sequence
  Description of Artificial Sequence: Synthetic peptide
DEEEIRTTNPVATEQYGSVSTMLQRGENR

SEQ ID NO: 5788 - protein, 29 aa, Artificial Sequence
  Description of Artificial Sequence: Synthetic peptide
DEEEIRTTNPVATEQYGSVSTNLQISGNR

SEQ ID NO: 5789 - protein, 28 aa, Artificial Sequence
  Description of Artificial Sequence: Synthetic peptide
DENEIRTTNPVATEQYGSVSTNLQQGNR

SEQ ID NO: 5790 - protein, 29 aa, Artificial Sequence
  Description of Artificial Sequence: Synthetic peptide
DEEEIRTTNPVATEQYGAVSTNLQREGNR

SEQ ID NO: 5791 - protein, 28 aa, Artificial Sequence
  Description of Artificial Sequence: Synthetic peptide
DEEEIRTTNPVATEQFGSVSTNLQRENR

SEQ ID NO: 5792 - protein, 30 aa, Artificial Sequence
  Description of Artificial Sequence: Synthetic polypeptide
DEEEIRTTNPVATEQYGSVSTMNLQLRGNR

SEQ ID NO: 5793 - protein, 28 aa, Artificial Sequence
  Description of Artificial Sequence: Synthetic peptide
DEEEIRTTNPVATEQYGSVSTNLQRGEW

SEQ ID NO: 5794 - protein, 28 aa, Artificial Sequence
  Description of Artificial Sequence: Synthetic peptide
DEEEIRTTNPVATEQFGVVSTNLQRGNR

SEQ ID NO: 5795 - protein, 29 aa, Artificial Sequence
  Description of Artificial Sequence: Synthetic peptide
DEEEIRTTNPVATEQYGDVSTNPLQRGNR

SEQ ID NO: 5796 - protein, 29 aa, Artificial Sequence
  Description of Artificial Sequence: Synthetic peptide
SEEEIRTTNPVATEQYGSVSTNGLQRGNR

SEQ ID NO: 5797 - protein, 28 aa, Artificial Sequence
  Description of Artificial Sequence: Synthetic peptide
DESEIRTTNPVASEQYGSVSTNLQRGNR

SEQ ID NO: 5798 - protein, 28 aa, Artificial Sequence
  Description of Artificial Sequence: Synthetic peptide
DEEEIRTTNPVATEQYGSVSTNLQRENN

SEQ ID NO: 5799 - protein, 28 aa, Artificial Sequence
  Description of Artificial Sequence: Synthetic peptide
DEQEITTTNPVATEQYGSVSTNLQRGNR

SEQ ID NO: 5800 - protein, 30 aa, Artificial Sequence
  Description of Artificial Sequence: Synthetic polypeptide
DEEEIRTTNPVATEQYGSVSTNLPQRGDNR

SEQ ID NO: 5801 - protein, 28 aa, Artificial Sequence
  Description of Artificial Sequence: Synthetic peptide
DEQEIRTTNPVATEHYGSVSTNLQRGNR

SEQ ID NO: 5802 - protein, 28 aa, Artificial Sequence
  Description of Artificial Sequence: Synthetic peptide
DEEEIRTTNPVATEQYGSVSTNLQEGNI

SEQ ID NO: 5803 - protein, 28 aa, Artificial Sequence
  Description of Artificial Sequence: Synthetic peptide
DEEEIRTTNPVATEQWGSWSTNLQRGNR

SEQ ID NO: 5804 - protein, 29 aa, Artificial Sequence
  Description of Artificial Sequence: Synthetic peptide
DEEEIRTTNPVATEQYGSVSGTNLYRGNR

SEQ ID NO: 5805 - protein, 29 aa, Artificial Sequence
  Description of Artificial Sequence: Synthetic peptide
DEEEIRTTNPVATEQYGSCVSTNLQRGPR

SEQ ID NO: 5806 - protein, 28 aa, Artificial Sequence
  Description of Artificial Sequence: Synthetic peptide
DEEEISTTNPVATEQYGSVSTNLQRGNY

SEQ ID NO: 5807 - protein, 29 aa, Artificial Sequence
  Description of Artificial Sequence: Synthetic peptide
DEEEIRTTNPVATEQYGSVSTNLQIRGNF

SEQ ID NO: 5808 - protein, 29 aa, Artificial Sequence
  Description of Artificial Sequence: Synthetic peptide
DEEEIRTTNPVATEQYGSVSTPLQIRGNR

SEQ ID NO: 5809 - protein, 30 aa, Artificial Sequence
  Description of Artificial Sequence: Synthetic polypeptide
DEEEIRTTNPVATEQYGSVMSTNLQRGDNR

SEQ ID NO: 5810 - protein, 29 aa, Artificial Sequence
  Description of Artificial Sequence: Synthetic peptide
DEEGIRTTNPVATEQYGSVSTNLQRGGNR

SEQ ID NO: 5811 - protein, 28 aa, Artificial Sequence
  Description of Artificial Sequence: Synthetic peptide
DEEEIRTTNPVATEQYGSVSTNLERGND

SEQ ID NO: 5812 - protein, 28 aa, Artificial Sequence
  Description of Artificial Sequence: Synthetic peptide
DEEEIRTTNPVATEQYGSVSTNLQQGNS

SEQ ID NO: 5813 - protein, 28 aa, Artificial Sequence
  Description of Artificial Sequence: Synthetic peptide
DEEEIRTTNPVATEMYGSVSTNLQRGND

SEQ ID NO: 5814 - protein, 28 aa, Artificial Sequence
  Description of Artificial Sequence: Synthetic peptide
DEEEIRTTNPVATEQYGSVSTDLQFGNR

SEQ ID NO: 5815 - protein, 28 aa, Artificial Sequence
  Description of Artificial Sequence: Synthetic peptide
DEEEIRTTNPVATEQYGSVSTNLERGER

SEQ ID NO: 5816 - protein, 28 aa, Artificial Sequence
  Description of Artificial Sequence: Synthetic peptide
DEEEIRTTNPVATEQYGSVSTNLQPGNI

SEQ ID NO: 5817 - protein, 29 aa, Artificial Sequence
  Description of Artificial Sequence: Synthetic peptide
DEQEIRTTNPVATEQYGSVSTNLQRGVNR

SEQ ID NO: 5818 - protein, 29 aa, Artificial Sequence
  Description of Artificial Sequence: Synthetic peptide
DEEEIRTTNPVATEQYGSVSDNLTQRGNR

SEQ ID NO: 5819 - protein, 29 aa, Artificial Sequence
  Description of Artificial Sequence: Synthetic peptide
DEEEIRTTNPVATEQYGGVSTNLQREGNR

SEQ ID NO: 5820 - protein, 28 aa, Artificial Sequence
  Description of Artificial Sequence: Synthetic peptide
DEGEIRTTNPVATEQYGSVSTNLQRGNN

SEQ ID NO: 5821 - protein, 28 aa, Artificial Sequence
  Description of Artificial Sequence: Synthetic peptide
KEEEIRTTNPVATEQYGSVSTNLQLGNR

SEQ ID NO: 5822 - protein, 29 aa, Artificial Sequence
  Description of Artificial Sequence: Synthetic peptide
DEEEIRTTNPVATEMYGSVSTNLQDRGNR

SEQ ID NO: 5823 - protein, 28 aa, Artificial Sequence
  Description of Artificial Sequence: Synthetic peptide
DEEEIATTNPVATEQYGSVSTNVQRGNR

SEQ ID NO: 5824 - protein, 28 aa, Artificial Sequence
  Description of Artificial Sequence: Synthetic peptide
DETEIRTTNPVATENYGSVSTNLQRGNR

SEQ ID NO: 5825 - protein, 29 aa, Artificial Sequence
  Description of Artificial Sequence: Synthetic peptide
DEEEIRTTNPIATEQYGSVSTNLQRNGNR

SEQ ID NO: 5826 - protein, 30 aa, Artificial Sequence
  Description of Artificial Sequence: Synthetic polypeptide
DEEEIRTTNPVATEQYGSVISTNLQDRGNR

SEQ ID NO: 5827 - protein, 28 aa, Artificial Sequence
  Description of Artificial Sequence: Synthetic peptide
DEEEIRTTNPVATEQYGSVTTNLQQGNR

SEQ ID NO: 5828 - protein, 28 aa, Artificial Sequence
  Description of Artificial Sequence: Synthetic peptide
DEEEIRTTNPTATEQYGGVSTNLQRGNR

SEQ ID NO: 5829 - protein, 28 aa, Artificial Sequence
  Description of Artificial Sequence: Synthetic peptide
NEEEIRTTNPVATEQYGSYSTNLQRGNR

SEQ ID NO: 5830 - protein, 28 aa, Artificial Sequence
  Description of Artificial Sequence: Synthetic peptide
DEEEIRTTNPVATEQYGSVSTNEQRGNF

SEQ ID NO: 5831 - protein, 28 aa, Artificial Sequence
  Description of Artificial Sequence: Synthetic peptide
QEEEIRTTNPVATEQYGSASTNLQRGNR

SEQ ID NO: 5832 - protein, 28 aa, Artificial Sequence
  Description of Artificial Sequence: Synthetic peptide
DEEEIRQTNPCATEQYGSVSTNLQRGNR

SEQ ID NO: 5833 - protein, 28 aa, Artificial Sequence
  Description of Artificial Sequence: Synthetic peptide
DEEEIRTTNPVACEQYGNVSTNLQRGNR

SEQ ID NO: 5834 - protein, 29 aa, Artificial Sequence
  Description of Artificial Sequence: Synthetic peptide
DEEEIRTTNPVATEQYGSVSTELTQRGNR

SEQ ID NO: 5835 - protein, 28 aa, Artificial Sequence
  Description of Artificial Sequence: Synthetic peptide
NEEEIRTTNPVATEQYGSVSTNLQRGTR

SEQ ID NO: 5836 - protein, 28 aa, Artificial Sequence
  Description of Artificial Sequence: Synthetic peptide
DEEEIRTTNPTAHEQYGSVSTNLQRGNR

SEQ ID NO: 5837 - protein, 28 aa, Artificial Sequence
  Description of Artificial Sequence: Synthetic peptide
DEEEIRTTNPVATEQYGSVFTNLQVGNR

SEQ ID NO: 5838 - protein, 28 aa, Artificial Sequence
  Description of Artificial Sequence: Synthetic peptide
DEEEIRTTNPVATEGYGSVSTNLQRGGR

SEQ ID NO: 5839 - protein, 29 aa, Artificial Sequence
  Description of Artificial Sequence: Synthetic peptide
DEEEIRTTNPVATEQYGSVSTNNLQRGER

SEQ ID NO: 5840 - protein, 28 aa, Artificial Sequence
  Description of Artificial Sequence: Synthetic peptide
DEEEIRTTNPVATEQYGSVSTNLQREER

SEQ ID NO: 5841 - protein, 28 aa, Artificial Sequence
  Description of Artificial Sequence: Synthetic peptide
DEEEIRTTNPVATEQYGSVSTNLQWGDR

SEQ ID NO: 5842 - protein, 29 aa, Artificial Sequence
  Description of Artificial Sequence: Synthetic peptide
DEEEIRTTNPEATEQYGSVSTNLQRGNPR

SEQ ID NO: 5843 - protein, 28 aa, Artificial Sequence
  Description of Artificial Sequence: Synthetic peptide
DEEEIRTTNPVATEQYGSVSTNLQQGNH

SEQ ID NO: 5844 - protein, 28 aa, Artificial Sequence
  Description of Artificial Sequence: Synthetic peptide
DEEEIRSTNPVATEQYGSVSTELQRGNR

SEQ ID NO: 5845 - protein, 28 aa, Artificial Sequence
  Description of Artificial Sequence: Synthetic peptide
DEEEIRTTNPEATEQYGSVSTNLQRGNP

SEQ ID NO: 5846 - protein, 28 aa, Artificial Sequence
  Description of Artificial Sequence: Synthetic peptide
DEEEICTTNIVATEQYGSVSTNLQRGNR

SEQ ID NO: 5847 - protein, 29 aa, Artificial Sequence
  Description of Artificial Sequence: Synthetic peptide
DEEEIWTTNPVATEQYGSVSTNLQRGPNR

SEQ ID NO: 5848 - protein, 28 aa, Artificial Sequence
  Description of Artificial Sequence: Synthetic peptide
DEEEIRTTNPVATEQYGSVSTNLQVGNW

SEQ ID NO: 5849 - protein, 29 aa, Artificial Sequence
  Description of Artificial Sequence: Synthetic peptide
DEEEIRTTNPVATEQYGFSVSTNLQRGQR

SEQ ID NO: 5850 - protein, 29 aa, Artificial Sequence
  Description of Artificial Sequence: Synthetic peptide
MEEEIRTTNPVATEQYGSVSTNLQERGNR

SEQ ID NO: 5851 - protein, 28 aa, Artificial Sequence
  Description of Artificial Sequence: Synthetic peptide
DEEEIRTTNPVATEQYGSVSTGDQRGNR

SEQ ID NO: 5852 - protein, 28 aa, Artificial Sequence
  Description of Artificial Sequence: Synthetic peptide
DEEEIRTTNPVATEQYGIVSTNLQRGNI

SEQ ID NO: 5853 - protein, 28 aa, Artificial Sequence
  Description of Artificial Sequence: Synthetic peptide
DEEEIRTTNPVATEQYGSVPTGLQRGNR

SEQ ID NO: 5854 - protein, 28 aa, Artificial Sequence
  Description of Artificial Sequence: Synthetic peptide
DEEEIRTTNPVATEQYGSVSTNLYRGND

SEQ ID NO: 5855 - protein, 28 aa, Artificial Sequence
  Description of Artificial Sequence: Synthetic peptide
DEQEIRTTNPVATEQYGSVSENLQRGNR

SEQ ID NO: 5856 - protein, 30 aa, Artificial Sequence
  Description of Artificial Sequence: Synthetic polypeptide
DEEEIRTTNPVATEQYGSVSTNGLQDRGNR

SEQ ID NO: 5857 - protein, 28 aa, Artificial Sequence
  Description of Artificial Sequence: Synthetic peptide
DEEEIRTTNPVATEQYGSVETNLQGGNR

SEQ ID NO: 5858 - protein, 28 aa, Artificial Sequence
  Description of Artificial Sequence: Synthetic peptide
DEEEIATTNPVATEQYGFVSTNLQRGNR

SEQ ID NO: 5859 - protein, 28 aa, Artificial Sequence
  Description of Artificial Sequence: Synthetic peptide
DEPEIRTTNPVATEQYGSVSTFLQRGNR

SEQ ID NO: 5860 - protein, 28 aa, Artificial Sequence
  Description of Artificial Sequence: Synthetic peptide
DEEEIRTTNPVSTEQYGSVATNLQRGNR

SEQ ID NO: 5861 - protein, 28 aa, Artificial Sequence
  Description of Artificial Sequence: Synthetic peptide
EEEEIRTTNPVATEQYGSVSTNLQRGNN

SEQ ID NO: 5862 - protein, 28 aa, Artificial Sequence
  Description of Artificial Sequence: Synthetic peptide
SEVEIRTTNPVATEQYGSVSTNLQRGNR

SEQ ID NO: 5863 - protein, 30 aa, Artificial Sequence
  Description of Artificial Sequence: Synthetic polypeptide
DEEEIRTTNPVATEQYGSVSATNLQDRGNR

SEQ ID NO: 5864 - protein, 29 aa, Artificial Sequence
  Description of Artificial Sequence: Synthetic peptide
DEEEIRTTNPVATEQYGAVSTTNLQRGNR

SEQ ID NO: 5865 - protein, 29 aa, Artificial Sequence
  Description of Artificial Sequence: Synthetic peptide
DEEEIRTTNPVATEQYGSVSDENLQRGNR

SEQ ID NO: 5866 - protein, 29 aa, Artificial Sequence
  Description of Artificial Sequence: Synthetic peptide
DEEEIRTTNPVATEQYGSVSTNLQENGNR

SEQ ID NO: 5867 - protein, 28 aa, Artificial Sequence
  Description of Artificial Sequence: Synthetic peptide
DEEEIRTTNPVASELYGSVSTNLQRGNR

SEQ ID NO: 5868 - protein, 28 aa, Artificial Sequence
  Description of Artificial Sequence: Synthetic peptide
DEEEIRTTNPVSTEQYGSVSTVLQRGNR

SEQ ID NO: 5869 - protein, 30 aa, Artificial Sequence
  Description of Artificial Sequence: Synthetic polypeptide
DEEEIRTTNPVATEQYGSVSDTGNLQRGNR

SEQ ID NO: 5870 - protein, 28 aa, Artificial Sequence
  Description of Artificial Sequence: Synthetic peptide
QEEEIVTTNPVATEQYGSVSTNLQRGNR

SEQ ID NO: 5871 - protein, 28 aa, Artificial Sequence
  Description of Artificial Sequence: Synthetic peptide
DEEEIMTTNPVATEQYGSVSTGLQRGNR

SEQ ID NO: 5872 - protein, 28 aa, Artificial Sequence
  Description of Artificial Sequence: Synthetic peptide
DEETIRSTNPVATEQYGSVSTNLQRGNR

SEQ ID NO: 5873 - protein, 29 aa, Artificial Sequence
  Description of Artificial Sequence: Synthetic peptide
AEEEIRTTNPVATEQYGSVSATNLQRGNR

SEQ ID NO: 5874 - protein, 28 aa, Artificial Sequence
  Description of Artificial Sequence: Synthetic peptide
DEEEIRTTNPTATEQYGSVSTDLQRGNR

SEQ ID NO: 5875 - protein, 28 aa, Artificial Sequence
  Description of Artificial Sequence: Synthetic peptide
DEEEIRTTNPVATEQYGSVSTNEQDGNR

SEQ ID NO: 5876 - protein, 29 aa, Artificial Sequence
  Description of Artificial Sequence: Synthetic peptide
DEEEIRTTNPVATEQYGSVSTNLQREGNL

SEQ ID NO: 5877 - protein, 28 aa, Artificial Sequence
  Description of Artificial Sequence: Synthetic peptide
AEEEIRTTNPVATEQYGSVSTNLERGNR

SEQ ID NO: 5878 - protein, 29 aa, Artificial Sequence
  Description of Artificial Sequence: Synthetic peptide
DEEEIRTTNPVATEQYGSVSTNLQRAGNS

SEQ ID NO: 5879 - protein, 28 aa, Artificial Sequence
  Description of Artificial Sequence: Synthetic peptide
DEEEIRTTNPVACEQYGLVSTNLQRGNR

SEQ ID NO: 5880 - protein, 28 aa, Artificial Sequence
  Description of Artificial Sequence: Synthetic peptide
DEEEIRTTNPVATEQYGSVPTNLQRGNA

SEQ ID NO: 5881 - protein, 28 aa, Artificial Sequence
  Description of Artificial Sequence: Synthetic peptide
DEEEIRTTNPVASEQYGSVSNNLQRGNR

SEQ ID NO: 5882 - protein, 28 aa, Artificial Sequence
  Description of Artificial Sequence: Synthetic peptide
DEEEIRTTNPVATEQYGSVSTNLQQGDR

SEQ ID NO: 5883 - protein, 29 aa, Artificial Sequence
  Description of Artificial Sequence: Synthetic peptide
DEEEIRTTNPVATEQYGSVSTNLQDRGNM

SEQ ID NO: 5884 - protein, 28 aa, Artificial Sequence
  Description of Artificial Sequence: Synthetic peptide
DEEEIRTTNPVSTEQYGSVSTELQRGNR

SEQ ID NO: 5885 - protein, 28 aa, Artificial Sequence
  Description of Artificial Sequence: Synthetic peptide
DEEEIRTVNPVATEQYGSVSTVLQRGNR

SEQ ID NO: 5886 - protein, 28 aa, Artificial Sequence
  Description of Artificial Sequence: Synthetic peptide
DEEEIRTVNPVATEQYGSVSTNLQRGNW

SEQ ID NO: 5887 - protein, 28 aa, Artificial Sequence
  Description of Artificial Sequence: Synthetic peptide
DENEIRTTNPVATEQYGSVSTNLQRGNY

SEQ ID NO: 5888 - protein, 28 aa, Artificial Sequence
  Description of Artificial Sequence: Synthetic peptide
DEEEIRTTNPIATEQYGAVSTNLQRGNR

SEQ ID NO: 5889 - protein, 28 aa, Artificial Sequence
  Description of Artificial Sequence: Synthetic peptide
DEEEISATNPVATEQYGSVSTNLQRGNR

SEQ ID NO: 5890 - protein, 29 aa, Artificial Sequence
  Description of Artificial Sequence: Synthetic peptide
DEEEIRTTNPVATEQYGSVSDTNLQPGNR

SEQ ID NO: 5891 - protein, 28 aa, Artificial Sequence
  Description of Artificial Sequence: Synthetic peptide
AEEEIRTTNPVATEQYGSVGTNLQRGNR

SEQ ID NO: 5892 - protein, 29 aa, Artificial Sequence
  Description of Artificial Sequence: Synthetic peptide
DEEEIRTTNPVATEQYGSHYSTNLQRGNR

SEQ ID NO: 5893 - protein, 29 aa, Artificial Sequence
  Description of Artificial Sequence: Synthetic peptide
DEEEIRTTNPVATEQYGSVSTNLQRNGNQ

SEQ ID NO: 5894 - protein, 29 aa, Artificial Sequence
  Description of Artificial Sequence: Synthetic peptide
DEEEIRTTNPVATEQYGSVSTNLQRKGNG

SEQ ID NO: 5895 - protein, 30 aa, Artificial Sequence
  Description of Artificial Sequence: Synthetic polypeptide
DEEEIRTTNPVATEQYGSVSTNLQIRGENR

SEQ ID NO: 5896 - protein, 28 aa, Artificial Sequence
  Description of Artificial Sequence: Synthetic peptide
DEEEIRTTNPVATEQYGSVSTNLQLGNV

SEQ ID NO: 5897 - protein, 28 aa, Artificial Sequence
  Description of Artificial Sequence: Synthetic peptide
DEEEIRTTNPVSTEQYGSVSTNLQRGNF

SEQ ID NO: 5898 - protein, 29 aa, Artificial Sequence
  Description of Artificial Sequence: Synthetic peptide
DEEEIRTTNPVATEQYGSVSTNLQGGNDR

SEQ ID NO: 5899 - protein, 29 aa, Artificial Sequence
  Description of Artificial Sequence: Synthetic peptide
DEEEIRTTNPVATEQYGSVSSTNEQRGNR

SEQ ID NO: 5900 - protein, 28 aa, Artificial Sequence
  Description of Artificial Sequence: Synthetic peptide
DEEEIRCTNPVATEQYGSVSTNLQQGNR

SEQ ID NO: 5901 - protein, 28 aa, Artificial Sequence
  Description of Artificial Sequence: Synthetic peptide
DEEEIRTTNPVATEQYGSVSTFHQRGNR

SEQ ID NO: 5902 - protein, 29 aa, Artificial Sequence
  Description of Artificial Sequence: Synthetic peptide
DEEEIRTTNPVATEQYGSVSTDLQRGENR

SEQ ID NO: 5903 - protein, 30 aa, Artificial Sequence
  Description of Artificial Sequence: Synthetic polypeptide
DEEEIRTTNPVATEQYGSVSETNLQREGNR

SEQ ID NO: 5904 - protein, 29 aa, Artificial Sequence
  Description of Artificial Sequence: Synthetic peptide
DEEEIRTTNPVATEQYGSVSTNLQDRGNW

SEQ ID NO: 5905 - protein, 29 aa, Artificial Sequence
  Description of Artificial Sequence: Synthetic peptide
DEEEIRTTNPVATEQYGSVSTNLQNRGNF

SEQ ID NO: 5906 - protein, 28 aa, Artificial Sequence
  Description of Artificial Sequence: Synthetic peptide
QEEEIRTTNPVATEQYGSVSTNLQTGNR

SEQ ID NO: 5907 - protein, 28 aa, Artificial Sequence
  Description of Artificial Sequence: Synthetic peptide
DEEEIATTNIVATEQYGSVSTNLQRGNR

SEQ ID NO: 5908 - protein, 29 aa, Artificial Sequence
  Description of Artificial Sequence: Synthetic peptide
DEEEIRTTNPVATEQYGSVSETNLQRGDR

SEQ ID NO: 5909 - protein, 30 aa, Artificial Sequence
  Description of Artificial Sequence: Synthetic polypeptide
DEEEIRTTNPVATEQYGSVSTWNLQRGLNR

SEQ ID NO: 5910 - protein, 28 aa, Artificial Sequence
  Description of Artificial Sequence: Synthetic peptide
DEEEIRTTNPVATEQYGSVSTNLQLGNH

SEQ ID NO: 5911 - protein, 29 aa, Artificial Sequence
  Description of Artificial Sequence: Synthetic peptide
DEEEIRTTNPVATEQYGSVSVTGLQRGNR

SEQ ID NO: 5912 - protein, 28 aa, Artificial Sequence
  Description of Artificial Sequence: Synthetic peptide
DDEEIRTTNPVATEQYGSVATNLQRGNR

SEQ ID NO: 5913 - protein, 28 aa, Artificial Sequence
  Description of Artificial Sequence: Synthetic peptide
DEEEIRTTNPVATEQYGSVSVNLQLGNR

SEQ ID NO: 5914 - protein, 28 aa, Artificial Sequence
  Description of Artificial Sequence: Synthetic peptide
DEEEIRTTNPVATEQYGSVSTNLQRGEF

SEQ ID NO: 5915 - protein, 29 aa, Artificial Sequence
  Description of Artificial Sequence: Synthetic peptide
DEEEIRTTNPTATEQYGSVSTENLQRGNR

SEQ ID NO: 5916 - protein, 29 aa, Artificial Sequence
  Description of Artificial Sequence: Synthetic peptide
DEEEIRTTNPVATEQYGSVTSTNLLRGNR

SEQ ID NO: 5917 - protein, 28 aa, Artificial Sequence
  Description of Artificial Sequence: Synthetic peptide
DEEEIRTTNPVATEQYGSVSENLQRGTR

SEQ ID NO: 5918 - protein, 28 aa, Artificial Sequence
  Description of Artificial Sequence: Synthetic peptide
DEEEIRTTNPVATEQYGSVSTNLQNGNV

SEQ ID NO: 5919 - protein, 29 aa, Artificial Sequence
  Description of Artificial Sequence: Synthetic peptide
DEEEIRTTNPVATEMYGSVSATNLQRGNR

SEQ ID NO: 5920 - protein, 28 aa, Artificial Sequence
  Description of Artificial Sequence: Synthetic peptide
DEEEIRTTNPVATEQYGSVSENLQRGNQ

SEQ ID NO: 5921 - protein, 28 aa, Artificial Sequence
  Description of Artificial Sequence: Synthetic peptide
DEEEIRTTNPFATEQYGSVSTNLQNGNR

SEQ ID NO: 5922 - protein, 28 aa, Artificial Sequence
  Description of Artificial Sequence: Synthetic peptide
DENEIRTTNPVATEQYGSVSTNLQRGER

SEQ ID NO: 5923 - protein, 28 aa, Artificial Sequence
  Description of Artificial Sequence: Synthetic peptide
DEEEIRTTNPVATEQYGSVSTNLQRGTY

SEQ ID NO: 5924 - protein, 28 aa, Artificial Sequence
  Description of Artificial Sequence: Synthetic peptide
DEEEIRTTNPVATEQFGSVSTNLQRGER

SEQ ID NO: 5925 - protein, 28 aa, Artificial Sequence
  Description of Artificial Sequence: Synthetic peptide
DEEEIRTTNPEATEQYGSVSTNLQRGNI

SEQ ID NO: 5926 - protein, 28 aa, Artificial Sequence
  Description of Artificial Sequence: Synthetic peptide
DEDEIRTTNPVATEQYGSVSTNLQRGNN

SEQ ID NO: 5927 - protein, 28 aa, Artificial Sequence
  Description of Artificial Sequence: Synthetic peptide
DEEEIRTTNIVATEQYGSVSTGLQRGNR

SEQ ID NO: 5928 - protein, 28 aa, Artificial Sequence
  Description of Artificial Sequence: Synthetic peptide
DEEEIRTTNPVATEQYGGVSTNPQRGNR

SEQ ID NO: 5929 - protein, 28 aa, Artificial Sequence
  Description of Artificial Sequence: Synthetic peptide
CEEEIRTTNPVATEQYGSVSTNLQRGNI

SEQ ID NO: 5930 - protein, 28 aa, Artificial Sequence
  Description of Artificial Sequence: Synthetic peptide
DEEEIRTTNPVAYEQYGSVSTNLDRGNR

SEQ ID NO: 5931 - protein, 28 aa, Artificial Sequence
  Description of Artificial Sequence: Synthetic peptide
DEEEIRTTNPVATEQYGSVSTNLQLGNN

SEQ ID NO: 5932 - protein, 30 aa, Artificial Sequence; identical to SEQ ID NO: 2284
  Description of Artificial Sequence: Synthetic polypeptide

SEQ ID NO: 5933 - protein, 28 aa, Artificial Sequence
  Description of Artificial Sequence: Synthetic peptide
DEEEIRTTNPVATEQYGSVSTNLTFGNR

SEQ ID NO: 5934 - protein, 29 aa, Artificial Sequence
  Description of Artificial Sequence: Synthetic peptide
DEEEIRTTNPVATEQYGEVSTNLQREGNR

SEQ ID NO: 5935 - protein, 28 aa, Artificial Sequence
  Description of Artificial Sequence: Synthetic peptide
DEEEIRATNPVATECYGSVSTNLQRGNR

SEQ ID NO: 5936 - protein, 28 aa, Artificial Sequence
  Description of Artificial Sequence: Synthetic peptide
DEEEIRTTNPVATEQYGSVSTNLQVGTR

SEQ ID NO: 5937 - protein, 28 aa, Artificial Sequence
  Description of Artificial Sequence: Synthetic peptide
DEEEIRTTNPVATEQYGSVSTNLQSGNN

SEQ ID NO: 5938 - protein, 28 aa, Artificial Sequence
  Description of Artificial Sequence: Synthetic peptide
DEEEIRTTNPVATEQYGSVSTNLQRGTW

SEQ ID NO: 5939 - protein, 28 aa, Artificial Sequence
  Description of Artificial Sequence: Synthetic peptide
DEEEIRTTNPVATEQYGSVYTNLQGGNR

SEQ ID NO: 5940 - protein, 28 aa, Artificial Sequence
  Description of Artificial Sequence: Synthetic peptide
DEEEIVTTNPVATEQYGSVSTNLQGGNR

SEQ ID NO: 5941 - protein, 29 aa, Artificial Sequence
  Description of Artificial Sequence: Synthetic peptide
DEEEIRTTNPVATEQYGSVSTNLQHRGNS

SEQ ID NO: 5942 - protein, 28 aa, Artificial Sequence
  Description of Artificial Sequence: Synthetic peptide
DEEEIRTTNPVATEQYGSVSTNLQQGNT

SEQ ID NO: 5943 - protein, 28 aa, Artificial Sequence
  Description of Artificial Sequence: Synthetic peptide
DEEEIRTTNPVATEQYGSVSENLQKGNR

SEQ ID NO: 5944 - protein, 28 aa, Artificial Sequence
  Description of Artificial Sequence: Synthetic peptide
DEEEIRTTNPVATEQYGSVSTNQQRLNR

SEQ ID NO: 5945 - protein, 28 aa, Artificial Sequence
  Description of Artificial Sequence: Synthetic peptide
DEEEIKTTNPVATEQYGSVSTNEQRGNR

SEQ ID NO: 5946 - protein, 28 aa, Artificial Sequence
  Description of Artificial Sequence: Synthetic peptide
DEEEIRTTNPVATEQYGSVDTNLQRGNP

SEQ ID NO: 5947 - protein, 29 aa, Artificial Sequence
  Description of Artificial Sequence: Synthetic peptide
DEEEIRTTNPVATEQYGSVSDTDLQRGNV

SEQ ID NO: 5948 - protein, 28 aa, Artificial Sequence
  Description of Artificial Sequence: Synthetic peptide
DEEEIRTTNPVATEQYGSVSTNPQNGNI

SEQ ID NO: 5949 - protein, 29 aa, Artificial Sequence
  Description of Artificial Sequence: Synthetic peptide
SEEEIRTTNPVATEQYGSTSTNLQRGNSR

SEQ ID NO: 5950 - protein, 29 aa, Artificial Sequence
  Description of Artificial Sequence: Synthetic peptide
DEEEIRTTNPVATEQYGSVSTNLQLVGND

SEQ ID NO: 5951 - protein, 28 aa, Artificial Sequence
  Description of Artificial Sequence: Synthetic peptide
DEEEIRTTNPVATEQYGSMSTDLQRGND

SEQ ID NO: 5952 - protein, 29 aa, Artificial Sequence
  Description of Artificial Sequence: Synthetic peptide
DEEEIRTTNPVATECYGVVSTNLQRNGNR

SEQ ID NO: 5953 - protein, 28 aa, Artificial Sequence
  Description of Artificial Sequence: Synthetic peptide
DEEEIRTTNPVATECYGSVSTNLQEGNL

SEQ ID NO: 5954 - protein, 28 aa, Artificial Sequence
  Description of Artificial Sequence: Synthetic peptide
SEEEIRTTNPFATENYGSVSTNLQRGNR

SEQ ID NO: 5955 - protein, 30 aa, Artificial Sequence
  Description of Artificial Sequence: Synthetic polypeptide
DEEEIRTTNPVATEQYGSVSTNELQQRGQR

SEQ ID NO: 5956 - protein, 29 aa, Artificial Sequence
  Description of Artificial Sequence: Synthetic peptide
DEREIRTTNPVATEQYGSVSTNLQQHGNR

SEQ ID NO: 5957 - protein, 28 aa, Artificial Sequence
  Description of Artificial Sequence: Synthetic peptide
DEEEIRTTNPVATEQYGSVSTALQSGNA

SEQ ID NO: 5958 - protein, 28 aa, Artificial Sequence
  Description of Artificial Sequence: Synthetic peptide
DDEEIRTTNPVATEQYGSVGTNLQRGPR

SEQ ID NO: 5959 - protein, 28 aa, Artificial Sequence
  Description of Artificial Sequence: Synthetic peptide
DEEEIRTTNPSATEQYGSVSTNFQIGNR

SEQ ID NO: 5960 - protein, 28 aa, Artificial Sequence
  Description of Artificial Sequence: Synthetic peptide
DEFEIATTNPVATEQYGNVSTNLQRGNR

SEQ ID NO: 5961 - protein, 29 aa, Artificial Sequence
  Description of Artificial Sequence: Synthetic peptide
DEEEIRTTNPVATEQYGSVSTDLQIRGNS

SEQ ID NO: 5962 - protein, 28 aa, Artificial Sequence
  Description of Artificial Sequence: Synthetic peptide
DEEEIRTTNPVATEQYGSVSTGLQVGNQ

SEQ ID NO: 5963 - protein, 31 aa, Artificial Sequence
  Description of Artificial Sequence: Synthetic polypeptide
DEEEIRTTNPVATEQYGSVTSTNLQRGVNDR

SEQ ID NO: 5964 - protein, 29 aa, Artificial Sequence
  Description of Artificial Sequence: Synthetic peptide
SEEEIRTTNPVATEQYGSVSTNLQRGDNF

SEQ ID NO: 5965 - protein, 31 aa, Artificial Sequence
  Description of Artificial Sequence: Synthetic polypeptide
DEEEIRTTNPVATEQYGSSVYSTNLPQRGNR

SEQ ID NO: 5966 - protein, 29 aa, Artificial Sequence
  Description of Artificial Sequence: Synthetic peptide
DEEEIRTTNPVATEQYGSVSTGLQIPGNR

SEQ ID NO: 5967 - protein, 28 aa, Artificial Sequence
  Description of Artificial Sequence: Synthetic peptide
MEEEIRTTNPVATEQYGSVSTNLQQGNF

SEQ ID NO: 5968 - protein, 28 aa, Artificial Sequence
  Description of Artificial Sequence: Synthetic peptide
DEEEIRTTNPVATEQYGSANTNLQRENR

SEQ ID NO: 5969 - protein, 28 aa, Artificial Sequence
  Description of Artificial Sequence: Synthetic peptide
DEEEIYTTNPVATEQYGSVSTNLQRGDH

SEQ ID NO: 5970 - protein, 29 aa, Artificial Sequence
  Description of Artificial Sequence: Synthetic peptide
DEEEINTTNPVACEQYGSVSATNLQRGNR

SEQ ID NO: 5971 - protein, 28 aa, Artificial Sequence
  Description of Artificial Sequence: Synthetic peptide
DEEEIRTTNPVATEQYGSVDTNLQYGNF

SEQ ID NO: 5972 - protein, 29 aa, Artificial Sequence
  Description of Artificial Sequence: Synthetic peptide
DEESIRTTNPVATEQAYGSVSTNLQHGNR

SEQ ID NO: 5973 - protein, 28 aa, Artificial Sequence
  Description of Artificial Sequence: Synthetic peptide
DEEEIRTTNPVATEQYGNVSTNDQPGNR

SEQ ID NO: 5974 - protein, 28 aa, Artificial Sequence
  Description of Artificial Sequence: Synthetic peptide
DEQEIRTTNPVATEVYGVVSTNLQRGNR

SEQ ID NO: 5975 - protein, 28 aa, Artificial Sequence
  Description of Artificial Sequence: Synthetic peptide
DENEIRTTNPVATEQYGSVSTNLQGGDR

SEQ ID NO: 5976 - protein, 28 aa, Artificial Sequence
  Description of Artificial Sequence: Synthetic peptide
DEEEVRTTNPVATEQYGSVGNNLQRGNR

SEQ ID NO: 5977 - protein, 28 aa, Artificial Sequence
  Description of Artificial Sequence: Synthetic peptide
DEEEIRTTNPVATECYGSVSTNLQQGNL

SEQ ID NO: 5978 - protein, 28 aa, Artificial Sequence
  Description of Artificial Sequence: Synthetic peptide
DEHEIRTTNPVATEQYGSVSTELQAGNR

SEQ ID NO: 5979 - protein, 28 aa, Artificial Sequence
  Description of Artificial Sequence: Synthetic peptide
DEEEIRTTNPTATELYGCVSTNLQRGNR

SEQ ID NO: 5980 - protein, 28 aa, Artificial Sequence
  Description of Artificial Sequence: Synthetic peptide
DEMEIWTTNPVATEQYGSVSDNLQRGNR

SEQ ID NO: 5981 - protein, 28 aa, Artificial Sequence
  Description of Artificial Sequence: Synthetic peptide
DEEEIRTTNPAATEQYGSVSTNLQVGNF

SEQ ID NO: 5982 - protein, 28 aa, Artificial Sequence
  Description of Artificial Sequence: Synthetic peptide
DEEEIRTTNPVATEQYGSVSTNLNEGND

SEQ ID NO: 5983 - protein, 29 aa, Artificial Sequence
  Description of Artificial Sequence: Synthetic peptide
DEEEIRTTNPVATEQYGSVSTNLQENGNM

SEQ ID NO: 5984 - protein, 30 aa, Artificial Sequence
  Description of Artificial Sequence: Synthetic polypeptide
DEEEIRTVNPVATEQYGSVSETNLQRGENR

SEQ ID NO: 5985 - protein, 29 aa, Artificial Sequence
  Description of Artificial Sequence: Synthetic peptide
DEEEIRTTNPVATEQYGSVSTNLMNRGNA

SEQ ID NO: 5986 - protein, 29 aa, Artificial Sequence
  Description of Artificial Sequence: Synthetic peptide
DEEEIRTTNPVATEQYGSVSTMDLQRGNQ

SEQ ID NO: 5987 - protein, 28 aa, Artificial Sequence
  Description of Artificial Sequence: Synthetic peptide
DEEEIRSTNPVATEQWGSYSTNLQRGNR

SEQ ID NO: 5988 - protein, 30 aa, Artificial Sequence
  Description of Artificial Sequence: Synthetic polypeptide
DEEEIRTTNPVATEQYGSVSDTNLQPGENR

SEQ ID NO: 5989 - protein, 29 aa, Artificial Sequence
  Description of Artificial Sequence: Synthetic peptide
DEEEIRTTNPVATEQYGSVSTNPQELGNR

SEQ ID NO: 5990 - protein, 28 aa, Artificial Sequence
  Description of Artificial Sequence: Synthetic peptide
DENEIRTTNPVATEQYGSVSTTLQHGNR

SEQ ID NO: 5991 - protein, 28 aa, Artificial Sequence
  Description of Artificial Sequence: Synthetic peptide
DEEEIRTTNPVATEFYGHVSTNLHRGNR

SEQ ID NO: 5992 - protein, 28 aa, Artificial Sequence
  Description of Artificial Sequence: Synthetic peptide
DEEEIRTTNPIATEQYGGVSANLQRGNR

SEQ ID NO: 5993 - protein, 28 aa, Artificial Sequence
  Description of Artificial Sequence: Synthetic peptide
DEEEIRTTNPEATEQYGSVSTGLQGGNR

SEQ ID NO: 5994 - protein, 28 aa, Artificial Sequence
  Description of Artificial Sequence: Synthetic peptide
DEEEIRTTNPVATEQYGSVSTNEQNGNG

SEQ ID NO: 5995 - protein, 28 aa, Artificial Sequence
  Description of Artificial Sequence: Synthetic peptide
DENEIRTTNPVATEQYGSVSTNEQRGNA

SEQ ID NO: 5996 - protein, 29 aa, Artificial Sequence
  Description of Artificial Sequence: Synthetic peptide
DEEEIRTTNPVATEQYGSVSTNTQRMVNR

SEQ ID NO: 5997 - protein, 28 aa, Artificial Sequence
  Description of Artificial Sequence: Synthetic peptide
DEQEIRTTNPVSTEVYGSVSTNLQRGNR

SEQ ID NO: 5998 - protein, 28 aa, Artificial Sequence
  Description of Artificial Sequence: Synthetic peptide
DEEEIRTTNPVATEQYGSVSTELQFGNE

SEQ ID NO: 5999 - protein, 28 aa, Artificial Sequence
  Description of Artificial Sequence: Synthetic peptide
DETEIRTTNPVATEQYGLVSTNLQRGQR

SEQ ID NO: 6000 - protein, 28 aa, Artificial Sequence
  Description of Artificial Sequence: Synthetic peptide
DEEEIRTTNPVATEQYGSVSTNLQFGET

SEQ ID NO: 6001 - protein, 28 aa, Artificial Sequence
  Description of Artificial Sequence: Synthetic peptide
DEEEIATTNPVATEQYGSVSTNLQTGNF

SEQ ID NO: 6002 - protein, 28 aa, Artificial Sequence
  Description of Artificial Sequence: Synthetic peptide
DEEEIRTTNPEATEQYGSVSTNLNYGNR

SEQ ID NO: 6003 - protein, 28 aa, Artificial Sequence
  Description of Artificial Sequence: Synthetic peptide
SEEEIRTTNPTATEQYGSVSTNLQQGNR

SEQ ID NO: 6004 - protein, 30 aa, Artificial Sequence
  Description of Artificial Sequence: Synthetic polypeptide
DEEEIRTTNPVATEQYGSVASLNLQRGNDR

SEQ ID NO: 6005 - protein, 29 aa, Artificial Sequence
  Description of Artificial Sequence: Synthetic peptide
DEEEIRTTNPVATEQYWSVSDNPLQRGNR

SEQ ID NO: 6006 - protein, 29 aa, Artificial Sequence
  Description of Artificial Sequence: Synthetic peptide
DEEEIRTTNPVATEQYGSVSENILQRGNA

SEQ ID NO: 6007 - protein, 30 aa, Artificial Sequence
  Description of Artificial Sequence: Synthetic polypeptide
DEEEIRTTNPVATEQYGSVSCTMNLCRGNR

SEQ ID NO: 6008 - protein, 29 aa, Artificial Sequence
  Description of Artificial Sequence: Synthetic peptide
HEEEIRTTNPVATEQYGSVSTGNLQRGER

SEQ ID NO: 6009 - protein, 29 aa, Artificial Sequence
  Description of Artificial Sequence: Synthetic peptide
DEVEIRTTNPVATEQYGSVSTNLQNRGTR

SEQ ID NO: 6010 - protein, 29 aa, Artificial Sequence
  Description of Artificial Sequence: Synthetic peptide
DEEEIRTTNPVATEQYGSVSATNLQHGNF

SEQ ID NO: 6011 - protein, 29 aa, Artificial Sequence
  Description of Artificial Sequence: Synthetic peptide
DEEEIRTTNPTATEQYGSVSTNLQRGDNQ

SEQ ID NO: 6012 - protein, 28 aa, Artificial Sequence
  Description of Artificial Sequence: Synthetic peptide
DEEEIRTVNPVATELYGSVSTNLQRGNM

SEQ ID NO: 6013 - protein, 28 aa, Artificial Sequence
  Description of Artificial Sequence: Synthetic peptide
DEEEIAQTNPVSTEQYGSVSTNLQRGNR

SEQ ID NO: 6014 - protein, 29 aa, Artificial Sequence
  Description of Artificial Sequence: Synthetic peptide
DEEEIRTTNPVATEQYGSVSTNLQEHGER

SEQ ID NO: 6015 - protein, 28 aa, Artificial Sequence
  Description of Artificial Sequence: Synthetic peptide
DEEEIRTTNPVATEQYGSVSTNLCNGNI

SEQ ID NO: 6016 - protein, 31 aa, Artificial Sequence
  Description of Artificial Sequence: Synthetic polypeptide
DEEEIRTTNPVATEQYGSVSTENLQERNGNR

SEQ ID NO: 6017 - protein, 28 aa, Artificial Sequence
  Description of Artificial Sequence: Synthetic peptide
DEEEIRTTNPVATEQYGSVHTNLQRGEP

SEQ ID NO: 6018 - protein, 31 aa, Artificial Sequence
  Description of Artificial Sequence: Synthetic polypeptide
DEEEIRTTNPVATEQYGSVSTANLQREGDNR

SEQ ID NO: 6019 - protein, 28 aa, Artificial Sequence
  Description of Artificial Sequence: Synthetic peptide
DEEEIRTTNPVATEQYGSVSTNLQHGDS

SEQ ID NO: 6020 - protein, 28 aa, Artificial Sequence
  Description of Artificial Sequence: Synthetic peptide
DEEEIRQTNPVATEQYGIVSDNLQRGNR

SEQ ID NO: 6021 - protein, 30 aa, Artificial Sequence
  Description of Artificial Sequence: Synthetic polypeptide
DEEEIVTTNPVATEQYGSVSTNLQRGINDR

SEQ ID NO: 6022 - protein, 29 aa, Artificial Sequence
  Description of Artificial Sequence: Synthetic peptide
DEEEIRTTNPVATEIYGAVSTNLQREGNR

SEQ ID NO: 6023 - protein, 31 aa, Artificial Sequence
  Description of Artificial Sequence: Synthetic polypeptide
DEEEIRTTNPVATEQYGSVSATNLQVRGNDR

SEQ ID NO: 6024 - protein, 28 aa, Artificial Sequence
  Description of Artificial Sequence: Synthetic peptide
DEEEIRTTNPVATEQYGSVSENLQVGNH

SEQ ID NO: 6025 - protein, 28 aa, Artificial Sequence
  Description of Artificial Sequence: Synthetic peptide
DEEEIRTTNPVATEQYGSVMTNLQPFNR

SEQ ID NO: 6026 - protein, 29 aa, Artificial Sequence
  Description of Artificial Sequence: Synthetic peptide
DEEEIRTVNPVATEQYGSVSTNLQRAGGR

SEQ ID NO: 6027 - protein, 28 aa, Artificial Sequence
  Description of Artificial Sequence: Synthetic peptide
DEEEIACTNPVATEQYGSVATNLQRGNR

SEQ ID NO: 6028 - protein, 28 aa, Artificial Sequence
  Description of Artificial Sequence: Synthetic peptide
DEEEIRTTNPVATEQYWSVSTNLQRENP

SEQ ID NO: 6029 - protein, 30 aa, Artificial Sequence
  Description of Artificial Sequence: Synthetic polypeptide
DEEEIRTTNPVATEQYGSVCSTNGLQRGNH

SEQ ID NO: 6030 - protein, 29 aa, Artificial Sequence
  Description of Artificial Sequence: Synthetic peptide
DEEEIRTTNPVATEQYGSVSTNLQRGEDM

SEQ ID NO: 6031 - protein, 28 aa, Artificial Sequence
  Description of Artificial Sequence: Synthetic peptide
DEEEIRTTNPVATEQYGSVSTNLQIGET

SEQ ID NO: 6032 - protein, 30 aa, Artificial Sequence
  Description of Artificial Sequence: Synthetic polypeptide
DEEEIRTTNPVATEQYGSVSDTTGLQRGNR

SEQ ID NO: 6033 - protein, 28 aa, Artificial Sequence
  Description of Artificial Sequence: Synthetic peptide
DEEEIHPTNPVATEQYGSVSENLQRGNR

SEQ ID NO: 6034 - protein, 28 aa, Artificial Sequence
  Description of Artificial Sequence: Synthetic peptide
DEVEIRTTNPVATECYGSVSTNLQRGTR

SEQ ID NO: 6035 - protein, 28 aa, Artificial Sequence
  Description of Artificial Sequence: Synthetic peptide
DEEEIRTTNPVATEQYGSVSTNLQGGDQ

SEQ ID NO: 6036 - protein, 30 aa, Artificial Sequence
  Description of Artificial Sequence: Synthetic polypeptide
DEEEIRTTNPVATEQYGSVDSTNLERDGNR

SEQ ID NO: 6037 - protein, 28 aa, Artificial Sequence
  Description of Artificial Sequence: Synthetic peptide
DEEEIRTTNPVATEQYGSVSTCEQNGNR

SEQ ID NO: 6038 - protein, 28 aa, Artificial Sequence
  Description of Artificial Sequence: Synthetic peptide
DEEEIRAVNPVATEQYGSVSTNLQLGNR

SEQ ID NO: 6039 - protein, 28 aa, Artificial Sequence
  Description of Artificial Sequence: Synthetic peptide
DEEEIRTTNPVATEQYGSVDTNLERGNA

SEQ ID NO: 6040 - protein, 28 aa, Artificial Sequence
  Description of Artificial Sequence: Synthetic peptide
DEEEIRTTNPVATEQYGSVSTNLEDGNQ

SEQ ID NO: 6041 - protein, 29 aa, Artificial Sequence
  Description of Artificial Sequence: Synthetic peptide
DEEEIRTTNPVATEQYGSVSHNLVQPGNR

SEQ ID NO: 6042 - protein, 28 aa, Artificial Sequence
  Description of Artificial Sequence: Synthetic peptide
DEEEIRTTNPTATEQYGSVSTNLQNGNQ

SEQ ID NO: 6043 - protein, 28 aa, Artificial Sequence
  Description of Artificial Sequence: Synthetic peptide
DEEEIRSTNPVATEQYGSVSENLQRGNC

SEQ ID NO: 6044 - protein, 30 aa, Artificial Sequence
  Description of Artificial Sequence: Synthetic polypeptide
DEEEIRTTNPVATEQYGSVSETNLIQFGNR

SEQ ID NO: 6045 - protein, 28 aa, Artificial Sequence
  Description of Artificial Sequence: Synthetic peptide
DEEEIRTTNPVATEIYGSVSTNLQVGNQ

SEQ ID NO: 6046 - protein, 28 aa, Artificial Sequence
  Description of Artificial Sequence: Synthetic peptide
DEEEIRTTNPVATEQYGSVSTGLERGNQ

SEQ ID NO: 6047 - protein, 28 aa, Artificial Sequence
  Description of Artificial Sequence: Synthetic peptide
DEEEIRTTNPVATEQYWSVEENLQRGNR

SEQ ID NO: 6048 - protein, 31 aa, Artificial Sequence
  Description of Artificial Sequence: Synthetic polypeptide
DEEEIRTTNPVATEQYGSVSTNLQERDGENR

SEQ ID NO: 6049 - protein, 28 aa, Artificial Sequence
  Description of Artificial Sequence: Synthetic peptide
DEEEIRTTNPVATEQYGSVSTNQEVGNR

SEQ ID NO: 6050 - protein, 28 aa, Artificial Sequence
  Description of Artificial Sequence: Synthetic peptide
DEEEIRTTNPVATEGYGSVSTNLCHGNR

SEQ ID NO: 6051 - protein, 29 aa, Artificial Sequence
  Description of Artificial Sequence: Synthetic peptide
DEEEIRTTNPVSTEQWGSVSTNLQRAGNR

SEQ ID NO: 6052 - protein, 29 aa, Artificial Sequence
  Description of Artificial Sequence: Synthetic peptide
DEEEIRTTNPVATEQYGSVSTDLQDYGNR

SEQ ID NO: 6053 - protein, 30 aa, Artificial Sequence
  Description of Artificial Sequence: Synthetic polypeptide
DEEEIRTTNPVATEQYGSVSTNLQDRDGNE

SEQ ID NO: 6054 - protein, 29 aa, Artificial Sequence
  Description of Artificial Sequence: Synthetic peptide
DEEEIRTTNPVATEQYGSVSDTPDQRGNR

SEQ ID NO: 6055 - protein, 28 aa, Artificial Sequence
  Description of Artificial Sequence: Synthetic peptide
IEEEIRTTNPVATEQYGMVSTPLQRGNR

SEQ ID NO: 6056 - protein, 28 aa, Artificial Sequence
  Description of Artificial Sequence: Synthetic peptide
DEEEIRTTNPVATECYGSVSTNLQSGND

SEQ ID NO: 6057 - protein, 28 aa, Artificial Sequence
  Description of Artificial Sequence: Synthetic peptide
DEEEIRTTNPVATEMFGLVSTNLQRGNR

SEQ ID NO: 6058 - protein, 28 aa, Artificial Sequence
  Description of Artificial Sequence: Synthetic peptide
DEEEIRTTNPVATEQYGSVSENLQSGER

SEQ ID NO: 6059 - protein, 28 aa, Artificial Sequence
  Description of Artificial Sequence: Synthetic peptide
DEQEVRTTNPVATEQYGCVSTNLQRGNR

SEQ ID NO: 6060 - protein, 28 aa, Artificial Sequence
  Description of Artificial Sequence: Synthetic peptide
DEEEIRTTNPVATEQYGSVSENLQHENR

SEQ ID NO: 6061 - protein, 28 aa, Artificial Sequence
  Description of Artificial Sequence: Synthetic peptide
DENEIRTTNPVATEQYGSVSTNLQVGNN

SEQ ID NO: 6062 - protein, 29 aa, Artificial Sequence
  Description of Artificial Sequence: Synthetic peptide
DEEEIGTTNPVATEQYGSVSTNLQDRGNV

SEQ ID NO: 6063 - protein, 29 aa, Artificial Sequence
  Description of Artificial Sequence: Synthetic peptide
DEEEIRTTNPVATEQYGSVSCTDLQQGNR

SEQ ID NO: 6064 - protein, 30 aa, Artificial Sequence
  Description of Artificial Sequence: Synthetic polypeptide
DEEEIRTTNPVATEQYGSVSTGNPQRGENR

SEQ ID NO: 6065 - protein, 28 aa, Artificial Sequence
  Description of Artificial Sequence: Synthetic peptide
DEEEIRTTNPVASEQYGSVATNLERGNR

SEQ ID NO: 6066 - protein, 28 aa, Artificial Sequence
  Description of Artificial Sequence: Synthetic peptide
DEEEIRTTNPVATEQYGSVSTNLQAGDL

SEQ ID NO: 6067 - protein, 29 aa, Artificial Sequence
  Description of Artificial Sequence: Synthetic peptide
DEEEIRTTNPVATEQYGSVSTALQRGDDR

SEQ ID NO: 6068 - protein, 28 aa, Artificial Sequence
  Description of Artificial Sequence: Synthetic peptide
DEEEIATTNPVATEQYGSVSTNLQRGEE

SEQ ID NO: 6069 - protein, 30 aa, Artificial Sequence
  Description of Artificial Sequence: Synthetic polypeptide
DEEEIATTNPVATEQYGSVSTNGLQERGNR

SEQ ID NO: 6070 - protein, 28 aa, Artificial Sequence
  Description of Artificial Sequence: Synthetic peptide
DEEEIATTNPVATEQYGSVSTNLERGER

SEQ ID NO: 6071 - protein, 29 aa, Artificial Sequence
  Description of Artificial Sequence: Synthetic peptide
DEEEIRTTNPVATECYGSVSTNLQDRGNN

SEQ ID NO: 6072 - protein, 30 aa, Artificial Sequence
  Description of Artificial Sequence: Synthetic polypeptide
DEEEIRTTNPVATEQYGSVSTMNLQHEGNR

SEQ ID NO: 6073 - protein, 28 aa, Artificial Sequence
  Description of Artificial Sequence: Synthetic peptide
DEEEIRTTNPVATEQYGSVSTELQLGNF

SEQ ID NO: 6074 - protein, 28 aa, Artificial Sequence
  Description of Artificial Sequence: Synthetic peptide
DEEEIRTTNPVATEVYGSVATNLDRGNR

SEQ ID NO: 6075 - protein, 30 aa, Artificial Sequence
  Description of Artificial Sequence: Synthetic polypeptide
DEEEIRTTNPVATEQYGSVSTNLQREGNDI

SEQ ID NO: 6076 - protein, 28 aa, Artificial Sequence
  Description of Artificial Sequence: Synthetic peptide
DEEEIRQTNPVATEQYGSVSENLQRGER

SEQ ID NO: 6077 - protein, 28 aa, Artificial Sequence
  Description of Artificial Sequence: Synthetic peptide
SEEEIRTTNPTATEQYGSVSTNLQRGTR

SEQ ID NO: 6078 - protein, 28 aa, Artificial Sequence
  Description of Artificial Sequence: Synthetic peptide
DEEEIRTTNPVATQQYGSVYTNLQSGNR

SEQ ID NO: 6079 - protein, 28 aa, Artificial Sequence
  Description of Artificial Sequence: Synthetic peptide
DEEEIRTTNPVATLQYGSVSTNEQRGNQ

SEQ ID NO: 6080 - protein, 28 aa, Artificial Sequence
  Description of Artificial Sequence: Synthetic peptide
DEEEIITTNPVATEQFGSVSDNLQRGNR

SEQ ID NO: 6081 - protein, 28 aa, Artificial Sequence
  Description of Artificial Sequence: Synthetic peptide
DEQEIRTTNPVATEQYGSVSTNLQLGNS

SEQ ID NO: 6082 - protein, 28 aa, Artificial Sequence
  Description of Artificial Sequence: Synthetic peptide
DEEEIRTTNPVATEIYGTVSMNLQRGNR

SEQ ID NO: 6083 - protein, 28 aa, Artificial Sequence
  Description of Artificial Sequence: Synthetic peptide
DEEEIRTTNPVATECYGSVSTDLQRGER

SEQ ID NO: 6084 - protein, 28 aa, Artificial Sequence
  Description of Artificial Sequence: Synthetic peptide
DEEEIRTTNPVATEQYGVVSTNLQNGNE

SEQ ID NO: 6085 - protein, 29 aa, Artificial Sequence
  Description of Artificial Sequence: Synthetic peptide
DEEEIRTTNPVATEQYGSVSTANPQIGNR

SEQ ID NO: 6086 - protein, 28 aa, Artificial Sequence
  Description of Artificial Sequence: Synthetic peptide
DEEEIRTTNPVATEQYGSVLTGLQIGNR

SEQ ID NO: 6087 - protein, 28 aa, Artificial Sequence
  Description of Artificial Sequence: Synthetic peptide
DEEEIRTTNPVATEQYGSVSTNLERGEN

SEQ ID NO: 6088 - protein, 30 aa, Artificial Sequence
  Description of Artificial Sequence: Synthetic polypeptide
DEEEIRTTNPVATEQYGSVSETNLTQNGNR

SEQ ID NO: 6089 - protein, 30 aa, Artificial Sequence
  Description of Artificial Sequence: Synthetic polypeptide
DEEEIRTTNPVATEQYGSVSTNEIQDRGNR

SEQ ID NO: 6090 - protein, 28 aa, Artificial Sequence
  Description of Artificial Sequence: Synthetic peptide
DEEEIRTTNPVCTEQYGSVGMNLQRGNR

SEQ ID NO: 6091 - protein, 29 aa, Artificial Sequence
  Description of Artificial Sequence: Synthetic peptide
DEEEIRTTNPVATEQYGSVSTDLQDRGNQ

SEQ ID NO: 6092 - protein, 28 aa, Artificial Sequence
  Description of Artificial Sequence: Synthetic peptide
DEEEIRTTNPVAIEVYGYVSTNLQRGNR

SEQ ID NO: 6093 - protein, 28 aa, Artificial Sequence
  Description of Artificial Sequence: Synthetic peptide
DEEEIRTTNPVATEQYGSVSTNLQHGEL

SEQ ID NO: 6094 - protein, 28 aa, Artificial Sequence
  Description of Artificial Sequence: Synthetic peptide
DTEEIRTTNPVATEQYGDVSTNEQRGNR

SEQ ID NO: 6095 - protein, 28 aa, Artificial Sequence
  Description of Artificial Sequence: Synthetic peptide
DEEEIRTTNPVATEFYGSVSTNLERPNR

SEQ ID NO: 6096 - protein, 28 aa, Artificial Sequence
  Description of Artificial Sequence: Synthetic peptide
DEEEIRTTNPVSTEQYGSVSTNEQRFNR

SEQ ID NO: 6097 - protein, 29 aa, Artificial Sequence
  Description of Artificial Sequence: Synthetic peptide
QEEEIRTTNPVATEQYGSASTNLQRAGNR

SEQ ID NO: 6098 - protein, 28 aa, Artificial Sequence
  Description of Artificial Sequence: Synthetic peptide
DEEEIRTTNPVCTEQYGSVSTNWQRGNN

SEQ ID NO: 6099 - protein, 28 aa, Artificial Sequence
  Description of Artificial Sequence: Synthetic peptide
DEEEIRTTNPVATEQYGSVDTDLQNGNR

SEQ ID NO: 6100 - protein, 28 aa, Artificial Sequence
  Description of Artificial Sequence: Synthetic peptide
DEEEIRTTNPVATECYGSVSTNPQPGNR

SEQ ID NO: 6101 - protein, 29 aa, Artificial Sequence
  Description of Artificial Sequence: Synthetic peptide
DEEEIRTTNPVATEQYGSVYSENLQRENR

SEQ ID NO: 6102 - protein, 29 aa, Artificial Sequence
  Description of Artificial Sequence: Synthetic peptide
DEEEIRTTNPVATEQYGSVSTNLQEVGNQ

SEQ ID NO: 6103 - protein, 29 aa, Artificial Sequence
  Description of Artificial Sequence: Synthetic peptide
DEEEIRTTNPVATEQYGSVTSTNLGIGNR

SEQ ID NO: 6104 - protein, 28 aa, Artificial Sequence
  Description of Artificial Sequence: Synthetic peptide
DEEEIRTTNPVATEQYGSVSTNLDHGNN

SEQ ID NO: 6105 - protein, 28 aa, Artificial Sequence
  Description of Artificial Sequence: Synthetic peptide
MEEEIRTTNPVATEQYGSVSTNLQNGNM

SEQ ID NO: 6106 - protein, 29 aa, Artificial Sequence
  Description of Artificial Sequence: Synthetic peptide
DEEEIRQTNPVATEQYGSVSTNLTQRGNG

SEQ ID NO: 6107 - protein, 28 aa, Artificial Sequence
  Description of Artificial Sequence: Synthetic peptide
DEEEITTTNPVATEQYGSVSTNLQTGND

SEQ ID NO: 6108 - protein, 28 aa, Artificial Sequence
  Description of Artificial Sequence: Synthetic peptide
DEQEIRTTNPVATEQYGSVSTNLQQGNA

SEQ ID NO: 6109 - protein, 28 aa, Artificial Sequence
  Description of Artificial Sequence: Synthetic peptide
DEEEIRTTNPVATEQYGSASTELQDGNR

SEQ ID NO: 6110 - protein, 28 aa, Artificial Sequence
  Description of Artificial Sequence: Synthetic peptide
DEEEIRTTNPVATEQWGSVSTNLTRGNS

SEQ ID NO: 6111 - protein, 28 aa, Artificial Sequence
  Description of Artificial Sequence: Synthetic peptide
DEEEIRTTNPVATEQYGSVSTNEQNGNE

SEQ ID NO: 6112 - protein, 28 aa, Artificial Sequence
  Description of Artificial Sequence: Synthetic peptide
DEEEIRTTNPVATEQYGSVSTNEQGGNS

SEQ ID NO: 6113 - protein, 30 aa, Artificial Sequence
  Description of Artificial Sequence: Synthetic polypeptide
DEEEIRTTNPVATEQYGSVWNSTNLQPGNR

SEQ ID NO: 6114 - protein, 28 aa, Artificial Sequence
  Description of Artificial Sequence: Synthetic peptide
DEEEIRATNPVATEMYGVVSTNLQRGNR

SEQ ID NO: 6115 - protein, 28 aa, Artificial Sequence
  Description of Artificial Sequence: Synthetic peptide
DEEEIRTTNPVATEQYGSVSENLQQGNC

SEQ ID NO: 6116 - protein, 28 aa, Artificial Sequence
  Description of Artificial Sequence: Synthetic peptide
DEEEIRCTNPVATEQWGSVDTNLQRGNR

SEQ ID NO: 6117 - protein, 30 aa, Artificial Sequence
  Description of Artificial Sequence: Synthetic polypeptide
DEEEIRTTNPVATEQYGSVSDTNLQDGNIR

SEQ ID NO: 6118 - protein, 28 aa, Artificial Sequence
  Description of Artificial Sequence: Synthetic peptide
DEEEIRTTNPVATEQYGSVSTNDQRGEP

SEQ ID NO: 6119 - protein, 28 aa, Artificial Sequence
  Description of Artificial Sequence: Synthetic peptide
DEEEIRTTNPVATEQYGSVSTNLQAGDF

SEQ ID NO: 6120 - protein, 30 aa, Artificial Sequence
  Description of Artificial Sequence: Synthetic polypeptide
DEEEIRTTNPTATEQYGSVSTNLQDRGENR

SEQ ID NO: 6121 - protein, 31 aa, Artificial Sequence
  Description of Artificial Sequence: Synthetic polypeptide
DEEEIRTTNPVATEQYGSVSCTNLPQRGNPR

SEQ ID NO: 6122 - protein, 30 aa, Artificial Sequence
  Description of Artificial Sequence: Synthetic polypeptide
DEEEIRTTNPVATEQYGDVSTNLQRGENDR

SEQ ID NO: 6123 - protein, 28 aa, Artificial Sequence
  Description of Artificial Sequence: Synthetic peptide
DEEEIRTTNPVATEQYGSVSTNLQTGEL

SEQ ID NO: 6124 - protein, 28 aa, Artificial Sequence
  Description of Artificial Sequence: Synthetic peptide
DEEEIRTTNPVATEQYGSVSTDLQAGNI

SEQ ID NO: 6125 - protein, 28 aa, Artificial Sequence
  Description of Artificial Sequence: Synthetic peptide
DEEEIETTNPVATSQYGSVSTNLQRPNR

SEQ ID NO: 6126 - protein, 28 aa, Artificial Sequence
  Description of Artificial Sequence: Synthetic peptide
DEEEIRTTNPVSTEQYGSVGTNLQRGPR

SEQ ID NO: 6127 - protein, 28 aa, Artificial Sequence
  Description of Artificial Sequence: Synthetic peptide
DEEEIRTTNPVATEQYGSVSTNEQIGNE

SEQ ID NO: 6128 - protein, 29 aa, Artificial Sequence
  Description of Artificial Sequence: Synthetic peptide
SEEEIRTTNPVATEQYGSVSTNPQRGDNR

SEQ ID NO: 6129 - protein, 28 aa, Artificial Sequence
  Description of Artificial Sequence: Synthetic peptide
DMEEIRTTNPVATEQYGCVSTNLQRGNM

SEQ ID NO: 6130 - protein, 28 aa, Artificial Sequence
  Description of Artificial Sequence: Synthetic peptide
DEEEIRTTNPVATEQYGSVSYNLQRGED

SEQ ID NO: 6131 - protein, 29 aa, Artificial Sequence
  Description of Artificial Sequence: Synthetic peptide
DEEEIATTNPVATEQYGSVSTNLQCRGNA

SEQ ID NO: 6132 - protein, 28 aa, Artificial Sequence
  Description of Artificial Sequence: Synthetic peptide
DEEEIRTTNPVATEQYGIVSTNLDRGNA

SEQ ID NO: 6133 - protein, 28 aa, Artificial Sequence
  Description of Artificial Sequence: Synthetic peptide
DENEIRTTNPVATEQYGSVSTNLQQGNY

SEQ ID NO: 6134 - protein, 28 aa, Artificial Sequence
  Description of Artificial Sequence: Synthetic peptide
DEEEIRTTNPIATELYGSVSNNLQRGNR

SEQ ID NO: 6135 - protein, 28 aa, Artificial Sequence
  Description of Artificial Sequence: Synthetic peptide
DEEEIRTTNPVATEQYWSVSTNDQNGNR

SEQ ID NO: 6136 - protein, 30 aa, Artificial Sequence
  Description of Artificial Sequence: Synthetic polypeptide
DEEEIRCTNPVATEQYGSVSATNLQLRGNR

SEQ ID NO: 6137 - protein, 29 aa, Artificial Sequence
  Description of Artificial Sequence: Synthetic peptide
DEEEIATTNPVATEQYGSVSTNLQRGNTF

SEQ ID NO: 6138 - protein, 29 aa, Artificial Sequence
  Description of Artificial Sequence: Synthetic peptide
DEEEIRTTNPVATEQYGSVSTMNLQQGNA

SEQ ID NO: 6139 - protein, 28 aa, Artificial Sequence
  Description of Artificial Sequence: Synthetic peptide
DEEEIRATNPTATEQYGSVSTNLERGNR

SEQ ID NO: 6140 - protein, 28 aa, Artificial Sequence
  Description of Artificial Sequence: Synthetic peptide
DEEEIRTTNPVATEQYGSVSTNLQAGEC

SEQ ID NO: 6141 - protein, 30 aa, Artificial Sequence
  Description of Artificial Sequence: Synthetic polypeptide
DEEEIRTTNPVATEQYGSLSSTPNLQRGNR

SEQ ID NO: 6142 - protein, 28 aa, Artificial Sequence
  Description of Artificial Sequence: Synthetic peptide
DEEEIRTTNPVATEQYGSVSTNLQRNQE

SEQ ID NO: 6143 - protein, 29 aa, Artificial Sequence
  Description of Artificial Sequence: Synthetic peptide
DEEEIRTTNPVAYEQYGSVDCTNLQRGNR

SEQ ID NO: 6144 - protein, 29 aa, Artificial Sequence
  Description of Artificial Sequence: Synthetic peptide
DEEEIRTTNPVATEVYGSVSTNLERGNDR

SEQ ID NO: 6145 - protein, 28 aa, Artificial Sequence
  Description of Artificial Sequence: Synthetic peptide
DEEEIRSTNPCATEQYGCVSTNLQRGNR

SEQ ID NO: 6146 - protein, 29 aa, Artificial Sequence
  Description of Artificial Sequence: Synthetic peptide
DEEEIRTTNPVATEQYGSYVSTNPQRMNR

SEQ ID NO: 6147 - protein, 30 aa, Artificial Sequence
  Description of Artificial Sequence: Synthetic polypeptide
DEEEIRTTNPVATEQYGSVSATNLQLRGND

SEQ ID NO: 6148 - protein, 30 aa, Artificial Sequence
  Description of Artificial Sequence: Synthetic polypeptide
SEEEIRTTNPVATEQYGSVSTNLQERGDNR

SEQ ID NO: 6149 - protein, 30 aa, Artificial Sequence
  Description of Artificial Sequence: Synthetic polypeptide
DEEEIRTTNPVATEQYGSVSSTLNLQRVNR

SEQ ID NO: 6150 - protein, 28 aa, Artificial Sequence
  Description of Artificial Sequence: Synthetic peptide
DEEEIRTTNPVAYEQYGSVSTNLQPGER

SEQ ID NO: 6151 - protein, 29 aa, Artificial Sequence
  Description of Artificial Sequence: Synthetic peptide
DEEEIRTTNPVAWEQYGSSVSTNLYRGNR

SEQ ID NO: 6152 - protein, 28 aa, Artificial Sequence
  Description of Artificial Sequence: Synthetic peptide
DENEIRTTNPVATEQYGVVSTNLQRGER

SEQ ID NO: 6153 - protein, 28 aa, Artificial Sequence
  Description of Artificial Sequence: Synthetic peptide
DEEEIRTTNPVAYEQYGSVSTNLQPGNP

SEQ ID NO: 6154 - protein, 30 aa, Artificial Sequence
  Description of Artificial Sequence: Synthetic polypeptide
DEEEIRTTNPVATEQYGSVSTNLERDGNER

SEQ ID NO: 6155 - protein, 28 aa, Artificial Sequence
  Description of Artificial Sequence: Synthetic peptide
DEEEIRTVNPVSTEQYGSVSTVLQRGNR

SEQ ID NO: 6156 - protein, 29 aa, Artificial Sequence
  Description of Artificial Sequence: Synthetic peptide
DEEEIRTVNPVATEQYGSVSENLQNRGNR

SEQ ID NO: 6157 - protein, 28 aa, Artificial Sequence
  Description of Artificial Sequence: Synthetic peptide
DEEEIRTTNPVATEQWGSWSTNLQRGNP

SEQ ID NO: 6158 - protein, 29 aa, Artificial Sequence
  Description of Artificial Sequence: Synthetic peptide
DEEEIRTTNPVATECYGSVTSTNLQRGER

SEQ ID NO: 6159 - protein, 28 aa, Artificial Sequence
  Description of Artificial Sequence: Synthetic peptide
DEEEIAQTNPVATEQYGSVSTNLQHGNR

SEQ ID NO: 6160 - protein, 28 aa, Artificial Sequence
  Description of Artificial Sequence: Synthetic peptide
DEEEIRAVNPVATEQYGSVSTNLQRGNI

SEQ ID NO: 6161 - protein, 30 aa, Artificial Sequence
  Description of Artificial Sequence: Synthetic polypeptide
DEEEIRTTNPVATEQYGSVSTMNLQIGDNR

SEQ ID NO: 6162 - protein, 28 aa, Artificial Sequence
  Description of Artificial Sequence: Synthetic peptide
DEECIRTTNPVATECYGSVSTNLQRGER

SEQ ID NO: 6163 - protein, 28 aa, Artificial Sequence
  Description of Artificial Sequence: Synthetic peptide
DEEEIRTTNPTATELYGSVSTNLQRGNL

SEQ ID NO: 6164 - protein, 29 aa, Artificial Sequence
  Description of Artificial Sequence: Synthetic peptide
DEEEIRTTNPVATEQYGSVSTNHLQYENR

SEQ ID NO: 6165 - protein, 28 aa, Artificial Sequence
  Description of Artificial Sequence: Synthetic peptide
DEEEIRTTNPVATEQYGVVSTNLQEGNQ

SEQ ID NO: 6166 - protein, 30 aa, Artificial Sequence
  Description of Artificial Sequence: Synthetic polypeptide
DEEEIRTTNPVATEQYGSQVSGNLQRSGNR

SEQ ID NO: 6167 - protein, 28 aa, Artificial Sequence
  Description of Artificial Sequence: Synthetic peptide
DEEEIRTTNPVATEQYGSVSTDLQRGEL

SEQ ID NO: 6168 - protein, 28 aa, Artificial Sequence
  Description of Artificial Sequence: Synthetic peptide
DELEIRTTNPVATEQYGSVSTNLQFNNR

SEQ ID NO: 6169 - protein, 28 aa, Artificial Sequence
  Description of Artificial Sequence: Synthetic peptide
DDEEIRQTNPVATEQYGSVSTNLQRGNQ

SEQ ID NO: 6170 - protein, 28 aa, Artificial Sequence
  Description of Artificial Sequence: Synthetic peptide
DETEIRGTNPVATEQYGSVSTNLQRGPR

SEQ ID NO: 6171 - protein, 28 aa, Artificial Sequence
  Description of Artificial Sequence: Synthetic peptide
DEGEIRTTNPCATEQYGSVSTNLQRGPR

SEQ ID NO: 6172 - protein, 29 aa, Artificial Sequence
  Description of Artificial Sequence: Synthetic peptide
MEEEIRTTNPVATEQYGSVSTNLQRGNDW

SEQ ID NO: 6173 - protein, 29 aa, Artificial Sequence
  Description of Artificial Sequence: Synthetic peptide
DEEEIRTTNPVATEQYGSVSDTNLQTGNM

SEQ ID NO: 6174 - protein, 28 aa, Artificial Sequence
  Description of Artificial Sequence: Synthetic peptide
DEEEIRTTNPVATEQYGSVSTNLQTGEQ

SEQ ID NO: 6175 - protein, 28 aa, Artificial Sequence
  Description of Artificial Sequence: Synthetic peptide
DEEEIRTTNPVSTSQYGSVSTNLGRGNR

SEQ ID NO: 6176 - protein, 28 aa, Artificial Sequence
  Description of Artificial Sequence: Synthetic peptide
GEEEIRTVNPVATEQYGTVSTNLQRGNR

SEQ ID NO: 6177 - protein, 30 aa, Artificial Sequence
  Description of Artificial Sequence: Synthetic polypeptide
DEEEIRTTNPVATEQYGSVSTNEQCRGNDR

SEQ ID NO: 6178 - protein, 29 aa, Artificial Sequence
  Description of Artificial Sequence: Synthetic peptide
DEEEIRTTNPVATEQYGSVSTDLQQAGNR

SEQ ID NO: 6179 - protein, 29 aa, Artificial Sequence
  Description of Artificial Sequence: Synthetic peptide
DEEEIATTNPVATGQYGSVSTNLQRFGNR

SEQ ID NO: 6180 - protein, 28 aa, Artificial Sequence
  Description of Artificial Sequence: Synthetic peptide
DEEEIRTTNPVATEQYGSVSTNPQNGNF

SEQ ID NO: 6181 - protein, 31 aa, Artificial Sequence
  Description of Artificial Sequence: Synthetic polypeptide
DEEEIRTTNPVATEQYGSVSTVNLQREGENR

SEQ ID NO: 6182 - protein, 28 aa, Artificial Sequence
  Description of Artificial Sequence: Synthetic peptide
DEEEIRTTNPVATEQYGSVSTELDNGNR

SEQ ID NO: 6183 - protein, 30 aa, Artificial Sequence
  Description of Artificial Sequence: Synthetic polypeptide
DEEEIRTTNPVATEQYGSVSTNLQCRGNDQ

SEQ ID NO: 6184 - protein, 28 aa, Artificial Sequence
  Description of Artificial Sequence: Synthetic peptide
DEEEIRTTNPVATEQYGGVSTNLQYGNE

SEQ ID NO: 6185 - protein, 28 aa, Artificial Sequence
  Description of Artificial Sequence: Synthetic peptide
DEEEIRTTNPVATEQYGSVTTTLMRGNR

SEQ ID NO: 6186 - protein, 30 aa, Artificial Sequence
  Description of Artificial Sequence: Synthetic polypeptide
DEEEIRTTNPVATEQYGSVNDTNLPQRGNR

SEQ ID NO: 6187 - protein, 28 aa, Artificial Sequence
  Description of Artificial Sequence: Synthetic peptide
DEFEIRTTNPVATEQYGEVSTNLQRGTR

SEQ ID NO: 6188 - protein, 28 aa, Artificial Sequence
  Description of Artificial Sequence: Synthetic peptide
DEEEIRTTNPCATEQYGSVSTNLQAGNC

SEQ ID NO: 6189 - protein, 29 aa, Artificial Sequence
  Description of Artificial Sequence: Synthetic peptide
DEEEIRTTNPVATEQYGAVSTNLQMEGNR

SEQ ID NO: 6190 - protein, 30 aa, Artificial Sequence
  Description of Artificial Sequence: Synthetic polypeptide
DEEEIRTTNPVATEQYGSVSTNLQVEGNDR

SEQ ID NO: 6191 - protein, 28 aa, Artificial Sequence
  Description of Artificial Sequence: Synthetic peptide
DEEEIRTCNPVATEQYGSVSTNLQHGNE

SEQ ID NO: 6192 - protein, 29 aa, Artificial Sequence
  Description of Artificial Sequence: Synthetic peptide
DEEEIRTTNPVATEQYGSVETNLQRNGNE

SEQ ID NO: 6193 - protein, 28 aa, Artificial Sequence
  Description of Artificial Sequence: Synthetic peptide
DEEEIRTTNPVATEQYGSVSENLQQGNA

SEQ ID NO: 6194 - protein, 28 aa, Artificial Sequence
  Description of Artificial Sequence: Synthetic peptide
QEEEIRTTNPVATEQYGSVSENLFRGNR

SEQ ID NO: 6195 - protein, 28 aa, Artificial Sequence
  Description of Artificial Sequence: Synthetic peptide
DEEEIRCTNPVASEQYGCVSTNLQRGNR

SEQ ID NO: 6196 - protein, 28 aa, Artificial Sequence
  Description of Artificial Sequence: Synthetic peptide
DEQEIRTTNPVASEIYGSVSTNLQRGNR

SEQ ID NO: 6197 - protein, 28 aa, Artificial Sequence
  Description of Artificial Sequence: Synthetic peptide
DEEEIRCTNPVATEQYGSVSTNLQRGEA

SEQ ID NO: 6198 - protein, 28 aa, Artificial Sequence
  Description of Artificial Sequence: Synthetic peptide
DEEEIRTTNPVATEQYGSASECLQRGNR

SEQ ID NO: 6199 - protein, 29 aa, Artificial Sequence
  Description of Artificial Sequence: Synthetic peptide
DEAEIRTTNPVATEQYGSVSTDNLQSGNR

SEQ ID NO: 6200 - protein, 30 aa, Artificial Sequence
  Description of Artificial Sequence: Synthetic polypeptide
DEEEIRTTNPVATEQYGSVVTSENLQRGNR

SEQ ID NO: 6201 - protein, 28 aa, Artificial Sequence
  Description of Artificial Sequence: Synthetic peptide
DEEEIRPTNPVATQQYGSVSTNLQRGNP

SEQ ID NO: 6202 - protein, 29 aa, Artificial Sequence
  Description of Artificial Sequence: Synthetic peptide
DEEEIRTTNPVATEQYGSVSTNLQINGNM

SEQ ID NO: 6203 - protein, 28 aa, Artificial Sequence
  Description of Artificial Sequence: Synthetic peptide
DEEEIRTTNPVATEQYGAVGTNLQRGTR

SEQ ID NO: 6204 - protein, 28 aa, Artificial Sequence
  Description of Artificial Sequence: Synthetic peptide
DEQEIRSTNPVATEIYGSVSTNLQRGNR

SEQ ID NO: 6205 - protein, 28 aa, Artificial Sequence
  Description of Artificial Sequence: Synthetic peptide
DEEEIRTTNPVATEQYWSVSTPLQDGNR

SEQ ID NO: 6206 - protein, 28 aa, Artificial Sequence
  Description of Artificial Sequence: Synthetic peptide
DEEEIRTTNPFACEQYGTVSTNLQRGNR

SEQ ID NO: 6207 - protein, 28 aa, Artificial Sequence
  Description of Artificial Sequence: Synthetic peptide
DPEEIRTTNPVATECYGSVSTNPQRGNR

SEQ ID NO: 6208 - protein, 28 aa, Artificial Sequence
  Description of Artificial Sequence: Synthetic peptide
SESEIRTTNPVATEMYGSVSTNLQRGNR

SEQ ID NO: 6209 - protein, 29 aa, Artificial Sequence
  Description of Artificial Sequence: Synthetic peptide
DEEEIRTTNPVATEQYGSVDCTNLQHGNR

SEQ ID NO: 6210 - protein, 28 aa, Artificial Sequence
  Description of Artificial Sequence: Synthetic peptide
DEEEIRPTNPVATEQYGVVSTGLQRGNR

SEQ ID NO: 6211 - protein, 28 aa, Artificial Sequence
  Description of Artificial Sequence: Synthetic peptide
DEEEIVCTNPVCTEQYGSVSTNLQRGNR

SEQ ID NO: 6212 - protein, 30 aa, Artificial Sequence
  Description of Artificial Sequence: Synthetic polypeptide
DEEEIRTTNPVATEQYGSVSTNLQRGENVP

SEQ ID NO: 6213 - protein, 28 aa, Artificial Sequence
  Description of Artificial Sequence: Synthetic peptide
DEEEIRTTNPFAYVQYGSVSTNLQRGNR

SEQ ID NO: 6214 - protein, 31 aa, Artificial Sequence
  Description of Artificial Sequence: Synthetic polypeptide
DEEEIRTTNPVATEQYGSVSETNLQERGDNR

SEQ ID NO: 6215 - protein, 28 aa, Artificial Sequence
  Description of Artificial Sequence: Synthetic peptide
DEEEIRTTNPVATEQYGSVSTCLNRGNT

SEQ ID NO: 6216 - protein, 29 aa, Artificial Sequence
  Description of Artificial Sequence: Synthetic peptide
DEVEIRTTNPVATEQYGSVSTNLQRGPNI

SEQ ID NO: 6217 - protein, 28 aa, Artificial Sequence
  Description of Artificial Sequence: Synthetic peptide
DEEEIRTTNPVATEQYGSVDTDLQRGNT

SEQ ID NO: 6218 - protein, 29 aa, Artificial Sequence
  Description of Artificial Sequence: Synthetic peptide
DEEEIRTTNPVATEQYGSVSCENLQRGNA

SEQ ID NO: 6219 - protein, 29 aa, Artificial Sequence
  Description of Artificial Sequence: Synthetic peptide
DEEEIRTTNPVATEQWGSVSTNLQWRGDR

SEQ ID NO: 6220 - protein, 30 aa, Artificial Sequence
  Description of Artificial Sequence: Synthetic polypeptide
DEEEIRTTNPVATEQYGSVSECNLQRDGNR

SEQ ID NO: 6221 - protein, 28 aa, Artificial Sequence
  Description of Artificial Sequence: Synthetic peptide
DEEEIRTTNPVATEQYGSVSTNDDRGNW

SEQ ID NO: 6222 - protein, 28 aa, Artificial Sequence
  Description of Artificial Sequence: Synthetic peptide
SEEEIRTTNPEATEQYGSVSTNLQRGNV

SEQ ID NO: 6223 - protein, 28 aa, Artificial Sequence
  Description of Artificial Sequence: Synthetic peptide
DEEEIRTTNPVATEQYGSVSTDLQAGNM

SEQ ID NO: 6224 - protein, 28 aa, Artificial Sequence
  Description of Artificial Sequence: Synthetic peptide
AEEEIRTTNPVATEQYGSVSTNLQLGDR

SEQ ID NO: 6225 - protein, 30 aa, Artificial Sequence
  Description of Artificial Sequence: Synthetic polypeptide
DEEEIRTTNPVATEQYGSVSTANLQSGNDR

SEQ ID NO: 6226 - protein, 28 aa, Artificial Sequence
  Description of Artificial Sequence: Synthetic peptide
DEEEIRTTNPVATEQYGSVSTADFRGNR

SEQ ID NO: 6227 - protein, 29 aa, Artificial Sequence
  Description of Artificial Sequence: Synthetic peptide
DEHEIRTTNPVATEQYGSVSENLQRVGNR

SEQ ID NO: 6228 - protein, 29 aa, Artificial Sequence
  Description of Artificial Sequence: Synthetic peptide
DEEEIAQTNPVATEQYGSVSTNLQRGPNR

SEQ ID NO: 6229 - protein, 29 aa, Artificial Sequence
  Description of Artificial Sequence: Synthetic peptide
DEEEIRTTNPVATEQYGSVDTELQQRGNR

SEQ ID NO: 6230 - protein, 30 aa, Artificial Sequence
  Description of Artificial Sequence: Synthetic polypeptide
DEEEIRTTNPVATEQYGSVSTNPLQRKGNE

SEQ ID NO: 6231 - protein, 28 aa, Artificial Sequence
  Description of Artificial Sequence: Synthetic peptide
DEEEVRTTNPVATENYGAVSTNLQRGNR

SEQ ID NO: 6232 - protein, 28 aa, Artificial Sequence
  Description of Artificial Sequence: Synthetic peptide
QEEEICQTNPVATEQYGSVSTNLQRGNR

SEQ ID NO: 6233 - protein, 28 aa, Artificial Sequence
  Description of Artificial Sequence: Synthetic peptide
DEEEIRTTNPVATEQFGLVSFNLQRGNR

SEQ ID NO: 6234 - protein, 28 aa, Artificial Sequence
  Description of Artificial Sequence: Synthetic peptide
DEQEIRTTNPVATEQYGSVSTNLQRGEI

SEQ ID NO: 6235 - protein, 29 aa, Artificial Sequence
  Description of Artificial Sequence: Synthetic peptide
DEEEIRTTNPVATEQYGSVSHTNLQAGNV

SEQ ID NO: 6236 - protein, 30 aa, Artificial Sequence
  Description of Artificial Sequence: Synthetic polypeptide
DEEEIRTTNPVATEQYGSVSTNLQREGNEE

SEQ ID NO: 6237 - protein, 29 aa, Artificial Sequence
  Description of Artificial Sequence: Synthetic peptide
DEEEIRTTNPVATEQYGSVSTNLQLEGNS

SEQ ID NO: 6238 - protein, 28 aa, Artificial Sequence
  Description of Artificial Sequence: Synthetic peptide
DEEEIRTTNPVATEQYGSVSTNLQNGEN

SEQ ID NO: 6239 - protein, 29 aa, Artificial Sequence
  Description of Artificial Sequence: Synthetic peptide
MEEEIRTTNPVATEQYGSVSTNLQREGNS

SEQ ID NO: 6240 - protein, 28 aa, Artificial Sequence
  Description of Artificial Sequence: Synthetic peptide
DEEEIRTTNPVCTEMYGSVSTGLQRGNR

SEQ ID NO: 6241 - protein, 29 aa, Artificial Sequence
  Description of Artificial Sequence: Synthetic peptide
DEEEIRTTNPVATEQYGSVSTNLQVEGNV

SEQ ID NO: 6242 - protein, 29 aa, Artificial Sequence
  Description of Artificial Sequence: Synthetic peptide
DEEEIRTTNPVATEQYGSVSTNLQENGNF

SEQ ID NO: 6243 - protein, 28 aa, Artificial Sequence
  Description of Artificial Sequence: Synthetic peptide
RDEEIRTTNPVATEQYGNVSTNLQRGNR

SEQ ID NO: 6244 - protein, 28 aa, Artificial Sequence
  Description of Artificial Sequence: Synthetic peptide
DECEIRTTNPVAVEQYGSVSENLQRGNR

SEQ ID NO: 6245 - protein, 29 aa, Artificial Sequence
  Description of Artificial Sequence: Synthetic peptide
DEEEIRTTNPVATEQYGSVHTNLTQRGNP

SEQ ID NO: 6246 - protein, 28 aa, Artificial Sequence
  Description of Artificial Sequence: Synthetic peptide
DEEEIRQTNPVATEQYGIVSNNLQRGNR

SEQ ID NO: 6247 - protein, 29 aa, Artificial Sequence
  Description of Artificial Sequence: Synthetic peptide
DEEEIRTTNPVATEQYGDSVSTNLERGER

SEQ ID NO: 6248 - protein, 29 aa, Artificial Sequence
  Description of Artificial Sequence: Synthetic peptide
DEIEIRTTNPVATEQYGSVSTNLQQLGNR

SEQ ID NO: 6249 - protein, 28 aa, Artificial Sequence
  Description of Artificial Sequence: Synthetic peptide
DEEEIVTTNPVATEQYGSMSTELQRGNR

SEQ ID NO: 6250 - protein, 28 aa, Artificial Sequence
  Description of Artificial Sequence: Synthetic peptide
DEEEIRTTNPVATEQYGSVSTNLQNGEM

SEQ ID NO: 6251 - protein, 28 aa, Artificial Sequence
  Description of Artificial Sequence: Synthetic peptide
AEEEIGTVNPVATEQYGSVSTNLQRGNR

SEQ ID NO: 6252 - protein, 28 aa, Artificial Sequence
  Description of Artificial Sequence: Synthetic peptide
DEEEIRTTNPVATEQYGSVSTNLELGNS

SEQ ID NO: 6253 - protein, 29 aa, Artificial Sequence
  Description of Artificial Sequence: Synthetic peptide
DEEEIRTTNPVATEQYGSVSTNGLQMGNI

SEQ ID NO: 6254 - protein, 28 aa, Artificial Sequence
  Description of Artificial Sequence: Synthetic peptide
DENEIRTTNPVATEQWGSNSTNLQRGNR

SEQ ID NO: 6255 - protein, 29 aa, Artificial Sequence
  Description of Artificial Sequence: Synthetic peptide
DEQEIRTTNPVATEQYGSVSTNLQDRGNL

SEQ ID NO: 6256 - protein, 28 aa, Artificial Sequence
  Description of Artificial Sequence: Synthetic peptide
DEEEIAATNPVATEQYGVVSTNLQRGNR

SEQ ID NO: 6257 - protein, 28 aa, Artificial Sequence
  Description of Artificial Sequence: Synthetic peptide
DEEEIRTTNPVATEQYGSVDTNPQRGNI

SEQ ID NO: 6258 - protein, 29 aa, Artificial Sequence
  Description of Artificial Sequence: Synthetic peptide
DEEEIRTTNPVATEQYGSVSTDLQNGDNR

SEQ ID NO: 6259 - protein, 28 aa, Artificial Sequence
  Description of Artificial Sequence: Synthetic peptide
DEEEIRTTNPVATEQYGSVSTDLQQGNA

SEQ ID NO: 6260 - protein, 28 aa, Artificial Sequence
  Description of Artificial Sequence: Synthetic peptide
DEEEIRPTNPVATQQYGSVSTNLQRGND

SEQ ID NO: 6261 - protein, 28 aa, Artificial Sequence
  Description of Artificial Sequence: Synthetic peptide
DEEEIRSTNPVATEQYGSVSTNLEFGNR

SEQ ID NO: 6262 - protein, 28 aa, Artificial Sequence
  Description of Artificial Sequence: Synthetic peptide
DEEEIRTTNPVATEQYGSVSTNLQQGDH

SEQ ID NO: 6263 - protein, 29 aa, Artificial Sequence
  Description of Artificial Sequence: Synthetic peptide
DEEEIRCTNPVATEQYGSVSTNLQIRGNF

SEQ ID NO: 6264 - protein, 30 aa, Artificial Sequence
  Description of Artificial Sequence: Synthetic polypeptide
DEEEIRTTNPVATEQYGSVKDTNLTQRGNR

SEQ ID NO: 6265 - protein, 28 aa, Artificial Sequence
  Description of Artificial Sequence: Synthetic peptide
DEEEIRTTNPVATEQYGSVGTNLERGIR

SEQ ID NO: 6266 - protein, 28 aa, Artificial Sequence
  Description of Artificial Sequence: Synthetic peptide
DEEEIRTTNPVATEQYGSVSTNLQQGEN

SEQ ID NO: 6267 - protein, 28 aa, Artificial Sequence
  Description of Artificial Sequence: Synthetic peptide
DEEEIRTTNPVATEQYGSVSTNEQLGNF

SEQ ID NO: 6268 - protein, 28 aa, Artificial Sequence
  Description of Artificial Sequence: Synthetic peptide
DEEEIRTTNPVATEQYGSVSTNPQIGNG

SEQ ID NO: 6269 - protein, 28 aa, Artificial Sequence
  Description of Artificial Sequence: Synthetic peptide
NEEEIRTTNPVAAEQYGSVSTNLARGNR

SEQ ID NO: 6270 - protein, 28 aa, Artificial Sequence
  Description of Artificial Sequence: Synthetic peptide
DEEEIRTTNPVATEQYGIVSTNLQYGNL

SEQ ID NO: 6271 - protein, 29 aa, Artificial Sequence
  Description of Artificial Sequence: Synthetic peptide
DEEEIRTTNPVATEQYGSVSTNLQILGNM

SEQ ID NO: 6272 - protein, 28 aa, Artificial Sequence
  Description of Artificial Sequence: Synthetic peptide
DEEEIRTTNPVATEQYGTVSTNLERSNR

SEQ ID NO: 6273 - protein, 30 aa, Artificial Sequence
  Description of Artificial Sequence: Synthetic polypeptide
DEEEIRTTNPVATEQYGSVSTNLQRDGNDH

SEQ ID NO: 6274 - protein, 28 aa, Artificial Sequence
  Description of Artificial Sequence: Synthetic peptide
DEEEIRTTNPVATEQWGSVDENLQRGNR

SEQ ID NO: 6275 - protein, 28 aa, Artificial Sequence
  Description of Artificial Sequence: Synthetic peptide
DEEEIRTTNPVATELYGCVSTNLQPGNR

SEQ ID NO: 6276 - protein, 28 aa, Artificial Sequence
  Description of Artificial Sequence: Synthetic peptide
DEEEIRTTNPVATEQYGSVSTDLQSGNN

SEQ ID NO: 6277 - protein, 28 aa, Artificial Sequence
  Description of Artificial Sequence: Synthetic peptide
DECEIRTTNPIATEQYGSVSTNLERGNR

SEQ ID NO: 6278 - protein, 29 aa, Artificial Sequence
  Description of Artificial Sequence: Synthetic peptide
DEEEIRTTNPVATEQYGSVSTNLQETGDR

SEQ ID NO: 6279 - protein, 28 aa, Artificial Sequence
  Description of Artificial Sequence: Synthetic peptide
DEECIRSTNPVATEQYGSVSTNVQRGNR

SEQ ID NO: 6280 - protein, 28 aa, Artificial Sequence
  Description of Artificial Sequence: Synthetic peptide
DEEEIRTTNPVATEQYGSVSTNPQQGNQ

SEQ ID NO: 6281 - protein, 28 aa, Artificial Sequence
  Description of Artificial Sequence: Synthetic peptide
DEEEIRTTNPVATEPYGSVSTNLGRLNR

SEQ ID NO: 6282 - protein, 30 aa, Artificial Sequence
  Description of Artificial Sequence: Synthetic polypeptide
DEEEIRTTNPVATEQYGSVSDTNLQIAGNR

SEQ ID NO: 6283 - protein, 30 aa, Artificial Sequence
  Description of Artificial Sequence: Synthetic polypeptide
DEEEIRTTNPVATEQYGSVSCTDLQRGNDR

SEQ ID NO: 6284 - protein, 28 aa, Artificial Sequence
  Description of Artificial Sequence: Synthetic peptide
DEEEIRTTNPVATEQYGAVATNLERGNR

SEQ ID NO: 6285 - protein, 28 aa, Artificial Sequence
  Description of Artificial Sequence: Synthetic peptide
DEEEIRTTNPVATEQYGSVSTNLQMGEN

SEQ ID NO: 6286 - protein, 28 aa, Artificial Sequence
  Description of Artificial Sequence: Synthetic peptide
DEEEIRTTNPVATEQYGSVSTNLDEGNF

SEQ ID NO: 6287 - protein, 29 aa, Artificial Sequence
  Description of Artificial Sequence: Synthetic peptide
DEEEIRTTNPVATEQYGSVSENLQHGNDR

SEQ ID NO: 6288 - protein, 28 aa, Artificial Sequence
  Description of Artificial Sequence: Synthetic peptide
DEEEIRTTNPVATEQYGSVSTCQERGNR

SEQ ID NO: 6289 - protein, 30 aa, Artificial Sequence
  Description of Artificial Sequence: Synthetic polypeptide
DEEEIRTTNPVATEQYGSVSTNLQQRGDNI

SEQ ID NO: 6290 - protein, 29 aa, Artificial Sequence
  Description of Artificial Sequence: Synthetic peptide
DEEEIRTTNPVATEQYGSVQSENRQRGNR

SEQ ID NO: 6291 - protein, 28 aa, Artificial Sequence
  Description of Artificial Sequence: Synthetic peptide
DENEIRTTNPVATEQYGSVSTNLQGGND

SEQ ID NO: 6292 - protein, 28 aa, Artificial Sequence
  Description of Artificial Sequence: Synthetic peptide
DEEEIRSTNPVSTEQYGSVSTNIQRGNR

SEQ ID NO: 6293 - protein, 28 aa, Artificial Sequence
  Description of Artificial Sequence: Synthetic peptide
DEEEIRTTNPVATELYGSVSTNLQQGDR

SEQ ID NO: 6294 - protein, 28 aa, Artificial Sequence
  Description of Artificial Sequence: Synthetic peptide
DEEEIRTTNPVATEQYGSVSTNLQWGEA

SEQ ID NO: 6295 - protein, 29 aa, Artificial Sequence
  Description of Artificial Sequence: Synthetic peptide
DEEEIRTTNPVATEQYGSVDSTNLQIGER

SEQ ID NO: 6296 - protein, 29 aa, Artificial Sequence
  Description of Artificial Sequence: Synthetic peptide
DEEEIRTTNPVATEQYGSVSTNLQDKGNI

SEQ ID NO: 6297 - protein, 28 aa, Artificial Sequence
  Description of Artificial Sequence: Synthetic peptide
DENEIATTNPVATEQYGSVSTNLQHGNR

SEQ ID NO: 6298 - protein, 28 aa, Artificial Sequence
  Description of Artificial Sequence: Synthetic peptide
DEQEIRTTNPVATEQYGSVSTNLERGNF

SEQ ID NO: 6299 - protein, 28 aa, Artificial Sequence
  Description of Artificial Sequence: Synthetic peptide
AEEEIRTTNPVSTEVYGSVSTNLQRGNR

SEQ ID NO: 6300 - protein, 28 aa, Artificial Sequence
  Description of Artificial Sequence: Synthetic peptide
DEEEIRTTNPVATEQYGSVSTELQLGNN

SEQ ID NO: 6301 - protein, 29 aa, Artificial Sequence
  Description of Artificial Sequence: Synthetic peptide
DEEEIRTTNPVATEQYGSVSTNLQEAGNF

SEQ ID NO: 6302 - protein, 30 aa, Artificial Sequence
  Description of Artificial Sequence: Synthetic polypeptide
DEEEIRTTNPVATEQYGSVSTNDQQREGNR

SEQ ID NO: 6303 - protein, 28 aa, Artificial Sequence
  Description of Artificial Sequence: Synthetic peptide
DEEEIRTTNPVATEQYGSVSTNLDRGEW

SEQ ID NO: 6304 - protein, 28 aa, Artificial Sequence
  Description of Artificial Sequence: Synthetic peptide
DEEEIRTTNPVATEQYGSVSTNPQEGNQ

SEQ ID NO: 6305 - protein, 30 aa, Artificial Sequence
  Description of Artificial Sequence: Synthetic polypeptide
DEEEIRTTNPVATEQYGSVSETDNLQRGER

SEQ ID NO: 6306 - protein, 28 aa, Artificial Sequence
  Description of Artificial Sequence: Synthetic peptide
DEEEIVTTNPVATEMYGSVSTDLQRGNR

SEQ ID NO: 6307 - protein, 28 aa, Artificial Sequence
  Description of Artificial Sequence: Synthetic peptide
DEEEIRTTNPVATELYGAVSTNLQRGNG

SEQ ID NO: 6308 - protein, 29 aa, Artificial Sequence
  Description of Artificial Sequence: Synthetic peptide
DEEEIRTTNPVCTEQYGLVSTNGLQRGNR

SEQ ID NO: 6309 - protein, 28 aa, Artificial Sequence
  Description of Artificial Sequence: Synthetic peptide
DEEEIRTTNPVAYEQYGSVETNLDRGNR

SEQ ID NO: 6310 - protein, 28 aa, Artificial Sequence
  Description of Artificial Sequence: Synthetic peptide
DEEEIRTTNPVATEQYGSVSTNLQAGEQ

SEQ ID NO: 6311 - protein, 28 aa, Artificial Sequence
  Description of Artificial Sequence: Synthetic peptide
DEEEIMTTNPVATEQYGSVSENLQRENR

SEQ ID NO: 6312 - protein, 30 aa, Artificial Sequence
  Description of Artificial Sequence: Synthetic polypeptide
DEEEIRTTNPVATEQYGSVSTNLTQRKGNV

SEQ ID NO: 6313 - protein, 28 aa, Artificial Sequence
  Description of Artificial Sequence: Synthetic peptide
DEEEIVTTNPVATEQYGSVSTPLQRGNL

SEQ ID NO: 6314 - protein, 30 aa, Artificial Sequence
  Description of Artificial Sequence: Synthetic polypeptide
DEEEIRTTNPVATEQYGSVSTNLVDERGNR

SEQ ID NO: 6315 - protein, 29 aa, Artificial Sequence
  Description of Artificial Sequence: Synthetic peptide
DEEEIRTTNPVATEQYGSVSCTDLQYGNR

SEQ ID NO: 6316 - protein, 29 aa, Artificial Sequence
  Description of Artificial Sequence: Synthetic peptide
DEENIRTTNPVATEVYGSVSCTNLQRGNR

SEQ ID NO: 6317 - protein, 30 aa, Artificial Sequence
  Description of Artificial Sequence: Synthetic polypeptide
DEEEIRTTNPVATEQYGSVSTNLVQEIGNR

SEQ ID NO: 6318 - protein, 30 aa, Artificial Sequence
  Description of Artificial Sequence: Synthetic polypeptide
DEEEIRTTNPVATEQYGSVYSTNLQRGDNH

SEQ ID NO: 6319 - protein, 29 aa, Artificial Sequence
  Description of Artificial Sequence: Synthetic peptide
DEEEITTTNPVATEQYGSVSTNLQRGNDN

SEQ ID NO: 6320 - protein, 28 aa, Artificial Sequence
  Description of Artificial Sequence: Synthetic peptide
DEEEIRCTNPVCTEQYGSVSTNLQRGAR

SEQ ID NO: 6321 - protein, 28 aa, Artificial Sequence
  Description of Artificial Sequence: Synthetic peptide
DEEEIRTTNPVATEQYGSVSTNLERGDQ

SEQ ID NO: 6322 - protein, 30 aa, Artificial Sequence
  Description of Artificial Sequence: Synthetic polypeptide
DEEEIRTTNPVATEQYGAVSTENLQRGNYR

SEQ ID NO: 6323 - protein, 28 aa, Artificial Sequence
  Description of Artificial Sequence: Synthetic peptide
DEEEIRTTNPVATEQYGSVSTNEQHGNQ

SEQ ID NO: 6324 - protein, 28 aa, Artificial Sequence
  Description of Artificial Sequence: Synthetic peptide
DEEEIRTTNPVATEQYGSVSTDLEVGNR

SEQ ID NO: 6325 - protein, 29 aa, Artificial Sequence
  Description of Artificial Sequence: Synthetic peptide
DEEEIRTTNPTATEQYGSVSTNLQNGDNR

SEQ ID NO: 6326 - protein, 28 aa, Artificial Sequence
  Description of Artificial Sequence: Synthetic peptide
KEEEIRTTNPVATEQYGSVSDNLQRGLR

SEQ ID NO: 6327 - protein, 28 aa, Artificial Sequence
  Description of Artificial Sequence: Synthetic peptide
DEEEIRTTNPVATEQYGVVSTNLQYGNG

SEQ ID NO: 6328 - protein, 29 aa, Artificial Sequence
  Description of Artificial Sequence: Synthetic peptide
DEEEIRTTNPVATEQYGSVSTNLQRGEDN

SEQ ID NO: 6329 - protein, 29 aa, Artificial Sequence
  Description of Artificial Sequence: Synthetic peptide
DEEEIRTTNPVCTEQYGSVSTMNLQRGLR

SEQ ID NO: 6330 - protein, 28 aa, Artificial Sequence
  Description of Artificial Sequence: Synthetic peptide
DEEEIRTTNPVATEIYGSVSTNLQQGNC

SEQ ID NO: 6331 - protein, 28 aa, Artificial Sequence
  Description of Artificial Sequence: Synthetic peptide
DEEEIRTTNPCATEQYGATSTNLQRGNR

SEQ ID NO: 6332 - protein, 29 aa, Artificial Sequence
  Description of Artificial Sequence: Synthetic peptide
DEEEVRTVNPVATEQYGSVSTNLQRAGNR

SEQ ID NO: 6333 - protein, 29 aa, Artificial Sequence
  Description of Artificial Sequence: Synthetic peptide
DNEEIRTTNPVATEQYGSVSTENLQRGNT

SEQ ID NO: 6334 - protein, 28 aa, Artificial Sequence
  Description of Artificial Sequence: Synthetic peptide
DEEEICTTNPVATEQCGSVSTNLQHGNR

SEQ ID NO: 6335 - protein, 29 aa, Artificial Sequence
  Description of Artificial Sequence: Synthetic peptide
DEEEIRTTNPVATEQYGSVDSTNDLRGNR

SEQ ID NO: 6336 - protein, 28 aa, Artificial Sequence
  Description of Artificial Sequence: Synthetic peptide
DEHEIRTTNPVATEQYGSVSTNLQLGNV

SEQ ID NO: 6337 - protein, 29 aa, Artificial Sequence
  Description of Artificial Sequence: Synthetic peptide
DEEEIRTTNPVATEQYGSVSTNDQREGNF

SEQ ID NO: 6338 - protein, 28 aa, Artificial Sequence
  Description of Artificial Sequence: Synthetic peptide
DEEEIATTNPVATEIYGSVSTNLQPGNR

SEQ ID NO: 6339 - protein, 28 aa, Artificial Sequence
  Description of Artificial Sequence: Synthetic peptide
DEEEIRTTNPVATEQYGSVSTELERGDR

SEQ ID NO: 6340 - protein, 28 aa, Artificial Sequence
  Description of Artificial Sequence: Synthetic peptide
DEEEIRTTNPVATEQYWSWSTNLQDGNR

SEQ ID NO: 6341 - protein, 29 aa, Artificial Sequence
  Description of Artificial Sequence: Synthetic peptide
DEEEIRTTNPVATEQYGWVSTNLQREGNI

SEQ ID NO: 6342 - protein, 29 aa, Artificial Sequence
  Description of Artificial Sequence: Synthetic peptide
DEEEIRTTNPVATEQYGSRSTNLQERTNR

SEQ ID NO: 6343 - protein, 29 aa, Artificial Sequence
  Description of Artificial Sequence: Synthetic peptide
DEEEIRTTNPVATEQYGSVSTNLQNIGNM

SEQ ID NO: 6344 - protein, 28 aa, Artificial Sequence
  Description of Artificial Sequence: Synthetic peptide
DEEEIRTTNPVATEQFGSVSTNLSRGVR

SEQ ID NO: 6345 - protein, 28 aa, Artificial Sequence
  Description of Artificial Sequence: Synthetic peptide
DEEEIRTTNPVATEQYGSVSTNLEVGND

SEQ ID NO: 6346 - protein, 28 aa, Artificial Sequence
  Description of Artificial Sequence: Synthetic peptide
DEEEIRTTNPVATEQYGSVSTDLQHGND

SEQ ID NO: 6347 - protein, 28 aa, Artificial Sequence
  Description of Artificial Sequence: Synthetic peptide
DEEEIRTTNPVATEQYGSVSTPLQRGEN

SEQ ID NO: 6348 - protein, 28 aa, Artificial Sequence
  Description of Artificial Sequence: Synthetic peptide
MEQEIRTTNPVATEQYGSVSTNLQNGNR

SEQ ID NO: 6349 - protein, 28 aa, Artificial Sequence
  Description of Artificial Sequence: Synthetic peptide
DEQEIATTNPVATESYGSVSTNLQRGNR

SEQ ID NO: 6350 - protein, 31 aa, Artificial Sequence
  Description of Artificial Sequence: Synthetic polypeptide
DEEEIRTTNPVATEQYGSVTSHTMNLQRGNR

SEQ ID NO: 6351 - protein, 28 aa, Artificial Sequence
  Description of Artificial Sequence: Synthetic peptide
DEQEIRTTNPVATEQYGSVSDNLDRGNR

SEQ ID NO: 6352 - protein, 29 aa, Artificial Sequence
  Description of Artificial Sequence: Synthetic peptide
DEEEIRTTNPCATEQYGSVSTNLIRNGNR

SEQ ID NO: 6353 - protein, 28 aa, Artificial Sequence
  Description of Artificial Sequence: Synthetic peptide
DEEEIRTTNPVCTEQYGSVDTNDQRGNR

SEQ ID NO: 6354 - protein, 28 aa, Artificial Sequence
  Description of Artificial Sequence: Synthetic peptide
DEEEINTTNPVATEQYGSVSENLQRGQR

SEQ ID NO: 6355 - protein, 30 aa, Artificial Sequence
  Description of Artificial Sequence: Synthetic polypeptide
DEEEIRTTNPVATEQYGSVSTENLQQGNDR

SEQ ID NO: 6356 - protein, 28 aa, Artificial Sequence
  Description of Artificial Sequence: Synthetic peptide
DEEEIRTTNPVATECYGSVSTNLQRGEW

SEQ ID NO: 6357 - protein, 28 aa, Artificial Sequence
  Description of Artificial Sequence: Synthetic peptide
DEEEIRTTNPVATEQYGSVSTPLQTGNH

SEQ ID NO: 6358 - protein, 29 aa, Artificial Sequence
  Description of Artificial Sequence: Synthetic peptide
SEEEIRTTNPVATEQYGSASTMNLQRGNR

SEQ ID NO: 6359 - protein, 29 aa, Artificial Sequence
  Description of Artificial Sequence: Synthetic peptide
LEEEIRTTNPVATEQYGSVSTNKLQKGNR

SEQ ID NO: 6360 - protein, 28 aa, Artificial Sequence
  Description of Artificial Sequence: Synthetic peptide
DEEEIRATNPAATEQYGSVSTNLQQGNR

SEQ ID NO: 6361 - protein, 30 aa, Artificial Sequence
  Description of Artificial Sequence: Synthetic polypeptide
DEEEIRTTNPVATEQYGSVSTAGWLQRGNR

SEQ ID NO: 6362 - protein, 28 aa, Artificial Sequence
  Description of Artificial Sequence: Synthetic peptide
DEDEIRTTNPVATEQYGSVPTNLMRGNR

SEQ ID NO: 6363 - protein, 28 aa, Artificial Sequence
  Description of Artificial Sequence: Synthetic peptide
DEEEIRTTNPVATEQYGSVSTELQEGER

SEQ ID NO: 6364 - protein, 29 aa, Artificial Sequence
  Description of Artificial Sequence: Synthetic peptide
DETEIRTTNPVATEQYGSVSTNLQRGNDS

SEQ ID NO: 6365 - protein, 28 aa, Artificial Sequence
  Description of Artificial Sequence: Synthetic peptide
DEEEVVTTNPVATEQYGSVSTNLQHGNR

SEQ ID NO: 6366 - protein, 29 aa, Artificial Sequence
  Description of Artificial Sequence: Synthetic peptide
DEEEIRSTNPVATEVYGSVSTNLQREGNR

SEQ ID NO: 6367 - protein, 28 aa, Artificial Sequence
  Description of Artificial Sequence: Synthetic peptide
DEEEIRTTNPCSTEQYGSVSTNCQRGNR

SEQ ID NO: 6368 - protein, 28 aa, Artificial Sequence
  Description of Artificial Sequence: Synthetic peptide
DEEEIRTTNPVATEQYGSVSTNEQNENR

SEQ ID NO: 6369 - protein, 30 aa, Artificial Sequence
  Description of Artificial Sequence: Synthetic polypeptide
DEEEIRTTNPVATEQYGSVSTMNLQRGDNG

SEQ ID NO: 6370 - protein, 29 aa, Artificial Sequence
  Description of Artificial Sequence: Synthetic peptide
KEEEIRTTNPVATEQYGSASTNLQRGNDR

SEQ ID NO: 6371 - protein, 29 aa, Artificial Sequence
  Description of Artificial Sequence: Synthetic peptide
DEEEIRTTNPVATEQYGSVSTGNEQRGNE

SEQ ID NO: 6372 - protein, 28 aa, Artificial Sequence
  Description of Artificial Sequence: Synthetic peptide
DEEEIRTTNPFATEQYGSVSTGLQRGNP

SEQ ID NO: 6373 - protein, 28 aa, Artificial Sequence
  Description of Artificial Sequence: Synthetic peptide
DEEEIRTTNPVATEQYGSWSTNDQRGNP

SEQ ID NO: 6374 - protein, 30 aa, Artificial Sequence
  Description of Artificial Sequence: Synthetic polypeptide
DEEEIRTTNPVATEQYGSVSTNLQVRGENW

SEQ ID NO: 6375 - protein, 28 aa, Artificial Sequence
  Description of Artificial Sequence: Synthetic peptide
DEEEIRTTNPVATEQYGSVSMNIQFGNR

SEQ ID NO: 6376 - protein, 29 aa, Artificial Sequence
  Description of Artificial Sequence: Synthetic peptide
DEDEIRTTNPVATEQYGSVSTNLPQIGNR

SEQ ID NO: 6377 - protein, 29 aa, Artificial Sequence
  Description of Artificial Sequence: Synthetic peptide
DEEEIRTTNPVSTEQYGSVSTNLQMRGNW

SEQ ID NO: 6378 - protein, 28 aa, Artificial Sequence
  Description of Artificial Sequence: Synthetic peptide
DEEEIRTTNPVCTEQYGDVSENLQRGNR

SEQ ID NO: 6379 - protein, 29 aa, Artificial Sequence
  Description of Artificial Sequence: Synthetic peptide
DEEEIRTTNPVATEQYGSVSTMNLQHGNQ

SEQ ID NO: 6380 - protein, 28 aa, Artificial Sequence
  Description of Artificial Sequence: Synthetic peptide
DEEEIRATNPVATEQYGSVSTNLQQGNF

SEQ ID NO: 6381 - protein, 28 aa, Artificial Sequence
  Description of Artificial Sequence: Synthetic peptide
DEEEIRTTNPVASEVYGCVSTNLQRGNR

SEQ ID NO: 6382 - protein, 29 aa, Artificial Sequence
  Description of Artificial Sequence: Synthetic peptide
DEEEIRTTNPVATEQYGSVSTNLQCKGNQ

SEQ ID NO: 6383 - protein, 28 aa, Artificial Sequence
  Description of Artificial Sequence: Synthetic peptide
DEEEIRTTNPVATEQYGSVSDNLCRGNS

SEQ ID NO: 6384 - protein, 28 aa, Artificial Sequence
  Description of Artificial Sequence: Synthetic peptide
DEEEIRTTNPVATEQYGAVSTNLDPGNR

SEQ ID NO: 6385 - protein, 29 aa, Artificial Sequence
  Description of Artificial Sequence: Synthetic peptide
DEMEIRTTNPVATECYGSVSTNLQRGENR

SEQ ID NO: 6386 - protein, 28 aa, Artificial Sequence
  Description of Artificial Sequence: Synthetic peptide
DENEIYTTNPEATEQYGSVSTNLQRGNR

SEQ ID NO: 6387 - protein, 28 aa, Artificial Sequence
  Description of Artificial Sequence: Synthetic peptide
DEEEIRTTNPVATEQYGSVSTELEQGNR

SEQ ID NO: 6388 - protein, 29 aa, Artificial Sequence
  Description of Artificial Sequence: Synthetic peptide
DEEEIRTTNPVATECYGSVSTELQERGNR

SEQ ID NO: 6389 - protein, 29 aa, Artificial Sequence
  Description of Artificial Sequence: Synthetic peptide
DEEEIRTTNPVATEQYGSVSTNQERGNDR

SEQ ID NO: 6390 - protein, 28 aa, Artificial Sequence
  Description of Artificial Sequence: Synthetic peptide
DEEEIRTTNPVATEHYGSVSTNLQHGNQ

SEQ ID NO: 6391 - protein, 31 aa, Artificial Sequence
  Description of Artificial Sequence: Synthetic polypeptide
DEEEIRTTNPVATEQYGSYVSVTNLQRGLNR

SEQ ID NO: 6392 - protein, 28 aa, Artificial Sequence
  Description of Artificial Sequence: Synthetic peptide
DEEEIRTTNPVATEQYGSVSTGLEDGNR

SEQ ID NO: 6393 - protein, 28 aa, Artificial Sequence
  Description of Artificial Sequence: Synthetic peptide
DSYEIRTTNPVATEQYGSVETNLQRGNR

SEQ ID NO: 6394 - protein, 30 aa, Artificial Sequence
  Description of Artificial Sequence: Synthetic polypeptide
DEEEIRTTNPVATEQYGSVSETNLQEDGNR

SEQ ID NO: 6395 - protein, 28 aa, Artificial Sequence
  Description of Artificial Sequence: Synthetic peptide
DEEEIRTTNPVATEQYGSVSTELQYGNM

SEQ ID NO: 6396 - protein, 28 aa, Artificial Sequence
  Description of Artificial Sequence: Synthetic peptide
DEEEIRTTNPVATEQYGSVSTDLQGGNT

SEQ ID NO: 6397 - protein, 29 aa, Artificial Sequence
  Description of Artificial Sequence: Synthetic peptide
DEEEIRTTNPVATEQYGSVSTNEQMVGNR

SEQ ID NO: 6398 - protein, 29 aa, Artificial Sequence
  Description of Artificial Sequence: Synthetic peptide
DEEEIRTTNPVATEQYGSVSTNLQREGED

SEQ ID NO: 6399 - protein, 28 aa, Artificial Sequence
  Description of Artificial Sequence: Synthetic peptide
DETEIRTTNPVATEQYGSVSTPLQRGNS

SEQ ID NO: 6400 - protein, 29 aa, Artificial Sequence
  Description of Artificial Sequence: Synthetic peptide
DEEEIRTTNPVATEQYGSVSLENLQRGPR

SEQ ID NO: 6401 - protein, 28 aa, Artificial Sequence
  Description of Artificial Sequence: Synthetic peptide
DEEEIRTTNPVATEPYGSVGTNLQRGND

SEQ ID NO: 6402 - protein, 29 aa, Artificial Sequence
  Description of Artificial Sequence: Synthetic peptide
DEEEIRTTNPVATEQYGSVSTNLQLGNDA

SEQ ID NO: 6403 - protein, 28 aa, Artificial Sequence
  Description of Artificial Sequence: Synthetic peptide
NEEEIRTTNPVATETYGSVSTPLQRGNR

SEQ ID NO: 6404 - protein, 30 aa, Artificial Sequence
  Description of Artificial Sequence: Synthetic polypeptide
DEEEIRTTNPVATEQYGSVDSTNLVQRGNI

SEQ ID NO: 6405 - protein, 29 aa, Artificial Sequence
  Description of Artificial Sequence: Synthetic peptide
DEEEIRTTNPVATEQYGSVSTELQRGDND

SEQ ID NO: 6406 - protein, 29 aa, Artificial Sequence
  Description of Artificial Sequence: Synthetic peptide
DEEEIRTTNPVATEQYGSVSTNLQVGDPR

SEQ ID NO: 6407 - protein, 29 aa, Artificial Sequence
  Description of Artificial Sequence: Synthetic peptide
AEEEIRTTNPFATEQYGSVSTNGLQRGNR

SEQ ID NO: 6408 - protein, 28 aa, Artificial Sequence
  Description of Artificial Sequence: Synthetic peptide
DEEEIRTTNPVATDQYGSVSTNLQTANR

SEQ ID NO: 6409 - protein, 28 aa, Artificial Sequence
  Description of Artificial Sequence: Synthetic peptide
DEEEVRATNPVASEQYGSVSTNLQRGNR

SEQ ID NO: 6410 - protein, 31 aa, Artificial Sequence
  Description of Artificial Sequence: Synthetic polypeptide
DEEEIRTTNPVATEQYGSVSTNLVQDRGNDR

SEQ ID NO: 6411 - protein, 28 aa, Artificial Sequence
  Description of Artificial Sequence: Synthetic peptide
DEEEIATTNPVATEQYGSVSANWQRGNR

SEQ ID NO: 6412 - protein, 31 aa, Artificial Sequence
  Description of Artificial Sequence: Synthetic polypeptide
DEEEIRTTNPVATEQYGHSVHSTNLQRVGNR

SEQ ID NO: 6413 - protein, 28 aa, Artificial Sequence
  Description of Artificial Sequence: Synthetic peptide
DEEEIRTTNTVATEQYGSVCTNLQRSNR

SEQ ID NO: 6414 - protein, 29 aa, Artificial Sequence
  Description of Artificial Sequence: Synthetic peptide
SEEEIRTTNPVATEQYGSVSTNLQREGNI

SEQ ID NO: 6415 - protein, 28 aa, Artificial Sequence
  Description of Artificial Sequence: Synthetic peptide
DEEEIRTTNPVATEQYGDVSTCLQRGER

SEQ ID NO: 6416 - protein, 28 aa, Artificial Sequence
  Description of Artificial Sequence: Synthetic peptide
DEEEIRTTNPDATEQYGSVSTNLLRGNL

SEQ ID NO: 6417 - protein, 28 aa, Artificial Sequence
  Description of Artificial Sequence: Synthetic peptide
SEEEIRPTNPVATEQYGSVATNLQRGNR

SEQ ID NO: 6418 - protein, 28 aa, Artificial Sequence
  Description of Artificial Sequence: Synthetic peptide
DEEEIRTTNPVATEQYGSVSTNLEYGNA

SEQ ID NO: 6419 - protein, 29 aa, Artificial Sequence
  Description of Artificial Sequence: Synthetic peptide
DEEEIRTTNPVATEQYGSVSTNLQDTGDR

SEQ ID NO: 6420 - protein, 29 aa, Artificial Sequence
  Description of Artificial Sequence: Synthetic peptide
DEEEIMTTNPVATEQYGSVSTNLQRGINS

SEQ ID NO: 6421 - protein, 29 aa, Artificial Sequence
  Description of Artificial Sequence: Synthetic peptide
DEEEIRTTNPVATEQYGSVSTNLPERGER

SEQ ID NO: 6422 - protein, 28 aa, Artificial Sequence
  Description of Artificial Sequence: Synthetic peptide
DEEEIRTTNPVATECYGSVSTNLQSGNN

SEQ ID NO: 6423 - protein, 28 aa, Artificial Sequence
  Description of Artificial Sequence: Synthetic peptide
DEEEIRTTNPVATEQYGSVSTGLQPGNP

SEQ ID NO: 6424 - protein, 29 aa, Artificial Sequence
  Description of Artificial Sequence: Synthetic peptide
DEEEIRTVNPVATEQYGSVGTNLQRNGNR

SEQ ID NO: 6425 - protein, 29 aa, Artificial Sequence
  Description of Artificial Sequence: Synthetic peptide
DEEEIRTTNPVATEQYGSVCSTCLQRGER

SEQ ID NO: 6426 - protein, 28 aa, Artificial Sequence
  Description of Artificial Sequence: Synthetic peptide
DENEIRTTNPVATEQYGSVSTNLQIGNQ

SEQ ID NO: 6427 - protein, 28 aa, Artificial Sequence
  Description of Artificial Sequence: Synthetic peptide
DEEEIRTTNPVATEQYGSVSTNLQYGES

SEQ ID NO: 6428 - protein, 28 aa, Artificial Sequence
  Description of Artificial Sequence: Synthetic peptide
DEEEIRTTNPVATEQYGSVETNDQRGNV

SEQ ID NO: 6429 - protein, 28 aa, Artificial Sequence
  Description of Artificial Sequence: Synthetic peptide
DEEEIRTTNPVATEQYGSVSTNLEIGNA

SEQ ID NO: 6430 - protein, 29 aa, Artificial Sequence
  Description of Artificial Sequence: Synthetic peptide
DEEEIATTNPVATEQYGSVSTNLQREGNF

SEQ ID NO: 6431 - protein, 28 aa, Artificial Sequence
  Description of Artificial Sequence: Synthetic peptide
DEEEIRTTNPVAYEQYGCVGTNLQRGNR

SEQ ID NO: 6432 - protein, 29 aa, Artificial Sequence
  Description of Artificial Sequence: Synthetic peptide
DEEEIRTTNPVATEQYGSVSTNLQNGNDA

SEQ ID NO: 6433 - protein, 28 aa, Artificial Sequence
  Description of Artificial Sequence: Synthetic peptide
DEEEIRTTNPVATECYGSVSMNLQRGTR

SEQ ID NO: 6434 - protein, 28 aa, Artificial Sequence
  Description of Artificial Sequence: Synthetic peptide
AEEEIRTTNPVATINYGSVSTNLQRGNR

SEQ ID NO: 6435 - protein, 28 aa, Artificial Sequence
  Description of Artificial Sequence: Synthetic peptide
DEEEVRTTNPVATEQYGSVSTQLQRGTR

SEQ ID NO: 6436 - protein, 31 aa, Artificial Sequence
  Description of Artificial Sequence: Synthetic polypeptide
DEEEIRTTNPVATEQYGSVSTANLQERGNTR

SEQ ID NO: 6437 - protein, 28 aa, Artificial Sequence
  Description of Artificial Sequence: Synthetic peptide
QENEIATTNPVATEQYGSVSTNLQRGNR

SEQ ID NO: 6438 - protein, 28 aa, Artificial Sequence
  Description of Artificial Sequence: Synthetic peptide
DEEEIRTTNPVATEQYGSVSTNDQMGND

SEQ ID NO: 6439 - protein, 28 aa, Artificial Sequence
  Description of Artificial Sequence: Synthetic peptide
DEEEIRTTNPVATEQYGSVSTDLQRGEV

SEQ ID NO: 6440 - protein, 30 aa, Artificial Sequence
  Description of Artificial Sequence: Synthetic polypeptide
DEEEIRTTNPVATEQYGYSVSTNLQEPGNR

SEQ ID NO: 6441 - protein, 28 aa, Artificial Sequence
  Description of Artificial Sequence: Synthetic peptide
DEEEIRTTNPVATEQYGSVSTNLQYGEL

SEQ ID NO: 6442 - protein, 28 aa, Artificial Sequence
  Description of Artificial Sequence: Synthetic peptide
DEEEIRTTNPVATECYGSVSTNLQAGNW

SEQ ID NO: 6443 - protein, 29 aa, Artificial Sequence
  Description of Artificial Sequence: Synthetic peptide
DEEEIRTTNPVATEQFGSVSTMNLQQGNR

SEQ ID NO: 6444 - protein, 28 aa, Artificial Sequence
  Description of Artificial Sequence: Synthetic peptide
DEEEIRTTNPCATFCYGSVSTNLQRGNR

SEQ ID NO: 6445 - protein, 28 aa, Artificial Sequence
  Description of Artificial Sequence: Synthetic peptide
DEVEITTTNPVATEIYGSVSTNLQRGNR

SEQ ID NO: 6446 - protein, 28 aa, Artificial Sequence
  Description of Artificial Sequence: Synthetic peptide
DEEEIRTTNPVATEQYGSVSTNEQQGNF

SEQ ID NO: 6447 - protein, 28 aa, Artificial Sequence
  Description of Artificial Sequence: Synthetic peptide
DEEYIRTTNPVATEQYGSVSTNLDNGNR

SEQ ID NO: 6448 - protein, 28 aa, Artificial Sequence
  Description of Artificial Sequence: Synthetic peptide
DEEEIRTTNPVATEQYGSVSTPLQAGNS

SEQ ID NO: 6449 - protein, 28 aa, Artificial Sequence
  Description of Artificial Sequence: Synthetic peptide
DEEEICTTNPVAWEQYGSVSTNMQRGNR

SEQ ID NO: 6450 - protein, 30 aa, Artificial Sequence
  Description of Artificial Sequence: Synthetic polypeptide
DEEEIRTTNPVATEQYGSVSPTNLQRKGNT

SEQ ID NO: 6451 - protein, 28 aa, Artificial Sequence
  Description of Artificial Sequence: Synthetic peptide
DEEEIRTTNPDSTEQYGSVSTNLQRGGR

SEQ ID NO: 6452 - protein, 28 aa, Artificial Sequence
  Description of Artificial Sequence: Synthetic peptide
DEEEIVTTNPVATEQYGFVSTNLQRGQR

SEQ ID NO: 6453 - protein, 28 aa, Artificial Sequence
  Description of Artificial Sequence: Synthetic peptide
DEEEIRTTNPVATEQYGIVSTNGQRGNP

SEQ ID NO: 6454 - protein, 28 aa, Artificial Sequence
  Description of Artificial Sequence: Synthetic peptide
DEHEIRTTNPVATEQYGSVSEDLQRGNR

SEQ ID NO: 6455 - protein, 28 aa, Artificial Sequence
  Description of Artificial Sequence: Synthetic peptide
NEHEIRTTNPVATEQYGSVSTNLQHGNR

SEQ ID NO: 6456 - protein, 28 aa, Artificial Sequence
  Description of Artificial Sequence: Synthetic peptide
DEEEIRTTNPVATEQYGSVDTEDQRGNR

SEQ ID NO: 6457 - protein, 28 aa, Artificial Sequence
  Description of Artificial Sequence: Synthetic peptide
DEEEIATTNPVATEQYGSASTNEQRGNR

SEQ ID NO: 6458 - protein, 28 aa, Artificial Sequence
  Description of Artificial Sequence: Synthetic peptide
DEEEIATTNPVATEQYGSVSTNLQQGNM

SEQ ID NO: 6459 - protein, 28 aa, Artificial Sequence
  Description of Artificial Sequence: Synthetic peptide
DEEEITTTNPVATEQYGSVSTNPQIGNR

SEQ ID NO: 6460 - protein, 29 aa, Artificial Sequence
  Description of Artificial Sequence: Synthetic peptide
DEEEIRTTNPVATEQYGSVSTNLQLHGNA

SEQ ID NO: 6461 - protein, 28 aa, Artificial Sequence
  Description of Artificial Sequence: Synthetic peptide
DEEEIRTTNPVATEQYGSVSTDLQLGNV

SEQ ID NO: 6462 - protein, 28 aa, Artificial Sequence
  Description of Artificial Sequence: Synthetic peptide
DEEEIRATNPVATEQYGSVSTNPQRGNG

SEQ ID NO: 6463 - protein, 28 aa, Artificial Sequence
  Description of Artificial Sequence: Synthetic peptide
DEEEIRTVNPVATEQYGNVSTNLQRGNE

SEQ ID NO: 6464 - protein, 28 aa, Artificial Sequence
  Description of Artificial Sequence: Synthetic peptide
DEEEIVTTNPVATEIYGWVSTNLQRGNR

SEQ ID NO: 6465 - protein, 28 aa, Artificial Sequence
  Description of Artificial Sequence: Synthetic peptide
DEEEIRTTNPAATEMYGSVSTNWQRGNR

SEQ ID NO: 6466 - protein, 28 aa, Artificial Sequence
  Description of Artificial Sequence: Synthetic peptide
DEEEIRTTNPVATEQYGSVSTNGQLGNW

SEQ ID NO: 6467 - protein, 28 aa, Artificial Sequence
  Description of Artificial Sequence: Synthetic peptide
AEEEIRTTNPVATEQYGSVSTDLQRGND

SEQ ID NO: 6468 - protein, 28 aa, Artificial Sequence
  Description of Artificial Sequence: Synthetic peptide
DEEEIRTTNPTATEQYGSVSTNLQIGNF

SEQ ID NO: 6469 - protein, 28 aa, Artificial Sequence
  Description of Artificial Sequence: Synthetic peptide
DENEIATTNPVATEQYGIVSTNLQRGNR

SEQ ID NO: 6470 - protein, 28 aa, Artificial Sequence
  Description of Artificial Sequence: Synthetic peptide
DEEEIATTNPVATEMFGSVSTNLQRGNR

SEQ ID NO: 6471 - protein, 28 aa, Artificial Sequence
  Description of Artificial Sequence: Synthetic peptide
DEEEIRTTNPVATEQYGSVDTNLQYGNA

SEQ ID NO: 6472 - protein, 28 aa, Artificial Sequence
  Description of Artificial Sequence: Synthetic peptide
DEEEIRTTNPVATEQWGSVHTNLQRGNF

SEQ ID NO: 6473 - protein, 28 aa, Artificial Sequence
  Description of Artificial Sequence: Synthetic peptide
DPEEIRTTNPVATEQYGSVHTNLQRGER

SEQ ID NO: 6474 - protein, 28 aa, Artificial Sequence
  Description of Artificial Sequence: Synthetic peptide
DEEEIRTTNPVATECYGSVSTNLQVGNS

SEQ ID NO: 6475 - protein, 28 aa, Artificial Sequence
  Description of Artificial Sequence: Synthetic peptide
DEDEIATTNPVATESYGSVSTNLQRGNR

SEQ ID NO: 6476 - protein, 28 aa, Artificial Sequence
  Description of Artificial Sequence: Synthetic peptide
DEEEIRTTNPVATEQYGSVSTNLQNGDS

SEQ ID NO: 6477 - protein, 28 aa, Artificial Sequence
  Description of Artificial Sequence: Synthetic peptide
DEEEIRTTNPVATEQYGSVSTNPQIGNE

SEQ ID NO: 6478 - protein, 31 aa, Artificial Sequence
  Description of Artificial Sequence: Synthetic polypeptide
DEEEIRTTNPVATEQYGSVSTCNLQREGVNR

SEQ ID NO: 6479 - protein, 30 aa, Artificial Sequence
  Description of Artificial Sequence: Synthetic polypeptide
DEEEIRTTNPVATEQYGSVSTNLQCSGNDR

SEQ ID NO: 6480 - protein, 28 aa, Artificial Sequence
  Description of Artificial Sequence: Synthetic peptide
DEEEIRTTNPVATEQYGSVSTNLQYGET

SEQ ID NO: 6481 - protein, 29 aa, Artificial Sequence
  Description of Artificial Sequence: Synthetic peptide
DEHEIRTTNPVCTEQYGSVSTNLQRGNDR

SEQ ID NO: 6482 - protein, 29 aa, Artificial Sequence
  Description of Artificial Sequence: Synthetic peptide
DEEEIRTTNPVATEQYGSVSWTNLHRGER

SEQ ID NO: 6483 - protein, 28 aa, Artificial Sequence
  Description of Artificial Sequence: Synthetic peptide
DEEEIRTTNPVATEQYGGVSTNLQSGNQ

SEQ ID NO: 6484 - protein, 29 aa, Artificial Sequence
  Description of Artificial Sequence: Synthetic peptide
DEEEIRTTNPVATEQYGSVSTDLQRGNDM

SEQ ID NO: 6485 - protein, 28 aa, Artificial Sequence
  Description of Artificial Sequence: Synthetic peptide
DEEEIRTTNPVATEQYGSVSTPDERGNR

SEQ ID NO: 6486 - protein, 28 aa, Artificial Sequence
  Description of Artificial Sequence: Synthetic peptide
DEEEIRTTNPCATETYGSVGTNLQRGNR

SEQ ID NO: 6487 - protein, 29 aa, Artificial Sequence
  Description of Artificial Sequence: Synthetic peptide
DEEEIRTTNPVATENYGSVSTCLQREGNR

SEQ ID NO: 6488 - protein, 30 aa, Artificial Sequence
  Description of Artificial Sequence: Synthetic polypeptide
DEEEIRTTNPVATEQYGSVSTPLVQREGNR

SEQ ID NO: 6489 - protein, 28 aa, Artificial Sequence
  Description of Artificial Sequence: Synthetic peptide
DEEEIRATNPVATEVYGSVGTNLQRGNR

SEQ ID NO: 6490 - protein, 28 aa, Artificial Sequence
  Description of Artificial Sequence: Synthetic peptide
KEEEIRTTNPVATEQYGSVSTNLQAGNY

SEQ ID NO: 6491 - protein, 29 aa, Artificial Sequence
  Description of Artificial Sequence: Synthetic peptide
DEEEIRTTNPVATEQYGSVSTNDQRLNPR

SEQ ID NO: 6492 - protein, 28 aa, Artificial Sequence
  Description of Artificial Sequence: Synthetic peptide
DEEEIRTTNPVATEQYGSVSTNQERGNW

SEQ ID NO: 6493 - protein, 28 aa, Artificial Sequence
  Description of Artificial Sequence: Synthetic peptide
DEQEIATTNPVATEVYGSVSTNLQRGNR

SEQ ID NO: 6494 - protein, 28 aa, Artificial Sequence
  Description of Artificial Sequence: Synthetic peptide
DEEEIRTTNPVCTEQYGVVSTELQRGNR

SEQ ID NO: 6495 - protein, 28 aa, Artificial Sequence
  Description of Artificial Sequence: Synthetic peptide
DDGEIRTTNPVATEQWGSVSTNLQRGNR

SEQ ID NO: 6496 - protein, 28 aa, Artificial Sequence
  Description of Artificial Sequence: Synthetic peptide
DEEEIRTTNPVATEQYGSVSTNPQQGNN

SEQ ID NO: 6497 - protein, 28 aa, Artificial Sequence
  Description of Artificial Sequence: Synthetic peptide
DEEEIRTTNPVATEIYGGVSTNLQVGNR

SEQ ID NO: 6498 - protein, 28 aa, Artificial Sequence
  Description of Artificial Sequence: Synthetic peptide
DEEEIRTTNPVATEQYGFVSTNLQAGNQ

SEQ ID NO: 6499 - protein, 28 aa, Artificial Sequence
  Description of Artificial Sequence: Synthetic peptide
DEEEIRTTNPVATEQYGSVSTNLQVGTA

SEQ ID NO: 6500 - protein, 28 aa, Artificial Sequence
  Description of Artificial Sequence: Synthetic peptide
DEEEIRTTNPVATMQYGSVSTGLDRGNR

SEQ ID NO: 6501 - protein, 28 aa, Artificial Sequence
  Description of Artificial Sequence: Synthetic peptide
DEEEIRTTNPVATMPYGSVSTNVQRGNR

SEQ ID NO: 6502 - protein, 28 aa, Artificial Sequence
  Description of Artificial Sequence: Synthetic peptide
DEEEIRTTNPVSTEQYGSVSTNLTRGDR

SEQ ID NO: 6503 - protein, 30 aa, Artificial Sequence
  Description of Artificial Sequence: Synthetic polypeptide
DEEEIRTTNPVATEQYGSVSTNPLQELGNR

SEQ ID NO: 6504 - protein, 28 aa, Artificial Sequence
  Description of Artificial Sequence: Synthetic peptide
DEEEIRTTNPVATEQYGSVSTNEQFGNA

SEQ ID NO: 6505 - protein, 30 aa, Artificial Sequence
  Description of Artificial Sequence: Synthetic polypeptide
DEEEIMTTNPVATEQYGSVSTNLQRNGNPR

SEQ ID NO: 6506 - protein, 30 aa, Artificial Sequence
  Description of Artificial Sequence: Synthetic polypeptide
DEEEIRTTNPVATEQYGSVSTNLQDTGNDR

SEQ ID NO: 6507 - protein, 28 aa, Artificial Sequence
  Description of Artificial Sequence: Synthetic peptide
DEEEIRTTNPAATEQYGSVSTNLQRGDY

SEQ ID NO: 6508 - protein, 29 aa, Artificial Sequence
  Description of Artificial Sequence: Synthetic peptide
DEEEIRTTNPVATEQYGSVSTNLQTEGNT

SEQ ID NO: 6509 - protein, 28 aa, Artificial Sequence
  Description of Artificial Sequence: Synthetic peptide
DESEIRTTNPVATEQYGSVSDNLQRENR

SEQ ID NO: 6510 - protein, 28 aa, Artificial Sequence
  Description of Artificial Sequence: Synthetic peptide
DEEEIRTTNPVATEQYGDVSTNIQRGNQ

SEQ ID NO: 6511 - protein, 30 aa, Artificial Sequence
  Description of Artificial Sequence: Synthetic polypeptide
DESEIRTTNPVATEQYGSVSTINGLQRGNR

SEQ ID NO: 6512 - protein, 28 aa, Artificial Sequence
  Description of Artificial Sequence: Synthetic peptide
DEEEIRTTNPVCTEQYGSVGENLQRGNR

SEQ ID NO: 6513 - protein, 28 aa, Artificial Sequence
  Description of Artificial Sequence: Synthetic peptide
DEEEVRTTNPVATEIYGSVSTNLQRGND

SEQ ID NO: 6514 - protein, 28 aa, Artificial Sequence
  Description of Artificial Sequence: Synthetic peptide
DEEEIRTTNPVATEQYGSVHTGLSRGNR

SEQ ID NO: 6515 - protein, 28 aa, Artificial Sequence
  Description of Artificial Sequence: Synthetic peptide
DEEEIRTTNPVATEQYGSVSTNDLRGER

SEQ ID NO: 6516 - protein, 29 aa, Artificial Sequence
  Description of Artificial Sequence: Synthetic peptide
DEEEIMTTNPVATEQYGCVSATNLQRGNR

SEQ ID NO: 6517 - protein, 30 aa, Artificial Sequence
  Description of Artificial Sequence: Synthetic polypeptide
DEEEIRTTNPVATEQYGSVSADNLQRAGNR

SEQ ID NO: 6518 - protein, 28 aa, Artificial Sequence
  Description of Artificial Sequence: Synthetic peptide
DEEETATTNPVATEQYGSVSTNLQRPNR

SEQ ID NO: 6519 - protein, 28 aa, Artificial Sequence
  Description of Artificial Sequence: Synthetic peptide
DEEEIRTTNPVATEQWGSVSTNLQIGNW

SEQ ID NO: 6520 - protein, 29 aa, Artificial Sequence
  Description of Artificial Sequence: Synthetic peptide
DENEIRTTNPVATEQYGSVSTNLQMQGNR

SEQ ID NO: 6521 - protein, 28 aa, Artificial Sequence
  Description of Artificial Sequence: Synthetic peptide
DEEEIRTTNCVATEQYGSVSTNGQLGNR

SEQ ID NO: 6522 - protein, 28 aa, Artificial Sequence
  Description of Artificial Sequence: Synthetic peptide
DEEEVRTTNPVATEIYGSVSTNLERGNR

SEQ ID NO: 6523 - protein, 29 aa, Artificial Sequence
  Description of Artificial Sequence: Synthetic peptide
IEEEIRPTNPVATEQYGSVSDTNLQRGNR

SEQ ID NO: 6524 - protein, 29 aa, Artificial Sequence
  Description of Artificial Sequence: Synthetic peptide
DEEEIRTTNPVATEQYGSVSTNLQTGEDR

SEQ ID NO: 6525 - protein, 30 aa, Artificial Sequence
  Description of Artificial Sequence: Synthetic polypeptide
DEEEIRTTNPVATEQYGSVSTANLQRGNTV

SEQ ID NO: 6526 - protein, 28 aa, Artificial Sequence
  Description of Artificial Sequence: Synthetic peptide
DEEEIRTTNPVATEQYGSVSTNEQDGER

SEQ ID NO: 6527 - protein, 28 aa, Artificial Sequence
  Description of Artificial Sequence: Synthetic peptide
DEEEIRTVNPVATEMYGSVGTNLQRGNR

SEQ ID NO: 6528 - protein, 28 aa, Artificial Sequence
  Description of Artificial Sequence: Synthetic peptide
DEEEIRTTNPVATEQYGSVSTNDQLGND

SEQ ID NO: 6529 - protein, 28 aa, Artificial Sequence
  Description of Artificial Sequence: Synthetic peptide
DEEEIRTTNPVATEGYGSVYLNLQRGNR

SEQ ID NO: 6530 - protein, 28 aa, Artificial Sequence
  Description of Artificial Sequence: Synthetic peptide
DEEEIRTTNPVATEQYGSVSTNLQHGEF

SEQ ID NO: 6531 - protein, 28 aa, Artificial Sequence
  Description of Artificial Sequence: Synthetic peptide
DEEEIRTTNPVATEIYGSVSTELQVGNR

SEQ ID NO: 6532 - protein, 28 aa, Artificial Sequence
  Description of Artificial Sequence: Synthetic peptide
DEEEIRTTNPVATEQYGSVSTNDQIGER

SEQ ID NO: 6533 - protein, 28 aa, Artificial Sequence
  Description of Artificial Sequence: Synthetic peptide
DEEEIRTTNPVATEQFGSYSTNLFRGNR

SEQ ID NO: 6534 - protein, 28 aa, Artificial Sequence
  Description of Artificial Sequence: Synthetic peptide
DEEEIRTTNPVATEQYGSVSTNLQNGEV

SEQ ID NO: 6535 - protein, 29 aa, Artificial Sequence
  Description of Artificial Sequence: Synthetic peptide
DEEELRTTNPVATEVYGSVSATNLQRGNR

SEQ ID NO: 6536 - protein, 28 aa, Artificial Sequence
  Description of Artificial Sequence: Synthetic peptide
DEEEIRTTNPVATEQYGSVSTNEQQGNS

SEQ ID NO: 6537 - protein, 28 aa, Artificial Sequence
  Description of Artificial Sequence: Synthetic peptide
DEEEIRTTNPVATEQYGSVSTNEQLGNA

SEQ ID NO: 6538 - protein, 28 aa, Artificial Sequence
  Description of Artificial Sequence: Synthetic peptide
DEEEIRTTNPVATEQYGSVSTNLQSGEN

SEQ ID NO: 6539 - protein, 28 aa, Artificial Sequence
  Description of Artificial Sequence: Synthetic peptide
DEEEIHTTNPVATEQWGSVSTNPQRGNR

SEQ ID NO: 6540 - protein, 28 aa, Artificial Sequence
  Description of Artificial Sequence: Synthetic peptide
GEEEIRATNPVATEVYGSVSTNLQRGNR

SEQ ID NO: 6541 - protein, 29 aa, Artificial Sequence
  Description of Artificial Sequence: Synthetic peptide
DEEEIRTTNPVATEQYGSVSTNEQLGNTR

SEQ ID NO: 6542 - protein, 28 aa, Artificial Sequence
  Description of Artificial Sequence: Synthetic peptide
DENEIRTTNPVATEQYGSVSTNLEHGNR

SEQ ID NO: 6543 - protein, 28 aa, Artificial Sequence
  Description of Artificial Sequence: Synthetic peptide
DEHEIRTTNPVATEQYGSVSENLQHGNR

SEQ ID NO: 6544 - protein, 28 aa, Artificial Sequence
  Description of Artificial Sequence: Synthetic peptide
DEEEIRTTNPVATEQYGSVSTNLQHGEN

SEQ ID NO: 6545 - protein, 29 aa, Artificial Sequence
  Description of Artificial Sequence: Synthetic peptide
DEEEIGTTNPVATEQYGSVSCNLQRAGNR

SEQ ID NO: 6546 - protein, 28 aa, Artificial Sequence
  Description of Artificial Sequence: Synthetic peptide
SEEEIRTTNPVATECYGSVSTNWQRGNR

SEQ ID NO: 6547 - protein, 29 aa, Artificial Sequence
  Description of Artificial Sequence: Synthetic peptide
DEEEIRTTNPVATEQYGSVLSTNLIRGNP

SEQ ID NO: 6548 - protein, 28 aa, Artificial Sequence
  Description of Artificial Sequence: Synthetic peptide
NEMEIRTTNPVATEQYGSVSTALQRGNR

SEQ ID NO: 6549 - protein, 31 aa, Artificial Sequence
  Description of Artificial Sequence: Synthetic polypeptide
DEEEIRTTNPVATEQYGSVSITNLQIRGNDR

SEQ ID NO: 6550 - protein, 29 aa, Artificial Sequence
  Description of Artificial Sequence: Synthetic peptide
DEAEIRTTNPVATEQYGDVSTNLQRGNYR

SEQ ID NO: 6551 - protein, 29 aa, Artificial Sequence
  Description of Artificial Sequence: Synthetic peptide
DEEEIRTTNPVATEQYGSVSTMDDQRGNR

SEQ ID NO: 6552 - protein, 28 aa, Artificial Sequence
  Description of Artificial Sequence: Synthetic peptide
DEEEIRTTNPVAWEQYGSVSSNDQRGNR

SEQ ID NO: 6553 - protein, 28 aa, Artificial Sequence
  Description of Artificial Sequence: Synthetic peptide
DEEEIRTTNPVATEQYGSVSTNLQLGDC

SEQ ID NO: 6554 - protein, 29 aa, Artificial Sequence
  Description of Artificial Sequence: Synthetic peptide
DEEMIRTTNPVATEQYGSVSTMGLQRGNR

SEQ ID NO: 6555 - protein, 28 aa, Artificial Sequence
  Description of Artificial Sequence: Synthetic peptide
VEEEIRTTNPVATEQYGSVGTNLQRGPR

SEQ ID NO: 6556 - protein, 29 aa, Artificial Sequence
  Description of Artificial Sequence: Synthetic peptide
DEEEIATTNPVATEQYGSVSTNLQREGTR

SEQ ID NO: 6557 - protein, 28 aa, Artificial Sequence
  Description of Artificial Sequence: Synthetic peptide
DEQEIRTTNPVATEMYGSVSTNLERGNR

SEQ ID NO: 6558 - protein, 28 aa, Artificial Sequence
  Description of Artificial Sequence: Synthetic peptide
DEEEIRTTNPVATECYGSVSTNEQIGNR

SEQ ID NO: 6559 - protein, 28 aa, Artificial Sequence
  Description of Artificial Sequence: Synthetic peptide
DEEEIRTTNPVATEQYGSVSTNDQSDNR

SEQ ID NO: 6560 - protein, 30 aa, Artificial Sequence
  Description of Artificial Sequence: Synthetic polypeptide
DEEEIRTTNPVATEQYGSVSTNLQENGNDR

SEQ ID NO: 6561 - protein, 28 aa, Artificial Sequence
  Description of Artificial Sequence: Synthetic peptide
DEEEIRTTNPVATEQYGSVSEADQRGNR

SEQ ID NO: 6562 - protein, 28 aa, Artificial Sequence
  Description of Artificial Sequence: Synthetic peptide
DEQEIRTTNPVATEQYGSVSTDLERGNR

SEQ ID NO: 6563 - protein, 28 aa, Artificial Sequence
  Description of Artificial Sequence: Synthetic peptide
DENEIRTVNPVATEQYGSVSTQLQRGNR

SEQ ID NO: 6564 - protein, 28 aa, Artificial Sequence
  Description of Artificial Sequence: Synthetic peptide
DEEEIRTTNPVATEQYGSVSTNEQQGNV

SEQ ID NO: 6565 - protein, 28 aa, Artificial Sequence
  Description of Artificial Sequence: Synthetic peptide
DELEIRTTNPVATEQYGSVSTNLQHGNA

SEQ ID NO: 6566 - protein, 28 aa, Artificial Sequence
  Description of Artificial Sequence: Synthetic peptide
DEEEIRTTNPVATELYGSVSTNLQRGTD

SEQ ID NO: 6567 - protein, 30 aa, Artificial Sequence
  Description of Artificial Sequence: Synthetic polypeptide
DEEEIRTTNPVATEQYGSASTNPLQRNGNR

SEQ ID NO: 6568 - protein, 28 aa, Artificial Sequence
  Description of Artificial Sequence: Synthetic peptide
DEEEIRTTNPVATECYGSVSTNLQRGES

SEQ ID NO: 6569 - protein, 28 aa, Artificial Sequence
  Description of Artificial Sequence: Synthetic peptide
DEEEIRTTNPVATEQYGSVSHNGQRPNR

SEQ ID NO: 6570 - protein, 28 aa, Artificial Sequence
  Description of Artificial Sequence: Synthetic peptide
DEEEIRTTNPVATEQYGSVSTDLQQGDR

SEQ ID NO: 6571 - protein, 29 aa, Artificial Sequence
  Description of Artificial Sequence: Synthetic peptide
DEEEIRTTNPVATEQYGSVSTNLQDQGNL

SEQ ID NO: 6572 - protein, 30 aa, Artificial Sequence
  Description of Artificial Sequence: Synthetic polypeptide
DEEEIRTTNPVATEQYGSVSMMNLQREGNR

SEQ ID NO: 6573 - protein, 28 aa, Artificial Sequence
  Description of Artificial Sequence: Synthetic peptide
DEEEIRTTNPVATEQYGSVSTELQRGES

SEQ ID NO: 6574 - protein, 29 aa, Artificial Sequence
  Description of Artificial Sequence: Synthetic peptide
NEENIRTTNPVATEQYGSVSTMNLQRGNR

SEQ ID NO: 6575 - protein, 28 aa, Artificial Sequence
  Description of Artificial Sequence: Synthetic peptide
DEEEITTTNPVCTEQYGSVSTNEQRGNR

SEQ ID NO: 6576 - protein, 29 aa, Artificial Sequence
  Description of Artificial Sequence: Synthetic peptide
DEEEIRTTNPVATEQYGSVSTNLQRNGEL

SEQ ID NO: 6577 - protein, 29 aa, Artificial Sequence
  Description of Artificial Sequence: Synthetic peptide
DEEEIRTTNPVATEQYGSVSTNLVQLGNN

SEQ ID NO: 6578 - protein, 28 aa, Artificial Sequence
  Description of Artificial Sequence: Synthetic peptide
DEDEIRTTNPVATEQYGSASTNLMRGNR

SEQ ID NO: 6579 - protein, 28 aa, Artificial Sequence
  Description of Artificial Sequence: Synthetic peptide
DEEEIRTTNPVATEQYGSVSTNLQREDA

SEQ ID NO: 6580 - protein, 28 aa, Artificial Sequence
  Description of Artificial Sequence: Synthetic peptide
HEEEIRTTNPVATENYGSVSNNLQRGNR

SEQ ID NO: 6581 - protein, 28 aa, Artificial Sequence
  Description of Artificial Sequence: Synthetic peptide
DEEEIRTTNPVATEQYGSVSTNLQAGEV

SEQ ID NO: 6582 - protein, 28 aa, Artificial Sequence
  Description of Artificial Sequence: Synthetic peptide
DEEEIRTTNPVATEQYGSVSTDLDPGNR

SEQ ID NO: 6583 - protein, 28 aa, Artificial Sequence
  Description of Artificial Sequence: Synthetic peptide
DDEEIRTTNPVASEQYGSVSSNLQRGNR

SEQ ID NO: 6584 - protein, 28 aa, Artificial Sequence
  Description of Artificial Sequence: Synthetic peptide
DEQEIRTTNPVATEQYGSVSECLQRGNR

SEQ ID NO: 6585 - protein, 30 aa, Artificial Sequence
  Description of Artificial Sequence: Synthetic polypeptide
DEEEIRTTNPVATEQYGSVSTNLQEHGNDR

SEQ ID NO: 6586 - protein, 28 aa, Artificial Sequence
  Description of Artificial Sequence: Synthetic peptide
QEEEIRTTNPVATEQYGTVSDNLQRGNR

SEQ ID NO: 6587 - protein, 30 aa, Artificial Sequence
  Description of Artificial Sequence: Synthetic polypeptide
DEEEIRTTNPVATEQYGSVSTPPLQRGNPR

SEQ ID NO: 6588 - protein, 28 aa, Artificial Sequence
  Description of Artificial Sequence: Synthetic peptide
DEQEIRTTNPVATEVYGWVSTNLQRGNR

SEQ ID NO: 6589 - protein, 28 aa, Artificial Sequence
  Description of Artificial Sequence: Synthetic peptide
DEMEIRTTNPVATEQYGSVSEVLQRGNR

SEQ ID NO: 6590 - protein, 28 aa, Artificial Sequence
  Description of Artificial Sequence: Synthetic peptide
DEEEIRTTNPVATEQYGSVDTDLQRGNL

SEQ ID NO: 6591 - protein, 29 aa, Artificial Sequence
  Description of Artificial Sequence: Synthetic peptide
DEESIRTTNPVATEQYGSVSETNLQRGER

SEQ ID NO: 6592 - protein, 29 aa, Artificial Sequence
  Description of Artificial Sequence: Synthetic peptide
DEEEIRTTNPVATEQYGSVETNLERGDNR

SEQ ID NO: 6593 - protein, 29 aa, Artificial Sequence
  Description of Artificial Sequence: Synthetic peptide
DEEEIRTTNPVATEQYGSVSTGLPQTGNR

SEQ ID NO: 6594 - protein, 28 aa, Artificial Sequence
  Description of Artificial Sequence: Synthetic peptide
DEEEIRATNPVATEQYGIVSMNLQRGNR

SEQ ID NO: 6595 - protein, 28 aa, Artificial Sequence
  Description of Artificial Sequence: Synthetic peptide
GEEEIRCTNPVATEQYGSVSTNDQRGNR

SEQ ID NO: 6596 - protein, 29 aa, Artificial Sequence
  Description of Artificial Sequence: Synthetic peptide
DEEEIRTTNPVATEQYWSVSTNLQRGVNP

SEQ ID NO: 6597 - protein, 29 aa, Artificial Sequence
  Description of Artificial Sequence: Synthetic peptide
DEEEIRTTNPVATEQYGSVSTNGEQSGNR

SEQ ID NO: 6598 - protein, 28 aa, Artificial Sequence
  Description of Artificial Sequence: Synthetic peptide
GEEEIRTTNPVATEQYGSVSTDLQRGER

SEQ ID NO: 6599 - protein, 28 aa, Artificial Sequence
  Description of Artificial Sequence: Synthetic peptide
DEMEIWTTNPVATEQYGSVSNNLQRGNR

SEQ ID NO: 6600 - protein, 30 aa, Artificial Sequence
  Description of Artificial Sequence: Synthetic polypeptide
DEEEIRTTNPVATEQYGSVSTTNLQRGEDR

SEQ ID NO: 6601 - protein, 28 aa, Artificial Sequence
  Description of Artificial Sequence: Synthetic peptide
DEEEIRTTNPVATEQYGSVSTNDQDGNI

SEQ ID NO: 6602 - protein, 29 aa, Artificial Sequence
  Description of Artificial Sequence: Synthetic peptide
DEEEIRTTNPVATEQYGSVSENLQWRGNY

SEQ ID NO: 6603 - protein, 28 aa, Artificial Sequence
  Description of Artificial Sequence: Synthetic peptide
DEQEIRTTNPVASETYGSVSTNLQRGNR

SEQ ID NO: 6604 - protein, 28 aa, Artificial Sequence
  Description of Artificial Sequence: Synthetic peptide
DEEEIRTTNPVATEQYGSVSTELERGNI

SEQ ID NO: 6605 - protein, 30 aa, Artificial Sequence
  Description of Artificial Sequence: Synthetic polypeptide
DEEEIRTTNPVATEQYGSVSTQNDQRGNDR

SEQ ID NO: 6606 - protein, 28 aa, Artificial Sequence
  Description of Artificial Sequence: Synthetic peptide
DEEEIRTTNPVATEQYGSVSTNEQLGNE

SEQ ID NO: 6607 - protein, 29 aa, Artificial Sequence
  Description of Artificial Sequence: Synthetic peptide
DEEEISTTNPVATEQYGSVSAENLQRGNR

SEQ ID NO: 6608 - protein, 30 aa, Artificial Sequence
  Description of Artificial Sequence: Synthetic polypeptide
DEEEIRTTNPVATEQYGSVDSTNLQRGNDF

SEQ ID NO: 6609 - protein, 28 aa, Artificial Sequence
  Description of Artificial Sequence: Synthetic peptide
DEQEIRTTNPIAHEQYGSVSTNLQRGNR

SEQ ID NO: 6610 - protein, 30 aa, Artificial Sequence
  Description of Artificial Sequence: Synthetic polypeptide
DEEEIRTTNPVATEQYGSVISTNLQERGNF

SEQ ID NO: 6611 - protein, 28 aa, Artificial Sequence
  Description of Artificial Sequence: Synthetic peptide
DEGGIRTTNPVATEQYGSVSTNLQMGNR

SEQ ID NO: 6612 - protein, 28 aa, Artificial Sequence
  Description of Artificial Sequence: Synthetic peptide
DEEEIRTTNPVATEQYGSVDENLQRGNI

SEQ ID NO: 6613 - protein, 30 aa, Artificial Sequence
  Description of Artificial Sequence: Synthetic polypeptide
DEEEIRTTNPVATEQYGSVSTTNLLRGDNR

SEQ ID NO: 6614 - protein, 29 aa, Artificial Sequence
  Description of Artificial Sequence: Synthetic peptide
DEEEIRTTNPVATEQYGSVSTNLMMQGNR

SEQ ID NO: 6615 - protein, 31 aa, Artificial Sequence
  Description of Artificial Sequence: Synthetic polypeptide
DEEEIRTTNPVATEQYGSVLSTWNFLQRGNR

SEQ ID NO: 6616 - protein, 28 aa, Artificial Sequence
  Description of Artificial Sequence: Synthetic peptide
DEEEIVTTNPVATEIYGSVSTELQRGNR

SEQ ID NO: 6617 - protein, 29 aa, Artificial Sequence
  Description of Artificial Sequence: Synthetic peptide
MEEEIRTTNPVATEQYGSVSTNLQTGNDR

SEQ ID NO: 6618 - protein, 29 aa, Artificial Sequence
  Description of Artificial Sequence: Synthetic peptide
DEQEIRTTNPVATEQYGSVSTNLQHKGNR

SEQ ID NO: 6619 - protein, 28 aa, Artificial Sequence
  Description of Artificial Sequence: Synthetic peptide
DEEEIRTVNPVATEQYGSVSTILQRMNR

SEQ ID NO: 6620 - protein, 28 aa, Artificial Sequence
  Description of Artificial Sequence: Synthetic peptide
DEEEIRTTNTVATEQWGSVSTNEQRGNR

SEQ ID NO: 6621 - protein, 29 aa, Artificial Sequence
  Description of Artificial Sequence: Synthetic peptide
DEEEIRTTNPVATEQYGSVSTNLQHGNDQ

SEQ ID NO: 6622 - protein, 28 aa, Artificial Sequence
  Description of Artificial Sequence: Synthetic peptide
DEEEIRTTNPVATEQYGSVSTNLEQGNT

SEQ ID NO: 6623 - protein, 30 aa, Artificial Sequence
  Description of Artificial Sequence: Synthetic polypeptide
DEEEIRTTNPVATEQYGSVGATNLQRGNDR

SEQ ID NO: 6624 - protein, 28 aa, Artificial Sequence
  Description of Artificial Sequence: Synthetic peptide
SEEEIRTTNPVATEQYGSVSTGLQSGNR

SEQ ID NO: 6625 - protein, 31 aa, Artificial Sequence
  Description of Artificial Sequence: Synthetic polypeptide
DEEEIRTTNPVATEQYGSVSTNLQERNGNDR

SEQ ID NO: 6626 - protein, 29 aa, Artificial Sequence
  Description of Artificial Sequence: Synthetic peptide
DEEEIRTTNPVASEQYGSVSTNLEREGNR

SEQ ID NO: 6627 - protein, 28 aa, Artificial Sequence
  Description of Artificial Sequence: Synthetic peptide
DEQEIRTTNPVATECYGSVSTNLQHGNR

SEQ ID NO: 6628 - protein, 28 aa, Artificial Sequence
  Description of Artificial Sequence: Synthetic peptide
DEEEIRTTNPVATEQYGSADSNLQRGNR

SEQ ID NO: 6629 - protein, 28 aa, Artificial Sequence
  Description of Artificial Sequence: Synthetic peptide
DEEEIRTTNPFATEQYGYVSTNLQRGNG

SEQ ID NO: 6630 - protein, 29 aa, Artificial Sequence
  Description of Artificial Sequence: Synthetic peptide
DEEEIRTTNPVATEQYGSVSTNLQEDGNQ

SEQ ID NO: 6631 - protein, 29 aa, Artificial Sequence
  Description of Artificial Sequence: Synthetic peptide
DEEEISTTNPVATECYGSVSTNLQRGNDR

SEQ ID NO: 6632 - protein, 28 aa, Artificial Sequence
  Description of Artificial Sequence: Synthetic peptide
DEEEIRTTNPVMTEYYGSVSTNLQRGNA

SEQ ID NO: 6633 - protein, 28 aa, Artificial Sequence
  Description of Artificial Sequence: Synthetic peptide
DEEEIATTNPVATEQYGSVSTELQRGNV

SEQ ID NO: 6634 - protein, 29 aa, Artificial Sequence
  Description of Artificial Sequence: Synthetic peptide
DEEEIRTTNPVAMEQYGSVSVTNTQRGNR

SEQ ID NO: 6635 - protein, 29 aa, Artificial Sequence
  Description of Artificial Sequence: Synthetic peptide
DEEEIATTNPVATEQYGSVSCTDLQRGNR

SEQ ID NO: 6636 - protein, 28 aa, Artificial Sequence
  Description of Artificial Sequence: Synthetic peptide
DEEEIVATNPVATEQYGSVATNLQRGNR

SEQ ID NO: 6637 - protein, 30 aa, Artificial Sequence
  Description of Artificial Sequence: Synthetic polypeptide
DEEEIRTTNPVATEQYGSVSTENLEQRGNA

SEQ ID NO: 6638 - protein, 28 aa, Artificial Sequence
  Description of Artificial Sequence: Synthetic peptide
DEEEIRTTNPVATEQYGSVSTGDQPGNR

SEQ ID NO: 6639 - protein, 28 aa, Artificial Sequence
  Description of Artificial Sequence: Synthetic peptide
DEEEIRTTNPDCTAQYGSVSTNLQRGNR

SEQ ID NO: 6640 - protein, 30 aa, Artificial Sequence
  Description of Artificial Sequence: Synthetic polypeptide
DEEEIRTTNPVATEQYGAVSTNLTQRDGNR

SEQ ID NO: 6641 - protein, 29 aa, Artificial Sequence
  Description of Artificial Sequence: Synthetic peptide
DEEEIRTTNPVATEQYGSVDTNLQMRGNQ

SEQ ID NO: 6642 - protein, 30 aa, Artificial Sequence
  Description of Artificial Sequence: Synthetic polypeptide
DEEEIRTTNPVATEQYGSVSTNLQGEGNDR

SEQ ID NO: 6643 - protein, 28 aa, Artificial Sequence
  Description of Artificial Sequence: Synthetic peptide
DEEEIRTTNPVATEQYGSVFTNLQRQNP

SEQ ID NO: 6644 - protein, 29 aa, Artificial Sequence
  Description of Artificial Sequence: Synthetic peptide
DEEEIRTTNPVATEQYWGEVSENLQRGNR

SEQ ID NO: 6645 - protein, 28 aa, Artificial Sequence
  Description of Artificial Sequence: Synthetic peptide
DENEIRTTNPVATEQYGSVSTEDQRGNR

SEQ ID NO: 6646 - protein, 28 aa, Artificial Sequence
  Description of Artificial Sequence: Synthetic peptide
DEIEIRTTNPVATELYGSVSTNLQRENR

SEQ ID NO: 6647 - protein, 28 aa, Artificial Sequence
  Description of Artificial Sequence: Synthetic peptide
SDEEIRTTNPVATEQYGSVSTNLQSGNR

SEQ ID NO: 6648 - protein, 28 aa, Artificial Sequence
  Description of Artificial Sequence: Synthetic peptide
DEEEIRATNPVATEQYGSVSTNLEAGNR

SEQ ID NO: 6649 - protein, 29 aa, Artificial Sequence
  Description of Artificial Sequence: Synthetic peptide
DEEEIRTTNPVATQQYGSVVDTNLQRGNR

SEQ ID NO: 6650 - protein, 28 aa, Artificial Sequence
  Description of Artificial Sequence: Synthetic peptide
DEEEIRTTNPCATEQYGSVSTNLEMGNR

SEQ ID NO: 6651 - protein, 28 aa, Artificial Sequence
  Description of Artificial Sequence: Synthetic peptide
DEEEIRSVNPVATEQYGSVATNLQRGNR

SEQ ID NO: 6652 - protein, 28 aa, Artificial Sequence
  Description of Artificial Sequence: Synthetic peptide
DESEIRATNPVSTEQYGSVSTNLQRGNR

SEQ ID NO: 6653 - protein, 28 aa, Artificial Sequence
  Description of Artificial Sequence: Synthetic peptide
DEEEIATTNPVATEQYGSVSTNEQHGNR

SEQ ID NO: 6654 - protein, 28 aa, Artificial Sequence
  Description of Artificial Sequence: Synthetic peptide
DEVEIRTTNPVATEQYGSVSDNLQFGNR

SEQ ID NO: 6655 - protein, 28 aa, Artificial Sequence
  Description of Artificial Sequence: Synthetic peptide
DEEEIATTNPVATEQYGWVSDNLQRGNR

SEQ ID NO: 6656 - protein, 29 aa, Artificial Sequence
  Description of Artificial Sequence: Synthetic peptide
DEEEIRTTNPVATEQYGSVESTNLQQGDR

SEQ ID NO: 6657 - protein, 28 aa, Artificial Sequence
  Description of Artificial Sequence: Synthetic peptide
DEEEIRTTNPVATEQYGSVSTGLQLGNN

SEQ ID NO: 6658 - protein, 28 aa, Artificial Sequence
  Description of Artificial Sequence: Synthetic peptide
DDEEIRTTNPVATEQYGSVSNNLMRGNR

SEQ ID NO: 6659 - protein, 28 aa, Artificial Sequence
  Description of Artificial Sequence: Synthetic peptide
DEEEIRTTNPVATEQYGSVSTNLQIGES

SEQ ID NO: 6660 - protein, 29 aa, Artificial Sequence
  Description of Artificial Sequence: Synthetic peptide
DEEEIRTTNPVATEQFGSVSTGNLQQGNR

SEQ ID NO: 6661 - protein, 31 aa, Artificial Sequence
  Description of Artificial Sequence: Synthetic polypeptide
DEEEIRTTNPVATEQYGSVYSETNLQPRGNR

SEQ ID NO: 6662 - protein, 28 aa, Artificial Sequence
  Description of Artificial Sequence: Synthetic peptide
DEEEIRTTNPTATEQYGSVSTNPQRGNN

SEQ ID NO: 6663 - protein, 28 aa, Artificial Sequence
  Description of Artificial Sequence: Synthetic peptide
DEEEIRTTNPVATEQYGSVSTNLMQGNA

SEQ ID NO: 6664 - protein, 28 aa, Artificial Sequence
  Description of Artificial Sequence: Synthetic peptide
DEEEIRTTNPVASETYGSVSTNLQRLNR

SEQ ID NO: 6665 - protein, 28 aa, Artificial Sequence
  Description of Artificial Sequence: Synthetic peptide
DEEELRTTNPVATEQYGNVSMNLQRGNR

SEQ ID NO: 6666 - protein, 28 aa, Artificial Sequence
  Description of Artificial Sequence: Synthetic peptide
DEEEIRTTNPVATEQYGSVSTNLDRGEM

SEQ ID NO: 6667 - protein, 29 aa, Artificial Sequence
  Description of Artificial Sequence: Synthetic peptide
DEEEIRTTNPVATEQFGSVSTMNLQRGNF

SEQ ID NO: 6668 - protein, 30 aa, Artificial Sequence
  Description of Artificial Sequence: Synthetic polypeptide
DEEEIRTTNPVATEQYGSVSTNPDQRGNPR

SEQ ID NO: 6669 - protein, 29 aa, Artificial Sequence
  Description of Artificial Sequence: Synthetic peptide
GEEEIRTTNPVATEQYGSVCSTNLQRGER

SEQ ID NO: 6670 - protein, 29 aa, Artificial Sequence
  Description of Artificial Sequence: Synthetic peptide
DEEEIRTTNPVATEQYGSVSTNLQQGNDI

SEQ ID NO: 6671 - protein, 28 aa, Artificial Sequence
  Description of Artificial Sequence: Synthetic peptide
DEEEIRTTNPVATEQYGSVHTNLDRGNW

SEQ ID NO: 6672 - protein, 28 aa, Artificial Sequence
  Description of Artificial Sequence: Synthetic peptide
DEEEIRTTNPVATEWYGSVGTNLMRGNR

SEQ ID NO: 6673 - protein, 28 aa, Artificial Sequence
  Description of Artificial Sequence: Synthetic peptide
DEEEIRTTNPVATEQYGWVSTPLQRGER

SEQ ID NO: 6674 - protein, 31 aa, Artificial Sequence
  Description of Artificial Sequence: Synthetic polypeptide
DEEEIRTTNPVATEQYGESVSETNGLQRGNR

SEQ ID NO: 6675 - protein, 29 aa, Artificial Sequence
  Description of Artificial Sequence: Synthetic peptide
DEEEIRTTNPVATEQYGSVSTNEQRGNDF

SEQ ID NO: 6676 - protein, 30 aa, Artificial Sequence
  Description of Artificial Sequence: Synthetic polypeptide
DEEEIRTTNPVATEQYGSVSCTNLQQRGNS

SEQ ID NO: 6677 - protein, 30 aa, Artificial Sequence
  Description of Artificial Sequence: Synthetic polypeptide
DEEEIRTTNPVATEQYGSVSTQNLQRGSNN

SEQ ID NO: 6678 - protein, 28 aa, Artificial Sequence
  Description of Artificial Sequence: Synthetic peptide
DEEEIRTTNPVATEQYGGVSTLLQHGNR

SEQ ID NO: 6679 - protein, 29 aa, Artificial Sequence
  Description of Artificial Sequence: Synthetic peptide
DEEEIRTTNPVATEQYGSVSTNLQIDGNQ

SEQ ID NO: 6680 - protein, 30 aa, Artificial Sequence
  Description of Artificial Sequence: Synthetic polypeptide
DEEEIRTTNPVATEQYGSVISTMNPQRGNR

SEQ ID NO: 6681 - protein, 29 aa, Artificial Sequence
  Description of Artificial Sequence: Synthetic peptide
DEEEIRTTNPVATEQYGSVSTNEQTPGNR

SEQ ID NO: 6682 - protein, 28 aa, Artificial Sequence
  Description of Artificial Sequence: Synthetic peptide
QEQEIVTTNPVATEQYGSVSTNLQRGNR

SEQ ID NO: 6683 - protein, 29 aa, Artificial Sequence
  Description of Artificial Sequence: Synthetic peptide
DEEEIRTTNPVATEQYGSVSTNLQINGNS

SEQ ID NO: 6684 - protein, 30 aa, Artificial Sequence
  Description of Artificial Sequence: Synthetic polypeptide
DEEEVRTTNPVATEQYGSVSVTNLQRGDNR

SEQ ID NO: 6685 - protein, 29 aa, Artificial Sequence
  Description of Artificial Sequence: Synthetic peptide
DEEEIRTTNPVATEVWGSVSSTNLQRGNR

SEQ ID NO: 6686 - protein, 29 aa, Artificial Sequence
  Description of Artificial Sequence: Synthetic peptide
DEEEIRTTNPVATEQYGSVSTPLQQGNER

SEQ ID NO: 6687 - protein, 28 aa, Artificial Sequence
  Description of Artificial Sequence: Synthetic peptide
DEEEIRTTNPVATEQYGSVSTDLQTGND

SEQ ID NO: 6688 - protein, 31 aa, Artificial Sequence
  Description of Artificial Sequence: Synthetic polypeptide
DEEEIRTTNPVATEQYGSSVSTNLQREGDNR

SEQ ID NO: 6689 - protein, 28 aa, Artificial Sequence
  Description of Artificial Sequence: Synthetic peptide
DEEEIRTTNPVATEQYGSVSTNLQGGEQ

SEQ ID NO: 6690 - protein, 29 aa, Artificial Sequence
  Description of Artificial Sequence: Synthetic peptide
DEEEIRTTNPVATELYGSVSTNPLQRGNI

SEQ ID NO: 6691 - protein, 28 aa, Artificial Sequence
  Description of Artificial Sequence: Synthetic peptide
DEEEIATTNPVATEQFGGVSTNLQRGNR

SEQ ID NO: 6692 - protein, 28 aa, Artificial Sequence
  Description of Artificial Sequence: Synthetic peptide
DEEEIRTTNPVATEQYGSVSDNLQGGNS

SEQ ID NO: 6693 - protein, 29 aa, Artificial Sequence
  Description of Artificial Sequence: Synthetic peptide
DEMECRTTNPVATEQYGSVSTNLQQRGNR

SEQ ID NO: 6694 - protein, 30 aa, Artificial Sequence
  Description of Artificial Sequence: Synthetic polypeptide
DEEEIRTTNPVATEQYGSVCTENLQERGNR

SEQ ID NO: 6695 - protein, 28 aa, Artificial Sequence
  Description of Artificial Sequence: Synthetic peptide
DEEEIRTTNPVATEQYGSVSTNLQTGEM

SEQ ID NO: 6696 - protein, 29 aa, Artificial Sequence
  Description of Artificial Sequence: Synthetic peptide
DEEEIRTTNPVATEQYGSVSTNLQEGGNS

SEQ ID NO: 6697 - protein, 28 aa, Artificial Sequence
  Description of Artificial Sequence: Synthetic peptide
DEEEIRTTNPVATEQYGSVSTNPQRENA

SEQ ID NO: 6698 - protein, 30 aa, Artificial Sequence
  Description of Artificial Sequence: Synthetic polypeptide
DEEEIRTTNPVATEQYGSVSDTPNLQRGNP

SEQ ID NO: 6699 - protein, 28 aa, Artificial Sequence
  Description of Artificial Sequence: Synthetic peptide
QEEEIRTVNPVATEQYGSVSTNLQRGNM

SEQ ID NO: 6700 - protein, 29 aa, Artificial Sequence
  Description of Artificial Sequence: Synthetic peptide
DEQEIRTTNPVATEQYGSVSTDNLERGNR

SEQ ID NO: 6701 - protein, 28 aa, Artificial Sequence
  Description of Artificial Sequence: Synthetic peptide
KEEEIRTTNPVATEQYGSCSTNLQRGNM

SEQ ID NO: 6702 - protein, 28 aa, Artificial Sequence
  Description of Artificial Sequence: Synthetic peptide
DEEEIYTTNPVATEQYGEVSTNLQRGNF

SEQ ID NO: 6703 - protein, 29 aa, Artificial Sequence
  Description of Artificial Sequence: Synthetic peptide
DEEEIRTTNPVATEQYGSVSATNLERGND

SEQ ID NO: 6704 - protein, 28 aa, Artificial Sequence
  Description of Artificial Sequence: Synthetic peptide
DEEEIRTTNPVCTEQYGYVSTNLQRGDR

SEQ ID NO: 6705 - protein, 28 aa, Artificial Sequence
  Description of Artificial Sequence: Synthetic peptide
DEEEIRTTNPVATEQYGSVSTNLQSGDQ

SEQ ID NO: 6706 - protein, 28 aa, Artificial Sequence
  Description of Artificial Sequence: Synthetic peptide
DEEEIRTTNPVCTEQYGSVSTELQNGNR

SEQ ID NO: 6707 - protein, 28 aa, Artificial Sequence
  Description of Artificial Sequence: Synthetic peptide
DEEEIETTNPVATEQYGSVGTQLQRGNR

SEQ ID NO: 6708 - protein, 29 aa, Artificial Sequence
  Description of Artificial Sequence: Synthetic peptide
DEEEIRTTNPVCTEQYGSVSTNLQAEGNR

SEQ ID NO: 6709 - protein, 28 aa, Artificial Sequence
  Description of Artificial Sequence: Synthetic peptide
DEEEIRTTNPVATEQYGCVSTNLDRGNL

SEQ ID NO: 6710 - protein, 28 aa, Artificial Sequence
  Description of Artificial Sequence: Synthetic peptide
DEEEIRTTNPVATEQYGSVSTNLQLGDH

SEQ ID NO: 6711 - protein, 28 aa, Artificial Sequence
  Description of Artificial Sequence: Synthetic peptide
DEEEIWTTNPVATEQYGDVSTNLQRGNQ

SEQ ID NO: 6712 - protein, 29 aa, Artificial Sequence
  Description of Artificial Sequence: Synthetic peptide
DEEEIRTTNPVATEQYGSVSTVNLDHGNR

SEQ ID NO: 6713 - protein, 28 aa, Artificial Sequence
  Description of Artificial Sequence: Synthetic peptide
DEEEIRTTNPVAYEYYGNVSTNLQRGNR

SEQ ID NO: 6714 - protein, 29 aa, Artificial Sequence
  Description of Artificial Sequence: Synthetic peptide
DEEEIRTTNPVATEQYGSVSTGNLQRGTD

SEQ ID NO: 6715 - protein, 31 aa, Artificial Sequence
  Description of Artificial Sequence: Synthetic polypeptide
DEEEIRTTNPVATEQYGSVSTNLQVRDGINR

SEQ ID NO: 6716 - protein, 28 aa, Artificial Sequence
  Description of Artificial Sequence: Synthetic peptide
DEEEIRTTNPVATEQYGSVSTALQWGNE

SEQ ID NO: 6717 - protein, 30 aa, Artificial Sequence
  Description of Artificial Sequence: Synthetic polypeptide
DEEEIRTTNPVATEQYGSVSSCTNLQPGNR

SEQ ID NO: 6718 - protein, 28 aa, Artificial Sequence
  Description of Artificial Sequence: Synthetic peptide
DEEEIRTTNPVATEQYGSVSTELQPGNF

SEQ ID NO: 6719 - protein, 28 aa, Artificial Sequence
  Description of Artificial Sequence: Synthetic peptide
DEQEIRTTNPVSTEIYGSVSTNLQRGNR

SEQ ID NO: 6720 - protein, 28 aa, Artificial Sequence
  Description of Artificial Sequence: Synthetic peptide
DEEEIRTTNPVATDQYGSVSTYLQNGNR

SEQ ID NO: 6721 - protein, 28 aa, Artificial Sequence
  Description of Artificial Sequence: Synthetic peptide
DEEEIRTTNPVATEQYGDVCTNLQRENR

SEQ ID NO: 6722 - protein, 28 aa, Artificial Sequence
  Description of Artificial Sequence: Synthetic peptide
DEEEIRTTNPVATEQYGSVSTDDQRGNF

SEQ ID NO: 6723 - protein, 28 aa, Artificial Sequence
  Description of Artificial Sequence: Synthetic peptide
DEEEIRTTNPVATEQYGSVSTNEQTGNF

SEQ ID NO: 6724 - protein, 30 aa, Artificial Sequence
  Description of Artificial Sequence: Synthetic polypeptide
DEEEIRTTNPVATEQYGESVSTNLQRGNDF

SEQ ID NO: 6725 - protein, 30 aa, Artificial Sequence
  Description of Artificial Sequence: Synthetic polypeptide
DEEEIRTTNPVATEQYGSVYSTPLQRDGNR

SEQ ID NO: 6726 - protein, 28 aa, Artificial Sequence
  Description of Artificial Sequence: Synthetic peptide
DEEEIRTTNPVATEQYGSVSMNLERGER

SEQ ID NO: 6727 - protein, 29 aa, Artificial Sequence
  Description of Artificial Sequence: Synthetic peptide
DEEEIRTTNPVATEQYGSVSTDLQDRGER

SEQ ID NO: 6728 - protein, 30 aa, Artificial Sequence
  Description of Artificial Sequence: Synthetic polypeptide
DEEEIRTTNPVATEQYGSVISTNLPQRGTR

SEQ ID NO: 6729 - protein, 29 aa, Artificial Sequence
  Description of Artificial Sequence: Synthetic peptide
DEEEIRTTNPVATEQYGSVSTNLQIIGNI

SEQ ID NO: 6730 - protein, 30 aa, Artificial Sequence
  Description of Artificial Sequence: Synthetic polypeptide
DEEEIRTTNPVATEQYGSVSTNWQERGNDR

SEQ ID NO: 6731 - protein, 29 aa, Artificial Sequence
  Description of Artificial Sequence: Synthetic peptide
DEEEIRTTNPVATEQYGSVSTNLQCMGNI

SEQ ID NO: 6732 - protein, 28 aa, Artificial Sequence
  Description of Artificial Sequence: Synthetic peptide
DEEEIRTTNPVATEQYGSVSTGLYRGLR

SEQ ID NO: 6733 - protein, 28 aa, Artificial Sequence
  Description of Artificial Sequence: Synthetic peptide
DEEEIRTTNPTATEQFGSVSTNLQRENR

SEQ ID NO: 6734 - protein, 28 aa, Artificial Sequence
  Description of Artificial Sequence: Synthetic peptide
DEEEIRTTNPVATEQYGSVSVALQLGNR

SEQ ID NO: 6735 - protein, 29 aa, Artificial Sequence
  Description of Artificial Sequence: Synthetic peptide
DDEEIRTTNPVATEQYGNVSTNLVQRGNR

SEQ ID NO: 6736 - protein, 28 aa, Artificial Sequence
  Description of Artificial Sequence: Synthetic peptide
DEEEIRTTNPAATEQYGSVSTNEQNGNR

SEQ ID NO: 6737 - protein, 29 aa, Artificial Sequence
  Description of Artificial Sequence: Synthetic peptide
DEEEIRTTNPVATEQYGSVSTNEQYDGNR

SEQ ID NO: 6738 - protein, 30 aa, Artificial Sequence
  Description of Artificial Sequence: Synthetic polypeptide
DEEEIRTTNPVATEQYGSVSTNLQLRGNDT

SEQ ID NO: 6739 - protein, 30 aa, Artificial Sequence
  Description of Artificial Sequence: Synthetic polypeptide
DEQEIRTTNPVATEQYGSVSCTNLQCRGNR

SEQ ID NO: 6740 - protein, 29 aa, Artificial Sequence
  Description of Artificial Sequence: Synthetic peptide
DEEEIRTTNPVATEQYGSVSTNEQRGLNM

SEQ ID NO: 6741 - protein, 28 aa, Artificial Sequence
  Description of Artificial Sequence: Synthetic peptide
DEDEIRTTNPVATECYGSVSTNLQRGDR

SEQ ID NO: 6742 - protein, 29 aa, Artificial Sequence
  Description of Artificial Sequence: Synthetic peptide
SEEEIRTVNPVATEQYGSVSTNLQERGNR

SEQ ID NO: 6743 - protein, 29 aa, Artificial Sequence
  Description of Artificial Sequence: Synthetic peptide
DEEEIRTTNPVATEQYGSVSTMDLQRGNI

SEQ ID NO: 6744 - protein, 28 aa, Artificial Sequence
  Description of Artificial Sequence: Synthetic peptide
DEQEVRCTNPVATEQYGSVSTNLQRGNR

SEQ ID NO: 6745 - protein, 28 aa, Artificial Sequence
  Description of Artificial Sequence: Synthetic peptide
NEEEIRTTNPVAWESYGSVSTNLQRGNR

SEQ ID NO: 6746 - protein, 28 aa, Artificial Sequence
  Description of Artificial Sequence: Synthetic peptide
DEEEIRTTNPVATEQYGGVSENDQRGNR

SEQ ID NO: 6747 - protein, 28 aa, Artificial Sequence
  Description of Artificial Sequence: Synthetic peptide
DEEEIRTTNPVATEQYGSVSTDLQNGNE

SEQ ID NO: 6748 - protein, 28 aa, Artificial Sequence
  Description of Artificial Sequence: Synthetic peptide
DEEEIRTTNPVATEQYGSVSTALQIGNV

SEQ ID NO: 6749 - protein, 28 aa, Artificial Sequence
  Description of Artificial Sequence: Synthetic peptide
DEEEIRCTNPVATEIYGCVSTNLQRGNR

SEQ ID NO: 6750 - protein, 28 aa, Artificial Sequence
  Description of Artificial Sequence: Synthetic peptide
DEQEIRTTNPVATEQYGSVSTNDQRGNF

SEQ ID NO: 6751 - protein, 28 aa, Artificial Sequence
  Description of Artificial Sequence: Synthetic peptide
MEEEIRTTNPVATEQYGSVSTNLQTGNM

SEQ ID NO: 6752 - protein, 29 aa, Artificial Sequence
  Description of Artificial Sequence: Synthetic peptide
DEEEIRTTNPVATEQYGSVSETDLQRGER

SEQ ID NO: 6753 - protein, 28 aa, Artificial Sequence
  Description of Artificial Sequence: Synthetic peptide
DEQEIRTTNPVATEQYGCVSMNLQRGNR

SEQ ID NO: 6754 - protein, 29 aa, Artificial Sequence
  Description of Artificial Sequence: Synthetic peptide
DEEEIRTTNPVATEQYGSVSTCNPQHGNR

SEQ ID NO: 6755 - protein, 29 aa, Artificial Sequence
  Description of Artificial Sequence: Synthetic peptide
DEEEIVTTNPVSTEQYGSVSTPNLQRGNR

SEQ ID NO: 6756 - protein, 28 aa, Artificial Sequence
  Description of Artificial Sequence: Synthetic peptide
DEEEIRTTNPVATEAYGSVSTNLERGND

SEQ ID NO: 6757 - protein, 29 aa, Artificial Sequence
  Description of Artificial Sequence: Synthetic peptide
DEEEIRTTNPVATEQYGGSVSTNWQEGNR

SEQ ID NO: 6758 - protein, 29 aa, Artificial Sequence
  Description of Artificial Sequence: Synthetic peptide
DEEEIRTTNPVATEQYGSVSDNLQIGENR

SEQ ID NO: 6759 - protein, 28 aa, Artificial Sequence
  Description of Artificial Sequence: Synthetic peptide
DEEEIRTTNPVATEQYGSVSTNLQFGEM

SEQ ID NO: 6760 - protein, 28 aa, Artificial Sequence
  Description of Artificial Sequence: Synthetic peptide
DEQEIRTTNPVATEQYGSVSTNLERGNA

SEQ ID NO: 6761 - protein, 28 aa, Artificial Sequence
  Description of Artificial Sequence: Synthetic peptide
DDCEIRTTNPVATEQYGSISTNLQRGNR

SEQ ID NO: 6762 - protein, 30 aa, Artificial Sequence
  Description of Artificial Sequence: Synthetic polypeptide
DEEEIRTTNPVATEQYGSVSTNPQEREGNR

SEQ ID NO: 6763 - protein, 29 aa, Artificial Sequence
  Description of Artificial Sequence: Synthetic peptide
DEEEIRTTNPVATEQYGSVSTNLMVGNDR

SEQ ID NO: 6764 - protein, 28 aa, Artificial Sequence
  Description of Artificial Sequence: Synthetic peptide
MEEEIRTTNPVATEQYGSVSTNLQVGNN

SEQ ID NO: 6765 - protein, 29 aa, Artificial Sequence
  Description of Artificial Sequence: Synthetic peptide
KEEEIRTTNPVATEQYGSVSTNLQRGNDN

SEQ ID NO: 6766 - protein, 28 aa, Artificial Sequence
  Description of Artificial Sequence: Synthetic peptide
DEQEIRTTNPVATECWGSVSTNLQRGNR

SEQ ID NO: 6767 - protein, 28 aa, Artificial Sequence
  Description of Artificial Sequence: Synthetic peptide
GEAEIATTNPVATEQYGSVSTNLQRGNR

SEQ ID NO: 6768 - protein, 31 aa, Artificial Sequence
  Description of Artificial Sequence: Synthetic polypeptide
DEEEIRTTNPVATEQYGSVSTNLQFRGGLNR

SEQ ID NO: 6769 - protein, 29 aa, Artificial Sequence
  Description of Artificial Sequence: Synthetic peptide
DEEEIRTTNPVATEQYWGSVETNLQRGNP

SEQ ID NO: 6770 - protein, 28 aa, Artificial Sequence
  Description of Artificial Sequence: Synthetic peptide
DEEEIRTTNPVATEQYGSVDTNQQRGDR

SEQ ID NO: 6771 - protein, 28 aa, Artificial Sequence
  Description of Artificial Sequence: Synthetic peptide
QEWEIRTTNPVATEQYGHVSTNLQRGNR

SEQ ID NO: 6772 - protein, 29 aa, Artificial Sequence
  Description of Artificial Sequence: Synthetic peptide
DAEEIRTTNPVATEQYGMSVSENLQRGNR

SEQ ID NO: 6773 - protein, 30 aa, Artificial Sequence
  Description of Artificial Sequence: Synthetic polypeptide
DEEEIRTTNPVATEQYGSVSTNLQERGNDQ

SEQ ID NO: 6774 - protein, 29 aa, Artificial Sequence
  Description of Artificial Sequence: Synthetic peptide
DEGEIRTTNPVATEYYGSVSTNLQFRGNR

SEQ ID NO: 6775 - protein, 29 aa, Artificial Sequence
  Description of Artificial Sequence: Synthetic peptide
DEEEIRTTNPDATEQYGSVSTPLIQRGNR

SEQ ID NO: 6776 - protein, 28 aa, Artificial Sequence
  Description of Artificial Sequence: Synthetic peptide
QEEEIRQTNPVATEQYGSVSTNLQRGMR

SEQ ID NO: 6777 - protein, 28 aa, Artificial Sequence
  Description of Artificial Sequence: Synthetic peptide
DEEEIRTTNPEATEQYGSVSTNPQRGDR

SEQ ID NO: 6778 - protein, 29 aa, Artificial Sequence
  Description of Artificial Sequence: Synthetic peptide
DENEIRTTNPVATEQYGSVSTNLQMRGNF

SEQ ID NO: 6779 - protein, 28 aa, Artificial Sequence
  Description of Artificial Sequence: Synthetic peptide
DENEIRTTNPVATEQYGSVDENLQRGNR

SEQ ID NO: 6780 - protein, 28 aa, Artificial Sequence
  Description of Artificial Sequence: Synthetic peptide
DEEEIVTTNPVATEVYGWVSTNLQRGNR

SEQ ID NO: 6781 - protein, 28 aa, Artificial Sequence
  Description of Artificial Sequence: Synthetic peptide
DEEEIRTTNPVATEQYGLVSTDLQRGNS

SEQ ID NO: 6782 - protein, 28 aa, Artificial Sequence
  Description of Artificial Sequence: Synthetic peptide
DEEEIRTTNPVATEQYGSVSTNLDSGNL

SEQ ID NO: 6783 - protein, 29 aa, Artificial Sequence
  Description of Artificial Sequence: Synthetic peptide
DEEEIRTTNPVATEQYGSVSTNLQEIGNN

SEQ ID NO: 6784 - protein, 30 aa, Artificial Sequence
  Description of Artificial Sequence: Synthetic polypeptide
DEEEIRTTNPVATEQYGSVSTTGLQREGNR

SEQ ID NO: 6785 - protein, 28 aa, Artificial Sequence
  Description of Artificial Sequence: Synthetic peptide
DEQEIRTTNPAATEQYGSVSTNLQQGNR

SEQ ID NO: 6786 - protein, 28 aa, Artificial Sequence
  Description of Artificial Sequence: Synthetic peptide
DEEEIRTTNPVATEQYGSVSTNDQGMNR

SEQ ID NO: 6787 - protein, 29 aa, Artificial Sequence
  Description of Artificial Sequence: Synthetic peptide
DEEEIRTTNPVATEQYGSVSTNLMNQGNR

SEQ ID NO: 6788 - protein, 28 aa, Artificial Sequence
  Description of Artificial Sequence: Synthetic peptide
DEEEIRTTNPVATEQYGSVSTDLQQGNY

SEQ ID NO: 6789 - protein, 28 aa, Artificial Sequence
  Description of Artificial Sequence: Synthetic peptide
DEVEIRTTNPVATEQFGSVSENLQRGNR

SEQ ID NO: 6790 - protein, 28 aa, Artificial Sequence
  Description of Artificial Sequence: Synthetic peptide
DEEEIATTNPVATECFGSVSTNLQRGNR

SEQ ID NO: 6791 - protein, 28 aa, Artificial Sequence
  Description of Artificial Sequence: Synthetic peptide
DEEEIRTTNPVATEIYGSVSTNLQRNAR

SEQ ID NO: 6792 - protein, 28 aa, Artificial Sequence
  Description of Artificial Sequence: Synthetic peptide
DEEEIRTTNPVATEQYGSVSTNLDTGNV

SEQ ID NO: 6793 - protein, 28 aa, Artificial Sequence
  Description of Artificial Sequence: Synthetic peptide
DTEEIRTTNPVATEQYGSVSTNDQFGNR

SEQ ID NO: 6794 - protein, 29 aa, Artificial Sequence
  Description of Artificial Sequence: Synthetic peptide
DEQEIRTTNPVATEQYGSVSTNLQRGENI

SEQ ID NO: 6795 - protein, 31 aa, Artificial Sequence
  Description of Artificial Sequence: Synthetic polypeptide
DEEEIRTTNPVATEQYGSVSTTNLQLRNGNR

SEQ ID NO: 6796 - protein, 30 aa, Artificial Sequence
  Description of Artificial Sequence: Synthetic polypeptide
DEEEIRTTNPVATEQYGSVSTNPLVERGNR

SEQ ID NO: 6797 - protein, 28 aa, Artificial Sequence
  Description of Artificial Sequence: Synthetic peptide
DEEEIRTTNPDATECYGSVSTNLQDGNR

SEQ ID NO: 6798 - protein, 30 aa, Artificial Sequence
  Description of Artificial Sequence: Synthetic polypeptide
DEEEIRTTNPVATEQYGSVSTTTNLQLGNR

SEQ ID NO: 6799 - protein, 28 aa, Artificial Sequence
  Description of Artificial Sequence: Synthetic peptide
DEMEIRTTNPVASEQYGSVSTNLQRGNQ

SEQ ID NO: 6800 - protein, 28 aa, Artificial Sequence
  Description of Artificial Sequence: Synthetic peptide
DEEEIRTTNPVATEQYGTVSTDLQSGNR

SEQ ID NO: 6801 - protein, 28 aa, Artificial Sequence
  Description of Artificial Sequence: Synthetic peptide
DEEEIRTTNPVATEVYGSVSDNLQRGMR

SEQ ID NO: 6802 - protein, 28 aa, Artificial Sequence
  Description of Artificial Sequence: Synthetic peptide
DEEEIRTTNPVATEQYGSVSTELCNGNR

SEQ ID NO: 6803 - protein, 28 aa, Artificial Sequence
  Description of Artificial Sequence: Synthetic peptide
DEEEIRTTNPVATEQYGSVSTNDERGND

SEQ ID NO: 6804 - protein, 28 aa, Artificial Sequence
  Description of Artificial Sequence: Synthetic peptide
DEEEIRTTNPVATEQYGSVSTNLQAGEI

SEQ ID NO: 6805 - protein, 28 aa, Artificial Sequence
  Description of Artificial Sequence: Synthetic peptide
MENEIRTTNPVATEQYGSVSDNLQRGNR

SEQ ID NO: 6806 - protein, 29 aa, Artificial Sequence
  Description of Artificial Sequence: Synthetic peptide
DEEEIRTTNPVATEQYGSVSTNLQLGNDS

SEQ ID NO: 6807 - protein, 30 aa, Artificial Sequence
  Description of Artificial Sequence: Synthetic polypeptide
DEEEIRTTNPVATEQYGSVSDTNLQRGNPF

SEQ ID NO: 6808 - protein, 28 aa, Artificial Sequence
  Description of Artificial Sequence: Synthetic peptide
DEEEIRTVNPVATEQYGAVSDNLQRGNR

SEQ ID NO: 6809 - protein, 30 aa, Artificial Sequence
  Description of Artificial Sequence: Synthetic polypeptide
DEEEIRTTNPVATEQYGSHVSTNLQRGSQR

SEQ ID NO: 6810 - protein, 30 aa, Artificial Sequence
  Description of Artificial Sequence: Synthetic polypeptide
DEEEIRTTNPVATEQYGESVSTDLQIRGNR

SEQ ID NO: 6811 - protein, 28 aa, Artificial Sequence
  Description of Artificial Sequence: Synthetic peptide
DECEIRSTNPVATEQYGSVGTNLQRGNR

SEQ ID NO: 6812 - protein, 30 aa, Artificial Sequence
  Description of Artificial Sequence: Synthetic polypeptide
DEEEIRTTNPVATEQYGNSVDSTNLQVGNR

SEQ ID NO: 6813 - protein, 29 aa, Artificial Sequence
  Description of Artificial Sequence: Synthetic peptide
DEEEIRTTNPVATEQYGSVSTNLQIDGNM

SEQ ID NO: 6814 - protein, 28 aa, Artificial Sequence
  Description of Artificial Sequence: Synthetic peptide
DEEEIRTTNPVATEQYGSVSTNLDIGNA

SEQ ID NO: 6815 - protein, 29 aa, Artificial Sequence
  Description of Artificial Sequence: Synthetic peptide
QEEEIRTTNPVATEQYGSVCTNLQRGNVR

SEQ ID NO: 6816 - protein, 29 aa, Artificial Sequence
  Description of Artificial Sequence: Synthetic peptide
DEEEIRTTNPVASENYGSVSTNLQRGENR

SEQ ID NO: 6817 - protein, 28 aa, Artificial Sequence
  Description of Artificial Sequence: Synthetic peptide
DEEEIRTTNPVATEQYGSVSTNDQQGNM

SEQ ID NO: 6818 - protein, 28 aa, Artificial Sequence
  Description of Artificial Sequence: Synthetic peptide
DENEIRTTNPVATEQYGDVSTNLQRGER

SEQ ID NO: 6819 - protein, 29 aa, Artificial Sequence
  Description of Artificial Sequence: Synthetic peptide
DEEEIRTTNPVATEQYGSVSQELQRGNDR

SEQ ID NO: 6820 - protein, 28 aa, Artificial Sequence
  Description of Artificial Sequence: Synthetic peptide
DEEEIRTTNPVATEQYGSVSTNDTRGNP

SEQ ID NO: 6821 - protein, 28 aa, Artificial Sequence
  Description of Artificial Sequence: Synthetic peptide
DENEIRTTNPVATEQYGSVSENTQRGNR

SEQ ID NO: 6822 - protein, 30 aa, Artificial Sequence
  Description of Artificial Sequence: Synthetic polypeptide
QEEEIRTTNPVATEQYGSVSTNLQIRGNDR

SEQ ID NO: 6823 - protein, 28 aa, Artificial Sequence
  Description of Artificial Sequence: Synthetic peptide
DEEEIRQTNPVATEQYGSASDNLQRGNR

SEQ ID NO: 6824 - protein, 28 aa, Artificial Sequence
  Description of Artificial Sequence: Synthetic peptide
DEEEIRTTNPVATEQYGSVETPLERGNR

SEQ ID NO: 6825 - protein, 29 aa, Artificial Sequence
  Description of Artificial Sequence: Synthetic peptide
DEEEIRTTNPVATEQYGSVSTPLQRDGNF

SEQ ID NO: 6826 - protein, 30 aa, Artificial Sequence
  Description of Artificial Sequence: Synthetic polypeptide
DEEEIRTTNPVATEQYGSVSTMNEQRGNLR

SEQ ID NO: 6827 - protein, 29 aa, Artificial Sequence
  Description of Artificial Sequence: Synthetic peptide
DEEEIRTTNPVATEQYGSVSTNLEREGNI

SEQ ID NO: 6828 - protein, 31 aa, Artificial Sequence
  Description of Artificial Sequence: Synthetic polypeptide
DEEEIRTTNPVATEQYGESVSLTNLQRNGNR

SEQ ID NO: 6829 - protein, 28 aa, Artificial Sequence
  Description of Artificial Sequence: Synthetic peptide
DEEEIRTTNPVATELYGWVGTNLQRGNR

SEQ ID NO: 6830 - protein, 29 aa, Artificial Sequence
  Description of Artificial Sequence: Synthetic peptide
DEEEIRTTNPVATEQYGSVSCENLQHGNR

SEQ ID NO: 6831 - protein, 28 aa, Artificial Sequence
  Description of Artificial Sequence: Synthetic peptide
DEEEIRPTNPVATEQYGVVSTNLQRGDR

SEQ ID NO: 6832 - protein, 28 aa, Artificial Sequence
  Description of Artificial Sequence: Synthetic peptide
DEEEIRTTNPVATEQYGSVSTDLQGGNP

SEQ ID NO: 6833 - protein, 29 aa, Artificial Sequence
  Description of Artificial Sequence: Synthetic peptide
QEEEIRTTNPVATEQYGSVSTALQLRGNR

SEQ ID NO: 6834 - protein, 30 aa, Artificial Sequence
  Description of Artificial Sequence: Synthetic polypeptide
DEEEIRTTNPVATEQYGSVSTNLQYEGNDR

SEQ ID NO: 6835 - protein, 28 aa, Artificial Sequence
  Description of Artificial Sequence: Synthetic peptide
DEGEIRTTNPVATEQYGSVSTNLQFGNC

SEQ ID NO: 6836 - protein, 29 aa, Artificial Sequence
  Description of Artificial Sequence: Synthetic peptide
DEEEIRQTNPVATEQYGSVSITNPQRGNR

SEQ ID NO: 6837 - protein, 28 aa, Artificial Sequence
  Description of Artificial Sequence: Synthetic peptide
MEEEIRTTNPVAVEQYGSVSTDLQRGNR

SEQ ID NO: 6838 - protein, 28 aa, Artificial Sequence
  Description of Artificial Sequence: Synthetic peptide
DEEEIATTNPVATEQYGSVSTNLQQGDR

SEQ ID NO: 6839 - protein, 29 aa, Artificial Sequence
  Description of Artificial Sequence: Synthetic peptide
DEEEIRTTNPVATEQYGSVETNDQRGNPR

SEQ ID NO: 6840 - protein, 28 aa, Artificial Sequence
  Description of Artificial Sequence: Synthetic peptide
DEEEIRTTNPVATEQYGSVSTGLEGGNR

SEQ ID NO: 6841 - protein, 28 aa, Artificial Sequence
  Description of Artificial Sequence: Synthetic peptide
AEEEIRTTNPVATEQYGSVSTNLEVGNR

SEQ ID NO: 6842 - protein, 28 aa, Artificial Sequence
  Description of Artificial Sequence: Synthetic peptide
DEEEIRTTNPVATEQYGSVSTNLQTGEY

SEQ ID NO: 6843 - protein, 30 aa, Artificial Sequence
  Description of Artificial Sequence: Synthetic polypeptide
DEEEIRTTNPVATEQYGSVSMNLQRNGENR

SEQ ID NO: 6844 - protein, 31 aa, Artificial Sequence
  Description of Artificial Sequence: Synthetic polypeptide
DEEEIRTTNPVATEQYGSVSITNPLQRGNPR

SEQ ID NO: 6845 - protein, 30 aa, Artificial Sequence
  Description of Artificial Sequence: Synthetic polypeptide
DEEEIRTTNPVATEQYGSVSATNEQLRGNR

SEQ ID NO: 6846 - protein, 30 aa, Artificial Sequence
  Description of Artificial Sequence: Synthetic polypeptide
DEEEIRTTNPVATEQYGSVSTNDVQRGDNR

SEQ ID NO: 6847 - protein, 29 aa, Artificial Sequence
  Description of Artificial Sequence: Synthetic peptide
DEEEIRTTNPVATEQYGSVSTDLQRNGND

SEQ ID NO: 6848 - protein, 28 aa, Artificial Sequence
  Description of Artificial Sequence: Synthetic peptide
DEEEIRTTNPVATEQYGSVGTNLMRGQR

SEQ ID NO: 6849 - protein, 29 aa, Artificial Sequence
  Description of Artificial Sequence: Synthetic peptide
DEEEIRTTNPVATEQWGSVSTNLMNRGNR

SEQ ID NO: 6850 - protein, 28 aa, Artificial Sequence
  Description of Artificial Sequence: Synthetic peptide
QENEIRTTNPVATECYGSVSTNLQRGNR

SEQ ID NO: 6851 - protein, 30 aa, Artificial Sequence
  Description of Artificial Sequence: Synthetic polypeptide
DEEEIRTTNPVATEQYGSVSTNLQERGNDL

SEQ ID NO: 6852 - protein, 29 aa, Artificial Sequence
  Description of Artificial Sequence: Synthetic peptide
DEEEIRTTNPVATEQYGSVSSTNLQNGPR

SEQ ID NO: 6853 - protein, 28 aa, Artificial Sequence
  Description of Artificial Sequence: Synthetic peptide
DEEEIRTTNPQATEQYGGVSTNLQTGNR

SEQ ID NO: 6854 - protein, 29 aa, Artificial Sequence
  Description of Artificial Sequence: Synthetic peptide
DPEEIRPTNPVATEQYGSVSTNLVQRGNR

SEQ ID NO: 6855 - protein, 28 aa, Artificial Sequence
  Description of Artificial Sequence: Synthetic peptide
YEEEIRTTNPVATEQYGSVSTNLQDGND

SEQ ID NO: 6856 - protein, 28 aa, Artificial Sequence
  Description of Artificial Sequence: Synthetic peptide
IEEEIRTTNPVSTENYGSVSTNLQRGNR

SEQ ID NO: 6857 - protein, 28 aa, Artificial Sequence
  Description of Artificial Sequence: Synthetic peptide
DEEEIRTTNPVATEQYGSVLTGLQDGNR

SEQ ID NO: 6858 - protein, 28 aa, Artificial Sequence
  Description of Artificial Sequence: Synthetic peptide
DEEEVRTTNPVSTEQYGSVATNLQRGNR

SEQ ID NO: 6859 - protein, 29 aa, Artificial Sequence
  Description of Artificial Sequence: Synthetic peptide
DEQEIVTTNPVATEQYGSVSATNLQRGNR

SEQ ID NO: 6860 - protein, 28 aa, Artificial Sequence
  Description of Artificial Sequence: Synthetic peptide
DEPEIRTTNPVATEQYGSVYTNLQRGGR

SEQ ID NO: 6861 - protein, 28 aa, Artificial Sequence
  Description of Artificial Sequence: Synthetic peptide
DEEEIRTTNPVATEQYGSVSTNLQYGEW

SEQ ID NO: 6862 - protein, 28 aa, Artificial Sequence
  Description of Artificial Sequence: Synthetic peptide
DEEEIRTTNPFATEQYGSVSTNPLRGNR

SEQ ID NO: 6863 - protein, 28 aa, Artificial Sequence
  Description of Artificial Sequence: Synthetic peptide
DEVEIRTTNPCATEQYGSVSTNLQVGNR

SEQ ID NO: 6864 - protein, 29 aa, Artificial Sequence
  Description of Artificial Sequence: Synthetic peptide
DEEEIRTTNPVATEQYGSVSTQNLQIGER

SEQ ID NO: 6865 - protein, 28 aa, Artificial Sequence
  Description of Artificial Sequence: Synthetic peptide
DEEELRTTNPVATEQYGSVGTNLFRGNR

SEQ ID NO: 6866 - protein, 28 aa, Artificial Sequence
  Description of Artificial Sequence: Synthetic peptide
HEEEIRTTNPVATEQYGDVSTNLQRGNQ

SEQ ID NO: 6867 - protein, 28 aa, Artificial Sequence
  Description of Artificial Sequence: Synthetic peptide
DEEEIRTTNPVATEQYGSVSTGDQRDNR

SEQ ID NO: 6868 - protein, 28 aa, Artificial Sequence
  Description of Artificial Sequence: Synthetic peptide
DEEEIRTTNPVATEQYGSVSTNEQLGNV

SEQ ID NO: 6869 - protein, 28 aa, Artificial Sequence
  Description of Artificial Sequence: Synthetic peptide
DEEEIRTTNPVATEQYWSVSTNDDRGNR

SEQ ID NO: 6870 - protein, 29 aa, Artificial Sequence
  Description of Artificial Sequence: Synthetic peptide
DEEEIGTTNPVATEQYGEVSTNLQRGNNR

SEQ ID NO: 6871 - protein, 28 aa, Artificial Sequence
  Description of Artificial Sequence: Synthetic peptide
DEEEIRGTNPVATEQYGSVSDNLQRGMR

SEQ ID NO: 6872 - protein, 28 aa, Artificial Sequence
  Description of Artificial Sequence: Synthetic peptide
DEQEIRTTNPVATEQYGWVATNLQRGNR

SEQ ID NO: 6873 - protein, 28 aa, Artificial Sequence
  Description of Artificial Sequence: Synthetic peptide
DEEEIRTTNPVATEQYGSVSTNLDREER

SEQ ID NO: 6874 - protein, 29 aa, Artificial Sequence
  Description of Artificial Sequence: Synthetic peptide
DEEEIRTTNPVATEQYGSVSSNLQRGDNL

SEQ ID NO: 6875 - protein, 28 aa, Artificial Sequence
  Description of Artificial Sequence: Synthetic peptide
DEEEIRTTNPVATEQYGGCSTNLQHGNR

SEQ ID NO: 6876 - protein, 28 aa, Artificial Sequence
  Description of Artificial Sequence: Synthetic peptide
DEEEIRPTNPCATEQYGSVSTNLQSGNR

SEQ ID NO: 6877 - protein, 29 aa, Artificial Sequence
  Description of Artificial Sequence: Synthetic peptide
DEEEIRTTNPVATEQYGSVSETNLERGNQ

SEQ ID NO: 6878 - protein, 29 aa, Artificial Sequence
  Description of Artificial Sequence: Synthetic peptide
DEEEIRTTNPVATEQYGSVSTNLQIGNDE

SEQ ID NO: 6879 - protein, 28 aa, Artificial Sequence
  Description of Artificial Sequence: Synthetic peptide
QEEEIRTTNPVATEQYGSVSTNLQYGNM

SEQ ID NO: 6880 - protein, 28 aa, Artificial Sequence
  Description of Artificial Sequence: Synthetic peptide
DEEEIRATNPVASEQYGSVSNNLQRGNR

SEQ ID NO: 6881 - protein, 29 aa, Artificial Sequence
  Description of Artificial Sequence: Synthetic peptide
DEEEIRTTNPTATEQYGSVSTNLQDNGNR

SEQ ID NO: 6882 - protein, 30 aa, Artificial Sequence
  Description of Artificial Sequence: Synthetic polypeptide
DEEEIRTTNPVATEQYGSVSLTSNLQIGNR

SEQ ID NO: 6883 - protein, 28 aa, Artificial Sequence
  Description of Artificial Sequence: Synthetic peptide
DEEEIRTTNPVCTEQYGSVDTNLQNGNR

SEQ ID NO: 6884 - protein, 30 aa, Artificial Sequence
  Description of Artificial Sequence: Synthetic polypeptide
DEEEIRTTNPVATEQYGSVSTEDLQVRGNR

SEQ ID NO: 6885 - protein, 28 aa, Artificial Sequence
  Description of Artificial Sequence: Synthetic peptide
DEQEIRTTNPVATEQYGCVATNLQRGNR

SEQ ID NO: 6886 - protein, 29 aa, Artificial Sequence
  Description of Artificial Sequence: Synthetic peptide
DEEEIRTTNPVAYEQYGSISTNNLQRGNR

SEQ ID NO: 6887 - protein, 28 aa, Artificial Sequence
  Description of Artificial Sequence: Synthetic peptide
DEEEIATTNPVATEQYGSVDTNLQHGNR

SEQ ID NO: 6888 - protein, 28 aa, Artificial Sequence
  Description of Artificial Sequence: Synthetic peptide
DEQEIRTTNPVATEQYGSVDTDLQRGNR

SEQ ID NO: 6889 - protein, 28 aa, Artificial Sequence
  Description of Artificial Sequence: Synthetic peptide
DEEEIRTTNPVATEQYGSVETNLQHGNN

SEQ ID NO: 6890 - protein, 28 aa, Artificial Sequence
  Description of Artificial Sequence: Synthetic peptide
DEEEIRTTNPVATEQYGSVSTNLELGER

SEQ ID NO: 6891 - protein, 28 aa, Artificial Sequence
  Description of Artificial Sequence: Synthetic peptide
DEEEISATNPVATEQYGSVSTNLQNGNR

SEQ ID NO: 6892 - protein, 28 aa, Artificial Sequence
  Description of Artificial Sequence: Synthetic peptide
DEEEIRTTNPVATEQYGSWSTNLQMGNA

SEQ ID NO: 6893 - protein, 30 aa, Artificial Sequence
  Description of Artificial Sequence: Synthetic polypeptide
DEEEIRTTNPVATEQYGSNVSTMNLQRGTR

SEQ ID NO: 6894 - protein, 28 aa, Artificial Sequence
  Description of Artificial Sequence: Synthetic peptide
DEEEIRTTNPVATEQYGSVSTNEQEGNP

SEQ ID NO: 6895 - protein, 29 aa, Artificial Sequence
  Description of Artificial Sequence: Synthetic peptide
DEEEIRTTNPVATEQYGSVSTNLQETGNY

SEQ ID NO: 6896 - protein, 28 aa, Artificial Sequence
  Description of Artificial Sequence: Synthetic peptide
DEEEIRTTNPVATEQYGSVSTAEQRGNH

SEQ ID NO: 6897 - protein, 28 aa, Artificial Sequence
  Description of Artificial Sequence: Synthetic peptide
DEEEIRTTNPVATEQYGSVSTNLQVVNF

SEQ ID NO: 6898 - protein, 30 aa, Artificial Sequence
  Description of Artificial Sequence: Synthetic polypeptide
DEEEIRTTNPVATEQYGSVSTPPLQREGNR

SEQ ID NO: 6899 - protein, 30 aa, Artificial Sequence
  Description of Artificial Sequence: Synthetic polypeptide
DEEEIRTTNPVATEQYGSVSTMNLQRGDNV

SEQ ID NO: 6900 - protein, 28 aa, Artificial Sequence
  Description of Artificial Sequence: Synthetic peptide
DEEEIRTTNPVATEQYGSVSEDLQVGNR

SEQ ID NO: 6901 - protein, 28 aa, Artificial Sequence
  Description of Artificial Sequence: Synthetic peptide
DEQEIRATNPVATEMYGSVSTNLQRGNR

SEQ ID NO: 6902 - protein, 29 aa, Artificial Sequence
  Description of Artificial Sequence: Synthetic peptide
DEQEIRTTNPEATEQYGSVSTNLQRGNDR

SEQ ID NO: 6903 - protein, 28 aa, Artificial Sequence
  Description of Artificial Sequence: Synthetic peptide
DEEEIRCTNPVASEIYGSVSTNLQRGNR

SEQ ID NO: 6904 - protein, 28 aa, Artificial Sequence
  Description of Artificial Sequence: Synthetic peptide
DEEEIRTTNPCATECYGSVSTNLQRLNR

SEQ ID NO: 6905 - protein, 29 aa, Artificial Sequence
  Description of Artificial Sequence: Synthetic peptide
DEEEIRTTNPVATEQYGSVSANLQSGNDR

SEQ ID NO: 6906 - protein, 29 aa, Artificial Sequence
  Description of Artificial Sequence: Synthetic peptide
DEEEIRTTNPVATEQYGSVSTNPLQIGNQ

SEQ ID NO: 6907 - protein, 28 aa, Artificial Sequence
  Description of Artificial Sequence: Synthetic peptide
DEEEIATTNPVATEQYGSVSTELQIGNR

SEQ ID NO: 6908 - protein, 28 aa, Artificial Sequence
  Description of Artificial Sequence: Synthetic peptide
DEEEIRTTNPVATEQYGSVSTDLQMGNQ

SEQ ID NO: 6909 - protein, 29 aa, Artificial Sequence
  Description of Artificial Sequence: Synthetic peptide
DEEEIRTTNPVATEQYGSVSTNEQNRGNF

SEQ ID NO: 6910 - protein, 28 aa, Artificial Sequence
  Description of Artificial Sequence: Synthetic peptide
DEEEIRTTNPVATEIYGSASTNLQYGNR

SEQ ID NO: 6911 - protein, 28 aa, Artificial Sequence
  Description of Artificial Sequence: Synthetic peptide
DEEEIRATNPTATEQFGSVSTNLQRGNR

SEQ ID NO: 6912 - protein, 28 aa, Artificial Sequence
  Description of Artificial Sequence: Synthetic peptide
DEEEIRTTNPVATEQYGWVSTNEQRGND

SEQ ID NO: 6913 - protein, 28 aa, Artificial Sequence
  Description of Artificial Sequence: Synthetic peptide
AEEEIVTTNPVATEQYGSVSTNLQRGNT

SEQ ID NO: 6914 - protein, 29 aa, Artificial Sequence
  Description of Artificial Sequence: Synthetic peptide
DEEEIRTTNPFATEQYGSVSTALVQRGNR

SEQ ID NO: 6915 - protein, 28 aa, Artificial Sequence
  Description of Artificial Sequence: Synthetic peptide
DENEIRTTNPVATEQYGSVSTDLERGNR

SEQ ID NO: 6916 - protein, 28 aa, Artificial Sequence
  Description of Artificial Sequence: Synthetic peptide
DEMEIRTTNPVATEQYGSTSTNLQRGPR

SEQ ID NO: 6917 - protein, 28 aa, Artificial Sequence
  Description of Artificial Sequence: Synthetic peptide
DEEEIRTTNPVATEQYGSVSTNDQLGNM

SEQ ID NO: 6918 - protein, 28 aa, Artificial Sequence
  Description of Artificial Sequence: Synthetic peptide
DEEEIRTTNPVATEQYGSVSTELQTGNS

SEQ ID NO: 6919 - protein, 28 aa, Artificial Sequence
  Description of Artificial Sequence: Synthetic peptide
DEEEIRTTNPVATEQYGSVSTPLDPGNR

SEQ ID NO: 6920 - protein, 29 aa, Artificial Sequence
  Description of Artificial Sequence: Synthetic peptide
DEEEIRTTNPVATEQYGSVSTNLQVGNDF

SEQ ID NO: 6921 - protein, 28 aa, Artificial Sequence
  Description of Artificial Sequence: Synthetic peptide
DEEEIRTTNPVATEQYGSVDTNLQTGTR

SEQ ID NO: 6922 - protein, 30 aa, Artificial Sequence
  Description of Artificial Sequence: Synthetic polypeptide
DEEEIRTTNPVATEQYGSVSTDGLQRGNPR

SEQ ID NO: 6923 - protein, 29 aa, Artificial Sequence
  Description of Artificial Sequence: Synthetic peptide
DEEEIRTTNPVATEQYGSVSTNLQGEGNE

SEQ ID NO: 6924 - protein, 28 aa, Artificial Sequence
  Description of Artificial Sequence: Synthetic peptide
DEEEIRTTNPVATEWYGSVSTNLMQGNR

SEQ ID NO: 6925 - protein, 29 aa, Artificial Sequence
  Description of Artificial Sequence: Synthetic peptide
DEEEIRTTNPVATEQYGSVSTNLQDAGER

SEQ ID NO: 6926 - protein, 28 aa, Artificial Sequence
  Description of Artificial Sequence: Synthetic peptide
DEECIRTTNPVAYEQYWSVSTNLQRGNR

SEQ ID NO: 6927 - protein, 29 aa, Artificial Sequence
  Description of Artificial Sequence: Synthetic peptide
DEEEIRTTNPVATEQYGSVSTNLQAGNDQ

SEQ ID NO: 6928 - protein, 30 aa, Artificial Sequence
  Description of Artificial Sequence: Synthetic polypeptide
DEEEIRTTNPVATEQYGSVSTNLQRNGNDN

SEQ ID NO: 6929 - protein, 29 aa, Artificial Sequence
  Description of Artificial Sequence: Synthetic peptide
DEEEIRTTNPCATEQYGSVGSTNLQRGER

SEQ ID NO: 6930 - protein, 28 aa, Artificial Sequence
  Description of Artificial Sequence: Synthetic peptide
DEEEIRTTNPVATEQYGSVDTNLQAGER

SEQ ID NO: 6931 - protein, 28 aa, Artificial Sequence
  Description of Artificial Sequence: Synthetic peptide
DEEEIVTTNPVASEQYGSVSTNLQRLNR

SEQ ID NO: 6932 - protein, 28 aa, Artificial Sequence
  Description of Artificial Sequence: Synthetic peptide
DEEEIRTTNPVATEQYGSVSTPLQIGDR

SEQ ID NO: 6933 - protein, 30 aa, Artificial Sequence
  Description of Artificial Sequence: Synthetic polypeptide
DEEEIRTTNPVATEQYGSVSTNPLQRGNDF

SEQ ID NO: 6934 - protein, 28 aa, Artificial Sequence
  Description of Artificial Sequence: Synthetic peptide
DEEEIRTTNPVATELYGSVSTNEQRGNA

SEQ ID NO: 6935 - protein, 28 aa, Artificial Sequence
  Description of Artificial Sequence: Synthetic peptide
DENEIRTTNPVATEMYGTVSTNLQRGNR

SEQ ID NO: 6936 - protein, 28 aa, Artificial Sequence
  Description of Artificial Sequence: Synthetic peptide
DEEEIRTTNPVATEQYGSVSTELQAGNA

SEQ ID NO: 6937 - protein, 28 aa, Artificial Sequence
  Description of Artificial Sequence: Synthetic peptide
DEEEIRCTNPAATEVYGSVSTNLQRGNR

SEQ ID NO: 6938 - protein, 28 aa, Artificial Sequence
  Description of Artificial Sequence: Synthetic peptide
DEEEIRTTNPVATEQYGSVSTNLQIGDF

SEQ ID NO: 6939 - protein, 30 aa, Artificial Sequence
  Description of Artificial Sequence: Synthetic polypeptide
DEEEIRTTNPVATEQYGSVSTMNLQHGNDR

SEQ ID NO: 6940 - protein, 28 aa, Artificial Sequence
  Description of Artificial Sequence: Synthetic peptide
DEEEIRTTNPVATEQYWSVSTDLQRGNQ

SEQ ID NO: 6941 - protein, 28 aa, Artificial Sequence
  Description of Artificial Sequence: Synthetic peptide
DEQEINTTNPVATEQYGSVSTNLQRGTR

SEQ ID NO: 6942 - protein, 28 aa, Artificial Sequence
  Description of Artificial Sequence: Synthetic peptide
DEEEIRTTNPVATECYGSVSTNLQVGND

SEQ ID NO: 6943 - protein, 28 aa, Artificial Sequence
  Description of Artificial Sequence: Synthetic peptide
DEEEIRTTNPVATEQYGSVSTGLEEGNR

SEQ ID NO: 6944 - protein, 30 aa, Artificial Sequence
  Description of Artificial Sequence: Synthetic polypeptide
DEEEIRTTNPVATEQYGSVSTNLQLEGNDR

SEQ ID NO: 6945 - protein, 29 aa, Artificial Sequence
  Description of Artificial Sequence: Synthetic peptide
DEVEIRTTNPVATEQYGSVSTDLPQRGNR

SEQ ID NO: 6946 - protein, 28 aa, Artificial Sequence
  Description of Artificial Sequence: Synthetic peptide
DEEEIRTTNPVATEVYGSVDTDLQRGNR

SEQ ID NO: 6947 - protein, 28 aa, Artificial Sequence
  Description of Artificial Sequence: Synthetic peptide
DEEEIRTTNPVATEQYGSVSTNLEIGNQ

SEQ ID NO: 6948 - protein, 29 aa, Artificial Sequence
  Description of Artificial Sequence: Synthetic peptide
DEEEIRTTNPVATEQYGSVSTNLQEQGNL

SEQ ID NO: 6949 - protein, 28 aa, Artificial Sequence
  Description of Artificial Sequence: Synthetic peptide
DEEEIRTTNPVATEQYGSVSTNLQGGEL

SEQ ID NO: 6950 - protein, 30 aa, Artificial Sequence
  Description of Artificial Sequence: Synthetic polypeptide
DEEEIRTTNPVATEQYGSVSTGNLQIRGND

SEQ ID NO: 6951 - protein, 30 aa, Artificial Sequence
  Description of Artificial Sequence: Synthetic polypeptide
DEEEIRATNPVATEQYGSVSTMDNLQRGNR

SEQ ID NO: 6952 - protein, 28 aa, Artificial Sequence
  Description of Artificial Sequence: Synthetic peptide
DEEEIRTTNPVATEQYGSVSTELQDGNW

SEQ ID NO: 6953 - protein, 28 aa, Artificial Sequence
  Description of Artificial Sequence: Synthetic peptide
DESEIRSTNPVATEQYGSVSTNLQRGPR

SEQ ID NO: 6954 - protein, 30 aa, Artificial Sequence
  Description of Artificial Sequence: Synthetic polypeptide
DEEELRTTNPVATEQYGVSVSTNLQRGNER

SEQ ID NO: 6955 - protein, 28 aa, Artificial Sequence
  Description of Artificial Sequence: Synthetic peptide
DEEEIRTTNPVATEQFGSVSTNEARGNR

SEQ ID NO: 6956 - protein, 29 aa, Artificial Sequence
  Description of Artificial Sequence: Synthetic peptide
DEQEIRTTNPVATEQYGEVSPTNLQRGNR

SEQ ID NO: 6957 - protein, 28 aa, Artificial Sequence
  Description of Artificial Sequence: Synthetic peptide
MENEIRTTNPVATEQYGSVSTNLQNGNR

SEQ ID NO: 6958 - protein, 28 aa, Artificial Sequence
  Description of Artificial Sequence: Synthetic peptide
DEEEIRTTNPFATEQYGSASTNLQYGNR

SEQ ID NO: 6959 - protein, 28 aa, Artificial Sequence
  Description of Artificial Sequence: Synthetic peptide
DEEEIRTTNPTATEQYGSVSTNEQRGNF

SEQ ID NO: 6960 - protein, 28 aa, Artificial Sequence
  Description of Artificial Sequence: Synthetic peptide
DEEEIRTTNPVATAQYGSVSTNEQRGND

SEQ ID NO: 6961 - protein, 28 aa, Artificial Sequence
  Description of Artificial Sequence: Synthetic peptide
DEEEIRTTNPVATEQYGSVSTNEQIGNQ

SEQ ID NO: 6962 - protein, 28 aa, Artificial Sequence
  Description of Artificial Sequence: Synthetic peptide
DEIEIRTTNPVATEQYGSVSTNLQLGND

SEQ ID NO: 6963 - protein, 28 aa, Artificial Sequence
  Description of Artificial Sequence: Synthetic peptide
DEEEIRTTNPVATEQYGSVSTNLQNGDE

SEQ ID NO: 6964 - protein, 28 aa, Artificial Sequence
  Description of Artificial Sequence: Synthetic peptide
DEEEIRTTNPVATELYGSVSTNDQRGNS

SEQ ID NO: 6965 - protein, 30 aa, Artificial Sequence
  Description of Artificial Sequence: Synthetic polypeptide
DEEEIRTTNPVATEQYGSVESETNDQRGNR

SEQ ID NO: 6966 - protein, 30 aa, Artificial Sequence
  Description of Artificial Sequence: Synthetic polypeptide
DEEEIRTTNPVATEQYGSVSENLEQRGNFR

SEQ ID NO: 6967 - protein, 29 aa, Artificial Sequence
  Description of Artificial Sequence: Synthetic peptide
DEEEIRTTNPVATEQYGSVSTNLQWDGND

SEQ ID NO: 6968 - protein, 28 aa, Artificial Sequence
  Description of Artificial Sequence: Synthetic peptide
DEEEIRTTNPVSTEQYGSVSTNLQMGND

SEQ ID NO: 6969 - protein, 29 aa, Artificial Sequence
  Description of Artificial Sequence: Synthetic peptide
DEEEIRTTNPVATEQYGSVSWNSQRGGNR

SEQ ID NO: 6970 - protein, 28 aa, Artificial Sequence
  Description of Artificial Sequence: Synthetic peptide
DESEIRTTNPVATEQYGSASTNLQRGGR

SEQ ID NO: 6971 - protein, 28 aa, Artificial Sequence
  Description of Artificial Sequence: Synthetic peptide
DEEEIRTTNPESTEQYGSVSTNEQRGNR

SEQ ID NO: 6972 - protein, 28 aa, Artificial Sequence
  Description of Artificial Sequence: Synthetic peptide
YEHEIVTTNPVATEQYGSVSTNLQRGNR

SEQ ID NO: 6973 - protein, 28 aa, Artificial Sequence
  Description of Artificial Sequence: Synthetic peptide
DENEIRSTNPVATEQYGSVCTNLQRGNR

SEQ ID NO: 6974 - protein, 28 aa, Artificial Sequence
  Description of Artificial Sequence: Synthetic peptide
DEEEIRTTNPVATEQYGDVSTNLQFGNF

SEQ ID NO: 6975 - protein, 28 aa, Artificial Sequence
  Description of Artificial Sequence: Synthetic peptide
DEEEIRTTNPVATEQYGSVSENLQMGNI

SEQ ID NO: 6976 - protein, 28 aa, Artificial Sequence
  Description of Artificial Sequence: Synthetic peptide
DEEEIRTTNPVATEIYGSVSTELQDGNR

SEQ ID NO: 6977 - protein, 30 aa, Artificial Sequence
  Description of Artificial Sequence: Synthetic polypeptide
DEEEIRTTNPVATEQYGSVSATNLQEVGNR

SEQ ID NO: 6978 - protein, 28 aa, Artificial Sequence
  Description of Artificial Sequence: Synthetic peptide
DEEEIRATNPVATEQYGWVATNLQRGNR

SEQ ID NO: 6979 - protein, 28 aa, Artificial Sequence
  Description of Artificial Sequence: Synthetic peptide
DEEEIRTTNPAATEQYGSVSTNWQLGNR

SEQ ID NO: 6980 - protein, 28 aa, Artificial Sequence
  Description of Artificial Sequence: Synthetic peptide
DEEEIRTTNPVATEQYGSVFENLQRGNA

SEQ ID NO: 6981 - protein, 29 aa, Artificial Sequence
  Description of Artificial Sequence: Synthetic peptide
SEEEIRTTNPVATEQYGSVSTMNLQRGTR

SEQ ID NO: 6982 - protein, 30 aa, Artificial Sequence
  Description of Artificial Sequence: Synthetic polypeptide
DEEEIATTNPVATEQYGSVSATNLQRAGNR

SEQ ID NO: 6983 - protein, 28 aa, Artificial Sequence
  Description of Artificial Sequence: Synthetic peptide
DEEEIRTTNPVATEQYGSVSTDLQMGNT

SEQ ID NO: 6984 - protein, 28 aa, Artificial Sequence
  Description of Artificial Sequence: Synthetic peptide
DEEEIRTTNPFATTQYGSVSTNLQHGNR

SEQ ID NO: 6985 - protein, 30 aa, Artificial Sequence
  Description of Artificial Sequence: Synthetic polypeptide
DEEEIRTTNPVATEQYGSVSTNRLQSGNPR

SEQ ID NO: 6986 - protein, 30 aa, Artificial Sequence
  Description of Artificial Sequence: Synthetic polypeptide
DEEEIRTTNPEATEQYGSVSTENGLQRGNR

SEQ ID NO: 6987 - protein, 28 aa, Artificial Sequence
  Description of Artificial Sequence: Synthetic peptide
DEEEIATTNPVATEQYGSVSTDLQRGNN

SEQ ID NO: 6988 - protein, 28 aa, Artificial Sequence
  Description of Artificial Sequence: Synthetic peptide
MEEEIRTTNPVATEQYGSVSTNLQTGNF

SEQ ID NO: 6989 - protein, 28 aa, Artificial Sequence
  Description of Artificial Sequence: Synthetic peptide
DLEEIRTTNPVATAQYGSVSTNLQQGNR

SEQ ID NO: 6990 - protein, 30 aa, Artificial Sequence
  Description of Artificial Sequence: Synthetic polypeptide
DEEEIRTTNPVATEQYGSVSTNLQERGNDF

SEQ ID NO: 6991 - protein, 28 aa, Artificial Sequence
  Description of Artificial Sequence: Synthetic peptide
DEEEIRTTNPVATEQYGSVSTDDQRGER

SEQ ID NO: 6992 - protein, 29 aa, Artificial Sequence
  Description of Artificial Sequence: Synthetic peptide
VEEEIRTTNPVATEMYGSVSTNLQRNGNR

SEQ ID NO: 6993 - protein, 28 aa, Artificial Sequence
  Description of Artificial Sequence: Synthetic peptide
DEEEIRTTNPVATEQYGSVSDNDQRGER

SEQ ID NO: 6994 - protein, 29 aa, Artificial Sequence
  Description of Artificial Sequence: Synthetic peptide
DEEEIRTTNPVATEQYGSVSTGNLIAGNR

SEQ ID NO: 6995 - protein, 28 aa, Artificial Sequence
  Description of Artificial Sequence: Synthetic peptide
DEEEIRTTNPVATEQYGSVSTNLQRSED

SEQ ID NO: 6996 - protein, 30 aa, Artificial Sequence
  Description of Artificial Sequence: Synthetic polypeptide
DEEEIRTTNPVATEQYGSVSTNLILREGNR

SEQ ID NO: 6997 - protein, 28 aa, Artificial Sequence
  Description of Artificial Sequence: Synthetic peptide
SEEEIRTTNPVATEQYGSVSTNDQRGNG

SEQ ID NO: 6998 - protein, 28 aa, Artificial Sequence
  Description of Artificial Sequence: Synthetic peptide
DEEEIRTTNPVATEQFGSVSTNLQLGDR

SEQ ID NO: 6999 - protein, 29 aa, Artificial Sequence
  Description of Artificial Sequence: Synthetic peptide
DEEEIRTTNPVATEQFGSVTTNLQFRGNR

SEQ ID NO: 7000 - protein, 28 aa, Artificial Sequence
  Description of Artificial Sequence: Synthetic peptide
DEEEVRTTNPVATEQYGSVSMNLERGNR

SEQ ID NO: 7001 - protein, 31 aa, Artificial Sequence
  Description of Artificial Sequence: Synthetic polypeptide
DEEEIRTTNPVATEQYGSVSTDNGLQREGNR

SEQ ID NO: 7002 - protein, 28 aa, Artificial Sequence
  Description of Artificial Sequence: Synthetic peptide
DEEEIRQTNPVATEQYGSVSTNDDRGNR

SEQ ID NO: 7003 - protein, 28 aa, Artificial Sequence
  Description of Artificial Sequence: Synthetic peptide
MEEEIRTTNPVATEQYGSVSTNLQVGNF

SEQ ID NO: 7004 - protein, 28 aa, Artificial Sequence
  Description of Artificial Sequence: Synthetic peptide
DENEIRQTNPVATEQYGSVSTNLQRGNQ

SEQ ID NO: 7005 - protein, 28 aa, Artificial Sequence
  Description of Artificial Sequence: Synthetic peptide
DEEEIRTTNPVATEQYGSVVHNLQRMNR

SEQ ID NO: 7006 - protein, 28 aa, Artificial Sequence
  Description of Artificial Sequence: Synthetic peptide
DEEEIRTTNPVCTEQYGSVSTNLQSGNL

SEQ ID NO: 7007 - protein, 28 aa, Artificial Sequence
  Description of Artificial Sequence: Synthetic peptide
DEQEIRTTNPDATEQYGSVSTNLQRENR

SEQ ID NO: 7008 - protein, 29 aa, Artificial Sequence
  Description of Artificial Sequence: Synthetic peptide
DEEEIRTTNPVATEQYGSVETNLQREGTR

SEQ ID NO: 7009 - protein, 28 aa, Artificial Sequence
  Description of Artificial Sequence: Synthetic peptide
DEEEIMTTNPVATEQYGGVSTNLQRGNV

SEQ ID NO: 7010 - protein, 28 aa, Artificial Sequence
  Description of Artificial Sequence: Synthetic peptide
DENEIRTTNPVATEQYGSVSTDLQRGER

SEQ ID NO: 7011 - protein, 30 aa, Artificial Sequence
  Description of Artificial Sequence: Synthetic polypeptide
DEEEIRTTNPVATEQYGSVSTNLQDYGNDR

SEQ ID NO: 7012 - protein, 28 aa, Artificial Sequence
  Description of Artificial Sequence: Synthetic peptide
DEEEIRTTNPVATEQYGSVSTDLQNGNA

SEQ ID NO: 7013 - protein, 28 aa, Artificial Sequence
  Description of Artificial Sequence: Synthetic peptide
DEEEIRTTNPVATEQYGSVDTNWQRENR

SEQ ID NO: 7014 - protein, 28 aa, Artificial Sequence
  Description of Artificial Sequence: Synthetic peptide
DEEEIRTTNPVASESYGSASTNLQRGNR

SEQ ID NO: 7015 - protein, 28 aa, Artificial Sequence
  Description of Artificial Sequence: Synthetic peptide
DENEIRTTNPVATEIYGAVSTNLQRGNR

SEQ ID NO: 7016 - protein, 28 aa, Artificial Sequence
  Description of Artificial Sequence: Synthetic peptide
DEEEIRQTNPVATEQYGSVSTNLERGNI

SEQ ID NO: 7017 - protein, 29 aa, Artificial Sequence
  Description of Artificial Sequence: Synthetic peptide
QEEEIRTTNPVATECYGSVSTNLQRGNTR

SEQ ID NO: 7018 - protein, 28 aa, Artificial Sequence
  Description of Artificial Sequence: Synthetic peptide
DEEEIRQTNPVATEQYGSASTNLQRGGR

SEQ ID NO: 7019 - protein, 29 aa, Artificial Sequence
  Description of Artificial Sequence: Synthetic peptide
DEEEIRTTNPVATEQYGSVDTNLQHGNDR

SEQ ID NO: 7020 - protein, 28 aa, Artificial Sequence
  Description of Artificial Sequence: Synthetic peptide
DEQEIRCTNPVASEQYGSVSTNLQRGNR

SEQ ID NO: 7021 - protein, 28 aa, Artificial Sequence
  Description of Artificial Sequence: Synthetic peptide
DEEEIRTTNPVATECYGSVSTNLDRGNN

SEQ ID NO: 7022 - protein, 28 aa, Artificial Sequence
  Description of Artificial Sequence: Synthetic peptide
DEEEIRTTNPVATEQYGSVSTELQRGDY

SEQ ID NO: 7023 - protein, 28 aa, Artificial Sequence
  Description of Artificial Sequence: Synthetic peptide
DEEEIRTTNPVATEQYGSVSTNLQGGEA

SEQ ID NO: 7024 - protein, 28 aa, Artificial Sequence
  Description of Artificial Sequence: Synthetic peptide
DEEEIRTTNPVATEQYGSVSTNPQLGNI

SEQ ID NO: 7025 - protein, 29 aa, Artificial Sequence
  Description of Artificial Sequence: Synthetic peptide
SEEEIRTTNPVATEQYGSVSTNLQRGDTR

SEQ ID NO: 7026 - protein, 29 aa, Artificial Sequence
  Description of Artificial Sequence: Synthetic peptide
DEEEIRTTNPVATEQYGSVSTNDQFRGNY

SEQ ID NO: 7027 - protein, 30 aa, Artificial Sequence
  Description of Artificial Sequence: Synthetic polypeptide
DEEEIRTTNPVATEQYGSQVSTNLQSGNNR

SEQ ID NO: 7028 - protein, 30 aa, Artificial Sequence
  Description of Artificial Sequence: Synthetic polypeptide
DEEEIRTTNPVATEQYGSVSTNLQIDGNPR

SEQ ID NO: 7029 - protein, 28 aa, Artificial Sequence
  Description of Artificial Sequence: Synthetic peptide
DEQEIRTTNPVATEQYGSVETNLQPGNR

SEQ ID NO: 7030 - protein, 28 aa, Artificial Sequence
  Description of Artificial Sequence: Synthetic peptide
DEEEIRTTNPVATMQYGSVPTNLQRINR

SEQ ID NO: 7031 - protein, 28 aa, Artificial Sequence
  Description of Artificial Sequence: Synthetic peptide
MEEEIRTTNPVATEQYGSVSTNLQIGNA

SEQ ID NO: 7032 - protein, 28 aa, Artificial Sequence
  Description of Artificial Sequence: Synthetic peptide
DDEEIRTTNPVGTEQYGSVSINLQRGNR

SEQ ID NO: 7033 - protein, 30 aa, Artificial Sequence
  Description of Artificial Sequence: Synthetic polypeptide
DEEEIRTTNPVATEQYGSVSTNLQEVGNTR

SEQ ID NO: 7034 - protein, 28 aa, Artificial Sequence
  Description of Artificial Sequence: Synthetic peptide
DEEEIRATNPVSTEQYGSVSTNLQNGNR

SEQ ID NO: 7035 - protein, 28 aa, Artificial Sequence
  Description of Artificial Sequence: Synthetic peptide
DEEEIRSTNPVATEQYGTVSNNLQRGNR

SEQ ID NO: 7036 - protein, 30 aa, Artificial Sequence
  Description of Artificial Sequence: Synthetic polypeptide
DEEEIRTTNPVATEQYGSVSTNLERNGENR

SEQ ID NO: 7037 - protein, 29 aa, Artificial Sequence
  Description of Artificial Sequence: Synthetic peptide
DEEEIRTTNPVATEQYGSVSATNLQRGEL

SEQ ID NO: 7038 - protein, 30 aa, Artificial Sequence
  Description of Artificial Sequence: Synthetic polypeptide
DEEEIRTTNPVATEQYGSVSTNPLQRDGER

SEQ ID NO: 7039 - protein, 28 aa, Artificial Sequence
  Description of Artificial Sequence: Synthetic peptide
DEAEIRTTNPVATEQYGSVSENVQRGNR

SEQ ID NO: 7040 - protein, 28 aa, Artificial Sequence
  Description of Artificial Sequence: Synthetic peptide
TEQEIRTTNPVATEQYGSTSTNLQRGNR

SEQ ID NO: 7041 - protein, 28 aa, Artificial Sequence
  Description of Artificial Sequence: Synthetic peptide
DEEEIRTTNPVCTEQYGSVSTNDQRGNQ

SEQ ID NO: 7042 - protein, 29 aa, Artificial Sequence
  Description of Artificial Sequence: Synthetic peptide
DEEEIRTTNPVATEQYGSVSTNGDERGNR

SEQ ID NO: 7043 - protein, 28 aa, Artificial Sequence
  Description of Artificial Sequence: Synthetic peptide
DEEEIRTTNPVATEQYGSVSENLQIGNA

SEQ ID NO: 7044 - protein, 29 aa, Artificial Sequence
  Description of Artificial Sequence: Synthetic peptide
DEEEIRTTNPVATEQYWSYVSTNLQRGER

SEQ ID NO: 7045 - protein, 28 aa, Artificial Sequence
  Description of Artificial Sequence: Synthetic peptide
DEEEIRTTNPVATEQYGSVSTNLDRGEQ

SEQ ID NO: 7046 - protein, 28 aa, Artificial Sequence
  Description of Artificial Sequence: Synthetic peptide
DEEEIRTTNPVATEQYGSVSTDLQWGDR

SEQ ID NO: 7047 - protein, 30 aa, Artificial Sequence
  Description of Artificial Sequence: Synthetic polypeptide
DEEEIRTTNPVATEQYGSVSTALQFRNGNR

SEQ ID NO: 7048 - protein, 28 aa, Artificial Sequence
  Description of Artificial Sequence: Synthetic peptide
DEEEIRTTNPVATEQYGSVSTPEDRGNR

SEQ ID NO: 7049 - protein, 28 aa, Artificial Sequence
  Description of Artificial Sequence: Synthetic peptide
DEEEIRTTNPVATEQYGSVSTNDQPGDR

SEQ ID NO: 7050 - protein, 28 aa, Artificial Sequence
  Description of Artificial Sequence: Synthetic peptide
DEEEIRTTNPVATEIYGSVSTNLQTGNV

SEQ ID NO: 7051 - protein, 28 aa, Artificial Sequence
  Description of Artificial Sequence: Synthetic peptide
DEEEIRTTNPVATEQYGSVSTNEMRGNM

SEQ ID NO: 7052 - protein, 29 aa, Artificial Sequence
  Description of Artificial Sequence: Synthetic peptide
DEEEIRTTNPVATEQYGSVSTNLQTEGNQ

SEQ ID NO: 7053 - protein, 29 aa, Artificial Sequence
  Description of Artificial Sequence: Synthetic peptide
DEEEIRTVNPIATEQYGSVSTNLQRGNDR

SEQ ID NO: 7054 - protein, 28 aa, Artificial Sequence
  Description of Artificial Sequence: Synthetic peptide
DEEEIATTNPVATEQYGSVSTNLQQENR

SEQ ID NO: 7055 - protein, 28 aa, Artificial Sequence
  Description of Artificial Sequence: Synthetic peptide
DEEEIRTTNPVASEQYGFVSTNLQRLNR

SEQ ID NO: 7056 - protein, 28 aa, Artificial Sequence
  Description of Artificial Sequence: Synthetic peptide
DEQEIRTTNPVATEQYGSVSTNLDRGDR

SEQ ID NO: 7057 - protein, 29 aa, Artificial Sequence
  Description of Artificial Sequence: Synthetic peptide
DEEEIRTTNPVATEQYGSVSENLQCHGNR

SEQ ID NO: 7058 - protein, 28 aa, Artificial Sequence
  Description of Artificial Sequence: Synthetic peptide
DEEEIRTTNPVATEQYGSVSTDLQGGND

SEQ ID NO: 7059 - protein, 28 aa, Artificial Sequence
  Description of Artificial Sequence: Synthetic peptide
DENEIRTTNPVATEQYGDVSTNLQRMNR

SEQ ID NO: 7060 - protein, 29 aa, Artificial Sequence
  Description of Artificial Sequence: Synthetic peptide
DEEEIRTTNPVATEQYGSYSTNLQWVGNR

SEQ ID NO: 7061 - protein, 28 aa, Artificial Sequence
  Description of Artificial Sequence: Synthetic peptide
DEEEIRTTNPVATEQYGSVSTNDEVGNR

SEQ ID NO: 7062 - protein, 28 aa, Artificial Sequence
  Description of Artificial Sequence: Synthetic peptide
KEEEIRTTNPVATEQYGEASTNLQRGNR

SEQ ID NO: 7063 - protein, 28 aa, Artificial Sequence
  Description of Artificial Sequence: Synthetic peptide
DEEEIRTVNPVATEQYGSVSNNLQRGQR

SEQ ID NO: 7064 - protein, 29 aa, Artificial Sequence
  Description of Artificial Sequence: Synthetic peptide
DEEEIRTTNPVSTEQYGSVSTNLMWRGNR

SEQ ID NO: 7065 - protein, 28 aa, Artificial Sequence
  Description of Artificial Sequence: Synthetic peptide
DEEEIRTTNPVATEQYGSVSTELQDGNQ

SEQ ID NO: 7066 - protein, 28 aa, Artificial Sequence
  Description of Artificial Sequence: Synthetic peptide
SEEEIRTTNPVATEWYGIVSTNLQRGNR

SEQ ID NO: 7067 - protein, 28 aa, Artificial Sequence
  Description of Artificial Sequence: Synthetic peptide
SEEMIRTTNPVATEQYGSVSTNLQRFNR

SEQ ID NO: 7068 - protein, 28 aa, Artificial Sequence
  Description of Artificial Sequence: Synthetic peptide
DEEEIRTTNPVATEQYGSMSTNLQRGEA

SEQ ID NO: 7069 - protein, 28 aa, Artificial Sequence
  Description of Artificial Sequence: Synthetic peptide
DEEEIRTTNPVAYEQYGSVSTNLDRGND

SEQ ID NO: 7070 - protein, 30 aa, Artificial Sequence
  Description of Artificial Sequence: Synthetic polypeptide
DEEEIRTTNPVATEQYGSVVSTPNLQGGNR

SEQ ID NO: 7071 - protein, 29 aa, Artificial Sequence
  Description of Artificial Sequence: Synthetic peptide
DEEEIRTTNPVATEQYGSVSTEDLQHGNR

SEQ ID NO: 7072 - protein, 28 aa, Artificial Sequence
  Description of Artificial Sequence: Synthetic peptide
DEEEIRTVNPVATEQYGSVATNLQRGNL

SEQ ID NO: 7073 - protein, 29 aa, Artificial Sequence
  Description of Artificial Sequence: Synthetic peptide
DEEEIMTTNPVATEQYGSVSSNGLQRGNR

SEQ ID NO: 7074 - protein, 28 aa, Artificial Sequence
  Description of Artificial Sequence: Synthetic peptide
MEEEIRTTNPVATEQYGSASENLQRGNR

SEQ ID NO: 7075 - protein, 28 aa, Artificial Sequence
  Description of Artificial Sequence: Synthetic peptide
DEEEIATTNPVATEQYGSVSTNLQNGNM

SEQ ID NO: 7076 - protein, 28 aa, Artificial Sequence
  Description of Artificial Sequence: Synthetic peptide
DEEEIRTTNPVATEQWGSVDTNLQLGNR

SEQ ID NO: 7077 - protein, 28 aa, Artificial Sequence
  Description of Artificial Sequence: Synthetic peptide
DEEEIRTTNPVATEQWGSVSTNLMRGDR

SEQ ID NO: 7078 - protein, 28 aa, Artificial Sequence
  Description of Artificial Sequence: Synthetic peptide
DEEEINTTNPVATEKYGSVSTNLQRGNE

SEQ ID NO: 7079 - protein, 29 aa, Artificial Sequence
  Description of Artificial Sequence: Synthetic peptide
DEEEIRTTNPVATEQYGSVFTDLQARGNR

SEQ ID NO: 7080 - protein, 29 aa, Artificial Sequence
  Description of Artificial Sequence: Synthetic peptide
DEEEIRTTNPVATEQYGSVDETNDQRGNR

SEQ ID NO: 7081 - protein, 28 aa, Artificial Sequence
  Description of Artificial Sequence: Synthetic peptide
SEEEIRTTNPVATEQFGSVSTNPQRGNR

SEQ ID NO: 7082 - protein, 28 aa, Artificial Sequence
  Description of Artificial Sequence: Synthetic peptide
VDEEIRTTNPVATECYGSVSTNLQRGNR

SEQ ID NO: 7083 - protein, 29 aa, Artificial Sequence
  Description of Artificial Sequence: Synthetic peptide
DEEEIRTTNPVATEQYGSVSTNLERGEDR

SEQ ID NO: 7084 - protein, 30 aa, Artificial Sequence
  Description of Artificial Sequence: Synthetic polypeptide
DEEEIRTTNPVATEQYGSVSGHNLQRGSNR

SEQ ID NO: 7085 - protein, 28 aa, Artificial Sequence
  Description of Artificial Sequence: Synthetic peptide
DEEEIGTTNPVSTEQYGSVSTDLQRGNR

SEQ ID NO: 7086 - protein, 28 aa, Artificial Sequence
  Description of Artificial Sequence: Synthetic peptide
DEEEIRTTNPCATEQYGSVSTNLQPLNR

SEQ ID NO: 7087 - protein, 29 aa, Artificial Sequence
  Description of Artificial Sequence: Synthetic peptide
MENEIRTTNPVATEQYGSVSTNLQREGNR

SEQ ID NO: 7088 - protein, 28 aa, Artificial Sequence
  Description of Artificial Sequence: Synthetic peptide
DEQEIRTTNPVATEQYGEVATNLQRGNR

SEQ ID NO: 7089 - protein, 30 aa, Artificial Sequence
  Description of Artificial Sequence: Synthetic polypeptide
DEEEIRTTNPVATEQYGSVDTINLQRGENR

SEQ ID NO: 7090 - protein, 28 aa, Artificial Sequence
  Description of Artificial Sequence: Synthetic peptide
DEEEIRTTNPVATEQYGSVSTDLEPGNR

SEQ ID NO: 7091 - protein, 28 aa, Artificial Sequence
  Description of Artificial Sequence: Synthetic peptide
DEEEIRTTNPVATEQYGSVSTNLMIGNA

SEQ ID NO: 7092 - protein, 29 aa, Artificial Sequence
  Description of Artificial Sequence: Synthetic peptide
DEEEIRTTNPVATEQYWSVSTNLQERGNP

SEQ ID NO: 7093 - protein, 28 aa, Artificial Sequence
  Description of Artificial Sequence: Synthetic peptide
DEEEIRTTNPTATEQFGGVSTNLQRGNR

SEQ ID NO: 7094 - protein, 28 aa, Artificial Sequence
  Description of Artificial Sequence: Synthetic peptide
NEEEIRTTNPDATEQYGSVSHNLQRGNR

SEQ ID NO: 7095 - protein, 28 aa, Artificial Sequence
  Description of Artificial Sequence: Synthetic peptide
DEEEIRTTNPVATEQYGSVSTPPQRGNA

SEQ ID NO: 7096 - protein, 29 aa, Artificial Sequence
  Description of Artificial Sequence: Synthetic peptide
DEEEIRTTNPVATEQYGSVSTYLQYRGNA

SEQ ID NO: 7097 - protein, 28 aa, Artificial Sequence
  Description of Artificial Sequence: Synthetic peptide
DEEEIRTVNPVATEPYGSVSTNLQRPNR

SEQ ID NO: 7098 - protein, 28 aa, Artificial Sequence
  Description of Artificial Sequence: Synthetic peptide
YEEEIRTTNPVCTEQYGSVSTNLQQGNR

SEQ ID NO: 7099 - protein, 28 aa, Artificial Sequence
  Description of Artificial Sequence: Synthetic peptide
DEEEIVTTNPVATEQYGSVSTELDRGNR

SEQ ID NO: 7100 - protein, 28 aa, Artificial Sequence
  Description of Artificial Sequence: Synthetic peptide
DEEEIRATNPVATEQYGSVSTNPQRGNA

SEQ ID NO: 7101 - protein, 29 aa, Artificial Sequence
  Description of Artificial Sequence: Synthetic peptide
DEEEIRTTNPVATEQYGSVSTGDLERGNR

SEQ ID NO: 7102 - protein, 31 aa, Artificial Sequence
  Description of Artificial Sequence: Synthetic polypeptide
DEEEIRTTNPVATEQYGSVSQTNLNQRGLNR

SEQ ID NO: 7103 - protein, 29 aa, Artificial Sequence
  Description of Artificial Sequence: Synthetic peptide
DEEEIRTTNPVATEQYGSVSTNLQIGNDF

SEQ ID NO: 7104 - protein, 29 aa, Artificial Sequence
  Description of Artificial Sequence: Synthetic peptide
DEEEIRTCNPVATEQYGSVSTMELQRGNR

SEQ ID NO: 7105 - protein, 29 aa, Artificial Sequence
  Description of Artificial Sequence: Synthetic peptide
DEEEIRTTNPVCTEQYGSVSTNLQYGNDR

SEQ ID NO: 7106 - protein, 28 aa, Artificial Sequence
  Description of Artificial Sequence: Synthetic peptide
DEEEIRTTNPVATEQYGSASENLQRGPR

SEQ ID NO: 7107 - protein, 29 aa, Artificial Sequence
  Description of Artificial Sequence: Synthetic peptide
DEEEIRTTNPVATEQYGSVSTNEQERENR

SEQ ID NO: 7108 - protein, 28 aa, Artificial Sequence
  Description of Artificial Sequence: Synthetic peptide
DEEEIRTVNPVATECYGSVATNLQRGNR

SEQ ID NO: 7109 - protein, 28 aa, Artificial Sequence
  Description of Artificial Sequence: Synthetic peptide
DEEEIRTTNPVATEQYGSVSTNLQMGES

SEQ ID NO: 7110 - protein, 28 aa, Artificial Sequence
  Description of Artificial Sequence: Synthetic peptide
DEHEIRTTNPVATEQYGTVSTNEQRGNR

SEQ ID NO: 7111 - protein, 30 aa, Artificial Sequence
  Description of Artificial Sequence: Synthetic polypeptide
DEEEIRTTNPVATEQYGSVSTNPLQPGDNR

SEQ ID NO: 7112 - protein, 29 aa, Artificial Sequence
  Description of Artificial Sequence: Synthetic peptide
DEEEISTTNPVATEQYGSVSDNLQQRGNR

SEQ ID NO: 7113 - protein, 29 aa, Artificial Sequence
  Description of Artificial Sequence: Synthetic peptide
DEEEIRTTNPVATEQYGSVSTNLQETGNW

SEQ ID NO: 7114 - protein, 29 aa, Artificial Sequence
  Description of Artificial Sequence: Synthetic peptide
DEEEIRQTNPVATEQYGSVSSTNLERGNR

SEQ ID NO: 7115 - protein, 29 aa, Artificial Sequence
  Description of Artificial Sequence: Synthetic peptide
DEEEIRTTNPVATEQYGSVSADVLQRGNR

SEQ ID NO: 7116 - protein, 28 aa, Artificial Sequence
  Description of Artificial Sequence: Synthetic peptide
EEECIRTTNPTATEQYGSVSTNLQRGNR

SEQ ID NO: 7117 - protein, 28 aa, Artificial Sequence
  Description of Artificial Sequence: Synthetic peptide
DEQEIRTTNPVATECYGSVSTNLERGNR

SEQ ID NO: 7118 - protein, 29 aa, Artificial Sequence
  Description of Artificial Sequence: Synthetic peptide
DEEEIRTTNPVATEQYGSVSTEDQRGENR

SEQ ID NO: 7119 - protein, 29 aa, Artificial Sequence
  Description of Artificial Sequence: Synthetic peptide
GEEEIRTTNPVATEQYGSVSTNLQERGNT

SEQ ID NO: 7120 - protein, 28 aa, Artificial Sequence
  Description of Artificial Sequence: Synthetic peptide
DEEEIRTTNPVATEQYGSVSTNLGPGNL

SEQ ID NO: 7121 - protein, 28 aa, Artificial Sequence
  Description of Artificial Sequence: Synthetic peptide
DEEEIRTTNPVATEQYGSVSTNDQSGNT

SEQ ID NO: 7122 - protein, 29 aa, Artificial Sequence
  Description of Artificial Sequence: Synthetic peptide
DEEEIRTTNPVATECYGSVSTNLQRGANG

SEQ ID NO: 7123 - protein, 30 aa, Artificial Sequence
  Description of Artificial Sequence: Synthetic polypeptide
DEEEIRTTNPVATEQYGSVSTGALQERGNR

SEQ ID NO: 7124 - protein, 28 aa, Artificial Sequence
  Description of Artificial Sequence: Synthetic peptide
DEEEIKTTNPVATMQYGSVSENLQRGNR

SEQ ID NO: 7125 - protein, 29 aa, Artificial Sequence
  Description of Artificial Sequence: Synthetic peptide
DEEEIRTTNPVATEQYGSWSTNLVQRGLR

SEQ ID NO: 7126 - protein, 28 aa, Artificial Sequence
  Description of Artificial Sequence: Synthetic peptide
DEEEIRTTNPVAWEQYGSVSTNLQRGTF

SEQ ID NO: 7127 - protein, 28 aa, Artificial Sequence
  Description of Artificial Sequence: Synthetic peptide
DEEEIRTTNPAATEQYGSVSTNLQNGNF

SEQ ID NO: 7128 - protein, 28 aa, Artificial Sequence
  Description of Artificial Sequence: Synthetic peptide
DEEEIVTTNPVATEQYGSVSTNLQHGNE

SEQ ID NO: 7129 - protein, 28 aa, Artificial Sequence
  Description of Artificial Sequence: Synthetic peptide
DEEEIRTTNPAATEQYGSVSTNLQTGNG

SEQ ID NO: 7130 - protein, 29 aa, Artificial Sequence
  Description of Artificial Sequence: Synthetic peptide
DEEEIRTTNPVATEQYGSVSTNLQELGNM

SEQ ID NO: 7131 - protein, 28 aa, Artificial Sequence
  Description of Artificial Sequence: Synthetic peptide
DEEEIRTTNPVATEIYGSVSTNLQLGNS

SEQ ID NO: 7132 - protein, 29 aa, Artificial Sequence
  Description of Artificial Sequence: Synthetic peptide
DEEEIRTTNPVATEQYGSVSTHLQRGNDM

SEQ ID NO: 7133 - protein, 28 aa, Artificial Sequence
  Description of Artificial Sequence: Synthetic peptide
DEEEIRTTNPVATEQYGSVDTNLQRENP

SEQ ID NO: 7134 - protein, 31 aa, Artificial Sequence
  Description of Artificial Sequence: Synthetic polypeptide
DEEEIRTTNPVATEQYGSVSITGNLQRGDNR

SEQ ID NO: 7135 - protein, 29 aa, Artificial Sequence
  Description of Artificial Sequence: Synthetic peptide
DEEEIRTTNPVATEQYGSVSTNLQEHGNV

SEQ ID NO: 7136 - protein, 28 aa, Artificial Sequence
  Description of Artificial Sequence: Synthetic peptide
DEEEIRTTNPVATEQYGSVSCLLQHGNR

SEQ ID NO: 7137 - protein, 31 aa, Artificial Sequence
  Description of Artificial Sequence: Synthetic polypeptide
DEEEIRTTNPVATEQYGSVDSTINLQRNGNR

SEQ ID NO: 7138 - protein, 28 aa, Artificial Sequence
  Description of Artificial Sequence: Synthetic peptide
DDENIATTNPVATEQYGSVSTNLQRGNR

SEQ ID NO: 7139 - protein, 29 aa, Artificial Sequence
  Description of Artificial Sequence: Synthetic peptide
DEGEIRTTNPVATEQYGSVYSTNLQRGNF

SEQ ID NO: 7140 - protein, 28 aa, Artificial Sequence
  Description of Artificial Sequence: Synthetic peptide
DEEEIRTTNPVATEYYGYVSTDLQRGNR

SEQ ID NO: 7141 - protein, 28 aa, Artificial Sequence
  Description of Artificial Sequence: Synthetic peptide
DEEEIRTTNPVATEQYGFVATNLGRGNR

SEQ ID NO: 7142 - protein, 28 aa, Artificial Sequence
  Description of Artificial Sequence: Synthetic peptide
DEEEIRTTNPTATEQYGSVSENPQRGNR

SEQ ID NO: 7143 - protein, 29 aa, Artificial Sequence
  Description of Artificial Sequence: Synthetic peptide
DEEEIRTTNPVATEQYGSVSTNLQENGNA

SEQ ID NO: 7144 - protein, 28 aa, Artificial Sequence
  Description of Artificial Sequence: Synthetic peptide
DEEEIRTTNPVATEQYGSVQGNLQRGNP

SEQ ID NO: 7145 - protein, 28 aa, Artificial Sequence
  Description of Artificial Sequence: Synthetic peptide
DDEEIRTTNPVATEQYGSVSENLERGNR

SEQ ID NO: 7146 - protein, 29 aa, Artificial Sequence
  Description of Artificial Sequence: Synthetic peptide
DEEEIRTTNPVATEQYGSVSTDLQDRGNL

SEQ ID NO: 7147 - protein, 29 aa, Artificial Sequence
  Description of Artificial Sequence: Synthetic peptide
DEEEIRTTNPVATEQYGDVSADNLQRGNR

SEQ ID NO: 7148 - protein, 30 aa, Artificial Sequence
  Description of Artificial Sequence: Synthetic polypeptide
DEEEIRTTNPVATEQYGSVESHNLQRVGNR

SEQ ID NO: 7149 - protein, 30 aa, Artificial Sequence
  Description of Artificial Sequence: Synthetic polypeptide
DEEEIRTTNPVATEQYGSVSTNLQLNGNDR

SEQ ID NO: 7150 - protein, 28 aa, Artificial Sequence
  Description of Artificial Sequence: Synthetic peptide
DEEEIRCTNPVATEQYGDVVTNLQRGNR

SEQ ID NO: 7151 - protein, 29 aa, Artificial Sequence
  Description of Artificial Sequence: Synthetic peptide
DEEEIRTTNPVATEQYGDVSENLQCRGNR

SEQ ID NO: 7152 - protein, 29 aa, Artificial Sequence
  Description of Artificial Sequence: Synthetic peptide
DEEEIRTTNPVATEQYGSFVFTPLQRGNR

SEQ ID NO: 7153 - protein, 28 aa, Artificial Sequence
  Description of Artificial Sequence: Synthetic peptide
DEEEIRTTNPVATEQYGCVSNNLQRENR

SEQ ID NO: 7154 - protein, 28 aa, Artificial Sequence
  Description of Artificial Sequence: Synthetic peptide
DEEEIRTTNPVATEMYGGVSTNLQRGNF

SEQ ID NO: 7155 - protein, 28 aa, Artificial Sequence
  Description of Artificial Sequence: Synthetic peptide
AEEEIRTTNPVATELYGGVSTNLQRGNR

SEQ ID NO: 7156 - protein, 30 aa, Artificial Sequence
  Description of Artificial Sequence: Synthetic polypeptide
DEEEIRTTNPVATECYGSVSTNLQRNGNDR

SEQ ID NO: 7157 - protein, 29 aa, Artificial Sequence
  Description of Artificial Sequence: Synthetic peptide
DEEEIRTTNPVATEQYGSVSENLQNGNDR

SEQ ID NO: 7158 - protein, 29 aa, Artificial Sequence
  Description of Artificial Sequence: Synthetic peptide
DEEEIRTTNPVATEQYGSVSTNLQIGNDS

SEQ ID NO: 7159 - protein, 28 aa, Artificial Sequence
  Description of Artificial Sequence: Synthetic peptide
DEEEVRTTNPVATEHYGSVSTNLERGNR

SEQ ID NO: 7160 - protein, 28 aa, Artificial Sequence
  Description of Artificial Sequence: Synthetic peptide
AEEEIRTTNPVASEQYGSVSTNLQRLNR

SEQ ID NO: 7161 - protein, 28 aa, Artificial Sequence
  Description of Artificial Sequence: Synthetic peptide
DEEEIRTTNPVATECYGSVSTNLQVGNV

SEQ ID NO: 7162 - protein, 29 aa, Artificial Sequence
  Description of Artificial Sequence: Synthetic peptide
DEEEIRTTNPVATEQYGSVSTNLQEQGER

SEQ ID NO: 7163 - protein, 28 aa, Artificial Sequence
  Description of Artificial Sequence: Synthetic peptide
DEEEIACTNPVATEQYGWVSTNLQRGNR

SEQ ID NO: 7164 - protein, 28 aa, Artificial Sequence
  Description of Artificial Sequence: Synthetic peptide
DEEEIRTTNPVATQQYGDVSENLQRGNR

SEQ ID NO: 7165 - protein, 29 aa, Artificial Sequence
  Description of Artificial Sequence: Synthetic peptide
DEQEIRTTNPVATEQYGSVSTNPLQRGNF

SEQ ID NO: 7166 - protein, 30 aa, Artificial Sequence
  Description of Artificial Sequence: Synthetic polypeptide
DEEEIRTTNPVATEQYGSVSTMGNLQFGNR

SEQ ID NO: 7167 - protein, 29 aa, Artificial Sequence
  Description of Artificial Sequence: Synthetic peptide
DEEEIRTTNPVATEQYGSVSTNLQDQGNF

SEQ ID NO: 7168 - protein, 28 aa, Artificial Sequence
  Description of Artificial Sequence: Synthetic peptide
DEEEIRTTNPVATEQYGSVETPLQLGNR

SEQ ID NO: 7169 - protein, 28 aa, Artificial Sequence
  Description of Artificial Sequence: Synthetic peptide
YEEEIRTTNPCATEQYGSVSMNLQRGNR

SEQ ID NO: 7170 - protein, 28 aa, Artificial Sequence
  Description of Artificial Sequence: Synthetic peptide
REEEIRTTNPVATEQYGSVSENLQRGPR

SEQ ID NO: 7171 - protein, 28 aa, Artificial Sequence
  Description of Artificial Sequence: Synthetic peptide
DEEEIRTTNPVATEQYGSVSTNLEREER

SEQ ID NO: 7172 - protein, 28 aa, Artificial Sequence
  Description of Artificial Sequence: Synthetic peptide
DEEEIRTTNPVATEQYGSVSTPPQNGNR

SEQ ID NO: 7173 - protein, 28 aa, Artificial Sequence
  Description of Artificial Sequence: Synthetic peptide
DEEEIRTTNPVATEQYGSVSTNLQWGEM

SEQ ID NO: 7174 - protein, 29 aa, Artificial Sequence
  Description of Artificial Sequence: Synthetic peptide
DEEEIRTTNPVATEQYGSVSTNLQENGNT

SEQ ID NO: 7175 - protein, 29 aa, Artificial Sequence
  Description of Artificial Sequence: Synthetic peptide
DEEEIRTTNPVATEQYGSVSTDLQIRGNM

SEQ ID NO: 7176 - protein, 30 aa, Artificial Sequence
  Description of Artificial Sequence: Synthetic polypeptide
DEEEIRTTNPVATEQYGSVSTINLQRDGNL

SEQ ID NO: 7177 - protein, 29 aa, Artificial Sequence
  Description of Artificial Sequence: Synthetic peptide
DEEEIRPTNPVATEQYGSVSTDNLYRGNR

SEQ ID NO: 7178 - protein, 30 aa, Artificial Sequence
  Description of Artificial Sequence: Synthetic polypeptide
DEEEIRTTNPVATEQYGSVSTNPLQVEGNR

SEQ ID NO: 7179 - protein, 28 aa, Artificial Sequence
  Description of Artificial Sequence: Synthetic peptide
DENEIRSTNPVATECYGSVSTNLQRGNR

SEQ ID NO: 7180 - protein, 29 aa, Artificial Sequence
  Description of Artificial Sequence: Synthetic peptide
DEEEIRTTNPVATEQYGSVSTNNLQNGNV

SEQ ID NO: 7181 - protein, 30 aa, Artificial Sequence
  Description of Artificial Sequence: Synthetic polypeptide
DEEEIRTTNPVATEQYGSVSTMNLQRGNDV

SEQ ID NO: 7182 - protein, 28 aa, Artificial Sequence
  Description of Artificial Sequence: Synthetic peptide
DEEEIRTTNPVATEQYGSVSTDLQSGNS

SEQ ID NO: 7183 - protein, 28 aa, Artificial Sequence
  Description of Artificial Sequence: Synthetic peptide
DEEEIRTTNPVATEQYGNVSTNLDRGNA

SEQ ID NO: 7184 - protein, 28 aa, Artificial Sequence
  Description of Artificial Sequence: Synthetic peptide
DEEEIRATNPVATEQYGSVSTNLQRGDY

SEQ ID NO: 7185 - protein, 28 aa, Artificial Sequence
  Description of Artificial Sequence: Synthetic peptide
DEEEIRQTNPVATEMYGSVSTNLQAGNR

SEQ ID NO: 7186 - protein, 29 aa, Artificial Sequence
  Description of Artificial Sequence: Synthetic peptide
DEEEIRTVNPVATEQYGSVSTNLQDRGER

SEQ ID NO: 7187 - protein, 28 aa, Artificial Sequence
  Description of Artificial Sequence: Synthetic peptide
SEEEIRTTNPVATECYGNVSTNLQRGNR

SEQ ID NO: 7188 - protein, 28 aa, Artificial Sequence
  Description of Artificial Sequence: Synthetic peptide
DEEEIETTNPVATEQYGSMSTNLQRNNR

SEQ ID NO: 7189 - protein, 28 aa, Artificial Sequence
  Description of Artificial Sequence: Synthetic peptide
YEEEIRTTNPVATEQYGSVSTNLQAGNF

SEQ ID NO: 7190 - protein, 29 aa, Artificial Sequence
  Description of Artificial Sequence: Synthetic peptide
DEQEIRTTNPVASEQYGSVSATNLQRGNR

SEQ ID NO: 7191 - protein, 28 aa, Artificial Sequence
  Description of Artificial Sequence: Synthetic peptide
DEEEIRCTNPVATELYGSVSMNLQRGNR

SEQ ID NO: 7192 - protein, 28 aa, Artificial Sequence
  Description of Artificial Sequence: Synthetic peptide
KEEEIRTTNPVATECYGSVSTELQRGNR

SEQ ID NO: 7193 - protein, 29 aa, Artificial Sequence
  Description of Artificial Sequence: Synthetic peptide
DEEEIRATNPVATEQYGSVSTNLQFEGNR

SEQ ID NO: 7194 - protein, 29 aa, Artificial Sequence
  Description of Artificial Sequence: Synthetic peptide
DEEEIRTTNPVATEQYGDVSTMNLQRGNV

SEQ ID NO: 7195 - protein, 29 aa, Artificial Sequence
  Description of Artificial Sequence: Synthetic peptide
DEEEIRTTNPVATEQYGSVSTMNGQRQNR

SEQ ID NO: 7196 - protein, 29 aa, Artificial Sequence
  Description of Artificial Sequence: Synthetic peptide
DEEEIRTTNPVATEQYGSVSTANLQLGNI

SEQ ID NO: 7197 - protein, 28 aa, Artificial Sequence
  Description of Artificial Sequence: Synthetic peptide
DEEEIRTTNPVATECYGSVSTDLQRGNA

SEQ ID NO: 7198 - protein, 28 aa, Artificial Sequence
  Description of Artificial Sequence: Synthetic peptide
DEEEIRTTNPVATEQYGSVSTNLIPGNP

SEQ ID NO: 7199 - protein, 28 aa, Artificial Sequence
  Description of Artificial Sequence: Synthetic peptide
DEEEIRTTNPFATEQYGSVSTPLDRGNR

SEQ ID NO: 7200 - protein, 30 aa, Artificial Sequence
  Description of Artificial Sequence: Synthetic polypeptide
DEEEIRQTNPVATEQYGSVSTNLQRNGNDR

SEQ ID NO: 7201 - protein, 28 aa, Artificial Sequence
  Description of Artificial Sequence: Synthetic peptide
DEEEIRTTNPVATELYGSVSTNLQFGNA

SEQ ID NO: 7202 - protein, 28 aa, Artificial Sequence
  Description of Artificial Sequence: Synthetic peptide
MENEIRTTNPVATEQYGSVSTNLQRGNW

SEQ ID NO: 7203 - protein, 28 aa, Artificial Sequence
  Description of Artificial Sequence: Synthetic peptide
SEVEIRTTNPVATEQYGSVSTNLQRGDR

SEQ ID NO: 7204 - protein, 28 aa, Artificial Sequence
  Description of Artificial Sequence: Synthetic peptide
DEQEIRTTNPVATEQYGVVATNLQRGNR

SEQ ID NO: 7205 - protein, 28 aa, Artificial Sequence
  Description of Artificial Sequence: Synthetic peptide
DEEEIRATNPVATEQYGSVSANLQRENR

SEQ ID NO: 7206 - protein, 28 aa, Artificial Sequence
  Description of Artificial Sequence: Synthetic peptide
DEEEIRTTNPVATECYGSVSTNLQDGNY

SEQ ID NO: 7207 - protein, 30 aa, Artificial Sequence
  Description of Artificial Sequence: Synthetic polypeptide
DEEEIRTTNPVATQQYGSVSTNLQERGDNR

SEQ ID NO: 7208 - protein, 31 aa, Artificial Sequence
  Description of Artificial Sequence: Synthetic polypeptide
DEEEIRTTNPVATEQYGSVSTNLQRDGDNPR

SEQ ID NO: 7209 - protein, 28 aa, Artificial Sequence
  Description of Artificial Sequence: Synthetic peptide
DEEEIRTTNPVATEQYGSVSTCLQHGNS

SEQ ID NO: 7210 - protein, 28 aa, Artificial Sequence
  Description of Artificial Sequence: Synthetic peptide
DEEEIRTTNPVATEQYGSVSTNLQMGEA

SEQ ID NO: 7211 - protein, 28 aa, Artificial Sequence
  Description of Artificial Sequence: Synthetic peptide
DEEEIRTTNPVATEQYGSVSTNEESGNR

SEQ ID NO: 7212 - protein, 28 aa, Artificial Sequence
  Description of Artificial Sequence: Synthetic peptide
DEQEIRTTNPVASEQYGSVATNLQRGNR

SEQ ID NO: 7213 - protein, 29 aa, Artificial Sequence
  Description of Artificial Sequence: Synthetic peptide
DEEEIATVNPVATEQYGSVSTNLQRGENR

SEQ ID NO: 7214 - protein, 28 aa, Artificial Sequence
  Description of Artificial Sequence: Synthetic peptide
DEEEIRTTNPFATEQYGAVSNNLQRGNR

SEQ ID NO: 7215 - protein, 28 aa, Artificial Sequence
  Description of Artificial Sequence: Synthetic peptide
DEQEIRTTNPVASEQYGSVSMNLQRGNR

SEQ ID NO: 7216 - protein, 28 aa, Artificial Sequence
  Description of Artificial Sequence: Synthetic peptide
DEEEIRSTNPVATEQYGCVSCNLQRGNR

SEQ ID NO: 7217 - protein, 28 aa, Artificial Sequence
  Description of Artificial Sequence: Synthetic peptide
DEEEIRTTNPVATEQYGSVSTNLQPGLD

SEQ ID NO: 7218 - protein, 31 aa, Artificial Sequence
  Description of Artificial Sequence: Synthetic polypeptide
DEEEIRTTNPVATEQYGSVSTLNPLQDRGNR

SEQ ID NO: 7219 - protein, 28 aa, Artificial Sequence
  Description of Artificial Sequence: Synthetic peptide
DEEEIRTTNPTATELYGSVSTNLQRGNF

SEQ ID NO: 7220 - protein, 28 aa, Artificial Sequence
  Description of Artificial Sequence: Synthetic peptide
DEEEIRQTNPVATEQYGSVSTVLQHGNR

SEQ ID NO: 7221 - protein, 30 aa, Artificial Sequence
  Description of Artificial Sequence: Synthetic polypeptide
DEEEIRTTNPVATEQYGSVSTNEQREGNDR

SEQ ID NO: 7222 - protein, 28 aa, Artificial Sequence
  Description of Artificial Sequence: Synthetic peptide
DEEEIRTTNPVATEQYGSVDTNLQRGDV

SEQ ID NO: 7223 - protein, 28 aa, Artificial Sequence
  Description of Artificial Sequence: Synthetic peptide
DEEEIRTTNPVATEQYGSVSTDLQPGNI

SEQ ID NO: 7224 - protein, 28 aa, Artificial Sequence
  Description of Artificial Sequence: Synthetic peptide
DEEEIRTTNPVATEQYGSVSTNPQVGNI

SEQ ID NO: 7225 - protein, 28 aa, Artificial Sequence
  Description of Artificial Sequence: Synthetic peptide
DEEEIRTTNPEATEQYGSVSTNQQYGNR

SEQ ID NO: 7226 - protein, 29 aa, Artificial Sequence
  Description of Artificial Sequence: Synthetic peptide
DEEEIRTTNPVATEQYGSVSTDLQDHGNR

SEQ ID NO: 7227 - protein, 28 aa, Artificial Sequence
  Description of Artificial Sequence: Synthetic peptide
DEEEIRTTNPVATEQYGEVSTNLLRGND

SEQ ID NO: 7228 - protein, 28 aa, Artificial Sequence
  Description of Artificial Sequence: Synthetic peptide
DEEEIRTTNPVATEQYGDVSTDLQRGNL

SEQ ID NO: 7229 - protein, 29 aa, Artificial Sequence
  Description of Artificial Sequence: Synthetic peptide
DEEEIATTNPVATEQYGSVSTNLQHNGNR

SEQ ID NO: 7230 - protein, 28 aa, Artificial Sequence
  Description of Artificial Sequence: Synthetic peptide
DEEEIRTTNPVATEQYGSVSTDLQSGNE

SEQ ID NO: 7231 - protein, 28 aa, Artificial Sequence
  Description of Artificial Sequence: Synthetic peptide
DEQEIRCTNPVATEVYGSVSTNLQRGNR

SEQ ID NO: 7232 - protein, 28 aa, Artificial Sequence
  Description of Artificial Sequence: Synthetic peptide
DEEEIRTTNPTATEQYGSVSTNEQRGNE

SEQ ID NO: 7233 - protein, 29 aa, Artificial Sequence
  Description of Artificial Sequence: Synthetic peptide
DEEEIKTTNPVATEQYGSASTNLQRGNDR

SEQ ID NO: 7234 - protein, 28 aa, Artificial Sequence
  Description of Artificial Sequence: Synthetic peptide
DEEEIRTTNPVATEQYGSVSTELQDGND

SEQ ID NO: 7235 - protein, 29 aa, Artificial Sequence
  Description of Artificial Sequence: Synthetic peptide
DEEEIRTTNPVATEQYGSVSTNLQEIGNQ

SEQ ID NO: 7236 - protein, 29 aa, Artificial Sequence
  Description of Artificial Sequence: Synthetic peptide
DEEEIRTTNPVATEQYGEVSATQLQRGNR

SEQ ID NO: 7237 - protein, 31 aa, Artificial Sequence
  Description of Artificial Sequence: Synthetic polypeptide
DEEEIRTTNPVATEQYGSVSDTGNLQRGENR

SEQ ID NO: 7238 - protein, 28 aa, Artificial Sequence
  Description of Artificial Sequence: Synthetic peptide
DEQEIRTTNPVATEIYGCVSTNLQRGNR

SEQ ID NO: 7239 - protein, 28 aa, Artificial Sequence
  Description of Artificial Sequence: Synthetic peptide
DEEEIRTTNPVATEQWGSVSTLLQVGNR

SEQ ID NO: 7240 - protein, 28 aa, Artificial Sequence
  Description of Artificial Sequence: Synthetic peptide
DEEEIRCTNPVATECYGSVSTNLMRGNR

SEQ ID NO: 7241 - protein, 30 aa, Artificial Sequence
  Description of Artificial Sequence: Synthetic polypeptide
DEEEIRTTNPVATEQYGSVSTNLQEQGNDR

SEQ ID NO: 7242 - protein, 29 aa, Artificial Sequence
  Description of Artificial Sequence: Synthetic peptide
DEEEIRTTNPVATEQYGSVSTNLQELGNA

SEQ ID NO: 7243 - protein, 31 aa, Artificial Sequence
  Description of Artificial Sequence: Synthetic polypeptide
DEEEIRTTNPVATEQYGSVSTNLQIRKGNDR

SEQ ID NO: 7244 - protein, 29 aa, Artificial Sequence
  Description of Artificial Sequence: Synthetic peptide
QEEEIRTTNPVATEQYGSVSTNLQRDGER

SEQ ID NO: 7245 - protein, 29 aa, Artificial Sequence
  Description of Artificial Sequence: Synthetic peptide
DEQEIRTTNPVATEIYGSVSTNLQREGNR

SEQ ID NO: 7246 - protein, 28 aa, Artificial Sequence
  Description of Artificial Sequence: Synthetic peptide
YEEEIRTTNPVATEQYGTVSTNLQNGNR

SEQ ID NO: 7247 - protein, 30 aa, Artificial Sequence
  Description of Artificial Sequence: Synthetic polypeptide
DEEEIRTTNPVATEQYGSVSENLQCRGNDR

SEQ ID NO: 7248 - protein, 28 aa, Artificial Sequence
  Description of Artificial Sequence: Synthetic peptide
DEEEIRTTNPVATECWGSVSTNEQRGNR

SEQ ID NO: 7249 - protein, 28 aa, Artificial Sequence
  Description of Artificial Sequence: Synthetic peptide
DEEEIRTTNPVATEQYWSVSTNLQDGND

SEQ ID NO: 7250 - protein, 28 aa, Artificial Sequence
  Description of Artificial Sequence: Synthetic peptide
DEGEIRTTNPVATEQYGSVSTDLQQGNR

SEQ ID NO: 7251 - protein, 28 aa, Artificial Sequence
  Description of Artificial Sequence: Synthetic peptide
DEEEIRTTNPVATEQYGSVSTELQIGNN

SEQ ID NO: 7252 - protein, 28 aa, Artificial Sequence
  Description of Artificial Sequence: Synthetic peptide
DEEEIRTTNPVATEQYGSVSTNLQPDNI

SEQ ID NO: 7253 - protein, 28 aa, Artificial Sequence
  Description of Artificial Sequence: Synthetic peptide
DEEEIRTTNPVATEQYGFVSTILQRQNR

SEQ ID NO: 7254 - protein, 29 aa, Artificial Sequence
  Description of Artificial Sequence: Synthetic peptide
DEEEIRTTNPVATEQYGSVSENLQPMGNR

SEQ ID NO: 7255 - protein, 28 aa, Artificial Sequence
  Description of Artificial Sequence: Synthetic peptide
DEEEIRTTNPVATEQYGSVSENLEVGNR

SEQ ID NO: 7256 - protein, 28 aa, Artificial Sequence
  Description of Artificial Sequence: Synthetic peptide
DEEEIRTTNPVATEQYGSVSTGPQRGNF

SEQ ID NO: 7257 - protein, 28 aa, Artificial Sequence
  Description of Artificial Sequence: Synthetic peptide
DEEEIRTTNPVATEQYGSVSTNLQGGEW

SEQ ID NO: 7258 - protein, 30 aa, Artificial Sequence
  Description of Artificial Sequence: Synthetic polypeptide
DEEEIRTTNPVATEQYGSVSTANLQLRGNI

SEQ ID NO: 7259 - protein, 28 aa, Artificial Sequence
  Description of Artificial Sequence: Synthetic peptide
DEEEIRTTNPVATEQYWSVSTNLQRGEP

SEQ ID NO: 7260 - protein, 28 aa, Artificial Sequence
  Description of Artificial Sequence: Synthetic peptide
DEEEIRTTNPVATEQYGSVSTNLQLGDW

SEQ ID NO: 7261 - protein, 28 aa, Artificial Sequence
  Description of Artificial Sequence: Synthetic peptide
FEEEIRTTNPVATEQYGSVSTNLQQGND

SEQ ID NO: 7262 - protein, 28 aa, Artificial Sequence
  Description of Artificial Sequence: Synthetic peptide
DEEEIRTTNPCSTEQYGSVSNNLQRGNR

SEQ ID NO: 7263 - protein, 28 aa, Artificial Sequence
  Description of Artificial Sequence: Synthetic peptide
DEEEIRTTNPVATEQYGSVSENLDRGNS

SEQ ID NO: 7264 - protein, 28 aa, Artificial Sequence
  Description of Artificial Sequence: Synthetic peptide
DEEEIRTTNPVATEQYGSVSTPLEVGNR

SEQ ID NO: 7265 - protein, 28 aa, Artificial Sequence
  Description of Artificial Sequence: Synthetic peptide
DEVEIRTTNPVATEQYGSVSENPQRGNR

SEQ ID NO: 7266 - protein, 31 aa, Artificial Sequence
  Description of Artificial Sequence: Synthetic polypeptide
DEEEIRTTNPVATEQYGSVSTNPLQRDGDNR

SEQ ID NO: 7267 - protein, 29 aa, Artificial Sequence
  Description of Artificial Sequence: Synthetic peptide
DEQEIRTTNPVATEQYGSVSTVNLQRGNF

SEQ ID NO: 7268 - protein, 28 aa, Artificial Sequence
  Description of Artificial Sequence: Synthetic peptide
DEEEIRTVNPVATEQYGAVSTLLQRGNR

SEQ ID NO: 7269 - protein, 29 aa, Artificial Sequence
  Description of Artificial Sequence: Synthetic peptide
DEEEIRTTNPVATEQYGSVSTNLEREGNL

SEQ ID NO: 7270 - protein, 30 aa, Artificial Sequence
  Description of Artificial Sequence: Synthetic polypeptide
DEHEIRTTNPVATEQYGSVSCTNLQERGNR

SEQ ID NO: 7271 - protein, 28 aa, Artificial Sequence
  Description of Artificial Sequence: Synthetic peptide
DEEEIRTTNPVATEQYGSVSTNLQQGEV

SEQ ID NO: 7272 - protein, 29 aa, Artificial Sequence
  Description of Artificial Sequence: Synthetic peptide
DEEEIRTTNPVATEQYGSVSTMNLQHGNA

SEQ ID NO: 7273 - protein, 31 aa, Artificial Sequence
  Description of Artificial Sequence: Synthetic polypeptide
DEEEIRTTNPVATEQYGSVSTPNLPQRGNPR

SEQ ID NO: 7274 - protein, 28 aa, Artificial Sequence
  Description of Artificial Sequence: Synthetic peptide
DEEEIRTTNPVATEQYGSVSTNLEGGER

SEQ ID NO: 7275 - protein, 30 aa, Artificial Sequence
  Description of Artificial Sequence: Synthetic polypeptide
DEEEIRTTNPVATEQYGSVSTELQDRKGNR

SEQ ID NO: 7276 - protein, 28 aa, Artificial Sequence
  Description of Artificial Sequence: Synthetic peptide
DEEEIRTTNPVATEQYGSVSTDEQNGNR

SEQ ID NO: 7277 - protein, 29 aa, Artificial Sequence
  Description of Artificial Sequence: Synthetic peptide
DEEEIRTTNPVATEQYGSVSINALQRGNE

SEQ ID NO: 7278 - protein, 28 aa, Artificial Sequence
  Description of Artificial Sequence: Synthetic peptide
QEEEIATTNPVATEQYGSVSTNLERGNR

SEQ ID NO: 7279 - protein, 28 aa, Artificial Sequence
  Description of Artificial Sequence: Synthetic peptide
DEEEIRTTNPVATEQYGSWSTDLQRGER

SEQ ID NO: 7280 - protein, 29 aa, Artificial Sequence
  Description of Artificial Sequence: Synthetic peptide
DEEEIRTTNPVATEQYGSVSTNEQIGDNR

SEQ ID NO: 7281 - protein, 28 aa, Artificial Sequence
  Description of Artificial Sequence: Synthetic peptide
DEEEIRTTNPVATEQYGSVSTNLEDGER

SEQ ID NO: 7282 - protein, 29 aa, Artificial Sequence
  Description of Artificial Sequence: Synthetic peptide
DENEIRTTNPVATEQYGSVSTNEQNRGNR

SEQ ID NO: 7283 - protein, 30 aa, Artificial Sequence
  Description of Artificial Sequence: Synthetic polypeptide
DEEEIRTTNPVATQQYGSVSTNLQERGNDR

SEQ ID NO: 7284 - protein, 30 aa, Artificial Sequence
  Description of Artificial Sequence: Synthetic polypeptide
DEEEIRTTNPVATEQYGWVSTCNLQRGENR

SEQ ID NO: 7285 - protein, 29 aa, Artificial Sequence
  Description of Artificial Sequence: Synthetic peptide
DEEEIRTTNPVATEQYGSVSTNLQINGNL

SEQ ID NO: 7286 - protein, 28 aa, Artificial Sequence
  Description of Artificial Sequence: Synthetic peptide
DEQEINTTNPVATEQYGWVSTNLQRGNR

SEQ ID NO: 7287 - protein, 30 aa, Artificial Sequence
  Description of Artificial Sequence: Synthetic polypeptide
DEEEIRTTNPVATEQYGSVSTNLQERGNDT

SEQ ID NO: 7288 - protein, 29 aa, Artificial Sequence
  Description of Artificial Sequence: Synthetic peptide
DEEEIRTTNPVATAQYGESVSTQLQRGNR

SEQ ID NO: 7289 - protein, 29 aa, Artificial Sequence
  Description of Artificial Sequence: Synthetic peptide
DEEEIRSTNPVATEQYGSVSETNLQRGNQ

SEQ ID NO: 7290 - protein, 28 aa, Artificial Sequence
  Description of Artificial Sequence: Synthetic peptide
DEEEIRTTNPVATEQYGSVSTNQERGNS

SEQ ID NO: 7291 - protein, 28 aa, Artificial Sequence
  Description of Artificial Sequence: Synthetic peptide
DEEEIRTTNPVATEQYGSVSTPLELGNR

SEQ ID NO: 7292 - protein, 29 aa, Artificial Sequence
  Description of Artificial Sequence: Synthetic peptide
DEEEIRTTNPVATEQYGSVSTNEQQEGNR

SEQ ID NO: 7293 - protein, 28 aa, Artificial Sequence
  Description of Artificial Sequence: Synthetic peptide
DEEEIRTTNPVATEQYGSVSTDLERGER

SEQ ID NO: 7294 - protein, 28 aa, Artificial Sequence
  Description of Artificial Sequence: Synthetic peptide
DEEEIRTTNPVATEQYGSVSTELQRGDV

SEQ ID NO: 7295 - protein, 28 aa, Artificial Sequence
  Description of Artificial Sequence: Synthetic peptide
DENEIRTTNPVATEQYGSVSENLERGNR

SEQ ID NO: 7296 - protein, 30 aa, Artificial Sequence
  Description of Artificial Sequence: Synthetic polypeptide
DEEEIRTTNPVATEQYGSVSTNLQRNGNDQ

SEQ ID NO: 7297 - protein, 28 aa, Artificial Sequence
  Description of Artificial Sequence: Synthetic peptide
DEEEIRTTNPVATEIYGSVSTNLQDGNL

SEQ ID NO: 7298 - protein, 28 aa, Artificial Sequence
  Description of Artificial Sequence: Synthetic peptide
DEEEIRTTNPVATEQYGSVSDNYQRGNS

SEQ ID NO: 7299 - protein, 28 aa, Artificial Sequence
  Description of Artificial Sequence: Synthetic peptide
DEEEIRTTNPVATEQYGSVSTNEQRGDA

SEQ ID NO: 7300 - protein, 28 aa, Artificial Sequence
  Description of Artificial Sequence: Synthetic peptide
DEEEIRTTNPVATEQYGSVSTDLQVGNL

SEQ ID NO: 7301 - protein, 29 aa, Artificial Sequence
  Description of Artificial Sequence: Synthetic peptide
DEEEIRTTNPVATEQYGSVSTTDLQRGND

SEQ ID NO: 7302 - protein, 28 aa, Artificial Sequence
  Description of Artificial Sequence: Synthetic peptide
DEEEIRTTNPVATEPYFSVSTNEQRGNR

SEQ ID NO: 7303 - protein, 28 aa, Artificial Sequence
  Description of Artificial Sequence: Synthetic peptide
DEEEIRTTNPVATEQYGSVSTNEQNGNF

SEQ ID NO: 7304 - protein, 28 aa, Artificial Sequence
  Description of Artificial Sequence: Synthetic peptide
MEEEIRTTNPVATEQYGSVSTNLQNGNA

SEQ ID NO: 7305 - protein, 29 aa, Artificial Sequence
  Description of Artificial Sequence: Synthetic peptide
DEEEIRTTNPVATEQYGSVSTNLQHGNDW

SEQ ID NO: 7306 - protein, 28 aa, Artificial Sequence
  Description of Artificial Sequence: Synthetic peptide
DEEEIITTNPVATEQYGSVSTNLQREER

SEQ ID NO: 7307 - protein, 29 aa, Artificial Sequence
  Description of Artificial Sequence: Synthetic peptide
DEEEIRTTNPVATEQYGSVSTNLMMRGNW

SEQ ID NO: 7308 - protein, 28 aa, Artificial Sequence
  Description of Artificial Sequence: Synthetic peptide
DEEEIRTTNPVATEQYGSVSTNEEIGNR

SEQ ID NO: 7309 - protein, 30 aa, Artificial Sequence
  Description of Artificial Sequence: Synthetic polypeptide
DEEEIRTTNPVATEQYGSQVSTNLQRGQWR

SEQ ID NO: 7310 - protein, 28 aa, Artificial Sequence
  Description of Artificial Sequence: Synthetic peptide
DEWEIRTTNPVATEQYGSVSTNAQRLNR

SEQ ID NO: 7311 - protein, 28 aa, Artificial Sequence
  Description of Artificial Sequence: Synthetic peptide
DEEEIRTTNPVASEQYGCVSTNLERGNR

SEQ ID NO: 7312 - protein, 28 aa, Artificial Sequence
  Description of Artificial Sequence: Synthetic peptide
DEEEIRTTNPVATEQYGSVSENLQAGNV

SEQ ID NO: 7313 - protein, 29 aa, Artificial Sequence
  Description of Artificial Sequence: Synthetic peptide
DEEEIRTTNPVAYEQYGSVSITNDQRGNR

SEQ ID NO: 7314 - protein, 28 aa, Artificial Sequence
  Description of Artificial Sequence: Synthetic peptide
DEEEIRTTNPVATEQYGSVSSNLQIGNI

SEQ ID NO: 7315 - protein, 29 aa, Artificial Sequence
  Description of Artificial Sequence: Synthetic peptide
DEEEIRTVNPVATEQYGSVSTNLQSEGNR

SEQ ID NO: 7316 - protein, 28 aa, Artificial Sequence
  Description of Artificial Sequence: Synthetic peptide
DESEIRTVNPVATEQYGVVSTNLQRGNR

SEQ ID NO: 7317 - protein, 30 aa, Artificial Sequence
  Description of Artificial Sequence: Synthetic polypeptide
DEEEIRTTNPVATEQYGSVSTDLQLRGENR

SEQ ID NO: 7318 - protein, 28 aa, Artificial Sequence
  Description of Artificial Sequence: Synthetic peptide
DEEEIATTNPVATECYGSVSTNLQHGNR

SEQ ID NO: 7319 - protein, 28 aa, Artificial Sequence
  Description of Artificial Sequence: Synthetic peptide
DEEEIRTTNPVATEVYGSVSTDLQMGNR

SEQ ID NO: 7320 - protein, 28 aa, Artificial Sequence
  Description of Artificial Sequence: Synthetic peptide
DEEEIRTTNPVATEQYGGVSEDLQRGNR

SEQ ID NO: 7321 - protein, 30 aa, Artificial Sequence
  Description of Artificial Sequence: Synthetic polypeptide
DEEEIRTTNPVATEQYGSVSTDLQVRGLNR

SEQ ID NO: 7322 - protein, 28 aa, Artificial Sequence
  Description of Artificial Sequence: Synthetic peptide
DEEEIYTTNPVATEMYGSVSTNLQRGNT

SEQ ID NO: 7323 - protein, 29 aa, Artificial Sequence
  Description of Artificial Sequence: Synthetic peptide
NEEEIRTTNPVCTEQYGSVSCTNLQRGNR

SEQ ID NO: 7324 - protein, 28 aa, Artificial Sequence
  Description of Artificial Sequence: Synthetic peptide
DEEEIRTTNPVATEQYGSVSTNPQQGNL

SEQ ID NO: 7325 - protein, 28 aa, Artificial Sequence
  Description of Artificial Sequence: Synthetic peptide
DEEEIRTTNPVATEQYGSVSENLWRGNL

SEQ ID NO: 7326 - protein, 29 aa, Artificial Sequence
  Description of Artificial Sequence: Synthetic peptide
SEEEIRTTNPVATEQYGSVSTNLQCSGNR

SEQ ID NO: 7327 - protein, 28 aa, Artificial Sequence
  Description of Artificial Sequence: Synthetic peptide
DEEEIRTTNPVATEQYGSVSTDLQVGNQ

SEQ ID NO: 7328 - protein, 28 aa, Artificial Sequence
  Description of Artificial Sequence: Synthetic peptide
SEEEIRTTNPVATEQYGSVSTNPQRGTR

SEQ ID NO: 7329 - protein, 28 aa, Artificial Sequence
  Description of Artificial Sequence: Synthetic peptide
DEEEIRTTNPVATEQYGWVSTDLERGNR

SEQ ID NO: 7330 - protein, 28 aa, Artificial Sequence
  Description of Artificial Sequence: Synthetic peptide
DEEEVRCTNPVATEQYGSVSTNLERGNR

SEQ ID NO: 7331 - protein, 29 aa, Artificial Sequence
  Description of Artificial Sequence: Synthetic peptide
DEEEIRTTNPVATEQYGESVSTELERGNR

SEQ ID NO: 7332 - protein, 29 aa, Artificial Sequence
  Description of Artificial Sequence: Synthetic peptide
DEEEIRTTNPVATEQYGSVETNPLERGNR

SEQ ID NO: 7333 - protein, 28 aa, Artificial Sequence
  Description of Artificial Sequence: Synthetic peptide
DEEEIRTVNPVATEQYGSVSTNLQLGNE

SEQ ID NO: 7334 - protein, 28 aa, Artificial Sequence
  Description of Artificial Sequence: Synthetic peptide
DEEEIRTTNPVATEQYGSVSTNLQIGDC

SEQ ID NO: 7335 - protein, 29 aa, Artificial Sequence
  Description of Artificial Sequence: Synthetic peptide
DEEEIRTTNPVATEQYGSVDSTPLQFGNR

SEQ ID NO: 7336 - protein, 29 aa, Artificial Sequence
  Description of Artificial Sequence: Synthetic peptide
DEEEIRTTNPVATEQYGSVSTNLEREGER

SEQ ID NO: 7337 - protein, 28 aa, Artificial Sequence
  Description of Artificial Sequence: Synthetic peptide
DEEEIRTTNPFATEQYGSVSTNLQRGEW

SEQ ID NO: 7338 - protein, 30 aa, Artificial Sequence
  Description of Artificial Sequence: Synthetic polypeptide
DEEEIRTTNPVATEQYGHSVSTNPLQRGAR

SEQ ID NO: 7339 - protein, 29 aa, Artificial Sequence
  Description of Artificial Sequence: Synthetic peptide
DEEEIRTTNPVATEQYGSVSTNLQRGDDT

SEQ ID NO: 7340 - protein, 30 aa, Artificial Sequence
  Description of Artificial Sequence: Synthetic polypeptide
DEEEIRTTNPDATEQYGSVSTPNLQRGTNR

SEQ ID NO: 7341 - protein, 28 aa, Artificial Sequence
  Description of Artificial Sequence: Synthetic peptide
DEEEIRTTNPVATEQYGEVSTNLQGGDR

SEQ ID NO: 7342 - protein, 28 aa, Artificial Sequence
  Description of Artificial Sequence: Synthetic peptide
DEEEIRTTNPVATEQYGSVGTADQRGNR

SEQ ID NO: 7343 - protein, 28 aa, Artificial Sequence
  Description of Artificial Sequence: Synthetic peptide
QEEEIRTTNPVATEQYGSVSTNLQPGNL

SEQ ID NO: 7344 - protein, 29 aa, Artificial Sequence
  Description of Artificial Sequence: Synthetic peptide
DEEEITTTNPVATEQYGSVDTNLQRGENR

SEQ ID NO: 7345 - protein, 28 aa, Artificial Sequence
  Description of Artificial Sequence: Synthetic peptide
DEEEIRTTNPVATEQYGSVSTNEQHGNE

SEQ ID NO: 7346 - protein, 29 aa, Artificial Sequence
  Description of Artificial Sequence: Synthetic peptide
DEEEIRTTNPVATEQYGSVDTANLDRGNR

SEQ ID NO: 7347 - protein, 30 aa, Artificial Sequence
  Description of Artificial Sequence: Synthetic polypeptide
DEEEIRTTNPVATEQYGSYVSTNLPDRGNR

SEQ ID NO: 7348 - protein, 29 aa, Artificial Sequence
  Description of Artificial Sequence: Synthetic peptide
DEEEIRTTNPVATEQYGSVSTNLQIAGER

SEQ ID NO: 7349 - protein, 28 aa, Artificial Sequence
  Description of Artificial Sequence: Synthetic peptide
DEEEIATTNPVATEQYGSVSTNEQQGNR

SEQ ID NO: 7350 - protein, 29 aa, Artificial Sequence
  Description of Artificial Sequence: Synthetic peptide
DEEEIRTTNPVATEQYGSVSENLQCRGNS

SEQ ID NO: 7351 - protein, 28 aa, Artificial Sequence
  Description of Artificial Sequence: Synthetic peptide
DEEEIRTTNPVATEQYGSVSTNLEQGNI

SEQ ID NO: 7352 - protein, 28 aa, Artificial Sequence
  Description of Artificial Sequence: Synthetic peptide
DEEELRTTNPVATELYGSVSTNLQRGNL

SEQ ID NO: 7353 - protein, 29 aa, Artificial Sequence
  Description of Artificial Sequence: Synthetic peptide
DEEEIRTTNPVATEQYGSVSTNEQFRGNI

SEQ ID NO: 7354 - protein, 28 aa, Artificial Sequence
  Description of Artificial Sequence: Synthetic peptide
DLEEITTTNPVATEQYGSVSTNLQQGNR

SEQ ID NO: 7355 - protein, 29 aa, Artificial Sequence
  Description of Artificial Sequence: Synthetic peptide
DEEEIRTTNPVATEQYGGVSTNLQQEGNR

SEQ ID NO: 7356 - protein, 28 aa, Artificial Sequence
  Description of Artificial Sequence: Synthetic peptide
DEEEIRTTNPVATEQYGSVETELQRGDR

SEQ ID NO: 7357 - protein, 28 aa, Artificial Sequence
  Description of Artificial Sequence: Synthetic peptide
DEEEIRTTNPVATEQYGAVSANLQPGNR

SEQ ID NO: 7358 - protein, 30 aa, Artificial Sequence
  Description of Artificial Sequence: Synthetic polypeptide
DEEEIRTTNPVATEQYGSVSTNGLPQRGNY

SEQ ID NO: 7359 - protein, 31 aa, Artificial Sequence
  Description of Artificial Sequence: Synthetic polypeptide
DEEEIRTTNPVATEQYGSYVSTPNPLQRGNR

SEQ ID NO: 7360 - protein, 29 aa, Artificial Sequence
  Description of Artificial Sequence: Synthetic peptide
DEEEIRTTNPVATEQYGFVSTPNDQRGNR

SEQ ID NO: 7361 - protein, 29 aa, Artificial Sequence
  Description of Artificial Sequence: Synthetic peptide
CEEEIRTTNPVATEQYGSVSTELQDRGNR

SEQ ID NO: 7362 - protein, 29 aa, Artificial Sequence
  Description of Artificial Sequence: Synthetic peptide
DEEEIVTTNPVATEQYGSVNVTNLQRGNR

SEQ ID NO: 7363 - protein, 29 aa, Artificial Sequence
  Description of Artificial Sequence: Synthetic peptide
DEEEIRATNPVATEQYGSVSTNLQREGNL

SEQ ID NO: 7364 - protein, 29 aa, Artificial Sequence
  Description of Artificial Sequence: Synthetic peptide
DEEEIATTNPVATEQYGSVSATNLQHGNR

SEQ ID NO: 7365 - protein, 28 aa, Artificial Sequence
  Description of Artificial Sequence: Synthetic peptide
DEEEIRTTNPVATEQYGSVSTNLQQGDM

SEQ ID NO: 7366 - protein, 29 aa, Artificial Sequence
  Description of Artificial Sequence: Synthetic peptide
DEEEIRTTNPVATEQYGSVSTNLQMTGNF

SEQ ID NO: 7367 - protein, 30 aa, Artificial Sequence
  Description of Artificial Sequence: Synthetic polypeptide
DEEEIRTTNPVATEQYGSVSTNGLDRGDNR

SEQ ID NO: 7368 - protein, 28 aa, Artificial Sequence
  Description of Artificial Sequence: Synthetic peptide
VEEEIRTTNPVATETYGSVGTNLQRGNR

SEQ ID NO: 7369 - protein, 28 aa, Artificial Sequence
  Description of Artificial Sequence: Synthetic peptide
DEEEIRTTNPVATEQYGSVSCNLQAGNQ

SEQ ID NO: 7370 - protein, 28 aa, Artificial Sequence
  Description of Artificial Sequence: Synthetic peptide
DEEEIRTTNPVATEQYGSVSTNEMGGNR

SEQ ID NO: 7371 - protein, 28 aa, Artificial Sequence
  Description of Artificial Sequence: Synthetic peptide
DEEEIRTTNPVATEQYGSASTNLQREER

SEQ ID NO: 7372 - protein, 29 aa, Artificial Sequence
  Description of Artificial Sequence: Synthetic peptide
YEEEIVTTNPVATEQYGSVSTNLQSRGNR

SEQ ID NO: 7373 - protein, 31 aa, Artificial Sequence
  Description of Artificial Sequence: Synthetic polypeptide
DEEEIRTTNPVATEQYGMSVSTNALQRGNFR

SEQ ID NO: 7374 - protein, 29 aa, Artificial Sequence
  Description of Artificial Sequence: Synthetic peptide
DEEEIRTTNPVATEQYGSVSTNLQRGEQE

SEQ ID NO: 7375 - protein, 30 aa, Artificial Sequence
  Description of Artificial Sequence: Synthetic polypeptide
DEEEIRTTNPVATEQYGSVSTANLQDIGNR

SEQ ID NO: 7376 - protein, 28 aa, Artificial Sequence
  Description of Artificial Sequence: Synthetic peptide
DEEEIKTTNPVATEQYGSVSTNYERGNR

SEQ ID NO: 7377 - protein, 29 aa, Artificial Sequence
  Description of Artificial Sequence: Synthetic peptide
DEEEIRTTNPVATEQYGSVSTMNWQRGTR

SEQ ID NO: 7378 - protein, 29 aa, Artificial Sequence
  Description of Artificial Sequence: Synthetic peptide
DEEEIRTTNPVATEQYGSVSTNLEVGENR

SEQ ID NO: 7379 - protein, 28 aa, Artificial Sequence
  Description of Artificial Sequence: Synthetic peptide
DEEEIRTTNPVATEQYGSVSTDLQTGNW

SEQ ID NO: 7380 - protein, 29 aa, Artificial Sequence
  Description of Artificial Sequence: Synthetic peptide
DEEEIRTTNPVATLQYGSVSTNDQRGDNR

SEQ ID NO: 7381 - protein, 28 aa, Artificial Sequence
  Description of Artificial Sequence: Synthetic peptide
DEVEIRTTNPVATEVYGSVSTALQRGNR

SEQ ID NO: 7382 - protein, 28 aa, Artificial Sequence
  Description of Artificial Sequence: Synthetic peptide
DEEEIRTTNPVATEQYGSVSTIEQRENR

SEQ ID NO: 7383 - protein, 28 aa, Artificial Sequence
  Description of Artificial Sequence: Synthetic peptide
DEEEVRTTNPVATEQYGAVSMNLQRGNR

SEQ ID NO: 7384 - protein, 28 aa, Artificial Sequence
  Description of Artificial Sequence: Synthetic peptide
DEEEIRTTNPVATEQYGSVSTDLERGNW

SEQ ID NO: 7385 - protein, 28 aa, Artificial Sequence
  Description of Artificial Sequence: Synthetic peptide
MEEEIRTTNPVATEQYGSVSTNLQVGNY

SEQ ID NO: 7386 - protein, 29 aa, Artificial Sequence
  Description of Artificial Sequence: Synthetic peptide
DEEEIVCTNPVATEQYGSVSATNLQRGNR

SEQ ID NO: 7387 - protein, 30 aa, Artificial Sequence
  Description of Artificial Sequence: Synthetic polypeptide
DEEEIRTTNPVATEQYGSVISTNLQRGDNF

SEQ ID NO: 7388 - protein, 28 aa, Artificial Sequence
  Description of Artificial Sequence: Synthetic peptide
DENEIRTTNPVATEQYGSYSTNLQRENR

SEQ ID NO: 7389 - protein, 28 aa, Artificial Sequence
  Description of Artificial Sequence: Synthetic peptide
DEEEIRTTNPVATEQYGSVSTNLEIGER

SEQ ID NO: 7390 - protein, 28 aa, Artificial Sequence
  Description of Artificial Sequence: Synthetic peptide
AENEIRTTNPVATEQYGDVSTNLQRGNR

SEQ ID NO: 7391 - protein, 28 aa, Artificial Sequence
  Description of Artificial Sequence: Synthetic peptide
DEEEIRTTNPVATEQYGDVDTNLQRGNL

SEQ ID NO: 7392 - protein, 28 aa, Artificial Sequence
  Description of Artificial Sequence: Synthetic peptide
DEEEIRTTNPVATEQYGSVDTNLQSGND

SEQ ID NO: 7393 - protein, 28 aa, Artificial Sequence
  Description of Artificial Sequence: Synthetic peptide
DEEEIRTTNPVATEQYGSVSTNGQRGLP

SEQ ID NO: 7394 - protein, 28 aa, Artificial Sequence
  Description of Artificial Sequence: Synthetic peptide
DEVEIRTTNPVATEQYGSVSTALQRGNF

SEQ ID NO: 7395 - protein, 29 aa, Artificial Sequence
  Description of Artificial Sequence: Synthetic peptide
DEEEIRTTNPVATETYGSVISTNLQSGNR

SEQ ID NO: 7396 - protein, 28 aa, Artificial Sequence
  Description of Artificial Sequence: Synthetic peptide
DEEEITQTNPVATEQYGSVSTNLQHGNR

SEQ ID NO: 7397 - protein, 28 aa, Artificial Sequence
  Description of Artificial Sequence: Synthetic peptide
DEEEIRTTNPFSTEQYGSVSTNLQRNNR

SEQ ID NO: 7398 - protein, 28 aa, Artificial Sequence
  Description of Artificial Sequence: Synthetic peptide
DEEEIRTTNPVATEQYGSVSSNLCRGNA

SEQ ID NO: 7399 - protein, 31 aa, Artificial Sequence
  Description of Artificial Sequence: Synthetic polypeptide
DEEEIRTTNPVATEQYGSVSDTNLQIREGNR

SEQ ID NO: 7400 - protein, 28 aa, Artificial Sequence
  Description of Artificial Sequence: Synthetic peptide
DECEIRTTNPVATETYGSVSTNDQRGNR

SEQ ID NO: 7401 - protein, 29 aa, Artificial Sequence
  Description of Artificial Sequence: Synthetic peptide
DEEEIRTTNPVATEQYGSVSTPALQSGNR

SEQ ID NO: 7402 - protein, 29 aa, Artificial Sequence
  Description of Artificial Sequence: Synthetic peptide
DEEEIRTTNPVATEQYGVVSTNLQHKGNR

SEQ ID NO: 7403 - protein, 28 aa, Artificial Sequence
  Description of Artificial Sequence: Synthetic peptide
DETEIRTTNPVATEQYGSVATTLQRGNR

SEQ ID NO: 7404 - protein, 28 aa, Artificial Sequence
  Description of Artificial Sequence: Synthetic peptide
DEEEIMTTNPVATESYGSVSTNLQRGNE

SEQ ID NO: 7405 - protein, 28 aa, Artificial Sequence
  Description of Artificial Sequence: Synthetic peptide
DEEEIRTTNPVATEQYGSVSTNCQPGNT

SEQ ID NO: 7406 - protein, 29 aa, Artificial Sequence
  Description of Artificial Sequence: Synthetic peptide
DENEIRTTNPVATEQYGDVSTNLQMRGNR

SEQ ID NO: 7407 - protein, 30 aa, Artificial Sequence
  Description of Artificial Sequence: Synthetic polypeptide
DEEEIRTTNPDATEQYGSVSTLNGLQRGNR

SEQ ID NO: 7408 - protein, 28 aa, Artificial Sequence
  Description of Artificial Sequence: Synthetic peptide
DEEEIRTTNPVATECYGSVSTNLQTGNI

SEQ ID NO: 7409 - protein, 28 aa, Artificial Sequence
  Description of Artificial Sequence: Synthetic peptide
DEQEIRTTNPVATEQYGSVSDNLQRLNR

SEQ ID NO: 7410 - protein, 28 aa, Artificial Sequence
  Description of Artificial Sequence: Synthetic peptide
DEEEVRTTNPVATEQYGCVSANLQRGNR

SEQ ID NO: 7411 - protein, 28 aa, Artificial Sequence
  Description of Artificial Sequence: Synthetic peptide
DENEITTTNPVATEQYGSVSTNLERGNR

SEQ ID NO: 7412 - protein, 29 aa, Artificial Sequence
  Description of Artificial Sequence: Synthetic peptide
DEEEIRTTNPVATEQYGSVSTTNLQRGEF

SEQ ID NO: 7413 - protein, 29 aa, Artificial Sequence
  Description of Artificial Sequence: Synthetic peptide
DEEEIRTTNPVATEQYGSVSTDLQNNGNR

SEQ ID NO: 7414 - protein, 28 aa, Artificial Sequence
  Description of Artificial Sequence: Synthetic peptide
DEEEIRTTNPVATEQYGSVSTELQDGNF

SEQ ID NO: 7415 - protein, 28 aa, Artificial Sequence
  Description of Artificial Sequence: Synthetic peptide
DEEEIRTTNPVATEPYGSVFTNLQRGDR

SEQ ID NO: 7416 - protein, 28 aa, Artificial Sequence
  Description of Artificial Sequence: Synthetic peptide
DEQEIRTTNPVATEQYGSVDTNLQRGNP

SEQ ID NO: 7417 - protein, 28 aa, Artificial Sequence
  Description of Artificial Sequence: Synthetic peptide
DEEEIRTTNPVATEQYGSVSTEKYRGNR

SEQ ID NO: 7418 - protein, 30 aa, Artificial Sequence
  Description of Artificial Sequence: Synthetic polypeptide
DEEEIRTTNPVATEQYGSVSTNLGIVRGNR

SEQ ID NO: 7419 - protein, 30 aa, Artificial Sequence
  Description of Artificial Sequence: Synthetic polypeptide
DEEEIRTTNPVATEQYGSVSTNLEDREGNR

SEQ ID NO: 7420 - protein, 30 aa, Artificial Sequence
  Description of Artificial Sequence: Synthetic polypeptide
DEEEIRTTNPFATEQYGSVSTNLVQRGENR

SEQ ID NO: 7421 - protein, 28 aa, Artificial Sequence
  Description of Artificial Sequence: Synthetic peptide
DEEEIRTTNPDATEQYGSVSENDQRGNR

SEQ ID NO: 7422 - protein, 28 aa, Artificial Sequence
  Description of Artificial Sequence: Synthetic peptide
DEEEIRTTNPVATEQYGSVSTNLQFGED

SEQ ID NO: 7423 - protein, 28 aa, Artificial Sequence
  Description of Artificial Sequence: Synthetic peptide
DEEEIRTTNPVATETYGSVSTDLQRGNA

SEQ ID NO: 7424 - protein, 30 aa, Artificial Sequence
  Description of Artificial Sequence: Synthetic polypeptide
DEEEIRTTNPVATEQYGMSVSTNGLQRGND

SEQ ID NO: 7425 - protein, 28 aa, Artificial Sequence
  Description of Artificial Sequence: Synthetic peptide
DEEEIRTTNPEATEQYGSVSTPDQRGNR

SEQ ID NO: 7426 - protein, 29 aa, Artificial Sequence
  Description of Artificial Sequence: Synthetic peptide
DEEEIRTTNPVATELYGSVSTNGLQSGNR

SEQ ID NO: 7427 - protein, 28 aa, Artificial Sequence
  Description of Artificial Sequence: Synthetic peptide
DEEEIRTTNPVATQQYGSVSTNDQDGNR

SEQ ID NO: 7428 - protein, 29 aa, Artificial Sequence
  Description of Artificial Sequence: Synthetic peptide
DEEEIRTTNPVATECYGSVSTELQRGENR

SEQ ID NO: 7429 - protein, 28 aa, Artificial Sequence
  Description of Artificial Sequence: Synthetic peptide
DEEEIATTNPVATEQYGSVSTNLQDGER

SEQ ID NO: 7430 - protein, 28 aa, Artificial Sequence
  Description of Artificial Sequence: Synthetic peptide
DEEEIRTTNPVATEQYGSVETNLERGER

SEQ ID NO: 7431 - protein, 28 aa, Artificial Sequence
  Description of Artificial Sequence: Synthetic peptide
GEEEIRTTNPVATEQYGSVSNNLERGNR

SEQ ID NO: 7432 - protein, 28 aa, Artificial Sequence
  Description of Artificial Sequence: Synthetic peptide
DEEEIRTTNPVATEQYGSVETPLQVGNR

SEQ ID NO: 7433 - protein, 28 aa, Artificial Sequence
  Description of Artificial Sequence: Synthetic peptide
DEEEIRTTNPVATEQYGSVSTNLEDGNL

SEQ ID NO: 7434 - protein, 28 aa, Artificial Sequence
  Description of Artificial Sequence: Synthetic peptide
DEEEIRTTNPVATEQYGEVSTMLQLGNR

SEQ ID NO: 7435 - protein, 28 aa, Artificial Sequence
  Description of Artificial Sequence: Synthetic peptide
DEEEIRTTNPVATEQYGSWSTNEDRGNR

SEQ ID NO: 7436 - protein, 28 aa, Artificial Sequence
  Description of Artificial Sequence: Synthetic peptide
DEEEIRTTNPFATEQYGSVSTNLELGNR

SEQ ID NO: 7437 - protein, 28 aa, Artificial Sequence
  Description of Artificial Sequence: Synthetic peptide
REEEIRTTNPVATEQYGSVGTNLQQGNR

SEQ ID NO: 7438 - protein, 28 aa, Artificial Sequence
  Description of Artificial Sequence: Synthetic peptide
DEEEIRTTNPVATEQYGSVSTNLQVGEP

SEQ ID NO: 7439 - protein, 28 aa, Artificial Sequence
  Description of Artificial Sequence: Synthetic peptide
GEQEIRTTNPVATEQYGSVSTNLQRGER

SEQ ID NO: 7440 - protein, 28 aa, Artificial Sequence
  Description of Artificial Sequence: Synthetic peptide
DEEEIRTTNPVATEQYGSVETNLDRGER

SEQ ID NO: 7441 - protein, 30 aa, Artificial Sequence
  Description of Artificial Sequence: Synthetic polypeptide
DEEEIRTTNPVATEQYGSVSTAGLQRGVNR

SEQ ID NO: 7442 - protein, 28 aa, Artificial Sequence
  Description of Artificial Sequence: Synthetic peptide
DSEEIRTTNPVATEQYGSVCTNLQPGNR

SEQ ID NO: 7443 - protein, 29 aa, Artificial Sequence
  Description of Artificial Sequence: Synthetic peptide
DPEEIRTTNPVATEQYGSVSTNLQRGDNW

SEQ ID NO: 7444 - protein, 28 aa, Artificial Sequence
  Description of Artificial Sequence: Synthetic peptide
DEEEIRTTNPVATEQYGSVSTNLQAGEA

SEQ ID NO: 7445 - protein, 29 aa, Artificial Sequence
  Description of Artificial Sequence: Synthetic peptide
DEEEIRTTNPVATEQYGSVSTDLQRGEER

SEQ ID NO: 7446 - protein, 29 aa, Artificial Sequence
  Description of Artificial Sequence: Synthetic peptide
DEEEIRTTNPVATEQYGSVETPLIQRGNR

SEQ ID NO: 7447 - protein, 30 aa, Artificial Sequence
  Description of Artificial Sequence: Synthetic polypeptide
DEEEITTTNPVATEQYGSVSTNLPQERGNR

SEQ ID NO: 7448 - protein, 28 aa, Artificial Sequence
  Description of Artificial Sequence: Synthetic peptide
DEEEIRTTNPVATEQYGSVSTCDERGNR

SEQ ID NO: 7449 - protein, 30 aa, Artificial Sequence
  Description of Artificial Sequence: Synthetic polypeptide
DEEEIRTTNPVATEQYGSVSTMNLQAGFNR

SEQ ID NO: 7450 - protein, 28 aa, Artificial Sequence
  Description of Artificial Sequence: Synthetic peptide
DENEIRTTNPVATEQYGVVATNLQRGNR

SEQ ID NO: 7451 - protein, 28 aa, Artificial Sequence
  Description of Artificial Sequence: Synthetic peptide
DEEEIRTTNPVATEQYGWVSTNLERGNA

SEQ ID NO: 7452 - protein, 28 aa, Artificial Sequence
  Description of Artificial Sequence: Synthetic peptide
DEEEIRTTNPVATEQYGSVETNLQRGEF

SEQ ID NO: 7453 - protein, 29 aa, Artificial Sequence
  Description of Artificial Sequence: Synthetic peptide
DEQEIRTTNPVATEQYGSASATNLQRGNR

SEQ ID NO: 7454 - protein, 31 aa, Artificial Sequence
  Description of Artificial Sequence: Synthetic polypeptide
DEEEIRTTNPVATEQYGSVESETNLQERGNR

SEQ ID NO: 7455 - protein, 31 aa, Artificial Sequence
  Description of Artificial Sequence: Synthetic polypeptide
DEEEIRTTNPVATEQYGSVISTNGLQRGINR

SEQ ID NO: 7456 - protein, 28 aa, Artificial Sequence
  Description of Artificial Sequence: Synthetic peptide
DEEEIRTTNPVCTESYGSVSTNLQRGNC

SEQ ID NO: 7457 - protein, 29 aa, Artificial Sequence
  Description of Artificial Sequence: Synthetic peptide
DEEEIRTTNPVATEQYGESVETNLQRGER

SEQ ID NO: 7458 - protein, 29 aa, Artificial Sequence
  Description of Artificial Sequence: Synthetic peptide
DEECIRTTNPVANEQYGSVSTMNLQRGNR

SEQ ID NO: 7459 - protein, 30 aa, Artificial Sequence
  Description of Artificial Sequence: Synthetic polypeptide
DEEEIRTTNPVATEQYGVVSTNLPQRGLNR

SEQ ID NO: 7460 - protein, 28 aa, Artificial Sequence
  Description of Artificial Sequence: Synthetic peptide
DEEEIRTTNPVATLQFGSVSTNLQRGER

SEQ ID NO: 7461 - protein, 28 aa, Artificial Sequence
  Description of Artificial Sequence: Synthetic peptide
DEEEIRTTNPVATEQYGSVSTDLQDGER

SEQ ID NO: 7462 - protein, 29 aa, Artificial Sequence
  Description of Artificial Sequence: Synthetic peptide
DEEEIRTTNPVATEQYGRVSTNELQYGNR

SEQ ID NO: 7463 - protein, 28 aa, Artificial Sequence
  Description of Artificial Sequence: Synthetic peptide
DEEEIRTTNPVATEQYGSVSTGLNPGNR

SEQ ID NO: 7464 - protein, 29 aa, Artificial Sequence
  Description of Artificial Sequence: Synthetic peptide
DEEEIRTTNPVATEQYGSVSTINLQRGEY

SEQ ID NO: 7465 - protein, 28 aa, Artificial Sequence
  Description of Artificial Sequence: Synthetic peptide
DEEEIGTTNPVATEQYGSMSTNLQHGNR

SEQ ID NO: 7466 - protein, 28 aa, Artificial Sequence
  Description of Artificial Sequence: Synthetic peptide
DEEEIRTTNPDATEQYGSVSENLQRGER

SEQ ID NO: 7467 - protein, 30 aa, Artificial Sequence
  Description of Artificial Sequence: Synthetic polypeptide
DEEEIRTTNPVATEQYGSVSTNLQDRGNDW

SEQ ID NO: 7468 - protein, 29 aa, Artificial Sequence
  Description of Artificial Sequence: Synthetic peptide
DLEEIRTTNPVATEQYGSVSTNLPQRGNG

SEQ ID NO: 7469 - protein, 28 aa, Artificial Sequence
  Description of Artificial Sequence: Synthetic peptide
DEEEIRTTNPEATEQYGSVSTNEDRGNR

SEQ ID NO: 7470 - protein, 29 aa, Artificial Sequence
  Description of Artificial Sequence: Synthetic peptide
DEEEIRTTNPVATEQYGSVSCTNLQYGNQ

SEQ ID NO: 7471 - protein, 28 aa, Artificial Sequence
  Description of Artificial Sequence: Synthetic peptide
DEEEIRTTNPVATEQYGSVSTDLIRGER

SEQ ID NO: 7472 - protein, 29 aa, Artificial Sequence
  Description of Artificial Sequence: Synthetic peptide
DEEEIRTTNPVATEQYGSVSTNLIQFGER

SEQ ID NO: 7473 - protein, 28 aa, Artificial Sequence
  Description of Artificial Sequence: Synthetic peptide
DEQEIRTTNPVATEQYGSVSYNLQRGNF

SEQ ID NO: 7474 - protein, 28 aa, Artificial Sequence
  Description of Artificial Sequence: Synthetic peptide
DEEEIRTTNPVATEQYGSVSTNLQEGEE

SEQ ID NO: 7475 - protein, 28 aa, Artificial Sequence
  Description of Artificial Sequence: Synthetic peptide
DEEEIRTTNPVATEQYGSVSTNLQQGED

SEQ ID NO: 7476 - protein, 28 aa, Artificial Sequence
  Description of Artificial Sequence: Synthetic peptide
DEEEIRTTNPDATEQYGSVSTNLQREER

SEQ ID NO: 7477 - protein, 29 aa, Artificial Sequence
  Description of Artificial Sequence: Synthetic peptide
DEEEIRTTNPVATEQYGDVSTNQQRGENR

SEQ ID NO: 7478 - protein, 28 aa, Artificial Sequence
  Description of Artificial Sequence: Synthetic peptide
DEEEIRQTNPVATEQYGSVSENLQRFNR

SEQ ID NO: 7479 - protein, 28 aa, Artificial Sequence
  Description of Artificial Sequence: Synthetic peptide
DEEEIRTTNPVATEQYGSVSTNEMRGNW

SEQ ID NO: 7480 - protein, 28 aa, Artificial Sequence
  Description of Artificial Sequence: Synthetic peptide
DENEIRSTNPVATEQYGSCSTNLQRGNR

SEQ ID NO: 7481 - protein, 29 aa, Artificial Sequence
  Description of Artificial Sequence: Synthetic peptide
DEEEIRTTNPVATEQYGSVSTNLERGNDM

SEQ ID NO: 7482 - protein, 28 aa, Artificial Sequence
  Description of Artificial Sequence: Synthetic peptide
DSEEIRTTNPVATNQYGSVSTELQRGNR

SEQ ID NO: 7483 - protein, 28 aa, Artificial Sequence
  Description of Artificial Sequence: Synthetic peptide
DEEEIRTTNPEATEQYGSVSTNLQREER

SEQ ID NO: 7484 - protein, 28 aa, Artificial Sequence
  Description of Artificial Sequence: Synthetic peptide
DEGEIYTTNPVATEQYGCVSTNLQRGNR

SEQ ID NO: 7485 - protein, 28 aa, Artificial Sequence
  Description of Artificial Sequence: Synthetic peptide
DEEEIRTTNPVATEIYGSVWTNLQPGNR

SEQ ID NO: 7486 - protein, 28 aa, Artificial Sequence
  Description of Artificial Sequence: Synthetic peptide
DEEEIRTTNPVATEQYGSVSTNEQQGDR

SEQ ID NO: 7487 - protein, 29 aa, Artificial Sequence
  Description of Artificial Sequence: Synthetic peptide
DEEEIRTTNPVATEQYGSVSTNLQEHGNI

SEQ ID NO: 7488 - protein, 28 aa, Artificial Sequence
  Description of Artificial Sequence: Synthetic peptide
DEEEIRTTNPVATEQYGSVSTNLDRGEH

SEQ ID NO: 7489 - protein, 28 aa, Artificial Sequence
  Description of Artificial Sequence: Synthetic peptide
DEEEIRTTNPVSTEIYGSVSTNLQRGNC

SEQ ID NO: 7490 - protein, 28 aa, Artificial Sequence
  Description of Artificial Sequence: Synthetic peptide
DEEEIRTTNPVATEQYGSVSGNDQRGND

SEQ ID NO: 7491 - protein, 28 aa, Artificial Sequence
  Description of Artificial Sequence: Synthetic peptide
QEEEIRTTNPVATEQYGSVSTNLQNGER

SEQ ID NO: 7492 - protein, 29 aa, Artificial Sequence
  Description of Artificial Sequence: Synthetic peptide
DEEEIRTTNPVATEQYGSVSTNLQNGDNV

SEQ ID NO: 7493 - protein, 29 aa, Artificial Sequence
  Description of Artificial Sequence: Synthetic peptide
DEDEIRTTNPVATEQYGSVSTNLQIGNDR

SEQ ID NO: 7494 - protein, 28 aa, Artificial Sequence
  Description of Artificial Sequence: Synthetic peptide
DEEEIRTTNPLATEQYGSVSTSLDRGNR

SEQ ID NO: 7495 - protein, 28 aa, Artificial Sequence
  Description of Artificial Sequence: Synthetic peptide
DEEEIRTTNPVATEQYGSVSTDLERGNG

SEQ ID NO: 7496 - protein, 29 aa, Artificial Sequence
  Description of Artificial Sequence: Synthetic peptide
DEQEIRTTNPVSTEQYGSVSATNLQRGNR

SEQ ID NO: 7497 - protein, 29 aa, Artificial Sequence
  Description of Artificial Sequence: Synthetic peptide
DEEGIRTTNPVATEQYGSVSEMNLQRGNR

SEQ ID NO: 7498 - protein, 30 aa, Artificial Sequence
  Description of Artificial Sequence: Synthetic polypeptide
DEEEIRTTNPVATEQYGSVSETNLQENGNR

SEQ ID NO: 7499 - protein, 29 aa, Artificial Sequence
  Description of Artificial Sequence: Synthetic peptide
DEEEIRTTNPVATEQYGDVSCTNLQRGER

SEQ ID NO: 7500 - protein, 28 aa, Artificial Sequence
  Description of Artificial Sequence: Synthetic peptide
DEEEIRTTNPVATQQYGSVSTPLQPGNR

SEQ ID NO: 7501 - protein, 29 aa, Artificial Sequence
  Description of Artificial Sequence: Synthetic peptide
DEEEIRTTNPVACEQYGSVSTPNDQRGNR

SEQ ID NO: 7502 - protein, 28 aa, Artificial Sequence
  Description of Artificial Sequence: Synthetic peptide
QEEEIRPTNPVATDQYGSVSTNLQRGNR

SEQ ID NO: 7503 - protein, 30 aa, Artificial Sequence
  Description of Artificial Sequence: Synthetic polypeptide
DEEEIRTTNPVATEQYGSVSTDPLQRGDNR

SEQ ID NO: 7504 - protein, 28 aa, Artificial Sequence
  Description of Artificial Sequence: Synthetic peptide
DEEEIATTNPVATEQYGSVSTDLERGNR

SEQ ID NO: 7505 - protein, 28 aa, Artificial Sequence
  Description of Artificial Sequence: Synthetic peptide
DEEEIRTTNPTATEQYGSVSTNEQRGNS

SEQ ID NO: 7506 - protein, 29 aa, Artificial Sequence
  Description of Artificial Sequence: Synthetic peptide
DEEEIRTTNPVATEQYGDVSTNLQRSYNR

SEQ ID NO: 7507 - protein, 28 aa, Artificial Sequence
  Description of Artificial Sequence: Synthetic peptide
DEEEIRTTNPVATEQYGGVSTNLQPLNR

SEQ ID NO: 7508 - protein, 28 aa, Artificial Sequence
  Description of Artificial Sequence: Synthetic peptide
DEEEIRATNPVATEQYGSVSTELQRGNA

SEQ ID NO: 7509 - protein, 30 aa, Artificial Sequence
  Description of Artificial Sequence: Synthetic polypeptide
DEEEIRTTNPVCTEQYGSVSCTNLQRGNDR

SEQ ID NO: 7510 - protein, 28 aa, Artificial Sequence
  Description of Artificial Sequence: Synthetic peptide
SEEEIRPTNPVCTEQYGSVSTNLQRGNR

SEQ ID NO: 7511 - protein, 30 aa, Artificial Sequence
  Description of Artificial Sequence: Synthetic polypeptide
DEEEIRTTNPVATEQYGSVDCTNLQRGENR

SEQ ID NO: 7512 - protein, 30 aa, Artificial Sequence
  Description of Artificial Sequence: Synthetic polypeptide
DEEEIRTTNPTATEQYGSVSTMNLQRGNDR

SEQ ID NO: 7513 - protein, 31 aa, Artificial Sequence
  Description of Artificial Sequence: Synthetic polypeptide
DEEEIRTTNPVATEQYGSVSTINPLQIRGNR

SEQ ID NO: 7514 - protein, 28 aa, Artificial Sequence
  Description of Artificial Sequence: Synthetic peptide
DEEEIRTTNPVATEQYGSVDTNDERGNR

SEQ ID NO: 7515 - protein, 28 aa, Artificial Sequence
  Description of Artificial Sequence: Synthetic peptide
DEEEIRTTNPVATELYGTVSANLQRGNR

SEQ ID NO: 7516 - protein, 29 aa, Artificial Sequence
  Description of Artificial Sequence: Synthetic peptide
DEECIRTTNPVATEQYGSVETNLQRNGNR

SEQ ID NO: 7517 - protein, 28 aa, Artificial Sequence
  Description of Artificial Sequence: Synthetic peptide
DEEEISTTNPVATEQYGSVSTNLQNGNA

SEQ ID NO: 7518 - protein, 28 aa, Artificial Sequence
  Description of Artificial Sequence: Synthetic peptide
DEEEIRTTNPVATEQYGSVSTEEERGNR

SEQ ID NO: 7519 - protein, 28 aa, Artificial Sequence
  Description of Artificial Sequence: Synthetic peptide
DEEEIRTTNPVAYAQYGVVSTNLQRGNR

SEQ ID NO: 7520 - protein, 31 aa, Artificial Sequence
  Description of Artificial Sequence: Synthetic polypeptide
DEEEIRTTNPVATEQYGSVISTNLPQLRGNR

SEQ ID NO: 7521 - protein, 28 aa, Artificial Sequence
  Description of Artificial Sequence: Synthetic peptide
DEEEIRTTNPVATEQYGSVSTPGQRGLR

SEQ ID NO: 7522 - protein, 28 aa, Artificial Sequence
  Description of Artificial Sequence: Synthetic peptide
FEEEIRTTNPVAGEQYGSVSTNLQLGNR

SEQ ID NO: 7523 - protein, 29 aa, Artificial Sequence
  Description of Artificial Sequence: Synthetic peptide
DEEEIRTTNPVATEQYGSVSTNLDQQGNS

SEQ ID NO: 7524 - protein, 28 aa, Artificial Sequence
  Description of Artificial Sequence: Synthetic peptide
DEEEIRTTNPVATEQYGSVSTDLFRGNN

SEQ ID NO: 7525 - protein, 28 aa, Artificial Sequence
  Description of Artificial Sequence: Synthetic peptide
DEEEIRTTNPVATEQYGSVSTNLDAGDR

SEQ ID NO: 7526 - protein, 30 aa, Artificial Sequence
  Description of Artificial Sequence: Synthetic polypeptide
DEEEIRTTNPVATEQYGSVSTNLQEREGNS

SEQ ID NO: 7527 - protein, 28 aa, Artificial Sequence
  Description of Artificial Sequence: Synthetic peptide
DEEEIRTTNPVATLQYGSVSTNLDEGNR

SEQ ID NO: 7528 - protein, 28 aa, Artificial Sequence
  Description of Artificial Sequence: Synthetic peptide
DEEEITTTNPVATEQYGSVSENLQRENR

SEQ ID NO: 7529 - protein, 30 aa, Artificial Sequence
  Description of Artificial Sequence: Synthetic polypeptide
SEEEIRTTNPVATEQYGSVSVTNLQRGNPR

SEQ ID NO: 7530 - protein, 29 aa, Artificial Sequence
  Description of Artificial Sequence: Synthetic peptide
DEEEIRTTNPVATEQYGSVSTDLQERGNE

SEQ ID NO: 7531 - protein, 29 aa, Artificial Sequence
  Description of Artificial Sequence: Synthetic peptide
DEEEIRTVNPVATEQYGSVSATVLQRGNR

SEQ ID NO: 7532 - protein, 29 aa, Artificial Sequence
  Description of Artificial Sequence: Synthetic peptide
DEEEIRTTNPVATEQYGSVSTNDMLRGNR

SEQ ID NO: 7533 - protein, 29 aa, Artificial Sequence
  Description of Artificial Sequence: Synthetic peptide
DEEEIRATNPVATEQYGSYSTNLMQRGNR

SEQ ID NO: 7534 - protein, 28 aa, Artificial Sequence
  Description of Artificial Sequence: Synthetic peptide
DEEEIRTTNPVATEIYGSVSTNLDPGNR

SEQ ID NO: 7535 - protein, 29 aa, Artificial Sequence
  Description of Artificial Sequence: Synthetic peptide
DEEEIRTTNPVATDQYGSVDTNLQQRGNR

SEQ ID NO: 7536 - protein, 28 aa, Artificial Sequence
  Description of Artificial Sequence: Synthetic peptide
DEGEIRTTNPVATEQYGSVSTNLYRGND

SEQ ID NO: 7537 - protein, 28 aa, Artificial Sequence
  Description of Artificial Sequence: Synthetic peptide
DEEEIETTNPVATEQYGSVSENLQRGNG

SEQ ID NO: 7538 - protein, 28 aa, Artificial Sequence
  Description of Artificial Sequence: Synthetic peptide
DETEIATTNPVATEIYGSVSTNLQRGNR

SEQ ID NO: 7539 - protein, 28 aa, Artificial Sequence
  Description of Artificial Sequence: Synthetic peptide
DEEEIRATNPVATEIYGSVATNLQRGNR

SEQ ID NO: 7540 - protein, 29 aa, Artificial Sequence
  Description of Artificial Sequence: Synthetic peptide
DEEEIRTTNPVATEQYGSVSTNLQEDGNA

SEQ ID NO: 7541 - protein, 28 aa, Artificial Sequence
  Description of Artificial Sequence: Synthetic peptide
DEEEIWTTNPVATEVYGSVSDNLQRGNR

SEQ ID NO: 7542 - protein, 30 aa, Artificial Sequence
  Description of Artificial Sequence: Synthetic polypeptide
DEEEIRTTNPEATEQYGSVSTTNLQRGNPR

SEQ ID NO: 7543 - protein, 30 aa, Artificial Sequence
  Description of Artificial Sequence: Synthetic polypeptide
DEEEIRTTNPVATEQYGSVDSTALQLRGNR

SEQ ID NO: 7544 - protein, 28 aa, Artificial Sequence
  Description of Artificial Sequence: Synthetic peptide
DEEEIRTTNPVAYEQYGSVETNLQRGND

SEQ ID NO: 7545 - protein, 30 aa, Artificial Sequence
  Description of Artificial Sequence: Synthetic polypeptide
DEEEIRTTNPVATEQYGSVSTNDQREGNDR

SEQ ID NO: 7546 - protein, 28 aa, Artificial Sequence
  Description of Artificial Sequence: Synthetic peptide
DEEEIRTTNPVCTEQYGDVSTDLQRGNR

SEQ ID NO: 7547 - protein, 30 aa, Artificial Sequence
  Description of Artificial Sequence: Synthetic polypeptide
DEEEIRTTNPVATEQYGSVSLTVNLQRGND

SEQ ID NO: 7548 - protein, 28 aa, Artificial Sequence
  Description of Artificial Sequence: Synthetic peptide
DEEEIRTTNPVATEQYGSVSTNDERGNF

SEQ ID NO: 7549 - protein, 28 aa, Artificial Sequence
  Description of Artificial Sequence: Synthetic peptide
QEEEIRTTNPVAAEQYGSVSTNLQRENR

SEQ ID NO: 7550 - protein, 30 aa, Artificial Sequence
  Description of Artificial Sequence: Synthetic polypeptide
DEEEIRTTNPVATEQYGISVSTVNLDRGNR

SEQ ID NO: 7551 - protein, 28 aa, Artificial Sequence
  Description of Artificial Sequence: Synthetic peptide
DEEEIRTTNPVATQQYGSVSTGLQPGNR

SEQ ID NO: 7552 - protein, 29 aa, Artificial Sequence
  Description of Artificial Sequence: Synthetic peptide
DDEEIRTTNPVATEQYGSVSATDLQRGNR

SEQ ID NO: 7553 - protein, 28 aa, Artificial Sequence
  Description of Artificial Sequence: Synthetic peptide
DEVEIAATNPVATEQYGSVSTNLQRGNR

SEQ ID NO: 7554 - protein, 28 aa, Artificial Sequence
  Description of Artificial Sequence: Synthetic peptide
DEEEIATTNPVATEQYGSVSTNLQHFNR

SEQ ID NO: 7555 - protein, 28 aa, Artificial Sequence
  Description of Artificial Sequence: Synthetic peptide
DEQEIRTTNPEATEQYGSVSTNLQRGNN

SEQ ID NO: 7556 - protein, 30 aa, Artificial Sequence
  Description of Artificial Sequence: Synthetic polypeptide
DEQEIRTTNPVATEQYGSVSETNLQRGENR

SEQ ID NO: 7557 - protein, 28 aa, Artificial Sequence
  Description of Artificial Sequence: Synthetic peptide
DEEEIRTTNPVATEQYGSYSTNLMRENR

SEQ ID NO: 7558 - protein, 29 aa, Artificial Sequence
  Description of Artificial Sequence: Synthetic peptide
DEEEIRTTNPVATEQYGSVSTNLVQHGNI

SEQ ID NO: 7559 - protein, 28 aa, Artificial Sequence
  Description of Artificial Sequence: Synthetic peptide
DAEEIRTTNPVATEQYGSWSTNLQRGND

SEQ ID NO: 7560 - protein, 29 aa, Artificial Sequence
  Description of Artificial Sequence: Synthetic peptide
DEEEIRTVNPCATEQYGSVSTNLQIRGNR

SEQ ID NO: 7561 - protein, 28 aa, Artificial Sequence
  Description of Artificial Sequence: Synthetic peptide
DEEEIRATNPTAGEQYGSVSTNLQRGNR

SEQ ID NO: 7562 - protein, 30 aa, Artificial Sequence
  Description of Artificial Sequence: Synthetic polypeptide
DEEEIRTTNPVATEQYGSVTSTNGLLRGNR

SEQ ID NO: 7563 - protein, 29 aa, Artificial Sequence
  Description of Artificial Sequence: Synthetic peptide
DEEEIRTTNPVATEQYGSVSTNLQIDGNF

SEQ ID NO: 7564 - protein, 29 aa, Artificial Sequence
  Description of Artificial Sequence: Synthetic peptide
DEEEIRTTNPVATEQYGSVSDTNLEPGNR

SEQ ID NO: 7565 - protein, 28 aa, Artificial Sequence
  Description of Artificial Sequence: Synthetic peptide
DEEEIRTTNPVATEQYGTVSMNLQRGNC

SEQ ID NO: 7566 - protein, 28 aa, Artificial Sequence
  Description of Artificial Sequence: Synthetic peptide
DEEEIRTTNPVATEQYGSVSTELQVGNN

SEQ ID NO: 7567 - protein, 28 aa, Artificial Sequence
  Description of Artificial Sequence: Synthetic peptide
DENEIATTNPVATEIYGSVSTNLQRGNR

SEQ ID NO: 7568 - protein, 31 aa, Artificial Sequence
  Description of Artificial Sequence: Synthetic polypeptide
DEEEIRTTNPVATEQYGSVSTSNLKQRGENR

SEQ ID NO: 7569 - protein, 28 aa, Artificial Sequence
  Description of Artificial Sequence: Synthetic peptide
DEEEIVTTNPVATEMYGWVSTNLQRGNR

SEQ ID NO: 7570 - protein, 28 aa, Artificial Sequence
  Description of Artificial Sequence: Synthetic peptide
DEEEICTTNPVATEQYGSVSTPLQRPNR

SEQ ID NO: 7571 - protein, 28 aa, Artificial Sequence
  Description of Artificial Sequence: Synthetic peptide
DEEEIRTTNPVAWEQYGSVSTNLDRGNV

SEQ ID NO: 7572 - protein, 28 aa, Artificial Sequence
  Description of Artificial Sequence: Synthetic peptide
DEEEIRTTNPVATEQYGSVDTDLQVGNR

SEQ ID NO: 7573 - protein, 29 aa, Artificial Sequence
  Description of Artificial Sequence: Synthetic peptide
DEEEIRPTNPVATEQYGSVSTNGQRGNYR

SEQ ID NO: 7574 - protein, 29 aa, Artificial Sequence
  Description of Artificial Sequence: Synthetic peptide
DEEEIRTTNPVATEQYGSVSTNLDDEGNR

SEQ ID NO: 7575 - protein, 28 aa, Artificial Sequence
  Description of Artificial Sequence: Synthetic peptide
DEEEIRTTNPVATEQYGSYSDNLQRGPR

SEQ ID NO: 7576 - protein, 28 aa, Artificial Sequence
  Description of Artificial Sequence: Synthetic peptide
AEEEIRTTNPVATEQYGSVSTNLQRTND

SEQ ID NO: 7577 - protein, 28 aa, Artificial Sequence
  Description of Artificial Sequence: Synthetic peptide
DEEEIRTTNPVATEQYGSVSTNLQSGEA

SEQ ID NO: 7578 - protein, 29 aa, Artificial Sequence
  Description of Artificial Sequence: Synthetic peptide
CEEEIRTTNPVATEQYGSVVSTNLQMGNR

SEQ ID NO: 7579 - protein, 28 aa, Artificial Sequence
  Description of Artificial Sequence: Synthetic peptide
DEEEIRSTNPVATELYGVVSTNLQRGNR

SEQ ID NO: 7580 - protein, 28 aa, Artificial Sequence
  Description of Artificial Sequence: Synthetic peptide
DEEEIRTTNPVATEQYGSVSTNLQWGEL

SEQ ID NO: 7581 - protein, 28 aa, Artificial Sequence
  Description of Artificial Sequence: Synthetic peptide
DEEEIRTTNPVATEQYGEVSTNLQRGDA

SEQ ID NO: 7582 - protein, 30 aa, Artificial Sequence
  Description of Artificial Sequence: Synthetic polypeptide
DEEEIRTTNPVATEQYGSVSETNLQVGNDR

SEQ ID NO: 7583 - protein, 29 aa, Artificial Sequence
  Description of Artificial Sequence: Synthetic peptide
DEEEIRTTNPVSTELYGSVSTNLQRNGNR

SEQ ID NO: 7584 - protein, 30 aa, Artificial Sequence
  Description of Artificial Sequence: Synthetic polypeptide
DEEEIRTTNPVATEQYGSVSETHNLQRGNV

SEQ ID NO: 7585 - protein, 28 aa, Artificial Sequence
  Description of Artificial Sequence: Synthetic peptide
DEEEIRTTNPEATEQYGSVSTNLEEGNR

SEQ ID NO: 7586 - protein, 28 aa, Artificial Sequence
  Description of Artificial Sequence: Synthetic peptide
DEEEIRTTNPVATEQYGWVSTNLQFGER

SEQ ID NO: 7587 - protein, 28 aa, Artificial Sequence
  Description of Artificial Sequence: Synthetic peptide
DEEEIRTTNPVATEWYGSVDTNLQRGDR

SEQ ID NO: 7588 - protein, 28 aa, Artificial Sequence
  Description of Artificial Sequence: Synthetic peptide
DEEEIRTTNPEATEQYGSVSTNLQRGPL

SEQ ID NO: 7589 - protein, 28 aa, Artificial Sequence
  Description of Artificial Sequence: Synthetic peptide
DEEEIRTTNPVATEQYGSVSEDLQRGNN

SEQ ID NO: 7590 - protein, 30 aa, Artificial Sequence
  Description of Artificial Sequence: Synthetic polypeptide
DEEEIRTTNPVATEQYGSVSCTNLQQHGNR

SEQ ID NO: 7591 - protein, 28 aa, Artificial Sequence
  Description of Artificial Sequence: Synthetic peptide
DEEEIRTTNPVATEQYGSVSTDLERGNE

SEQ ID NO: 7592 - protein, 31 aa, Artificial Sequence
  Description of Artificial Sequence: Synthetic polypeptide
DEEEIRTTNPVATEQYGSVSTNLVQRDGNPR

SEQ ID NO: 7593 - protein, 30 aa, Artificial Sequence
  Description of Artificial Sequence: Synthetic polypeptide
DEEEIATTNPVATEQYGSVSTMNLQRGDNR

SEQ ID NO: 7594 - protein, 30 aa, Artificial Sequence
  Description of Artificial Sequence: Synthetic polypeptide
DEEEIRTTNPVATEQYGSVSDTNLELRGNR

SEQ ID NO: 7595 - protein, 31 aa, Artificial Sequence
  Description of Artificial Sequence: Synthetic polypeptide
DEEEIRTTNPVATEQYGSVSATNLQLRNGNR

SEQ ID NO: 7596 - protein, 30 aa, Artificial Sequence
  Description of Artificial Sequence: Synthetic polypeptide
DEEEIRTTNPVATEQYGESYVSTNLQVGNR

SEQ ID NO: 7597 - protein, 30 aa, Artificial Sequence
  Description of Artificial Sequence: Synthetic polypeptide
DEEEIRTTNPVATEQYGSVDSDTNLERGNR

SEQ ID NO: 7598 - protein, 28 aa, Artificial Sequence
  Description of Artificial Sequence: Synthetic peptide
DEEEIRTTNPVATEQYGDVSENLQRGER

SEQ ID NO: 7599 - protein, 28 aa, Artificial Sequence
  Description of Artificial Sequence: Synthetic peptide
DEDEIRATNPTATEQYGSVSTNLQRGNR

SEQ ID NO: 7600 - protein, 28 aa, Artificial Sequence
  Description of Artificial Sequence: Synthetic peptide
DNEEIRTTNPVATEQYGSVSTNAQPGNR

SEQ ID NO: 7601 - protein, 28 aa, Artificial Sequence
  Description of Artificial Sequence: Synthetic peptide
DEQEIRTTNPVATEQYGSVETNLERGNR

SEQ ID NO: 7602 - protein, 29 aa, Artificial Sequence
  Description of Artificial Sequence: Synthetic peptide
DEEEIRTTNPVCTEQYGSVSTMNLQRGNL

SEQ ID NO: 7603 - protein, 29 aa, Artificial Sequence
  Description of Artificial Sequence: Synthetic peptide
GEEEIRTTNPVATEQYGSVSTENLQRGDR

SEQ ID NO: 7604 - protein, 30 aa, Artificial Sequence
  Description of Artificial Sequence: Synthetic polypeptide
DEEEIRTVNPVATEQYGSVSTTNGLQRGNR

SEQ ID NO: 7605 - protein, 29 aa, Artificial Sequence
  Description of Artificial Sequence: Synthetic peptide
GEEEIRTTNPVATEQYGSVSTNLERGENR

SEQ ID NO: 7606 - protein, 28 aa, Artificial Sequence
  Description of Artificial Sequence: Synthetic peptide
GEEEIRTTNPVATEQYGSVGTNLQRGTR

SEQ ID NO: 7607 - protein, 28 aa, Artificial Sequence
  Description of Artificial Sequence: Synthetic peptide
DEEEIRTTNPVATEQYGSVSTNLDTGER

SEQ ID NO: 7608 - protein, 31 aa, Artificial Sequence
  Description of Artificial Sequence: Synthetic polypeptide
DEEEIRTTNPVATEQYGSVDSTPNLQRGNDR

SEQ ID NO: 7609 - protein, 28 aa, Artificial Sequence
  Description of Artificial Sequence: Synthetic peptide
DDTEIRTTNPVATEQYGSVSTNLDRGNR

SEQ ID NO: 7610 - protein, 28 aa, Artificial Sequence
  Description of Artificial Sequence: Synthetic peptide
DEEEIRSTNPCATEMYGSVSTNLQRGNR

SEQ ID NO: 7611 - protein, 28 aa, Artificial Sequence
  Description of Artificial Sequence: Synthetic peptide
DEEEIRTTNPDATEQYGSVSTNLQRENF

SEQ ID NO: 7612 - protein, 28 aa, Artificial Sequence
  Description of Artificial Sequence: Synthetic peptide
DEEEIRTTNPVCTEQYGSVSTDLQGGNR

SEQ ID NO: 7613 - protein, 28 aa, Artificial Sequence
  Description of Artificial Sequence: Synthetic peptide
RDEEIRTTNPVATEQYGSVSDNLQRGNR

SEQ ID NO: 7614 - protein, 29 aa, Artificial Sequence
  Description of Artificial Sequence: Synthetic peptide
DEEEIRTTNPVATEQYGSVSTNLVQLGNE

SEQ ID NO: 7615 - protein, 28 aa, Artificial Sequence
  Description of Artificial Sequence: Synthetic peptide
DEQEISTTNPVATEQYGSTSTNLQRGNR

SEQ ID NO: 7616 - protein, 28 aa, Artificial Sequence
  Description of Artificial Sequence: Synthetic peptide
DEEEICTTNPVATEQYGSASTVLQRGNR

SEQ ID NO: 7617 - protein, 28 aa, Artificial Sequence
  Description of Artificial Sequence: Synthetic peptide
HEEEIRTTNPVATEQYGSVSTDLQNGNR

SEQ ID NO: 7618 - protein, 29 aa, Artificial Sequence
  Description of Artificial Sequence: Synthetic peptide
FEEEIRTTNPVATEQYGSVSTKNLQRGNY

SEQ ID NO: 7619 - protein, 28 aa, Artificial Sequence
  Description of Artificial Sequence: Synthetic peptide
DEEEIRTTNPVATEQYGYFSTGLQRGNR

SEQ ID NO: 7620 - protein, 29 aa, Artificial Sequence
  Description of Artificial Sequence: Synthetic peptide
DEEEIRTTNPVATEQYGSVAMNLVQRGNR

SEQ ID NO: 7621 - protein, 29 aa, Artificial Sequence
  Description of Artificial Sequence: Synthetic peptide
DEEEIRTTNPVATEQYGSVSTNLQELGNQ

SEQ ID NO: 7622 - protein, 30 aa, Artificial Sequence
  Description of Artificial Sequence: Synthetic polypeptide
DTEEIRTTNPVATEQYGSVSITNLQRGNDR

SEQ ID NO: 7623 - protein, 28 aa, Artificial Sequence
  Description of Artificial Sequence: Synthetic peptide
DEEEIRTTNPVATEQYGIVSTNLQDGND

SEQ ID NO: 7624 - protein, 29 aa, Artificial Sequence
  Description of Artificial Sequence: Synthetic peptide
DEEEIRTTNPVATEQYGSVSTNLQREGEF

SEQ ID NO: 7625 - protein, 29 aa, Artificial Sequence
  Description of Artificial Sequence: Synthetic peptide
DEEEISTTNPVATEQYGSVSTDLQRGNDR

SEQ ID NO: 7626 - protein, 28 aa, Artificial Sequence
  Description of Artificial Sequence: Synthetic peptide
DEEEIRTTNPVATEQYGSVSTNLQYGEV

SEQ ID NO: 7627 - protein, 29 aa, Artificial Sequence
  Description of Artificial Sequence: Synthetic peptide
DEEEIRTTNPVATEQYGSVSATVLQRGGR

SEQ ID NO: 7628 - protein, 28 aa, Artificial Sequence
  Description of Artificial Sequence: Synthetic peptide
QEEEIRTTNPVATEQYGDVSTDLQRGNR

SEQ ID NO: 7629 - protein, 28 aa, Artificial Sequence
  Description of Artificial Sequence: Synthetic peptide
DEEEIRSTNPVATEQYGVMSTNLQRGNR

SEQ ID NO: 7630 - protein, 28 aa, Artificial Sequence
  Description of Artificial Sequence: Synthetic peptide
DEEEIRTTNPVATEQFGSVGTNMQRGNR

SEQ ID NO: 7631 - protein, 28 aa, Artificial Sequence
  Description of Artificial Sequence: Synthetic peptide
DEQEIRTTNPVATEHYGWVSTNLQRGNR

SEQ ID NO: 7632 - protein, 28 aa, Artificial Sequence
  Description of Artificial Sequence: Synthetic peptide
DEEEIRCTNPVATELYGSVSTALQRGNR

SEQ ID NO: 7633 - protein, 28 aa, Artificial Sequence
  Description of Artificial Sequence: Synthetic peptide
DEEEIRTTNPVATEQYGSVSTEDERGNR

SEQ ID NO: 7634 - protein, 29 aa, Artificial Sequence
  Description of Artificial Sequence: Synthetic peptide
DEEEIRTTNPVCTEQYGSVDCTNLQRGNR

SEQ ID NO: 7635 - protein, 28 aa, Artificial Sequence
  Description of Artificial Sequence: Synthetic peptide
SEEEIRATNPVATEQYGSVSANLQRGNR

SEQ ID NO: 7636 - protein, 30 aa, Artificial Sequence
  Description of Artificial Sequence: Synthetic polypeptide
DEEEIRTTNPVATEQYGSVETNPLQRNGNR

SEQ ID NO: 7637 - protein, 28 aa, Artificial Sequence
  Description of Artificial Sequence: Synthetic peptide
VEQEIATTNPVATEQYGSVSTNLQRGNR

SEQ ID NO: 7638 - protein, 28 aa, Artificial Sequence
  Description of Artificial Sequence: Synthetic peptide
DEEEITTTNPVATEQYGSVSENDQRGNR

SEQ ID NO: 7639 - protein, 29 aa, Artificial Sequence
  Description of Artificial Sequence: Synthetic peptide
DEEETRTVNPVATEQYGSVSTNLQRGNER

SEQ ID NO: 7640 - protein, 30 aa, Artificial Sequence
  Description of Artificial Sequence: Synthetic polypeptide
DEEEIRTTNPVATEQYGSVETENLVQRGNR

SEQ ID NO: 7641 - protein, 28 aa, Artificial Sequence
  Description of Artificial Sequence: Synthetic peptide
DNEEIRTTNPVATEQYGSVSTGDQRGNR

SEQ ID NO: 7642 - protein, 29 aa, Artificial Sequence
  Description of Artificial Sequence: Synthetic peptide
DEEEIRTTNPVATEQYGSVSTDLQDEGNR

SEQ ID NO: 7643 - protein, 29 aa, Artificial Sequence
  Description of Artificial Sequence: Synthetic peptide
GEEEIRTTNPVATEQYGSVSTNLQVGNDR

SEQ ID NO: 7644 - protein, 28 aa, Artificial Sequence
  Description of Artificial Sequence: Synthetic peptide
DEEEIRTTNPVATEQYGSVSTNLELGNV

SEQ ID NO: 7645 - protein, 30 aa, Artificial Sequence
  Description of Artificial Sequence: Synthetic polypeptide
DEEEIRTTNPVATEQYGSVDTNNLQRGNDR

SEQ ID NO: 7646 - protein, 29 aa, Artificial Sequence
  Description of Artificial Sequence: Synthetic peptide
DEEEIRTTNPVATEQYGSVDCTNLQRGNQ

SEQ ID NO: 7647 - protein, 30 aa, Artificial Sequence
  Description of Artificial Sequence: Synthetic polypeptide
DEEEIRTTNPVATEQYGSVSTANLQREGNQ

SEQ ID NO: 7648 - protein, 30 aa, Artificial Sequence
  Description of Artificial Sequence: Synthetic polypeptide
DEEEIRTTNPVATEQYGVVSSTPNLQRGNR

SEQ ID NO: 7649 - protein, 28 aa, Artificial Sequence
  Description of Artificial Sequence: Synthetic peptide
DEHEIRTVNPVATEQYGSVSTVLQRGNR

SEQ ID NO: 7650 - protein, 28 aa, Artificial Sequence
  Description of Artificial Sequence: Synthetic peptide
DDEEIRTTNPVATEQYGSVSTNDQRGDR

SEQ ID NO: 7651 - protein, 28 aa, Artificial Sequence
  Description of Artificial Sequence: Synthetic peptide
SEEEISTTNPVATEQYGSVSTNWQRGNR

SEQ ID NO: 7652 - protein, 31 aa, Artificial Sequence
  Description of Artificial Sequence: Synthetic polypeptide
DEEEIRTTNPVATEQYGSVSDTNLQRGENDR

SEQ ID NO: 7653 - protein, 28 aa, Artificial Sequence
  Description of Artificial Sequence: Synthetic peptide
MEEEIRTTNPVATEVYGVVSTNLQRGNR

SEQ ID NO: 7654 - protein, 28 aa, Artificial Sequence
  Description of Artificial Sequence: Synthetic peptide
QEEEIRTTNPVATEQYGSVSTVLQRGGR

SEQ ID NO: 7655 - protein, 31 aa, Artificial Sequence
  Description of Artificial Sequence: Synthetic polypeptide
DEEEIRTTNPVATEQYGSVSETNLQRGDNPR

SEQ ID NO: 7656 - protein, 28 aa, Artificial Sequence
  Description of Artificial Sequence: Synthetic peptide
DEEEIRTTNPFATEQYGSVSTNDQRDNR

SEQ ID NO: 7657 - protein, 28 aa, Artificial Sequence
  Description of Artificial Sequence: Synthetic peptide
DEQEIRTTNPVATEQYGSWSTNLQRENR

SEQ ID NO: 7658 - protein, 28 aa, Artificial Sequence
  Description of Artificial Sequence: Synthetic peptide
DEIEIRTTNPVATEQYGSVSTNPQRGNI

SEQ ID NO: 7659 - protein, 28 aa, Artificial Sequence
  Description of Artificial Sequence: Synthetic peptide
DEQEIRTTNPVATEQYGDVSTDLQRGNR

SEQ ID NO: 7660 - protein, 28 aa, Artificial Sequence
  Description of Artificial Sequence: Synthetic peptide
DEECIRTTNPVATEQYGSWSTNDQRGNR

SEQ ID NO: 7661 - protein, 30 aa, Artificial Sequence
  Description of Artificial Sequence: Synthetic polypeptide
DEEEIRATNPVATEQYGSVSTNLQIRGNDR

SEQ ID NO: 7662 - protein, 28 aa, Artificial Sequence
  Description of Artificial Sequence: Synthetic peptide
DEEEIRTTNPVATEQYGSVSTNLDAGNT

SEQ ID NO: 7663 - protein, 28 aa, Artificial Sequence
  Description of Artificial Sequence: Synthetic peptide
QEEEVRTTNPVATEQYGSVSTNLERGNR

SEQ ID NO: 7664 - protein, 29 aa, Artificial Sequence
  Description of Artificial Sequence: Synthetic peptide
DEEEIRTTNPVATEQYGSVSTNLQEIGER

SEQ ID NO: 7665 - protein, 28 aa, Artificial Sequence
  Description of Artificial Sequence: Synthetic peptide
DEEEIRTTNPVATEQYGVVAMNLQRGNR

SEQ ID NO: 7666 - protein, 29 aa, Artificial Sequence
  Description of Artificial Sequence: Synthetic peptide
DEEEIRTTNPVATEQYGSVSTELQERGNA

SEQ ID NO: 7667 - protein, 28 aa, Artificial Sequence
  Description of Artificial Sequence: Synthetic peptide
DEEEIRTTNPVATEQYGSVSTNDQRGDA

SEQ ID NO: 7668 - protein, 30 aa, Artificial Sequence
  Description of Artificial Sequence: Synthetic polypeptide
DEEEIRTTNPVATEQYGSVSTNLQLRGDNN

SEQ ID NO: 7669 - protein, 30 aa, Artificial Sequence
  Description of Artificial Sequence: Synthetic polypeptide
DEEEIRTTNPVATEQYGSNVSTNLQYGNDR

SEQ ID NO: 7670 - protein, 28 aa, Artificial Sequence
  Description of Artificial Sequence: Synthetic peptide
DEEEIRTTNPDATEQYGSVSTNLEDGNR

SEQ ID NO: 7671 - protein, 29 aa, Artificial Sequence
  Description of Artificial Sequence: Synthetic peptide
DEEEIATTNPVATEQYGSVSTNLQDRGNE

SEQ ID NO: 7672 - protein, 29 aa, Artificial Sequence
  Description of Artificial Sequence: Synthetic peptide
DEEEIRTTNPVAYEQYGSWSDTNLQRGNR

SEQ ID NO: 7673 - protein, 30 aa, Artificial Sequence
  Description of Artificial Sequence: Synthetic polypeptide
DEEEIRTTNPVATEQYGSVSTNLQDNGNDR

SEQ ID NO: 7674 - protein, 28 aa, Artificial Sequence
  Description of Artificial Sequence: Synthetic peptide
DEEEIRTTNPVASEQYGDVSTNLDRGNR

SEQ ID NO: 7675 - protein, 28 aa, Artificial Sequence
  Description of Artificial Sequence: Synthetic peptide
DEEMIRTTNPVATEQYGSVSTNNDRGNR

SEQ ID NO: 7676 - protein, 28 aa, Artificial Sequence
  Description of Artificial Sequence: Synthetic peptide
DEEEIRTTNPDATEQYGSVSTNLDRGQR

SEQ ID NO: 7677 - protein, 29 aa, Artificial Sequence
  Description of Artificial Sequence: Synthetic peptide
DEEEIRTTNPVATEQYGSVSTNLEREGNM

SEQ ID NO: 7678 - protein, 28 aa, Artificial Sequence
  Description of Artificial Sequence: Synthetic peptide
QEQEIATTNPVATEQYGSVSTNLQRGNR

SEQ ID NO: 7679 - protein, 30 aa, Artificial Sequence
  Description of Artificial Sequence: Synthetic polypeptide
DEEEIRTTNPVATEQYGSVSTMNLQFRGER

SEQ ID NO: 7680 - protein, 29 aa, Artificial Sequence
  Description of Artificial Sequence: Synthetic peptide
DEEEIRTTNPVATEQYGSVSTCLQAGNDR

SEQ ID NO: 7681 - protein, 28 aa, Artificial Sequence
  Description of Artificial Sequence: Synthetic peptide
DEECIRTTNPVAWEQYGSVSTNEQRGNR

SEQ ID NO: 7682 - protein, 28 aa, Artificial Sequence
  Description of Artificial Sequence: Synthetic peptide
DEEEIRTTNPVATQQYGSVSTNLDRGNP

SEQ ID NO: 7683 - protein, 28 aa, Artificial Sequence
  Description of Artificial Sequence: Synthetic peptide
SEECIRTTNPVATEQYGSVSTNLQRGND

SEQ ID NO: 7684 - protein, 28 aa, Artificial Sequence
  Description of Artificial Sequence: Synthetic peptide
MEQEIRTTNPVATEQYGSVSTDLQRGNR

SEQ ID NO: 7685 - protein, 28 aa, Artificial Sequence
  Description of Artificial Sequence: Synthetic peptide
DEEEIRTTNPDATEQYGSVSTNEQRGER

SEQ ID NO: 7686 - protein, 29 aa, Artificial Sequence
  Description of Artificial Sequence: Synthetic peptide
DEEEIRTTNPVATEQYGSWSTNLNRGNER

SEQ ID NO: 7687 - protein, 28 aa, Artificial Sequence
  Description of Artificial Sequence: Synthetic peptide
DEEEIRTTNPVATEIYGVVSTNLQRLNR

SEQ ID NO: 7688 - protein, 28 aa, Artificial Sequence
  Description of Artificial Sequence: Synthetic peptide
VEEEIRCTNPVATEQYGWVSTNLQRGNR

SEQ ID NO: 7689 - protein, 28 aa, Artificial Sequence
  Description of Artificial Sequence: Synthetic peptide
DEEEIRTTNPDATEQYGSVSTNLDRGND

SEQ ID NO: 7690 - protein, 28 aa, Artificial Sequence
  Description of Artificial Sequence: Synthetic peptide
DEEEIRTTNPDATEQYGSVSTNLQNGNH

SEQ ID NO: 7691 - protein, 28 aa, Artificial Sequence
  Description of Artificial Sequence: Synthetic peptide
DEDEIRTTNPVATEQYGWVSMNLQRGNR

SEQ ID NO: 7692 - protein, 28 aa, Artificial Sequence
  Description of Artificial Sequence: Synthetic peptide
DEFEIVTTNPVATEQYGTVSTNLQRGNR

SEQ ID NO: 7693 - protein, 28 aa, Artificial Sequence
  Description of Artificial Sequence: Synthetic peptide
AEEEIWTTNPVATEQYGWVSTNLQRGNR

SEQ ID NO: 7694 - protein, 28 aa, Artificial Sequence
  Description of Artificial Sequence: Synthetic peptide
DEEEIRTTNPVATEQYGSVETNLQQGNP

SEQ ID NO: 7695 - protein, 30 aa, Artificial Sequence
  Description of Artificial Sequence: Synthetic polypeptide
DEEEIRTTNPVATEQYGSVSTNLEDRGNER

SEQ ID NO: 7696 - protein, 30 aa, Artificial Sequence
  Description of Artificial Sequence: Synthetic polypeptide
DEEEIRTTNPVATEQYGSVSTNFQTRGVNR

SEQ ID NO: 7697 - protein, 28 aa, Artificial Sequence
  Description of Artificial Sequence: Synthetic peptide
DEEEIRTTNPVATEQYGSVSTDWQAGNR

SEQ ID NO: 7698 - protein, 29 aa, Artificial Sequence
  Description of Artificial Sequence: Synthetic peptide
DEEEIRTTNPVSTEQYGSASTNLQSRGNR

SEQ ID NO: 7699 - protein, 28 aa, Artificial Sequence
  Description of Artificial Sequence: Synthetic peptide
DEEEIRTTNPEATEQYGSVSTDLQRGDR

SEQ ID NO: 7700 - protein, 30 aa, Artificial Sequence
  Description of Artificial Sequence: Synthetic polypeptide
DEEEIRTTNPVATEQYGSVSTNLQGGDNFR

SEQ ID NO: 7701 - protein, 29 aa, Artificial Sequence
  Description of Artificial Sequence: Synthetic peptide
DEEEIRTTNPVATEQYGSVSTNLQNQGNW

SEQ ID NO: 7702 - protein, 29 aa, Artificial Sequence
  Description of Artificial Sequence: Synthetic peptide
DEEEIRTTNPTATEQYGSVSTNPQLRGNR

SEQ ID NO: 7703 - protein, 29 aa, Artificial Sequence
  Description of Artificial Sequence: Synthetic peptide
DEECIRTTNPVATEQYGESVSTNLDRGNR

SEQ ID NO: 7704 - protein, 28 aa, Artificial Sequence
  Description of Artificial Sequence: Synthetic peptide
DEEEIRTTNPVATEQYGSVETNLELGNR

SEQ ID NO: 7705 - protein, 28 aa, Artificial Sequence
  Description of Artificial Sequence: Synthetic peptide
DENEIRTTNPVCTEQYGSVMTNLQRGNR

SEQ ID NO: 7706 - protein, 29 aa, Artificial Sequence
  Description of Artificial Sequence: Synthetic peptide
DEEEIRTTNPTATEQYGSVSTNLQQGDNR

SEQ ID NO: 7707 - protein, 28 aa, Artificial Sequence
  Description of Artificial Sequence: Synthetic peptide
DEEEIRTTNPEATEQYGSVSTNLQSGNV

SEQ ID NO: 7708 - protein, 30 aa, Artificial Sequence
  Description of Artificial Sequence: Synthetic polypeptide
DEEEIRTTNPVATEQYGSVDSTNLQQGDNR

SEQ ID NO: 7709 - protein, 28 aa, Artificial Sequence
  Description of Artificial Sequence: Synthetic peptide
DEQEIATTNPVATECYGSVSTNLQRGNR

SEQ ID NO: 7710 - protein, 29 aa, Artificial Sequence
  Description of Artificial Sequence: Synthetic peptide
DEEEIRTTNPVATEQYGSVDTNLMRGENR

SEQ ID NO: 7711 - protein, 28 aa, Artificial Sequence
  Description of Artificial Sequence: Synthetic peptide
DEEEIRTTNPVSTEQYGSVSTCLQRGNH

SEQ ID NO: 7712 - protein, 30 aa, Artificial Sequence
  Description of Artificial Sequence: Synthetic polypeptide
LEEEIRTTNPVATEQYGSVSTNLPQRGFNR

SEQ ID NO: 7713 - protein, 30 aa, Artificial Sequence
  Description of Artificial Sequence: Synthetic polypeptide
DEEEIRTTNPVATEQYGSVSTNLQEAGNDR

SEQ ID NO: 7714 - protein, 28 aa, Artificial Sequence
  Description of Artificial Sequence: Synthetic peptide
DEEEIRTTNPEATEQYGSVSTNLQDGNT

SEQ ID NO: 7715 - protein, 28 aa, Artificial Sequence
  Description of Artificial Sequence: Synthetic peptide
DEEEIRTTNPEATEQYGSVSTNLQIGER

SEQ ID NO: 7716 - protein, 29 aa, Artificial Sequence
  Description of Artificial Sequence: Synthetic peptide
DEVEIRTTNPTATEQYGSVSTNLQRGNTR

SEQ ID NO: 7717 - protein, 28 aa, Artificial Sequence
  Description of Artificial Sequence: Synthetic peptide
DEEEIRTTNPVATEQYGSVETNEQRGNH

SEQ ID NO: 7718 - protein, 28 aa, Artificial Sequence
  Description of Artificial Sequence: Synthetic peptide
DEEEIRTTNPVATECYGSVSTNLERGNA

SEQ ID NO: 7719 - protein, 29 aa, Artificial Sequence
  Description of Artificial Sequence: Synthetic peptide
QEEEIATTNPVATEQYGSVISTNLQRGNR

SEQ ID NO: 7720 - protein, 28 aa, Artificial Sequence
  Description of Artificial Sequence: Synthetic peptide
DEEELRTTNPVATEQYGCVSNNLQRGNR

SEQ ID NO: 7721 - protein, 28 aa, Artificial Sequence
  Description of Artificial Sequence: Synthetic peptide
DEEEIRTTNPVATEQYGSVSTDLQPGNH

SEQ ID NO: 7722 - protein, 29 aa, Artificial Sequence
  Description of Artificial Sequence: Synthetic peptide
DEEEIRTTNPVATEQYGSVSTMNLCRGNC

SEQ ID NO: 7723 - protein, 29 aa, Artificial Sequence
  Description of Artificial Sequence: Synthetic peptide
DEEEIRTTNPVATEQYGSVSTDLQHGNDR

SEQ ID NO: 7724 - protein, 28 aa, Artificial Sequence
  Description of Artificial Sequence: Synthetic peptide
DEEEIRTTNPEATEQYGSVSTNLQDENR

SEQ ID NO: 7725 - protein, 28 aa, Artificial Sequence
  Description of Artificial Sequence: Synthetic peptide
DEEEIRTTNPVATLQYGSVSTNLERPNR

SEQ ID NO: 7726 - protein, 30 aa, Artificial Sequence
  Description of Artificial Sequence: Synthetic polypeptide
DEEEIRTTNPEATEQYGSVSTNPLQRGDNR

SEQ ID NO: 7727 - protein, 29 aa, Artificial Sequence
  Description of Artificial Sequence: Synthetic peptide
DEQEIRTTNPVATEQYGEVSATNLQRGNR

SEQ ID NO: 7728 - protein, 29 aa, Artificial Sequence
  Description of Artificial Sequence: Synthetic peptide
DEEEIRTTNPVATEQYGMSVSTNDQPGNR

SEQ ID NO: 7729 - protein, 28 aa, Artificial Sequence
  Description of Artificial Sequence: Synthetic peptide
DEEEIRTTNPVATEQYGSWSTNLELGNR

SEQ ID NO: 7730 - protein, 30 aa, Artificial Sequence
  Description of Artificial Sequence: Synthetic polypeptide
DEEEIRTTNPVATEQYGSVSTNLDRDGNER

SEQ ID NO: 7731 - protein, 30 aa, Artificial Sequence
  Description of Artificial Sequence: Synthetic polypeptide
DEEEIRTTNPDATEQYGSVSTNLQRDGNER

SEQ ID NO: 7732 - protein, 28 aa, Artificial Sequence
  Description of Artificial Sequence: Synthetic peptide
DEEEIRTTNPVACEQYGSVGTLLQRGNR

SEQ ID NO: 7733 - protein, 29 aa, Artificial Sequence
  Description of Artificial Sequence: Synthetic peptide
DEEEIRTTNPVATEQYGSVSTNPLFRGPR

SEQ ID NO: 7734 - protein, 28 aa, Artificial Sequence
  Description of Artificial Sequence: Synthetic peptide
DEEEIGTTNPVATEQYGSVSTILQKGNR

SEQ ID NO: 7735 - protein, 28 aa, Artificial Sequence
  Description of Artificial Sequence: Synthetic peptide
DEEEIRCTNPVATEQYGSVSTNSSRGNR

SEQ ID NO: 7736 - protein, 28 aa, Artificial Sequence
  Description of Artificial Sequence: Synthetic peptide
DEEEIRCTNPVATEIYGSVSMNLQRGNR

SEQ ID NO: 7737 - protein, 28 aa, Artificial Sequence
  Description of Artificial Sequence: Synthetic peptide
DEEEIYTTNPVATEQYGSVSANLQRGNF

SEQ ID NO: 7738 - protein, 28 aa, Artificial Sequence
  Description of Artificial Sequence: Synthetic peptide
DEEEIRTTNPVATEQYGSVSTEDQRGND

SEQ ID NO: 7739 - protein, 28 aa, Artificial Sequence
  Description of Artificial Sequence: Synthetic peptide
DEEEIRATNPVCTEQYGSVATNLQRGNR

SEQ ID NO: 7740 - protein, 28 aa, Artificial Sequence
  Description of Artificial Sequence: Synthetic peptide
DEEEIRTTNPVATEQYGSVSTNEQRENS

SEQ ID NO: 7741 - protein, 29 aa, Artificial Sequence
  Description of Artificial Sequence: Synthetic peptide
DEESIRTTNPVATEQYGSVSTNLPQRGGR

SEQ ID NO: 7742 - protein, 30 aa, Artificial Sequence
  Description of Artificial Sequence: Synthetic polypeptide
DEEEIRTTNPEATEQYGSVSTNGLQREGNR

SEQ ID NO: 7743 - protein, 30 aa, Artificial Sequence
  Description of Artificial Sequence: Synthetic polypeptide
DAEEIRTTNPVATEQYGSVSTVNLQRGDNR

SEQ ID NO: 7744 - protein, 29 aa, Artificial Sequence
  Description of Artificial Sequence: Synthetic peptide
DEEEIRTTNPVATEQYGSVSTPLVLRGNR

SEQ ID NO: 7745 - protein, 28 aa, Artificial Sequence
  Description of Artificial Sequence: Synthetic peptide
DEEEIRTTNPVATEQYGSVFEPLQRGNR

SEQ ID NO: 7746 - protein, 29 aa, Artificial Sequence
  Description of Artificial Sequence: Synthetic peptide
DEEEIGTTNPVATEQYGSVSATNLQRGNT

SEQ ID NO: 7747 - protein, 28 aa, Artificial Sequence
  Description of Artificial Sequence: Synthetic peptide
DEEEIRTTNPVATEQYGSVETNLERGNF

SEQ ID NO: 7748 - protein, 28 aa, Artificial Sequence
  Description of Artificial Sequence: Synthetic peptide
DEEEIRTTNPVATEQYGSVDTNEQRGDR

SEQ ID NO: 7749 - protein, 28 aa, Artificial Sequence
  Description of Artificial Sequence: Synthetic peptide
DEEEIRTTNPDATEQYGSVSTGLIRGNR

SEQ ID NO: 7750 - protein, 30 aa, Artificial Sequence
  Description of Artificial Sequence: Synthetic polypeptide
DEEEIRTTNPVATEQYGSVSTDDLQERGNR

SEQ ID NO: 7751 - protein, 29 aa, Artificial Sequence
  Description of Artificial Sequence: Synthetic peptide
DEEEICTTNPVATEQYGSVASTNLQRLNR

SEQ ID NO: 7752 - protein, 28 aa, Artificial Sequence
  Description of Artificial Sequence: Synthetic peptide
DEEEIRTTNPVATEQYGSVSTNPQQGNA

SEQ ID NO: 7753 - protein, 28 aa, Artificial Sequence
  Description of Artificial Sequence: Synthetic peptide
DEEEIRTTNPVATEQYGCVSMNLQRGTR

SEQ ID NO: 7754 - protein, 30 aa, Artificial Sequence
  Description of Artificial Sequence: Synthetic polypeptide
DEEEIRTTNPVATEQYGSVAATNLQRLGNR

SEQ ID NO: 7755 - protein, 29 aa, Artificial Sequence
  Description of Artificial Sequence: Synthetic peptide
DEEEIRTTNPVATEQYGSVSTNLQNGNDS

SEQ ID NO: 7756 - protein, 30 aa, Artificial Sequence
  Description of Artificial Sequence: Synthetic polypeptide
DEEEIRTTNPVATEQYGSVSETNLVQVGNR

SEQ ID NO: 7757 - protein, 28 aa, Artificial Sequence
  Description of Artificial Sequence: Synthetic peptide
DENEIRTTNPVATEQYGSVHENLQRGNR

SEQ ID NO: 7758 - protein, 28 aa, Artificial Sequence
  Description of Artificial Sequence: Synthetic peptide
DEEEIRTTNPAATEQYGSVSTNLQIGNQ

SEQ ID NO: 7759 - protein, 28 aa, Artificial Sequence
  Description of Artificial Sequence: Synthetic peptide
DEEEIRTTNPVASEQYGSVSTELQQGNR

SEQ ID NO: 7760 - protein, 29 aa, Artificial Sequence
  Description of Artificial Sequence: Synthetic peptide
DEEEIRTTNPVATEQYGSVSTEDQRGNER

SEQ ID NO: 7761 - protein, 28 aa, Artificial Sequence
  Description of Artificial Sequence: Synthetic peptide
DEEEIRTTNPVATEWWGSVSTNLQPGNR

SEQ ID NO: 7762 - protein, 28 aa, Artificial Sequence
  Description of Artificial Sequence: Synthetic peptide
DEEEIYATNPVATEQYGSVSTNLQRGDR

SEQ ID NO: 7763 - protein, 28 aa, Artificial Sequence
  Description of Artificial Sequence: Synthetic peptide
KEEEIRTTNPVATEQYGSVSTNLQHGNC

SEQ ID NO: 7764 - protein, 28 aa, Artificial Sequence
  Description of Artificial Sequence: Synthetic peptide
DEEEIRGTNPVATEQYGSVAMNLQRGNR

SEQ ID NO: 7765 - protein, 28 aa, Artificial Sequence
  Description of Artificial Sequence: Synthetic peptide
DEEEIRTTNPFATEQYGSTSTNLQTGNR

SEQ ID NO: 7766 - protein, 28 aa, Artificial Sequence
  Description of Artificial Sequence: Synthetic peptide
DEEEIRTTNPHATEQYGSVSTNLQPGNT

SEQ ID NO: 7767 - protein, 28 aa, Artificial Sequence
  Description of Artificial Sequence: Synthetic peptide
DEEEIHTTNPVATEQYGSVSTPLQRGTR

SEQ ID NO: 7768 - protein, 29 aa, Artificial Sequence
  Description of Artificial Sequence: Synthetic peptide
DEEEIRTTNPVATEQYGSVSDVLQRAGNR

SEQ ID NO: 7769 - protein, 28 aa, Artificial Sequence
  Description of Artificial Sequence: Synthetic peptide
DEEEIRTTNPVATEQYGSVSTNLQFGEL

SEQ ID NO: 7770 - protein, 28 aa, Artificial Sequence
  Description of Artificial Sequence: Synthetic peptide
DEEEIRTTNPFATEQYGSVSTELQRGDR

SEQ ID NO: 7771 - protein, 29 aa, Artificial Sequence
  Description of Artificial Sequence: Synthetic peptide
DEEEIRTTNPVATEQYGSVSTNLQERGEL

SEQ ID NO: 7772 - protein, 28 aa, Artificial Sequence
  Description of Artificial Sequence: Synthetic peptide
DEQEIVATNPVATEQYGSVSTNLQRGNR

SEQ ID NO: 7773 - protein, 30 aa, Artificial Sequence
  Description of Artificial Sequence: Synthetic polypeptide
DEMEIRTTNPVATEQYGSVSTGNLQRGDNR

SEQ ID NO: 7774 - protein, 29 aa, Artificial Sequence
  Description of Artificial Sequence: Synthetic peptide
DEEEIRTTNPVATEQYGSVSTNLQENGNV

SEQ ID NO: 7775 - protein, 28 aa, Artificial Sequence
  Description of Artificial Sequence: Synthetic peptide
DEGEIRTTNPVATEIYGIVSTNLQRGNR

SEQ ID NO: 7776 - protein, 28 aa, Artificial Sequence
  Description of Artificial Sequence: Synthetic peptide
DEEEIRTTNPVATEQYGSVSTNLDSGND

SEQ ID NO: 7777 - protein, 30 aa, Artificial Sequence
  Description of Artificial Sequence: Synthetic polypeptide
DEEEIRTTNPVATEQYGSVSTNLNDRGNER

SEQ ID NO: 7778 - protein, 30 aa, Artificial Sequence
  Description of Artificial Sequence: Synthetic polypeptide
DEEEIRTTNPVATEQYGSVSDTGLQLRGNR

SEQ ID NO: 7779 - protein, 28 aa, Artificial Sequence
  Description of Artificial Sequence: Synthetic peptide
DEEEIRTTNPVATEQYGSVSEFLQRGNY

SEQ ID NO: 7780 - protein, 28 aa, Artificial Sequence
  Description of Artificial Sequence: Synthetic peptide
DEEEIRTTNPVATEQYGSVFTNPQRENR

SEQ ID NO: 7781 - protein, 29 aa, Artificial Sequence
  Description of Artificial Sequence: Synthetic peptide
DEEEIRTTNPVATEQWGSSVSTNLQRMNR

SEQ ID NO: 7782 - protein, 28 aa, Artificial Sequence
  Description of Artificial Sequence: Synthetic peptide
DSEEIRTTNPVATQQYGSVSTNLQRGER

SEQ ID NO: 7783 - protein, 29 aa, Artificial Sequence
  Description of Artificial Sequence: Synthetic peptide
DEEEIRTTNPVATEQYGSVCSTNLQNGER

SEQ ID NO: 7784 - protein, 30 aa, Artificial Sequence
  Description of Artificial Sequence: Synthetic polypeptide
DEEEIRTTNPVATEQYGSVSETNLQDRGND

SEQ ID NO: 7785 - protein, 29 aa, Artificial Sequence
  Description of Artificial Sequence: Synthetic peptide
DEEEIRTTNPVATEQYGSVHQTNLQMGNR

SEQ ID NO: 7786 - protein, 29 aa, Artificial Sequence
  Description of Artificial Sequence: Synthetic peptide
DEQEIRATNPVATEQYGSVSATNLQRGNR

SEQ ID NO: 7787 - protein, 28 aa, Artificial Sequence
  Description of Artificial Sequence: Synthetic peptide
DEEEIRTTNPVATEQYGSVFENLQRGNN

SEQ ID NO: 7788 - protein, 28 aa, Artificial Sequence
  Description of Artificial Sequence: Synthetic peptide
DEEEIRTTNPVATECYGSVSTNLQRGED

SEQ ID NO: 7789 - protein, 28 aa, Artificial Sequence
  Description of Artificial Sequence: Synthetic peptide
AEEEIRQTNPVATEQYGEVSTNLQRGNR

SEQ ID NO: 7790 - protein, 30 aa, Artificial Sequence
  Description of Artificial Sequence: Synthetic polypeptide
DEEEIRTTNPDATEQYGSVSTNLVQRGENR

SEQ ID NO: 7791 - protein, 28 aa, Artificial Sequence
  Description of Artificial Sequence: Synthetic peptide
DEEEIRTTNPVATEWYGSVSTNLMRGTR

SEQ ID NO: 7792 - protein, 29 aa, Artificial Sequence
  Description of Artificial Sequence: Synthetic peptide
DEEEIRTTNPVATEQYGSVETNQQRGVNR

SEQ ID NO: 7793 - protein, 30 aa, Artificial Sequence
  Description of Artificial Sequence: Synthetic polypeptide
DEEEIRTTNPVATEQYGSVISTNLQELGNR

SEQ ID NO: 7794 - protein, 29 aa, Artificial Sequence
  Description of Artificial Sequence: Synthetic peptide
DEEEIRTTNPVATEQYGVVSTNLQTRGND

SEQ ID NO: 7795 - protein, 28 aa, Artificial Sequence
  Description of Artificial Sequence: Synthetic peptide
DEEEIRTTNPICTEQYGSVSTNLERGNR

SEQ ID NO: 7796 - protein, 28 aa, Artificial Sequence
  Description of Artificial Sequence: Synthetic peptide
DEEEIRTTNPEATEQYGSVSTNEQQGNR

SEQ ID NO: 7797 - protein, 28 aa, Artificial Sequence
  Description of Artificial Sequence: Synthetic peptide
DEEEIRTTNPVATEQYGSVSTNLQLGET

SEQ ID NO: 7798 - protein, 29 aa, Artificial Sequence
  Description of Artificial Sequence: Synthetic peptide
QEEEIRTTNPVATEQYGSTSTNLQVRGNR

SEQ ID NO: 7799 - protein, 29 aa, Artificial Sequence
  Description of Artificial Sequence: Synthetic peptide
DENEIRTTNPVATEQYGSVSDNGLQRGNR

SEQ ID NO: 7800 - protein, 28 aa, Artificial Sequence
  Description of Artificial Sequence: Synthetic peptide
DEEEIRATNPVATEVYGNVSTNLQRGNR

SEQ ID NO: 7801 - protein, 28 aa, Artificial Sequence
  Description of Artificial Sequence: Synthetic peptide
DEEEIRTTNPVATEQYGSVSTNDFDGNR

SEQ ID NO: 7802 - protein, 28 aa, Artificial Sequence
  Description of Artificial Sequence: Synthetic peptide
DEEEIRTTNPVATEQYGSVSTDLQYGNE

SEQ ID NO: 7803 - protein, 28 aa, Artificial Sequence
  Description of Artificial Sequence: Synthetic peptide
DDEEIRTTNPVATEQYGSVVTNLQRGGR

SEQ ID NO: 7804 - protein, 28 aa, Artificial Sequence
  Description of Artificial Sequence: Synthetic peptide
DEVEIRTTNPVATEQYGTVSTNLQLGNR

SEQ ID NO: 7805 - protein, 30 aa, Artificial Sequence
  Description of Artificial Sequence: Synthetic polypeptide
DEEEIRTTNPCATEQYGSVSTTNLQRGENR

SEQ ID NO: 7806 - protein, 28 aa, Artificial Sequence
  Description of Artificial Sequence: Synthetic peptide
DEEEIRTTNPVATEQYGSVDTNEQRGNA

SEQ ID NO: 7807 - protein, 30 aa, Artificial Sequence
  Description of Artificial Sequence: Synthetic polypeptide
DEEEIRTTNPVATEQYGESVSTNLIQRGNF

SEQ ID NO: 7808 - protein, 29 aa, Artificial Sequence
  Description of Artificial Sequence: Synthetic peptide
DEEEIRTTNPVATEQYGLVSENLQRGNYR

SEQ ID NO: 7809 - protein, 29 aa, Artificial Sequence
  Description of Artificial Sequence: Synthetic peptide
DEEEIRTTNPVATEQYGSVGMTNPQRGNR

SEQ ID NO: 7810 - protein, 29 aa, Artificial Sequence
  Description of Artificial Sequence: Synthetic peptide
DEEEVRTTNPVATEQYGSVSTGNLQRLNR

SEQ ID NO: 7811 - protein, 28 aa, Artificial Sequence
  Description of Artificial Sequence: Synthetic peptide
DEEEIRTTNPVATEQYGSVDTYEQRGNR

SEQ ID NO: 7812 - protein, 28 aa, Artificial Sequence
  Description of Artificial Sequence: Synthetic peptide
DEEEIRTTNPFATEQYGSVSTNLERGND

SEQ ID NO: 7813 - protein, 30 aa, Artificial Sequence
  Description of Artificial Sequence: Synthetic polypeptide
DEEEIRTTNPVATEQYGSVETNPLQRGDNR

SEQ ID NO: 7814 - protein, 29 aa, Artificial Sequence
  Description of Artificial Sequence: Synthetic peptide
REEEIRTTNPVATEQYGSVSVNLQFRGNR

SEQ ID NO: 7815 - protein, 30 aa, Artificial Sequence
  Description of Artificial Sequence: Synthetic polypeptide
DEEEIRTTNPVATEQYGSNVSTNNLQRGNE

SEQ ID NO: 7816 - protein, 31 aa, Artificial Sequence
  Description of Artificial Sequence: Synthetic polypeptide
DEEEIRTTNPVATEQYGSVTSTTNLQDRGNR

SEQ ID NO: 7817 - protein, 30 aa, Artificial Sequence
  Description of Artificial Sequence: Synthetic polypeptide
DEEEIRTTNPVATEQYGSVSCTMNLQVGNR

SEQ ID NO: 7818 - protein, 30 aa, Artificial Sequence
  Description of Artificial Sequence: Synthetic polypeptide
DEEEIRTTNPVATEQYGSVSTANLQWGENR

SEQ ID NO: 7819 - protein, 30 aa, Artificial Sequence
  Description of Artificial Sequence: Synthetic polypeptide
DEEEIRTTNPVATEQYGSIVSTNPLQRINR

SEQ ID NO: 7820 - protein, 30 aa, Artificial Sequence
  Description of Artificial Sequence: Synthetic polypeptide
DEEEIRTTNPVATENYGSVSTNGLQQRGNR

SEQ ID NO: 7821 - protein, 30 aa, Artificial Sequence
  Description of Artificial Sequence: Synthetic polypeptide
DEEEIRTTNPVATEQYGSVSTNLQEDNGNR

SEQ ID NO: 7822 - protein, 29 aa, Artificial Sequence
  Description of Artificial Sequence: Synthetic peptide
DEEEIRTTNPVATEQYGSVYSENLQQGNR

SEQ ID NO: 7823 - protein, 29 aa, Artificial Sequence
  Description of Artificial Sequence: Synthetic peptide
DEEEIRTTNPVATEQYGSVDTNLPDRGNR

SEQ ID NO: 7824 - protein, 29 aa, Artificial Sequence
  Description of Artificial Sequence: Synthetic peptide
DEEEIRTVNPVATEMYGSVSTNLQRGENR

SEQ ID NO: 7825 - protein, 30 aa, Artificial Sequence
  Description of Artificial Sequence: Synthetic polypeptide
DEESIRTTNPVATEQYGSVSTNGLQRGNIR

SEQ ID NO: 7826 - protein, 28 aa, Artificial Sequence
  Description of Artificial Sequence: Synthetic peptide
DEEEICCTNPVATEQFGSVSTNLQRGNR

SEQ ID NO: 7827 - protein, 28 aa, Artificial Sequence
  Description of Artificial Sequence: Synthetic peptide
DEEEIRTTNPVATEQYGSVSTNLQDGEI

SEQ ID NO: 7828 - protein, 28 aa, Artificial Sequence
  Description of Artificial Sequence: Synthetic peptide
DEEEIRTTNPVATEQYGSVSENLQCGPR

SEQ ID NO: 7829 - protein, 30 aa, Artificial Sequence
  Description of Artificial Sequence: Synthetic polypeptide
DEEEIRTTNPVATEQYGSVSTNLEERKGNR

SEQ ID NO: 7830 - protein, 31 aa, Artificial Sequence
  Description of Artificial Sequence: Synthetic polypeptide
DEEEIRTTNPVATEQYGSVSDTNLQDRGNPR

SEQ ID NO: 7831 - protein, 29 aa, Artificial Sequence
  Description of Artificial Sequence: Synthetic peptide
DEEEIRTTNPVATEQYGSVSTDLQNGNER

SEQ ID NO: 7832 - protein, 28 aa, Artificial Sequence
  Description of Artificial Sequence: Synthetic peptide
DEEEICTTNPVATEQYGSVSTNEQRGNF

SEQ ID NO: 7833 - protein, 28 aa, Artificial Sequence
  Description of Artificial Sequence: Synthetic peptide
QETEIRTTNPVATEQYGVVSTNLQRGNR

SEQ ID NO: 7834 - protein, 28 aa, Artificial Sequence
  Description of Artificial Sequence: Synthetic peptide
DEECIRTTNPVATEQYGSVSHNDQRGNR

SEQ ID NO: 7835 - protein, 28 aa, Artificial Sequence
  Description of Artificial Sequence: Synthetic peptide
DEEEIRTTNPVATEQYGSWSTCLQDGNR

SEQ ID NO: 7836 - protein, 28 aa, Artificial Sequence
  Description of Artificial Sequence: Synthetic peptide
DEEAIRTTNPVATNQYGSVSTNLQHGNR

SEQ ID NO: 7837 - protein, 28 aa, Artificial Sequence
  Description of Artificial Sequence: Synthetic peptide
AEEEIRTTNPVATEQYGSVSTNLLQGNR

SEQ ID NO: 7838 - protein, 28 aa, Artificial Sequence
  Description of Artificial Sequence: Synthetic peptide
DEEEIRTTNPVCTEQYGLVGTNLQRGNR

SEQ ID NO: 7839 - protein, 30 aa, Artificial Sequence
  Description of Artificial Sequence: Synthetic polypeptide
DEEEIRTTNPVATEQYGESVSTELQREGNR

SEQ ID NO: 7840 - protein, 28 aa, Artificial Sequence
  Description of Artificial Sequence: Synthetic peptide
SEEEIRTTNPVATEQFGGVSTNLQRGNR

SEQ ID NO: 7841 - protein, 29 aa, Artificial Sequence
  Description of Artificial Sequence: Synthetic peptide
DEEEIRTTNPVATEQYGSCPTNLQRGNVR

SEQ ID NO: 7842 - protein, 31 aa, Artificial Sequence
  Description of Artificial Sequence: Synthetic polypeptide
DEEEIRTTNPVATEQYGESVSDTNLQRGNDR

SEQ ID NO: 7843 - protein, 28 aa, Artificial Sequence
  Description of Artificial Sequence: Synthetic peptide
DEEEIRTTNPEATEQFGSVSTNLQRGNQ

SEQ ID NO: 7844 - protein, 28 aa, Artificial Sequence
  Description of Artificial Sequence: Synthetic peptide
DEEEVRTTNPVATEIYGSVSTNLDRGNR

SEQ ID NO: 7845 - protein, 28 aa, Artificial Sequence
  Description of Artificial Sequence: Synthetic peptide
DEEEIRTTNPAATEQYGSVCTQLQRGNR

SEQ ID NO: 7846 - protein, 30 aa, Artificial Sequence
  Description of Artificial Sequence: Synthetic polypeptide
DEEEIATTNPVATEQYGSVSTMNLQQRGNR

SEQ ID NO: 7847 - protein, 28 aa, Artificial Sequence
  Description of Artificial Sequence: Synthetic peptide
CEEEIRTTNPVACEQYGSVSTNLQRGTR

SEQ ID NO: 7848 - protein, 28 aa, Artificial Sequence
  Description of Artificial Sequence: Synthetic peptide
DEEEIRAVNPVATEQYGSVSTNLQRGNS

SEQ ID NO: 7849 - protein, 28 aa, Artificial Sequence
  Description of Artificial Sequence: Synthetic peptide
DEEEIRQTNPVATEQYGSVSTNQQRGND

SEQ ID NO: 7850 - protein, 28 aa, Artificial Sequence
  Description of Artificial Sequence: Synthetic peptide
HEEEIWTTNPVATEQYGSVATNLQRGNR

SEQ ID NO: 7851 - protein, 28 aa, Artificial Sequence
  Description of Artificial Sequence: Synthetic peptide
DEEEIRTTNPVATQIYGSVSTNLDRGNR

SEQ ID NO: 7852 - protein, 28 aa, Artificial Sequence
  Description of Artificial Sequence: Synthetic peptide
DEEEIRTTNPVATEQYGSVSTNEMRGDR

SEQ ID NO: 7853 - protein, 30 aa, Artificial Sequence
  Description of Artificial Sequence: Synthetic polypeptide
DEEEIRTTNPVATEQYGSVSTNLQEREGER

SEQ ID NO: 7854 - protein, 28 aa, Artificial Sequence
  Description of Artificial Sequence: Synthetic peptide
DEEEIRTTNPVATEQYGSVDTDLQRGNV

SEQ ID NO: 7855 - protein, 31 aa, Artificial Sequence
  Description of Artificial Sequence: Synthetic polypeptide
DEEEIRTTNPVATEQYGSVESTINLQHRGNR

SEQ ID NO: 7856 - protein, 28 aa, Artificial Sequence
  Description of Artificial Sequence: Synthetic peptide
DENEIVTVNPVATEQYGSVSTNLQRGNR

SEQ ID NO: 7857 - protein, 28 aa, Artificial Sequence
  Description of Artificial Sequence: Synthetic peptide
DEEEIRPTNPVATECYGSVSTNLQRGNP

SEQ ID NO: 7858 - protein, 28 aa, Artificial Sequence
  Description of Artificial Sequence: Synthetic peptide
DQEEIRTTNPVATEQYGSYSTNLQRGER

SEQ ID NO: 7859 - protein, 28 aa, Artificial Sequence
  Description of Artificial Sequence: Synthetic peptide
DEEEIRTTNPVATEQYGSVSTCLQWGNM

SEQ ID NO: 7860 - protein, 29 aa, Artificial Sequence
  Description of Artificial Sequence: Synthetic peptide
DEEEIRTTNPVATETYGSVYSTNLQVGNR

SEQ ID NO: 7861 - protein, 28 aa, Artificial Sequence
  Description of Artificial Sequence: Synthetic peptide
SENEIATTNPVATEQYGSVSTNLQRGNR

SEQ ID NO: 7862 - protein, 28 aa, Artificial Sequence
  Description of Artificial Sequence: Synthetic peptide
DEEEIRTTNPVATEQYGSVDTNDQRGNA

SEQ ID NO: 7863 - protein, 28 aa, Artificial Sequence
  Description of Artificial Sequence: Synthetic peptide
DEEMIRTTNPIATEQYGSVSTNDQRGNR

SEQ ID NO: 7864 - protein, 29 aa, Artificial Sequence
  Description of Artificial Sequence: Synthetic peptide
DEEEITTTNPVATEQYGSVSTMNLQRGNL

SEQ ID NO: 7865 - protein, 30 aa, Artificial Sequence
  Description of Artificial Sequence: Synthetic polypeptide
DEEEIRTTNPVATEQYGSVSITNLQRGIER

SEQ ID NO: 7866 - protein, 28 aa, Artificial Sequence
  Description of Artificial Sequence: Synthetic peptide
DHEEIRTTNPVAYEQYGSVSTGLQRGNR

SEQ ID NO: 7867 - protein, 30 aa, Artificial Sequence
  Description of Artificial Sequence: Synthetic polypeptide
DEEEIRTTNPVATEQYGSVDSTNLERGENR

SEQ ID NO: 7868 - protein, 30 aa, Artificial Sequence
  Description of Artificial Sequence: Synthetic polypeptide
DEEEIRTTNPVATEQYGESVSTNLQRLGNA

SEQ ID NO: 7869 - protein, 28 aa, Artificial Sequence
  Description of Artificial Sequence: Synthetic peptide
DEEEIRTTNPDATEQYGSVSTDLQNGNR

SEQ ID NO: 7870 - protein, 30 aa, Artificial Sequence
  Description of Artificial Sequence: Synthetic polypeptide
DEEEIRTTNPVATEQYGSVSDTNLDRGDNR

SEQ ID NO: 7871 - protein, 28 aa, Artificial Sequence
  Description of Artificial Sequence: Synthetic peptide
DEEEIRCTNPVATEMYGSVSTNGQRGNR

SEQ ID NO: 7872 - protein, 28 aa, Artificial Sequence
  Description of Artificial Sequence: Synthetic peptide
DEEEIRTTNPVATECYGSVSTNLQHGER

SEQ ID NO: 7873 - protein, 28 aa, Artificial Sequence
  Description of Artificial Sequence: Synthetic peptide
DEEEIRTTNPVAYEQYGSVSSNLQRPNR

SEQ ID NO: 7874 - protein, 28 aa, Artificial Sequence
  Description of Artificial Sequence: Synthetic peptide
DEEEIRTTNPVATEQYGSVSENLQMGNC

SEQ ID NO: 7875 - protein, 28 aa, Artificial Sequence
  Description of Artificial Sequence: Synthetic peptide
DEEEIRTTNPEATEQYGSVSTNLQVGER

SEQ ID NO: 7876 - protein, 28 aa, Artificial Sequence
  Description of Artificial Sequence: Synthetic peptide
DEQEIRTTNPVATEEYGSVSANLQRGNR

SEQ ID NO: 7877 - protein, 28 aa, Artificial Sequence
  Description of Artificial Sequence: Synthetic peptide
DEEEIRTTNPFATEQYGSVSTGLLRGNR

SEQ ID NO: 7878 - protein, 28 aa, Artificial Sequence
  Description of Artificial Sequence: Synthetic peptide
DEEEIRTTNPAATEQFGSVSTNLQRGNA

SEQ ID NO: 7879 - protein, 28 aa, Artificial Sequence
  Description of Artificial Sequence: Synthetic peptide
DENEIRTTNPVATEQYGTVSTNLQRGER

SEQ ID NO: 7880 - protein, 28 aa, Artificial Sequence
  Description of Artificial Sequence: Synthetic peptide
DEEEIRTVNPCATEQYGSVSMNLQRGNR

SEQ ID NO: 7881 - protein, 28 aa, Artificial Sequence
  Description of Artificial Sequence: Synthetic peptide
DEQEIRATNPVATEQYGVVSTNLQRGNR

SEQ ID NO: 7882 - protein, 29 aa, Artificial Sequence
  Description of Artificial Sequence: Synthetic peptide
DENEIRTTNPVATEQYGSVSCTNLQFGNR

SEQ ID NO: 7883 - protein, 28 aa, Artificial Sequence
  Description of Artificial Sequence: Synthetic peptide
DEEEIRTTNPVATEQYGSVDTNLERGND

SEQ ID NO: 7884 - protein, 28 aa, Artificial Sequence
  Description of Artificial Sequence: Synthetic peptide
DEEEIRCTNPVATEIYGVVSTNLQRGNR

SEQ ID NO: 7885 - protein, 30 aa, Artificial Sequence
  Description of Artificial Sequence: Synthetic polypeptide
DEEEIRTTNPVATEQYGSVSTNLQDRGNDS

SEQ ID NO: 7886 - protein, 29 aa, Artificial Sequence
  Description of Artificial Sequence: Synthetic peptide
DEEEIRTTNPVATEQYGSVSTDLQNEGNR

SEQ ID NO: 7887 - protein, 28 aa, Artificial Sequence
  Description of Artificial Sequence: Synthetic peptide
DEEEIRTTNPVATEQYGSVSTNLEGGNW

SEQ ID NO: 7888 - protein, 28 aa, Artificial Sequence
  Description of Artificial Sequence: Synthetic peptide
DEEEIRTTNPVATEQYGSVSTNLEVGNL

SEQ ID NO: 7889 - protein, 29 aa, Artificial Sequence
  Description of Artificial Sequence: Synthetic peptide
FEEEIRTTNPVATEQYGSVIETNLQRGNR

SEQ ID NO: 7890 - protein, 28 aa, Artificial Sequence
  Description of Artificial Sequence: Synthetic peptide
DEEEIRTTNPVATEQYGAVSTCLQRGND

SEQ ID NO: 7891 - protein, 29 aa, Artificial Sequence
  Description of Artificial Sequence: Synthetic peptide
DEGEIRTTNPVATEQYGSYVSTNLIRGNR

SEQ ID NO: 7892 - protein, 28 aa, Artificial Sequence
  Description of Artificial Sequence: Synthetic peptide
DDEEIRTTNPVATEPYGSVSTNQQRGNR

SEQ ID NO: 7893 - protein, 28 aa, Artificial Sequence
  Description of Artificial Sequence: Synthetic peptide
DEDEIRTTNPVATEIYGAVSTNLQRGNR

SEQ ID NO: 7894 - protein, 30 aa, Artificial Sequence
  Description of Artificial Sequence: Synthetic polypeptide
DEEEIRTTNPVATEQYGSVSTNLEQRNGND

SEQ ID NO: 7895 - protein, 28 aa, Artificial Sequence
  Description of Artificial Sequence: Synthetic peptide
DEEEIETTNPVATEQYGSVSTELQDGNR

SEQ ID NO: 7896 - protein, 30 aa, Artificial Sequence
  Description of Artificial Sequence: Synthetic polypeptide
DEEEIRTTNPVATEQYGSVSTWLNQRGFNR

SEQ ID NO: 7897 - protein, 29 aa, Artificial Sequence
  Description of Artificial Sequence: Synthetic peptide
DEEEIRTTNPVATEQYGSVSTNLQEQGNA

SEQ ID NO: 7898 - protein, 30 aa, Artificial Sequence
  Description of Artificial Sequence: Synthetic polypeptide
DEEEIRTTNPVATEQYGSVSTDLQRKGENR

SEQ ID NO: 7899 - protein, 30 aa, Artificial Sequence
  Description of Artificial Sequence: Synthetic polypeptide
DEEEIRTTNPVATEQYGSVDSTMNWQRGNR

SEQ ID NO: 7900 - protein, 28 aa, Artificial Sequence
  Description of Artificial Sequence: Synthetic peptide
DEQEIRTTNPVATEHYGSASTNLQRGNR

SEQ ID NO: 7901 - protein, 29 aa, Artificial Sequence
  Description of Artificial Sequence: Synthetic peptide
DEGEIRTTNPVATEQYGSVSTGNLQQGNR

SEQ ID NO: 7902 - protein, 29 aa, Artificial Sequence
  Description of Artificial Sequence: Synthetic peptide
SENEIRTTNPVATEQYGSVSTNLQIRGNR

SEQ ID NO: 7903 - protein, 28 aa, Artificial Sequence
  Description of Artificial Sequence: Synthetic peptide
DEEEIRTTNPVATECYGSVSTNLQDGNM

SEQ ID NO: 7904 - protein, 28 aa, Artificial Sequence
  Description of Artificial Sequence: Synthetic peptide
DEECIRTTNPVATEQYGSVSTNLQDENR

SEQ ID NO: 7905 - protein, 29 aa, Artificial Sequence
  Description of Artificial Sequence: Synthetic peptide
DEEEIRTTNPVATEQYGSVSTNLQRGEDL

SEQ ID NO: 7906 - protein, 29 aa, Artificial Sequence
  Description of Artificial Sequence: Synthetic peptide
DEEEIRTTNPVAVEQYGSVSTNLQREGNL

SEQ ID NO: 7907 - protein, 28 aa, Artificial Sequence
  Description of Artificial Sequence: Synthetic peptide
DEEEIRTTNPEATEQYGSVSTDLQRGNV

SEQ ID NO: 7908 - protein, 30 aa, Artificial Sequence
  Description of Artificial Sequence: Synthetic polypeptide
DEEEIRTTNPVATEQYGSVSTNLQERGNDA

SEQ ID NO: 7909 - protein, 28 aa, Artificial Sequence
  Description of Artificial Sequence: Synthetic peptide
DEEEIRTTNPVAFEQYGSVSTNLLRGPR

SEQ ID NO: 7910 - protein, 30 aa, Artificial Sequence
  Description of Artificial Sequence: Synthetic polypeptide
DEEEIRTTNPVSTEQYGSVSATNLQRAGNR

SEQ ID NO: 7911 - protein, 28 aa, Artificial Sequence
  Description of Artificial Sequence: Synthetic peptide
DEEEIRTTNPEATEQYGSVSTEEQRGNR

SEQ ID NO: 7912 - protein, 30 aa, Artificial Sequence
  Description of Artificial Sequence: Synthetic polypeptide
DEEEIRTTNPVATEQYGSVSTNLQEIGNDR

SEQ ID NO: 7913 - protein, 28 aa, Artificial Sequence
  Description of Artificial Sequence: Synthetic peptide
DEEEIRTTNPVATEQYGSVSTELQAGNS

SEQ ID NO: 7914 - protein, 29 aa, Artificial Sequence
  Description of Artificial Sequence: Synthetic peptide
DEEEIRTTNPVATEQYGSVSTNLDREGND

SEQ ID NO: 7915 - protein, 29 aa, Artificial Sequence
  Description of Artificial Sequence: Synthetic peptide
SEEEIRTTNPVATEQYGSVSTNLQREGNA

SEQ ID NO: 7916 - protein, 28 aa, Artificial Sequence
  Description of Artificial Sequence: Synthetic peptide
DEEEIRTTNPVATEQYGSVSTNLQHGEM

SEQ ID NO: 7917 - protein, 28 aa, Artificial Sequence
  Description of Artificial Sequence: Synthetic peptide
DEEEIRTTNPVATEQYGSVDTPLERGNR

SEQ ID NO: 7918 - protein, 28 aa, Artificial Sequence
  Description of Artificial Sequence: Synthetic peptide
DEEEISTTNPVSTEQYGSVGTNLQRGNR

SEQ ID NO: 7919 - protein, 29 aa, Artificial Sequence
  Description of Artificial Sequence: Synthetic peptide
DEEEIRTTNPVATEQYGHSYSENLQRGNR

SEQ ID NO: 7920 - protein, 31 aa, Artificial Sequence
  Description of Artificial Sequence: Synthetic polypeptide
DEEEIRTTNPVATEQYGSLVSSTNLQERGNR

SEQ ID NO: 7921 - protein, 28 aa, Artificial Sequence
  Description of Artificial Sequence: Synthetic peptide
DEEEIRTTNPVATEQYGSVSTNLQQGEM

SEQ ID NO: 7922 - protein, 28 aa, Artificial Sequence
  Description of Artificial Sequence: Synthetic peptide
DEEEIRTTNPEATEQYGSVSTNLDVGNR

SEQ ID NO: 7923 - protein, 30 aa, Artificial Sequence
  Description of Artificial Sequence: Synthetic polypeptide
DEEEIRTTNPVATEQYGSVSTNDQERGHNR

SEQ ID NO: 7924 - protein, 29 aa, Artificial Sequence
  Description of Artificial Sequence: Synthetic peptide
DEEEIRTTNPVATEQYGSVSTNLQQEGNF

SEQ ID NO: 7925 - protein, 28 aa, Artificial Sequence
  Description of Artificial Sequence: Synthetic peptide
DEEEIATTNPVAFEQYGSVSTGLQRGNR

SEQ ID NO: 7926 - protein, 29 aa, Artificial Sequence
  Description of Artificial Sequence: Synthetic peptide
DEEEIRATNPEATEQYGSVSTNLQREGNR

SEQ ID NO: 7927 - protein, 28 aa, Artificial Sequence
  Description of Artificial Sequence: Synthetic peptide
DEEEIRTTNPFATEQYGSVSTNLQVGNL

SEQ ID NO: 7928 - protein, 29 aa, Artificial Sequence
  Description of Artificial Sequence: Synthetic peptide
DEEEIRTTNPVATEQYGSVESTWLQRGNK

SEQ ID NO: 7929 - protein, 30 aa, Artificial Sequence
  Description of Artificial Sequence: Synthetic polypeptide
DEEEIRTTNPVATEQYGSVSTNLQDNGDNR

SEQ ID NO: 7930 - protein, 28 aa, Artificial Sequence
  Description of Artificial Sequence: Synthetic peptide
DEVEIATTNPVATEQYGSVSTNLQRGNN

SEQ ID NO: 7931 - protein, 28 aa, Artificial Sequence
  Description of Artificial Sequence: Synthetic peptide
DEEEIRTTNPEATEQYGSVSTNEQNGNR

SEQ ID NO: 7932 - protein, 28 aa, Artificial Sequence
  Description of Artificial Sequence: Synthetic peptide
HEGEIRTTNPVATEQYGSVSTNLQRGER

SEQ ID NO: 7933 - protein, 28 aa, Artificial Sequence
  Description of Artificial Sequence: Synthetic peptide
DEEEIRTTNPVASEVYGAVSTNLQRGNR

SEQ ID NO: 7934 - protein, 28 aa, Artificial Sequence
  Description of Artificial Sequence: Synthetic peptide
DEIEIRTTNPVATEQYGSVSVNLQRGMR

SEQ ID NO: 7935 - protein, 30 aa, Artificial Sequence
  Description of Artificial Sequence: Synthetic polypeptide
DEEEIRTTNPVATEQYGSVSSTNPLQDGNR

SEQ ID NO: 7936 - protein, 28 aa, Artificial Sequence
  Description of Artificial Sequence: Synthetic peptide
DEEEIRTTNPVATEQYGSVSTELQVGNY

SEQ ID NO: 7937 - protein, 28 aa, Artificial Sequence
  Description of Artificial Sequence: Synthetic peptide
DEEEIRTTNPVATEQYGDASTNEQRGNR

SEQ ID NO: 7938 - protein, 28 aa, Artificial Sequence
  Description of Artificial Sequence: Synthetic peptide
DEEEIRTTNPVATFQYGSVSTDLQRGLR

SEQ ID NO: 7939 - protein, 28 aa, Artificial Sequence
  Description of Artificial Sequence: Synthetic peptide
DEEEIRTTNPVATEQYGSVSTPLFRGNP

SEQ ID NO: 7940 - protein, 29 aa, Artificial Sequence
  Description of Artificial Sequence: Synthetic peptide
DEEEIRTTNPVATEQYGSVDSTNLQIGNQ

SEQ ID NO: 7941 - protein, 28 aa, Artificial Sequence
  Description of Artificial Sequence: Synthetic peptide
DEEEIRTTNPVAYEQYGSVSTNLQLGNL

SEQ ID NO: 7942 - protein, 28 aa, Artificial Sequence
  Description of Artificial Sequence: Synthetic peptide
KEEEIRTTNPVATECYGSVSTDLQRGNR

SEQ ID NO: 7943 - protein, 29 aa, Artificial Sequence
  Description of Artificial Sequence: Synthetic peptide
DEEEIRTTNPVATEQYGSYSFNLQRPGNR

SEQ ID NO: 7944 - protein, 30 aa, Artificial Sequence
  Description of Artificial Sequence: Synthetic polypeptide
DEEEIRTTNPVATCQYGSVSTNLNQRDGNR

SEQ ID NO: 7945 - protein, 28 aa, Artificial Sequence
  Description of Artificial Sequence: Synthetic peptide
DEEEIVATNPVATEVYGSVSTNLQRGNR

SEQ ID NO: 7946 - protein, 28 aa, Artificial Sequence
  Description of Artificial Sequence: Synthetic peptide
DESEIVTVNPVATEQYGSVSTNLQRGNR

SEQ ID NO: 7947 - protein, 29 aa, Artificial Sequence
  Description of Artificial Sequence: Synthetic peptide
DEEEIRTTNPVATEQYGSVSTNLQHFGND

SEQ ID NO: 7948 - protein, 29 aa, Artificial Sequence
  Description of Artificial Sequence: Synthetic peptide
DEEEIYTTNPVATEQYGSVSTNLQRGENQ

SEQ ID NO: 7949 - protein, 28 aa, Artificial Sequence
  Description of Artificial Sequence: Synthetic peptide
DEENIRTTNPVATEQYGSVSTIDQRGNR

SEQ ID NO: 7950 - protein, 28 aa, Artificial Sequence
  Description of Artificial Sequence: Synthetic peptide
DEEEIRTTNPVATEQYGSVSTCLQFGNN

SEQ ID NO: 7951 - protein, 30 aa, Artificial Sequence
  Description of Artificial Sequence: Synthetic polypeptide
DEEEIRTTNPVATEQYGSVEDTNLQIRGNR

SEQ ID NO: 7952 - protein, 30 aa, Artificial Sequence
  Description of Artificial Sequence: Synthetic polypeptide
DEEEIRTTNPVATEQYGSYVSTNLQRENER

SEQ ID NO: 7953 - protein, 30 aa, Artificial Sequence
  Description of Artificial Sequence: Synthetic polypeptide
DEEEIRTTNPTATEQYGSVSTENLQREGNR

SEQ ID NO: 7954 - protein, 31 aa, Artificial Sequence
  Description of Artificial Sequence: Synthetic polypeptide
DEEEIRTTNPVATEQYGSVTSMTNLPQRGNR

SEQ ID NO: 7955 - protein, 28 aa, Artificial Sequence
  Description of Artificial Sequence: Synthetic peptide
DEEEIRTTNPDATEQYGSVSTNLEFGNR

SEQ ID NO: 7956 - protein, 30 aa, Artificial Sequence
  Description of Artificial Sequence: Synthetic polypeptide
DEEEIRTTNPVATEQYGSVSTNLQRGDNDQ

SEQ ID NO: 7957 - protein, 29 aa, Artificial Sequence
  Description of Artificial Sequence: Synthetic peptide
DEEEIRTTNPVATEQYGSVSTNLQENGNL

SEQ ID NO: 7958 - protein, 28 aa, Artificial Sequence
  Description of Artificial Sequence: Synthetic peptide
DEEEIRTVNPVATEQYGEVSTSLQRGNR

SEQ ID NO: 7959 - protein, 29 aa, Artificial Sequence
  Description of Artificial Sequence: Synthetic peptide
SEEEISTTNPVATEQYGSVSTNLPQRGNR

SEQ ID NO: 7960 - protein, 28 aa, Artificial Sequence
  Description of Artificial Sequence: Synthetic peptide
DEEEIRTTNPVATEMYGSVSTDLQRGNN

SEQ ID NO: 7961 - protein, 29 aa, Artificial Sequence
  Description of Artificial Sequence: Synthetic peptide
DEEEIRTTNPVATEQYGSVSTNGLQVGNF

SEQ ID NO: 7962 - protein, 29 aa, Artificial Sequence
  Description of Artificial Sequence: Synthetic peptide
DEEEIRTTNPVATEQYGSVSTNEQREGNG

SEQ ID NO: 7963 - protein, 29 aa, Artificial Sequence
  Description of Artificial Sequence: Synthetic peptide
DEFEIRTTNPVATEQYGSVSTGNLQRGNS

SEQ ID NO: 7964 - protein, 28 aa, Artificial Sequence
  Description of Artificial Sequence: Synthetic peptide
DEEEIATTNPDATEQYGSVSTNLQIGNR

SEQ ID NO: 7965 - protein, 29 aa, Artificial Sequence
  Description of Artificial Sequence: Synthetic peptide
DEEEIRTTNPDATEQYGSVSDTNLDRGNR

SEQ ID NO: 7966 - protein, 30 aa, Artificial Sequence
  Description of Artificial Sequence: Synthetic polypeptide
DEEEIRTTNPVATEQYGSVSQTTLQRMGNR

SEQ ID NO: 7967 - protein, 30 aa, Artificial Sequence
  Description of Artificial Sequence: Synthetic polypeptide
DEEEIRTTNPVATEQYGSVSTTMNLNRGNR

SEQ ID NO: 7968 - protein, 29 aa, Artificial Sequence
  Description of Artificial Sequence: Synthetic peptide
DEEEIRTTNPVATENYGSVSTNLGRGANR

SEQ ID NO: 7969 - protein, 29 aa, Artificial Sequence
  Description of Artificial Sequence: Synthetic peptide
DEEEIRTTNPVATEQYGSVSTNLQENGNQ

SEQ ID NO: 7970 - protein, 28 aa, Artificial Sequence
  Description of Artificial Sequence: Synthetic peptide
DEEEIRTTNPVATEQYGSVETNLQRGEY

SEQ ID NO: 7971 - protein, 28 aa, Artificial Sequence
  Description of Artificial Sequence: Synthetic peptide
DEEEIRTTNPVATEQYGSVSTNDQDGNP

SEQ ID NO: 7972 - protein, 31 aa, Artificial Sequence
  Description of Artificial Sequence: Synthetic polypeptide
DEEEIRTTNPVATEQYGSVSTNLQVRKGDNR

SEQ ID NO: 7973 - protein, 30 aa, Artificial Sequence
  Description of Artificial Sequence: Synthetic polypeptide
DEEEIRTTNPVATEQYGSVESTNPLQMGNR

SEQ ID NO: 7974 - protein, 29 aa, Artificial Sequence
  Description of Artificial Sequence: Synthetic peptide
DEEEIRSTNPVATEQYGTVSATNLQRGNR

SEQ ID NO: 7975 - protein, 29 aa, Artificial Sequence
  Description of Artificial Sequence: Synthetic peptide
DEEEIRTTNPVATEQYGSVEETNLQRGER

SEQ ID NO: 7976 - protein, 30 aa, Artificial Sequence
  Description of Artificial Sequence: Synthetic polypeptide
DEEEIRTTNPVATEQYGSVSTNLQEVGNDR

SEQ ID NO: 7977 - protein, 29 aa, Artificial Sequence
  Description of Artificial Sequence: Synthetic peptide
DEEEIRTTNPCATEQYGCVSATNLQRGNR

SEQ ID NO: 7978 - protein, 28 aa, Artificial Sequence
  Description of Artificial Sequence: Synthetic peptide
DEEEIRTTNPVATEQYGSVETNDQRGDR

SEQ ID NO: 7979 - protein, 28 aa, Artificial Sequence
  Description of Artificial Sequence: Synthetic peptide
DENEIRTTNPVATECWGSVSTNLQRGNR

SEQ ID NO: 7980 - protein, 29 aa, Artificial Sequence
  Description of Artificial Sequence: Synthetic peptide
DEEEIRTTNPVATEQYGSVSTLNLQQGNE

SEQ ID NO: 7981 - protein, 29 aa, Artificial Sequence
  Description of Artificial Sequence: Synthetic peptide
DAEEIRTTNPVATEQFGSVSTNLQRGNPR

SEQ ID NO: 7982 - protein, 29 aa, Artificial Sequence
  Description of Artificial Sequence: Synthetic peptide
DEEEIRTTNPVATEQYGSCSTDLQREGNR

SEQ ID NO: 7983 - protein, 28 aa, Artificial Sequence
  Description of Artificial Sequence: Synthetic peptide
NEEEVRATNPVATEQYGSVSTNLQRGNR

SEQ ID NO: 7984 - protein, 30 aa, Artificial Sequence
  Description of Artificial Sequence: Synthetic polypeptide
DEEEIRTTNPVATEQYGSVSTNLQRKGEPR

SEQ ID NO: 7985 - protein, 28 aa, Artificial Sequence
  Description of Artificial Sequence: Synthetic peptide
DEEEIRTTNPVATEQYGSVDTNLNRDNR

SEQ ID NO: 7986 - protein, 28 aa, Artificial Sequence
  Description of Artificial Sequence: Synthetic peptide
DEQEIVSTNPVATEQYGSVSTNLQRGNR

SEQ ID NO: 7987 - protein, 28 aa, Artificial Sequence
  Description of Artificial Sequence: Synthetic peptide
DEEEIRTTNPGATEQYGCVSTNFQRGNR

SEQ ID NO: 7988 - protein, 29 aa, Artificial Sequence
  Description of Artificial Sequence: Synthetic peptide
DEEEIRTTNPVATEQYGSVSTGLQTDGNR

SEQ ID NO: 7989 - protein, 28 aa, Artificial Sequence
  Description of Artificial Sequence: Synthetic peptide
DEEEIRTTNPVATEQFGEVSTNEQRGNR

SEQ ID NO: 7990 - protein, 30 aa, Artificial Sequence
  Description of Artificial Sequence: Synthetic polypeptide
DEEEIRTTNPVATEQYGSVETNLVQREGNR

SEQ ID NO: 7991 - protein, 30 aa, Artificial Sequence
  Description of Artificial Sequence: Synthetic polypeptide
DEEEIRTTNPVATEIYGSVSDTNLQDRGNR

SEQ ID NO: 7992 - protein, 28 aa, Artificial Sequence
  Description of Artificial Sequence: Synthetic peptide
DEFEIRTTNPVATEQYGDVSDNLQRGNR

SEQ ID NO: 7993 - protein, 29 aa, Artificial Sequence
  Description of Artificial Sequence: Synthetic peptide
DEEEIATTNPVATEQYGSVDTNLQRGNDR

SEQ ID NO: 7994 - protein, 28 aa, Artificial Sequence
  Description of Artificial Sequence: Synthetic peptide
DEEEIRTTNPVATEQYGSVSANLARGNF

SEQ ID NO: 7995 - protein, 28 aa, Artificial Sequence
  Description of Artificial Sequence: Synthetic peptide
DEEEIRTVNPVATEQYGSVSTDLQRGNN

SEQ ID NO: 7996 - protein, 29 aa, Artificial Sequence
  Description of Artificial Sequence: Synthetic peptide
DEEEIRTTNPVATEQYGSVSTDLQRGNDD

SEQ ID NO: 7997 - protein, 28 aa, Artificial Sequence
  Description of Artificial Sequence: Synthetic peptide
NDEEIRTTNPVATEQYGCVSTNLQRGNR

SEQ ID NO: 7998 - protein, 28 aa, Artificial Sequence
  Description of Artificial Sequence: Synthetic peptide
CESEIRTTNPVATEQYGWVSTNLQRGNR

SEQ ID NO: 7999 - protein, 28 aa, Artificial Sequence
  Description of Artificial Sequence: Synthetic peptide
DEEEIRTTNPVCTEQYGSVSSNLQRGLR

SEQ ID NO: 8000 - protein, 29 aa, Artificial Sequence
  Description of Artificial Sequence: Synthetic peptide
DEEEIRTTNPVATEQYGAVSANNLQRGNR

SEQ ID NO: 8001 - protein, 30 aa, Artificial Sequence
  Description of Artificial Sequence: Synthetic polypeptide
DEEEIRTTNPVATEQYGSVDSTNILQRGER

SEQ ID NO: 8002 - protein, 29 aa, Artificial Sequence
  Description of Artificial Sequence: Synthetic peptide
DEEEIRTTNPVATEQYGSVSTNLQHGEDR

SEQ ID NO: 8003 - protein, 29 aa, Artificial Sequence
  Description of Artificial Sequence: Synthetic peptide
DEEEIRTTNPIATEQFGSVSTNLQRNGNR

SEQ ID NO: 8004 - protein, 29 aa, Artificial Sequence
  Description of Artificial Sequence: Synthetic peptide
DEEPIRTTNPVATEQYGSVSTNLTRGLNR

SEQ ID NO: 8005 - protein, 28 aa, Artificial Sequence
  Description of Artificial Sequence: Synthetic peptide
AEEEIATTNPFATEQYGSVSTNLQRGNR

SEQ ID NO: 8006 - protein, 31 aa, Artificial Sequence
  Description of Artificial Sequence: Synthetic polypeptide
DEEEIRTTNPVATEQYGSVSETNLQRDGNDR

SEQ ID NO: 8007 - protein, 28 aa, Artificial Sequence
  Description of Artificial Sequence: Synthetic peptide
SEEEIRTTNPVATEQYGSVQTNLIRGNR

SEQ ID NO: 8008 - protein, 28 aa, Artificial Sequence
  Description of Artificial Sequence: Synthetic peptide
DEEEIMTTNPVATEQYGSVGTNLQDGNR

SEQ ID NO: 8009 - protein, 29 aa, Artificial Sequence
  Description of Artificial Sequence: Synthetic peptide
DEEEIRTTNPVATEQYGESVSTNDQRGER

SEQ ID NO: 8010 - protein, 29 aa, Artificial Sequence
  Description of Artificial Sequence: Synthetic peptide
DEEEIRTTNPVATEQYGSVSTPLQDGDNR

SEQ ID NO: 8011 - protein, 28 aa, Artificial Sequence
  Description of Artificial Sequence: Synthetic peptide
DEEEIRTTNPVATEQYGSWSTNEQRGNY

SEQ ID NO: 8012 - protein, 28 aa, Artificial Sequence
  Description of Artificial Sequence: Synthetic peptide
DEEEIRTVNPVATEQYGSVDTNLERGNR

SEQ ID NO: 8013 - protein, 28 aa, Artificial Sequence
  Description of Artificial Sequence: Synthetic peptide
KEEEIRTTNPVATEQYGSVSTDLDRGNR

SEQ ID NO: 8014 - protein, 28 aa, Artificial Sequence
  Description of Artificial Sequence: Synthetic peptide
DEEEIAATNPVATENYGSVSTNLQRGNR

SEQ ID NO: 8015 - protein, 30 aa, Artificial Sequence
  Description of Artificial Sequence: Synthetic polypeptide
DEEEIRTTNPVCTEQYGSVSTGNLQTRGNR

SEQ ID NO: 8016 - protein, 28 aa, Artificial Sequence
  Description of Artificial Sequence: Synthetic peptide
DEEEIRTTNPVATEVYGSVSTDEQRGNR

SEQ ID NO: 8017 - protein, 28 aa, Artificial Sequence
  Description of Artificial Sequence: Synthetic peptide
DEEEIRTTNPCATELYGNVSTNLQRGNR

SEQ ID NO: 8018 - protein, 28 aa, Artificial Sequence
  Description of Artificial Sequence: Synthetic peptide
DEEEIRTTNPEATEQYGSISTNLQPGNR

SEQ ID NO: 8019 - protein, 28 aa, Artificial Sequence
  Description of Artificial Sequence: Synthetic peptide
DEEEIRTTNPVATENYGCVSNNLQRGNR

SEQ ID NO: 8020 - protein, 28 aa, Artificial Sequence
  Description of Artificial Sequence: Synthetic peptide
DEHEIATTNPVATEQYGSVSTNIQRGNR

SEQ ID NO: 8021 - protein, 31 aa, Artificial Sequence
  Description of Artificial Sequence: Synthetic polypeptide
DEEEIRTTNPVATEQYGVSVISTNLQRGNNR

SEQ ID NO: 8022 - protein, 28 aa, Artificial Sequence
  Description of Artificial Sequence: Synthetic peptide
DEQEIRCTNPVATEIYGSVSTNLQRGNR

SEQ ID NO: 8023 - protein, 30 aa, Artificial Sequence
  Description of Artificial Sequence: Synthetic polypeptide
DEEEIRTTNPVATEQYGSVSTNGLERGNER

SEQ ID NO: 8024 - protein, 31 aa, Artificial Sequence
  Description of Artificial Sequence: Synthetic polypeptide
DEEEIRTTNPVATEQYGSVSTNLVQRGDNDR

SEQ ID NO: 8025 - protein, 31 aa, Artificial Sequence
  Description of Artificial Sequence: Synthetic polypeptide
DEEEIRTTNPVATEQYGSVSATNGLQRGENR

SEQ ID NO: 8026 - protein, 29 aa, Artificial Sequence
  Description of Artificial Sequence: Synthetic peptide
DEEEIRTTNPVATEQYGSVSTNDERDGNR

SEQ ID NO: 8027 - protein, 30 aa, Artificial Sequence
  Description of Artificial Sequence: Synthetic polypeptide
DEEEIRTTNPVATEQYGSVSTNLQELGNTR

SEQ ID NO: 8028 - protein, 30 aa, Artificial Sequence
  Description of Artificial Sequence: Synthetic polypeptide
DEEEIRTTNPVATEQYGSVDSTDLQRGDNR

SEQ ID NO: 8029 - protein, 28 aa, Artificial Sequence
  Description of Artificial Sequence: Synthetic peptide
DEEEIRTTNPIAYEMYGSVSTNLQRGNR

SEQ ID NO: 8030 - protein, 28 aa, Artificial Sequence
  Description of Artificial Sequence: Synthetic peptide
DEEEIRTTNPVATEQYGSVSTNLQMGEQ

SEQ ID NO: 8031 - protein, 28 aa, Artificial Sequence
  Description of Artificial Sequence: Synthetic peptide
DEEEIRTTNPVAWEQYGSVSTGLYRGNR

SEQ ID NO: 8032 - protein, 28 aa, Artificial Sequence
  Description of Artificial Sequence: Synthetic peptide
DEEMIRTTNPVATEPYGSVSTNLQRGNQ

SEQ ID NO: 8033 - protein, 28 aa, Artificial Sequence
  Description of Artificial Sequence: Synthetic peptide
DEHEIRTTNPVATEQYGSVSTNLQHGNC

SEQ ID NO: 8034 - protein, 28 aa, Artificial Sequence
  Description of Artificial Sequence: Synthetic peptide
DEEEITTTNPTATEQYGSVSENLQRGNR

SEQ ID NO: 8035 - protein, 28 aa, Artificial Sequence
  Description of Artificial Sequence: Synthetic peptide
LEEEIRTTNPVATEQYGEVSMNLQRGNR

SEQ ID NO: 8036 - protein, 30 aa, Artificial Sequence
  Description of Artificial Sequence: Synthetic polypeptide
DEEEIRTTNPVATEQYGSVSTDELQREGNR

SEQ ID NO: 8037 - protein, 28 aa, Artificial Sequence
  Description of Artificial Sequence: Synthetic peptide
DEEEIRTTNPEATEQYGSVSTNLQQGLR

SEQ ID NO: 8038 - protein, 31 aa, Artificial Sequence
  Description of Artificial Sequence: Synthetic polypeptide
DEEEIRTTNPVATEQYGSVSTTNLIQRGINR

SEQ ID NO: 8039 - protein, 29 aa, Artificial Sequence
  Description of Artificial Sequence: Synthetic peptide
DEEEIRTVNPCATEQYGSVSTNLQLRGNR

SEQ ID NO: 8040 - protein, 28 aa, Artificial Sequence
  Description of Artificial Sequence: Synthetic peptide
DENEIAATNPVATEQYGSVSTNLQRGNR

SEQ ID NO: 8041 - protein, 28 aa, Artificial Sequence
  Description of Artificial Sequence: Synthetic peptide
DEEEIRTTNPVSTEQYGTVATNLQRGNR

SEQ ID NO: 8042 - protein, 28 aa, Artificial Sequence
  Description of Artificial Sequence: Synthetic peptide
DEEEIRGTNPVATEMYGTVSTNLQRGNR

SEQ ID NO: 8043 - protein, 28 aa, Artificial Sequence
  Description of Artificial Sequence: Synthetic peptide
DEEEVRTTNPVATEQYGAVSNNLQRGNR

SEQ ID NO: 8044 - protein, 28 aa, Artificial Sequence
  Description of Artificial Sequence: Synthetic peptide
DEEEIRTTNPFATEQYGSVSTNLQVGND

SEQ ID NO: 8045 - protein, 28 aa, Artificial Sequence
  Description of Artificial Sequence: Synthetic peptide
DEEEIRQTNPVATEQYGDVSTNLQRENR

SEQ ID NO: 8046 - protein, 28 aa, Artificial Sequence
  Description of Artificial Sequence: Synthetic peptide
DEEEVRTTNPVSTEQYGVVSTNLQRGNR

SEQ ID NO: 8047 - protein, 28 aa, Artificial Sequence
  Description of Artificial Sequence: Synthetic peptide
DEEEIRTTNPVATEQYGSVSTDLQDGNE

SEQ ID NO: 8048 - protein, 28 aa, Artificial Sequence
  Description of Artificial Sequence: Synthetic peptide
DEEEIRTTNPVATEQYGSVSENLQHGNN

SEQ ID NO: 8049 - protein, 28 aa, Artificial Sequence
  Description of Artificial Sequence: Synthetic peptide
DEEEIRTTNPVATECYGSVSTNLMRGNW

SEQ ID NO: 8050 - protein, 29 aa, Artificial Sequence
  Description of Artificial Sequence: Synthetic peptide
DEEEIRTTNPVATEQYGEVSTNLQNRGNQ

SEQ ID NO: 8051 - protein, 29 aa, Artificial Sequence
  Description of Artificial Sequence: Synthetic peptide
DEEEIRCTNPVATEQYGSVSANLPQRGNR

SEQ ID NO: 8052 - protein, 29 aa, Artificial Sequence
  Description of Artificial Sequence: Synthetic peptide
DEEEIRTTNPVATEQYGIVSTNDQRGENR

SEQ ID NO: 8053 - protein, 29 aa, Artificial Sequence
  Description of Artificial Sequence: Synthetic peptide
DEQEIRTTNPVATEQYGSVSTNLEREGNR

SEQ ID NO: 8054 - protein, 28 aa, Artificial Sequence
  Description of Artificial Sequence: Synthetic peptide
DEEEIATTNPVATEQYGSVSTCLQRGER

SEQ ID NO: 8055 - protein, 29 aa, Artificial Sequence
  Description of Artificial Sequence: Synthetic peptide
DEEEIRTTNPVATEQYGSVSVANLERGNR

SEQ ID NO: 8056 - protein, 31 aa, Artificial Sequence
  Description of Artificial Sequence: Synthetic polypeptide
DEEEIRTTNPVATEQYGSVSSCTNLQCRGNR

SEQ ID NO: 8057 - protein, 28 aa, Artificial Sequence
  Description of Artificial Sequence: Synthetic peptide
DEEEIRTTNPVATEQYGSVDTNLQRGTS

SEQ ID NO: 8058 - protein, 29 aa, Artificial Sequence
  Description of Artificial Sequence: Synthetic peptide
DEEEIRTTNPVATEQYGSVSTTLQERGNM

SEQ ID NO: 8059 - protein, 28 aa, Artificial Sequence
  Description of Artificial Sequence: Synthetic peptide
DEEEIRQTNPVATEQYGSVSENLQRMNR

SEQ ID NO: 8060 - protein, 28 aa, Artificial Sequence
  Description of Artificial Sequence: Synthetic peptide
DDEEIRTTNPVCTEQYGSVATNLQRGNR

SEQ ID NO: 8061 - protein, 29 aa, Artificial Sequence
  Description of Artificial Sequence: Synthetic peptide
DEEEIRTTNPVATEQYGSVDTNLQMRGDR

SEQ ID NO: 8062 - protein, 28 aa, Artificial Sequence
  Description of Artificial Sequence: Synthetic peptide
DEEEIRTTNPVATEQYGSHSTNDQRGER

SEQ ID NO: 8063 - protein, 28 aa, Artificial Sequence
  Description of Artificial Sequence: Synthetic peptide
DEEEIRTTNPVATEQYGSVNTNLQYGNW

SEQ ID NO: 8064 - protein, 30 aa, Artificial Sequence
  Description of Artificial Sequence: Synthetic polypeptide
DEEEIATTNPVATEQYGSVSATNLQERGNR

SEQ ID NO: 8065 - protein, 28 aa, Artificial Sequence
  Description of Artificial Sequence: Synthetic peptide
DDEEIRTTNPVATEQYGSVSDCLQRGNR

SEQ ID NO: 8066 - protein, 28 aa, Artificial Sequence
  Description of Artificial Sequence: Synthetic peptide
DEEEIRTTNPEATEQYGSVSTNLQRGDP

SEQ ID NO: 8067 - protein, 31 aa, Artificial Sequence
  Description of Artificial Sequence: Synthetic polypeptide
DEEEIRTTNPVATEQYGSVSDTNLQRNGENR

SEQ ID NO: 8068 - protein, 30 aa, Artificial Sequence
  Description of Artificial Sequence: Synthetic polypeptide
DEEEIRTTNPVATEQYGSVSTNLDQRGENF

SEQ ID NO: 8069 - protein, 29 aa, Artificial Sequence
  Description of Artificial Sequence: Synthetic peptide
DEEEIVTTNPVATEQYGSVSTNLQQGDNR

SEQ ID NO: 8070 - protein, 28 aa, Artificial Sequence
  Description of Artificial Sequence: Synthetic peptide
DEEEIRTTNPVATEQYGSVETNLQPGER

SEQ ID NO: 8071 - protein, 28 aa, Artificial Sequence
  Description of Artificial Sequence: Synthetic peptide
DEEEISTTNPVATEQYGSVSTNLQSGNF

SEQ ID NO: 8072 - protein, 29 aa, Artificial Sequence
  Description of Artificial Sequence: Synthetic peptide
DEEEIRTTNPVATEQYGSVSITNLQYGND

SEQ ID NO: 8073 - protein, 29 aa, Artificial Sequence
  Description of Artificial Sequence: Synthetic peptide
DEEEIRTTNPVSTEQYGSVSTNGLQRLNR

SEQ ID NO: 8074 - protein, 28 aa, Artificial Sequence
  Description of Artificial Sequence: Synthetic peptide
DEEEIRTTNPVATEQYGSVSTPPDRGNR

SEQ ID NO: 8075 - protein, 30 aa, Artificial Sequence
  Description of Artificial Sequence: Synthetic polypeptide
DEEEIRTTNPDATEQYGSVSETNLQRGENR

SEQ ID NO: 8076 - protein, 28 aa, Artificial Sequence
  Description of Artificial Sequence: Synthetic peptide
GEDEIRTTNPVGTEQYGSVSTNLQRGNR

SEQ ID NO: 8077 - protein, 30 aa, Artificial Sequence
  Description of Artificial Sequence: Synthetic polypeptide
DEEEIRTTNPVATEQYGESVSTINLQVGNR

SEQ ID NO: 8078 - protein, 30 aa, Artificial Sequence
  Description of Artificial Sequence: Synthetic polypeptide
DEEEIRTTNPVATEQYGSVSCTNLQRGNDD

SEQ ID NO: 8079 - protein, 28 aa, Artificial Sequence
  Description of Artificial Sequence: Synthetic peptide
DETEIRTTNPVATEQYGSVSCNLQRGQR

SEQ ID NO: 8080 - protein, 29 aa, Artificial Sequence
  Description of Artificial Sequence: Synthetic peptide
DEEEIRTTNPDATEQYGSVSTNLQMNGNR

SEQ ID NO: 8081 - protein, 29 aa, Artificial Sequence
  Description of Artificial Sequence: Synthetic peptide
DEEEIRTTNPVATEQYGSVSTNLQRDNPT

SEQ ID NO: 8082 - protein, 30 aa, Artificial Sequence
  Description of Artificial Sequence: Synthetic polypeptide
DEEEIRTTNPVATEQYGSVYSTNLQQGVNR

SEQ ID NO: 8083 - protein, 28 aa, Artificial Sequence
  Description of Artificial Sequence: Synthetic peptide
DEEEIRTTNPVATEQYGSVSTNLQAGES

SEQ ID NO: 8084 - protein, 29 aa, Artificial Sequence
  Description of Artificial Sequence: Synthetic peptide
DEQEIRTTNPVATEIYGSVSATNLQRGNR

SEQ ID NO: 8085 - protein, 28 aa, Artificial Sequence
  Description of Artificial Sequence: Synthetic peptide
DEEEIRSTNPVATEVYGSVSTNLNRGNR

SEQ ID NO: 8086 - protein, 29 aa, Artificial Sequence
  Description of Artificial Sequence: Synthetic peptide
DEEEIRTTNPVATEQYGSVCATVLQRGNR

SEQ ID NO: 8087 - protein, 28 aa, Artificial Sequence
  Description of Artificial Sequence: Synthetic peptide
KEEEIRTTNPVATEQYGSVSTNLQLGER

SEQ ID NO: 8088 - protein, 29 aa, Artificial Sequence
  Description of Artificial Sequence: Synthetic peptide
DEEEIRTTNPVATEQYGSVSTDDQDRGNR

SEQ ID NO: 8089 - protein, 28 aa, Artificial Sequence
  Description of Artificial Sequence: Synthetic peptide
DEEEIRTTNPVATEQYGSASTCLQHGNR

SEQ ID NO: 8090 - protein, 30 aa, Artificial Sequence
  Description of Artificial Sequence: Synthetic polypeptide
DEEEIRTTNPVATEQYGSVESTNLQRGDNP

SEQ ID NO: 8091 - protein, 28 aa, Artificial Sequence
  Description of Artificial Sequence: Synthetic peptide
DEEEIRTTNPVATELYGSVSTALQLGNR

SEQ ID NO: 8092 - protein, 28 aa, Artificial Sequence
  Description of Artificial Sequence: Synthetic peptide
DEEEIATTNPFATEQYGSVSTGLQRGNR

SEQ ID NO: 8093 - protein, 28 aa, Artificial Sequence
  Description of Artificial Sequence: Synthetic peptide
DEEEIRTTNPVATEQYGSVSTDGDRGNR

SEQ ID NO: 8094 - protein, 30 aa, Artificial Sequence
  Description of Artificial Sequence: Synthetic polypeptide
DEEEIRTTNPVATEQYGSVSTNEQERGNTR

SEQ ID NO: 8095 - protein, 28 aa, Artificial Sequence
  Description of Artificial Sequence: Synthetic peptide
DEEEIRTTNPVATEQYGSVSTNLQSGES

SEQ ID NO: 8096 - protein, 28 aa, Artificial Sequence
  Description of Artificial Sequence: Synthetic peptide
DEEEIRTTNPVATEQYGSVSTNDQDGER

SEQ ID NO: 8097 - protein, 30 aa, Artificial Sequence
  Description of Artificial Sequence: Synthetic polypeptide
DEEEIRTTNPVATEQYGSVPSTQNLQTGNR

SEQ ID NO: 8098 - protein, 28 aa, Artificial Sequence
  Description of Artificial Sequence: Synthetic peptide
DEREIRTTNPVATEQYGSVSTNEQRGNF

SEQ ID NO: 8099 - protein, 28 aa, Artificial Sequence
  Description of Artificial Sequence: Synthetic peptide
DEEEIRTTNPVATEQYGSVSTDLQVGNA

SEQ ID NO: 8100 - protein, 30 aa, Artificial Sequence
  Description of Artificial Sequence: Synthetic polypeptide
DEEEIRTTNPVATEQYGSVSTNLQDRGENQ

SEQ ID NO: 8101 - protein, 28 aa, Artificial Sequence
  Description of Artificial Sequence: Synthetic peptide
DSEEIRTTNPVAIEQYGSVSTNLQDGNR

SEQ ID NO: 8102 - protein, 30 aa, Artificial Sequence
  Description of Artificial Sequence: Synthetic polypeptide
DEEEIRTTNPVATEQYGSVSTENLQREGNW

SEQ ID NO: 8103 - protein, 28 aa, Artificial Sequence
  Description of Artificial Sequence: Synthetic peptide
DEEEIRTTNPVATEQYGSVETPLDRGNR

SEQ ID NO: 8104 - protein, 29 aa, Artificial Sequence
  Description of Artificial Sequence: Synthetic peptide
DEEEIRTTNPVATEQYGSVSTNLENGNDR

SEQ ID NO: 8105 - protein, 28 aa, Artificial Sequence
  Description of Artificial Sequence: Synthetic peptide
DEEEIRTTNPVATAQYGSVSTNLQHGNC

SEQ ID NO: 8106 - protein, 28 aa, Artificial Sequence
  Description of Artificial Sequence: Synthetic peptide
DEEEIRTTNPVATEQYGSVSTNLQLGEM

SEQ ID NO: 8107 - protein, 30 aa, Artificial Sequence
  Description of Artificial Sequence: Synthetic polypeptide
DEEEIRTTNPVATEQYGSVSTANLQHGNTR

SEQ ID NO: 8108 - protein, 28 aa, Artificial Sequence
  Description of Artificial Sequence: Synthetic peptide
DEEEIRTTNPVATEQYGSVSTNLQEGEV

SEQ ID NO: 8109 - protein, 28 aa, Artificial Sequence
  Description of Artificial Sequence: Synthetic peptide
DEEEIRTTNPDATAQYGSVSTNLQRGND

SEQ ID NO: 8110 - protein, 28 aa, Artificial Sequence
  Description of Artificial Sequence: Synthetic peptide
DEEEIRTTNPFATEQYGSVSTNDQRGER

SEQ ID NO: 8111 - protein, 28 aa, Artificial Sequence
  Description of Artificial Sequence: Synthetic peptide
DENEIRTTNPVSTEQWGSVSTNLQRGNR

SEQ ID NO: 8112 - protein, 30 aa, Artificial Sequence
  Description of Artificial Sequence: Synthetic polypeptide
DEEEIRTTNPVATELYGSVSATNLQREGNR

SEQ ID NO: 8113 - protein, 30 aa, Artificial Sequence
  Description of Artificial Sequence: Synthetic polypeptide
MEEEIRTTNPVATEQYGSVSTNLQREGNDR

SEQ ID NO: 8114 - protein, 30 aa, Artificial Sequence
  Description of Artificial Sequence: Synthetic polypeptide
DEEEIRTTNPVATEQYGSVSCTNLQRGNDM

SEQ ID NO: 8115 - protein, 29 aa, Artificial Sequence
  Description of Artificial Sequence: Synthetic peptide
DEEEIRTTNPVATEQYGDVSTMDLQRGNR

SEQ ID NO: 8116 - protein, 29 aa, Artificial Sequence
  Description of Artificial Sequence: Synthetic peptide
DEEEIRTTNPTATEQYGSVSTMNLQRGNA

SEQ ID NO: 8117 - protein, 28 aa, Artificial Sequence
  Description of Artificial Sequence: Synthetic peptide
DEEEIRTTNPVAWEQYGSVHTNLQRGNV

SEQ ID NO: 8118 - protein, 28 aa, Artificial Sequence
  Description of Artificial Sequence: Synthetic peptide
DEEEIRTTNPVATEQYGSVSTDLERGNF

SEQ ID NO: 8119 - protein, 28 aa, Artificial Sequence
  Description of Artificial Sequence: Synthetic peptide
DEEEIRTTNPVATEQYGSVSTNLQEGDD

SEQ ID NO: 8120 - protein, 29 aa, Artificial Sequence
  Description of Artificial Sequence: Synthetic peptide
DEEEIRTTNPTATEQYGSVSTNEQDRGNR

SEQ ID NO: 8121 - protein, 28 aa, Artificial Sequence
  Description of Artificial Sequence: Synthetic peptide
DEEEIRTTNPVATEQYGSVSENLQRGDA

SEQ ID NO: 8122 - protein, 28 aa, Artificial Sequence
  Description of Artificial Sequence: Synthetic peptide
DEEEIRTTNPVATEQYGSVDTGLQRGDR

SEQ ID NO: 8123 - protein, 29 aa, Artificial Sequence
  Description of Artificial Sequence: Synthetic peptide
DEEEIRTTNPVATEQYGSVSMNLQEHGNR

SEQ ID NO: 8124 - protein, 30 aa, Artificial Sequence
  Description of Artificial Sequence: Synthetic polypeptide
DEELIRTTNPVATEQYGSVSTNLPQRVGNR

SEQ ID NO: 8125 - protein, 28 aa, Artificial Sequence
  Description of Artificial Sequence: Synthetic peptide
DEEEIRTTNPVATEQYGSVSEELFRGNR

SEQ ID NO: 8126 - protein, 30 aa, Artificial Sequence
  Description of Artificial Sequence: Synthetic polypeptide
DEEEIRTTNPVCTEQYGSVSTNLQERGNDR

SEQ ID NO: 8127 - protein, 28 aa, Artificial Sequence
  Description of Artificial Sequence: Synthetic peptide
DEFEIRTTNPVASEQYGSVSTNLQRGNT

SEQ ID NO: 8128 - protein, 28 aa, Artificial Sequence
  Description of Artificial Sequence: Synthetic peptide
DEEEIRTTNPVATEQYGSVSTDLQVGNM

SEQ ID NO: 8129 - protein, 28 aa, Artificial Sequence
  Description of Artificial Sequence: Synthetic peptide
DEEEIRTTNPDATEQYGDVSTNLQAGNR

SEQ ID NO: 8130 - protein, 29 aa, Artificial Sequence
  Description of Artificial Sequence: Synthetic peptide
DEEEIRTTNPVATEQYGSVSTDLQEIGNR

SEQ ID NO: 8131 - protein, 28 aa, Artificial Sequence
  Description of Artificial Sequence: Synthetic peptide
DEEEIRTTNPVATEQYGSVDTDLQQGNR

SEQ ID NO: 8132 - protein, 30 aa, Artificial Sequence
  Description of Artificial Sequence: Synthetic polypeptide
DEEEIRTTNPVATEQYGSVGSTNLQRGENG

SEQ ID NO: 8133 - protein, 28 aa, Artificial Sequence
  Description of Artificial Sequence: Synthetic peptide
DDEEIRTTNPVATEQYGSASTNLQRGPR

SEQ ID NO: 8134 - protein, 28 aa, Artificial Sequence
  Description of Artificial Sequence: Synthetic peptide
DEEEIRTTNPVATAQYGSVSTNLGFGNR

SEQ ID NO: 8135 - protein, 28 aa, Artificial Sequence
  Description of Artificial Sequence: Synthetic peptide
DEEEIRTTNPVATEQYGSVSTGLQWGNT

SEQ ID NO: 8136 - protein, 31 aa, Artificial Sequence
  Description of Artificial Sequence: Synthetic polypeptide
DEEEIRTTNPVATEQYGSVSTNLQDREGNTR

SEQ ID NO: 8137 - protein, 28 aa, Artificial Sequence
  Description of Artificial Sequence: Synthetic peptide
DEEEVRTTNPVASEQYGSVSTNLQFGNR

SEQ ID NO: 8138 - protein, 28 aa, Artificial Sequence
  Description of Artificial Sequence: Synthetic peptide
QEEEIRTTNPVATEQYGSASTNLQRGGR

SEQ ID NO: 8139 - protein, 28 aa, Artificial Sequence
  Description of Artificial Sequence: Synthetic peptide
DEEEIRTTNPDATEQYGSVSTNLDPGNR

SEQ ID NO: 8140 - protein, 29 aa, Artificial Sequence
  Description of Artificial Sequence: Synthetic peptide
DEEEIRTTNPIATEQYGSVDSTNLQRGNI

SEQ ID NO: 8141 - protein, 30 aa, Artificial Sequence
  Description of Artificial Sequence: Synthetic polypeptide
DEEEIRTTNPEATEQYGSVSTNLQRDGLNR

SEQ ID NO: 8142 - protein, 29 aa, Artificial Sequence
  Description of Artificial Sequence: Synthetic peptide
DEEEIRTTNPVATEQYGSVSTNLQDGNDS

SEQ ID NO: 8143 - protein, 29 aa, Artificial Sequence
  Description of Artificial Sequence: Synthetic peptide
DEEEIRTTNPVATEQYGSVECTNLQRGER

SEQ ID NO: 8144 - protein, 31 aa, Artificial Sequence
  Description of Artificial Sequence: Synthetic polypeptide
DEEEIRTTNPVATEQYGMSVSTNGLQRGNDR

SEQ ID NO: 8145 - protein, 28 aa, Artificial Sequence
  Description of Artificial Sequence: Synthetic peptide
DEEEINTTNPVATEQYGSVCTNLQRLNR

SEQ ID NO: 8146 - protein, 30 aa, Artificial Sequence
  Description of Artificial Sequence: Synthetic polypeptide
DEEEIRTTNPVATEQYGSVYSTNLQLRGNV

SEQ ID NO: 8147 - protein, 28 aa, Artificial Sequence
  Description of Artificial Sequence: Synthetic peptide
DEEEIRTTNPFATEQYGSVSEGLQRGNR

SEQ ID NO: 8148 - protein, 30 aa, Artificial Sequence
  Description of Artificial Sequence: Synthetic polypeptide
DEEEIRTTNPVATEQYGSVSTNLQCRGNNG

SEQ ID NO: 8149 - protein, 29 aa, Artificial Sequence
  Description of Artificial Sequence: Synthetic peptide
DEEEIRTTNPVATEQYGSVSWTNLQAGNF

SEQ ID NO: 8150 - protein, 28 aa, Artificial Sequence
  Description of Artificial Sequence: Synthetic peptide
GENEIRTTNPVATEQYGSVSTDLQRGNR

SEQ ID NO: 8151 - protein, 30 aa, Artificial Sequence
  Description of Artificial Sequence: Synthetic polypeptide
DEEEIRTTNPVATEQYGSVDSTNLQRMMNR

SEQ ID NO: 8152 - protein, 28 aa, Artificial Sequence
  Description of Artificial Sequence: Synthetic peptide
DEEEIRQTNPVATEQYGSVSTNDQRGNA

SEQ ID NO: 8153 - protein, 29 aa, Artificial Sequence
  Description of Artificial Sequence: Synthetic peptide
DECEIYTTNPVATEQYGSVSATNLQRGNR

SEQ ID NO: 8154 - protein, 28 aa, Artificial Sequence
  Description of Artificial Sequence: Synthetic peptide
DEEEIRTTNPVATDIYGSVMTNLQRGNR

SEQ ID NO: 8155 - protein, 28 aa, Artificial Sequence
  Description of Artificial Sequence: Synthetic peptide
DEQEIATTNPVATEQYGSVATNLQRGNR

SEQ ID NO: 8156 - protein, 31 aa, Artificial Sequence
  Description of Artificial Sequence: Synthetic polypeptide
DEEEIRTTNPVATEQYGSVSMTNLQLRGINR

SEQ ID NO: 8157 - protein, 30 aa, Artificial Sequence
  Description of Artificial Sequence: Synthetic polypeptide
DEEEIRTTNPVATEQYGSVCSTWNLQRGNW

SEQ ID NO: 8158 - protein, 29 aa, Artificial Sequence
  Description of Artificial Sequence: Synthetic peptide
DEEEITTTNPVATEQYGSVSTALQREGNR

SEQ ID NO: 8159 - protein, 28 aa, Artificial Sequence
  Description of Artificial Sequence: Synthetic peptide
DEEEIRTTNPVATEQYGSVETELQRGNE

SEQ ID NO: 8160 - protein, 29 aa, Artificial Sequence
  Description of Artificial Sequence: Synthetic peptide
GEEEIRTTNPVATEQYGCVSTNGLQRGNR

SEQ ID NO: 8161 - protein, 28 aa, Artificial Sequence
  Description of Artificial Sequence: Synthetic peptide
DEEEIRTTNPFATEQYGSVSTGLQRGND

SEQ ID NO: 8162 - protein, 31 aa, Artificial Sequence
  Description of Artificial Sequence: Synthetic polypeptide
DEEEIRTTNPVATEQYGESVSTANLQRGNHR

SEQ ID NO: 8163 - protein, 30 aa, Artificial Sequence
  Description of Artificial Sequence: Synthetic polypeptide
DEEEIRTTNPVATEQYGSVSDTNLQRGENY

SEQ ID NO: 8164 - protein, 28 aa, Artificial Sequence
  Description of Artificial Sequence: Synthetic peptide
DEEEIRTTNPCAHEIYGSVSTNLQRGNR

SEQ ID NO: 8165 - protein, 29 aa, Artificial Sequence
  Description of Artificial Sequence: Synthetic peptide
DEEEIRTTNPVATEQYGSVSTNPLQRGEV

SEQ ID NO: 8166 - protein, 28 aa, Artificial Sequence
  Description of Artificial Sequence: Synthetic peptide
NEEEIRTTNPVATEQYGDVSTLLQRGNR

SEQ ID NO: 8167 - protein, 30 aa, Artificial Sequence
  Description of Artificial Sequence: Synthetic polypeptide
DEEEIRTTNPVATEQYGSVSCTNLIQRGNP

SEQ ID NO: 8168 - protein, 29 aa, Artificial Sequence
  Description of Artificial Sequence: Synthetic peptide
DEENIRTTNPVATEQYGSVSTNLERAGNR

SEQ ID NO: 8169 - protein, 29 aa, Artificial Sequence
  Description of Artificial Sequence: Synthetic peptide
DEEEIRTTNPVATEQYGSVSTNVLQDGND

SEQ ID NO: 8170 - protein, 28 aa, Artificial Sequence
  Description of Artificial Sequence: Synthetic peptide
DEEEIRTTNPDATEQYGSVSTNLQRGEW

SEQ ID NO: 8171 - protein, 29 aa, Artificial Sequence
  Description of Artificial Sequence: Synthetic peptide
DEEEIRTTNPVATEQYGSVSSTGLQDGNR

SEQ ID NO: 8172 - protein, 30 aa, Artificial Sequence
  Description of Artificial Sequence: Synthetic polypeptide
DEEEIRCTNPVATEQYGSVSTNLQVRGNPR

SEQ ID NO: 8173 - protein, 28 aa, Artificial Sequence
  Description of Artificial Sequence: Synthetic peptide
DEEEIRTTNPVATEQYGSVSTDLQLGNQ

SEQ ID NO: 8174 - protein, 30 aa, Artificial Sequence
  Description of Artificial Sequence: Synthetic polypeptide
DEEEIRTTNPVATEQYGSVSTNGLQMGNFR

SEQ ID NO: 8175 - protein, 30 aa, Artificial Sequence
  Description of Artificial Sequence: Synthetic polypeptide
DEEEIRTTNPVATELYGSVISTNLQDRGNR

SEQ ID NO: 8176 - protein, 28 aa, Artificial Sequence
  Description of Artificial Sequence: Synthetic peptide
DEEEIRTTNPFATEQYGSVSTGLERGNR

SEQ ID NO: 8177 - protein, 28 aa, Artificial Sequence
  Description of Artificial Sequence: Synthetic peptide
DEEEIRSTNPVATEQWGSTSTNLQRGNR

SEQ ID NO: 8178 - protein, 28 aa, Artificial Sequence
  Description of Artificial Sequence: Synthetic peptide
DEDEIRTTNPVATEQYGSVSTNLQAGNA

SEQ ID NO: 8179 - protein, 28 aa, Artificial Sequence
  Description of Artificial Sequence: Synthetic peptide
DEEEIRTTNPVATEQYGDVSTNLQIGER

SEQ ID NO: 8180 - protein, 29 aa, Artificial Sequence
  Description of Artificial Sequence: Synthetic peptide
DEEEIRTTNPVATEQYGSVSTNLQENGNS

SEQ ID NO: 8181 - protein, 29 aa, Artificial Sequence
  Description of Artificial Sequence: Synthetic peptide
DEEEIRTTNPVATEQYGSVSTNLQQGDNQ

SEQ ID NO: 8182 - protein, 28 aa, Artificial Sequence
  Description of Artificial Sequence: Synthetic peptide
LEEEIRTTNPVATEQYGEVSENLQRGNR

SEQ ID NO: 8183 - protein, 30 aa, Artificial Sequence
  Description of Artificial Sequence: Synthetic polypeptide
DEEEIRTTNPDATEQYGSVSDTNLQRGENR

SEQ ID NO: 8184 - protein, 29 aa, Artificial Sequence
  Description of Artificial Sequence: Synthetic peptide
DEEELRTTNPVATEQYGSVSTNLGNRGNR

SEQ ID NO: 8185 - protein, 28 aa, Artificial Sequence
  Description of Artificial Sequence: Synthetic peptide
DEEEIRCVNPVATEQYGSVSTNLQRGNE

SEQ ID NO: 8186 - protein, 29 aa, Artificial Sequence
  Description of Artificial Sequence: Synthetic peptide
DEEEIRTTNPVATEQYGSVDTNLQEFGNR

SEQ ID NO: 8187 - protein, 28 aa, Artificial Sequence
  Description of Artificial Sequence: Synthetic peptide
DEEEIRCTNPVATEVYGTVSTNLQRGNR

SEQ ID NO: 8188 - protein, 29 aa, Artificial Sequence
  Description of Artificial Sequence: Synthetic peptide
DEEEIRTTNPVASEQYGSVSTNLQLEGNR

SEQ ID NO: 8189 - protein, 28 aa, Artificial Sequence
  Description of Artificial Sequence: Synthetic peptide
DEEEIRTTNPVATEQYGSVSTDLQQGNS

SEQ ID NO: 8190 - protein, 28 aa, Artificial Sequence
  Description of Artificial Sequence: Synthetic peptide
DEELIRTTNPVATEQYGSVSTNDQWGNR

SEQ ID NO: 8191 - protein, 30 aa, Artificial Sequence
  Description of Artificial Sequence: Synthetic polypeptide
DEMEIRTTNPVATEQYGSVSTNDLQRGNFR

SEQ ID NO: 8192 - protein, 28 aa, Artificial Sequence
  Description of Artificial Sequence: Synthetic peptide
DEEEIRTTNPFATECYGSVSTNLQRENR

SEQ ID NO: 8193 - protein, 28 aa, Artificial Sequence
  Description of Artificial Sequence: Synthetic peptide
DEEEIRTTNPVATEQYGSVETNDQRGNF

SEQ ID NO: 8194 - protein, 28 aa, Artificial Sequence
  Description of Artificial Sequence: Synthetic peptide
DENEIRATNPVATEVYGSVSTNLQRGNR

SEQ ID NO: 8195 - protein, 28 aa, Artificial Sequence
  Description of Artificial Sequence: Synthetic peptide
DEEEIRTTNPVATEQWGDVHTNLQRGNR

SEQ ID NO: 8196 - protein, 28 aa, Artificial Sequence
  Description of Artificial Sequence: Synthetic peptide
DEEEIRTTNPVATEQYGSDSTNLQWGER

SEQ ID NO: 8197 - protein, 29 aa, Artificial Sequence
  Description of Artificial Sequence: Synthetic peptide
DEEEIRTTNPVATEQYGSVSTCLDRTGNR

SEQ ID NO: 8198 - protein, 29 aa, Artificial Sequence
  Description of Artificial Sequence: Synthetic peptide
DEEEIRTTNPVATEQYGSVSTNGPDRGNR

SEQ ID NO: 8199 - protein, 28 aa, Artificial Sequence
  Description of Artificial Sequence: Synthetic peptide
DEEEIRTTNPEATEQYGSVSTNLQRGDL

SEQ ID NO: 8200 - protein, 28 aa, Artificial Sequence
  Description of Artificial Sequence: Synthetic peptide
DEECIRTTNPVATEQYGSWSTNLQRGER

SEQ ID NO: 8201 - protein, 28 aa, Artificial Sequence
  Description of Artificial Sequence: Synthetic peptide
DAEEIRTTNPVATEQYGSVSTNLDRGER

SEQ ID NO: 8202 - protein, 28 aa, Artificial Sequence
  Description of Artificial Sequence: Synthetic peptide
SEEEIRTTNPEATEQYGSVSTNLQRGNI

SEQ ID NO: 8203 - protein, 29 aa, Artificial Sequence
  Description of Artificial Sequence: Synthetic peptide
DEQEIRTTNPVATEQYGCVSATNLQRGNR

SEQ ID NO: 8204 - protein, 28 aa, Artificial Sequence
  Description of Artificial Sequence: Synthetic peptide
DEEEIRTTNPVATEVYGSVSTPMQRGNR

SEQ ID NO: 8205 - protein, 28 aa, Artificial Sequence
  Description of Artificial Sequence: Synthetic peptide
DEHEIVTTNPVATEQYGSVSTNLQRGTR

SEQ ID NO: 8206 - protein, 28 aa, Artificial Sequence
  Description of Artificial Sequence: Synthetic peptide
QDEEIRTTNPVATEQYGSVSNNLQRGNR

SEQ ID NO: 8207 - protein, 28 aa, Artificial Sequence
  Description of Artificial Sequence: Synthetic peptide
DDEEISTTNPVCTEQYGSVSTNLQRGNR

SEQ ID NO: 8208 - protein, 29 aa, Artificial Sequence
  Description of Artificial Sequence: Synthetic peptide
DEEEIRTTNPVATEQYGSVSTNLQENGNI

SEQ ID NO: 8209 - protein, 28 aa, Artificial Sequence
  Description of Artificial Sequence: Synthetic peptide
DEEEVRTTNPIATEQYGVVSTNLQRGNR

SEQ ID NO: 8210 - protein, 28 aa, Artificial Sequence
  Description of Artificial Sequence: Synthetic peptide
DEEEIRTTNPDATEQYGSVATNLQRGND

SEQ ID NO: 8211 - protein, 28 aa, Artificial Sequence
  Description of Artificial Sequence: Synthetic peptide
DEEEIRTTNPVATEQWGIVDTNLQRGNR

SEQ ID NO: 8212 - protein, 31 aa, Artificial Sequence
  Description of Artificial Sequence: Synthetic polypeptide
DEEEIRTTNPVATEQYGSVESTNGLQRDGNR

SEQ ID NO: 8213 - protein, 28 aa, Artificial Sequence
  Description of Artificial Sequence: Synthetic peptide
DEEEIRTTNPVATEIYGTVSTNLQRGTR

SEQ ID NO: 8214 - protein, 28 aa, Artificial Sequence
  Description of Artificial Sequence: Synthetic peptide
DEEEIRQTNPVATELYGSVSTNLQQGNR

SEQ ID NO: 8215 - protein, 28 aa, Artificial Sequence
  Description of Artificial Sequence: Synthetic peptide
DEVEIRTTNPVATEQYGEVSTNLQRGNC

SEQ ID NO: 8216 - protein, 28 aa, Artificial Sequence
  Description of Artificial Sequence: Synthetic peptide
DEEEIRTTNPVATEQYGSVSTNLQIGEA

SEQ ID NO: 8217 - protein, 30 aa, Artificial Sequence
  Description of Artificial Sequence: Synthetic polypeptide
DEEEIRTTNPVATEQYGSVSTTNLQVGNDR

SEQ ID NO: 8218 - protein, 29 aa, Artificial Sequence
  Description of Artificial Sequence: Synthetic peptide
DEEEIRTTNPVATEQYGSVSTDLQRGNDQ

SEQ ID NO: 8219 - protein, 28 aa, Artificial Sequence
  Description of Artificial Sequence: Synthetic peptide
DEEEVRTTNPVATEQYGSVSTNDDRGNR

SEQ ID NO: 8220 - protein, 30 aa, Artificial Sequence
  Description of Artificial Sequence: Synthetic polypeptide
DEEEIRTTNPVATEQYWGSVSTNLQARGER

SEQ ID NO: 8221 - protein, 30 aa, Artificial Sequence
  Description of Artificial Sequence: Synthetic polypeptide
DEEEIRTTNPVATEQYGSVSTNLQLKGVNR

SEQ ID NO: 8222 - protein, 29 aa, Artificial Sequence
  Description of Artificial Sequence: Synthetic peptide
DEEEIRTTNPDATEQYGSVSTNLQRGEDR

SEQ ID NO: 8223 - protein, 28 aa, Artificial Sequence
  Description of Artificial Sequence: Synthetic peptide
DEGEIRTTNPVAWEQYGSVSTNLQRGNG

SEQ ID NO: 8224 - protein, 28 aa, Artificial Sequence
  Description of Artificial Sequence: Synthetic peptide
DEEEIRTTNPVATEQYGSSSTNLQQGNS

SEQ ID NO: 8225 - protein, 29 aa, Artificial Sequence
  Description of Artificial Sequence: Synthetic peptide
DEEEIRTTNPFATEQYGSVSTNLDLRGNR

SEQ ID NO: 8226 - protein, 29 aa, Artificial Sequence
  Description of Artificial Sequence: Synthetic peptide
DEEEIRTTNPVATTQYGSVSTNLQQFGNR

SEQ ID NO: 8227 - protein, 28 aa, Artificial Sequence
  Description of Artificial Sequence: Synthetic peptide
DEEEIRCTNPVATEMYGVVSTNLQRGNR

SEQ ID NO: 8228 - protein, 28 aa, Artificial Sequence
  Description of Artificial Sequence: Synthetic peptide
DENEIVTTNPVATEQYGWVSTNLQRGNR

SEQ ID NO: 8229 - protein, 30 aa, Artificial Sequence
  Description of Artificial Sequence: Synthetic polypeptide
DEEEIRTTNPVATEQYGSVSTPNLQIRGER

SEQ ID NO: 8230 - protein, 28 aa, Artificial Sequence
  Description of Artificial Sequence: Synthetic peptide
DEEEIRTTNPVATECYGSVDTNLQIGNR

SEQ ID NO: 8231 - protein, 28 aa, Artificial Sequence
  Description of Artificial Sequence: Synthetic peptide
DEEEIRTTNPVATEQYGSVSTNLQTGES

SEQ ID NO: 8232 - protein, 28 aa, Artificial Sequence
  Description of Artificial Sequence: Synthetic peptide
DEEEIRTTNPVATEQYGSVSTNLQGGEN

SEQ ID NO: 8233 - protein, 28 aa, Artificial Sequence
  Description of Artificial Sequence: Synthetic peptide
AEEEIRQTNPVATEQYGSVSTNLQRGND

SEQ ID NO: 8234 - protein, 30 aa, Artificial Sequence
  Description of Artificial Sequence: Synthetic polypeptide
DEEEIRTTNPVATEQYGSVSCTDLQQRGNR

SEQ ID NO: 8235 - protein, 30 aa, Artificial Sequence
  Description of Artificial Sequence: Synthetic polypeptide
DEEEIRTTNPVATEQYGSVSTNLEDRNGNR

SEQ ID NO: 8236 - protein, 28 aa, Artificial Sequence
  Description of Artificial Sequence: Synthetic peptide
NEEMIRTTNPVATEQYGSVSTNDQRGNR

SEQ ID NO: 8237 - protein, 29 aa, Artificial Sequence
  Description of Artificial Sequence: Synthetic peptide
DEEEIRTTNPVATEQYGSVETPNLDRGNR

SEQ ID NO: 8238 - protein, 30 aa, Artificial Sequence
  Description of Artificial Sequence: Synthetic polypeptide
DEEEIRTTNPVAWEQYGSVYSFTNLQRGNR

SEQ ID NO: 8239 - protein, 28 aa, Artificial Sequence
  Description of Artificial Sequence: Synthetic peptide
DDEEIRTTNPVAYEQYGSVSTNLQRPNR

SEQ ID NO: 8240 - protein, 31 aa, Artificial Sequence
  Description of Artificial Sequence: Synthetic polypeptide
DEEEIRTTNPVATEQYGSVSTNLQEREGNDR

SEQ ID NO: 8241 - protein, 28 aa, Artificial Sequence
  Description of Artificial Sequence: Synthetic peptide
DEEEIRTTNPDATEQYGSVSTNLQPGER

SEQ ID NO: 8242 - protein, 28 aa, Artificial Sequence
  Description of Artificial Sequence: Synthetic peptide
DEGEIRATNPVATEQYGSVSTNLQRGDR

SEQ ID NO: 8243 - protein, 29 aa, Artificial Sequence
  Description of Artificial Sequence: Synthetic peptide
CEEEIRTTNPVATEQYGSVSTNLNRGNVR

SEQ ID NO: 8244 - protein, 30 aa, Artificial Sequence
  Description of Artificial Sequence: Synthetic polypeptide
DEEEIRTTNPVATEQYGSVSTNLQDRGNDL

SEQ ID NO: 8245 - protein, 28 aa, Artificial Sequence
  Description of Artificial Sequence: Synthetic peptide
AEMEIRTTNPVATEQYGSVSTNLQRVNR

SEQ ID NO: 8246 - protein, 28 aa, Artificial Sequence
  Description of Artificial Sequence: Synthetic peptide
DEEEVRTTNPVCTEQYGSVSTNLQRPNR

SEQ ID NO: 8247 - protein, 31 aa, Artificial Sequence
  Description of Artificial Sequence: Synthetic polypeptide
DEEEIRTTNPVATEQYGSYVESTNPLQRGNR

SEQ ID NO: 8248 - protein, 28 aa, Artificial Sequence
  Description of Artificial Sequence: Synthetic peptide
DEECIRTTNPVATEQYGSVETNDQRGNR

SEQ ID NO: 8249 - protein, 28 aa, Artificial Sequence
  Description of Artificial Sequence: Synthetic peptide
DEEEIRTTNPVATLQYGSVSTNLQVGNP

SEQ ID NO: 8250 - protein, 28 aa, Artificial Sequence
  Description of Artificial Sequence: Synthetic peptide
DEEPIRTTNPVATEQYGSVSTHLQRGDR

SEQ ID NO: 8251 - protein, 28 aa, Artificial Sequence
  Description of Artificial Sequence: Synthetic peptide
DEEEIRTTNPVATEQYGSVETNDQGGNR

SEQ ID NO: 8252 - protein, 30 aa, Artificial Sequence
  Description of Artificial Sequence: Synthetic polypeptide
DEEEIRTTNPTATEQYGSVSTANLQREGNR

SEQ ID NO: 8253 - protein, 30 aa, Artificial Sequence
  Description of Artificial Sequence: Synthetic polypeptide
DEEEIRTTNPVATEQYGSSTVETNLQRGNR

SEQ ID NO: 8254 - protein, 28 aa, Artificial Sequence
  Description of Artificial Sequence: Synthetic peptide
DEEEIRTVNPVATEQYGSVSTNLQNGER

SEQ ID NO: 8255 - protein, 29 aa, Artificial Sequence
  Description of Artificial Sequence: Synthetic peptide
DEEEIVTTNPVATEQYGSVSTNLQLGNDR

SEQ ID NO: 8256 - protein, 30 aa, Artificial Sequence
  Description of Artificial Sequence: Synthetic polypeptide
DEEEIRTTNPVATEQYGSVSTNLQREGNDF

SEQ ID NO: 8257 - protein, 30 aa, Artificial Sequence
  Description of Artificial Sequence: Synthetic polypeptide
AEEEIRTTNPVATEQYGSVSTVNNLQRGNR

SEQ ID NO: 8258 - protein, 30 aa, Artificial Sequence
  Description of Artificial Sequence: Synthetic polypeptide
DEEEIRTTNPVATEQYGVSVSTNLQRGNDS

SEQ ID NO: 8259 - protein, 29 aa, Artificial Sequence
  Description of Artificial Sequence: Synthetic peptide
DEEEIRCTNPVATEQYGSVSTNLQYLGNR

SEQ ID NO: 8260 - protein, 28 aa, Artificial Sequence
  Description of Artificial Sequence: Synthetic peptide
DEEEIRGTNPVATEQYGCVSTNLQRGTR

SEQ ID NO: 8261 - protein, 28 aa, Artificial Sequence
  Description of Artificial Sequence: Synthetic peptide
DEEEIRTTNPVATKQYGSVSTNLQLGNH

SEQ ID NO: 8262 - protein, 29 aa, Artificial Sequence
  Description of Artificial Sequence: Synthetic peptide
DEEEIRTTNPVATEQYGSVSTNPLDYGNR

SEQ ID NO: 8263 - protein, 28 aa, Artificial Sequence
  Description of Artificial Sequence: Synthetic peptide
YEEEIVTTNPVATEQYGSVSTNLERGNR

SEQ ID NO: 8264 - protein, 28 aa, Artificial Sequence
  Description of Artificial Sequence: Synthetic peptide
DEEEIRTTNPVATEQWGIVSTNLMRGNR

SEQ ID NO: 8265 - protein, 28 aa, Artificial Sequence
  Description of Artificial Sequence: Synthetic peptide
DEEEIRTTNPEATEQYGSVSTNLQAGDR

SEQ ID NO: 8266 - protein, 28 aa, Artificial Sequence
  Description of Artificial Sequence: Synthetic peptide
DEEEIRPTNPVATELYGSVSTNLERGNR

SEQ ID NO: 8267 - protein, 28 aa, Artificial Sequence
  Description of Artificial Sequence: Synthetic peptide
DEEEIRTTNPVATEQWGSVSTNLQTGNV

SEQ ID NO: 8268 - protein, 29 aa, Artificial Sequence
  Description of Artificial Sequence: Synthetic peptide
DEEEIRTTNPVATEQYGSVSETELQRGND

SEQ ID NO: 8269 - protein, 29 aa, Artificial Sequence
  Description of Artificial Sequence: Synthetic peptide
DEEEIRTTNPVATEQYGSVSTMNLQAGPR

SEQ ID NO: 8270 - protein, 29 aa, Artificial Sequence
  Description of Artificial Sequence: Synthetic peptide
DEEEIRTTNPVATECYGSVSTNLQERGNI

SEQ ID NO: 8271 - protein, 29 aa, Artificial Sequence
  Description of Artificial Sequence: Synthetic peptide
DEEEIRTTNPDATEQYGSVSTGLVQRGNR

SEQ ID NO: 8272 - protein, 28 aa, Artificial Sequence
  Description of Artificial Sequence: Synthetic peptide
DENEIRTTNPVATEQYGVVSTNGQRGNR

SEQ ID NO: 8273 - protein, 29 aa, Artificial Sequence
  Description of Artificial Sequence: Synthetic peptide
DEEEIRTTNPVATEQYGVVSTMNLTRGNR

SEQ ID NO: 8274 - protein, 29 aa, Artificial Sequence
  Description of Artificial Sequence: Synthetic peptide
DEEEIRTTNPVATEQYGSVSCTDLQRGNY

SEQ ID NO: 8275 - protein, 28 aa, Artificial Sequence
  Description of Artificial Sequence: Synthetic peptide
DPEEIRTTNPVATEQYGSVSTNLDRGER

SEQ ID NO: 8276 - protein, 29 aa, Artificial Sequence
  Description of Artificial Sequence: Synthetic peptide
DEEEIRTTNPIATEQYGSVSTNLQFRGND

SEQ ID NO: 8277 - protein, 28 aa, Artificial Sequence
  Description of Artificial Sequence: Synthetic peptide
DEEEIRTTNPVATEQYGSVSTDLQHGNL

SEQ ID NO: 8278 - protein, 29 aa, Artificial Sequence
  Description of Artificial Sequence: Synthetic peptide
DEEEIRTTNPVATEQYGSVSTNLQEEGNQ

SEQ ID NO: 8279 - protein, 29 aa, Artificial Sequence
  Description of Artificial Sequence: Synthetic peptide
DEEEIRTTNPVATEQYGSVETNLQLRGER

SEQ ID NO: 8280 - protein, 29 aa, Artificial Sequence
  Description of Artificial Sequence: Synthetic peptide
DEEEIRTTNPFATEQYGSVSTNDQRGNPR

SEQ ID NO: 8281 - protein, 29 aa, Artificial Sequence
  Description of Artificial Sequence: Synthetic peptide
DEEEIRTTNPVATEIYGSVSTNLEIRGNR

SEQ ID NO: 8282 - protein, 29 aa, Artificial Sequence
  Description of Artificial Sequence: Synthetic peptide
DEEEIRTTNPVATEQYGSVSTNLQNGNEN

SEQ ID NO: 8283 - protein, 28 aa, Artificial Sequence
  Description of Artificial Sequence: Synthetic peptide
DEAEIRTTNPVATENYGSVSCNLQRGNR

SEQ ID NO: 8284 - protein, 28 aa, Artificial Sequence
  Description of Artificial Sequence: Synthetic peptide
AEEEIRQTNPVATEQYGSVSTDLQRGNR

SEQ ID NO: 8285 - protein, 28 aa, Artificial Sequence
  Description of Artificial Sequence: Synthetic peptide
DEEEIRTTNPFATEQYGSVSTNLQPGNP

SEQ ID NO: 8286 - protein, 28 aa, Artificial Sequence
  Description of Artificial Sequence: Synthetic peptide
DEEEIRTTNPVATEQYGSVSTNLQTGEN

SEQ ID NO: 8287 - protein, 28 aa, Artificial Sequence
  Description of Artificial Sequence: Synthetic peptide
DEEEIRTTNPVATEQYGSVETNLEPGNR

SEQ ID NO: 8288 - protein, 31 aa, Artificial Sequence
  Description of Artificial Sequence: Synthetic polypeptide
DEEEIRTTNPVATEQYGSVSTNPLQRKGDNR

SEQ ID NO: 8289 - protein, 28 aa, Artificial Sequence
  Description of Artificial Sequence: Synthetic peptide
DEEEIRTTNPFATEQYGSVSTNLQEGER

SEQ ID NO: 8290 - protein, 31 aa, Artificial Sequence
  Description of Artificial Sequence: Synthetic polypeptide
DEEEIRTTNPVATEQYGSVESTNGLQIRGNR

SEQ ID NO: 8291 - protein, 29 aa, Artificial Sequence
  Description of Artificial Sequence: Synthetic peptide
DEEEIRTTNPVATEHYGSVSTNGPQRGNR

SEQ ID NO: 8292 - protein, 28 aa, Artificial Sequence
  Description of Artificial Sequence: Synthetic peptide
DEEEIRQTNPVATEMYGTVSTNLQRGNR

SEQ ID NO: 8293 - protein, 28 aa, Artificial Sequence
  Description of Artificial Sequence: Synthetic peptide
DEEEIRTTNPDATEQYGSVSTNLDRGNM

SEQ ID NO: 8294 - protein, 28 aa, Artificial Sequence
  Description of Artificial Sequence: Synthetic peptide
DEEEIRTTNPVATEQYGSVDTELQRGNT

SEQ ID NO: 8295 - protein, 29 aa, Artificial Sequence
  Description of Artificial Sequence: Synthetic peptide
DEEEIRTTNPVATEIYGSVSTNLEREGNR

SEQ ID NO: 8296 - protein, 28 aa, Artificial Sequence
  Description of Artificial Sequence: Synthetic peptide
NEEELRTTNPVATEQYGSVSTNLMRGNR

SEQ ID NO: 8297 - protein, 28 aa, Artificial Sequence
  Description of Artificial Sequence: Synthetic peptide
DETEIRTTNPTATEQYGSVSTNPQRGNR

SEQ ID NO: 8298 - protein, 28 aa, Artificial Sequence
  Description of Artificial Sequence: Synthetic peptide
DEEEIAQTNPCATEQYGSVSTNLQRGNR

SEQ ID NO: 8299 - protein, 28 aa, Artificial Sequence
  Description of Artificial Sequence: Synthetic peptide
DESEITTTNPVATEIYGSVSTNLQRGNR

SEQ ID NO: 8300 - protein, 29 aa, Artificial Sequence
  Description of Artificial Sequence: Synthetic peptide
DEEEIRTTNPVATEQYGSVSTNLERGNEN

SEQ ID NO: 8301 - protein, 28 aa, Artificial Sequence
  Description of Artificial Sequence: Synthetic peptide
DEEEIRTTNPDATEQYGSVSTNDQRGND

SEQ ID NO: 8302 - protein, 28 aa, Artificial Sequence
  Description of Artificial Sequence: Synthetic peptide
DEEEIRTTNPCATEQYGVVSLNLQRGNR

SEQ ID NO: 8303 - protein, 30 aa, Artificial Sequence
  Description of Artificial Sequence: Synthetic polypeptide
DEEEIRTTNPVATEQYGSVSTNLQREGINQ

SEQ ID NO: 8304 - protein, 28 aa, Artificial Sequence
  Description of Artificial Sequence: Synthetic peptide
DEDEIRATNPVATEIYGSVSTNLQRGNR

SEQ ID NO: 8305 - protein, 28 aa, Artificial Sequence
  Description of Artificial Sequence: Synthetic peptide
DETEIRTTNPVATEVYGSVSTALQRGNR

SEQ ID NO: 8306 - protein, 28 aa, Artificial Sequence
  Description of Artificial Sequence: Synthetic peptide
DSEEIRTTNPVATEQYGSVSTNLQRPER

SEQ ID NO: 8307 - protein, 30 aa, Artificial Sequence
  Description of Artificial Sequence: Synthetic polypeptide
DEEEIRTTNPVATEQYGSVSCTNLQVGNDR

SEQ ID NO: 8308 - protein, 29 aa, Artificial Sequence
  Description of Artificial Sequence: Synthetic peptide
DECEIRTTNPVATEQYGSVSTNLTQRLNR

SEQ ID NO: 8309 - protein, 28 aa, Artificial Sequence
  Description of Artificial Sequence: Synthetic peptide
DEEEIRTTNPVATEQYGDASTNDQRGNR

SEQ ID NO: 8310 - protein, 28 aa, Artificial Sequence
  Description of Artificial Sequence: Synthetic peptide
DEEEIRTVNPVATEHYGNVSTNLQRGNR

SEQ ID NO: 8311 - protein, 29 aa, Artificial Sequence
  Description of Artificial Sequence: Synthetic peptide
DEEEIRTTNPVATEQYGSVSTNLQESGNQ

SEQ ID NO: 8312 - protein, 29 aa, Artificial Sequence
  Description of Artificial Sequence: Synthetic peptide
DEEEIRTTNPVATEQYGSVSETNDDRGNR

SEQ ID NO: 8313 - protein, 28 aa, Artificial Sequence
  Description of Artificial Sequence: Synthetic peptide
DEYEIRTTNPVATEQYGSVSENLQRGIR

SEQ ID NO: 8314 - protein, 28 aa, Artificial Sequence
  Description of Artificial Sequence: Synthetic peptide
DEEEIRTTNPVATEQHGSVSTQLQRGND

SEQ ID NO: 8315 - protein, 30 aa, Artificial Sequence
  Description of Artificial Sequence: Synthetic polypeptide
DEEEIRTTNPVATEQYGSVSTNLQCCTGNR

SEQ ID NO: 8316 - protein, 30 aa, Artificial Sequence
  Description of Artificial Sequence: Synthetic polypeptide
DEEEIRTTNPVATEQYGSVSTANLQELGNR

SEQ ID NO: 8317 - protein, 30 aa, Artificial Sequence
  Description of Artificial Sequence: Synthetic polypeptide
DEEEIRTTNPVATEQYGHSVSTNLQQGNDR

SEQ ID NO: 8318 - protein, 28 aa, Artificial Sequence
  Description of Artificial Sequence: Synthetic peptide
DDNEIRTTNPVSTEQYGSVSTNLQRGNR

SEQ ID NO: 8319 - protein, 28 aa, Artificial Sequence
  Description of Artificial Sequence: Synthetic peptide
HEEEVGTTNPVATEQYGSVSTNLQRGNR

SEQ ID NO: 8320 - protein, 31 aa, Artificial Sequence
  Description of Artificial Sequence: Synthetic polypeptide
DEEEIRTTNPVATEQYGSVSETNLQDRGENR

SEQ ID NO: 8321 - protein, 28 aa, Artificial Sequence
  Description of Artificial Sequence: Synthetic peptide
DEEEIRTTNPEATEQYGSVSTDLQIGNR

SEQ ID NO: 8322 - protein, 29 aa, Artificial Sequence
  Description of Artificial Sequence: Synthetic peptide
DCEEIRTTNPVATEQYGSVSTNWLERGNR

SEQ ID NO: 8323 - protein, 31 aa, Artificial Sequence
  Description of Artificial Sequence: Synthetic polypeptide
DEEEIRTTNPVATEQYGSVSITNLQRKGNDR

SEQ ID NO: 8324 - protein, 28 aa, Artificial Sequence
  Description of Artificial Sequence: Synthetic peptide
DENEIATTNPVATECYGSVSTNLQRGNR

SEQ ID NO: 8325 - protein, 29 aa, Artificial Sequence
  Description of Artificial Sequence: Synthetic peptide
DEEEITTTNPVATEQYGSVSTNGQRGDNR

SEQ ID NO: 8326 - protein, 29 aa, Artificial Sequence
  Description of Artificial Sequence: Synthetic peptide
DEEEIRTTNPVATEQYGSVSTNPLMRHNR

SEQ ID NO: 8327 - protein, 30 aa, Artificial Sequence
  Description of Artificial Sequence: Synthetic polypeptide
DEEEIRTTNPVATEQYGESVSTNLQSGINR

SEQ ID NO: 8328 - protein, 28 aa, Artificial Sequence
  Description of Artificial Sequence: Synthetic peptide
DEEEIRTTNPTATEQYGSVSTNLQLGNQ

SEQ ID NO: 8329 - protein, 28 aa, Artificial Sequence
  Description of Artificial Sequence: Synthetic peptide
DEEEIRTTNPVATEQYGSVSTNLQDGEN

SEQ ID NO: 8330 - protein, 30 aa, Artificial Sequence
  Description of Artificial Sequence: Synthetic polypeptide
DEEEIRTTNPVATEQYGSVSTNLQNEGNDR

SEQ ID NO: 8331 - protein, 28 aa, Artificial Sequence
  Description of Artificial Sequence: Synthetic peptide
DEDEIRTTNPVATEQYGSVSTCLQRGND

SEQ ID NO: 8332 - protein, 28 aa, Artificial Sequence
  Description of Artificial Sequence: Synthetic peptide
NECEIRTTNPVATEQYGSASTNLQRGNR

SEQ ID NO: 8333 - protein, 28 aa, Artificial Sequence
  Description of Artificial Sequence: Synthetic peptide
DEEEIRTTNPVATEQWGSVSTNLMRGNW

SEQ ID NO: 8334 - protein, 29 aa, Artificial Sequence
  Description of Artificial Sequence: Synthetic peptide
DEEEIRTTNPVATEQYGSVSTMNLQRGDF

SEQ ID NO: 8335 - protein, 28 aa, Artificial Sequence
  Description of Artificial Sequence: Synthetic peptide
DEETIRTTNPVATEQYGSVETNGQRGNR

SEQ ID NO: 8336 - protein, 28 aa, Artificial Sequence
  Description of Artificial Sequence: Synthetic peptide
DEQEIRTTNPVATEQYGSVETNEQRGNR

SEQ ID NO: 8337 - protein, 29 aa, Artificial Sequence
  Description of Artificial Sequence: Synthetic peptide
DEEEIRTTNPFATEQYGTVSTNLQERGNR

SEQ ID NO: 8338 - protein, 31 aa, Artificial Sequence
  Description of Artificial Sequence: Synthetic polypeptide
DEEEIRTTNPVATEQYGSVESTNLQIRGENR

SEQ ID NO: 8339 - protein, 28 aa, Artificial Sequence
  Description of Artificial Sequence: Synthetic peptide
DEEEIRATNPTATEQYGSVSTNLQRGTR

SEQ ID NO: 8340 - protein, 28 aa, Artificial Sequence
  Description of Artificial Sequence: Synthetic peptide
DEEEIRTTNPDATEQYGSVSTNLQEGNG

SEQ ID NO: 8341 - protein, 28 aa, Artificial Sequence
  Description of Artificial Sequence: Synthetic peptide
DEEEIRPTNPVATEQYGSVSTALFRGNR

SEQ ID NO: 8342 - protein, 31 aa, Artificial Sequence
  Description of Artificial Sequence: Synthetic polypeptide
DEEEIRTTNPVATEQYGSMVSTNPLQRGENR

SEQ ID NO: 8343 - protein, 28 aa, Artificial Sequence
  Description of Artificial Sequence: Synthetic peptide
DEEEIRTTNPVATEQYGSVSTELERGNV

SEQ ID NO: 8344 - protein, 28 aa, Artificial Sequence
  Description of Artificial Sequence: Synthetic peptide
DEEEIRTTNPVATEQYGSVSTLLDIGNR

SEQ ID NO: 8345 - protein, 28 aa, Artificial Sequence
  Description of Artificial Sequence: Synthetic peptide
DEELTRTTNPVATEQYGSVSTNLQNGNR

SEQ ID NO: 8346 - protein, 28 aa, Artificial Sequence
  Description of Artificial Sequence: Synthetic peptide
DDEEIRTTNPVATETYGSVSTNLERGNR

SEQ ID NO: 8347 - protein, 28 aa, Artificial Sequence
  Description of Artificial Sequence: Synthetic peptide
DEEEIRTTNPVATEQYGSVSTNLEVENR

SEQ ID NO: 8348 - protein, 29 aa, Artificial Sequence
  Description of Artificial Sequence: Synthetic peptide
DEEEIRTTNPVATEQYGSVSTALIPRGNR

SEQ ID NO: 8349 - protein, 28 aa, Artificial Sequence
  Description of Artificial Sequence: Synthetic peptide
DEEEIRTTNPVATEQYGSVSTNLEDGND

SEQ ID NO: 8350 - protein, 28 aa, Artificial Sequence
  Description of Artificial Sequence: Synthetic peptide
DEEEIRTTNPVATEQYGSVETNLERDNR

SEQ ID NO: 8351 - protein, 29 aa, Artificial Sequence
  Description of Artificial Sequence: Synthetic peptide
DEEEIRTTNPVATEQYGSVSCTNLQQGNQ

SEQ ID NO: 8352 - protein, 28 aa, Artificial Sequence
  Description of Artificial Sequence: Synthetic peptide
VEEEIRTTNPVATELYGSVSMNLQRGNR

SEQ ID NO: 8353 - protein, 29 aa, Artificial Sequence
  Description of Artificial Sequence: Synthetic peptide
DEEEIRTTNPVATEQYGSVFTPNLQRENR

SEQ ID NO: 8354 - protein, 29 aa, Artificial Sequence
  Description of Artificial Sequence: Synthetic peptide
DEEEIRTTNPVATEQYGSYWSTNLQHGNR

SEQ ID NO: 8355 - protein, 29 aa, Artificial Sequence
  Description of Artificial Sequence: Synthetic peptide
DEEEIRTTNPVATEQYGSVSCTNLQTGNH

SEQ ID NO: 8356 - protein, 28 aa, Artificial Sequence
  Description of Artificial Sequence: Synthetic peptide
DEEEIRTTNPTATEQYGSVSTNEQRGNV

SEQ ID NO: 8357 - protein, 28 aa, Artificial Sequence
  Description of Artificial Sequence: Synthetic peptide
DEVEIRTTNPVATECYGEVSTNLQRGNR

SEQ ID NO: 8358 - protein, 28 aa, Artificial Sequence
  Description of Artificial Sequence: Synthetic peptide
DEEEIRATNPVASEQYGSVSTNLDRGNR

SEQ ID NO: 8359 - protein, 30 aa, Artificial Sequence
  Description of Artificial Sequence: Synthetic polypeptide
DEEEIRTTNPVATEQYGSVSTNLQREGNDD

SEQ ID NO: 8360 - protein, 28 aa, Artificial Sequence
  Description of Artificial Sequence: Synthetic peptide
DPEEIRTTNPVATEQYGSVSTNLQDENR

SEQ ID NO: 8361 - protein, 29 aa, Artificial Sequence
  Description of Artificial Sequence: Synthetic peptide
DEEEIRTTNPVATEQYGESVSSNLQFGNR

SEQ ID NO: 8362 - protein, 29 aa, Artificial Sequence
  Description of Artificial Sequence: Synthetic peptide
KEEEIRTTNPVGTEQYGSVSTNLQRGNDR

SEQ ID NO: 8363 - protein, 28 aa, Artificial Sequence
  Description of Artificial Sequence: Synthetic peptide
DTEEIRTTNPVATEQYGSVSTNLDRGHR

SEQ ID NO: 8364 - protein, 29 aa, Artificial Sequence
  Description of Artificial Sequence: Synthetic peptide
DEEEIRTTNPVATEQYGSVDSTNEQRGNN

SEQ ID NO: 8365 - protein, 30 aa, Artificial Sequence
  Description of Artificial Sequence: Synthetic polypeptide
DEEEIRTTNPVATEQYGSVSTNLQRGENED

SEQ ID NO: 8366 - protein, 29 aa, Artificial Sequence
  Description of Artificial Sequence: Synthetic peptide
DEEEIRTTNPTATEQYGSVSTANLQQGNR

SEQ ID NO: 8367 - protein, 29 aa, Artificial Sequence
  Description of Artificial Sequence: Synthetic peptide
DEEEIRTTNPVATEQYGSVSTNLQLVGNE

SEQ ID NO: 8368 - protein, 28 aa, Artificial Sequence
  Description of Artificial Sequence: Synthetic peptide
DEEEIRTTNPEATEQYGVVSTNLQRGNG

SEQ ID NO: 8369 - protein, 30 aa, Artificial Sequence
  Description of Artificial Sequence: Synthetic polypeptide
DEEELRTTNPVATEQYGSVSTNLGQPRGNR

SEQ ID NO: 8370 - protein, 28 aa, Artificial Sequence
  Description of Artificial Sequence: Synthetic peptide
DEEEIATTNPVCTETYGSVSTNLQRGNR

SEQ ID NO: 8371 - protein, 29 aa, Artificial Sequence
  Description of Artificial Sequence: Synthetic peptide
DEEEIRTTNPVASEQYGSVSTNPLQRGDR

SEQ ID NO: 8372 - protein, 30 aa, Artificial Sequence
  Description of Artificial Sequence: Synthetic polypeptide
DEEEIRTTNPVATEQYGSVSTDLQREGNDR

SEQ ID NO: 8373 - protein, 28 aa, Artificial Sequence
  Description of Artificial Sequence: Synthetic peptide
DESEIATVNPVATEQYGSVSTNLQRGNR

SEQ ID NO: 8374 - protein, 30 aa, Artificial Sequence
  Description of Artificial Sequence: Synthetic polypeptide
DEEEIRTTNPVATEQYGSVESTNLDRGDNR

SEQ ID NO: 8375 - protein, 29 aa, Artificial Sequence
  Description of Artificial Sequence: Synthetic peptide
DEEEIRTTNPEATEQYGSVSETNLQRGNE

SEQ ID NO: 8376 - protein, 30 aa, Artificial Sequence
  Description of Artificial Sequence: Synthetic polypeptide
DEEEIRTTNPVATEQYGSVSCTNLQMGNDR

SEQ ID NO: 8377 - protein, 28 aa, Artificial Sequence
  Description of Artificial Sequence: Synthetic peptide
DEEEIRTTNPVAGEQYGSVSENLQRGER

SEQ ID NO: 8378 - protein, 28 aa, Artificial Sequence
  Description of Artificial Sequence: Synthetic peptide
DEEEIRTTNPVATQQYGSVSTNLQDGNS

SEQ ID NO: 8379 - protein, 28 aa, Artificial Sequence
  Description of Artificial Sequence: Synthetic peptide
DEEEIRATNPVCTEQYGSVSTNLNRGNR

SEQ ID NO: 8380 - protein, 28 aa, Artificial Sequence
  Description of Artificial Sequence: Synthetic peptide
DEEEIRTTNPVATEQYGSVSTELEEGNR

SEQ ID NO: 8381 - protein, 28 aa, Artificial Sequence
  Description of Artificial Sequence: Synthetic peptide
DEEEIRTTNPVATEQYGSVDTNEQPGNR

SEQ ID NO: 8382 - protein, 28 aa, Artificial Sequence
  Description of Artificial Sequence: Synthetic peptide
DEEELRTTNPVATEQYGSVSTNLTRGNQ

SEQ ID NO: 8383 - protein, 28 aa, Artificial Sequence
  Description of Artificial Sequence: Synthetic peptide
DEEEIRTTNPVATEQVGSVSTNLQTGNT

SEQ ID NO: 8384 - protein, 29 aa, Artificial Sequence
  Description of Artificial Sequence: Synthetic peptide
DEEEIRTTNPVATEQYGSVSTGNWQRLNR

SEQ ID NO: 8385 - protein, 28 aa, Artificial Sequence
  Description of Artificial Sequence: Synthetic peptide
GEEEIRTTNPVATEQYGSVSTPLQRGNI

SEQ ID NO: 8386 - protein, 28 aa, Artificial Sequence
  Description of Artificial Sequence: Synthetic peptide
DEEEIRSTNPVASEQYGAVSTNLQRGNR

SEQ ID NO: 8387 - protein, 28 aa, Artificial Sequence
  Description of Artificial Sequence: Synthetic peptide
DEEEIRTTNPVATEQYGSVSTNLQHGEC

SEQ ID NO: 8388 - protein, 30 aa, Artificial Sequence
  Description of Artificial Sequence: Synthetic polypeptide
DEEEIRTTNPVATEQYGSYVSTDLQERGNR

SEQ ID NO: 8389 - protein, 29 aa, Artificial Sequence
  Description of Artificial Sequence: Synthetic peptide
DEEEIRTTNPVATEQYGSVSTNEQRGNWF

SEQ ID NO: 8390 - protein, 31 aa, Artificial Sequence
  Description of Artificial Sequence: Synthetic polypeptide
DEEEIRTTNPVATEQYGESVSTDNLQERGNR

SEQ ID NO: 8391 - protein, 30 aa, Artificial Sequence
  Description of Artificial Sequence: Synthetic polypeptide
DEEEIRTTNPVATEQYGYVDSTGNLQRGNR

SEQ ID NO: 8392 - protein, 28 aa, Artificial Sequence
  Description of Artificial Sequence: Synthetic peptide
DEEEIRQTNPVATEQYGDVSCNLQRGNR

SEQ ID NO: 8393 - protein, 28 aa, Artificial Sequence
  Description of Artificial Sequence: Synthetic peptide
DEEEIRTTNPVAVEQYGSVSFNLQRGDR

SEQ ID NO: 8394 - protein, 29 aa, Artificial Sequence
  Description of Artificial Sequence: Synthetic peptide
DEEEIRTTNPVATEQYGSVSTNLQREGEM

SEQ ID NO: 8395 - protein, 28 aa, Artificial Sequence
  Description of Artificial Sequence: Synthetic peptide
DEEEIRTTNPVATEQYGAVFTNLQYGNR

SEQ ID NO: 8396 - protein, 28 aa, Artificial Sequence
  Description of Artificial Sequence: Synthetic peptide
DEEEVRTTNPVATEMYGSVSTNLQPGNR

SEQ ID NO: 8397 - protein, 30 aa, Artificial Sequence
  Description of Artificial Sequence: Synthetic polypeptide
DEEEIRTTNPVATEQYGSVSTNGEQVRGNR

SEQ ID NO: 8398 - protein, 28 aa, Artificial Sequence
  Description of Artificial Sequence: Synthetic peptide
DEEEIRTTNPVATEQYGSVETNDQVGNR

SEQ ID NO: 8399 - protein, 28 aa, Artificial Sequence
  Description of Artificial Sequence: Synthetic peptide
DEEEIRTTNPVATEQYGSWSTNLQRGEP

SEQ ID NO: 8400 - protein, 28 aa, Artificial Sequence
  Description of Artificial Sequence: Synthetic peptide
DEECIRTTNPEATEQYGSVSTNPQRGNR

SEQ ID NO: 8401 - protein, 29 aa, Artificial Sequence
  Description of Artificial Sequence: Synthetic peptide
DEEEIYTTNPVATEQYGSVSTNLQVGNDR

SEQ ID NO: 8402 - protein, 28 aa, Artificial Sequence
  Description of Artificial Sequence: Synthetic peptide
DCEEIRTTNPVATEQYGSVSTNLQHGER

SEQ ID NO: 8403 - protein, 28 aa, Artificial Sequence
  Description of Artificial Sequence: Synthetic peptide
DEEEIRTTNPVATEQWGSVHTNLQRGNP

SEQ ID NO: 8404 - protein, 28 aa, Artificial Sequence
  Description of Artificial Sequence: Synthetic peptide
DEEEIRTTNPNATEQYGAVSTNLQRGND

SEQ ID NO: 8405 - protein, 29 aa, Artificial Sequence
  Description of Artificial Sequence: Synthetic peptide
DEEEIRTTNPVATEQYGSVSTNLQDDGND

SEQ ID NO: 8406 - protein, 29 aa, Artificial Sequence
  Description of Artificial Sequence: Synthetic peptide
DEEEIRTTNPVATEQYGSYSTNLMNRGNR

SEQ ID NO: 8407 - protein, 29 aa, Artificial Sequence
  Description of Artificial Sequence: Synthetic peptide
DEEEIRTTNPVATEQYGSWSTNLQPAGNR

SEQ ID NO: 8408 - protein, 28 aa, Artificial Sequence
  Description of Artificial Sequence: Synthetic peptide
DEEEIRTTNPVATEQYGSVSTNLQDGEF

SEQ ID NO: 8409 - protein, 29 aa, Artificial Sequence
  Description of Artificial Sequence: Synthetic peptide
NEEEIRTTNPVATELYGSVSTNLQNRGNR

SEQ ID NO: 8410 - protein, 29 aa, Artificial Sequence
  Description of Artificial Sequence: Synthetic peptide
AEEEIVTTNPVATEQYGSVSATNLQRGNR

SEQ ID NO: 8411 - protein, 30 aa, Artificial Sequence
  Description of Artificial Sequence: Synthetic polypeptide
DEEEIRPTNPVATEQYGSVSTPNLQRGNDR

SEQ ID NO: 8412 - protein, 28 aa, Artificial Sequence
  Description of Artificial Sequence: Synthetic peptide
DEEEIRTTNPVATEQYGSVSTNEQNGNH

SEQ ID NO: 8413 - protein, 30 aa, Artificial Sequence
  Description of Artificial Sequence: Synthetic polypeptide
DEEEIRTTNPVATEQYGSVISTNLQDRGNE

SEQ ID NO: 8414 - protein, 29 aa, Artificial Sequence
  Description of Artificial Sequence: Synthetic peptide
DEEEIRTTNPVATEQYGSVSTDWQRGVNR

SEQ ID NO: 8415 - protein, 28 aa, Artificial Sequence
  Description of Artificial Sequence: Synthetic peptide
DEQEITTTNPVATEQYGWVSTNLQRGNR

SEQ ID NO: 8416 - protein, 28 aa, Artificial Sequence
  Description of Artificial Sequence: Synthetic peptide
DEEEIRTTNPVATEQYGSVSTDLYRGNA

SEQ ID NO: 8417 - protein, 28 aa, Artificial Sequence
  Description of Artificial Sequence: Synthetic peptide
DEEEIRTTNPVATEQYGSVSTNLQPGED

SEQ ID NO: 8418 - protein, 28 aa, Artificial Sequence
  Description of Artificial Sequence: Synthetic peptide
DEECIRTTNPVATEQYGSVETNLQRGND

SEQ ID NO: 8419 - protein, 29 aa, Artificial Sequence
  Description of Artificial Sequence: Synthetic peptide
DEEEIRTTNPVSTEQYGSVTTNPLQRGNR

SEQ ID NO: 8420 - protein, 30 aa, Artificial Sequence
  Description of Artificial Sequence: Synthetic polypeptide
DEEEIRTTNPVATEQYGSVSTINLVQRGNW

SEQ ID NO: 8421 - protein, 28 aa, Artificial Sequence
  Description of Artificial Sequence: Synthetic peptide
QDEEIRTTNPVATEQYGSVSTNLQRGLR

SEQ ID NO: 8422 - protein, 28 aa, Artificial Sequence
  Description of Artificial Sequence: Synthetic peptide
DEEHIRTTNPVATHQYGSVSTNLQFGNR

SEQ ID NO: 8423 - protein, 28 aa, Artificial Sequence
  Description of Artificial Sequence: Synthetic peptide
DEEEIRTTNPCASEQYGCVSTNLQRGNR

SEQ ID NO: 8424 - protein, 30 aa, Artificial Sequence
  Description of Artificial Sequence: Synthetic polypeptide
DEEEIRTTNPVATEQYGSVSTNMPQRFGNR

SEQ ID NO: 8425 - protein, 28 aa, Artificial Sequence
  Description of Artificial Sequence: Synthetic peptide
DEQEIRTTNPVATENYGWVSTNLQRGNR

SEQ ID NO: 8426 - protein, 28 aa, Artificial Sequence
  Description of Artificial Sequence: Synthetic peptide
DEEEIWATNPVATEQYGSVSTNLQRGNF

SEQ ID NO: 8427 - protein, 30 aa, Artificial Sequence
  Description of Artificial Sequence: Synthetic polypeptide
DMEEIRTTNPVATEQYGSVSTFNLQRGDNR

SEQ ID NO: 8428 - protein, 28 aa, Artificial Sequence
  Description of Artificial Sequence: Synthetic peptide
DEEEIRTTNPVATAQYGSVSTNLDRGNW

SEQ ID NO: 8429 - protein, 28 aa, Artificial Sequence
  Description of Artificial Sequence: Synthetic peptide
DEETIRTTNPVATEQYGSVMTNLQRGNP

SEQ ID NO: 8430 - protein, 28 aa, Artificial Sequence
  Description of Artificial Sequence: Synthetic peptide
DEEEIRTTNPVATEQFGSVSTNLQRMQR

SEQ ID NO: 8431 - protein, 28 aa, Artificial Sequence
  Description of Artificial Sequence: Synthetic peptide
DEEEVACTNPVATEQYGSVSTNLQRGNR

SEQ ID NO: 8432 - protein, 29 aa, Artificial Sequence
  Description of Artificial Sequence: Synthetic peptide
DEEEIVTTNPVATEQYGSVSSTNLQFGNR

SEQ ID NO: 8433 - protein, 29 aa, Artificial Sequence
  Description of Artificial Sequence: Synthetic peptide
DEEEIRTTNPVATEQYGSVSCTNLQNGNM

SEQ ID NO: 8434 - protein, 30 aa, Artificial Sequence
  Description of Artificial Sequence: Synthetic polypeptide
DEEEIRTTNPVATEQYGSVISTMNLQRENR

SEQ ID NO: 8435 - protein, 30 aa, Artificial Sequence
  Description of Artificial Sequence: Synthetic polypeptide
DEQEIRTTNPVATEQYGCSVDSTNLQRGNR

SEQ ID NO: 8436 - protein, 28 aa, Artificial Sequence
  Description of Artificial Sequence: Synthetic peptide
DVEEIRTTNPVATEQYGSVSTNLQRGEA

SEQ ID NO: 8437 - protein, 28 aa, Artificial Sequence
  Description of Artificial Sequence: Synthetic peptide
DEEVIRTTNPVATEQYGSVSTNLQQGTR

SEQ ID NO: 8438 - protein, 28 aa, Artificial Sequence
  Description of Artificial Sequence: Synthetic peptide
NEEEIRTVNPVATEQYGSVSMNLQRGNR

SEQ ID NO: 8439 - protein, 28 aa, Artificial Sequence
  Description of Artificial Sequence: Synthetic peptide
DEEEISGTNPVATEQYGSVSDNLQRGNR

SEQ ID NO: 8440 - protein, 28 aa, Artificial Sequence
  Description of Artificial Sequence: Synthetic peptide
DEEEIRQTNPVSTEQYGSVSTNLQRGGR

SEQ ID NO: 8441 - protein, 30 aa, Artificial Sequence
  Description of Artificial Sequence: Synthetic polypeptide
DEEEIRTTNPVATEQYGSVSTNEQVREGNR

SEQ ID NO: 8442 - protein, 28 aa, Artificial Sequence
  Description of Artificial Sequence: Synthetic peptide
DEEEIRTTNPVATEQYGSVETNDQTGNR

SEQ ID NO: 8443 - protein, 31 aa, Artificial Sequence
  Description of Artificial Sequence: Synthetic polypeptide
DEEEIRTTNPVATEQYGSVSITMNLQPRGNR

SEQ ID NO: 8444 - protein, 30 aa, Artificial Sequence
  Description of Artificial Sequence: Synthetic polypeptide
DEEEIRTTNPVATEIYGSVSTNGLQRGINR

SEQ ID NO: 8445 - protein, 29 aa, Artificial Sequence
  Description of Artificial Sequence: Synthetic peptide
MEEEIRTTNPVATEQYGSVQTNLLQRGNR

SEQ ID NO: 8446 - protein, 29 aa, Artificial Sequence
  Description of Artificial Sequence: Synthetic peptide
DEEVIRTTNPVATELYGSVSTTNLQRGNR

SEQ ID NO: 8447 - protein, 28 aa, Artificial Sequence
  Description of Artificial Sequence: Synthetic peptide
DEEEIYTTNPVATEQYGSVSTGLARGNR

SEQ ID NO: 8448 - protein, 31 aa, Artificial Sequence
  Description of Artificial Sequence: Synthetic polypeptide
DEEEIRTTNPVATEQYGSVSVTNGLQRGINR

SEQ ID NO: 8449 - protein, 28 aa, Artificial Sequence
  Description of Artificial Sequence: Synthetic peptide
DEEEIRTTNPVATQQYGSVSTNLQDGNP

SEQ ID NO: 8450 - protein, 28 aa, Artificial Sequence
  Description of Artificial Sequence: Synthetic peptide
DEEEIRTTNPVATEQYGSVSTNLQWGDV

SEQ ID NO: 8451 - protein, 28 aa, Artificial Sequence
  Description of Artificial Sequence: Synthetic peptide
DENEIRATNPVATEQYGSVATNLQRGNR

SEQ ID NO: 8452 - protein, 29 aa, Artificial Sequence
  Description of Artificial Sequence: Synthetic peptide
DEEEIRTTNPVATEQYGSVSTNLQTGNDE

SEQ ID NO: 8453 - protein, 29 aa, Artificial Sequence
  Description of Artificial Sequence: Synthetic peptide
DEEEIRTTNPVATEQYGSVWDTNLDRGNR

SEQ ID NO: 8454 - protein, 28 aa, Artificial Sequence
  Description of Artificial Sequence: Synthetic peptide
DENEIRTTNPVATEQYGSVPTNLWRGNR

SEQ ID NO: 8455 - protein, 28 aa, Artificial Sequence
  Description of Artificial Sequence: Synthetic peptide
DEQEIRTTNPVATEQYGSVCTQLQRGNR

SEQ ID NO: 8456 - protein, 28 aa, Artificial Sequence
  Description of Artificial Sequence: Synthetic peptide
DEFEIRQTNPVATEQYGSVSTNLQRGNM

SEQ ID NO: 8457 - protein, 28 aa, Artificial Sequence
  Description of Artificial Sequence: Synthetic peptide
DEEEIAQTNPVATEQYGSVSENLQRGNR

SEQ ID NO: 8458 - protein, 28 aa, Artificial Sequence
  Description of Artificial Sequence: Synthetic peptide
DEEEIRTTNPVCTECYGSVSTNLQRGNF

SEQ ID NO: 8459 - protein, 29 aa, Artificial Sequence
  Description of Artificial Sequence: Synthetic peptide
DEEEIRTTNPDATEQYGSVSTNLTQRGER

SEQ ID NO: 8460 - protein, 28 aa, Artificial Sequence
  Description of Artificial Sequence: Synthetic peptide
DEEEIMTTNPVATEQYGSVSTDLQLGNR

SEQ ID NO: 8461 - protein, 28 aa, Artificial Sequence
  Description of Artificial Sequence: Synthetic peptide
DEEEIRTTNPTATEQYGSVSTNEQQGNR

SEQ ID NO: 8462 - protein, 29 aa, Artificial Sequence
  Description of Artificial Sequence: Synthetic peptide
DEEEIRTTNPVATEQYGSVSTNEEWRGNR

SEQ ID NO: 8463 - protein, 29 aa, Artificial Sequence
  Description of Artificial Sequence: Synthetic peptide
DEEEIRTTNPVATEQYGTVSCTNLQRGNY

SEQ ID NO: 8464 - protein, 28 aa, Artificial Sequence
  Description of Artificial Sequence: Synthetic peptide
DEEEIRTTNPVATEQYGSVSYNLQHGND

SEQ ID NO: 8465 - protein, 28 aa, Artificial Sequence
  Description of Artificial Sequence: Synthetic peptide
DEEEIRTTNPSATEHYGSVSTNLQRGNP

SEQ ID NO: 8466 - protein, 28 aa, Artificial Sequence
  Description of Artificial Sequence: Synthetic peptide
DEEEIRTTNPVSSEHYGSVSTNLQRGNR

SEQ ID NO: 8467 - protein, 31 aa, Artificial Sequence
  Description of Artificial Sequence: Synthetic polypeptide
DEEEIRTTNPVATEQYGSIVSDTNLQERGNR

SEQ ID NO: 8468 - protein, 29 aa, Artificial Sequence
  Description of Artificial Sequence: Synthetic peptide
DEEEIRTTNPVATEQYGLVDSTNLARGNR

SEQ ID NO: 8469 - protein, 29 aa, Artificial Sequence
  Description of Artificial Sequence: Synthetic peptide
MEEEIRTTNPVATEQYGSVSTNLQRGNDD

SEQ ID NO: 8470 - protein, 30 aa, Artificial Sequence
  Description of Artificial Sequence: Synthetic polypeptide
DEEEIRTTNPVATEQYGSVFTDNLVQRGNR

SEQ ID NO: 8471 - protein, 28 aa, Artificial Sequence
  Description of Artificial Sequence: Synthetic peptide
AEEEIRTTNPVATEQYGSASTNLMRGNR

SEQ ID NO: 8472 - protein, 28 aa, Artificial Sequence
  Description of Artificial Sequence: Synthetic peptide
DEEEIRTTNPFATEQYGSVPTNLQRGNL

SEQ ID NO: 8473 - protein, 31 aa, Artificial Sequence
  Description of Artificial Sequence: Synthetic polypeptide
DEEEIRTTNPVATEQYGSVSETNLQRDGENR

SEQ ID NO: 8474 - protein, 30 aa, Artificial Sequence
  Description of Artificial Sequence: Synthetic polypeptide
DEEEIRCTNPVATEQYGSVDSTKNLQRGNR

SEQ ID NO: 8475 - protein, 28 aa, Artificial Sequence
  Description of Artificial Sequence: Synthetic peptide
DEEEIRTTNPVATEQYGDVSENLQRGDR

SEQ ID NO: 8476 - protein, 28 aa, Artificial Sequence
  Description of Artificial Sequence: Synthetic peptide
DEEEIRTTNPDATEQYGSVSTNDQRGNF

SEQ ID NO: 8477 - protein, 30 aa, Artificial Sequence
  Description of Artificial Sequence: Synthetic polypeptide
DEEEIRTTNPVATEQYGSVSTNEQRGVNTR

SEQ ID NO: 8478 - protein, 28 aa, Artificial Sequence
  Description of Artificial Sequence: Synthetic peptide
DEEEIRATNPVATEIYGTVSTNLQRGNR

SEQ ID NO: 8479 - protein, 28 aa, Artificial Sequence
  Description of Artificial Sequence: Synthetic peptide
DEEEIRTTNPVCCEQYGSVSTNVQRGNR

SEQ ID NO: 8480 - protein, 28 aa, Artificial Sequence
  Description of Artificial Sequence: Synthetic peptide
DEVEIRTTNPVATEQYGSVSTNGQRGTR

SEQ ID NO: 8481 - protein, 29 aa, Artificial Sequence
  Description of Artificial Sequence: Synthetic peptide
QEEEIRTTNPVATEQYGSVSTDLQIRGNR

SEQ ID NO: 8482 - protein, 31 aa, Artificial Sequence
  Description of Artificial Sequence: Synthetic polypeptide
DEEEIRTTNPVATEQYGSVSCTNLQRAGNDR

SEQ ID NO: 8483 - protein, 28 aa, Artificial Sequence
  Description of Artificial Sequence: Synthetic peptide
DSNEIRTTNPVATEQYGSVSENLQRGNR

SEQ ID NO: 8484 - protein, 28 aa, Artificial Sequence
  Description of Artificial Sequence: Synthetic peptide
DEEEIRTTNPVATEMYGAVSNNLQRGNR

SEQ ID NO: 8485 - protein, 29 aa, Artificial Sequence
  Description of Artificial Sequence: Synthetic peptide
DEEEIRTTNPVATEQYGSWSTNGLQRGNM

SEQ ID NO: 8486 - protein, 29 aa, Artificial Sequence
  Description of Artificial Sequence: Synthetic peptide
DEEEIRTTNPVATESYGSVSTNDQRGNDR

SEQ ID NO: 8487 - protein, 28 aa, Artificial Sequence
  Description of Artificial Sequence: Synthetic peptide
DEEEIRCTNPVATEQYGSVSTNLMRGTR

SEQ ID NO: 8488 - protein, 28 aa, Artificial Sequence
  Description of Artificial Sequence: Synthetic peptide
DEEELRTTNPVCTEQWGSVSTNLQRGNR

SEQ ID NO: 8489 - protein, 28 aa, Artificial Sequence
  Description of Artificial Sequence: Synthetic peptide
DEEEIRTTNPVSTEQYGCVATNLQRGNR

SEQ ID NO: 8490 - protein, 28 aa, Artificial Sequence
  Description of Artificial Sequence: Synthetic peptide
DDEEVRTTNPVATEQYGSVSTNLQRGPR

SEQ ID NO: 8491 - protein, 28 aa, Artificial Sequence
  Description of Artificial Sequence: Synthetic peptide
DEEEIRTTNPVSTEQYGSVSTNDQVGNR

SEQ ID NO: 8492 - protein, 28 aa, Artificial Sequence
  Description of Artificial Sequence: Synthetic peptide
DENEIRTTNPVATEQYGSVDTDLQRGNR

SEQ ID NO: 8493 - protein, 28 aa, Artificial Sequence
  Description of Artificial Sequence: Synthetic peptide
DEEEIRTTNPFATEQYGSVSTDQQRGNR

SEQ ID NO: 8494 - protein, 30 aa, Artificial Sequence
  Description of Artificial Sequence: Synthetic polypeptide
DEEEIRTTNPVATEVYGSVSTNPLQRNGNR

SEQ ID NO: 8495 - protein, 28 aa, Artificial Sequence
  Description of Artificial Sequence: Synthetic peptide
DEEEIRTTNPVATEQYGSVETPLQRGER

SEQ ID NO: 8496 - protein, 30 aa, Artificial Sequence
  Description of Artificial Sequence: Synthetic polypeptide
DEEEIRTTNPVATEQYGESVSTNLQRGENS

SEQ ID NO: 8497 - protein, 29 aa, Artificial Sequence
  Description of Artificial Sequence: Synthetic peptide
DEEEIRTTNPVATEQYGSVSTANLQIGNE

SEQ ID NO: 8498 - protein, 30 aa, Artificial Sequence
  Description of Artificial Sequence: Synthetic polypeptide
QEEEIRTTNPVATEQYGSVSTNLQDRGENR

SEQ ID NO: 8499 - protein, 30 aa, Artificial Sequence
  Description of Artificial Sequence: Synthetic polypeptide
DEEEIRTTNPVATEQYGSVSDTNLQPNGNR

SEQ ID NO: 8500 - protein, 28 aa, Artificial Sequence
  Description of Artificial Sequence: Synthetic peptide
DEGEIRTTNPVATEHFGSVSTNLQRGNR

SEQ ID NO: 8501 - protein, 28 aa, Artificial Sequence
  Description of Artificial Sequence: Synthetic peptide
DEEEIRTTNPVATEHYGTVGTNLQRGNR

SEQ ID NO: 8502 - protein, 28 aa, Artificial Sequence
  Description of Artificial Sequence: Synthetic peptide
QEEEIRTTNPVATEQYGSVSDNLQRGER

SEQ ID NO: 8503 - protein, 28 aa, Artificial Sequence
  Description of Artificial Sequence: Synthetic peptide
DEEEIRTTNPVATEQYGSVDTNLQGGDR

SEQ ID NO: 8504 - protein, 28 aa, Artificial Sequence
  Description of Artificial Sequence: Synthetic peptide
DEENIRTTNPVATEQYGSVSENLQRGNN

SEQ ID NO: 8505 - protein, 28 aa, Artificial Sequence
  Description of Artificial Sequence: Synthetic peptide
DEEEIRPTNPVATEQYGDVSTNLQRGNC

SEQ ID NO: 8506 - protein, 28 aa, Artificial Sequence
  Description of Artificial Sequence: Synthetic peptide
DEEEIRTTNPVATEQYGSVETDLQRGNN

SEQ ID NO: 8507 - protein, 28 aa, Artificial Sequence
  Description of Artificial Sequence: Synthetic peptide
DEPELRTTNPVATEQYGSVSDNLQRGNR

SEQ ID NO: 8508 - protein, 29 aa, Artificial Sequence
  Description of Artificial Sequence: Synthetic peptide
DEEEIRTTNPVATEQYGSVLSNLEQRGNR

SEQ ID NO: 8509 - protein, 28 aa, Artificial Sequence
  Description of Artificial Sequence: Synthetic peptide
DEEEIRTTNPVATEQYGSVSTEDQEGNR

SEQ ID NO: 8510 - protein, 28 aa, Artificial Sequence
  Description of Artificial Sequence: Synthetic peptide
DEEEIRTVNPVATEQYGSVGTTLQRGNR

SEQ ID NO: 8511 - protein, 28 aa, Artificial Sequence
  Description of Artificial Sequence: Synthetic peptide
DEEEIRTTNPVATEQYGSVSTNLIQGND

SEQ ID NO: 8512 - protein, 29 aa, Artificial Sequence
  Description of Artificial Sequence: Synthetic peptide
DEEEIRTTNPVATEQYGSVSTDNLQRGDG

SEQ ID NO: 8513 - protein, 28 aa, Artificial Sequence
  Description of Artificial Sequence: Synthetic peptide
DEEEIRTTNPVATEQYGSVSTNLQTGDA

SEQ ID NO: 8514 - protein, 28 aa, Artificial Sequence
  Description of Artificial Sequence: Synthetic peptide
DEEEIRTTNPVATEQYGSVSTNDEDGNR

SEQ ID NO: 8515 - protein, 29 aa, Artificial Sequence
  Description of Artificial Sequence: Synthetic peptide
DETEIRTTNPVATEQYGSVSCTNLQRGNV

SEQ ID NO: 8516 - protein, 28 aa, Artificial Sequence
  Description of Artificial Sequence: Synthetic peptide
DEEEIRTTNPVATEQYGSVSTALQYGNY

SEQ ID NO: 8517 - protein, 29 aa, Artificial Sequence
  Description of Artificial Sequence: Synthetic peptide
DEEEIATTNPVATEQYGSNSTPNLQRGNR

SEQ ID NO: 8518 - protein, 28 aa, Artificial Sequence
  Description of Artificial Sequence: Synthetic peptide
DEEEICTTNPVATEQYGSVSTNLQIGND

SEQ ID NO: 8519 - protein, 28 aa, Artificial Sequence
  Description of Artificial Sequence: Synthetic peptide
DEEEIATTNPVATEQWGSVSTNLMRGNR

SEQ ID NO: 8520 - protein, 28 aa, Artificial Sequence
  Description of Artificial Sequence: Synthetic peptide
DEEEIRCTNPVATETYGSVSTNPQRGNR

SEQ ID NO: 8521 - protein, 28 aa, Artificial Sequence
  Description of Artificial Sequence: Synthetic peptide
DEEEIRTTNPVATEQYGSVETNDQRGNA

SEQ ID NO: 8522 - protein, 30 aa, Artificial Sequence
  Description of Artificial Sequence: Synthetic polypeptide
DEEEIRTTNPVATEQYGSVSTDNLQRDGNG

SEQ ID NO: 8523 - protein, 28 aa, Artificial Sequence
  Description of Artificial Sequence: Synthetic peptide
DEDEIRTVNPVATEIYGSVSTNLQRGNR

SEQ ID NO: 8524 - protein, 29 aa, Artificial Sequence
  Description of Artificial Sequence: Synthetic peptide
DEEEIRTTNPVATTQYGSVSTNLQYEGNR

SEQ ID NO: 8525 - protein, 28 aa, Artificial Sequence
  Description of Artificial Sequence: Synthetic peptide
VEEEIRTTNPVATEQYGSVSTNLQRPNP

SEQ ID NO: 8526 - protein, 29 aa, Artificial Sequence
  Description of Artificial Sequence: Synthetic peptide
DPEEIRTTNPVATEQYGSVSTNPDQRGNR

SEQ ID NO: 8527 - protein, 30 aa, Artificial Sequence
  Description of Artificial Sequence: Synthetic polypeptide
DEEEIRTTNPVATEQYGSVDETNLQREGNR

SEQ ID NO: 8528 - protein, 28 aa, Artificial Sequence
  Description of Artificial Sequence: Synthetic peptide
DEEEIRATNPVATELYGSVNTNLQRGNR

SEQ ID NO: 8529 - protein, 29 aa, Artificial Sequence
  Description of Artificial Sequence: Synthetic peptide
DEEEIRTTNPVATEQHGSVSTNLQLEGNR

SEQ ID NO: 8530 - protein, 28 aa, Artificial Sequence
  Description of Artificial Sequence: Synthetic peptide
DEEEIRTTNPDATEQYGSVSTNLQDGNV

SEQ ID NO: 8531 - protein, 29 aa, Artificial Sequence
  Description of Artificial Sequence: Synthetic peptide
DEEEIRTTNPYATEQYGSVSTNLVQRGER

SEQ ID NO: 8532 - protein, 29 aa, Artificial Sequence
  Description of Artificial Sequence: Synthetic peptide
DEEEIRTTNPDATEQYGSVSTNQQRGENR

SEQ ID NO: 8533 - protein, 28 aa, Artificial Sequence
  Description of Artificial Sequence: Synthetic peptide
DEEEIRTTNPVATELYGSVSTNLQEGNE

SEQ ID NO: 8534 - protein, 28 aa, Artificial Sequence
  Description of Artificial Sequence: Synthetic peptide
DEEEIRTTNPFATEQYGSVSTNLEQGNR

SEQ ID NO: 8535 - protein, 28 aa, Artificial Sequence
  Description of Artificial Sequence: Synthetic peptide
DEEEIRTTNPVATEQYGSVSTNDEIGNR

SEQ ID NO: 8536 - protein, 28 aa, Artificial Sequence
  Description of Artificial Sequence: Synthetic peptide
DEEEINSTNPVATEQYGSVSTNLQHGNR

SEQ ID NO: 8537 - protein, 29 aa, Artificial Sequence
  Description of Artificial Sequence: Synthetic peptide
KEEEIRTTNPVATEQYGSVDSTNLQRGNF

SEQ ID NO: 8538 - protein, 29 aa, Artificial Sequence
  Description of Artificial Sequence: Synthetic peptide
IEEEIRTTNPVATEQYGSVSTNLQMIGNR

SEQ ID NO: 8539 - protein, 28 aa, Artificial Sequence
  Description of Artificial Sequence: Synthetic peptide
DEEEIRTTNPVATEQYGSVSTNLEDGNE

SEQ ID NO: 8540 - protein, 29 aa, Artificial Sequence
  Description of Artificial Sequence: Synthetic peptide
DEEEIRTTNPVATEQYGSVSTNLQMQGNF

SEQ ID NO: 8541 - protein, 28 aa, Artificial Sequence
  Description of Artificial Sequence: Synthetic peptide
DEEEIRTTNPVATEQYGSWSDNLQRGNQ

SEQ ID NO: 8542 - protein, 28 aa, Artificial Sequence
  Description of Artificial Sequence: Synthetic peptide
DEEEIRTTNPVATEQYGSWSENDQRGNR

SEQ ID NO: 8543 - protein, 28 aa, Artificial Sequence
  Description of Artificial Sequence: Synthetic peptide
DEEEIRTTNPVATEQYGQVSTCQQRGNR

SEQ ID NO: 8544 - protein, 30 aa, Artificial Sequence
  Description of Artificial Sequence: Synthetic polypeptide
DEEEIRTTNPVATEQYGVVCSTNLQRGVNR

SEQ ID NO: 8545 - protein, 28 aa, Artificial Sequence
  Description of Artificial Sequence: Synthetic peptide
DEEEIRTTNPAATEMYGSVSTNLQQGNR

SEQ ID NO: 8546 - protein, 28 aa, Artificial Sequence
  Description of Artificial Sequence: Synthetic peptide
DENEIRTTNPVATEVYGWVSTNLQRGNR

SEQ ID NO: 8547 - protein, 30 aa, Artificial Sequence
  Description of Artificial Sequence: Synthetic polypeptide
DEEEIRTTNPVATEQYGSVSCTENLERGNR

SEQ ID NO: 8548 - protein, 30 aa, Artificial Sequence
  Description of Artificial Sequence: Synthetic polypeptide
DEEEIRTTNPLATEQYGSVSTNMLQRGNDR

SEQ ID NO: 8549 - protein, 28 aa, Artificial Sequence
  Description of Artificial Sequence: Synthetic peptide
GEEEIRTTNPVATEVYGSVSTNLERGNR

SEQ ID NO: 8550 - protein, 29 aa, Artificial Sequence
  Description of Artificial Sequence: Synthetic peptide
DEEEIRTTNPVATEQYGSVSTNLQEQGNT

SEQ ID NO: 8551 - protein, 28 aa, Artificial Sequence
  Description of Artificial Sequence: Synthetic peptide
QEEEIRTTNPVSTEQYGSVSTLLQRGNR

SEQ ID NO: 8552 - protein, 29 aa, Artificial Sequence
  Description of Artificial Sequence: Synthetic peptide
DEEEIRTTNPVATEQYGDVSTNLEQHGNR

SEQ ID NO: 8553 - protein, 29 aa, Artificial Sequence
  Description of Artificial Sequence: Synthetic peptide
DEEEIRTTNPVATEQYGSVSTNLVQDGNV

SEQ ID NO: 8554 - protein, 29 aa, Artificial Sequence
  Description of Artificial Sequence: Synthetic peptide
DEEEIRTTNPVATEQYGSVSTNLQNGNDM

SEQ ID NO: 8555 - protein, 29 aa, Artificial Sequence
  Description of Artificial Sequence: Synthetic peptide
DEEEIRTTNPVATEQYGSVSTNLQDGEND

SEQ ID NO: 8556 - protein, 29 aa, Artificial Sequence
  Description of Artificial Sequence: Synthetic peptide
DEEEIRTTNPVATEQYGSVMDTNEQRGNR

SEQ ID NO: 8557 - protein, 28 aa, Artificial Sequence
  Description of Artificial Sequence: Synthetic peptide
DEEMIRTTNPVATEQYGSVSHNLQRGNP

SEQ ID NO: 8558 - protein, 29 aa, Artificial Sequence
  Description of Artificial Sequence: Synthetic peptide
DEEEIRTTNPVATEQYGSCSTINLMRGNR

SEQ ID NO: 8559 - protein, 28 aa, Artificial Sequence
  Description of Artificial Sequence: Synthetic peptide
DEEEIRTTNPVATEQYGSVSTNDESGNR

SEQ ID NO: 8560 - protein, 28 aa, Artificial Sequence
  Description of Artificial Sequence: Synthetic peptide
DEEEIRTTNPFATEQYGSVSENLQRGND

SEQ ID NO: 8561 - protein, 28 aa, Artificial Sequence
  Description of Artificial Sequence: Synthetic peptide
DEEEIRTTNPVATEQYGSVSTNDEEGNR

SEQ ID NO: 8562 - protein, 30 aa, Artificial Sequence
  Description of Artificial Sequence: Synthetic polypeptide
DEEEIRTTNPVATEQYGSVSTNGLQDGENR

SEQ ID NO: 8563 - protein, 30 aa, Artificial Sequence
  Description of Artificial Sequence: Synthetic polypeptide
DEEEIRTTNPVATEQYGSVHSTNLDRGENR

SEQ ID NO: 8564 - protein, 28 aa, Artificial Sequence
  Description of Artificial Sequence: Synthetic peptide
DEFEIRTTNPVATEQYGDVGTNLQRGNR

SEQ ID NO: 8565 - protein, 30 aa, Artificial Sequence
  Description of Artificial Sequence: Synthetic polypeptide
DEEEIRTTNPVATEQYGSVSETNLEERGNR

SEQ ID NO: 8566 - protein, 28 aa, Artificial Sequence
  Description of Artificial Sequence: Synthetic peptide
DEEEIRTTNPYATEQYGSVSTNLQQGNN

SEQ ID NO: 8567 - protein, 30 aa, Artificial Sequence
  Description of Artificial Sequence: Synthetic polypeptide
DEEEIRTTNPVATEQYGSVSTNLQDREGND

SEQ ID NO: 8568 - protein, 29 aa, Artificial Sequence
  Description of Artificial Sequence: Synthetic peptide
DEQEIRTTNPVATEQYGVVSATNLQRGNR

SEQ ID NO: 8569 - protein, 29 aa, Artificial Sequence
  Description of Artificial Sequence: Synthetic peptide
DEEEIRTTNPTATEQYGSVSTNEQRGDNR

SEQ ID NO: 8570 - protein, 28 aa, Artificial Sequence
  Description of Artificial Sequence: Synthetic peptide
DEEEIRATNPVATEQYGGVATNLQRGNR

SEQ ID NO: 8571 - protein, 28 aa, Artificial Sequence
  Description of Artificial Sequence: Synthetic peptide
DAEEIRTTNPVATEIYGSVSTNLDRGNR

SEQ ID NO: 8572 - protein, 28 aa, Artificial Sequence
  Description of Artificial Sequence: Synthetic peptide
DEEEIRTTNPVATEAWGGVSTNLQRGNR

SEQ ID NO: 8573 - protein, 28 aa, Artificial Sequence
  Description of Artificial Sequence: Synthetic peptide
DEEEINTVNPVATEQYGSVSTNLQRGNF

SEQ ID NO: 8574 - protein, 28 aa, Artificial Sequence
  Description of Artificial Sequence: Synthetic peptide
DEEEIRTTNPVATEQYGLVSTVLQRGNG

SEQ ID NO: 8575 - protein, 29 aa, Artificial Sequence
  Description of Artificial Sequence: Synthetic peptide
DEEEIRTTNPVATEQYGSVESTNLQYGNY

SEQ ID NO: 8576 - protein, 31 aa, Artificial Sequence
  Description of Artificial Sequence: Synthetic polypeptide
DEEEIRTTNPVATEQYGSVESDTNLQRGDNR

SEQ ID NO: 8577 - protein, 30 aa, Artificial Sequence
  Description of Artificial Sequence: Synthetic polypeptide
DEEEIRTTNPVATEQYGSVSTTDLQDRGNR

SEQ ID NO: 8578 - protein, 28 aa, Artificial Sequence
  Description of Artificial Sequence: Synthetic peptide
DEEEIRTTNPVATEQYGNVSTNLQMGND

SEQ ID NO: 8579 - protein, 28 aa, Artificial Sequence
  Description of Artificial Sequence: Synthetic peptide
DEEEIRTTNPVATEQYGSVSTNLQQGEL

SEQ ID NO: 8580 - protein, 30 aa, Artificial Sequence
  Description of Artificial Sequence: Synthetic polypeptide
DEEEIRTTNPVATEQYGSVDSDTNLQRGND

SEQ ID NO: 8581 - protein, 29 aa, Artificial Sequence
  Description of Artificial Sequence: Synthetic peptide
DEEEIRTTNPVATEQYGSVSTELQDRGNG

SEQ ID NO: 8582 - protein, 29 aa, Artificial Sequence
  Description of Artificial Sequence: Synthetic peptide
DEEEIRTTNPVATEQYGSVSENLQMRGNA

SEQ ID NO: 8583 - protein, 28 aa, Artificial Sequence
  Description of Artificial Sequence: Synthetic peptide
DEELIRTTNPVATEQYGSWSTNLQDGNR

SEQ ID NO: 8584 - protein, 28 aa, Artificial Sequence
  Description of Artificial Sequence: Synthetic peptide
SEEEIRPTNPVATEQYGSVSTGLQRGNR

SEQ ID NO: 8585 - protein, 28 aa, Artificial Sequence
  Description of Artificial Sequence: Synthetic peptide
DEEEIRTTNPVATEQYGSWSTNLQHGER

SEQ ID NO: 8586 - protein, 28 aa, Artificial Sequence
  Description of Artificial Sequence: Synthetic peptide
DEDEIRTTNPVSTEQYGLVSTNLQRGNR

SEQ ID NO: 8587 - protein, 29 aa, Artificial Sequence
  Description of Artificial Sequence: Synthetic peptide
DEEEIRTTNPVASEIYGSVSTNLQRNGNR

SEQ ID NO: 8588 - protein, 29 aa, Artificial Sequence
  Description of Artificial Sequence: Synthetic peptide
DEEEIRQTNPVATEQYGSVSATNQQRGNR

SEQ ID NO: 8589 - protein, 28 aa, Artificial Sequence
  Description of Artificial Sequence: Synthetic peptide
DEEEIRPTNPVATEQYGSVSTPLFRGNR

SEQ ID NO: 8590 - protein, 29 aa, Artificial Sequence
  Description of Artificial Sequence: Synthetic peptide
KEEEIRTTNPVATEQYGWVSTNLQDRGNR

SEQ ID NO: 8591 - protein, 28 aa, Artificial Sequence
  Description of Artificial Sequence: Synthetic peptide
DEEEIRTTNPVATEQYGSVSTNVLIGNR

SEQ ID NO: 8592 - protein, 28 aa, Artificial Sequence
  Description of Artificial Sequence: Synthetic peptide
DEEEIRTTNPVCFEQYGSVSTNDQRGNR

SEQ ID NO: 8593 - protein, 28 aa, Artificial Sequence
  Description of Artificial Sequence: Synthetic peptide
DEEQIRTTNPVATEQYGSVSPNLQVGNR

SEQ ID NO: 8594 - protein, 28 aa, Artificial Sequence
  Description of Artificial Sequence: Synthetic peptide
DEEMIRTTNPVATEQYGSVSTNKERGNR

SEQ ID NO: 8595 - protein, 30 aa, Artificial Sequence
  Description of Artificial Sequence: Synthetic polypeptide
DEEEIRTTNPVATEQYGSVSDTNLQRGDER

SEQ ID NO: 8596 - protein, 30 aa, Artificial Sequence
  Description of Artificial Sequence: Synthetic polypeptide
DEEEIRTTNPVATEQYGSVSTENLQDEGNR

SEQ ID NO: 8597 - protein, 30 aa, Artificial Sequence
  Description of Artificial Sequence: Synthetic polypeptide
DEEEIRTTNPVATEQYGSVSTNLEDRGNDR

SEQ ID NO: 8598 - protein, 29 aa, Artificial Sequence
  Description of Artificial Sequence: Synthetic peptide
DEEEIRTTNPVCTEQYGSVSTNLQIGDNR

SEQ ID NO: 8599 - protein, 28 aa, Artificial Sequence
  Description of Artificial Sequence: Synthetic peptide
DEMEIRTTNPVATENYGSVSTNLGRGNR

SEQ ID NO: 8600 - protein, 28 aa, Artificial Sequence
  Description of Artificial Sequence: Synthetic peptide
DEEEIGTTNPVATEQYGSCSTTLQRGNR

SEQ ID NO: 8601 - protein, 30 aa, Artificial Sequence
  Description of Artificial Sequence: Synthetic polypeptide
DEEEIRTTNPVAWEQYGSVSTNGLQLRGNR

SEQ ID NO: 8602 - protein, 29 aa, Artificial Sequence
  Description of Artificial Sequence: Synthetic peptide
DEEEIRTTNPTATEQYGSVDSTNLQGGNR

SEQ ID NO: 8603 - protein, 30 aa, Artificial Sequence
  Description of Artificial Sequence: Synthetic polypeptide
DEEEIGTTNPVATEQYGSVGSTNLQREGNR

SEQ ID NO: 8604 - protein, 28 aa, Artificial Sequence
  Description of Artificial Sequence: Synthetic peptide
DEEEIRTTNPVATEQYGSVSTNDQAGDR

SEQ ID NO: 8605 - protein, 31 aa, Artificial Sequence
  Description of Artificial Sequence: Synthetic polypeptide
DEEEIRTTNPVATEQYGSVDSTNLPQFRGNR

SEQ ID NO: 8606 - protein, 31 aa, Artificial Sequence
  Description of Artificial Sequence: Synthetic polypeptide
DEEEIRTTNPVATEQYGSVDSTNLQREGNDR

SEQ ID NO: 8607 - protein, 30 aa, Artificial Sequence
  Description of Artificial Sequence: Synthetic polypeptide
DEEEIRTTNPVATEQYGSVSYMNLQRGNNR

SEQ ID NO: 8608 - protein, 28 aa, Artificial Sequence
  Description of Artificial Sequence: Synthetic peptide
DEEEIRTTNPCCTEQYGSASTNLQRGNR

SEQ ID NO: 8609 - protein, 28 aa, Artificial Sequence
  Description of Artificial Sequence: Synthetic peptide
DDEEIRTTNPVSTEQYGTVSTNLQRGNR

SEQ ID NO: 8610 - protein, 28 aa, Artificial Sequence
  Description of Artificial Sequence: Synthetic peptide
DEEEIRTTNPVATEVYGWVATNLQRGNR

SEQ ID NO: 8611 - protein, 30 aa, Artificial Sequence
  Description of Artificial Sequence: Synthetic polypeptide
DEEEIRTTNPVATENYGSVSLTNPLQRGNR

SEQ ID NO: 8612 - protein, 31 aa, Artificial Sequence
  Description of Artificial Sequence: Synthetic polypeptide
DEEEIRTTNPVATEQYGSVNSTNLQLREGNR

SEQ ID NO: 8613 - protein, 28 aa, Artificial Sequence
  Description of Artificial Sequence: Synthetic peptide
DEEEIRTTNPFATEQYGSVSTNLIRGER

SEQ ID NO: 8614 - protein, 31 aa, Artificial Sequence
  Description of Artificial Sequence: Synthetic polypeptide
DEEEIRTTNPVATEQYGSVSITNPLVQRGNR

SEQ ID NO: 8615 - protein, 29 aa, Artificial Sequence
  Description of Artificial Sequence: Synthetic peptide
DEEVIRTTNPVATEQYGSVSTNLRQNGNR

SEQ ID NO: 8616 - protein, 28 aa, Artificial Sequence
  Description of Artificial Sequence: Synthetic peptide
DEEEIRTTNPVAGEQYGSVSTNDYRGNR

SEQ ID NO: 8617 - protein, 29 aa, Artificial Sequence
  Description of Artificial Sequence: Synthetic peptide
DEEEIRTTNPVATEMYGSVSTNLPQRGGR

SEQ ID NO: 8618 - protein, 28 aa, Artificial Sequence
  Description of Artificial Sequence: Synthetic peptide
DEEEIRTTNPVATEQYGSVSTNLQQGDC

SEQ ID NO: 8619 - protein, 30 aa, Artificial Sequence
  Description of Artificial Sequence: Synthetic polypeptide
DEEEIVTTNPVATEQYGSVSSTNLQRGVNR

SEQ ID NO: 8620 - protein, 30 aa, Artificial Sequence
  Description of Artificial Sequence: Synthetic polypeptide
DEEEIRTTNPVATEQYGSVSETNLQPGENR

SEQ ID NO: 8621 - protein, 28 aa, Artificial Sequence
  Description of Artificial Sequence: Synthetic peptide
DEEEIRTTNPEATEQYGSVSTNLERGNM

SEQ ID NO: 8622 - protein, 28 aa, Artificial Sequence
  Description of Artificial Sequence: Synthetic peptide
MEEEIRTTNPVATEQYGDVSTLLQRGNR

SEQ ID NO: 8623 - protein, 31 aa, Artificial Sequence
  Description of Artificial Sequence: Synthetic polypeptide
DEEEIRTTNPVATEQYGSVSETHNLQIRGNR

SEQ ID NO: 8624 - protein, 28 aa, Artificial Sequence
  Description of Artificial Sequence: Synthetic peptide
DEPEISTTNPVATEQYGSVSTNIQRGNR

SEQ ID NO: 8625 - protein, 28 aa, Artificial Sequence
  Description of Artificial Sequence: Synthetic peptide
DEEEIRTTNPVATEQYGSVSTNLQDGES

SEQ ID NO: 8626 - protein, 30 aa, Artificial Sequence
  Description of Artificial Sequence: Synthetic polypeptide
DEEEIRTTNPVATEQYGVVSTNLVQLRGNR

SEQ ID NO: 8627 - protein, 30 aa, Artificial Sequence
  Description of Artificial Sequence: Synthetic polypeptide
DEEEIRTTNPVATEQYGSVSCTMNLQRGNV

SEQ ID NO: 8628 - protein, 28 aa, Artificial Sequence
  Description of Artificial Sequence: Synthetic peptide
DPEEIRTTNPVATECYGSVSTNLQDGNR

SEQ ID NO: 8629 - protein, 28 aa, Artificial Sequence
  Description of Artificial Sequence: Synthetic peptide
DEEEIRTTNPDATEQYGSVSTNDLRGNR

SEQ ID NO: 8630 - protein, 28 aa, Artificial Sequence
  Description of Artificial Sequence: Synthetic peptide
DDEEIRTVNPVATEQYGSVATNLQRGNR

SEQ ID NO: 8631 - protein, 30 aa, Artificial Sequence
  Description of Artificial Sequence: Synthetic polypeptide
DEEEISTTNPVATEQYGSVSTDNLQERGNR

SEQ ID NO: 8632 - protein, 30 aa, Artificial Sequence
  Description of Artificial Sequence: Synthetic polypeptide
DEEEIRTTNPVATEQYGSVSTNLQEREGNF

SEQ ID NO: 8633 - protein, 28 aa, Artificial Sequence
  Description of Artificial Sequence: Synthetic peptide
DEEEIRTTNPFATECYGSVSTGLQRGNR

SEQ ID NO: 8634 - protein, 28 aa, Artificial Sequence
  Description of Artificial Sequence: Synthetic peptide
DEEEIRTTNPVAVEQYGSVSTNPQRGNV

SEQ ID NO: 8635 - protein, 30 aa, Artificial Sequence
  Description of Artificial Sequence: Synthetic polypeptide
DEEEIRTTNPVATEQYGSVSTNLQDRGENE

SEQ ID NO: 8636 - protein, 28 aa, Artificial Sequence
  Description of Artificial Sequence: Synthetic peptide
DEEEIRTTNPVATEWYGSVDTNLQSGNR

SEQ ID NO: 8637 - protein, 30 aa, Artificial Sequence
  Description of Artificial Sequence: Synthetic polypeptide
DEEEIRTTNPVATEQYGSVSTNLEIRGNDR

SEQ ID NO: 8638 - protein, 28 aa, Artificial Sequence
  Description of Artificial Sequence: Synthetic peptide
DEEEIRTTNPVSTEHYGSVGTNLQRGNR

SEQ ID NO: 8639 - protein, 28 aa, Artificial Sequence
  Description of Artificial Sequence: Synthetic peptide
DENEIRTTNPVATEIYGVVSTNLQRGNR

SEQ ID NO: 8640 - protein, 30 aa, Artificial Sequence
  Description of Artificial Sequence: Synthetic polypeptide
DEEEIRTTNPVATEQYGSVSTNPQDRGINR

SEQ ID NO: 8641 - protein, 28 aa, Artificial Sequence
  Description of Artificial Sequence: Synthetic peptide
DEEEIRTTNPVATEQYGSVDTNLQLGDR

SEQ ID NO: 8642 - protein, 31 aa, Artificial Sequence
  Description of Artificial Sequence: Synthetic polypeptide
DEEEIRTTNPVATEQYGSVTSTNLQRNGENR

SEQ ID NO: 8643 - protein, 28 aa, Artificial Sequence
  Description of Artificial Sequence: Synthetic peptide
DEEEIRSTNPVATEQYGCVSMNLQRGNR

SEQ ID NO: 8644 - protein, 28 aa, Artificial Sequence
  Description of Artificial Sequence: Synthetic peptide
DEEEIRTTNPVATEQYGSVSTDLEEGNR

SEQ ID NO: 8645 - protein, 29 aa, Artificial Sequence
  Description of Artificial Sequence: Synthetic peptide
DEEEIRTTNPVATEQYGSVSTNLQEIGNA

SEQ ID NO: 8646 - protein, 30 aa, Artificial Sequence
  Description of Artificial Sequence: Synthetic polypeptide
DEEEIRTTNPVATEQYGSVSTMNLQRGNDS

SEQ ID NO: 8647 - protein, 29 aa, Artificial Sequence
  Description of Artificial Sequence: Synthetic peptide
DEEEIRTTNPVATEQYGSVSTDLQREGNS

SEQ ID NO: 8648 - protein, 31 aa, Artificial Sequence
  Description of Artificial Sequence: Synthetic polypeptide
DEEEIRTTNPVATEQYGSVSATNLQRGENDR

SEQ ID NO: 8649 - protein, 28 aa, Artificial Sequence
  Description of Artificial Sequence: Synthetic peptide
DEEEIRTTNPEATEQYGSVSTDDQRGNR

SEQ ID NO: 8650 - protein, 30 aa, Artificial Sequence
  Description of Artificial Sequence: Synthetic polypeptide
DEEEIRTTNPVATEQYGSVSTSNLTRNGNR

SEQ ID NO: 8651 - protein, 28 aa, Artificial Sequence
  Description of Artificial Sequence: Synthetic peptide
DESEIRTTNCVATEQYGSVSTNLNRGNR

SEQ ID NO: 8652 - protein, 28 aa, Artificial Sequence
  Description of Artificial Sequence: Synthetic peptide
DMEEIRTTNPVATEQYGSVSTNLQKGNE

SEQ ID NO: 8653 - protein, 28 aa, Artificial Sequence
  Description of Artificial Sequence: Synthetic peptide
SEEEIRTTNPVATEQYGSVSTNEQRGNP

SEQ ID NO: 8654 - protein, 28 aa, Artificial Sequence
  Description of Artificial Sequence: Synthetic peptide
DEVEIRTTNPVATEQYGGVSENLQRGNR

SEQ ID NO: 8655 - protein, 30 aa, Artificial Sequence
  Description of Artificial Sequence: Synthetic polypeptide
DEEEIRTTNPVATEQYGSVSVTNLLRGENR

SEQ ID NO: 8656 - protein, 28 aa, Artificial Sequence
  Description of Artificial Sequence: Synthetic peptide
DEEEIRTTNPVATEQYGSVSDNLQAGNN

SEQ ID NO: 8657 - protein, 28 aa, Artificial Sequence
  Description of Artificial Sequence: Synthetic peptide
DEEEIRTTNPVATEQYGSVETDLQRGER

SEQ ID NO: 8658 - protein, 28 aa, Artificial Sequence
  Description of Artificial Sequence: Synthetic peptide
DEEEIRTTNPEATETYGSVSTNLQRGNN

SEQ ID NO: 8659 - protein, 28 aa, Artificial Sequence
  Description of Artificial Sequence: Synthetic peptide
DEEEIRTTNPVATEQYGSVSHNLQDGNP

SEQ ID NO: 8660 - protein, 28 aa, Artificial Sequence
  Description of Artificial Sequence: Synthetic peptide
DEEEIRTTNPVATEQYGSVEHNLQRGND

SEQ ID NO: 8661 - protein, 29 aa, Artificial Sequence
  Description of Artificial Sequence: Synthetic peptide
DEQEIRTTNPVATEQWGSVSTNLQMRGNR

SEQ ID NO: 8662 - protein, 29 aa, Artificial Sequence
  Description of Artificial Sequence: Synthetic peptide
DEEEIRTTNPVATEQYGSVSTNLQEAGER

SEQ ID NO: 8663 - protein, 28 aa, Artificial Sequence
  Description of Artificial Sequence: Synthetic peptide
DLEEIRTTNPVATEQYGSVSTNDIRGNR

SEQ ID NO: 8664 - protein, 29 aa, Artificial Sequence
  Description of Artificial Sequence: Synthetic peptide
DEEEIRTTNPVATEQYGSVSTNLQEQGNH

SEQ ID NO: 8665 - protein, 29 aa, Artificial Sequence
  Description of Artificial Sequence: Synthetic peptide
DEEEIRCTNPVAYEQYGSVSATNLQRGNR

SEQ ID NO: 8666 - protein, 30 aa, Artificial Sequence
  Description of Artificial Sequence: Synthetic polypeptide
DEEEIRTTNPVATEQYGSVSTNLQELGNDR

SEQ ID NO: 8667 - protein, 29 aa, Artificial Sequence
  Description of Artificial Sequence: Synthetic peptide
DEEEIRTTNPVATEQYGSVSTMNLQVGNF

SEQ ID NO: 8668 - protein, 28 aa, Artificial Sequence
  Description of Artificial Sequence: Synthetic peptide
DEEEIRTTNPVATEQYGSVSTNLQAGDM

SEQ ID NO: 8669 - protein, 28 aa, Artificial Sequence
  Description of Artificial Sequence: Synthetic peptide
DEEEIRTTNPEATEQYGSVSTNLQEGNL

SEQ ID NO: 8670 - protein, 28 aa, Artificial Sequence
  Description of Artificial Sequence: Synthetic peptide
DEEEIRTTNPVATEQYGSVSTNLQWGET

SEQ ID NO: 8671 - protein, 30 aa, Artificial Sequence
  Description of Artificial Sequence: Synthetic polypeptide
DEEEIRTTNPVATEQYGSVSTMNLQTGNDR

SEQ ID NO: 8672 - protein, 28 aa, Artificial Sequence
  Description of Artificial Sequence: Synthetic peptide
DEEEIRTTNPVATEQYGSVSHNLQRGIP

SEQ ID NO: 8673 - protein, 28 aa, Artificial Sequence
  Description of Artificial Sequence: Synthetic peptide
DEEEIRTTNPVATEQYGSVSTCLQNGNA

SEQ ID NO: 8674 - protein, 28 aa, Artificial Sequence
  Description of Artificial Sequence: Synthetic peptide
DEEEIRTTNPVATEQYGSVSTNLQVGEL

SEQ ID NO: 8675 - protein, 28 aa, Artificial Sequence
  Description of Artificial Sequence: Synthetic peptide
DEEEIRTTNPTATEQYGDVSTYLQRGNR

SEQ ID NO: 8676 - protein, 30 aa, Artificial Sequence
  Description of Artificial Sequence: Synthetic polypeptide
DEEEIRTTNPVATEQYGSVSTNLQERGNDS

SEQ ID NO: 8677 - protein, 29 aa, Artificial Sequence
  Description of Artificial Sequence: Synthetic peptide
DEEEIRTTNPVATEQYGSVDTDLVQRGNR

SEQ ID NO: 8678 - protein, 29 aa, Artificial Sequence
  Description of Artificial Sequence: Synthetic peptide
DEEEIRTTNPVATECYGSVSTNLQRGNDD

SEQ ID NO: 8679 - protein, 28 aa, Artificial Sequence
  Description of Artificial Sequence: Synthetic peptide
DEEEIRSVNPVATEQYGNVSTNLQRGNR

SEQ ID NO: 8680 - protein, 30 aa, Artificial Sequence
  Description of Artificial Sequence: Synthetic polypeptide
DEEEIRTTNPVATEQYGSVSTNPLDREGNR

SEQ ID NO: 8681 - protein, 28 aa, Artificial Sequence
  Description of Artificial Sequence: Synthetic peptide
DEEEIRCTNPVATEQYGGVSTNLQRGTR

SEQ ID NO: 8682 - protein, 28 aa, Artificial Sequence
  Description of Artificial Sequence: Synthetic peptide
DEEEIRQTNPVATEQYGEVPTNLQRGNR

SEQ ID NO: 8683 - protein, 31 aa, Artificial Sequence
  Description of Artificial Sequence: Synthetic polypeptide
DEEEIRTTNPVATEQYGSTVSTNLQREGENR

SEQ ID NO: 8684 - protein, 28 aa, Artificial Sequence
  Description of Artificial Sequence: Synthetic peptide
DEEEIRTTNPVATEQMGYVSTNLQNGNR

SEQ ID NO: 8685 - protein, 30 aa, Artificial Sequence
  Description of Artificial Sequence: Synthetic polypeptide
DEGEIRTTNPVATEQYGSVSTMNLQRGENR

SEQ ID NO: 8686 - protein, 28 aa, Artificial Sequence
  Description of Artificial Sequence: Synthetic peptide
DEEEIRATNPVATEQYGSVSTNLQPGNE

SEQ ID NO: 8687 - protein, 28 aa, Artificial Sequence
  Description of Artificial Sequence: Synthetic peptide
DEEEIRTTNPFATEQYGSVSTNLTHGNR

SEQ ID NO: 8688 - protein, 28 aa, Artificial Sequence
  Description of Artificial Sequence: Synthetic peptide
DEEEIRTTNPDATEQYGSVSTNLDRGNP

SEQ ID NO: 8689 - protein, 29 aa, Artificial Sequence
  Description of Artificial Sequence: Synthetic peptide
DEEEIRTTNPVATEQYGSVSTNLDEDGNR

SEQ ID NO: 8690 - protein, 28 aa, Artificial Sequence
  Description of Artificial Sequence: Synthetic peptide
DEEEIRTTNPFATEQYGSVSTNLTRGNS

SEQ ID NO: 8691 - protein, 28 aa, Artificial Sequence
  Description of Artificial Sequence: Synthetic peptide
DEEEIRQTNPVSTEQYGSVSTNLQRENR

SEQ ID NO: 8692 - protein, 29 aa, Artificial Sequence
  Description of Artificial Sequence: Synthetic peptide
DEEEIVTTNPVATEQYGSVSCENLQRGNR

SEQ ID NO: 8693 - protein, 29 aa, Artificial Sequence
  Description of Artificial Sequence: Synthetic peptide
DEEEIRTTNPVATEQYGSVITNLQRGIER

SEQ ID NO: 8694 - protein, 28 aa, Artificial Sequence
  Description of Artificial Sequence: Synthetic peptide
DEEEIRTTNPVSTEQYGSYSTNLERGNR

SEQ ID NO: 8695 - protein, 28 aa, Artificial Sequence
  Description of Artificial Sequence: Synthetic peptide
DEEEIRQTNPVATEQYGWVSTNLQRGGR

SEQ ID NO: 8696 - protein, 30 aa, Artificial Sequence
  Description of Artificial Sequence: Synthetic polypeptide
DEEEIRTTNPEATEQYGSVSETNLQRGNPR

SEQ ID NO: 8697 - protein, 28 aa, Artificial Sequence
  Description of Artificial Sequence: Synthetic peptide
DEEEIRTTNPVATEQYGSVDTDLERGNR

SEQ ID NO: 8698 - protein, 30 aa, Artificial Sequence
  Description of Artificial Sequence: Synthetic polypeptide
DEEEIRTTNPVATEQYGSVSTNLQREGNED

SEQ ID NO: 8699 - protein, 28 aa, Artificial Sequence
  Description of Artificial Sequence: Synthetic peptide
DEEEIRSTNPVATECYGSVSTNLQRPNR

SEQ ID NO: 8700 - protein, 31 aa, Artificial Sequence
  Description of Artificial Sequence: Synthetic polypeptide
DEEEIRTTNPVATEQYGSVSTDNLVQRGNDR

SEQ ID NO: 8701 - protein, 28 aa, Artificial Sequence
  Description of Artificial Sequence: Synthetic peptide
DEEEIYTTNPVATEIYGSVSTNEQRGNR

SEQ ID NO: 8702 - protein, 28 aa, Artificial Sequence
  Description of Artificial Sequence: Synthetic peptide
DEEEITATNPVATEQYGSVATNLQRGNR

SEQ ID NO: 8703 - protein, 28 aa, Artificial Sequence
  Description of Artificial Sequence: Synthetic peptide
QEHEIRTTNPVATEQYGSVSTNLQRENR

SEQ ID NO: 8704 - protein, 29 aa, Artificial Sequence
  Description of Artificial Sequence: Synthetic peptide
DEEEIRTTNPVATEQYGSVSTNLQVAGNI

SEQ ID NO: 8705 - protein, 30 aa, Artificial Sequence
  Description of Artificial Sequence: Synthetic polypeptide
DEEEIRTTNPVATEQYGSVSPENNLQRGNR

SEQ ID NO: 8706 - protein, 28 aa, Artificial Sequence
  Description of Artificial Sequence: Synthetic peptide
DEEELRTTNPVATEIYGVVSTNLQRGNR

SEQ ID NO: 8707 - protein, 28 aa, Artificial Sequence
  Description of Artificial Sequence: Synthetic peptide
DEESIRTTNPVATEQYGSPSTNLQRGNV

SEQ ID NO: 8708 - protein, 29 aa, Artificial Sequence
  Description of Artificial Sequence: Synthetic peptide
DEQEIRTTNPVATEQYGSVSTPLQRGNDR

SEQ ID NO: 8709 - protein, 29 aa, Artificial Sequence
  Description of Artificial Sequence: Synthetic peptide
DEEEIRTTNPVATEQYGSWSTNDQRGNPR

SEQ ID NO: 8710 - protein, 28 aa, Artificial Sequence
  Description of Artificial Sequence: Synthetic peptide
DEEEIRTTNPCCTEQYGSVATNLQRGNR

SEQ ID NO: 8711 - protein, 28 aa, Artificial Sequence
  Description of Artificial Sequence: Synthetic peptide
DEEEIRTTNPVATEQYGSVSTCDQHGNR

SEQ ID NO: 8712 - protein, 28 aa, Artificial Sequence
  Description of Artificial Sequence: Synthetic peptide
DAEEIRTTNPVATEQYGSVSTNGQTGNR

SEQ ID NO: 8713 - protein, 31 aa, Artificial Sequence
  Description of Artificial Sequence: Synthetic polypeptide
DEEEIRTTNPVATEQYGSVISTNLQMREGNR

SEQ ID NO: 8714 - protein, 28 aa, Artificial Sequence
  Description of Artificial Sequence: Synthetic peptide
DEEEIRTTNPVSTEIYGSVATNLQRGNR

SEQ ID NO: 8715 - protein, 28 aa, Artificial Sequence
  Description of Artificial Sequence: Synthetic peptide
DEEEIETTNPVATEQYGSVSTNLQVGNF

SEQ ID NO: 8716 - protein, 28 aa, Artificial Sequence
  Description of Artificial Sequence: Synthetic peptide
DEECIRTTNPVATEQYGSVSTNDERGNR

SEQ ID NO: 8717 - protein, 28 aa, Artificial Sequence
  Description of Artificial Sequence: Synthetic peptide
DEEEIRTTNPVATEQYGSVSTDLEIGNR

SEQ ID NO: 8718 - protein, 28 aa, Artificial Sequence
  Description of Artificial Sequence: Synthetic peptide
DEEEIRTTNPAATEQYGSVSTNEQRGNS

SEQ ID NO: 8719 - protein, 28 aa, Artificial Sequence
  Description of Artificial Sequence: Synthetic peptide
MEEEIRTTNPVATVQYGSVSTNDQRGNR

SEQ ID NO: 8720 - protein, 28 aa, Artificial Sequence
  Description of Artificial Sequence: Synthetic peptide
DEEEIRTTNPDATEQYGSVSTDPQRGNR

SEQ ID NO: 8721 - protein, 30 aa, Artificial Sequence
  Description of Artificial Sequence: Synthetic polypeptide
DEEEIRTTNPVATEQYGSVSTNLQDIGNDR

SEQ ID NO: 8722 - protein, 28 aa, Artificial Sequence
  Description of Artificial Sequence: Synthetic peptide
YEEEIRTTNPVATEQYGEVSTVLQRGNR

SEQ ID NO: 8723 - protein, 29 aa, Artificial Sequence
  Description of Artificial Sequence: Synthetic peptide
DEEEIRTTNPVATEQWGSVSGTNLQRGNP

SEQ ID NO: 8724 - protein, 29 aa, Artificial Sequence
  Description of Artificial Sequence: Synthetic peptide
DEEEIRTTNPVATEQYGVVSTNLQDRGNF

SEQ ID NO: 8725 - protein, 28 aa, Artificial Sequence
  Description of Artificial Sequence: Synthetic peptide
DEEEIRTTNPVATEMYGNVSTLLQRGNR

SEQ ID NO: 8726 - protein, 29 aa, Artificial Sequence
  Description of Artificial Sequence: Synthetic peptide
DEEEIRTTNPTATEQYGSVSTANEQRGNR

SEQ ID NO: 8727 - protein, 29 aa, Artificial Sequence
  Description of Artificial Sequence: Synthetic peptide
DEEEIRTTNPFATEQYGSVSTNLQREGND

SEQ ID NO: 8728 - protein, 31 aa, Artificial Sequence
  Description of Artificial Sequence: Synthetic polypeptide
DEEEIRTTNPVATEQYGSVDSTNGLQRGNDR

SEQ ID NO: 8729 - protein, 30 aa, Artificial Sequence
  Description of Artificial Sequence: Synthetic polypeptide
DCEEIRTTNPVATEQYGSVSTNLQRAGLNR

SEQ ID NO: 8730 - protein, 29 aa, Artificial Sequence
  Description of Artificial Sequence: Synthetic peptide
DEEEIRTTNPTATEQYGSVSTNLQRGDNS

SEQ ID NO: 8731 - protein, 29 aa, Artificial Sequence
  Description of Artificial Sequence: Synthetic peptide
DGEEIRTTNPVATEQYGSVPDTNLQRGNR

SEQ ID NO: 8732 - protein, 29 aa, Artificial Sequence
  Description of Artificial Sequence: Synthetic peptide
DEEEIRTTNPVATAQYGSVSTMNLQRENR

SEQ ID NO: 8733 - protein, 30 aa, Artificial Sequence
  Description of Artificial Sequence: Synthetic polypeptide
DEEEIRTTNPVATEWYGSVSTNPLQNRGNR

SEQ ID NO: 8734 - protein, 28 aa, Artificial Sequence
  Description of Artificial Sequence: Synthetic peptide
DEECIRTTNPVATAQYGSVSTNLQRENR

SEQ ID NO: 8735 - protein, 28 aa, Artificial Sequence
  Description of Artificial Sequence: Synthetic peptide
KENEIRTTNPVATEQYGSVSTNLQRGNI

SEQ ID NO: 8736 - protein, 28 aa, Artificial Sequence
  Description of Artificial Sequence: Synthetic peptide
DEEEIRTTNPIATEQYGSVSYNLQFGNR

SEQ ID NO: 8737 - protein, 30 aa, Artificial Sequence
  Description of Artificial Sequence: Synthetic polypeptide
DEEEIRTTNPVATEQYGESVSTNLVQRGER

SEQ ID NO: 8738 - protein, 31 aa, Artificial Sequence
  Description of Artificial Sequence: Synthetic polypeptide
DEEEIRTTNPVATEQYGSMVSDTNLQRGENR

SEQ ID NO: 8739 - protein, 30 aa, Artificial Sequence
  Description of Artificial Sequence: Synthetic polypeptide
DEEEIRTTNPVAYEQYGSVSTMNLQRGINR

SEQ ID NO: 8740 - protein, 28 aa, Artificial Sequence
  Description of Artificial Sequence: Synthetic peptide
DEEEIRATNPVATHQYGSVSTNLDRGNR

SEQ ID NO: 8741 - protein, 28 aa, Artificial Sequence
  Description of Artificial Sequence: Synthetic peptide
DEEEIRTTNPAATEQYGSVSTGLQRGLR

SEQ ID NO: 8742 - protein, 29 aa, Artificial Sequence
  Description of Artificial Sequence: Synthetic peptide
DEEEIRTTNPVATEQYGSVSTNLQWKGNY

SEQ ID NO: 8743 - protein, 30 aa, Artificial Sequence
  Description of Artificial Sequence: Synthetic polypeptide
DEEEIRTTNPVATEQYGSVSTTNLERGDNR

SEQ ID NO: 8744 - protein, 28 aa, Artificial Sequence
  Description of Artificial Sequence: Synthetic peptide
DEEEIATTNPVATEQWGSVSTNLERGNR

SEQ ID NO: 8745 - protein, 28 aa, Artificial Sequence
  Description of Artificial Sequence: Synthetic peptide
DEEEIRTTNPEATEQYGSVSTNLDRGDR

SEQ ID NO: 8746 - protein, 29 aa, Artificial Sequence
  Description of Artificial Sequence: Synthetic peptide
DEEEIRTTNPVATEQYGSVETNQQRGNDR

SEQ ID NO: 8747 - protein, 28 aa, Artificial Sequence
  Description of Artificial Sequence: Synthetic peptide
DEEEIRTTNPVATEQYGSVSTNLQHGEQ

SEQ ID NO: 8748 - protein, 29 aa, Artificial Sequence
  Description of Artificial Sequence: Synthetic peptide
DEEEIRCTNPVATENYGSVSATNLQRGNR

SEQ ID NO: 8749 - protein, 30 aa, Artificial Sequence
  Description of Artificial Sequence: Synthetic polypeptide
DEEEIRTTNPVATEQYGSVDSTNLDRGNER

SEQ ID NO: 8750 - protein, 29 aa, Artificial Sequence
  Description of Artificial Sequence: Synthetic peptide
DENEIRTTNPVATEQYGSVSTNLQREGER

SEQ ID NO: 8751 - protein, 29 aa, Artificial Sequence
  Description of Artificial Sequence: Synthetic peptide
DEEEIRTTNPTATEQYGSVSEMNLQRGNR

SEQ ID NO: 8752 - protein, 28 aa, Artificial Sequence
  Description of Artificial Sequence: Synthetic peptide
DEEEIRTTNPEATEQYGSVSTNLQRGEF

SEQ ID NO: 8753 - protein, 28 aa, Artificial Sequence
  Description of Artificial Sequence: Synthetic peptide
DEQEIRTTNPVATEHYGVVSTNLQRGNR

SEQ ID NO: 8754 - protein, 28 aa, Artificial Sequence
  Description of Artificial Sequence: Synthetic peptide
DEEEIRTTNPEATEQYGSVSTNDQRGER

SEQ ID NO: 8755 - protein, 28 aa, Artificial Sequence
  Description of Artificial Sequence: Synthetic peptide
DEEEIRTTNPVATEQYGSVETNLERGDR

SEQ ID NO: 8756 - protein, 30 aa, Artificial Sequence
  Description of Artificial Sequence: Synthetic polypeptide
DEEEIRSTNPVATEQYGSVSTNLPQRGNTR

SEQ ID NO: 8757 - protein, 29 aa, Artificial Sequence
  Description of Artificial Sequence: Synthetic peptide
DEEEIRTTNPVATEQYGSVQITDLQRGNR

SEQ ID NO: 8758 - protein, 28 aa, Artificial Sequence
  Description of Artificial Sequence: Synthetic peptide
DEEEIRTTNPVATEQWGSWSTNLIRGNR

SEQ ID NO: 8759 - protein, 28 aa, Artificial Sequence
  Description of Artificial Sequence: Synthetic peptide
DEEEIRSTNPVATEQYGSVDTNLQRGND

SEQ ID NO: 8760 - protein, 28 aa, Artificial Sequence
  Description of Artificial Sequence: Synthetic peptide
DEESIRTTNPVATEQYGQVSTNLQIGNR

SEQ ID NO: 8761 - protein, 30 aa, Artificial Sequence
  Description of Artificial Sequence: Synthetic polypeptide
DEEEIRTTNPVATEQYGSVSTMNLQELGNR

SEQ ID NO: 8762 - protein, 30 aa, Artificial Sequence
  Description of Artificial Sequence: Synthetic polypeptide
DEEEIRTTNPVATEQYGSVSTNLQYDGNDR

SEQ ID NO: 8763 - protein, 29 aa, Artificial Sequence
  Description of Artificial Sequence: Synthetic peptide
DEEEIRTTNPVATEQYGSVSETNLQDGND

SEQ ID NO: 8764 - protein, 28 aa, Artificial Sequence
  Description of Artificial Sequence: Synthetic peptide
DEEEIRATNPVSTECYGSVSTNLQRGNR

SEQ ID NO: 8765 - protein, 29 aa, Artificial Sequence
  Description of Artificial Sequence: Synthetic peptide
DEEEIRTTNPVATEQYGSVSCTNLQSGNF

SEQ ID NO: 8766 - protein, 28 aa, Artificial Sequence
  Description of Artificial Sequence: Synthetic peptide
DEEEIRTTNPVATEQYGSVSTNPQFGNL

SEQ ID NO: 8767 - protein, 29 aa, Artificial Sequence
  Description of Artificial Sequence: Synthetic peptide
DEEEIRCTNPVATEQYGSVSWNLQREGNR

SEQ ID NO: 8768 - protein, 28 aa, Artificial Sequence
  Description of Artificial Sequence: Synthetic peptide
DEEEIRTTNPVATEQYGSVSTNLQWGEQ

SEQ ID NO: 8769 - protein, 30 aa, Artificial Sequence
  Description of Artificial Sequence: Synthetic polypeptide
DEEEIRTTNPVATEQYGSVSTNLQRYDNTR

SEQ ID NO: 8770 - protein, 30 aa, Artificial Sequence
  Description of Artificial Sequence: Synthetic polypeptide
DEEEIRTTNPVATEQYGSFVSTNLQNGHNR

SEQ ID NO: 8771 - protein, 28 aa, Artificial Sequence
  Description of Artificial Sequence: Synthetic peptide
DEEEIRTTNPVATEQYGSVSTELQDGER

SEQ ID NO: 8772 - protein, 28 aa, Artificial Sequence
  Description of Artificial Sequence: Synthetic peptide
DEEEIRTTNPVATEVYGSVSTNLMRGPR

SEQ ID NO: 8773 - protein, 30 aa, Artificial Sequence
  Description of Artificial Sequence: Synthetic polypeptide
DEEEIRTTNPVATEQYGSVSTANLQARGNV

SEQ ID NO: 8774 - protein, 28 aa, Artificial Sequence
  Description of Artificial Sequence: Synthetic peptide
DEEEIRTTNPDATEQYGSVSTNEQAGNR

SEQ ID NO: 8775 - protein, 28 aa, Artificial Sequence
  Description of Artificial Sequence: Synthetic peptide
DEEEIATTNPVATEQYGSVDENLQRGNR

SEQ ID NO: 8776 - protein, 28 aa, Artificial Sequence
  Description of Artificial Sequence: Synthetic peptide
DEQEIVTTNPVATEHYGSVSTNLQRGNR

SEQ ID NO: 8777 - protein, 29 aa, Artificial Sequence
  Description of Artificial Sequence: Synthetic peptide
DEEEIRTTNPDATEQYGSVSTENLDRGNR

SEQ ID NO: 8778 - protein, 28 aa, Artificial Sequence
  Description of Artificial Sequence: Synthetic peptide
KEEEIRTTNPVATEQYGSVSTDLQRGDR

SEQ ID NO: 8779 - protein, 29 aa, Artificial Sequence
  Description of Artificial Sequence: Synthetic peptide
DEEEIRTTNPDATEQYGSVSTNLEERGNR

SEQ ID NO: 8780 - protein, 28 aa, Artificial Sequence
  Description of Artificial Sequence: Synthetic peptide
HEEEIRTTNPTATEQYGSVSTNLARGNR

SEQ ID NO: 8781 - protein, 29 aa, Artificial Sequence
  Description of Artificial Sequence: Synthetic peptide
DEEEIRTTNPVATEQYGSVSTNLQELGNV

SEQ ID NO: 8782 - protein, 28 aa, Artificial Sequence
  Description of Artificial Sequence: Synthetic peptide
DEEEIRTTNPVATEQYGAVSTNLQPPNR

SEQ ID NO: 8783 - protein, 30 aa, Artificial Sequence
  Description of Artificial Sequence: Synthetic polypeptide
DEEEIRTTNPVATEQYGSVHSTNDVQRGNR

SEQ ID NO: 8784 - protein, 29 aa, Artificial Sequence
  Description of Artificial Sequence: Synthetic peptide
DEEEIRTTNPVATEQYGSVSDTELQRGNL

SEQ ID NO: 8785 - protein, 28 aa, Artificial Sequence
  Description of Artificial Sequence: Synthetic peptide
DEEEIATTNPVATEQYGDVSTCLQRGNR

SEQ ID NO: 8786 - protein, 29 aa, Artificial Sequence
  Description of Artificial Sequence: Synthetic peptide
DEEEIRTTNPVATECYGSVSCTNLQRGNC

SEQ ID NO: 8787 - protein, 30 aa, Artificial Sequence
  Description of Artificial Sequence: Synthetic polypeptide
DEEEIRTTNPVATEQYGSVSTDPLPQRGNR

SEQ ID NO: 8788 - protein, 28 aa, Artificial Sequence
  Description of Artificial Sequence: Synthetic peptide
DENEINTTNPVATEQFGSVSTNLQRGNR

SEQ ID NO: 8789 - protein, 29 aa, Artificial Sequence
  Description of Artificial Sequence: Synthetic peptide
DEEQIRTTNPVATEIYGSVSTNLQRGDNR

SEQ ID NO: 8790 - protein, 29 aa, Artificial Sequence
  Description of Artificial Sequence: Synthetic peptide
DEEEIRTTNPVATEQYGSVTSTNLQAGNG

SEQ ID NO: 8791 - protein, 28 aa, Artificial Sequence
  Description of Artificial Sequence: Synthetic peptide
DEEEIRTTNPEATEQYGSVSTNLQFGNM

SEQ ID NO: 8792 - protein, 28 aa, Artificial Sequence
  Description of Artificial Sequence: Synthetic peptide
DEEEIRTTNPEATEQYGSVSTNLQFGNI

SEQ ID NO: 8793 - protein, 29 aa, Artificial Sequence
  Description of Artificial Sequence: Synthetic peptide
DEEEIRTTNPVATEQYGSTSCTNLERGNR

SEQ ID NO: 8794 - protein, 28 aa, Artificial Sequence
  Description of Artificial Sequence: Synthetic peptide
DEEEIRTTNPVATECYGSVSTNLQPGND

SEQ ID NO: 8795 - protein, 28 aa, Artificial Sequence
  Description of Artificial Sequence: Synthetic peptide
DEEEIRTTNPVCTEQYGSVDTNLQTGNR

SEQ ID NO: 8796 - protein, 31 aa, Artificial Sequence
  Description of Artificial Sequence: Synthetic polypeptide
DEEEIRTTNPVATEQYGSVSETNLQRDGNPR

SEQ ID NO: 8797 - protein, 30 aa, Artificial Sequence
  Description of Artificial Sequence: Synthetic polypeptide
DEEEIRTTNPVATEQFGSVSTMNLQRGDNR

SEQ ID NO: 8798 - protein, 31 aa, Artificial Sequence
  Description of Artificial Sequence: Synthetic polypeptide
DEEEIRTTNPVATEQYGMSVSTNLVQRGNDR

SEQ ID NO: 8799 - protein, 30 aa, Artificial Sequence
  Description of Artificial Sequence: Synthetic polypeptide
DEEEIRTTNPVATEQYGSVSTNLVQIRGNQ

SEQ ID NO: 8800 - protein, 29 aa, Artificial Sequence
  Description of Artificial Sequence: Synthetic peptide
DEEEIRTTNPVATEQYGSVSTNLMIRGNL

SEQ ID NO: 8801 - protein, 30 aa, Artificial Sequence
  Description of Artificial Sequence: Synthetic polypeptide
DEEEIRTTNPVATEQYGSVSCTNLCRGNDR

SEQ ID NO: 8802 - protein, 30 aa, Artificial Sequence
  Description of Artificial Sequence: Synthetic polypeptide
DEEEIRTTNPVATEQYGSVSEMNLQRGNDR

SEQ ID NO: 8803 - protein, 29 aa, Artificial Sequence
  Description of Artificial Sequence: Synthetic peptide
DEEEIRTTNPVATEQYGSVSTNLRFRGNQ

SEQ ID NO: 8804 - protein, 28 aa, Artificial Sequence
  Description of Artificial Sequence: Synthetic peptide
DPEEIRTTNPVATECYGSVSTNDQRGNR

SEQ ID NO: 8805 - protein, 30 aa, Artificial Sequence
  Description of Artificial Sequence: Synthetic polypeptide
DPEEIRTTNPVATEQYGSVSTHNLQERGNR

SEQ ID NO: 8806 - protein, 30 aa, Artificial Sequence
  Description of Artificial Sequence: Synthetic polypeptide
DEEEIRTTNPVATEQYGSVQTANLQRGINR

SEQ ID NO: 8807 - protein, 30 aa, Artificial Sequence
  Description of Artificial Sequence: Synthetic polypeptide
DEEEIRTTNPVATEQYGSVSCTNLQLRGNQ

SEQ ID NO: 8808 - protein, 28 aa, Artificial Sequence
  Description of Artificial Sequence: Synthetic peptide
DEEEISATNPVATEQYGSVSTTLQRGNR

SEQ ID NO: 8809 - protein, 29 aa, Artificial Sequence
  Description of Artificial Sequence: Synthetic peptide
DEEEIRTTNPVATEAYGSVSYTALQRGNR

SEQ ID NO: 8810 - protein, 28 aa, Artificial Sequence
  Description of Artificial Sequence: Synthetic peptide
DEEEIRTTNPDATEQYGSVSTNLIPGNR

SEQ ID NO: 8811 - protein, 30 aa, Artificial Sequence
  Description of Artificial Sequence: Synthetic polypeptide
DEEEIRTTNPVATEQYGSVSTNLQREGNDA

SEQ ID NO: 8812 - protein, 28 aa, Artificial Sequence
  Description of Artificial Sequence: Synthetic peptide
DENEIATTNPVATEHYGSVSTNLQRGNR

SEQ ID NO: 8813 - protein, 28 aa, Artificial Sequence
  Description of Artificial Sequence: Synthetic peptide
DEEEIRTTNPVATEVYGAVSNNLQRGNR

SEQ ID NO: 8814 - protein, 29 aa, Artificial Sequence
  Description of Artificial Sequence: Synthetic peptide
DEEEIRTTNPVATELYGVVSATNLQRGNR

SEQ ID NO: 8815 - protein, 28 aa, Artificial Sequence
  Description of Artificial Sequence: Synthetic peptide
DEEEIRTTNPEATEQYGSVSTNLDRGER

SEQ ID NO: 8816 - protein, 28 aa, Artificial Sequence
  Description of Artificial Sequence: Synthetic peptide
DEEEIRTTNPEATEQYGSVSTNLERGNF

SEQ ID NO: 8817 - protein, 29 aa, Artificial Sequence
  Description of Artificial Sequence: Synthetic peptide
DEEEIRTTNPTATEQYGSVDSTNLQRGNE

SEQ ID NO: 8818 - protein, 29 aa, Artificial Sequence
  Description of Artificial Sequence: Synthetic peptide
DEEEIRTTNPVATEQYGSVSTNLEDRGER

SEQ ID NO: 8819 - protein, 28 aa, Artificial Sequence
  Description of Artificial Sequence: Synthetic peptide
DEEEIRTTNPDAFEQYGSVSTNDQRGNR

SEQ ID NO: 8820 - protein, 28 aa, Artificial Sequence
  Description of Artificial Sequence: Synthetic peptide
DEEHIRTTNPVATEQYGSVDTNLQRGNN

SEQ ID NO: 8821 - protein, 29 aa, Artificial Sequence
  Description of Artificial Sequence: Synthetic peptide
QEDEIRTTNPVATEQYGSVSATNLQRGNR

SEQ ID NO: 8822 - protein, 28 aa, Artificial Sequence
  Description of Artificial Sequence: Synthetic peptide
DEEEIVTVNPVATEQYGSVSTNIQRGNR

SEQ ID NO: 8823 - protein, 28 aa, Artificial Sequence
  Description of Artificial Sequence: Synthetic peptide
DEEEIRTTNPEATEQYGSVSTNLERGNP

SEQ ID NO: 8824 - protein, 28 aa, Artificial Sequence
  Description of Artificial Sequence: Synthetic peptide
KEEEIRTTNPVATEQYGSVSTDLQNGNR

SEQ ID NO: 8825 - protein, 30 aa, Artificial Sequence
  Description of Artificial Sequence: Synthetic polypeptide
DEEEIRTTNPVATEQYGSVISTNLPQQGNR

SEQ ID NO: 8826 - protein, 28 aa, Artificial Sequence
  Description of Artificial Sequence: Synthetic peptide
DEEEIRTTNPVATEQYGSVSENLQAGNC

SEQ ID NO: 8827 - protein, 29 aa, Artificial Sequence
  Description of Artificial Sequence: Synthetic peptide
DLEEIRTTNPVATEQYGSVSTVNLQSGNR

SEQ ID NO: 8828 - protein, 31 aa, Artificial Sequence
  Description of Artificial Sequence: Synthetic polypeptide
DEEEIRTTNPVATEQYGSVISTNLPQRGINR

SEQ ID NO: 8829 - protein, 29 aa, Artificial Sequence
  Description of Artificial Sequence: Synthetic peptide
DEEEIRTTNPVATEQYGSVSCTNLQQGNA

SEQ ID NO: 8830 - protein, 29 aa, Artificial Sequence
  Description of Artificial Sequence: Synthetic peptide
DEEEIRTTNPVATEQYGSWSTNLQEPGNR

SEQ ID NO: 8831 - protein, 29 aa, Artificial Sequence
  Description of Artificial Sequence: Synthetic peptide
DTEEIRTTNPVATEQYGSVSTGLQRGNGR

SEQ ID NO: 8832 - protein, 28 aa, Artificial Sequence
  Description of Artificial Sequence: Synthetic peptide
DEEEIRTTNPVATEIYGVVSTNLQRGTR

SEQ ID NO: 8833 - protein, 31 aa, Artificial Sequence
  Description of Artificial Sequence: Synthetic polypeptide
DEEEIRTTNPVATEQYGSVSNTMNLQRPGNR

SEQ ID NO: 8834 - protein, 30 aa, Artificial Sequence
  Description of Artificial Sequence: Synthetic polypeptide
DEEEIRTTNPVATEQYGSVSTNLQELEGNR

SEQ ID NO: 8835 - protein, 29 aa, Artificial Sequence
  Description of Artificial Sequence: Synthetic peptide
DEEEIRTTNPDATEQYGSVSTQNLQTGNR

SEQ ID NO: 8836 - protein, 29 aa, Artificial Sequence
  Description of Artificial Sequence: Synthetic peptide
DEEEIRTTNPVATEQYGSVSTNLQDNGNL

SEQ ID NO: 8837 - protein, 28 aa, Artificial Sequence
  Description of Artificial Sequence: Synthetic peptide
VEEEIRTTNPVATEQYGSVGNNLQRGNR

SEQ ID NO: 8838 - protein, 28 aa, Artificial Sequence
  Description of Artificial Sequence: Synthetic peptide
DEEEIRTTNPVATEQYGSWSTNLFAGNR

SEQ ID NO: 8839 - protein, 28 aa, Artificial Sequence
  Description of Artificial Sequence: Synthetic peptide
DEEEIRTTNPVATEQYGSVSTNEQEGER

SEQ ID NO: 8840 - protein, 29 aa, Artificial Sequence
  Description of Artificial Sequence: Synthetic peptide
DEEEIRTTNPVATEQYGSVSTNLQDGENS

SEQ ID NO: 8841 - protein, 29 aa, Artificial Sequence
  Description of Artificial Sequence: Synthetic peptide
DEELIRTTNPVATEQYGSVTSTNLQRGER

SEQ ID NO: 8842 - protein, 30 aa, Artificial Sequence
  Description of Artificial Sequence: Synthetic polypeptide
DEEEIRTTNPVATELYGSVSTNGLQRGVNR

SEQ ID NO: 8843 - protein, 29 aa, Artificial Sequence
  Description of Artificial Sequence: Synthetic peptide
DEEEIRTTNPVATEQYGSVSTNLQELGNF

SEQ ID NO: 8844 - protein, 29 aa, Artificial Sequence
  Description of Artificial Sequence: Synthetic peptide
DEEEIRTTNPVATEQFGSVATANLQRGNR

SEQ ID NO: 8845 - protein, 28 aa, Artificial Sequence
  Description of Artificial Sequence: Synthetic peptide
DEEEIRTTNPVATECYGSVSTNLQDGNA

SEQ ID NO: 8846 - protein, 28 aa, Artificial Sequence
  Description of Artificial Sequence: Synthetic peptide
DEEEIRTTNPDATEQYGSVSTNLQVGER

SEQ ID NO: 8847 - protein, 30 aa, Artificial Sequence
  Description of Artificial Sequence: Synthetic polypeptide
DEEEIRTTNPVATEQYGSVSCTNLQVDGNR

SEQ ID NO: 8848 - protein, 31 aa, Artificial Sequence
  Description of Artificial Sequence: Synthetic polypeptide
DEEEIRTTNPVATEQYGSVDSDTDNLQRGNR

SEQ ID NO: 8849 - protein, 31 aa, Artificial Sequence
  Description of Artificial Sequence: Synthetic polypeptide
DEEEIRTTNPVATEQYGSYVSTPNLQRGNPR

SEQ ID NO: 8850 - protein, 29 aa, Artificial Sequence
  Description of Artificial Sequence: Synthetic peptide
DEEEIRTTNPVATEQYGSVSTNLENRGTR

SEQ ID NO: 8851 - protein, 28 aa, Artificial Sequence
  Description of Artificial Sequence: Synthetic peptide
DEEEIRTTNPVAWEQYGSVSTGGQRGNR

SEQ ID NO: 8852 - protein, 28 aa, Artificial Sequence
  Description of Artificial Sequence: Synthetic peptide
DEEMIRTTNPVATEQYGSVSTNLQEGNP

SEQ ID NO: 8853 - protein, 30 aa, Artificial Sequence
  Description of Artificial Sequence: Synthetic polypeptide
DEEEIRTTNPVAYEQYGSVSITNPLQRGNR

SEQ ID NO: 8854 - protein, 31 aa, Artificial Sequence
  Description of Artificial Sequence: Synthetic polypeptide
DEEEIRTTNPVATEQYGSVSTNLVQRNGSNR

SEQ ID NO: 8855 - protein, 28 aa, Artificial Sequence
  Description of Artificial Sequence: Synthetic peptide
DEEEIRTTNPVASEQYGSVYTNLDRGNR

SEQ ID NO: 8856 - protein, 30 aa, Artificial Sequence
  Description of Artificial Sequence: Synthetic polypeptide
DEEEIRTTNPVATEQYGSVSTANLQRGDNG

SEQ ID NO: 8857 - protein, 28 aa, Artificial Sequence
  Description of Artificial Sequence: Synthetic peptide
DEEEIRTTNPDATEQYGSVSTNLQRGDT

SEQ ID NO: 8858 - protein, 31 aa, Artificial Sequence
  Description of Artificial Sequence: Synthetic polypeptide
DEEEIRTTNPVATEQYGSVDSTNLQRGDNDR

SEQ ID NO: 8859 - protein, 29 aa, Artificial Sequence
  Description of Artificial Sequence: Synthetic peptide
DEEEIRTTNPVATEQYGGVSTMNLQIGNR

SEQ ID NO: 8860 - protein, 28 aa, Artificial Sequence
  Description of Artificial Sequence: Synthetic peptide
DEEEIRATNPVATENYGSVGTNLQRGNR

SEQ ID NO: 8861 - protein, 28 aa, Artificial Sequence
  Description of Artificial Sequence: Synthetic peptide
HEEEIRQTNPVATEQYGSVSTNLQYGNR

SEQ ID NO: 8862 - protein, 30 aa, Artificial Sequence
  Description of Artificial Sequence: Synthetic polypeptide
DEEEIRTTNPVATEQYGSVSTNELQERMNR

SEQ ID NO: 8863 - protein, 28 aa, Artificial Sequence
  Description of Artificial Sequence: Synthetic peptide
DEEEIRTTNPVATEQYGSVSTNPQLGNF

SEQ ID NO: 8864 - protein, 30 aa, Artificial Sequence
  Description of Artificial Sequence: Synthetic polypeptide
DEEEIRTTNPVATEQYGSVSTNPEQRGDNR

SEQ ID NO: 8865 - protein, 30 aa, Artificial Sequence
  Description of Artificial Sequence: Synthetic polypeptide
DEEEIRTTNPVATEQYGSVVSTNLQARGNS

SEQ ID NO: 8866 - protein, 29 aa, Artificial Sequence
  Description of Artificial Sequence: Synthetic peptide
DEQEIATTNPVATEQYGSVSATNLQRGNR

SEQ ID NO: 8867 - protein, 29 aa, Artificial Sequence
  Description of Artificial Sequence: Synthetic peptide
DEEEIRTTNPVATEQYGSVSCTNLQYGNC

SEQ ID NO: 8868 - protein, 28 aa, Artificial Sequence
  Description of Artificial Sequence: Synthetic peptide
DEEHIRTTNPVATEQYGSVSTNQDRGNR

SEQ ID NO: 8869 - protein, 28 aa, Artificial Sequence
  Description of Artificial Sequence: Synthetic peptide
DEEEIRTTNPVAFEQYGSVSTNLHPGNR

SEQ ID NO: 8870 - protein, 28 aa, Artificial Sequence
  Description of Artificial Sequence: Synthetic peptide
DEEEIRTTNPDATEQYGSVSTNLQDENR

SEQ ID NO: 8871 - protein, 28 aa, Artificial Sequence
  Description of Artificial Sequence: Synthetic peptide
DEEPIRTTNPVATEQYGSVSENLQIGNR

SEQ ID NO: 8872 - protein, 30 aa, Artificial Sequence
  Description of Artificial Sequence: Synthetic polypeptide
DEEEIRTTNPVATEQYGSVSTGNLQMQGNR

SEQ ID NO: 8873 - protein, 30 aa, Artificial Sequence
  Description of Artificial Sequence: Synthetic polypeptide
DEEEIRTTNPVATEQYGSVSCTVNLQRGNA

SEQ ID NO: 8874 - protein, 30 aa, Artificial Sequence
  Description of Artificial Sequence: Synthetic polypeptide
DEEEIRTTNPVATEQYGSVSDTNLQRGEND

SEQ ID NO: 8875 - protein, 29 aa, Artificial Sequence
  Description of Artificial Sequence: Synthetic peptide
DEEEIRTTNPEATEQYGSVSTNGQRDGNR

SEQ ID NO: 8876 - protein, 28 aa, Artificial Sequence
  Description of Artificial Sequence: Synthetic peptide
DEEEIRTTNPVATEQWGSWSTPLQRGNR

SEQ ID NO: 8877 - protein, 28 aa, Artificial Sequence
  Description of Artificial Sequence: Synthetic peptide
DEEEIRTTNPEATEQYGSVSTELQRGNF

SEQ ID NO: 8878 - protein, 30 aa, Artificial Sequence
  Description of Artificial Sequence: Synthetic polypeptide
DEEEIRTTNPVATEQYGSVSTNLQQEGNDR

SEQ ID NO: 8879 - protein, 29 aa, Artificial Sequence
  Description of Artificial Sequence: Synthetic peptide
DEEEITTTNPVATEQYGSVSTNLERGNDR

SEQ ID NO: 8880 - protein, 30 aa, Artificial Sequence
  Description of Artificial Sequence: Synthetic polypeptide
DEEEIRTTNPVATEQYGSVSNTNLQDRGNF

SEQ ID NO: 8881 - protein, 28 aa, Artificial Sequence
  Description of Artificial Sequence: Synthetic peptide
DEEEIRTVNPVATEQYGFVSTGLQRGNR

SEQ ID NO: 8882 - protein, 30 aa, Artificial Sequence
  Description of Artificial Sequence: Synthetic polypeptide
DEEEIRTTNPVATEQYGSVSTFNLQRGMNT

SEQ ID NO: 8883 - protein, 29 aa, Artificial Sequence
  Description of Artificial Sequence: Synthetic peptide
DEEEIRTTNPVATEQYGAVSTNWQLRGNR

SEQ ID NO: 8884 - protein, 28 aa, Artificial Sequence
  Description of Artificial Sequence: Synthetic peptide
SEEEIRTTNPVATEQYGDVSTNEQRGNR

SEQ ID NO: 8885 - protein, 28 aa, Artificial Sequence
  Description of Artificial Sequence: Synthetic peptide
DEEEIATTNPVATEMYGSVATNLQRGNR

SEQ ID NO: 8886 - protein, 28 aa, Artificial Sequence
  Description of Artificial Sequence: Synthetic peptide
DEEEIRTTNPVATECYGSVSTCLQHGNR

SEQ ID NO: 8887 - protein, 30 aa, Artificial Sequence
  Description of Artificial Sequence: Synthetic polypeptide
DEEEIRTTNPVATEQYGSVSCTNLQRGNDV

SEQ ID NO: 8888 - protein, 29 aa, Artificial Sequence
  Description of Artificial Sequence: Synthetic peptide
DEEEIRTTNPVATEQFGSVSTNLQRGNDL

SEQ ID NO: 8889 - protein, 28 aa, Artificial Sequence
  Description of Artificial Sequence: Synthetic peptide
DEECIRTTNPVATENYGSVSTNLQRGER

SEQ ID NO: 8890 - protein, 28 aa, Artificial Sequence
  Description of Artificial Sequence: Synthetic peptide
DEEEIRTTNPVATEQYGSVSTDLQREER

SEQ ID NO: 8891 - protein, 28 aa, Artificial Sequence
  Description of Artificial Sequence: Synthetic peptide
DEEEIRTTNPFATEQYGSVSTPLQAGNR

SEQ ID NO: 8892 - protein, 28 aa, Artificial Sequence
  Description of Artificial Sequence: Synthetic peptide
DEEEIRTTNPFATEQYGSVSSNDQRGNR

SEQ ID NO: 8893 - protein, 31 aa, Artificial Sequence
  Description of Artificial Sequence: Synthetic polypeptide
DEEEIRTTNPVATEQYGSVSTNLQVRKGENR

SEQ ID NO: 8894 - protein, 28 aa, Artificial Sequence
  Description of Artificial Sequence: Synthetic peptide
DEEEIRTTNPVSTEQWGSVSTNLMRGNR

SEQ ID NO: 8895 - protein, 28 aa, Artificial Sequence
  Description of Artificial Sequence: Synthetic peptide
DEEEIRTTNPVATEQYGSVSTNLEPGND

SEQ ID NO: 8896 - protein, 28 aa, Artificial Sequence
  Description of Artificial Sequence: Synthetic peptide
DEEEIRTTNPVATEQYGCVSMNIQRGNR

SEQ ID NO: 8897 - protein, 28 aa, Artificial Sequence
  Description of Artificial Sequence: Synthetic peptide
DESEIRTTNPVATEQWGSVDTNLQRGNR

SEQ ID NO: 8898 - protein, 30 aa, Artificial Sequence
  Description of Artificial Sequence: Synthetic polypeptide
DEEEIGTTNPVATEQYGSVSDTNPLQRGNR

SEQ ID NO: 8899 - protein, 30 aa, Artificial Sequence
  Description of Artificial Sequence: Synthetic polypeptide
DEEEIRTTNPVATEQYGSVSTNLQDRGENS

SEQ ID NO: 8900 - protein, 30 aa, Artificial Sequence
  Description of Artificial Sequence: Synthetic polypeptide
DEEEIRTTNPTATEQYGSVISTNLQREGNR

SEQ ID NO: 8901 - protein, 28 aa, Artificial Sequence
  Description of Artificial Sequence: Synthetic peptide
DEECIRTTNPVATEQYGDVSTNLQRENR

SEQ ID NO: 8902 - protein, 28 aa, Artificial Sequence
  Description of Artificial Sequence: Synthetic peptide
DEEEIRQTNPVATEQYGSVSTCLQRGER

SEQ ID NO: 8903 - protein, 28 aa, Artificial Sequence
  Description of Artificial Sequence: Synthetic peptide
DEEEIATVNPVATENYGSVSTNLQRGNR

SEQ ID NO: 8904 - protein, 30 aa, Artificial Sequence
  Description of Artificial Sequence: Synthetic polypeptide
DEEEIRTTNPVATEQYGSVDSTNLQREGNA

SEQ ID NO: 8905 - protein, 28 aa, Artificial Sequence
  Description of Artificial Sequence: Synthetic peptide
DEEEIRTTNPVATEQYGSVSTNLQSGET

SEQ ID NO: 8906 - protein, 29 aa, Artificial Sequence
  Description of Artificial Sequence: Synthetic peptide
DEEEVRTTNPVATEQYGSVGTNLQRNGNR

SEQ ID NO: 8907 - protein, 28 aa, Artificial Sequence
  Description of Artificial Sequence: Synthetic peptide
DEEEIRTTNPVATEQYGQVSNNLQRGND

SEQ ID NO: 8908 - protein, 30 aa, Artificial Sequence
  Description of Artificial Sequence: Synthetic polypeptide
DEEEIRTTNPVATEQYGSYVSDENLQRGNR

SEQ ID NO: 8909 - protein, 28 aa, Artificial Sequence
  Description of Artificial Sequence: Synthetic peptide
DEEEIRTTNPVATEQYGSVSENLQKENR

SEQ ID NO: 8910 - protein, 31 aa, Artificial Sequence
  Description of Artificial Sequence: Synthetic polypeptide
DEEEIRTTNPVATEQYGSYVSDTNLQMRGNR

SEQ ID NO: 8911 - protein, 28 aa, Artificial Sequence
  Description of Artificial Sequence: Synthetic peptide
DEVEIRTTNPVATEQYGSSSENLQRGNR

SEQ ID NO: 8912 - protein, 28 aa, Artificial Sequence
  Description of Artificial Sequence: Synthetic peptide
DEEEIRTTNPEATEQYGSVSTEDQRGNR

SEQ ID NO: 8913 - protein, 28 aa, Artificial Sequence
  Description of Artificial Sequence: Synthetic peptide
DEEEIRTTNPVATEQYGSVSTDLDQGNR

SEQ ID NO: 8914 - protein, 28 aa, Artificial Sequence
  Description of Artificial Sequence: Synthetic peptide
YEEEIRTTNPVATEQYGSVSTNLQHGNG

SEQ ID NO: 8915 - protein, 30 aa, Artificial Sequence
  Description of Artificial Sequence: Synthetic polypeptide
DEEEIRTTNPVATEQYGSVSTNLVQLRGLR

SEQ ID NO: 8916 - protein, 28 aa, Artificial Sequence
  Description of Artificial Sequence: Synthetic peptide
SDEEIRTTNPVATEQYGSYSTNLQRGNR

SEQ ID NO: 8917 - protein, 28 aa, Artificial Sequence
  Description of Artificial Sequence: Synthetic peptide
DEEEIRTTNPVATEQYGSWSTNLQRENP

SEQ ID NO: 8918 - protein, 28 aa, Artificial Sequence
  Description of Artificial Sequence: Synthetic peptide
DEEEIRTTNPVATEQYGSWSTNLQEGNS

SEQ ID NO: 8919 - protein, 28 aa, Artificial Sequence
  Description of Artificial Sequence: Synthetic peptide
DETEITTTNPVATEQYGSVSTNLTRGNR

SEQ ID NO: 8920 - protein, 30 aa, Artificial Sequence
  Description of Artificial Sequence: Synthetic polypeptide
DEEEIRTTNPVATEQYGSVSCTNLQQAGNR

SEQ ID NO: 8921 - protein, 29 aa, Artificial Sequence
  Description of Artificial Sequence: Synthetic peptide
DEEEIRTTNPVATEQYGSVSTNLQRGEPP

SEQ ID NO: 8922 - protein, 28 aa, Artificial Sequence
  Description of Artificial Sequence: Synthetic peptide
DEEEIRTTNPVATEQYGSVSTNDERGNG

SEQ ID NO: 8923 - protein, 28 aa, Artificial Sequence
  Description of Artificial Sequence: Synthetic peptide
DEEEIRTTNPVATEQYGSVSTELQPGNS

SEQ ID NO: 8924 - protein, 28 aa, Artificial Sequence
  Description of Artificial Sequence: Synthetic peptide
DEEEIRTTNPVATEQYGSVETNDQIGNR

SEQ ID NO: 8925 - protein, 28 aa, Artificial Sequence
  Description of Artificial Sequence: Synthetic peptide
DEEEIRTTNPVATEQWGSVSTNEERGNR

SEQ ID NO: 8926 - protein, 28 aa, Artificial Sequence
  Description of Artificial Sequence: Synthetic peptide
DEEEIRATNPVATEQYGTMSTNLQRGNR

SEQ ID NO: 8927 - protein, 28 aa, Artificial Sequence
  Description of Artificial Sequence: Synthetic peptide
DEEEIRTTNPVATEQYGFVSTNLFEGNR

SEQ ID NO: 8928 - protein, 29 aa, Artificial Sequence
  Description of Artificial Sequence: Synthetic peptide
DEEEIRTTNPVATEQYGSWSTNLQPGDNR

SEQ ID NO: 8929 - protein, 28 aa, Artificial Sequence
  Description of Artificial Sequence: Synthetic peptide
DDGEIRTTNPVATEQYGSVSTALQRGNR

SEQ ID NO: 8930 - protein, 30 aa, Artificial Sequence
  Description of Artificial Sequence: Synthetic polypeptide
DEEEIRTTNPVATEQYGMSVSQTNLQRGNP

SEQ ID NO: 8931 - protein, 28 aa, Artificial Sequence
  Description of Artificial Sequence: Synthetic peptide
DEEEIRTTNPVADEQYGSVSTNLQDGER

SEQ ID NO: 8932 - protein, 30 aa, Artificial Sequence
  Description of Artificial Sequence: Synthetic polypeptide
DEEEIRTTNPVATEQYGSVSCTNLQCAGNR

SEQ ID NO: 8933 - protein, 28 aa, Artificial Sequence
  Description of Artificial Sequence: Synthetic peptide
DEEEIRTTNPFATEQYGSVSTNLQAGNI

SEQ ID NO: 8934 - protein, 30 aa, Artificial Sequence
  Description of Artificial Sequence: Synthetic polypeptide
DEEEIRTTNPVATEQYGSVSTNLVQEDGNR

SEQ ID NO: 8935 - protein, 28 aa, Artificial Sequence
  Description of Artificial Sequence: Synthetic peptide
DEGEIRATNPVATEQYGSVSTDLQRGNR

SEQ ID NO: 8936 - protein, 30 aa, Artificial Sequence
  Description of Artificial Sequence: Synthetic polypeptide
DEEEIRTTNPVATEQYGSVSCTNLQDGGNR

SEQ ID NO: 8937 - protein, 29 aa, Artificial Sequence
  Description of Artificial Sequence: Synthetic peptide
DEEEIRTTNPVATEQYGNVSTTNLQRGNW

SEQ ID NO: 8938 - protein, 29 aa, Artificial Sequence
  Description of Artificial Sequence: Synthetic peptide
DEEEIRTTNPVATEQYGSVSENLQIRGND

SEQ ID NO: 8939 - protein, 29 aa, Artificial Sequence
  Description of Artificial Sequence: Synthetic peptide
DEEEIRTTNPVATEQYGSVWTNLQRGNQP

SEQ ID NO: 8940 - protein, 28 aa, Artificial Sequence
  Description of Artificial Sequence: Synthetic peptide
DEGEIRTTNPVATEQYGNVMTNLQRGNR

SEQ ID NO: 8941 - protein, 28 aa, Artificial Sequence
  Description of Artificial Sequence: Synthetic peptide
DEEEIRTTNPVCTEQYGSVSTNLQVGNY

SEQ ID NO: 8942 - protein, 29 aa, Artificial Sequence
  Description of Artificial Sequence: Synthetic peptide
DEEEIGTTNPVATEQYGSVSTALQWRGNR

SEQ ID NO: 8943 - protein, 29 aa, Artificial Sequence
  Description of Artificial Sequence: Synthetic peptide
DEEEICTTNPVATEQYGSVISTNLQFGNR

SEQ ID NO: 8944 - protein, 30 aa, Artificial Sequence
  Description of Artificial Sequence: Synthetic polypeptide
DEEEIRTTNPVATEQYGSVSTNLQDRGNDQ

SEQ ID NO: 8945 - protein, 29 aa, Artificial Sequence
  Description of Artificial Sequence: Synthetic peptide
DEEEIRTTNPVATEQYGSVETNDQREGNR

SEQ ID NO: 8946 - protein, 29 aa, Artificial Sequence
  Description of Artificial Sequence: Synthetic peptide
DEEEIRTTNPVATECYGSVSTNLEDRGNR

SEQ ID NO: 8947 - protein, 28 aa, Artificial Sequence
  Description of Artificial Sequence: Synthetic peptide
DEEEIRTTNPVATEQYGSTSTNLQHGNF

SEQ ID NO: 8948 - protein, 31 aa, Artificial Sequence
  Description of Artificial Sequence: Synthetic polypeptide
DEEEIRTTNPVATEQYGSVESTNLQRNGNDR

SEQ ID NO: 8949 - protein, 28 aa, Artificial Sequence
  Description of Artificial Sequence: Synthetic peptide
DEEEIRTTNPDATEQYGSVWTGLQRGNR

SEQ ID NO: 8950 - protein, 28 aa, Artificial Sequence
  Description of Artificial Sequence: Synthetic peptide
DEEEIRTTNPVATEQYGSVSTNLQHGEV

SEQ ID NO: 8951 - protein, 28 aa, Artificial Sequence
  Description of Artificial Sequence: Synthetic peptide
DEEEIRTTNPVATEQYWSVETNLQRGER

SEQ ID NO: 8952 - protein, 30 aa, Artificial Sequence
  Description of Artificial Sequence: Synthetic polypeptide
MEEEIRTTNPVATEQYGSVSTMNLQDRGNR

SEQ ID NO: 8953 - protein, 30 aa, Artificial Sequence
  Description of Artificial Sequence: Synthetic polypeptide
DEEEIRTTNPVATEQYGSVSCTNLQQGNDR

SEQ ID NO: 8954 - protein, 28 aa, Artificial Sequence
  Description of Artificial Sequence: Synthetic peptide
QEEEIRTVNPVATEQYGSVSTVLQRGNR

SEQ ID NO: 8955 - protein, 28 aa, Artificial Sequence
  Description of Artificial Sequence: Synthetic peptide
DEEEIRTTNPVATEQYGSVSTNLERGEM

SEQ ID NO: 8956 - protein, 28 aa, Artificial Sequence
  Description of Artificial Sequence: Synthetic peptide
DEEEIRTTNPVATEQYGTVDTNPQRGNR

SEQ ID NO: 8957 - protein, 28 aa, Artificial Sequence
  Description of Artificial Sequence: Synthetic peptide
DEEEIRTTNPDATEQYGSVSENLQRGND

SEQ ID NO: 8958 - protein, 31 aa, Artificial Sequence
  Description of Artificial Sequence: Synthetic polypeptide
DEEEIRTTNPVATEQYGSVSTNLTQRGDNPR

SEQ ID NO: 8959 - protein, 28 aa, Artificial Sequence
  Description of Artificial Sequence: Synthetic peptide
DEEEIRTTNPVATEQYGSVSTDLQMGND

SEQ ID NO: 8960 - protein, 28 aa, Artificial Sequence
  Description of Artificial Sequence: Synthetic peptide
DEEEIRTTNPVATEQYGSVDTNDQRGNM

SEQ ID NO: 8961 - protein, 28 aa, Artificial Sequence
  Description of Artificial Sequence: Synthetic peptide
DDETIRTTNPVATEQYGSVSTNLDRGNR

SEQ ID NO: 8962 - protein, 29 aa, Artificial Sequence
  Description of Artificial Sequence: Synthetic peptide
DEEEIRTTNPVATEQYGSVSCENLQRGNL

SEQ ID NO: 8963 - protein, 28 aa, Artificial Sequence
  Description of Artificial Sequence: Synthetic peptide
MEEEIRTVNPVATEQYGWVSTNLQRGNR

SEQ ID NO: 8964 - protein, 28 aa, Artificial Sequence
  Description of Artificial Sequence: Synthetic peptide
DEEEITTTNPVATEQYGSVSTNLEDGNR

SEQ ID NO: 8965 - protein, 29 aa, Artificial Sequence
  Description of Artificial Sequence: Synthetic peptide
DEELIRTTNPVATEQYGSVSTNLQHWGNR

SEQ ID NO: 8966 - protein, 30 aa, Artificial Sequence
  Description of Artificial Sequence: Synthetic polypeptide
DEEEIRTTNPVATEQYGSVSTNLQERGNDM

SEQ ID NO: 8967 - protein, 29 aa, Artificial Sequence
  Description of Artificial Sequence: Synthetic peptide
DEEEIATVNPVATEQYGSVSATNLQRGNR

SEQ ID NO: 8968 - protein, 29 aa, Artificial Sequence
  Description of Artificial Sequence: Synthetic peptide
DEEEIRATNPVATEQYGASVSTNLDRGNR

SEQ ID NO: 8969 - protein, 29 aa, Artificial Sequence
  Description of Artificial Sequence: Synthetic peptide
DEEEIRTTNPVATEQYGSVDTNLLRGENR

SEQ ID NO: 8970 - protein, 29 aa, Artificial Sequence
  Description of Artificial Sequence: Synthetic peptide
DEEEIRTTNPVATETYGSVAATNLQRGNR

SEQ ID NO: 8971 - protein, 29 aa, Artificial Sequence
  Description of Artificial Sequence: Synthetic peptide
DEEEIRTTNPVATEQYGSVETNDQRGENR

SEQ ID NO: 8972 - protein, 30 aa, Artificial Sequence
  Description of Artificial Sequence: Synthetic polypeptide
DEEEIRTTNPVATEQYGSVDSETNLDRGNR

SEQ ID NO: 8973 - protein, 30 aa, Artificial Sequence
  Description of Artificial Sequence: Synthetic polypeptide
DEEEIRTTNPVATEQYGSVESTNLTRNGNR

SEQ ID NO: 8974 - protein, 28 aa, Artificial Sequence
  Description of Artificial Sequence: Synthetic peptide
DEEEVRATNPVAYEQYGSVSTNLQRGNR

SEQ ID NO: 8975 - protein, 30 aa, Artificial Sequence
  Description of Artificial Sequence: Synthetic polypeptide
DEEEIRTTNPVATEQYGSVSTNLQREGNDE

SEQ ID NO: 8976 - protein, 28 aa, Artificial Sequence
  Description of Artificial Sequence: Synthetic peptide
DEEEIRTTNPVATECYGSVSTELQRGNE

SEQ ID NO: 8977 - protein, 28 aa, Artificial Sequence
  Description of Artificial Sequence: Synthetic peptide
DEEEIRTTNPFATEQYGSVSNNLQRENR

SEQ ID NO: 8978 - protein, 29 aa, Artificial Sequence
  Description of Artificial Sequence: Synthetic peptide
DEEEIRTTNPVATEQYGSVSCTYLQRGNA

SEQ ID NO: 8979 - protein, 30 aa, Artificial Sequence
  Description of Artificial Sequence: Synthetic polypeptide
DEEEIRTTNPVATENYGSVSTNLTQLRGNR

SEQ ID NO: 8980 - protein, 29 aa, Artificial Sequence
  Description of Artificial Sequence: Synthetic peptide
DEEEIRTTNPVATEQYGSVSTINLQHGNI

SEQ ID NO: 8981 - protein, 30 aa, Artificial Sequence
  Description of Artificial Sequence: Synthetic polypeptide
DEEEIRTTNPEATEQYGSVSTENLVQRGNR

SEQ ID NO: 8982 - protein, 28 aa, Artificial Sequence
  Description of Artificial Sequence: Synthetic peptide
DDSEIRTTNPVATEQYGSVSNNLQRGNR

SEQ ID NO: 8983 - protein, 28 aa, Artificial Sequence
  Description of Artificial Sequence: Synthetic peptide
CDEEIRTTNPVATEQYGSVSTNLQRPNR

SEQ ID NO: 8984 - protein, 28 aa, Artificial Sequence
  Description of Artificial Sequence: Synthetic peptide
DEEEIRTTNPVATEQYGSVSTELQRLNN

SEQ ID NO: 8985 - protein, 30 aa, Artificial Sequence
  Description of Artificial Sequence: Synthetic polypeptide
DEEEIRTTNPVATEQYGSVLSTNLQESGNR

SEQ ID NO: 8986 - protein, 28 aa, Artificial Sequence
  Description of Artificial Sequence: Synthetic peptide
DEEEIRTTNPVATEHYGNVGTNLQRGNR

SEQ ID NO: 8987 - protein, 28 aa, Artificial Sequence
  Description of Artificial Sequence: Synthetic peptide
DETEIVTTNPVATEMYGSVSTNLQRGNR

SEQ ID NO: 8988 - protein, 30 aa, Artificial Sequence
  Description of Artificial Sequence: Synthetic polypeptide
DEEEIRTTNPVATEQYGSVSTNLQEREGND

SEQ ID NO: 8989 - protein, 28 aa, Artificial Sequence
  Description of Artificial Sequence: Synthetic peptide
DEEEIRTTNPVATEQYGSVWTNLDTGNR

SEQ ID NO: 8990 - protein, 29 aa, Artificial Sequence
  Description of Artificial Sequence: Synthetic peptide
DEIEIRTTNPVATEQYGSVSKTNLQRGER

SEQ ID NO: 8991 - protein, 29 aa, Artificial Sequence
  Description of Artificial Sequence: Synthetic peptide
DEEEITTTNPVATEQYGSVSTELQRGNAR

SEQ ID NO: 8992 - protein, 28 aa, Artificial Sequence
  Description of Artificial Sequence: Synthetic peptide
DEEEIRTTNPVATEQYGSVSTEEQRGNE

SEQ ID NO: 8993 - protein, 30 aa, Artificial Sequence
  Description of Artificial Sequence: Synthetic polypeptide
DEEEIRTTNPVATEQYGSVSETNLQRDGNE

SEQ ID NO: 8994 - protein, 28 aa, Artificial Sequence
  Description of Artificial Sequence: Synthetic peptide
DEEEIRTTNPVATEQYGSVSTNLQGGEM

SEQ ID NO: 8995 - protein, 29 aa, Artificial Sequence
  Description of Artificial Sequence: Synthetic peptide
DEEEIRTTNPVATEQYGSVSTNLQNGNDF

SEQ ID NO: 8996 - protein, 28 aa, Artificial Sequence
  Description of Artificial Sequence: Synthetic peptide
DEEEIATTNPFATEQYGSVSTNLQRGNS

SEQ ID NO: 8997 - protein, 28 aa, Artificial Sequence
  Description of Artificial Sequence: Synthetic peptide
DEEEIRTTNPVATEQYGVVSTNLERGNF

SEQ ID NO: 8998 - protein, 31 aa, Artificial Sequence
  Description of Artificial Sequence: Synthetic polypeptide
DEEEIRTTNPVATEQYGSVISTNGLQRGDNR

SEQ ID NO: 8999 - protein, 29 aa, Artificial Sequence
  Description of Artificial Sequence: Synthetic peptide
DEEEIRTTNPCATEQWGSVSTTNLQRGNR

SEQ ID NO: 9000 - protein, 28 aa, Artificial Sequence
  Description of Artificial Sequence: Synthetic peptide
DEEMIRTTNPVATEQYGSVSTGLQRGNP

SEQ ID NO: 9001 - protein, 28 aa, Artificial Sequence
  Description of Artificial Sequence: Synthetic peptide
DEEEIRTTNPVATEIYGSVSTNPARGNR

SEQ ID NO: 9002 - protein, 28 aa, Artificial Sequence
  Description of Artificial Sequence: Synthetic peptide
DPEEIRTTNPVATEQYGSVSTPLQRGER

SEQ ID NO: 9003 - protein, 28 aa, Artificial Sequence
  Description of Artificial Sequence: Synthetic peptide
DEEEIRTTNPTATEQYGSVSDNLARGNR

SEQ ID NO: 9004 - protein, 28 aa, Artificial Sequence
  Description of Artificial Sequence: Synthetic peptide
DEEEIRTTNPVATEQYGFVSTPLQSGNR

SEQ ID NO: 9005 - protein, 28 aa, Artificial Sequence
  Description of Artificial Sequence: Synthetic peptide
DEEEIRTTNPDATELYGSVSTNLQEGNR

SEQ ID NO: 9006 - protein, 28 aa, Artificial Sequence
  Description of Artificial Sequence: Synthetic peptide
DEEEIRTTNPVATEQYGSVETNEQRGDR

SEQ ID NO: 9007 - protein, 30 aa, Artificial Sequence
  Description of Artificial Sequence: Synthetic polypeptide
DEEEIRTTNPVATEQYGSVSCTNLQRGNDC

SEQ ID NO: 9008 - protein, 30 aa, Artificial Sequence
  Description of Artificial Sequence: Synthetic polypeptide
DEEEIRTTNPVATEQYGSVSDTNDQRGENR

SEQ ID NO: 9009 - protein, 30 aa, Artificial Sequence
  Description of Artificial Sequence: Synthetic polypeptide
DEEEIRTTNPVATEQYGSVSETNLQRGMND

SEQ ID NO: 9010 - protein, 29 aa, Artificial Sequence
  Description of Artificial Sequence: Synthetic peptide
DEEEIRTTNPVATEQYGSVSTDLQEVGNR

SEQ ID NO: 9011 - protein, 31 aa, Artificial Sequence
  Description of Artificial Sequence: Synthetic polypeptide
DEEEIRTTNPVATEQYGSVSITHNLQRGNDR

SEQ ID NO: 9012 - protein, 28 aa, Artificial Sequence
  Description of Artificial Sequence: Synthetic peptide
DEDETRTTNPVSTEQYGSVSTNLQRGNR

SEQ ID NO: 9013 - protein, 28 aa, Artificial Sequence
  Description of Artificial Sequence: Synthetic peptide
DEECIRTTNPVATEQYGSVSHNLQDGNR

SEQ ID NO: 9014 - protein, 28 aa, Artificial Sequence
  Description of Artificial Sequence: Synthetic peptide
DEEEIRTTNPEATEQYGSVSTNDQRGNQ

SEQ ID NO: 9015 - protein, 29 aa, Artificial Sequence
  Description of Artificial Sequence: Synthetic peptide
YEEEIRTTNPVATEQYGSVSTNDQRGNDR

SEQ ID NO: 9016 - protein, 28 aa, Artificial Sequence
  Description of Artificial Sequence: Synthetic peptide
DEEEIRTTNPVATEQYGSVSTDLQDGND

SEQ ID NO: 9017 - protein, 29 aa, Artificial Sequence
  Description of Artificial Sequence: Synthetic peptide
DEEEIRTTNPVATEQYGSVETNLQRGDNP

SEQ ID NO: 9018 - protein, 28 aa, Artificial Sequence
  Description of Artificial Sequence: Synthetic peptide
MEEEIRTTNPVATEQYGSVSTNLQNGNW

SEQ ID NO: 9019 - protein, 30 aa, Artificial Sequence
  Description of Artificial Sequence: Synthetic polypeptide
DEEEIRTTNPVATEQYGSVSTNLQTDGLNR

SEQ ID NO: 9020 - protein, 28 aa, Artificial Sequence
  Description of Artificial Sequence: Synthetic peptide
DEEELRTTNPVATEQYGAVGTNLQRGNR

SEQ ID NO: 9021 - protein, 28 aa, Artificial Sequence
  Description of Artificial Sequence: Synthetic peptide
DLEEIATTNPVATEQYGSVSTNLQRGNF

SEQ ID NO: 9022 - protein, 28 aa, Artificial Sequence
  Description of Artificial Sequence: Synthetic peptide
DEEEIVTTNPVATEQYGSVSTNLQLGND

SEQ ID NO: 9023 - protein, 29 aa, Artificial Sequence
  Description of Artificial Sequence: Synthetic peptide
DEEEIRTTNPVATEQYGSVSTNEQNRGNW

SEQ ID NO: 9024 - protein, 30 aa, Artificial Sequence
  Description of Artificial Sequence: Synthetic polypeptide
DEEEIRTTNPVATEQYGSVSTNGPQRGNWR

SEQ ID NO: 9025 - protein, 28 aa, Artificial Sequence
  Description of Artificial Sequence: Synthetic peptide
DEEEISTTNPVATECYGSVSTNLQRGND

SEQ ID NO: 9026 - protein, 29 aa, Artificial Sequence
  Description of Artificial Sequence: Synthetic peptide
DEEEIRTTNPTATEQYGSVSTNLPQRGNF

SEQ ID NO: 9027 - protein, 28 aa, Artificial Sequence
  Description of Artificial Sequence: Synthetic peptide
DEQEIRTTNPVATEQYGSVSTNLQYENR

SEQ ID NO: 9028 - protein, 28 aa, Artificial Sequence
  Description of Artificial Sequence: Synthetic peptide
DEEEIRTTNPVATEQYGSVSTHLQLGNS

SEQ ID NO: 9029 - protein, 29 aa, Artificial Sequence
  Description of Artificial Sequence: Synthetic peptide
DENEIRTTNPVATEQYGSVDTNLQDRGNR

SEQ ID NO: 9030 - protein, 30 aa, Artificial Sequence
  Description of Artificial Sequence: Synthetic polypeptide
DEEEIRTTNPVATEQYGSVSTQNLQRDGER

SEQ ID NO: 9031 - protein, 28 aa, Artificial Sequence
  Description of Artificial Sequence: Synthetic peptide
DEEEIRTTNPEATEQYGSVSTNEQRGER

SEQ ID NO: 9032 - protein, 28 aa, Artificial Sequence
  Description of Artificial Sequence: Synthetic peptide
DEEEIRTTNPVATDCYGSVSTNLMRGNR

SEQ ID NO: 9033 - protein, 28 aa, Artificial Sequence
  Description of Artificial Sequence: Synthetic peptide
DEEELRTTNPIATEQYGSVSTNLQRPNR

SEQ ID NO: 9034 - protein, 29 aa, Artificial Sequence
  Description of Artificial Sequence: Synthetic peptide
DEEEIRTTNPVATEIYGSVNSTNLSRGNR

SEQ ID NO: 9035 - protein, 29 aa, Artificial Sequence
  Description of Artificial Sequence: Synthetic peptide
DEEEIRTTNPEATEQYGSVSTNLPQHGNR

SEQ ID NO: 9036 - protein, 28 aa, Artificial Sequence
  Description of Artificial Sequence: Synthetic peptide
DEEEIRTVNPVATEQYGSVSSDLQRGNR

SEQ ID NO: 9037 - protein, 30 aa, Artificial Sequence
  Description of Artificial Sequence: Synthetic polypeptide
DEEEIRTTNPVATEQYGSVVSTGNLQFGNR

SEQ ID NO: 9038 - protein, 28 aa, Artificial Sequence
  Description of Artificial Sequence: Synthetic peptide
DEEEIRTTNPVATEQYGSHSENLQDGNR

SEQ ID NO: 9039 - protein, 28 aa, Artificial Sequence
  Description of Artificial Sequence: Synthetic peptide
DEEEIRTTNPVATEQYGSWSEGLQRGNR

SEQ ID NO: 9040 - protein, 28 aa, Artificial Sequence
  Description of Artificial Sequence: Synthetic peptide
DEEEIRPTNPVAWEQYGSVSTGLQRGNR

SEQ ID NO: 9041 - protein, 29 aa, Artificial Sequence
  Description of Artificial Sequence: Synthetic peptide
DEEEIRTTNPEATEQYGSVSTNPLQRGNH

SEQ ID NO: 9042 - protein, 30 aa, Artificial Sequence
  Description of Artificial Sequence: Synthetic polypeptide
DEEEIRTTNPVATEQYGSVSTMNLQRGTTR

SEQ ID NO: 9043 - protein, 28 aa, Artificial Sequence
  Description of Artificial Sequence: Synthetic peptide
DEEEIATTNPVATEQYGSVPTNPQRGNR

SEQ ID NO: 9044 - protein, 28 aa, Artificial Sequence
  Description of Artificial Sequence: Synthetic peptide
DEEAICTTNPDATEQYGSVSTNLQRGNR

SEQ ID NO: 9045 - protein, 28 aa, Artificial Sequence
  Description of Artificial Sequence: Synthetic peptide
DEEEIRTTNPVATEQYGSVSTNKQDGNP

SEQ ID NO: 9046 - protein, 29 aa, Artificial Sequence
  Description of Artificial Sequence: Synthetic peptide
DEEEIRTTNPVATEQYGESVETNEQRGNR

SEQ ID NO: 9047 - protein, 30 aa, Artificial Sequence
  Description of Artificial Sequence: Synthetic polypeptide
DEEEIRTTNPVATEQYGSVSCTNLQQRENR

SEQ ID NO: 9048 - protein, 29 aa, Artificial Sequence
  Description of Artificial Sequence: Synthetic peptide
DEEEIRTTNPVATEQYGSVDTMNLQRGNI

SEQ ID NO: 9049 - protein, 29 aa, Artificial Sequence
  Description of Artificial Sequence: Synthetic peptide
QEEEIRTTNPVATEQYGWVSATNLQRGNR

SEQ ID NO: 9050 - protein, 29 aa, Artificial Sequence
  Description of Artificial Sequence: Synthetic peptide
DEEEIRTTNPVATEQYGSVSTNLQDLGNF

SEQ ID NO: 9051 - protein, 28 aa, Artificial Sequence
  Description of Artificial Sequence: Synthetic peptide
DEEEIRTTNPVATEQYGSVSDNLCRGNC

SEQ ID NO: 9052 - protein, 28 aa, Artificial Sequence
  Description of Artificial Sequence: Synthetic peptide
DDEEIRTTNPVATEQYGSVSTNLQHGND

SEQ ID NO: 9053 - protein, 28 aa, Artificial Sequence
  Description of Artificial Sequence: Synthetic peptide
NEEEITTTNPVATEQYGSVSSNLQRGNR

SEQ ID NO: 9054 - protein, 28 aa, Artificial Sequence
  Description of Artificial Sequence: Synthetic peptide
DENEIRTTNPVATELYGWVSTNLQRGNR

SEQ ID NO: 9055 - protein, 29 aa, Artificial Sequence
  Description of Artificial Sequence: Synthetic peptide
DEEEIRTTNPVATEQYGSVSTDLQENGNR

SEQ ID NO: 9056 - protein, 28 aa, Artificial Sequence
  Description of Artificial Sequence: Synthetic peptide
DEEEIRTTNPVGTELYGSVSTNVQRGNR

SEQ ID NO: 9057 - protein, 29 aa, Artificial Sequence
  Description of Artificial Sequence: Synthetic peptide
GEEEIRTTNPVATEQYGSVSATNLQPGNR

SEQ ID NO: 9058 - protein, 28 aa, Artificial Sequence
  Description of Artificial Sequence: Synthetic peptide
DEEEIRTTNPVATEQYGSVETNDQRGNT

SEQ ID NO: 9059 - protein, 28 aa, Artificial Sequence
  Description of Artificial Sequence: Synthetic peptide
DEEHIRTTNPLATEQYGSVSTNLQRGNP

SEQ ID NO: 9060 - protein, 30 aa, Artificial Sequence
  Description of Artificial Sequence: Synthetic polypeptide
DEEEIRTTNPVATEQYGSVSTINGWQRGNR

SEQ ID NO: 9061 - protein, 30 aa, Artificial Sequence
  Description of Artificial Sequence: Synthetic polypeptide
DEEEIRTTNPVATEQYGSVSTMNLQRGNDG

SEQ ID NO: 9062 - protein, 28 aa, Artificial Sequence
  Description of Artificial Sequence: Synthetic peptide
DEEEIRSTNPVATEQYGWVGTNLQRGNR

SEQ ID NO: 9063 - protein, 29 aa, Artificial Sequence
  Description of Artificial Sequence: Synthetic peptide
DEEEIRTTNPVATEQYGSVSTNLIRGVER

SEQ ID NO: 9064 - protein, 30 aa, Artificial Sequence
  Description of Artificial Sequence: Synthetic polypeptide
DEEEIRTTNPVATEQYGSVDSTNLVERGNR

SEQ ID NO: 9065 - protein, 29 aa, Artificial Sequence
  Description of Artificial Sequence: Synthetic peptide
DEEEIRTTNPVSTEQFGSVDSTNLQRGNR

SEQ ID NO: 9066 - protein, 28 aa, Artificial Sequence
  Description of Artificial Sequence: Synthetic peptide
DEEEISTTNPVATEQYGSVSTNLQNGNS

SEQ ID NO: 9067 - protein, 31 aa, Artificial Sequence
  Description of Artificial Sequence: Synthetic polypeptide
DEEEIRTTNPVATEQYGSVSTTNLQREGNDR

SEQ ID NO: 9068 - protein, 28 aa, Artificial Sequence
  Description of Artificial Sequence: Synthetic peptide
DEEEIRTTNPVATDQYGSVSTNLQLGNL

SEQ ID NO: 9069 - protein, 28 aa, Artificial Sequence
  Description of Artificial Sequence: Synthetic peptide
DEEEIRTTNPVSTELWGSVSTNLQRGNR

SEQ ID NO: 9070 - protein, 28 aa, Artificial Sequence
  Description of Artificial Sequence: Synthetic peptide
DEEEIRTTNPVATEQYGSMSTNLQRMMR

SEQ ID NO: 9071 - protein, 29 aa, Artificial Sequence
  Description of Artificial Sequence: Synthetic peptide
DEEEIRTTNPVATEQYGSVSTDLQVGNDR

SEQ ID NO: 9072 - protein, 28 aa, Artificial Sequence
  Description of Artificial Sequence: Synthetic peptide
GEEEIRTTNPVATEQYGSASENLQRGNR

SEQ ID NO: 9073 - protein, 28 aa, Artificial Sequence
  Description of Artificial Sequence: Synthetic peptide
DEEEIRTTNPVATEQYGSVSTNEDNGNR

SEQ ID NO: 9074 - protein, 28 aa, Artificial Sequence
  Description of Artificial Sequence: Synthetic peptide
FEEEIRTTNPVATEQYGDVSTCLQRGNR

SEQ ID NO: 9075 - protein, 29 aa, Artificial Sequence
  Description of Artificial Sequence: Synthetic peptide
DEEEIRSTNPVATEQYGSVSTNLQRGNDF

SEQ ID NO: 9076 - protein, 30 aa, Artificial Sequence
  Description of Artificial Sequence: Synthetic polypeptide
DEEEIATTNPVATEQYGSVSTNLQREGNDR

SEQ ID NO: 9077 - protein, 29 aa, Artificial Sequence
  Description of Artificial Sequence: Synthetic peptide
DEEEIRTTNPVATEQYGSVSCEKLQRGNR

SEQ ID NO: 9078 - protein, 31 aa, Artificial Sequence
  Description of Artificial Sequence: Synthetic polypeptide
DEEEIRTTNPVATEQYGSVSTVNLPQRGNDR

SEQ ID NO: 9079 - protein, 28 aa, Artificial Sequence
  Description of Artificial Sequence: Synthetic peptide
DEEEIRTTNPVATEQYGVVSTNLERGND

SEQ ID NO: 9080 - protein, 29 aa, Artificial Sequence
  Description of Artificial Sequence: Synthetic peptide
DEEEIRTTNPVATEQYGSVSTNLQILGNV

SEQ ID NO: 9081 - protein, 28 aa, Artificial Sequence
  Description of Artificial Sequence: Synthetic peptide
DEEEIRTTNPVATEQYGWVSTGLQRGND

SEQ ID NO: 9082 - protein, 28 aa, Artificial Sequence
  Description of Artificial Sequence: Synthetic peptide
DDEEIRCTNPVATEQYGSVSMNLQRGNR

SEQ ID NO: 9083 - protein, 30 aa, Artificial Sequence
  Description of Artificial Sequence: Synthetic polypeptide
DEEEIRTTNPVATEQYGSFVSTNLPRLGNR

SEQ ID NO: 9084 - protein, 31 aa, Artificial Sequence
  Description of Artificial Sequence: Synthetic polypeptide
DEEEIRTTNPVATEQYGSVSTMNLQDRGDNR

SEQ ID NO: 9085 - protein, 28 aa, Artificial Sequence
  Description of Artificial Sequence: Synthetic peptide
DEEEVRTTNPVATEQYGSVCNNLQRGNR

SEQ ID NO: 9086 - protein, 28 aa, Artificial Sequence
  Description of Artificial Sequence: Synthetic peptide
DEEEIRTTNPVATEQYGSVSTDLQNGNS

SEQ ID NO: 9087 - protein, 28 aa, Artificial Sequence
  Description of Artificial Sequence: Synthetic peptide
DEEEIRTTNPVATDQYGSVSTNLVPGNR

SEQ ID NO: 9088 - protein, 28 aa, Artificial Sequence
  Description of Artificial Sequence: Synthetic peptide
DEETIRTTNPVATQQYGSVSTNDQRGNR

SEQ ID NO: 9089 - protein, 29 aa, Artificial Sequence
  Description of Artificial Sequence: Synthetic peptide
DEEEIRATNPVATEQYGSVSTLNLQRGNS

SEQ ID NO: 9090 - protein, 28 aa, Artificial Sequence
  Description of Artificial Sequence: Synthetic peptide
DEEEIRTTNPVATEQYGSVSTNMIRDNR

SEQ ID NO: 9091 - protein, 29 aa, Artificial Sequence
  Description of Artificial Sequence: Synthetic peptide
DEEEIRTTNPVATEQYGSVSTNLQRGEEN

SEQ ID NO: 9092 - protein, 28 aa, Artificial Sequence
  Description of Artificial Sequence: Synthetic peptide
DEEEIRCVNPVATEQYGSVSTNLQRGNT

SEQ ID NO: 9093 - protein, 30 aa, Artificial Sequence
  Description of Artificial Sequence: Synthetic polypeptide
DEEEIRTTNPVATEQYGSVSTNGLQRGENG

SEQ ID NO: 9094 - protein, 28 aa, Artificial Sequence
  Description of Artificial Sequence: Synthetic peptide
DEEEIRTTNPVATEQYGSVSTNLQEGEA

SEQ ID NO: 9095 - protein, 30 aa, Artificial Sequence
  Description of Artificial Sequence: Synthetic polypeptide
DEEEIRTTNPVATEQYGSVSETDGLQRGNR

SEQ ID NO: 9096 - protein, 31 aa, Artificial Sequence
  Description of Artificial Sequence: Synthetic polypeptide
DEEEIRTTNPVATEQYGSVSCTNLQRNGNPR

SEQ ID NO: 9097 - protein, 28 aa, Artificial Sequence
  Description of Artificial Sequence: Synthetic peptide
DEEEIRTTNPVGTEQYGSVSTELDRGNR

SEQ ID NO: 9098 - protein, 31 aa, Artificial Sequence
  Description of Artificial Sequence: Synthetic polypeptide
DEEEIRTTNPVATEQYGSVESITVNLQRGNR

SEQ ID NO: 9099 - protein, 29 aa, Artificial Sequence
  Description of Artificial Sequence: Synthetic peptide
DEEEIRTTNPVATCQYGSVSTNLQIRGNP

SEQ ID NO: 9100 - protein, 28 aa, Artificial Sequence
  Description of Artificial Sequence: Synthetic peptide
DEEEIVTTNPVATEQYGSVSTELQRGNA

SEQ ID NO: 9101 - protein, 28 aa, Artificial Sequence
  Description of Artificial Sequence: Synthetic peptide
DEEEIRTTNPVATEIYGAVSMNLQRGNR

SEQ ID NO: 9102 - protein, 29 aa, Artificial Sequence
  Description of Artificial Sequence: Synthetic peptide
DEEEIRTTNPVATEQYGSVSAMNLQRGDR

SEQ ID NO: 9103 - protein, 30 aa, Artificial Sequence
  Description of Artificial Sequence: Synthetic polypeptide
VEEEIRTTNPVATEQYGSVSTNLNQRQGNR

SEQ ID NO: 9104 - protein, 28 aa, Artificial Sequence
  Description of Artificial Sequence: Synthetic peptide
DDEEIRGTNPVATEQYGSVSTNLQRGPR

SEQ ID NO: 9105 - protein, 28 aa, Artificial Sequence
  Description of Artificial Sequence: Synthetic peptide
DEEEIRTTNPVATEQYGSVSTELQEGNL

SEQ ID NO: 9106 - protein, 28 aa, Artificial Sequence
  Description of Artificial Sequence: Synthetic peptide
DEEEIRTTNPVATEQYGSVSTNEDTGNR

SEQ ID NO: 9107 - protein, 29 aa, Artificial Sequence
  Description of Artificial Sequence: Synthetic peptide
DEEEIRTTNPVATEQYGSVSTNLQQGDNF

SEQ ID NO: 9108 - protein, 29 aa, Artificial Sequence
  Description of Artificial Sequence: Synthetic peptide
DEEEIRTTNPVATEQYGSVHTNEQNRGNR

SEQ ID NO: 9109 - protein, 29 aa, Artificial Sequence
  Description of Artificial Sequence: Synthetic peptide
DEEEIRSTNPVATEQYGSVSTNLQRGDPR

SEQ ID NO: 9110 - protein, 31 aa, Artificial Sequence
  Description of Artificial Sequence: Synthetic polypeptide
DEEEIRTTNPVATEQYGSVSMTNLPQRGENR

SEQ ID NO: 9111 - protein, 28 aa, Artificial Sequence
  Description of Artificial Sequence: Synthetic peptide
DEEEIRTTNPVATEQYGSVSTELQEGNY

SEQ ID NO: 9112 - protein, 30 aa, Artificial Sequence
  Description of Artificial Sequence: Synthetic polypeptide
DEEEIRTTNPVATEQYGSVSATNLQRGNDL

SEQ ID NO: 9113 - protein, 28 aa, Artificial Sequence
  Description of Artificial Sequence: Synthetic peptide
DEEEIRTTNPVATEQYGSWSTNLQHGNF

SEQ ID NO: 9114 - protein, 28 aa, Artificial Sequence
  Description of Artificial Sequence: Synthetic peptide
DENEIRTTNPVATEIYGWVSTNLQRGNR

SEQ ID NO: 9115 - protein, 28 aa, Artificial Sequence
  Description of Artificial Sequence: Synthetic peptide
DEEEIRCTNPVATEHYGVVSTNLQRGNR

SEQ ID NO: 9116 - protein, 28 aa, Artificial Sequence
  Description of Artificial Sequence: Synthetic peptide
DEQEIRTTNPVATEIYGSVSMNLQRGNR

SEQ ID NO: 9117 - protein, 30 aa, Artificial Sequence
  Description of Artificial Sequence: Synthetic polypeptide
DEEEIRTTNPVATEQYGSVSTNLQDREGNQ

SEQ ID NO: 9118 - protein, 30 aa, Artificial Sequence
  Description of Artificial Sequence: Synthetic polypeptide
DEEEIRTTNPVATEQYGSVSTNNLQQRGER

SEQ ID NO: 9119 - protein, 28 aa, Artificial Sequence
  Description of Artificial Sequence: Synthetic peptide
DEEEIRTTNPVATEQYGSVSTNPQIGNQ

SEQ ID NO: 9120 - protein, 30 aa, Artificial Sequence
  Description of Artificial Sequence: Synthetic polypeptide
DEEEIRTTNPVATEQYGSVSTMNLQQGNDR

SEQ ID NO: 9121 - protein, 29 aa, Artificial Sequence
  Description of Artificial Sequence: Synthetic peptide
DEEEIRTTNPVATEWYGQSVSTNNQRGNR

SEQ ID NO: 9122 - protein, 28 aa, Artificial Sequence
  Description of Artificial Sequence: Synthetic peptide
DEEEIRTTNPVATEQYGSVSTELQQGNL

SEQ ID NO: 9123 - protein, 28 aa, Artificial Sequence
  Description of Artificial Sequence: Synthetic peptide
DEEEIRGTNPVATEQYGAVGTNLQRGNR

SEQ ID NO: 9124 - protein, 28 aa, Artificial Sequence
  Description of Artificial Sequence: Synthetic peptide
DEEEIRTTNPVATEQYGSVSTNLYQGNA

SEQ ID NO: 9125 - protein, 28 aa, Artificial Sequence
  Description of Artificial Sequence: Synthetic peptide
DEQEIRTTNPVATEIYGWVSTNLQRGNR

SEQ ID NO: 9126 - protein, 28 aa, Artificial Sequence
  Description of Artificial Sequence: Synthetic peptide
DENEIRTTNPVATEQYGSVSTNPQRGQR

SEQ ID NO: 9127 - protein, 29 aa, Artificial Sequence
  Description of Artificial Sequence: Synthetic peptide
DEEEIRTTNPVATEQYGSVSCTNLQNGNC

SEQ ID NO: 9128 - protein, 30 aa, Artificial Sequence
  Description of Artificial Sequence: Synthetic polypeptide
DEEEIVTTNPVATEQYGSVSTNLQRGENDR

SEQ ID NO: 9129 - protein, 28 aa, Artificial Sequence
  Description of Artificial Sequence: Synthetic peptide
GEEEIRTTNPVATEQYGSVSTNLQHGNS

SEQ ID NO: 9130 - protein, 29 aa, Artificial Sequence
  Description of Artificial Sequence: Synthetic peptide
DEEEIRTTNPVATEQYGSVDTNLQRGNDV

SEQ ID NO: 9131 - protein, 29 aa, Artificial Sequence
  Description of Artificial Sequence: Synthetic peptide
DEEEIRTTNPVATQQYGSVSTELQRGNHR

SEQ ID NO: 9132 - protein, 28 aa, Artificial Sequence
  Description of Artificial Sequence: Synthetic peptide
DDEEIRTTNPVATEQYGSVSTNWQRPNR

SEQ ID NO: 9133 - protein, 31 aa, Artificial Sequence
  Description of Artificial Sequence: Synthetic polypeptide
DEEEIRTTNPVATEQYGSVSTNPLVQRGNER

SEQ ID NO: 9134 - protein, 29 aa, Artificial Sequence
  Description of Artificial Sequence: Synthetic peptide
DEEEIRTTNPVATEQYGSVSTNLEEFGNR

SEQ ID NO: 9135 - protein, 30 aa, Artificial Sequence
  Description of Artificial Sequence: Synthetic polypeptide
DEEEIRTTNPVATEQYGSVSTNDQRDGNSR

SEQ ID NO: 9136 - protein, 29 aa, Artificial Sequence
  Description of Artificial Sequence: Synthetic peptide
DEEEIYTTNPVATEQYGSVSTANLQRGNH

SEQ ID NO: 9137 - protein, 29 aa, Artificial Sequence
  Description of Artificial Sequence: Synthetic peptide
DEEEIRTTNPVATEQYGSVSTNGLERGDR

SEQ ID NO: 9138 - protein, 29 aa, Artificial Sequence
  Description of Artificial Sequence: Synthetic peptide
DEEEIRQTNPVATEQYGSVSTINLQRGNE

SEQ ID NO: 9139 - protein, 28 aa, Artificial Sequence
  Description of Artificial Sequence: Synthetic peptide
DLEEIRTTNPVATEQYGSVGTNLQRGER

SEQ ID NO: 9140 - protein, 29 aa, Artificial Sequence
  Description of Artificial Sequence: Synthetic peptide
DEEEIRTTNPVATEQYGSVSTFNLQDGDR

SEQ ID NO: 9141 - protein, 28 aa, Artificial Sequence
  Description of Artificial Sequence: Synthetic peptide
DEEEIRTTNPVATEQYGSVSTDDQRGNG

SEQ ID NO: 9142 - protein, 29 aa, Artificial Sequence
  Description of Artificial Sequence: Synthetic peptide
DEEMIRTTNPVATEQYGSYVSTNLQRGND

SEQ ID NO: 9143 - protein, 28 aa, Artificial Sequence
  Description of Artificial Sequence: Synthetic peptide
DEEEIRTVNPVATEQYGSVSQNDQRGNR

SEQ ID NO: 9144 - protein, 29 aa, Artificial Sequence
  Description of Artificial Sequence: Synthetic peptide
DEEEIRTTNPVATEQYGSVESTPLQRGER

SEQ ID NO: 9145 - protein, 29 aa, Artificial Sequence
  Description of Artificial Sequence: Synthetic peptide
DEQEIRTTNPVATEQYGSVSLTNLQRGNS

SEQ ID NO: 9146 - protein, 29 aa, Artificial Sequence
  Description of Artificial Sequence: Synthetic peptide
HEEEIYTTNPVATEQYGSVSTNLQRGENR

SEQ ID NO: 9147 - protein, 29 aa, Artificial Sequence
  Description of Artificial Sequence: Synthetic peptide
DEEEIRTTNPVATEQYGSVDTNLQREGNW

SEQ ID NO: 9148 - protein, 28 aa, Artificial Sequence
  Description of Artificial Sequence: Synthetic peptide
DEQEIRTTNPVATEQYGSASENLQRGNR

SEQ ID NO: 9149 - protein, 28 aa, Artificial Sequence
  Description of Artificial Sequence: Synthetic peptide
DEEEIRTTNPFASEQYGSVSTNLQRGNN

SEQ ID NO: 9150 - protein, 28 aa, Artificial Sequence
  Description of Artificial Sequence: Synthetic peptide
DEQEIRTTNPVATECYGSVSTNLQRGNN

SEQ ID NO: 9151 - protein, 28 aa, Artificial Sequence
  Description of Artificial Sequence: Synthetic peptide
DHEEIRTTNPVATEQYGSVSTNLDRGNP

SEQ ID NO: 9152 - protein, 28 aa, Artificial Sequence
  Description of Artificial Sequence: Synthetic peptide
DEEEIRTVNPVCTEQYGSVSTNDQRGNR

SEQ ID NO: 9153 - protein, 28 aa, Artificial Sequence
  Description of Artificial Sequence: Synthetic peptide
DEEEIRTTNPVATEQYGSVSTNPQLGNA

SEQ ID NO: 9154 - protein, 28 aa, Artificial Sequence
  Description of Artificial Sequence: Synthetic peptide
DEGEIRGTNPVATEHYGSVSTNLQRGNR

SEQ ID NO: 9155 - protein, 30 aa, Artificial Sequence
  Description of Artificial Sequence: Synthetic polypeptide
DEEEIRTTNPVATEQYGSVSETNLQPGDNR

SEQ ID NO: 9156 - protein, 28 aa, Artificial Sequence
  Description of Artificial Sequence: Synthetic peptide
DEEEIVTTNPVATEQYGSVDTNDQRGNR

SEQ ID NO: 9157 - protein, 28 aa, Artificial Sequence
  Description of Artificial Sequence: Synthetic peptide
DEEEIRTTNPVATEQYGFVSDLLQRGNR

SEQ ID NO: 9158 - protein, 29 aa, Artificial Sequence
  Description of Artificial Sequence: Synthetic peptide
DEEEIRTTNPVATEQYWGSVSTGDQRGNR

SEQ ID NO: 9159 - protein, 30 aa, Artificial Sequence
  Description of Artificial Sequence: Synthetic polypeptide
DEEEIRTTNPVATEQYGSVSTNLQDWGDNR

SEQ ID NO: 9160 - protein, 28 aa, Artificial Sequence
  Description of Artificial Sequence: Synthetic peptide
DEEEIRTTNPVATEQYGSVSTDLQVGND

SEQ ID NO: 9161 - protein, 28 aa, Artificial Sequence
  Description of Artificial Sequence: Synthetic peptide
DEEEIRTTNPVATEQYGSVDTNLMRGTR

SEQ ID NO: 9162 - protein, 28 aa, Artificial Sequence
  Description of Artificial Sequence: Synthetic peptide
DEEEIRTTNPVATEQYGSVSTNLQMGEM

SEQ ID NO: 9163 - protein, 30 aa, Artificial Sequence
  Description of Artificial Sequence: Synthetic polypeptide
DGEEIRTTNPVATEQYGSVSVTNNLQRGNR

SEQ ID NO: 9164 - protein, 28 aa, Artificial Sequence
  Description of Artificial Sequence: Synthetic peptide
DEEEIRTTNPVATEQYGSVSTNPQNGNA

SEQ ID NO: 9165 - protein, 28 aa, Artificial Sequence
  Description of Artificial Sequence: Synthetic peptide
DEEEIRTTNPVATEQYGSVSTNEQMGNW

SEQ ID NO: 9166 - protein, 29 aa, Artificial Sequence
  Description of Artificial Sequence: Synthetic peptide
DEEEIRTTNPVATEQYGSVSTNEQDHGNR

SEQ ID NO: 9167 - protein, 29 aa, Artificial Sequence
  Description of Artificial Sequence: Synthetic peptide
DEQEIRTTNPVATEQYGSVDTMNLQRGNR

SEQ ID NO: 9168 - protein, 28 aa, Artificial Sequence
  Description of Artificial Sequence: Synthetic peptide
NEEEIRCTNPVATEQYGSVSMNLQRGNR

SEQ ID NO: 9169 - protein, 28 aa, Artificial Sequence
  Description of Artificial Sequence: Synthetic peptide
DEEEIRTTNPVATEQYGSVSTNLQVGDL

SEQ ID NO: 9170 - protein, 28 aa, Artificial Sequence
  Description of Artificial Sequence: Synthetic peptide
DEEEIRTTNPVSTEMYGSVATNLQRGNR

SEQ ID NO: 9171 - protein, 29 aa, Artificial Sequence
  Description of Artificial Sequence: Synthetic peptide
DEEEIRTTNPVATEQYGEVSADNLQRGNR

SEQ ID NO: 9172 - protein, 28 aa, Artificial Sequence
  Description of Artificial Sequence: Synthetic peptide
DEEEIRTTNPVATGQYGSVSTNLDRGNS

SEQ ID NO: 9173 - protein, 28 aa, Artificial Sequence
  Description of Artificial Sequence: Synthetic peptide
DEEEIRTTNPTATEQYGSVSTNEQRGNG

SEQ ID NO: 9174 - protein, 28 aa, Artificial Sequence
  Description of Artificial Sequence: Synthetic peptide
CEEEIITTNPVSTEQYGSVSTNLQRGNR

SEQ ID NO: 9175 - protein, 29 aa, Artificial Sequence
  Description of Artificial Sequence: Synthetic peptide
DEEEIRTTNPVATEQYGSVSTDLQNGNDR

SEQ ID NO: 9176 - protein, 29 aa, Artificial Sequence
  Description of Artificial Sequence: Synthetic peptide
DEEEIRTTNPVATEQYGSVSTNLFRNGNE

SEQ ID NO: 9177 - protein, 28 aa, Artificial Sequence
  Description of Artificial Sequence: Synthetic peptide
DEECIRTTNPVAYEQYGSVSTNLQRGND

SEQ ID NO: 9178 - protein, 29 aa, Artificial Sequence
  Description of Artificial Sequence: Synthetic peptide
WEEEIRTTNPVATEHYGSVSTNLQRGFNR

SEQ ID NO: 9179 - protein, 31 aa, Artificial Sequence
  Description of Artificial Sequence: Synthetic polypeptide
DEEEIRTTNPVATEQYGSVSTNLQLRGENDR

SEQ ID NO: 9180 - protein, 29 aa, Artificial Sequence
  Description of Artificial Sequence: Synthetic peptide
DEEEIRCTNPVATEQYGSVSTNLPQFGNR

SEQ ID NO: 9181 - protein, 28 aa, Artificial Sequence
  Description of Artificial Sequence: Synthetic peptide
DEEEIRTTNPVASEQYGSVSTNLGRGTR

SEQ ID NO: 9182 - protein, 28 aa, Artificial Sequence
  Description of Artificial Sequence: Synthetic peptide
DEEEIRTTNPVATEQYGSVDENLQRGPR

SEQ ID NO: 9183 - protein, 29 aa, Artificial Sequence
  Description of Artificial Sequence: Synthetic peptide
DEEEIRTTNPVATEQYGSVSTNLNREGNI

SEQ ID NO: 9184 - protein, 28 aa, Artificial Sequence
  Description of Artificial Sequence: Synthetic peptide
DEEEIRTTNPVATEQLGVVSVNLQRGNR

SEQ ID NO: 9185 - protein, 30 aa, Artificial Sequence
  Description of Artificial Sequence: Synthetic polypeptide
DEEEIRTTNPVATEQYGSVSTLNLQYRGNS

SEQ ID NO: 9186 - protein, 30 aa, Artificial Sequence
  Description of Artificial Sequence: Synthetic polypeptide
DTEEIRTTNPVATEQYGSVLSTNPLQRGNR

SEQ ID NO: 9187 - protein, 28 aa, Artificial Sequence
  Description of Artificial Sequence: Synthetic peptide
DEEEIRQTNPVSTEQYGSCSTNLQRGNR

SEQ ID NO: 9188 - protein, 28 aa, Artificial Sequence
  Description of Artificial Sequence: Synthetic peptide
DEEEIRTTNPVATEQYGVVSTNLQSGER

SEQ ID NO: 9189 - protein, 28 aa, Artificial Sequence
  Description of Artificial Sequence: Synthetic peptide
DEEEIRTTNPEATEQYGSVSTNLQLGNI

SEQ ID NO: 9190 - protein, 28 aa, Artificial Sequence
  Description of Artificial Sequence: Synthetic peptide
DEEEIRSTNPVATECYGSVSNNLQRGNR

SEQ ID NO: 9191 - protein, 28 aa, Artificial Sequence
  Description of Artificial Sequence: Synthetic peptide
DENEIVTTNPVATEQYGVVSTNLQRGNR

SEQ ID NO: 9192 - protein, 28 aa, Artificial Sequence
  Description of Artificial Sequence: Synthetic peptide
DEIEIRTTNPVATEQYGSVSDNLQHGNR

SEQ ID NO: 9193 - protein, 31 aa, Artificial Sequence
  Description of Artificial Sequence: Synthetic polypeptide
DEEEIRTTNPVATEQYGSVSTGNLVQRGVNR

SEQ ID NO: 9194 - protein, 30 aa, Artificial Sequence
  Description of Artificial Sequence: Synthetic polypeptide
DEEEIRTTNPVATEQYGSVSTTNLQRGENF

SEQ ID NO: 9195 - protein, 29 aa, Artificial Sequence
  Description of Artificial Sequence: Synthetic peptide
DEEEIRTTNPVATEQYGDSVSTNDQFGNR

SEQ ID NO: 9196 - protein, 28 aa, Artificial Sequence
  Description of Artificial Sequence: Synthetic peptide
DEEEIRTTNPVATEQYGSWSTDDQRGNR

SEQ ID NO: 9197 - protein, 28 aa, Artificial Sequence
  Description of Artificial Sequence: Synthetic peptide
DEEYIRTTNPVATEQYGSVSTNDQRGER

SEQ ID NO: 9198 - protein, 29 aa, Artificial Sequence
  Description of Artificial Sequence: Synthetic peptide
DEEEIRTTNPVATEQYGGVSTNEQERGNR

SEQ ID NO: 9199 - protein, 28 aa, Artificial Sequence
  Description of Artificial Sequence: Synthetic peptide
DEEEIRTTNPVATEIYGSVSTNLDRGNN

SEQ ID NO: 9200 - protein, 30 aa, Artificial Sequence
  Description of Artificial Sequence: Synthetic polypeptide
DEEEIRTTNPVAYEQYGYSVSLTNLQRGNR

SEQ ID NO: 9201 - protein, 30 aa, Artificial Sequence
  Description of Artificial Sequence: Synthetic polypeptide
DEEEIRTTNPVATEQYGASVSTNLDREGNR

SEQ ID NO: 9202 - protein, 29 aa, Artificial Sequence
  Description of Artificial Sequence: Synthetic peptide
DEEEIRTTNPVATEQYGSVSTNEQREGNF

SEQ ID NO: 9203 - protein, 28 aa, Artificial Sequence
  Description of Artificial Sequence: Synthetic peptide
DEEEVRTTNPVAYEQYGSVSSNLQRGNR

SEQ ID NO: 9204 - protein, 28 aa, Artificial Sequence
  Description of Artificial Sequence: Synthetic peptide
DEEEIRTTNPVATEQYGSVPTNLQRGIS

SEQ ID NO: 9205 - protein, 30 aa, Artificial Sequence
  Description of Artificial Sequence: Synthetic polypeptide
DEEEIRATNPVATEQYGSVSTNLQQRSGNR

SEQ ID NO: 9206 - protein, 30 aa, Artificial Sequence
  Description of Artificial Sequence: Synthetic polypeptide
DEEEIRTTNPVATEQYGSVESLTNLQYGNR

SEQ ID NO: 9207 - protein, 29 aa, Artificial Sequence
  Description of Artificial Sequence: Synthetic peptide
DEEEIRTTNPVATECYGSACSTNLQRGNR

SEQ ID NO: 9208 - protein, 28 aa, Artificial Sequence
  Description of Artificial Sequence: Synthetic peptide
DEEEIRTTNPVATEQYGSVDTPLDRGNR

SEQ ID NO: 9209 - protein, 29 aa, Artificial Sequence
  Description of Artificial Sequence: Synthetic peptide
DEEEIRTTNPVATEQYGSVSTNEQDEGNR

SEQ ID NO: 9210 - protein, 28 aa, Artificial Sequence
  Description of Artificial Sequence: Synthetic peptide
DENEIRATNPVATEMYGSVSTNLQRGNR

SEQ ID NO: 9211 - protein, 28 aa, Artificial Sequence
  Description of Artificial Sequence: Synthetic peptide
DEEEIRTTNPVATEQYGSWSTELQVGNR

SEQ ID NO: 9212 - protein, 28 aa, Artificial Sequence
  Description of Artificial Sequence: Synthetic peptide
DEEEIRTTNPVATEQYGSVSENEERGNR

SEQ ID NO: 9213 - protein, 28 aa, Artificial Sequence
  Description of Artificial Sequence: Synthetic peptide
DEEEIRTTNPVATEQYGSVSTNEQHGNL

SEQ ID NO: 9214 - protein, 30 aa, Artificial Sequence
  Description of Artificial Sequence: Synthetic polypeptide
DEEEIRTTNPVATEQYGSVISTNEQRSGNR

SEQ ID NO: 9215 - protein, 28 aa, Artificial Sequence
  Description of Artificial Sequence: Synthetic peptide
NEEEIRTTNPCATETYGSVSTNLQRGNR

SEQ ID NO: 9216 - protein, 28 aa, Artificial Sequence
  Description of Artificial Sequence: Synthetic peptide
DEEEIRATNPIATEQYGSVSTELQRGNR

SEQ ID NO: 9217 - protein, 29 aa, Artificial Sequence
  Description of Artificial Sequence: Synthetic peptide
DEQEIRTTNPVATEQYGSVSTENLERGNR

SEQ ID NO: 9218 - protein, 30 aa, Artificial Sequence
  Description of Artificial Sequence: Synthetic polypeptide
DEEEIRTTNPVATEQYGTSVSTNLQHGTNR

SEQ ID NO: 9219 - protein, 28 aa, Artificial Sequence
  Description of Artificial Sequence: Synthetic peptide
DEEEIRTTNPVATEQYGSVSTNLQVGEE

SEQ ID NO: 9220 - protein, 28 aa, Artificial Sequence
  Description of Artificial Sequence: Synthetic peptide
DDEEIRTTNPVATENYGSVSTNLNRGNR

SEQ ID NO: 9221 - protein, 28 aa, Artificial Sequence
  Description of Artificial Sequence: Synthetic peptide
DEEEIRTTNPVATEVYGNVGTNLQRGNR

SEQ ID NO: 9222 - protein, 28 aa, Artificial Sequence
  Description of Artificial Sequence: Synthetic peptide
DEEEIRTTNPVATEQYGSVSTNLQGGEV

SEQ ID NO: 9223 - protein, 29 aa, Artificial Sequence
  Description of Artificial Sequence: Synthetic peptide
DEQEIRTTNPVATECYGSVSATNLQRGNR

SEQ ID NO: 9224 - protein, 28 aa, Artificial Sequence
  Description of Artificial Sequence: Synthetic peptide
DEEEIRTTNPVATEQYGSVSTNLDPGNP

SEQ ID NO: 9225 - protein, 28 aa, Artificial Sequence
  Description of Artificial Sequence: Synthetic peptide
DEEEIRTTNPVATELYGSTSTNDQRGNR

SEQ ID NO: 9226 - protein, 28 aa, Artificial Sequence
  Description of Artificial Sequence: Synthetic peptide
DETEIRTTNPVATEQYGNVSTNPQRGNR

SEQ ID NO: 9227 - protein, 28 aa, Artificial Sequence
  Description of Artificial Sequence: Synthetic peptide
DEEELRTTNPVATEQYGAASTNLQRGNR

SEQ ID NO: 9228 - protein, 29 aa, Artificial Sequence
  Description of Artificial Sequence: Synthetic peptide
DEEETRTTNPVATEQYGSVSTPNLQPGNR

SEQ ID NO: 9229 - protein, 28 aa, Artificial Sequence
  Description of Artificial Sequence: Synthetic peptide
DEEEIRTTNPVATEIFGGVSTNLQRGNR

SEQ ID NO: 9230 - protein, 29 aa, Artificial Sequence
  Description of Artificial Sequence: Synthetic peptide
DEEEIRTTNPVATEQYGSVETNLQAAGNR

SEQ ID NO: 9231 - protein, 29 aa, Artificial Sequence
  Description of Artificial Sequence: Synthetic peptide
DEEEIRTTNPVATEQYGSVLHENLQRGNR

SEQ ID NO: 9232 - protein, 29 aa, Artificial Sequence
  Description of Artificial Sequence: Synthetic peptide
DEEEIRTTNPVATEQYGSVSTYLQRNGNE

SEQ ID NO: 9233 - protein, 29 aa, Artificial Sequence
  Description of Artificial Sequence: Synthetic peptide
DEEEIRTTNPVATEQYGSVSTNLQDVGNE

SEQ ID NO: 9234 - protein, 28 aa, Artificial Sequence
  Description of Artificial Sequence: Synthetic peptide
QEEEVRTTNPVATEQYGSVGTNLQRGNR

SEQ ID NO: 9235 - protein, 30 aa, Artificial Sequence
  Description of Artificial Sequence: Synthetic polypeptide
DEEEIRTTNPVATEQYGSVSTNPLQERGER

SEQ ID NO: 9236 - protein, 28 aa, Artificial Sequence
  Description of Artificial Sequence: Synthetic peptide
DEEEIRTVNPVATEQYGSVATNLQRENR

SEQ ID NO: 9237 - protein, 28 aa, Artificial Sequence
  Description of Artificial Sequence: Synthetic peptide
DEEEIRATNPVATEQYGCVSTNLQRENR

SEQ ID NO: 9238 - protein, 29 aa, Artificial Sequence
  Description of Artificial Sequence: Synthetic peptide
DEEEIRTTNPVATEQYGSVSTNLQINGNV

SEQ ID NO: 9239 - protein, 29 aa, Artificial Sequence
  Description of Artificial Sequence: Synthetic peptide
DEEEIRTTNPVATEQYGWVSTENLQRGNF

SEQ ID NO: 9240 - protein, 29 aa, Artificial Sequence
  Description of Artificial Sequence: Synthetic peptide
DEEEIRTTNPVATEQYGESVSHNLDRGNR

SEQ ID NO: 9241 - protein, 29 aa, Artificial Sequence
  Description of Artificial Sequence: Synthetic peptide
DEEEIRQTNPVATEQYGSVSTLNPQRGNR

SEQ ID NO: 9242 - protein, 28 aa, Artificial Sequence
  Description of Artificial Sequence: Synthetic peptide
DEEEIATTNPVATEQYGSVSTVLQRGPR

SEQ ID NO: 9243 - protein, 29 aa, Artificial Sequence
  Description of Artificial Sequence: Synthetic peptide
DEEEIRPTNPVATEQYGSVSENLQRGNPR

SEQ ID NO: 9244 - protein, 28 aa, Artificial Sequence
  Description of Artificial Sequence: Synthetic peptide
QEEEIVTTNPVATEQYGIVSTNLQRGNR

SEQ ID NO: 9245 - protein, 28 aa, Artificial Sequence
  Description of Artificial Sequence: Synthetic peptide
DEEEIRTTNPVAYEQYWSVSTNLQPGNR

SEQ ID NO: 9246 - protein, 28 aa, Artificial Sequence
  Description of Artificial Sequence: Synthetic peptide
DEEEVRTTNPVATETYGAVSTNLQRGNR

SEQ ID NO: 9247 - protein, 28 aa, Artificial Sequence
  Description of Artificial Sequence: Synthetic peptide
DAEEIRTTNPVATEQYGSVSTNFQRGNA

SEQ ID NO: 9248 - protein, 29 aa, Artificial Sequence
  Description of Artificial Sequence: Synthetic peptide
DEEEIRTTNPVATEQYGSVSTNLQDVGND

SEQ ID NO: 9249 - protein, 30 aa, Artificial Sequence
  Description of Artificial Sequence: Synthetic polypeptide
DEEEIRTTNPVATEQYGSVSTNLQRNGNDE

SEQ ID NO: 9250 - protein, 30 aa, Artificial Sequence
  Description of Artificial Sequence: Synthetic polypeptide
DEEEIRTTNPVATEQYGSVESTPNLIRGNR

SEQ ID NO: 9251 - protein, 29 aa, Artificial Sequence
  Description of Artificial Sequence: Synthetic peptide
DEEEIRTTNPVATEQYGSVSTNLQQGNDM

SEQ ID NO: 9252 - protein, 29 aa, Artificial Sequence
  Description of Artificial Sequence: Synthetic peptide
DEEEIRTTNPVATEQWGSVSTNLQILGNR

SEQ ID NO: 9253 - protein, 30 aa, Artificial Sequence
  Description of Artificial Sequence: Synthetic polypeptide
DEEEIRTTNPVATEQYGSVSTPNLVQRGNP

SEQ ID NO: 9254 - protein, 28 aa, Artificial Sequence
  Description of Artificial Sequence: Synthetic peptide
DEEEIRTTNPVATEQYGSVHENLMRGNR

SEQ ID NO: 9255 - protein, 28 aa, Artificial Sequence
  Description of Artificial Sequence: Synthetic peptide
DEEEIRSTNPVATEMYGSVATNLQRGNR

SEQ ID NO: 9256 - protein, 30 aa, Artificial Sequence
  Description of Artificial Sequence: Synthetic polypeptide
DEEEIRTTNPVATEQYGESVSQTNLTRGNR

SEQ ID NO: 9257 - protein, 29 aa, Artificial Sequence
  Description of Artificial Sequence: Synthetic peptide
DENEIRTTNPVATEQYGSVSTNLQREGNM

SEQ ID NO: 9258 - protein, 29 aa, Artificial Sequence
  Description of Artificial Sequence: Synthetic peptide
DEEEIRTTNPVATEQYGSVSTNLQDAGNM

SEQ ID NO: 9259 - protein, 28 aa, Artificial Sequence
  Description of Artificial Sequence: Synthetic peptide
DEEEIRTTNPVATEQYGSVSENLQNGNV

SEQ ID NO: 9260 - protein, 28 aa, Artificial Sequence
  Description of Artificial Sequence: Synthetic peptide
GDEEIRTTNPVSTEQYGSVSTNLQRGNR

SEQ ID NO: 9261 - protein, 31 aa, Artificial Sequence
  Description of Artificial Sequence: Synthetic polypeptide
DEEEIRTTNPVATEQYGSVSTMNLQLRGNFR

SEQ ID NO: 9262 - protein, 28 aa, Artificial Sequence
  Description of Artificial Sequence: Synthetic peptide
DEEEIRTTNPVATEQYGSVETNDERGNR

SEQ ID NO: 9263 - protein, 28 aa, Artificial Sequence
  Description of Artificial Sequence: Synthetic peptide
DEEEIAATNPVATEQYGSVSTNLQRGNC

SEQ ID NO: 9264 - protein, 28 aa, Artificial Sequence
  Description of Artificial Sequence: Synthetic peptide
DESEIRTTNPVASEQYGSVSTNLQTGNR

SEQ ID NO: 9265 - protein, 28 aa, Artificial Sequence
  Description of Artificial Sequence: Synthetic peptide
DEEEIRTTNPVATEQYGSASTNIQRGDR

SEQ ID NO: 9266 - protein, 28 aa, Artificial Sequence
  Description of Artificial Sequence: Synthetic peptide
DEEEIRTTNPVATEQLGTVSTNLQRGNT

SEQ ID NO: 9267 - protein, 29 aa, Artificial Sequence
  Description of Artificial Sequence: Synthetic peptide
DEEEIRATNPVATEQYGSVSTNLQDRGNW

SEQ ID NO: 9268 - protein, 28 aa, Artificial Sequence
  Description of Artificial Sequence: Synthetic peptide
GEEEIRTTNPVATEQYGSVSTNLQAGNV

SEQ ID NO: 9269 - protein, 29 aa, Artificial Sequence
  Description of Artificial Sequence: Synthetic peptide
DEEEIRTTNPVATEQYGSVSTNLQEIGNW

SEQ ID NO: 9270 - protein, 28 aa, Artificial Sequence
  Description of Artificial Sequence: Synthetic peptide
AEEEIRTTNPFATECYGSVSTNLQRGNR

SEQ ID NO: 9271 - protein, 28 aa, Artificial Sequence
  Description of Artificial Sequence: Synthetic peptide
DTEEIRTTNPVATEQYGSVHTNLQRGNP

SEQ ID NO: 9272 - protein, 28 aa, Artificial Sequence
  Description of Artificial Sequence: Synthetic peptide
DEEEIATTNPVATEQYGSVSTNLQLGNA

SEQ ID NO: 9273 - protein, 28 aa, Artificial Sequence
  Description of Artificial Sequence: Synthetic peptide
DEEEIRTVNPCATEQYGSVSTNLQLGNR

SEQ ID NO: 9274 - protein, 28 aa, Artificial Sequence
  Description of Artificial Sequence: Synthetic peptide
DEEEIRTVNPVATEQYGSVSTNLQHGDR

SEQ ID NO: 9275 - protein, 28 aa, Artificial Sequence
  Description of Artificial Sequence: Synthetic peptide
DEEEIRTTNPAATEQYGSVSTNLQRGDQ

SEQ ID NO: 9276 - protein, 28 aa, Artificial Sequence
  Description of Artificial Sequence: Synthetic peptide
DDEEIRTTNPVATETYGAVSTNLQRGNR

SEQ ID NO: 9277 - protein, 31 aa, Artificial Sequence
  Description of Artificial Sequence: Synthetic polypeptide
DEEEIRTTNPVATEQYGSVSTLNLPQRGNDR

SEQ ID NO: 9278 - protein, 29 aa, Artificial Sequence
  Description of Artificial Sequence: Synthetic peptide
DEEEISTTNPVATEMYGSVSATNLQRGNR

SEQ ID NO: 9279 - protein, 28 aa, Artificial Sequence
  Description of Artificial Sequence: Synthetic peptide
DEEEIRTTNPVATMQWGSVSTNLQEGNR

SEQ ID NO: 9280 - protein, 29 aa, Artificial Sequence
  Description of Artificial Sequence: Synthetic peptide
DEDEIRTTNPEATEQYGSVSTNLPQRGNR

SEQ ID NO: 9281 - protein, 28 aa, Artificial Sequence
  Description of Artificial Sequence: Synthetic peptide
MEEEIRTTNPVATEQYGSVSTNLQYGNM

SEQ ID NO: 9282 - protein, 30 aa, Artificial Sequence
  Description of Artificial Sequence: Synthetic polypeptide
DEEEIRTTNPVATEQYGSVDTNLQLRNGNR

SEQ ID NO: 9283 - protein, 28 aa, Artificial Sequence
  Description of Artificial Sequence: Synthetic peptide
DEEEIRTTNPVATECYGSVSTNLQRGEC

SEQ ID NO: 9284 - protein, 28 aa, Artificial Sequence
  Description of Artificial Sequence: Synthetic peptide
DEEEIRTTNPVATEQYGSVSTNLQIGDM

SEQ ID NO: 9285 - protein, 30 aa, Artificial Sequence
  Description of Artificial Sequence: Synthetic polypeptide
KEEEIRTTNPVATEQYGSVSTNLQEREGNR

SEQ ID NO: 9286 - protein, 28 aa, Artificial Sequence
  Description of Artificial Sequence: Synthetic peptide
DEEEIVTTNPVATEQYGSVSDNLERGNR

SEQ ID NO: 9287 - protein, 29 aa, Artificial Sequence
  Description of Artificial Sequence: Synthetic peptide
DEEEIRTTNPVATEQYGSVSCTNLQNGNN

SEQ ID NO: 9288 - protein, 28 aa, Artificial Sequence
  Description of Artificial Sequence: Synthetic peptide
DEEEIRQTNPVATEQYGDVSTNLQRGNL

SEQ ID NO: 9289 - protein, 28 aa, Artificial Sequence
  Description of Artificial Sequence: Synthetic peptide
DEEEIRTTNPVATEQYGSASTNLQHENR

SEQ ID NO: 9290 - protein, 28 aa, Artificial Sequence
  Description of Artificial Sequence: Synthetic peptide
DEREIRTTNPIATEQYGSVSENLQRGNR

SEQ ID NO: 9291 - protein, 28 aa, Artificial Sequence
  Description of Artificial Sequence: Synthetic peptide
DEEEIRTTNPVATEQYGSVSTNLQMGEL

SEQ ID NO: 9292 - protein, 28 aa, Artificial Sequence
  Description of Artificial Sequence: Synthetic peptide
DEEEIRTTNPVATEQYGSVETDLQQGNR

SEQ ID NO: 9293 - protein, 28 aa, Artificial Sequence
  Description of Artificial Sequence: Synthetic peptide
DEEEIRTTNPVATEQYGSVSTDLQRGEA

SEQ ID NO: 9294 - protein, 28 aa, Artificial Sequence
  Description of Artificial Sequence: Synthetic peptide
DEEEIRSTNPVATEIYGVVSTNLQRGNR

SEQ ID NO: 9295 - protein, 28 aa, Artificial Sequence
  Description of Artificial Sequence: Synthetic peptide
DEEEIRTTNPYATEQYGSVSTNLMEGNR

SEQ ID NO: 9296 - protein, 28 aa, Artificial Sequence
  Description of Artificial Sequence: Synthetic peptide
DEEEIRTVNPVATEQYGSVSTNLQGGMR

SEQ ID NO: 9297 - protein, 28 aa, Artificial Sequence
  Description of Artificial Sequence: Synthetic peptide
DEEEIRATNPVATEQYGSVSTELQRGER

SEQ ID NO: 9298 - protein, 28 aa, Artificial Sequence
  Description of Artificial Sequence: Synthetic peptide
DEEEIRTTNPVATEQYGSVSTNLQNGEQ

SEQ ID NO: 9299 - protein, 29 aa, Artificial Sequence
  Description of Artificial Sequence: Synthetic peptide
DEEEIRTTNPVATEQYGSVSENLQVEGNR

SEQ ID NO: 9300 - protein, 29 aa, Artificial Sequence
  Description of Artificial Sequence: Synthetic peptide
DEEEIRTTNPVATEQYGEVSAENLQRGNR

SEQ ID NO: 9301 - protein, 28 aa, Artificial Sequence
  Description of Artificial Sequence: Synthetic peptide
DEEEIRTTNPVATEQYGDASTNLQRENR

SEQ ID NO: 9302 - protein, 28 aa, Artificial Sequence
  Description of Artificial Sequence: Synthetic peptide
DEEEIRTTNPVATEQYGSVDTNLQQGNS

SEQ ID NO: 9303 - protein, 28 aa, Artificial Sequence
  Description of Artificial Sequence: Synthetic peptide
DENEIRTTNPVATEQYGIVSTGLQRGNR

SEQ ID NO: 9304 - protein, 28 aa, Artificial Sequence
  Description of Artificial Sequence: Synthetic peptide
DEEEIRTTNPVATEQYGSVSTNLCTGNI

SEQ ID NO: 9305 - protein, 28 aa, Artificial Sequence
  Description of Artificial Sequence: Synthetic peptide
DEEEIRCTNPVATEQYGSVSTCDQRGNR

SEQ ID NO: 9306 - protein, 28 aa, Artificial Sequence
  Description of Artificial Sequence: Synthetic peptide
DEEEIRTVNPCSTEQYGSVSTNLQRGNR

SEQ ID NO: 9307 - protein, 28 aa, Artificial Sequence
  Description of Artificial Sequence: Synthetic peptide
DEECIRTTNPVATEQYGSWSENLQRGNR

SEQ ID NO: 9308 - protein, 30 aa, Artificial Sequence
  Description of Artificial Sequence: Synthetic polypeptide
DEEEIRTTNPEATEQYGSVCSTNLQPRGNR

SEQ ID NO: 9309 - protein, 30 aa, Artificial Sequence
  Description of Artificial Sequence: Synthetic polypeptide
DEEEIRTTNPVATEQYGSVSTINLQRDGNN

SEQ ID NO: 9310 - protein, 30 aa, Artificial Sequence
  Description of Artificial Sequence: Synthetic polypeptide
DEEEIRTTNPVATEQYGSVSTIELQRGDNR

SEQ ID NO: 9311 - protein, 28 aa, Artificial Sequence
  Description of Artificial Sequence: Synthetic peptide
DEEEIRTTNPVASEQYGSVGTNLERGNR

SEQ ID NO: 9312 - protein, 28 aa, Artificial Sequence
  Description of Artificial Sequence: Synthetic peptide
DEEEIRTTNPVATEQYGSVSTNDQREDR

SEQ ID NO: 9313 - protein, 28 aa, Artificial Sequence
  Description of Artificial Sequence: Synthetic peptide
DEEEIRTTNPVATEIYGAVGTNLQRGNR

SEQ ID NO: 9314 - protein, 28 aa, Artificial Sequence
  Description of Artificial Sequence: Synthetic peptide
DEEEIRTTNPVATEQYGSVSTNLQLENC

SEQ ID NO: 9315 - protein, 28 aa, Artificial Sequence
  Description of Artificial Sequence: Synthetic peptide
DEEEIRTTNPVATECYGSVSTELQRGNA

SEQ ID NO: 9316 - protein, 29 aa, Artificial Sequence
  Description of Artificial Sequence: Synthetic peptide
DEEEIRTTNPVATEQYGSVSTNGLQHGNL

SEQ ID NO: 9317 - protein, 28 aa, Artificial Sequence
  Description of Artificial Sequence: Synthetic peptide
DEECIRTTNPVAWEQYGSVSTNLQNGNR

SEQ ID NO: 9318 - protein, 31 aa, Artificial Sequence
  Description of Artificial Sequence: Synthetic polypeptide
DEEEIRTTNPVATEQYGSVSTNGLVQDRGNR

SEQ ID NO: 9319 - protein, 28 aa, Artificial Sequence
  Description of Artificial Sequence: Synthetic peptide
REEEIRTTNPVATEQYGVVSTNLQRLNR

SEQ ID NO: 9320 - protein, 28 aa, Artificial Sequence
  Description of Artificial Sequence: Synthetic peptide
DEEEIRTTNPVATESYGSASQNLQRGNR

SEQ ID NO: 9321 - protein, 29 aa, Artificial Sequence
  Description of Artificial Sequence: Synthetic peptide
DEEEIRATNPVATEQYGSVSTNLPQRGTR

SEQ ID NO: 9322 - protein, 30 aa, Artificial Sequence
  Description of Artificial Sequence: Synthetic polypeptide
DEEEIRTTNPVATEQYGSVSATNLQHGNDR

SEQ ID NO: 9323 - protein, 28 aa, Artificial Sequence
  Description of Artificial Sequence: Synthetic peptide
DEWEIVTTNPVATEQYGSVSTNEQRGNR

SEQ ID NO: 9324 - protein, 30 aa, Artificial Sequence
  Description of Artificial Sequence: Synthetic polypeptide
DEEEIRTTNPVATEQYGSWSVTNLQRGDNR

SEQ ID NO: 9325 - protein, 28 aa, Artificial Sequence
  Description of Artificial Sequence: Synthetic peptide
DEQEIRATNPVATEQYGWVSTNLQRGNR

SEQ ID NO: 9326 - protein, 28 aa, Artificial Sequence
  Description of Artificial Sequence: Synthetic peptide
KEEEIRTTNPVATEQYGSVSTDLQAGNR

SEQ ID NO: 9327 - protein, 29 aa, Artificial Sequence
  Description of Artificial Sequence: Synthetic peptide
DEEEIRTTNPVATECYGSIVSTNLQRGER

SEQ ID NO: 9328 - protein, 28 aa, Artificial Sequence
  Description of Artificial Sequence: Synthetic peptide
DEEEIRTTNPVATEQYGSVSTDLERGNQ

SEQ ID NO: 9329 - protein, 28 aa, Artificial Sequence
  Description of Artificial Sequence: Synthetic peptide
DEEEIRTTNPEATEQYGSVSANLQRGNN

SEQ ID NO: 9330 - protein, 29 aa, Artificial Sequence
  Description of Artificial Sequence: Synthetic peptide
DEEEIRTTNPVATEIYGSVSENLTQRGNR

SEQ ID NO: 9331 - protein, 29 aa, Artificial Sequence
  Description of Artificial Sequence: Synthetic peptide
DEEEIRTTNPVATEQYGSVSTDLQLEGNR

SEQ ID NO: 9332 - protein, 30 aa, Artificial Sequence
  Description of Artificial Sequence: Synthetic polypeptide
DEEEIRTTNPVATEQYGSVSTLDLQRGENR

SEQ ID NO: 9333 - protein, 28 aa, Artificial Sequence
  Description of Artificial Sequence: Synthetic peptide
DEEEIRSTNPVCTEQYGSVSTNLQRPNR

SEQ ID NO: 9334 - protein, 29 aa, Artificial Sequence
  Description of Artificial Sequence: Synthetic peptide
REEEIRTTNPVATEQYGSVSATNLQRGTR

SEQ ID NO: 9335 - protein, 28 aa, Artificial Sequence
  Description of Artificial Sequence: Synthetic peptide
DEEEIRTTNPVATEQYGSVSTDLELGNR

SEQ ID NO: 9336 - protein, 28 aa, Artificial Sequence
  Description of Artificial Sequence: Synthetic peptide
DEEEIRTTNPVATEQYGSVSTDLDNGNR

SEQ ID NO: 9337 - protein, 28 aa, Artificial Sequence
  Description of Artificial Sequence: Synthetic peptide
DEEEIRTTNPVATEQYGSVETNLDRENR

SEQ ID NO: 9338 - protein, 28 aa, Artificial Sequence
  Description of Artificial Sequence: Synthetic peptide
DEEEIRTTNPVATQQYGSVFTNDQRGNR

SEQ ID NO: 9339 - protein, 31 aa, Artificial Sequence
  Description of Artificial Sequence: Synthetic polypeptide
DEEEIRTTNPVATEQYGSVSTNLQDREGDNR

SEQ ID NO: 9340 - protein, 29 aa, Artificial Sequence
  Description of Artificial Sequence: Synthetic peptide
DEEEIRTTNPVATEQYGSVESTGLQRMNR

SEQ ID NO: 9341 - protein, 31 aa, Artificial Sequence
  Description of Artificial Sequence: Synthetic polypeptide
DEEEIRTTNPVATEQYGSVSSTNLQDRGHNR

SEQ ID NO: 9342 - protein, 28 aa, Artificial Sequence
  Description of Artificial Sequence: Synthetic peptide
NEESIRTTNPVATEQYGSVSTNDQRGNR

SEQ ID NO: 9343 - protein, 28 aa, Artificial Sequence
  Description of Artificial Sequence: Synthetic peptide
DEEEIRTTNPVATEQYGSVSTNLQTGDV

SEQ ID NO: 9344 - protein, 28 aa, Artificial Sequence
  Description of Artificial Sequence: Synthetic peptide
DEEEIRTTNPVATEQYGSVSTDLERENR

SEQ ID NO: 9345 - protein, 29 aa, Artificial Sequence
  Description of Artificial Sequence: Synthetic peptide
DEEEIRTTNPVATEQYGSVSDNLQDRGNI

SEQ ID NO: 9346 - protein, 30 aa, Artificial Sequence
  Description of Artificial Sequence: Synthetic polypeptide
DEEEIRTTNPVATEQYGSVSATNLQREGER

SEQ ID NO: 9347 - protein, 28 aa, Artificial Sequence
  Description of Artificial Sequence: Synthetic peptide
DEEEIRTTNPEATEQYGSVSTALDRGNR

SEQ ID NO: 9348 - protein, 28 aa, Artificial Sequence
  Description of Artificial Sequence: Synthetic peptide
DEEEIRTTNPVATECYGSVSTDLQRGND

SEQ ID NO: 9349 - protein, 30 aa, Artificial Sequence
  Description of Artificial Sequence: Synthetic polypeptide
DEEEIRTTNPVATEQYGSVFCTNLQRNGNR

SEQ ID NO: 9350 - protein, 30 aa, Artificial Sequence
  Description of Artificial Sequence: Synthetic polypeptide
AEEEIRTTNPVATEQYGSVSTNLQRNGVNR

SEQ ID NO: 9351 - protein, 28 aa, Artificial Sequence
  Description of Artificial Sequence: Synthetic peptide
DEQEIRTTNPVATEQYGCVSTNLERGNR

SEQ ID NO: 9352 - protein, 28 aa, Artificial Sequence
  Description of Artificial Sequence: Synthetic peptide
DEEEISTTNPVATEQYGSVDTNLERGNR

SEQ ID NO: 9353 - protein, 28 aa, Artificial Sequence
  Description of Artificial Sequence: Synthetic peptide
DEEEIRTTNPVATEQYGSVSTNLQVGEM

SEQ ID NO: 9354 - protein, 28 aa, Artificial Sequence
  Description of Artificial Sequence: Synthetic peptide
NEEEIRTTNPVSTEQYGIVSTNLQRGNR

SEQ ID NO: 9355 - protein, 29 aa, Artificial Sequence
  Description of Artificial Sequence: Synthetic peptide
DEEEIATTNPVATEMYGSVSTMNLQRGNR

SEQ ID NO: 9356 - protein, 28 aa, Artificial Sequence
  Description of Artificial Sequence: Synthetic peptide
DEEEIRTTNPVATEQYGSASTNLNRGND

SEQ ID NO: 9357 - protein, 28 aa, Artificial Sequence
  Description of Artificial Sequence: Synthetic peptide
DEEEIRTTNPVATEIYGSVSTNLQRENP

SEQ ID NO: 9358 - protein, 29 aa, Artificial Sequence
  Description of Artificial Sequence: Synthetic peptide
DETEIRTTNPVATEQYGSVENTNLQRGNR

SEQ ID NO: 9359 - protein, 28 aa, Artificial Sequence
  Description of Artificial Sequence: Synthetic peptide
DEEEIRTTNPVAFEQYGSVSTNDQRGNP

SEQ ID NO: 9360 - protein, 30 aa, Artificial Sequence
  Description of Artificial Sequence: Synthetic polypeptide
DEEEIRTTNPVATEQYGSVSCTNLCREGNR

SEQ ID NO: 9361 - protein, 28 aa, Artificial Sequence
  Description of Artificial Sequence: Synthetic peptide
DEEEISSTNPVATEQYGDVSTNLQRGNR

SEQ ID NO: 9362 - protein, 30 aa, Artificial Sequence
  Description of Artificial Sequence: Synthetic polypeptide
DEEEIRTTNPDATEQYGSVSTNLQREGNER

SEQ ID NO: 9363 - protein, 29 aa, Artificial Sequence
  Description of Artificial Sequence: Synthetic peptide
DEEEIRTTNPVATEQYGWVSATNMQRGNR

SEQ ID NO: 9364 - protein, 28 aa, Artificial Sequence
  Description of Artificial Sequence: Synthetic peptide
DEVEITTTNPVATEQYGSVSENLQRGNR

SEQ ID NO: 9365 - protein, 28 aa, Artificial Sequence
  Description of Artificial Sequence: Synthetic peptide
DEEEIRTTNPVATEQWGSVSTNEQRGNF

SEQ ID NO: 9366 - protein, 28 aa, Artificial Sequence
  Description of Artificial Sequence: Synthetic peptide
DEEEIRTTNPVSTEQYGSVGTNLQDGNR

SEQ ID NO: 9367 - protein, 28 aa, Artificial Sequence
  Description of Artificial Sequence: Synthetic peptide
DEEQIRTTNPVATEQYGSVDTNLQRGTR

SEQ ID NO: 9368 - protein, 30 aa, Artificial Sequence
  Description of Artificial Sequence: Synthetic polypeptide
DEEEIRTTNPVATEQYGSYVSTNLQRGNDP

SEQ ID NO: 9369 - protein, 29 aa, Artificial Sequence
  Description of Artificial Sequence: Synthetic peptide
DEEEIRTTNPVATEQYGSVETNLQRGDNN

SEQ ID NO: 9370 - protein, 28 aa, Artificial Sequence
  Description of Artificial Sequence: Synthetic peptide
DEEEIRTTNPCATEQYGSVSTGLQRGND

SEQ ID NO: 9371 - protein, 28 aa, Artificial Sequence
  Description of Artificial Sequence: Synthetic peptide
DEEEIFTTNPVATEAYGSVSTNLQRQNR

SEQ ID NO: 9372 - protein, 29 aa, Artificial Sequence
  Description of Artificial Sequence: Synthetic peptide
DEEEIRTTNPVATEQYGSVSTPLVQRGER

SEQ ID NO: 9373 - protein, 28 aa, Artificial Sequence
  Description of Artificial Sequence: Synthetic peptide
DEEEIRTTNPVATEQYGSVSTDLQGGNW

SEQ ID NO: 9374 - protein, 28 aa, Artificial Sequence
  Description of Artificial Sequence: Synthetic peptide
DEEEIRTTNPVCTEQYGSVSTNWERGNR

SEQ ID NO: 9375 - protein, 29 aa, Artificial Sequence
  Description of Artificial Sequence: Synthetic peptide
DEEEIRTTNPVATEQYGSVSDTNLQRGEL

SEQ ID NO: 9376 - protein, 29 aa, Artificial Sequence
  Description of Artificial Sequence: Synthetic peptide
DEGEIRTTNPVATEQYGSVSTVNLQRGNT

SEQ ID NO: 9377 - protein, 29 aa, Artificial Sequence
  Description of Artificial Sequence: Synthetic peptide
DEEEIRTTNPEATEQYGSVSCTNLQMGNR

SEQ ID NO: 9378 - protein, 29 aa, Artificial Sequence
  Description of Artificial Sequence: Synthetic peptide
DEEHIRTTNPVATEQYGSVSNNLQRSGNR

SEQ ID NO: 9379 - protein, 31 aa, Artificial Sequence
  Description of Artificial Sequence: Synthetic polypeptide
DEEEIRTTNPVATEQYGSVSVTNLQERGNDR

SEQ ID NO: 9380 - protein, 28 aa, Artificial Sequence
  Description of Artificial Sequence: Synthetic peptide
AEEEIRTTNPVATEQYGDASTNLQRGNR

SEQ ID NO: 9381 - protein, 29 aa, Artificial Sequence
  Description of Artificial Sequence: Synthetic peptide
DEEEIRTTNPVATEQYGSVSTVNLQFGNN

SEQ ID NO: 9382 - protein, 28 aa, Artificial Sequence
  Description of Artificial Sequence: Synthetic peptide
DEEEIRTTNPVATEQYGSVSTELQRGEW

SEQ ID NO: 9383 - protein, 29 aa, Artificial Sequence
  Description of Artificial Sequence: Synthetic peptide
DEEEIRTTNPVATEQYGSVSTNLERGEER

SEQ ID NO: 9384 - protein, 29 aa, Artificial Sequence
  Description of Artificial Sequence: Synthetic peptide
DEEEIRTTNPVSCEQYGSVSTNLQRLGNR

SEQ ID NO: 9385 - protein, 28 aa, Artificial Sequence
  Description of Artificial Sequence: Synthetic peptide
DEEEIRTTNPVATEQYGSYSTNLQLGNW

SEQ ID NO: 9386 - protein, 31 aa, Artificial Sequence
  Description of Artificial Sequence: Synthetic polypeptide
DEEEIRTTNPVATEQYGSVSTGNLVQVRGNR

SEQ ID NO: 9387 - protein, 29 aa, Artificial Sequence
  Description of Artificial Sequence: Synthetic peptide
DEEEIGTTNPVATEQYGSVSTNALQRPNR

SEQ ID NO: 9388 - protein, 28 aa, Artificial Sequence
  Description of Artificial Sequence: Synthetic peptide
DDEEIRTTNPVATEQYGSVATNVQRGNR

SEQ ID NO: 9389 - protein, 28 aa, Artificial Sequence
  Description of Artificial Sequence: Synthetic peptide
DEEEIRTTNPVATEQYGSVETDLQRGNF

SEQ ID NO: 9390 - protein, 28 aa, Artificial Sequence
  Description of Artificial Sequence: Synthetic peptide
DPEEIRTTNPVASEQYGSVSTNLQRENR

SEQ ID NO: 9391 - protein, 29 aa, Artificial Sequence
  Description of Artificial Sequence: Synthetic peptide
DEEEIRTTNPVATEQYGSVSTNLFLGNPR

SEQ ID NO: 9392 - protein, 30 aa, Artificial Sequence
  Description of Artificial Sequence: Synthetic polypeptide
DEEEIRTTNPVATEQYGSVSTNLQREGTDR

SEQ ID NO: 9393 - protein, 29 aa, Artificial Sequence
  Description of Artificial Sequence: Synthetic peptide
DEEEIRTTNPVATEQYGSVSTNEVQRGNW

SEQ ID NO: 9394 - protein, 29 aa, Artificial Sequence
  Description of Artificial Sequence: Synthetic peptide
DEEEIRTTNPVATEQYGSVSTNLQTEGNM

SEQ ID NO: 9395 - protein, 28 aa, Artificial Sequence
  Description of Artificial Sequence: Synthetic peptide
DEDETRTTNPVATEQYGSISTNLQRGNR

SEQ ID NO: 9396 - protein, 28 aa, Artificial Sequence
  Description of Artificial Sequence: Synthetic peptide
DEEEIYTTNPAATEQYGSVSENLQRGNR

SEQ ID NO: 9397 - protein, 28 aa, Artificial Sequence
  Description of Artificial Sequence: Synthetic peptide
AEEEIRTTNPFATEQYGSVSENLQRGNR

SEQ ID NO: 9398 - protein, 28 aa, Artificial Sequence
  Description of Artificial Sequence: Synthetic peptide
DEEEIRTVNPVATEQYGWVSTNLERGNR

SEQ ID NO: 9399 - protein, 28 aa, Artificial Sequence
  Description of Artificial Sequence: Synthetic peptide
DEEEIRTTNPVATEQYGSVFTNLDRGND

SEQ ID NO: 9400 - protein, 29 aa, Artificial Sequence
  Description of Artificial Sequence: Synthetic peptide
DEEEIRTTNPVATEQYGISVSTNLDRGER

SEQ ID NO: 9401 - protein, 30 aa, Artificial Sequence
  Description of Artificial Sequence: Synthetic polypeptide
DEEEIRTTNPVATEQYGSVSETNLQRGENP

SEQ ID NO: 9402 - protein, 29 aa, Artificial Sequence
  Description of Artificial Sequence: Synthetic peptide
DEEEIRTTNPVATEQYGSVSTDLQRGNPY

SEQ ID NO: 9403 - protein, 28 aa, Artificial Sequence
  Description of Artificial Sequence: Synthetic peptide
DEQEIRTTNPVATEQWGSVSTNLMRGNR

SEQ ID NO: 9404 - protein, 28 aa, Artificial Sequence
  Description of Artificial Sequence: Synthetic peptide
DEEEIRTTNPVATEQYGDVSTNEQQGNR

SEQ ID NO: 9405 - protein, 30 aa, Artificial Sequence
  Description of Artificial Sequence: Synthetic polypeptide
DEEEIRTTNPVATEQYGSVSCTMELQRGNR

SEQ ID NO: 9406 - protein, 30 aa, Artificial Sequence
  Description of Artificial Sequence: Synthetic polypeptide
DEEEIRTTNPVATEQYGSVSTNLQENEGNR

SEQ ID NO: 9407 - protein, 28 aa, Artificial Sequence
  Description of Artificial Sequence: Synthetic peptide
DEEEIRTTNPVATEQYGSVSTNEQRGES

SEQ ID NO: 9408 - protein, 29 aa, Artificial Sequence
  Description of Artificial Sequence: Synthetic peptide
DEVEIRTTNPVATEQYGSVSTMNEQRGNR

SEQ ID NO: 9409 - protein, 28 aa, Artificial Sequence
  Description of Artificial Sequence: Synthetic peptide
DEEEIRCTNPVATEQYGCVATNLQRGNR

SEQ ID NO: 9410 - protein, 30 aa, Artificial Sequence
  Description of Artificial Sequence: Synthetic polypeptide
DEEEIRTTNPVATEQYGSVSTPLQLRGNAR

SEQ ID NO: 9411 - protein, 29 aa, Artificial Sequence
  Description of Artificial Sequence: Synthetic peptide
DEEEIRTVNPVATEQYGSVCSTGLQRGNR

SEQ ID NO: 9412 - protein, 28 aa, Artificial Sequence
  Description of Artificial Sequence: Synthetic peptide
DEEEILTTNPTATEQYGSVSTNLQRGNV

SEQ ID NO: 9413 - protein, 28 aa, Artificial Sequence
  Description of Artificial Sequence: Synthetic peptide
DEEEIRTTNPNATEQYGSVSTNLQRGHG

SEQ ID NO: 9414 - protein, 28 aa, Artificial Sequence
  Description of Artificial Sequence: Synthetic peptide
DEEEIRTTNPVATECYGSVSTDLQLGNR

SEQ ID NO: 9415 - protein, 28 aa, Artificial Sequence
  Description of Artificial Sequence: Synthetic peptide
DEEEIRTTNPVATEQYGSYSTNLQVGNI

SEQ ID NO: 9416 - protein, 29 aa, Artificial Sequence
  Description of Artificial Sequence: Synthetic peptide
AEEEIRTTNPVATEQYGSVSATVLQRGNR

SEQ ID NO: 9417 - protein, 28 aa, Artificial Sequence
  Description of Artificial Sequence: Synthetic peptide
DEEEIRTTNPVATEQYGSVSTNLQYFER

SEQ ID NO: 9418 - protein, 29 aa, Artificial Sequence
  Description of Artificial Sequence: Synthetic peptide
DEEEIRTTNPVATEQFGSVSTNLQRGNTF

SEQ ID NO: 9419 - protein, 29 aa, Artificial Sequence
  Description of Artificial Sequence: Synthetic peptide
AEEEIRTTNPVATEGYGSVSTNLVQRGNR

SEQ ID NO: 9420 - protein, 28 aa, Artificial Sequence
  Description of Artificial Sequence: Synthetic peptide
DEEEIRQTNPVATECYGSVSTNQQRGNR

SEQ ID NO: 9421 - protein, 30 aa, Artificial Sequence
  Description of Artificial Sequence: Synthetic polypeptide
DEEEIRTTNPVATEQYGSVSCTQNLQRGND

SEQ ID NO: 9422 - protein, 28 aa, Artificial Sequence
  Description of Artificial Sequence: Synthetic peptide
KEEEIRTTNPVATEQYGSVSTNLQIGNN

SEQ ID NO: 9423 - protein, 28 aa, Artificial Sequence
  Description of Artificial Sequence: Synthetic peptide
DEEEIRTTNPCATEPYGSVSNNLQRGNR

SEQ ID NO: 9424 - protein, 29 aa, Artificial Sequence
  Description of Artificial Sequence: Synthetic peptide
DEEEIRTTNPVATEQYGESVSTDDQRGNR

SEQ ID NO: 9425 - protein, 28 aa, Artificial Sequence
  Description of Artificial Sequence: Synthetic peptide
DEQEIRTTNPVSTEQYGSVSNNLQRGNR

SEQ ID NO: 9426 - protein, 30 aa, Artificial Sequence
  Description of Artificial Sequence: Synthetic polypeptide
DEEEIRTTNPVATEQYGSLVLVTNLQRGNR

SEQ ID NO: 9427 - protein, 28 aa, Artificial Sequence
  Description of Artificial Sequence: Synthetic peptide
DEEEIRTTNPVATEQYGSVSDNLQSGDR

SEQ ID NO: 9428 - protein, 29 aa, Artificial Sequence
  Description of Artificial Sequence: Synthetic peptide
DEEEIRTTNPVATEQYGKSVSTNDQRGVR

SEQ ID NO: 9429 - protein, 29 aa, Artificial Sequence
  Description of Artificial Sequence: Synthetic peptide
DPEEIRTTNPVATEQYGSVSTPNLQRGND

SEQ ID NO: 9430 - protein, 28 aa, Artificial Sequence
  Description of Artificial Sequence: Synthetic peptide
DEEMIRTTNPVATEQYGSVSENLMRGNR

SEQ ID NO: 9431 - protein, 30 aa, Artificial Sequence
  Description of Artificial Sequence: Synthetic polypeptide
DEEEIRTTNPVATEQYGSVSTYNLQFGNER

SEQ ID NO: 9432 - protein, 28 aa, Artificial Sequence
  Description of Artificial Sequence: Synthetic peptide
DEEEIRTTNPSATEQYGDVSTELQRGNR

SEQ ID NO: 9433 - protein, 28 aa, Artificial Sequence
  Description of Artificial Sequence: Synthetic peptide
DEEEIRTTNPVATEQYGSVSTNLQEGEN

SEQ ID NO: 9434 - protein, 28 aa, Artificial Sequence
  Description of Artificial Sequence: Synthetic peptide
DEEEIRTTNPVATEQYGSVSTDLQNGNQ

SEQ ID NO: 9435 - protein, 30 aa, Artificial Sequence
  Description of Artificial Sequence: Synthetic polypeptide
DEEEIRTTNPVATEQYGSVSTGLQIREGNR

SEQ ID NO: 9436 - protein, 31 aa, Artificial Sequence
  Description of Artificial Sequence: Synthetic polypeptide
DEEEIRTTNPVATEQYGSVESDTNLQRGENR

SEQ ID NO: 9437 - protein, 28 aa, Artificial Sequence
  Description of Artificial Sequence: Synthetic peptide
DEEEIRTTNPEATEQYGSVSANLQRGPR

SEQ ID NO: 9438 - protein, 28 aa, Artificial Sequence
  Description of Artificial Sequence: Synthetic peptide
DEEEIRTTNPVATEQYGSVSTDLQNGER

SEQ ID NO: 9439 - protein, 29 aa, Artificial Sequence
  Description of Artificial Sequence: Synthetic peptide
DEEEIRTTNPVATMQYGSVSVNLQRGNIR

SEQ ID NO: 9440 - protein, 28 aa, Artificial Sequence
  Description of Artificial Sequence: Synthetic peptide
DEEEIRTTNPVATEQYGAASTNDQRGNR

SEQ ID NO: 9441 - protein, 28 aa, Artificial Sequence
  Description of Artificial Sequence: Synthetic peptide
DEEEIRTTNPVATEQYGSVSTNPQRGEM

SEQ ID NO: 9442 - protein, 28 aa, Artificial Sequence
  Description of Artificial Sequence: Synthetic peptide
DEEEIRTTNPVATEQYGSVSTNLDRGED

SEQ ID NO: 9443 - protein, 29 aa, Artificial Sequence
  Description of Artificial Sequence: Synthetic peptide
DEEEIRCTNPVCTEQYGSVSTMNLQRGNR

SEQ ID NO: 9444 - protein, 28 aa, Artificial Sequence
  Description of Artificial Sequence: Synthetic peptide
DEEEIRTTNPVATEQYGSVSTELERGNE

SEQ ID NO: 9445 - protein, 29 aa, Artificial Sequence
  Description of Artificial Sequence: Synthetic peptide
DEEEIRTTNPVATEQYGSVSTDLQRGEER

SEQ ID NO: 9446 - protein, 30 aa, Artificial Sequence
  Description of Artificial Sequence: Synthetic polypeptide
DEEEIRTTNPVATEQYGSWSTNPLQRGNDR

SEQ ID NO: 9447 - protein, 30 aa, Artificial Sequence
  Description of Artificial Sequence: Synthetic polypeptide
DEAEIRTTNPVATEQYGSVYSITNLQRGNR

SEQ ID NO: 9448 - protein, 28 aa, Artificial Sequence
  Description of Artificial Sequence: Synthetic peptide
DEEEIRTTNPVATEQYGSVDTNLIRGNP

SEQ ID NO: 9449 - protein, 28 aa, Artificial Sequence
  Description of Artificial Sequence: Synthetic peptide
DEEEIRTTNPVATEQYGSVSTDLQMGNE

SEQ ID NO: 9450 - protein, 30 aa, Artificial Sequence
  Description of Artificial Sequence: Synthetic polypeptide
DEEEIRTTNPVATEQYGSVASTNLQSRGND

SEQ ID NO: 9451 - protein, 30 aa, Artificial Sequence
  Description of Artificial Sequence: Synthetic polypeptide
DEEEIRTTNPVATEQYGSVSFWNPLQRGNR

SEQ ID NO: 9452 - protein, 28 aa, Artificial Sequence
  Description of Artificial Sequence: Synthetic peptide
DEEEIRTTNPVATEQYGIVSTNLQDGNM

SEQ ID NO: 9453 - protein, 28 aa, Artificial Sequence
  Description of Artificial Sequence: Synthetic peptide
DEEEIRTTNPVASEQYGTVSTNLDRGNR

SEQ ID NO: 9454 - protein, 28 aa, Artificial Sequence
  Description of Artificial Sequence: Synthetic peptide
DEEEIRTTNPVATEQYGSVSTPDQRGNP

SEQ ID NO: 9455 - protein, 28 aa, Artificial Sequence
  Description of Artificial Sequence: Synthetic peptide
SDEEIRTTNPVATEMYGSVSTNLQRGNR

SEQ ID NO: 9456 - protein, 28 aa, Artificial Sequence
  Description of Artificial Sequence: Synthetic peptide
DEEEIVTTNPVATEQYGSYSTNLQQGNR

SEQ ID NO: 9457 - protein, 29 aa, Artificial Sequence
  Description of Artificial Sequence: Synthetic peptide
DEEAIRTTNPVATEQYGSVSTNLQYGENR

SEQ ID NO: 9458 - protein, 30 aa, Artificial Sequence
  Description of Artificial Sequence: Synthetic polypeptide
DEEEIRTTNPVATEQYGSVSTTNLQDGNDR

SEQ ID NO: 9459 - protein, 28 aa, Artificial Sequence
  Description of Artificial Sequence: Synthetic peptide
DEEEIRCTNPVATEQYGSVSTNLQNGNC

SEQ ID NO: 9460 - protein, 29 aa, Artificial Sequence
  Description of Artificial Sequence: Synthetic peptide
DEEEIRTTNPVATEQYGSVSKNLQWRGNI

SEQ ID NO: 9461 - protein, 29 aa, Artificial Sequence
  Description of Artificial Sequence: Synthetic peptide
DEFEIRTTNPVATEQYGSVSTVLQSRGNR

SEQ ID NO: 9462 - protein, 30 aa, Artificial Sequence
  Description of Artificial Sequence: Synthetic polypeptide
DEEEIRTTNPVATEQYGSVSTSNLQRFGMR

SEQ ID NO: 9463 - protein, 28 aa, Artificial Sequence
  Description of Artificial Sequence: Synthetic peptide
DEEEIRTTNPVATEQYGSVSTDLQIGNQ

SEQ ID NO: 9464 - protein, 29 aa, Artificial Sequence
  Description of Artificial Sequence: Synthetic peptide
MEEEIRTTNPVATEQYGSVSTNLQNEGNR

SEQ ID NO: 9465 - protein, 30 aa, Artificial Sequence
  Description of Artificial Sequence: Synthetic polypeptide
DEEEIRTTNPVATEQFGSVISTVNLQRGNR

SEQ ID NO: 9466 - protein, 30 aa, Artificial Sequence
  Description of Artificial Sequence: Synthetic polypeptide
DEEEIRTTNPVATEQYGSVSTNLVDLRGNR

SEQ ID NO: 9467 - protein, 28 aa, Artificial Sequence
  Description of Artificial Sequence: Synthetic peptide
DEEEIRQTNPVATEQYGSVSTNLQDGER

SEQ ID NO: 9468 - protein, 28 aa, Artificial Sequence
  Description of Artificial Sequence: Synthetic peptide
DPEEIRTTNPVAYEQYGSVSTNLQRGNP

SEQ ID NO: 9469 - protein, 28 aa, Artificial Sequence
  Description of Artificial Sequence: Synthetic peptide
DLEEIRTTNPVAYEQYGSVSTGLQRGNR

SEQ ID NO: 9470 - protein, 31 aa, Artificial Sequence
  Description of Artificial Sequence: Synthetic polypeptide
DEEEIRTTNPVATEQYGSVSTNGLQREGENR

SEQ ID NO: 9471 - protein, 31 aa, Artificial Sequence
  Description of Artificial Sequence: Synthetic polypeptide
DEEEIRTTNPVATEQYGSVSTANLPQRGDNR

SEQ ID NO: 9472 - protein, 28 aa, Artificial Sequence
  Description of Artificial Sequence: Synthetic peptide
DECEIRTTNPVATELYGTVSTNLQRGNR

SEQ ID NO: 9473 - protein, 28 aa, Artificial Sequence
  Description of Artificial Sequence: Synthetic peptide
DEEEIRTTNPVATENYGNVATNLQRGNR

SEQ ID NO: 9474 - protein, 28 aa, Artificial Sequence
  Description of Artificial Sequence: Synthetic peptide
DEEEIRTTNPVATEQYGSVSTDLQVGNF

SEQ ID NO: 9475 - protein, 28 aa, Artificial Sequence
  Description of Artificial Sequence: Synthetic peptide
DEEEIRTTNPVATEQYGSVSTELQHGDR

SEQ ID NO: 9476 - protein, 28 aa, Artificial Sequence
  Description of Artificial Sequence: Synthetic peptide
DEEEIRATNPVATEQYGSVSTDLQAGNR

SEQ ID NO: 9477 - protein, 31 aa, Artificial Sequence
  Description of Artificial Sequence: Synthetic polypeptide
DEEEIRTTNPVATEQYGSVSCTNLQCRGNDR

SEQ ID NO: 9478 - protein, 29 aa, Artificial Sequence
  Description of Artificial Sequence: Synthetic peptide
DEEEIRTTNPVATEQYGSVVTNLQMIGNR

SEQ ID NO: 9479 - protein, 28 aa, Artificial Sequence
  Description of Artificial Sequence: Synthetic peptide
KEEEIRTTNPVATEQYGSVSTNLQRGDA

SEQ ID NO: 9480 - protein, 28 aa, Artificial Sequence
  Description of Artificial Sequence: Synthetic peptide
DEFEIRTTNPVATEQYGIVSDNLQRGNR

SEQ ID NO: 9481 - protein, 28 aa, Artificial Sequence
  Description of Artificial Sequence: Synthetic peptide
DEEEIRTVNPVATEQYGFVSENLQRGNR

SEQ ID NO: 9482 - protein, 28 aa, Artificial Sequence
  Description of Artificial Sequence: Synthetic peptide
DEEEIRTTNPVATEQYGSVSTDLQAGNE

SEQ ID NO: 9483 - protein, 30 aa, Artificial Sequence
  Description of Artificial Sequence: Synthetic polypeptide
DEEEIRTTNPVATEQYGSVSTELDQRSGNR

SEQ ID NO: 9484 - protein, 28 aa, Artificial Sequence
  Description of Artificial Sequence: Synthetic peptide
DEEEIRTTNPVATEQYGSVFTNLDRGNP

SEQ ID NO: 9485 - protein, 28 aa, Artificial Sequence
  Description of Artificial Sequence: Synthetic peptide
DEEEIRTTNPVATEQYGDASTALQRGNR

SEQ ID NO: 9486 - protein, 30 aa, Artificial Sequence
  Description of Artificial Sequence: Synthetic polypeptide
DEEEIRTTNPVATEQYGSVSETNLQTGNDR

SEQ ID NO: 9487 - protein, 28 aa, Artificial Sequence
  Description of Artificial Sequence: Synthetic peptide
DEPEIRQTNPVATEQYGSVSTNLQRGNY

SEQ ID NO: 9488 - protein, 28 aa, Artificial Sequence
  Description of Artificial Sequence: Synthetic peptide
NEEEIRTTNPVATEQYGSVSTNLQMGNF

SEQ ID NO: 9489 - protein, 29 aa, Artificial Sequence
  Description of Artificial Sequence: Synthetic peptide
DEEEIRTTNPVATECYGSVSTNLQDRGNM

SEQ ID NO: 9490 - protein, 29 aa, Artificial Sequence
  Description of Artificial Sequence: Synthetic peptide
DEEEIRTTNPVATEQYGSVSVTNLQAGNA

SEQ ID NO: 9491 - protein, 28 aa, Artificial Sequence
  Description of Artificial Sequence: Synthetic peptide
DEEEIRTTNPVATEQYWSVSTNLDRGNP

SEQ ID NO: 9492 - protein, 28 aa, Artificial Sequence
  Description of Artificial Sequence: Synthetic peptide
DEEEIRTVNPVATEQYGSVSTNLMHGNR

SEQ ID NO: 9493 - protein, 28 aa, Artificial Sequence
  Description of Artificial Sequence: Synthetic peptide
DEEEIRTTNPEATEQYGSVSTNLQRGEL

SEQ ID NO: 9494 - protein, 28 aa, Artificial Sequence
  Description of Artificial Sequence: Synthetic peptide
DEEEIRTTNPVATEQYGEVMTNLQRGNS

SEQ ID NO: 9495 - protein, 29 aa, Artificial Sequence
  Description of Artificial Sequence: Synthetic peptide
EEEEIRTTNPVATEQYGSVISTNLQNGNR

SEQ ID NO: 9496 - protein, 28 aa, Artificial Sequence
  Description of Artificial Sequence: Synthetic peptide
DEEEIRTTNPVATEQYWSVSTNDQRGHR

SEQ ID NO: 9497 - protein, 28 aa, Artificial Sequence
  Description of Artificial Sequence: Synthetic peptide
DEEEIRTTNPVATEQYGSVSTNLENGNY

SEQ ID NO: 9498 - protein, 30 aa, Artificial Sequence
  Description of Artificial Sequence: Synthetic polypeptide
DEEEIRTTNPVATEQYGSVSTMNLQRGNDH

SEQ ID NO: 9499 - protein, 29 aa, Artificial Sequence
  Description of Artificial Sequence: Synthetic peptide
DDEEIHTTNPVATEQYGSVASTNLQRGNR

SEQ ID NO: 9500 - protein, 28 aa, Artificial Sequence
  Description of Artificial Sequence: Synthetic peptide
DEEEIRTTNPVATEQYGSVSTDLQAGNA

SEQ ID NO: 9501 - protein, 30 aa, Artificial Sequence
  Description of Artificial Sequence: Synthetic polypeptide
DEEEIRTTNPVATEQYGQVVSTNLQRGTNR

SEQ ID NO: 9502 - protein, 29 aa, Artificial Sequence
  Description of Artificial Sequence: Synthetic peptide
DEEEIRTTNPVASEQYGSVSTENDQRGNR

SEQ ID NO: 9503 - protein, 28 aa, Artificial Sequence
  Description of Artificial Sequence: Synthetic peptide
HEQEIRTTNPVATEQYGDVSTNLQRGNR

SEQ ID NO: 9504 - protein, 29 aa, Artificial Sequence
  Description of Artificial Sequence: Synthetic peptide
DEEEIRTTNPVATEQYGSVSTNLQHGNDL

SEQ ID NO: 9505 - protein, 28 aa, Artificial Sequence
  Description of Artificial Sequence: Synthetic peptide
DEEEIASTNPVATEVYGSVSTNLQRGNR

SEQ ID NO: 9506 - protein, 29 aa, Artificial Sequence
  Description of Artificial Sequence: Synthetic peptide
DEEEIRTTNPVATEQYGSVSTNQELRGNR

SEQ ID NO: 9507 - protein, 28 aa, Artificial Sequence
  Description of Artificial Sequence: Synthetic peptide
DEEEIRTTNPVATEQWGDVSTNEQRGNR

SEQ ID NO: 9508 - protein, 28 aa, Artificial Sequence
  Description of Artificial Sequence: Synthetic peptide
HEEEIRTTNPVATEQYGSVSTNEQQGNR

SEQ ID NO: 9509 - protein, 30 aa, Artificial Sequence
  Description of Artificial Sequence: Synthetic polypeptide
DEEEIRTTNPVATEQYGSVSTNDQRGENDR

SEQ ID NO: 9510 - protein, 28 aa, Artificial Sequence
  Description of Artificial Sequence: Synthetic peptide
DEEEISSTNPVATEQWGSVSTNLQRGNR

SEQ ID NO: 9511 - protein, 29 aa, Artificial Sequence
  Description of Artificial Sequence: Synthetic peptide
DEEEIVTTNPVATEQYGSVSAENLQRGNR

SEQ ID NO: 9512 - protein, 28 aa, Artificial Sequence
  Description of Artificial Sequence: Synthetic peptide
DEEEIRTTNPVAWEQYGSVSTNLQQGLR

SEQ ID NO: 9513 - protein, 28 aa, Artificial Sequence
  Description of Artificial Sequence: Synthetic peptide
DEQEIRTTNPVATEQYGSVSTDLQRENR

SEQ ID NO: 9514 - protein, 30 aa, Artificial Sequence
  Description of Artificial Sequence: Synthetic polypeptide
DEEEIRTTNPVATEQYGSASTCNLQRGNDR

SEQ ID NO: 9515 - protein, 29 aa, Artificial Sequence
  Description of Artificial Sequence: Synthetic peptide
DEEEIRTTNPVATEQYGDVSDNLNQRGNR

SEQ ID NO: 9516 - protein, 28 aa, Artificial Sequence
  Description of Artificial Sequence: Synthetic peptide
DESEISTTNPVATEQYGSVGTNLQRGNR

SEQ ID NO: 9517 - protein, 29 aa, Artificial Sequence
  Description of Artificial Sequence: Synthetic peptide
MEEEIRTTNPVATEQYGSMSTNLQREGNR

SEQ ID NO: 9518 - protein, 28 aa, Artificial Sequence
  Description of Artificial Sequence: Synthetic peptide
DEEEIRSVNPVSTEQYGSVSTNLQRGNR

SEQ ID NO: 9519 - protein, 28 aa, Artificial Sequence
  Description of Artificial Sequence: Synthetic peptide
DEEEIRTTNPVATEQYGIVSTCLQRGNY

SEQ ID NO: 9520 - protein, 28 aa, Artificial Sequence
  Description of Artificial Sequence: Synthetic peptide
DEEEIRTTNPVATEQYGSVSTELQQGNN

SEQ ID NO: 9521 - protein, 29 aa, Artificial Sequence
  Description of Artificial Sequence: Synthetic peptide
DEEEIQTTNPVATEQYGSVSTNLQRGELR

SEQ ID NO: 9522 - protein, 28 aa, Artificial Sequence
  Description of Artificial Sequence: Synthetic peptide
DEEEIRTTNPVATECYGSVSTNLERGNM

SEQ ID NO: 9523 - protein, 28 aa, Artificial Sequence
  Description of Artificial Sequence: Synthetic peptide
QEEEIRTTNPVATEQYGEQSTNLQRGNR

SEQ ID NO: 9524 - protein, 28 aa, Artificial Sequence
  Description of Artificial Sequence: Synthetic peptide
DEEEIRTTNPFATEQYGSVSTDLERGNR

SEQ ID NO: 9525 - protein, 28 aa, Artificial Sequence
  Description of Artificial Sequence: Synthetic peptide
DEEEIYTTNPVATEQYGSVSTNLARGNA

SEQ ID NO: 9526 - protein, 28 aa, Artificial Sequence
  Description of Artificial Sequence: Synthetic peptide
DEEEIRATNPVATEQYGSVSTNLQRGEC

SEQ ID NO: 9527 - protein, 28 aa, Artificial Sequence
  Description of Artificial Sequence: Synthetic peptide
DEEEIRTTNPVATEQYGSVSTDLQSGNF

SEQ ID NO: 9528 - protein, 30 aa, Artificial Sequence
  Description of Artificial Sequence: Synthetic polypeptide
DEEEIRTTNPVATEQYGSVSTNLQENGDNR

SEQ ID NO: 9529 - protein, 29 aa, Artificial Sequence
  Description of Artificial Sequence: Synthetic peptide
DEEEIRTTNPVATEQYGSVSTNLQVDGNV

SEQ ID NO: 9530 - protein, 28 aa, Artificial Sequence
  Description of Artificial Sequence: Synthetic peptide
SEEEIRTTNPVATEIFGSVSTNLQRGNR

SEQ ID NO: 9531 - protein, 28 aa, Artificial Sequence
  Description of Artificial Sequence: Synthetic peptide
DEEEIRTTNPVATEQYGSVHTGLQTGNR

SEQ ID NO: 9532 - protein, 30 aa, Artificial Sequence
  Description of Artificial Sequence: Synthetic polypeptide
DEEEIRTTNPVATEQYGSVSETNLQAEGNR

SEQ ID NO: 9533 - protein, 28 aa, Artificial Sequence
  Description of Artificial Sequence: Synthetic peptide
DEEEIRTTNPVATEQYGSVSTCLQVGND

SEQ ID NO: 9534 - protein, 29 aa, Artificial Sequence
  Description of Artificial Sequence: Synthetic peptide
DEEEIRTTNPVATEQYGSVSITNLQFGNH

SEQ ID NO: 9535 - protein, 29 aa, Artificial Sequence
  Description of Artificial Sequence: Synthetic peptide
DEEEIRTTNPTATEQYGSVSTGNLQRGNE

SEQ ID NO: 9536 - protein, 28 aa, Artificial Sequence
  Description of Artificial Sequence: Synthetic peptide
DEEEIATTNPVATEQYGSVSTNEQRGNG

SEQ ID NO: 9537 - protein, 28 aa, Artificial Sequence
  Description of Artificial Sequence: Synthetic peptide
DEEEIRTTNPVATEQYGSVSTNLQNGDT

SEQ ID NO: 9538 - protein, 28 aa, Artificial Sequence
  Description of Artificial Sequence: Synthetic peptide
DEEEIRTTNPVATEQYGSVSTNLQREEE

SEQ ID NO: 9539 - protein, 28 aa, Artificial Sequence
  Description of Artificial Sequence: Synthetic peptide
DEQEIRTTNPVATEQYGSVETNLQRGER

SEQ ID NO: 9540 - protein, 28 aa, Artificial Sequence
  Description of Artificial Sequence: Synthetic peptide
DEEEIRCTNPIATEQYGSVSTNLQRGTR

SEQ ID NO: 9541 - protein, 28 aa, Artificial Sequence
  Description of Artificial Sequence: Synthetic peptide
DEEEIRTTNPVATEQYGSVSTNPQLGNN

SEQ ID NO: 9542 - protein, 30 aa, Artificial Sequence
  Description of Artificial Sequence: Synthetic polypeptide
DEEEIRTTNPVATEQYGSAVSTNLQDGNQR

SEQ ID NO: 9543 - protein, 30 aa, Artificial Sequence
  Description of Artificial Sequence: Synthetic polypeptide
DEEEIRCTNPVATEQYGSVISTGNLQRGNR

SEQ ID NO: 9544 - protein, 28 aa, Artificial Sequence
  Description of Artificial Sequence: Synthetic peptide
DEEEISTTNPVATEQYGSVSTNLQMGNF

SEQ ID NO: 9545 - protein, 29 aa, Artificial Sequence
  Description of Artificial Sequence: Synthetic peptide
DEEEIRTTNPVATEQYGSVSTPNLDRGER

SEQ ID NO: 9546 - protein, 28 aa, Artificial Sequence
  Description of Artificial Sequence: Synthetic peptide
DEQEIRTTNPVATEQYGSVSTNDQDGNR

SEQ ID NO: 9547 - protein, 30 aa, Artificial Sequence
  Description of Artificial Sequence: Synthetic polypeptide
DEEEIRTTNPVATECYGSVSTNLQDREGNR

SEQ ID NO: 9548 - protein, 28 aa, Artificial Sequence
  Description of Artificial Sequence: Synthetic peptide
DEEEIRTTNPVATEQYGSVSTDLQYGER

SEQ ID NO: 9549 - protein, 29 aa, Artificial Sequence
  Description of Artificial Sequence: Synthetic peptide
DEEEIRTTNPVATEQYGSVSEDNLQRGNL

SEQ ID NO: 9550 - protein, 28 aa, Artificial Sequence
  Description of Artificial Sequence: Synthetic peptide
DEEEIVATNPVATEIYGSVSTNLQRGNR

SEQ ID NO: 9551 - protein, 29 aa, Artificial Sequence
  Description of Artificial Sequence: Synthetic peptide
DEEEIRTTNPVATEQYGSVSTGNLQRENL

SEQ ID NO: 9552 - protein, 30 aa, Artificial Sequence
  Description of Artificial Sequence: Synthetic polypeptide
DEEEIRTTNPVATEQYGSVSTMNEQRGNTR

SEQ ID NO: 9553 - protein, 30 aa, Artificial Sequence
  Description of Artificial Sequence: Synthetic polypeptide
DEEEIRTTNPVATEQYGSVSTNLQREGNDN

SEQ ID NO: 9554 - protein, 28 aa, Artificial Sequence
  Description of Artificial Sequence: Synthetic peptide
DENEIRTTNPVATEQYGSVSTELQVGNR

SEQ ID NO: 9555 - protein, 31 aa, Artificial Sequence
  Description of Artificial Sequence: Synthetic polypeptide
DEEEIRTTNPVATEQYGISVHSTGNLQRGNR

SEQ ID NO: 9556 - protein, 28 aa, Artificial Sequence
  Description of Artificial Sequence: Synthetic peptide
DEEEIRTTNPVATEQYGSVSTNLEPGNI

SEQ ID NO: 9557 - protein, 28 aa, Artificial Sequence
  Description of Artificial Sequence: Synthetic peptide
DEEEIRQTNPVATEQYGSVSTDLQRGER

SEQ ID NO: 9558 - protein, 29 aa, Artificial Sequence
  Description of Artificial Sequence: Synthetic peptide
DEEEIAQTNPVATEQYGSVSTNLQNRGNR

SEQ ID NO: 9559 - protein, 29 aa, Artificial Sequence
  Description of Artificial Sequence: Synthetic peptide
DEEEIRTTNPVATEQYGSVSTNLQIHGNS

SEQ ID NO: 9560 - protein, 28 aa, Artificial Sequence
  Description of Artificial Sequence: Synthetic peptide
DEEEIRTTNPVATEQYGSVSTDLERGNN

SEQ ID NO: 9561 - protein, 30 aa, Artificial Sequence
  Description of Artificial Sequence: Synthetic polypeptide
DEEEIRTTNPVATEQYGSVSTGNLQSGDNR

SEQ ID NO: 9562 - protein, 29 aa, Artificial Sequence
  Description of Artificial Sequence: Synthetic peptide
DEEEIRTTNPVATEQYGSVSTELQRGDDR

SEQ ID NO: 9563 - protein, 30 aa, Artificial Sequence
  Description of Artificial Sequence: Synthetic polypeptide
DEEEIRTTNPVATEQYGSVSTNLQDRGENF

SEQ ID NO: 9564 - protein, 29 aa, Artificial Sequence
  Description of Artificial Sequence: Synthetic peptide
DEEEIRTTNPVATEQYGSVSTNLQQEGNY

SEQ ID NO: 9565 - protein, 30 aa, Artificial Sequence
  Description of Artificial Sequence: Synthetic polypeptide
DEEEIRTTNPVATCQYGSSVSTNLQREGNR

SEQ ID NO: 9566 - protein, 28 aa, Artificial Sequence
  Description of Artificial Sequence: Synthetic peptide
DEEEIRTTNPVCTEQYGSVSTNLQYGNC

SEQ ID NO: 9567 - protein, 28 aa, Artificial Sequence
  Description of Artificial Sequence: Synthetic peptide
DEEEIRTTNPVATEQWGSVSTNEQQGNR

SEQ ID NO: 9568 - protein, 29 aa, Artificial Sequence
  Description of Artificial Sequence: Synthetic peptide
DEEEIRTTNPVAFEQYGSVCTMNLQRGNR

SEQ ID NO: 9569 - protein, 29 aa, Artificial Sequence
  Description of Artificial Sequence: Synthetic peptide
DEEEIRTTNPVATEQYGSVDTNLQRGPNF

SEQ ID NO: 9570 - protein, 28 aa, Artificial Sequence
  Description of Artificial Sequence: Synthetic peptide
DEGEIRTTNPVASEQYGSVQTNLQRGNR

SEQ ID NO: 9571 - protein, 28 aa, Artificial Sequence
  Description of Artificial Sequence: Synthetic peptide
DEHEIRTTNPVATEQYGSVSTELQVGNR

SEQ ID NO: 9572 - protein, 29 aa, Artificial Sequence
  Description of Artificial Sequence: Synthetic peptide
DEEEIRTTNPVATEQYGSVSTNLQIDGNV

SEQ ID NO: 9573 - protein, 28 aa, Artificial Sequence
  Description of Artificial Sequence: Synthetic peptide
DEMEICTTNPVCTEQYGSVSTNLQRGNR

SEQ ID NO: 9574 - protein, 28 aa, Artificial Sequence
  Description of Artificial Sequence: Synthetic peptide
DEEEIRTTNPVATEQYGSVSTDLQNGND

SEQ ID NO: 9575 - protein, 28 aa, Artificial Sequence
  Description of Artificial Sequence: Synthetic peptide
MEEEIRTTNPVATEQFGSVGTNLQRGNR

SEQ ID NO: 9576 - protein, 29 aa, Artificial Sequence
  Description of Artificial Sequence: Synthetic peptide
SEEEIRTTNPVATEQYGSVSTNLPQLGNR

SEQ ID NO: 9577 - protein, 30 aa, Artificial Sequence
  Description of Artificial Sequence: Synthetic polypeptide
DEEEIRTTNPVATEQYGSVSTMNLQRGNDQ

SEQ ID NO: 9578 - protein, 31 aa, Artificial Sequence
  Description of Artificial Sequence: Synthetic polypeptide
DEEEIRTTNPVATEQYGESVSTENLQRDGNR

SEQ ID NO: 9579 - protein, 28 aa, Artificial Sequence
  Description of Artificial Sequence: Synthetic peptide
DEEEIRTTNPVATNQYGSVSTNLQSGNG

SEQ ID NO: 9580 - protein, 28 aa, Artificial Sequence
  Description of Artificial Sequence: Synthetic peptide
DEEEIRTTNPVATEQYGIVSTNEERGNR

SEQ ID NO: 9581 - protein, 28 aa, Artificial Sequence
  Description of Artificial Sequence: Synthetic peptide
MEEEIRTTNPVATEQYGSVSTDLQRGND

SEQ ID NO: 9582 - protein, 28 aa, Artificial Sequence
  Description of Artificial Sequence: Synthetic peptide
DEEEIRTTNPVATEQYGSVSTNPQIGNN

SEQ ID NO: 9583 - protein, 28 aa, Artificial Sequence
  Description of Artificial Sequence: Synthetic peptide
DEEEIRTTNPVACESYGSVSTGLQRGNR

SEQ ID NO: 9584 - protein, 31 aa, Artificial Sequence
  Description of Artificial Sequence: Synthetic polypeptide
DEEEIRTTNPVATEQYGSVSTPNVLQRGNIR

SEQ ID NO: 9585 - protein, 28 aa, Artificial Sequence
  Description of Artificial Sequence: Synthetic peptide
DEEEIRTTNPAATELYGSVSTNLQRGNS

SEQ ID NO: 9586 - protein, 28 aa, Artificial Sequence
  Description of Artificial Sequence: Synthetic peptide
DEEEIRTTNPVATECYGSVSTDLQRGNE

SEQ ID NO: 9587 - protein, 29 aa, Artificial Sequence
  Description of Artificial Sequence: Synthetic peptide
DEEEIRTTNPVATEQYGSVSTNEQIGNTR

SEQ ID NO: 9588 - protein, 28 aa, Artificial Sequence
  Description of Artificial Sequence: Synthetic peptide
DEEEIRTTNPVATEPYGSVSTNLQEGND

SEQ ID NO: 9589 - protein, 28 aa, Artificial Sequence
  Description of Artificial Sequence: Synthetic peptide
DEEEIRTTNPTATEQYGSVSTDLQRGND

SEQ ID NO: 9590 - protein, 28 aa, Artificial Sequence
  Description of Artificial Sequence: Synthetic peptide
DEEEIRTTNPVATEQYGSVETELQFGNR

SEQ ID NO: 9591 - protein, 29 aa, Artificial Sequence
  Description of Artificial Sequence: Synthetic peptide
DEEEIRTTNPVATEQYGSVSTNLQREGDF

SEQ ID NO: 9592 - protein, 29 aa, Artificial Sequence
  Description of Artificial Sequence: Synthetic peptide
DEEEIRTTNPVATEQYGSVSTNLQIIGNQ

SEQ ID NO: 9593 - protein, 30 aa, Artificial Sequence
  Description of Artificial Sequence: Synthetic polypeptide
DTEEIRTTNPVATEQYGISVMSTNLQRGNR

SEQ ID NO: 9594 - protein, 29 aa, Artificial Sequence
  Description of Artificial Sequence: Synthetic peptide
DEEEIRTTNPVATEQYGSVSTNLQVGEDR

SEQ ID NO: 9595 - protein, 28 aa, Artificial Sequence
  Description of Artificial Sequence: Synthetic peptide
DEEEIRATNPVATEIYGSVSMNLQRGNR

SEQ ID NO: 9596 - protein, 28 aa, Artificial Sequence
  Description of Artificial Sequence: Synthetic peptide
DEEEIRTTNPVATEQYGSVSENLQHGNA

SEQ ID NO: 9597 - protein, 28 aa, Artificial Sequence
  Description of Artificial Sequence: Synthetic peptide
DEEEIRTTNPVATEQYGSVDTDLQRGER

SEQ ID NO: 9598 - protein, 28 aa, Artificial Sequence
  Description of Artificial Sequence: Synthetic peptide
DEHEIRTTNPVATEQYGSVSNLLQRGNR

SEQ ID NO: 9599 - protein, 28 aa, Artificial Sequence
  Description of Artificial Sequence: Synthetic peptide
DENEIVTTNPVATEVYGSVSTNLQRGNR

SEQ ID NO: 9600 - protein, 29 aa, Artificial Sequence
  Description of Artificial Sequence: Synthetic peptide
DEEEIRTTNPAATEQYGSVSTNLPQLGNR

SEQ ID NO: 9601 - protein, 29 aa, Artificial Sequence
  Description of Artificial Sequence: Synthetic peptide
DEEEIRTTNPVATEQYGSVSTNDPDRGNR

SEQ ID NO: 9602 - protein, 29 aa, Artificial Sequence
  Description of Artificial Sequence: Synthetic peptide
DEEEIRTTNPVATEQYGSVSTLPLERGNR

SEQ ID NO: 9603 - protein, 29 aa, Artificial Sequence
  Description of Artificial Sequence: Synthetic peptide
DEEEIRTTNPVATEQYGSVSTNLQEVGND

SEQ ID NO: 9604 - protein, 28 aa, Artificial Sequence
  Description of Artificial Sequence: Synthetic peptide
DEEEIWTTNPVATEGYGDVSTNLQRGNR

SEQ ID NO: 9605 - protein, 28 aa, Artificial Sequence
  Description of Artificial Sequence: Synthetic peptide
DDEEIRTTNPVATEIYGSVSSNLQRGNR

SEQ ID NO: 9606 - protein, 29 aa, Artificial Sequence
  Description of Artificial Sequence: Synthetic peptide
DEEEIRTTNPVATEQYGSVSTNPLQWGND

SEQ ID NO: 9607 - protein, 28 aa, Artificial Sequence
  Description of Artificial Sequence: Synthetic peptide
MEDEIATTNPVATEQYGSVSTNLQRGNR

SEQ ID NO: 9608 - protein, 28 aa, Artificial Sequence
  Description of Artificial Sequence: Synthetic peptide
DEEEIRTTNPVATEQYGDVSTNLMRGNQ

SEQ ID NO: 9609 - protein, 28 aa, Artificial Sequence
  Description of Artificial Sequence: Synthetic peptide
DEEEIRTTNPVATEQYGCVSTDLQRGNA

SEQ ID NO: 9610 - protein, 29 aa, Artificial Sequence
  Description of Artificial Sequence: Synthetic peptide
DEEEIRTTNPVATEQYGSVSTNLQDDGNL

SEQ ID NO: 9611 - protein, 28 aa, Artificial Sequence
  Description of Artificial Sequence: Synthetic peptide
AEQEIATTNPVATEQYGSVSTNLQRGNR

SEQ ID NO: 9612 - protein, 30 aa, Artificial Sequence
  Description of Artificial Sequence: Synthetic polypeptide
DEEEIRTTNPVATEQYGSVSTMNEQRGDNR

SEQ ID NO: 9613 - protein, 28 aa, Artificial Sequence
  Description of Artificial Sequence: Synthetic peptide
DEEEIRTTNPVASEQYGSVSNNLERGNR

SEQ ID NO: 9614 - protein, 29 aa, Artificial Sequence
  Description of Artificial Sequence: Synthetic peptide
DEEEIRTTNPVATEQYGSVSCTNLCHGNR

SEQ ID NO: 9615 - protein, 28 aa, Artificial Sequence
  Description of Artificial Sequence: Synthetic peptide
DEEEIRTTNPVATEQYGSVSTNPQRGEF

SEQ ID NO: 9616 - protein, 28 aa, Artificial Sequence
  Description of Artificial Sequence: Synthetic peptide
DEEEIRTTNPVATEQYGSVSTNLERGEA

SEQ ID NO: 9617 - protein, 28 aa, Artificial Sequence
  Description of Artificial Sequence: Synthetic peptide
DEEEIRTTNPVATEQCGSVSTNLQHGNA

SEQ ID NO: 9618 - protein, 28 aa, Artificial Sequence
  Description of Artificial Sequence: Synthetic peptide
MEEEIRTTNPVATEQYGSVSTNLQHGNE

SEQ ID NO: 9619 - protein, 28 aa, Artificial Sequence
  Description of Artificial Sequence: Synthetic peptide
DEEEIRTTNPVATEQYGSVSTDLEYGNR

SEQ ID NO: 9620 - protein, 28 aa, Artificial Sequence
  Description of Artificial Sequence: Synthetic peptide
DEEEIRTTNPVATEQYGSVSTDLQIGNE

SEQ ID NO: 9621 - protein, 28 aa, Artificial Sequence
  Description of Artificial Sequence: Synthetic peptide
DEEEIRTTNPVATEQYGSVDTDLQHGNR

SEQ ID NO: 9622 - protein, 28 aa, Artificial Sequence
  Description of Artificial Sequence: Synthetic peptide
DEEEIRTTNPVATEQYGSVSTDLQTGNM

SEQ ID NO: 9623 - protein, 28 aa, Artificial Sequence
  Description of Artificial Sequence: Synthetic peptide
DEEEIRTTNPVATEQYGSVSTPLEPGNR

SEQ ID NO: 9624 - protein, 29 aa, Artificial Sequence
  Description of Artificial Sequence: Synthetic peptide
DEEEIRTTNPVATEQYGSVSTPPLQRGER

SEQ ID NO: 9625 - protein, 28 aa, Artificial Sequence
  Description of Artificial Sequence: Synthetic peptide
DEQEIRTTNPVATEQYGSVSTNDQPGNR

SEQ ID NO: 9626 - protein, 29 aa, Artificial Sequence
  Description of Artificial Sequence: Synthetic peptide
DEEEIRTTNPVATEQYGSVSTNDQDRGNE

SEQ ID NO: 9627 - protein, 30 aa, Artificial Sequence
  Description of Artificial Sequence: Synthetic polypeptide
DEEEIRTTNPVATEQFGSVSATNLQREGNR

SEQ ID NO: 9628 - protein, 28 aa, Artificial Sequence
  Description of Artificial Sequence: Synthetic peptide
DEEEIRPTNPVATEQCGSVSTNLQRGER

SEQ ID NO: 9629 - protein, 29 aa, Artificial Sequence
  Description of Artificial Sequence: Synthetic peptide
DEEEIRTTNPVCTEQYGSVSTNLQREGNE

SEQ ID NO: 9630 - protein, 28 aa, Artificial Sequence
  Description of Artificial Sequence: Synthetic peptide
DEEEIRTTNPFATEQYGSVSTNLIRGNP

SEQ ID NO: 9631 - protein, 28 aa, Artificial Sequence
  Description of Artificial Sequence: Synthetic peptide
DEEEIRTTNPVATEQYGSVSTNLQNGEI

SEQ ID NO: 9632 - protein, 29 aa, Artificial Sequence
  Description of Artificial Sequence: Synthetic peptide
DEEEIRTTNPVATEQYGSVSTNLQLEGNW

SEQ ID NO: 9633 - protein, 28 aa, Artificial Sequence
  Description of Artificial Sequence: Synthetic peptide
DEEEIRTTNPVSTEQYGSVPTNLMRGNR

SEQ ID NO: 9634 - protein, 29 aa, Artificial Sequence
  Description of Artificial Sequence: Synthetic peptide
DEEEIRTTNPVATEQYGSVSTMELQRGNE

SEQ ID NO: 9635 - protein, 31 aa, Artificial Sequence
  Description of Artificial Sequence: Synthetic polypeptide
DEEEIRTTNPVATEQYGASVSTMNLQRGNMR

SEQ ID NO: 9636 - protein, 28 aa, Artificial Sequence
  Description of Artificial Sequence: Synthetic peptide
DEQEIATTNPVATEQYGTVSTNLQRGNR

SEQ ID NO: 9637 - protein, 28 aa, Artificial Sequence
  Description of Artificial Sequence: Synthetic peptide
NEEEIYTTNPVATEQYGSVSTNLQRGNA

SEQ ID NO: 9638 - protein, 28 aa, Artificial Sequence
  Description of Artificial Sequence: Synthetic peptide
DEEEIRTTNPVATEQYGSVSYNLMRGPR

SEQ ID NO: 9639 - protein, 28 aa, Artificial Sequence
  Description of Artificial Sequence: Synthetic peptide
DEVEIRTTNPVCTEQYGSVSTNLQRGNE

SEQ ID NO: 9640 - protein, 29 aa, Artificial Sequence
  Description of Artificial Sequence: Synthetic peptide
DEEEIRTTNPVATEQYGSVSTNDDRDGNR

SEQ ID NO: 9641 - protein, 28 aa, Artificial Sequence
  Description of Artificial Sequence: Synthetic peptide
DEEEISTTNPVATEQYGSVSTNLQRISR

SEQ ID NO: 9642 - protein, 28 aa, Artificial Sequence
  Description of Artificial Sequence: Synthetic peptide
DEEEIRTTNPVATEQYGSVSNNWERGNR

SEQ ID NO: 9643 - protein, 30 aa, Artificial Sequence
  Description of Artificial Sequence: Synthetic polypeptide
DEEEIRTTNPVATEQYGHSVSTNLQQGNGR

SEQ ID NO: 9644 - protein, 29 aa, Artificial Sequence
  Description of Artificial Sequence: Synthetic peptide
DEEEITTTNPVATEQYGSVSCTNLQRGNA

SEQ ID NO: 9645 - protein, 29 aa, Artificial Sequence
  Description of Artificial Sequence: Synthetic peptide
DEEEIRTTNPVATEQYGSVSTNLQEMGNF

SEQ ID NO: 9646 - protein, 28 aa, Artificial Sequence
  Description of Artificial Sequence: Synthetic peptide
DEEECRTTNPVATEQYGSVSTNLERGNV

SEQ ID NO: 9647 - protein, 29 aa, Artificial Sequence
  Description of Artificial Sequence: Synthetic peptide
DEEEIRTTNPDATEQYGSVSDNGLQRGNR

SEQ ID NO: 9648 - protein, 28 aa, Artificial Sequence
  Description of Artificial Sequence: Synthetic peptide
DEQEIRTTNPVATEQYGSVSTNLQVGDR

SEQ ID NO: 9649 - protein, 28 aa, Artificial Sequence
  Description of Artificial Sequence: Synthetic peptide
DEEEIRTTNPVATEVYGSVSTNPQRGNP

SEQ ID NO: 9650 - protein, 28 aa, Artificial Sequence
  Description of Artificial Sequence: Synthetic peptide
DEEEIRSTNPVASEMYGSVSTNLQRGNR

SEQ ID NO: 9651 - protein, 28 aa, Artificial Sequence
  Description of Artificial Sequence: Synthetic peptide
DEEEIRTTNPTATEQYGSVSTNLQNGNF

SEQ ID NO: 9652 - protein, 29 aa, Artificial Sequence
  Description of Artificial Sequence: Synthetic peptide
DEEEIRTTNPVATEQYGSVSTDLQVGENR

SEQ ID NO: 9653 - protein, 28 aa, Artificial Sequence
  Description of Artificial Sequence: Synthetic peptide
DEEEIRTTNPMATEQYGSVSSNLQWGNR

SEQ ID NO: 9654 - protein, 28 aa, Artificial Sequence
  Description of Artificial Sequence: Synthetic peptide
DEEEIRTTNPVATEQYGSVSTNLQYGDS

SEQ ID NO: 9655 - protein, 28 aa, Artificial Sequence
  Description of Artificial Sequence: Synthetic peptide
DEEEIRTTNPVATEQYGSVSTNDQRGEW

SEQ ID NO: 9656 - protein, 28 aa, Artificial Sequence
  Description of Artificial Sequence: Synthetic peptide
DEEEIRTTNPVATEQYGSVSTNLELGNF

SEQ ID NO: 9657 - protein, 30 aa, Artificial Sequence
  Description of Artificial Sequence: Synthetic polypeptide
DEEEIRTTNPVATENYGSVSTNLTQRGYNR

SEQ ID NO: 9658 - protein, 28 aa, Artificial Sequence
  Description of Artificial Sequence: Synthetic peptide
DEEEITTTNPVATEQYGGVSTNLQYGNR

SEQ ID NO: 9659 - protein, 28 aa, Artificial Sequence
  Description of Artificial Sequence: Synthetic peptide
DEEEIRTTNPVATEQYGSVSTGLQVGNV

SEQ ID NO: 9660 - protein, 30 aa, Artificial Sequence
  Description of Artificial Sequence: Synthetic polypeptide
DEEEIRTTNPVATEQYGSVSTNLQREGEDR

SEQ ID NO: 9661 - protein, 28 aa, Artificial Sequence
  Description of Artificial Sequence: Synthetic peptide
DEEEIRTTNPVATEQYGVVSTDLQFGNR

SEQ ID NO: 9662 - protein, 28 aa, Artificial Sequence
  Description of Artificial Sequence: Synthetic peptide
DEEEIRTTNPVATEQWGSVSTNLEPGNR

SEQ ID NO: 9663 - protein, 28 aa, Artificial Sequence
  Description of Artificial Sequence: Synthetic peptide
DDEEIRTTNPVATEQYGSVAYNLQRGNR

SEQ ID NO: 9664 - protein, 28 aa, Artificial Sequence
  Description of Artificial Sequence: Synthetic peptide
DEEEIRTCNPVATEQYGGVSTNLQQGNR

SEQ ID NO: 9665 - protein, 28 aa, Artificial Sequence
  Description of Artificial Sequence: Synthetic peptide
SEEEIRTTNPVATEIYGIVSTNLQRGNR

SEQ ID NO: 9666 - protein, 29 aa, Artificial Sequence
  Description of Artificial Sequence: Synthetic peptide
DEEEIRTTNPCSTEQYGSVSTNLQRGQNR

SEQ ID NO: 9667 - protein, 30 aa, Artificial Sequence
  Description of Artificial Sequence: Synthetic polypeptide
DEEEIRTTNPVATEQYGSVSTNLPLREGNR

SEQ ID NO: 9668 - protein, 29 aa, Artificial Sequence
  Description of Artificial Sequence: Synthetic peptide
DEEEIRTTNPVATEQYGSVSTELQVVGNR

SEQ ID NO: 9669 - protein, 29 aa, Artificial Sequence
  Description of Artificial Sequence: Synthetic peptide
DEEEIRSTNPVATEQYGEVSTNLQERGNR

SEQ ID NO: 9670 - protein, 28 aa, Artificial Sequence
  Description of Artificial Sequence: Synthetic peptide
DEEGIRTTNPVATEQYGSVSTNGMRGNR

SEQ ID NO: 9671 - protein, 28 aa, Artificial Sequence
  Description of Artificial Sequence: Synthetic peptide
DEEEVRTTNPVSTECYGSVSTNLQRGNR

SEQ ID NO: 9672 - protein, 29 aa, Artificial Sequence
  Description of Artificial Sequence: Synthetic peptide
DEEEIRTTNPVATEQYGSVSTNKLQHGGR

SEQ ID NO: 9673 - protein, 30 aa, Artificial Sequence
  Description of Artificial Sequence: Synthetic polypeptide
DEECIRTTNPVATEQYYGSVSTNLQRGNPR

SEQ ID NO: 9674 - protein, 28 aa, Artificial Sequence
  Description of Artificial Sequence: Synthetic peptide
QEEEIRTTNPVATEQYGEASTNLQRGNR

SEQ ID NO: 9675 - protein, 28 aa, Artificial Sequence
  Description of Artificial Sequence: Synthetic peptide
DEEEIRTTNPVATEQYGSVSDNLQTGNC

SEQ ID NO: 9676 - protein, 28 aa, Artificial Sequence
  Description of Artificial Sequence: Synthetic peptide
DEESIRTTNPVATEQYGSVSTNLQVGNM

SEQ ID NO: 9677 - protein, 29 aa, Artificial Sequence
  Description of Artificial Sequence: Synthetic peptide
DEEEISTTNPVATEQYGSVSTFLQARGNR

SEQ ID NO: 9678 - protein, 29 aa, Artificial Sequence
  Description of Artificial Sequence: Synthetic peptide
DEEEIKTTNPVATEHYGSVSTNLQRNGNR

SEQ ID NO: 9679 - protein, 30 aa, Artificial Sequence
  Description of Artificial Sequence: Synthetic polypeptide
DEEEIRTTNPVATEQYGSVSTNLQDREGNM

SEQ ID NO: 9680 - protein, 28 aa, Artificial Sequence
  Description of Artificial Sequence: Synthetic peptide
DEEEIRTTNPVATEQYGSVSTDLQGGNQ

SEQ ID NO: 9681 - protein, 28 aa, Artificial Sequence
  Description of Artificial Sequence: Synthetic peptide
DEVEIRTTNPVATEQYGSVSTNEQQGNR

SEQ ID NO: 9682 - protein, 28 aa, Artificial Sequence
  Description of Artificial Sequence: Synthetic peptide
DEEEIRTTNPVATEQYGIASTVLQRGNR

SEQ ID NO: 9683 - protein, 28 aa, Artificial Sequence
  Description of Artificial Sequence: Synthetic peptide
DEEEVRTTNPVCTEQYGSVSTNDQRGNR

SEQ ID NO: 9684 - protein, 28 aa, Artificial Sequence
  Description of Artificial Sequence: Synthetic peptide
DEEEIRTTNPVATEQYGSVSTNLQNGEH

SEQ ID NO: 9685 - protein, 29 aa, Artificial Sequence
  Description of Artificial Sequence: Synthetic peptide
DEEEIRTTNPVATEQYGSVSTANLQVGNY

SEQ ID NO: 9686 - protein, 28 aa, Artificial Sequence
  Description of Artificial Sequence: Synthetic peptide
DEEEITTTNPVSTEQYGSVSNNLQRGNR

SEQ ID NO: 9687 - protein, 28 aa, Artificial Sequence
  Description of Artificial Sequence: Synthetic peptide
DENEIRTTNPEATEQYGSVSTNLQRGNQ

SEQ ID NO: 9688 - protein, 29 aa, Artificial Sequence
  Description of Artificial Sequence: Synthetic peptide
DENEIATTNPVATEQYGSVDSTNLQRGNR

SEQ ID NO: 9689 - protein, 29 aa, Artificial Sequence
  Description of Artificial Sequence: Synthetic peptide
DEEEIRTTNPVATEQYGSVSTDLQDRGNT

SEQ ID NO: 9690 - protein, 28 aa, Artificial Sequence
  Description of Artificial Sequence: Synthetic peptide
DENEIRTTNPVATEVYGVVSTNLQRGNR

SEQ ID NO: 9691 - protein, 30 aa, Artificial Sequence
  Description of Artificial Sequence: Synthetic polypeptide
DEEEIRTTNPEATEQYGSVSTNLQARGNLR

SEQ ID NO: 9692 - protein, 28 aa, Artificial Sequence
  Description of Artificial Sequence: Synthetic peptide
DEEEIRTTNPVATEQYGWVSTELIRGNR

SEQ ID NO: 9693 - protein, 29 aa, Artificial Sequence
  Description of Artificial Sequence: Synthetic peptide
DEEEIRTTNPVATEQYGSVSTNLQDTGNL

SEQ ID NO: 9694 - protein, 30 aa, Artificial Sequence
  Description of Artificial Sequence: Synthetic polypeptide
DEEEIRTTNPCATEQYGSVASTNLQRGVNR

SEQ ID NO: 9695 - protein, 29 aa, Artificial Sequence
  Description of Artificial Sequence: Synthetic peptide
DEEEIRTTNPVATEQYGFVSTGLQRGDNR

SEQ ID NO: 9696 - protein, 28 aa, Artificial Sequence
  Description of Artificial Sequence: Synthetic peptide
SEEEIRTTNPVATMQWGSVSTNLQRGNR

SEQ ID NO: 9697 - protein, 28 aa, Artificial Sequence
  Description of Artificial Sequence: Synthetic peptide
DEEEIRCTNPIASEQYGSVSTNLQRGNR

SEQ ID NO: 9698 - protein, 28 aa, Artificial Sequence
  Description of Artificial Sequence: Synthetic peptide
DEEEIRTTNPVATEVYGSVSNNLERGNR

SEQ ID NO: 9699 - protein, 30 aa, Artificial Sequence
  Description of Artificial Sequence: Synthetic polypeptide
DEEEIRTTNPVATEQYGSVSTCNLQRGDNQ

SEQ ID NO: 9700 - protein, 29 aa, Artificial Sequence
  Description of Artificial Sequence: Synthetic peptide
DEEEIRSTNPVATEQYGSVSTNLQVNGNR

SEQ ID NO: 9701 - protein, 28 aa, Artificial Sequence
  Description of Artificial Sequence: Synthetic peptide
DEEEIRTTNPVATEQYGSVSTNLQHGET

SEQ ID NO: 9702 - protein, 30 aa, Artificial Sequence
  Description of Artificial Sequence: Synthetic polypeptide
DEEEIRTTNPVATEQYGSVSTNEQDRGDNR

SEQ ID NO: 9703 - protein, 30 aa, Artificial Sequence
  Description of Artificial Sequence: Synthetic polypeptide
DEEEIRTTNPFATEQYGSVSTDNLVQRGNR

SEQ ID NO: 9704 - protein, 28 aa, Artificial Sequence
  Description of Artificial Sequence: Synthetic peptide
DEEEIRTTNPVATEQYGSVSTDLQRGEW

SEQ ID NO: 9705 - protein, 29 aa, Artificial Sequence
  Description of Artificial Sequence: Synthetic peptide
DEEEIRTTNPVATEQYGSVSTNLQIDGNS

SEQ ID NO: 9706 - protein, 28 aa, Artificial Sequence
  Description of Artificial Sequence: Synthetic peptide
DEEEIRSTNPVATENYGVVSTNLQRGNR

SEQ ID NO: 9707 - protein, 28 aa, Artificial Sequence
  Description of Artificial Sequence: Synthetic peptide
DEEEIRTTNPVATEQYGSVSTNLQFGEA

SEQ ID NO: 9708 - protein, 28 aa, Artificial Sequence
  Description of Artificial Sequence: Synthetic peptide
DEEEIRTTNPVCTEQYGDVSTNDQRGNR

SEQ ID NO: 9709 - protein, 28 aa, Artificial Sequence
  Description of Artificial Sequence: Synthetic peptide
DENEIRQTNPVATEQYGSVSTNQQRGNR

SEQ ID NO: 9710 - protein, 31 aa, Artificial Sequence
  Description of Artificial Sequence: Synthetic polypeptide
DEEEIRTTNPVATEQYGSVSITENLQRDGNR

SEQ ID NO: 9711 - protein, 28 aa, Artificial Sequence
  Description of Artificial Sequence: Synthetic peptide
DEEEIRTTNPVATEQYGSVSTNLQWGEN

SEQ ID NO: 9712 - protein, 28 aa, Artificial Sequence
  Description of Artificial Sequence: Synthetic peptide
DEEEIRTTNPVATEMYGCVATNLQRGNR

SEQ ID NO: 9713 - protein, 29 aa, Artificial Sequence
  Description of Artificial Sequence: Synthetic peptide
DEEEIRTTNPVATEQYGSVSTNLQDNGNM

SEQ ID NO: 9714 - protein, 28 aa, Artificial Sequence
  Description of Artificial Sequence: Synthetic peptide
DEEEIRTVNPVSTEQYGSVATNLQRGNR

SEQ ID NO: 9715 - protein, 28 aa, Artificial Sequence
  Description of Artificial Sequence: Synthetic peptide
DEEEIRQTNPVATEQYGSVPTNLMRGNR

SEQ ID NO: 9716 - protein, 28 aa, Artificial Sequence
  Description of Artificial Sequence: Synthetic peptide
DEEEIVTTNPCATEQYGWVSTNLQRGNR

SEQ ID NO: 9717 - protein, 28 aa, Artificial Sequence
  Description of Artificial Sequence: Synthetic peptide
DEEEIRTTNPVATEQYGSTSTNLQAGNP

SEQ ID NO: 9718 - protein, 28 aa, Artificial Sequence
  Description of Artificial Sequence: Synthetic peptide
DEEEIRTTNPVATEQYGSVSNNLQRGEF

SEQ ID NO: 9719 - protein, 28 aa, Artificial Sequence
  Description of Artificial Sequence: Synthetic peptide
DEEEIRTTNPVATEQYGSVETPLQRGNG

SEQ ID NO: 9720 - protein, 28 aa, Artificial Sequence
  Description of Artificial Sequence: Synthetic peptide
DEECIRTTNPVATGQYGSVSTNLQRGNP

SEQ ID NO: 9721 - protein, 28 aa, Artificial Sequence
  Description of Artificial Sequence: Synthetic peptide
AEEEIRTTNPFATEQYGSVSTDLQRGNR

SEQ ID NO: 9722 - protein, 30 aa, Artificial Sequence
  Description of Artificial Sequence: Synthetic polypeptide
DEEEIRTTNPVATEQYGSVSCTNLQCYGNR

SEQ ID NO: 9723 - protein, 29 aa, Artificial Sequence
  Description of Artificial Sequence: Synthetic peptide
DEEEIRTTNPVATEQYGSVSTDLQREGER

SEQ ID NO: 9724 - protein, 28 aa, Artificial Sequence
  Description of Artificial Sequence: Synthetic peptide
DEEEIRTTNPVATEQWGSVSTNLQTGDR

SEQ ID NO: 9725 - protein, 28 aa, Artificial Sequence
  Description of Artificial Sequence: Synthetic peptide
DEEEIRTTNPVATEQYGSVPENEQRGNR

SEQ ID NO: 9726 - protein, 28 aa, Artificial Sequence
  Description of Artificial Sequence: Synthetic peptide
DEEEIRTTNPVATEQYGSVSDNLQNGER

SEQ ID NO: 9727 - protein, 28 aa, Artificial Sequence
  Description of Artificial Sequence: Synthetic peptide
DEEEIRTTNPVATEQYGSVSMNDQRGNY

SEQ ID NO: 9728 - protein, 28 aa, Artificial Sequence
  Description of Artificial Sequence: Synthetic peptide
DEEEIRTTNPVATEQYGIASENLQRGNR

SEQ ID NO: 9729 - protein, 29 aa, Artificial Sequence
  Description of Artificial Sequence: Synthetic peptide
DEEELRTTNPVATEQYGSVSTNLQVEGNR

SEQ ID NO: 9730 - protein, 30 aa, Artificial Sequence
  Description of Artificial Sequence: Synthetic polypeptide
DEEEIRTTNPVATEQYGSVSTNLQERGNDD

SEQ ID NO: 9731 - protein, 29 aa, Artificial Sequence
  Description of Artificial Sequence: Synthetic peptide
DEEEIRTTNPVATEQYGSVSTNLQDQGNE

SEQ ID NO: 9732 - protein, 28 aa, Artificial Sequence
  Description of Artificial Sequence: Synthetic peptide
YEEEIRTTNPMATEQYGSVSTNLQAGNR

SEQ ID NO: 9733 - protein, 29 aa, Artificial Sequence
  Description of Artificial Sequence: Synthetic peptide
DEEEIRTVNPVATEQYGSVSATNLQHGNR

SEQ ID NO: 9734 - protein, 28 aa, Artificial Sequence
  Description of Artificial Sequence: Synthetic peptide
DEEEIRATNPVCTEMYGSVSTNLQRGNR

SEQ ID NO: 9735 - protein, 30 aa, Artificial Sequence
  Description of Artificial Sequence: Synthetic polypeptide
DEEEIRTTNPVATEQYGSVSTNPEQRGNDR

SEQ ID NO: 9736 - protein, 29 aa, Artificial Sequence
  Description of Artificial Sequence: Synthetic peptide
DEEEIRTTNPVATEQYGSVSTNLEMVGNR

SEQ ID NO: 9737 - protein, 28 aa, Artificial Sequence
  Description of Artificial Sequence: Synthetic peptide
DEEEIRTTNPVATEQYGSVSTNLQNGDL

SEQ ID NO: 9738 - protein, 29 aa, Artificial Sequence
  Description of Artificial Sequence: Synthetic peptide
DEEEIRTTNPVATEQYGSVSTNLQEQGNV

SEQ ID NO: 9739 - protein, 29 aa, Artificial Sequence
  Description of Artificial Sequence: Synthetic peptide
DEEEIRTTNPVATEQYGSVSTNLQIDGNN

SEQ ID NO: 9740 - protein, 28 aa, Artificial Sequence
  Description of Artificial Sequence: Synthetic peptide
DEEEIRTCNPVATEQYGSVGTNLQRGND

SEQ ID NO: 9741 - protein, 30 aa, Artificial Sequence
  Description of Artificial Sequence: Synthetic polypeptide
DEEEIRTTNPVATEQYGSVSTNLQLRNGNT

SEQ ID NO: 9742 - protein, 28 aa, Artificial Sequence
  Description of Artificial Sequence: Synthetic peptide
DEEEIRTTNPVATEQYGSVSTNLEMGNA

SEQ ID NO: 9743 - protein, 28 aa, Artificial Sequence
  Description of Artificial Sequence: Synthetic peptide
DEEEIRTTNPVATEQYGSVSTNPQLGNQ

SEQ ID NO: 9744 - protein, 29 aa, Artificial Sequence
  Description of Artificial Sequence: Synthetic peptide
DEEEIRTTNPVATEQYGSVSNNLLRGNER

SEQ ID NO: 9745 - protein, 28 aa, Artificial Sequence
  Description of Artificial Sequence: Synthetic peptide
QEEEIRTTNPVATEVYGSASTNLQRGNR

SEQ ID NO: 9746 - protein, 28 aa, Artificial Sequence
  Description of Artificial Sequence: Synthetic peptide
DEEEIRTTNPVATEQYGLVSTVLQRGSR

SEQ ID NO: 9747 - protein, 28 aa, Artificial Sequence
  Description of Artificial Sequence: Synthetic peptide
DEEEIRTTNPVSTEQYGVVATNLQRGNR

SEQ ID NO: 9748 - protein, 28 aa, Artificial Sequence
  Description of Artificial Sequence: Synthetic peptide
AEEEIRTTNPDATEQYGSVSTNDQRGNR

SEQ ID NO: 9749 - protein, 28 aa, Artificial Sequence
  Description of Artificial Sequence: Synthetic peptide
DEGEIRTVNPVSTEQYGSVSTNLQRGNR

SEQ ID NO: 9750 - protein, 28 aa, Artificial Sequence
  Description of Artificial Sequence: Synthetic peptide
DEEEIRTTNPVATEQYGSVSTFLQPGNN

SEQ ID NO: 9751 - protein, 28 aa, Artificial Sequence
  Description of Artificial Sequence: Synthetic peptide
DEQEIRTTNPVATECYGSVSTNLQRGNC

SEQ ID NO: 9752 - protein, 28 aa, Artificial Sequence
  Description of Artificial Sequence: Synthetic peptide
DEEEIRTTNPVATEQYGSVETNDQPGNR

SEQ ID NO: 9753 - protein, 28 aa, Artificial Sequence
  Description of Artificial Sequence: Synthetic peptide
DEEEISTTNPVATEQYGSASTNLQHGNR

SEQ ID NO: 9754 - protein, 28 aa, Artificial Sequence
  Description of Artificial Sequence: Synthetic peptide
DEEEIRTTNPCATEQYGSVSTALQGGNR

SEQ ID NO: 9755 - protein, 28 aa, Artificial Sequence
  Description of Artificial Sequence: Synthetic peptide
DEEEIRTTNPVATENYGSVSTNLFRGNQ

SEQ ID NO: 9756 - protein, 30 aa, Artificial Sequence
  Description of Artificial Sequence: Synthetic polypeptide
DEEEIRTTNPVATEQYGSVSTNLQDRNGND

SEQ ID NO: 9757 - protein, 29 aa, Artificial Sequence
  Description of Artificial Sequence: Synthetic peptide
DEEEIRTTNPVACEQYGSVSTNGPQRGNR

SEQ ID NO: 9758 - protein, 28 aa, Artificial Sequence
  Description of Artificial Sequence: Synthetic peptide
DEEEIRTTNPDATEQYGSVSTNPIRGNR

SEQ ID NO: 9759 - protein, 28 aa, Artificial Sequence
  Description of Artificial Sequence: Synthetic peptide
DEEEIRTTNPVATEQYGSVSTNLQGGEH

SEQ ID NO: 9760 - protein, 28 aa, Artificial Sequence
  Description of Artificial Sequence: Synthetic peptide
SEVEIRCTNPVATEQYGSVSTNLQRGNR

SEQ ID NO: 9761 - protein, 29 aa, Artificial Sequence
  Description of Artificial Sequence: Synthetic peptide
DEEEIRTTNPVATEQYGSVSTNLQDHGNL

SEQ ID NO: 9762 - protein, 30 aa, Artificial Sequence
  Description of Artificial Sequence: Synthetic polypeptide
DEEEIRTTNPVATEQYGMSVSTNPLQRPNR

SEQ ID NO: 9763 - protein, 28 aa, Artificial Sequence
  Description of Artificial Sequence: Synthetic peptide
DEEEIRTVNPVATEQYGDVSTNLQRGNS

SEQ ID NO: 9764 - protein, 29 aa, Artificial Sequence
  Description of Artificial Sequence: Synthetic peptide
DEEEIRTTNPVATEQYGSVSTNLEDNGNR

SEQ ID NO: 9765 - protein, 28 aa, Artificial Sequence
  Description of Artificial Sequence: Synthetic peptide
DEEEIRTTNPVATEQYGNVHTNLQRGER

SEQ ID NO: 9766 - protein, 29 aa, Artificial Sequence
  Description of Artificial Sequence: Synthetic peptide
DEEEIRTTNPVATEQYGVVSTVNLQRGNF

SEQ ID NO: 9767 - protein, 28 aa, Artificial Sequence
  Description of Artificial Sequence: Synthetic peptide
DEEEIRTTNPDATEQYGSVSTPLQRGNF

SEQ ID NO: 9768 - protein, 28 aa, Artificial Sequence
  Description of Artificial Sequence: Synthetic peptide
DEEEIRTTNPVATEQYGYVSNNQQRGNR

SEQ ID NO: 9769 - protein, 28 aa, Artificial Sequence
  Description of Artificial Sequence: Synthetic peptide
DEEEIRTTNPVATEQYGSVSTNLQIGDV

SEQ ID NO: 9770 - protein, 28 aa, Artificial Sequence
  Description of Artificial Sequence: Synthetic peptide
DENEIRTTNPVATECYGSVSTNLERGNR

SEQ ID NO: 9771 - protein, 28 aa, Artificial Sequence
  Description of Artificial Sequence: Synthetic peptide
DEEEIVTTNPVATEQYGSVSDNAQRGNR

SEQ ID NO: 9772 - protein, 30 aa, Artificial Sequence
  Description of Artificial Sequence: Synthetic polypeptide
DEEMIRTTNPVATEQYGSVSTNLQRNGDNR

SEQ ID NO: 9773 - protein, 28 aa, Artificial Sequence
  Description of Artificial Sequence: Synthetic peptide
DEEEIRTTNPVATEQYGSVSTNEQQGNE

SEQ ID NO: 9774 - protein, 28 aa, Artificial Sequence
  Description of Artificial Sequence: Synthetic peptide
DEQEIRTTNPVATEQYGSSSTNLQRGER

SEQ ID NO: 9775 - protein, 30 aa, Artificial Sequence
  Description of Artificial Sequence: Synthetic polypeptide
DEEEIRTTNPVATEQYGSVSCTMNLQRGND

SEQ ID NO: 9776 - protein, 29 aa, Artificial Sequence
  Description of Artificial Sequence: Synthetic peptide
DEEEIRTTNPVATEQYGSVSTNLQTGEPR

SEQ ID NO: 9777 - protein, 28 aa, Artificial Sequence
  Description of Artificial Sequence: Synthetic peptide
DEEEIRTTNPVATELYGCVSNNLQRGNR

SEQ ID NO: 9778 - protein, 29 aa, Artificial Sequence
  Description of Artificial Sequence: Synthetic peptide
DEEEIRTTNPVATEQYGSVSTDNLQRGTF

SEQ ID NO: 9779 - protein, 28 aa, Artificial Sequence
  Description of Artificial Sequence: Synthetic peptide
DEEEIRTTNPVATEQYGSWSTNLQGGNE

SEQ ID NO: 9780 - protein, 28 aa, Artificial Sequence
  Description of Artificial Sequence: Synthetic peptide
DEQEIRTTNPVATEQYGSVDTNLQRGNA

SEQ ID NO: 9781 - protein, 28 aa, Artificial Sequence
  Description of Artificial Sequence: Synthetic peptide
DEEEINTTNPVATMQYGSVSTNLQKGNR

SEQ ID NO: 9782 - protein, 31 aa, Artificial Sequence
  Description of Artificial Sequence: Synthetic polypeptide
DEEEIRTTNPVATEQYGSVSTENLQIRKGNR

SEQ ID NO: 9783 - protein, 28 aa, Artificial Sequence
  Description of Artificial Sequence: Synthetic peptide
AEEEIRQTNPVATEQYGSVSTNLERGNR

SEQ ID NO: 9784 - protein, 28 aa, Artificial Sequence
  Description of Artificial Sequence: Synthetic peptide
DEEEIRTTNPVATEQYGSYSTHLQRHNR

SEQ ID NO: 9785 - protein, 28 aa, Artificial Sequence
  Description of Artificial Sequence: Synthetic peptide
DEEEVRTTNPVATEQYGSASTNLQRMNR

SEQ ID NO: 9786 - protein, 28 aa, Artificial Sequence
  Description of Artificial Sequence: Synthetic peptide
DENEIRSTNPVATENYGSVSTNLQRGNR

SEQ ID NO: 9787 - protein, 28 aa, Artificial Sequence
  Description of Artificial Sequence: Synthetic peptide
DEEEIRTTNPVATEQYGSVSTNDQVGNM

SEQ ID NO: 9788 - protein, 30 aa, Artificial Sequence
  Description of Artificial Sequence: Synthetic polypeptide
DEEEIRTTNPVATEQYGSYVDSTNLQVGNR

SEQ ID NO: 9789 - protein, 28 aa, Artificial Sequence
  Description of Artificial Sequence: Synthetic peptide
DEEEICQTNPVATEQYGSVSTNLQFGNR

SEQ ID NO: 9790 - protein, 28 aa, Artificial Sequence
  Description of Artificial Sequence: Synthetic peptide
DEEEIRTTNPVATEQYGSVSTNLQQGES

SEQ ID NO: 9791 - protein, 28 aa, Artificial Sequence
  Description of Artificial Sequence: Synthetic peptide
DEEEIWTTNPVATEQYGSVSTGLQRGND

SEQ ID NO: 9792 - protein, 28 aa, Artificial Sequence
  Description of Artificial Sequence: Synthetic peptide
DENEIVTTNPVATEMYGSVSTNLQRGNR

SEQ ID NO: 9793 - protein, 28 aa, Artificial Sequence
  Description of Artificial Sequence: Synthetic peptide
DEEEIRTTNPVATEQYGSVSTNLQLGEY

SEQ ID NO: 9794 - protein, 28 aa, Artificial Sequence
  Description of Artificial Sequence: Synthetic peptide
DEEELRTTNPVATEQYGSVGTNLQRGND

SEQ ID NO: 9795 - protein, 29 aa, Artificial Sequence
  Description of Artificial Sequence: Synthetic peptide
DEEEIRTTNPVATEQYGSVSTMNLQAGNA

SEQ ID NO: 9796 - protein, 28 aa, Artificial Sequence
  Description of Artificial Sequence: Synthetic peptide
DEEEIRTTNPVATEQWGSVSTILQRENR

SEQ ID NO: 9797 - protein, 29 aa, Artificial Sequence
  Description of Artificial Sequence: Synthetic peptide
DEEEIRTTNPVATEQYGSVSTNLQEAGNT

SEQ ID NO: 9798 - protein, 29 aa, Artificial Sequence
  Description of Artificial Sequence: Synthetic peptide
DEEEIRTVNPVATEQYGWVSTNLQRAGNR

SEQ ID NO: 9799 - protein, 28 aa, Artificial Sequence
  Description of Artificial Sequence: Synthetic peptide
DEEEIRTTNPVATEQYGSVSTEDQRGNG

SEQ ID NO: 9800 - protein, 29 aa, Artificial Sequence
  Description of Artificial Sequence: Synthetic peptide
DEEEIRTTNPVATEQYGSVPSDNLQRGNA

SEQ ID NO: 9801 - protein, 29 aa, Artificial Sequence
  Description of Artificial Sequence: Synthetic peptide
DEEEIRTTNPVATEQYGSVSTLNDQRGNF

SEQ ID NO: 9802 - protein, 28 aa, Artificial Sequence
  Description of Artificial Sequence: Synthetic peptide
DEEEIRTTNPVATEQYGSVSTALFQGNR

SEQ ID NO: 9803 - protein, 31 aa, Artificial Sequence
  Description of Artificial Sequence: Synthetic polypeptide
DEEEIRTTNPVATEQYGSVSTNLQDREGNDR

SEQ ID NO: 9804 - protein, 29 aa, Artificial Sequence
  Description of Artificial Sequence: Synthetic peptide
DEEEIRTTNPTATEQYGSVSTNEQRGNDR

SEQ ID NO: 9805 - protein, 29 aa, Artificial Sequence
  Description of Artificial Sequence: Synthetic peptide
DEEEIRTTNPVATEQYGSVSAINLQRGLR

SEQ ID NO: 9806 - protein, 29 aa, Artificial Sequence
  Description of Artificial Sequence: Synthetic peptide
DEEEIRTTNPVATECYGSVSTMNLQRENR

SEQ ID NO: 9807 - protein, 29 aa, Artificial Sequence
  Description of Artificial Sequence: Synthetic peptide
DEEEIRTTNPVATEQYGSVSTNLQRENNI

SEQ ID NO: 9808 - protein, 28 aa, Artificial Sequence
  Description of Artificial Sequence: Synthetic peptide
DEEEIRATNPVATEQFGGVSTNLQRGNR

SEQ ID NO: 9809 - protein, 29 aa, Artificial Sequence
  Description of Artificial Sequence: Synthetic peptide
DEEEIRTTNPVATEQYGSVSTGLTDRGNR

SEQ ID NO: 9810 - protein, 28 aa, Artificial Sequence
  Description of Artificial Sequence: Synthetic peptide
DEEEIRCTNPVATEIYGSVSTNLERGNR

SEQ ID NO: 9811 - protein, 28 aa, Artificial Sequence
  Description of Artificial Sequence: Synthetic peptide
DEQEIRTTNPVATEQYGSVDTNLQFGNR

SEQ ID NO: 9812 - protein, 28 aa, Artificial Sequence
  Description of Artificial Sequence: Synthetic peptide
DEEEIRATNPVASEQWGSVSTNLQRGNR

SEQ ID NO: 9813 - protein, 30 aa, Artificial Sequence
  Description of Artificial Sequence: Synthetic polypeptide
DEEEICTTNPVATEQYGSVSTNLPQRGNTR

SEQ ID NO: 9814 - protein, 28 aa, Artificial Sequence
  Description of Artificial Sequence: Synthetic peptide
DEEEITTTNPVATEQYGWVSTNLQRGQR

SEQ ID NO: 9815 - protein, 31 aa, Artificial Sequence
  Description of Artificial Sequence: Synthetic polypeptide
DEEEIRTTNPVATEQYGSVSETNLQREGENR

SEQ ID NO: 9816 - protein, 28 aa, Artificial Sequence
  Description of Artificial Sequence: Synthetic peptide
DEIEIRTTNPVATEQYGSVSTNLSRGAR

SEQ ID NO: 9817 - protein, 28 aa, Artificial Sequence
  Description of Artificial Sequence: Synthetic peptide
DEEEIRTTNPVATEQYGSVSTNPQIGNV

SEQ ID NO: 9818 - protein, 28 aa, Artificial Sequence
  Description of Artificial Sequence: Synthetic peptide
DEEEIRTTNPVATEQYGSVSTNLQHGDM

SEQ ID NO: 9819 - protein, 29 aa, Artificial Sequence
  Description of Artificial Sequence: Synthetic peptide
DEEEIRTVNPVATEQYGSVSTALTQRGNR

SEQ ID NO: 9820 - protein, 28 aa, Artificial Sequence
  Description of Artificial Sequence: Synthetic peptide
YEEECRTTNPVATEQYGSVSTNLQHGNR

SEQ ID NO: 9821 - protein, 29 aa, Artificial Sequence
  Description of Artificial Sequence: Synthetic peptide
DEEEIRTTNPVATEQYGSVSTNLQDSGND

SEQ ID NO: 9822 - protein, 28 aa, Artificial Sequence
  Description of Artificial Sequence: Synthetic peptide
HEEEIRTTNPVATEQYGSVSTNLQRENW

SEQ ID NO: 9823 - protein, 29 aa, Artificial Sequence
  Description of Artificial Sequence: Synthetic peptide
DEEEIRTTNPVCTEQYGSVSCTELQRGNR

SEQ ID NO: 9824 - protein, 30 aa, Artificial Sequence
  Description of Artificial Sequence: Synthetic polypeptide
DEEEIRTTNPVATEQYGSVASTTNDQRGNR

SEQ ID NO: 9825 - protein, 28 aa, Artificial Sequence
  Description of Artificial Sequence: Synthetic peptide
DEEEIRTTNPVATEQYGSVSTDLQLGER

SEQ ID NO: 9826 - protein, 28 aa, Artificial Sequence
  Description of Artificial Sequence: Synthetic peptide
DENEIRTTNPVATEQYGSVSTCLQRENR

SEQ ID NO: 9827 - protein, 29 aa, Artificial Sequence
  Description of Artificial Sequence: Synthetic peptide
DEEEIRTTNPVATEQYGSVSTNLQHNGNW

SEQ ID NO: 9828 - protein, 30 aa, Artificial Sequence
  Description of Artificial Sequence: Synthetic polypeptide
DEEEIRTTNPVATEQYGSVSDTNLERGENR

SEQ ID NO: 9829 - protein, 29 aa, Artificial Sequence
  Description of Artificial Sequence: Synthetic peptide
DEEEIRTTNPVATEQYGSVSTNLQETGNV

SEQ ID NO: 9830 - protein, 29 aa, Artificial Sequence
  Description of Artificial Sequence: Synthetic peptide
DEEEIRTTNPVATEQYGSVSTNLQEEGNW

SEQ ID NO: 9831 - protein, 29 aa, Artificial Sequence
  Description of Artificial Sequence: Synthetic peptide
DEEEIRTTNPVATEQYGSVSTNLERNGNL

SEQ ID NO: 9832 - protein, 30 aa, Artificial Sequence
  Description of Artificial Sequence: Synthetic polypeptide
DEEEIRTTNPVATEQYGSVSTNGDQREGNR

SEQ ID NO: 9833 - protein, 29 aa, Artificial Sequence
  Description of Artificial Sequence: Synthetic peptide
DEEEIRATNPVATEQYGSVSTNLQERGNT

SEQ ID NO: 9834 - protein, 28 aa, Artificial Sequence
  Description of Artificial Sequence: Synthetic peptide
DEEEIRTTNPVATEQYGSVSTNLQNGES

SEQ ID NO: 9835 - protein, 28 aa, Artificial Sequence
  Description of Artificial Sequence: Synthetic peptide
VEEEIRTTNPVSTEQYGSVSTNLQRGTR

SEQ ID NO: 9836 - protein, 31 aa, Artificial Sequence
  Description of Artificial Sequence: Synthetic polypeptide
DEEEIRTTNPVATEQYGSVSITNLQDRGDNR

SEQ ID NO: 9837 - protein, 28 aa, Artificial Sequence
  Description of Artificial Sequence: Synthetic peptide
DEEELRTTNPVATEHWGSVSTNLQRGNR

SEQ ID NO: 9838 - protein, 29 aa, Artificial Sequence
  Description of Artificial Sequence: Synthetic peptide
DEEEIRQTNPVATEQYGSVSETGLQRGNR

SEQ ID NO: 9839 - protein, 28 aa, Artificial Sequence
  Description of Artificial Sequence: Synthetic peptide
DEEEIRTTNPVATEQYGSVSTDLQEGNF

SEQ ID NO: 9840 - protein, 28 aa, Artificial Sequence
  Description of Artificial Sequence: Synthetic peptide
DEEEIRTTNPVATEQYGSVSDNEQRGNF

SEQ ID NO: 9841 - protein, 29 aa, Artificial Sequence
  Description of Artificial Sequence: Synthetic peptide
DEEEIRQTNPVATEQYGSVSTNLQDRGNW

SEQ ID NO: 9842 - protein, 29 aa, Artificial Sequence
  Description of Artificial Sequence: Synthetic peptide
DEEEIRTTNPVATEQWGSVSTNEQNRGNR

SEQ ID NO: 9843 - protein, 30 aa, Artificial Sequence
  Description of Artificial Sequence: Synthetic polypeptide
DEEEIRTTNPVATEQYGVVSTNLQRGENDR

SEQ ID NO: 9844 - protein, 28 aa, Artificial Sequence
  Description of Artificial Sequence: Synthetic peptide
DEEEIRTTNPDATEQYGSVSTELQQGNR

SEQ ID NO: 9845 - protein, 28 aa, Artificial Sequence
  Description of Artificial Sequence: Synthetic peptide
DEEEIRTTNPVATEQYGSVETNDQRGER

SEQ ID NO: 9846 - protein, 28 aa, Artificial Sequence
  Description of Artificial Sequence: Synthetic peptide
DEEEIRTTNPCAYEWYGSVSTNLQRGNR

SEQ ID NO: 9847 - protein, 28 aa, Artificial Sequence
  Description of Artificial Sequence: Synthetic peptide
DEEEIRTTNPVATEQYGSVDTNDQRGNS

SEQ ID NO: 9848 - protein, 28 aa, Artificial Sequence
  Description of Artificial Sequence: Synthetic peptide
DEQEIRTTNPVATEQYGSVSTNDQRGDR

SEQ ID NO: 9849 - protein, 28 aa, Artificial Sequence
  Description of Artificial Sequence: Synthetic peptide
DQEEIRTTNPVATEQWGSVSTNLQEGNR

SEQ ID NO: 9850 - protein, 28 aa, Artificial Sequence
  Description of Artificial Sequence: Synthetic peptide
DEQEIASTNPVATEQYGSVSTNLQRGNR

SEQ ID NO: 9851 - protein, 30 aa, Artificial Sequence
  Description of Artificial Sequence: Synthetic polypeptide
DEEEIRTTNPVATEQYGSVSTGNPQRGNWR

SEQ ID NO: 9852 - protein, 30 aa, Artificial Sequence
  Description of Artificial Sequence: Synthetic polypeptide
DEEEIRTTNPVATEQYGSVSTPNLQPGDNR

SEQ ID NO: 9853 - protein, 29 aa, Artificial Sequence
  Description of Artificial Sequence: Synthetic peptide
DEEMIRTTNPVATEQYGSVSTPPLQRGNR

SEQ ID NO: 9854 - protein, 28 aa, Artificial Sequence
  Description of Artificial Sequence: Synthetic peptide
DEEEIRTTNPVATEQYGSVDTNLQLGNQ

SEQ ID NO: 9855 - protein, 30 aa, Artificial Sequence
  Description of Artificial Sequence: Synthetic polypeptide
DEEELRTTNPVATEQYGSVSTNLDQDRGNR

SEQ ID NO: 9856 - protein, 28 aa, Artificial Sequence
  Description of Artificial Sequence: Synthetic peptide
DEEEIRTTNPVATEQYGSVSTNLQWGES

SEQ ID NO: 9857 - protein, 29 aa, Artificial Sequence
  Description of Artificial Sequence: Synthetic peptide
DENEIRTTNPVATEQYGSVSTNLQNIGNR

SEQ ID NO: 9858 - protein, 28 aa, Artificial Sequence
  Description of Artificial Sequence: Synthetic peptide
DEEEIRTTNPVATEQYGSVSTNLQYGEA

SEQ ID NO: 9859 - protein, 31 aa, Artificial Sequence
  Description of Artificial Sequence: Synthetic polypeptide
DEEEIRTTNPVATEQYGSVSCTNLQYRAGNR

SEQ ID NO: 9860 - protein, 29 aa, Artificial Sequence
  Description of Artificial Sequence: Synthetic peptide
DEEEIRTVNPVATEQYGSVSTNLQIGNDR

SEQ ID NO: 9861 - protein, 28 aa, Artificial Sequence
  Description of Artificial Sequence: Synthetic peptide
DEEEIRTTNPVATEQYGGVSTNLQNGND

SEQ ID NO: 9862 - protein, 28 aa, Artificial Sequence
  Description of Artificial Sequence: Synthetic peptide
DEEEIRTTNPVATEQYGSVSTNEQPGNS

SEQ ID NO: 9863 - protein, 28 aa, Artificial Sequence
  Description of Artificial Sequence: Synthetic peptide
DEVEIRTTNPVATEQYGCVSTNLARGNR

SEQ ID NO: 9864 - protein, 31 aa, Artificial Sequence
  Description of Artificial Sequence: Synthetic polypeptide
DEEEIRTTNPVATEQYGSVSTTNLVQRGDNR

SEQ ID NO: 9865 - protein, 28 aa, Artificial Sequence
  Description of Artificial Sequence: Synthetic peptide
DEEEIRTTNPVATEQYGSVSTDLQYGNN

SEQ ID NO: 9866 - protein, 28 aa, Artificial Sequence
  Description of Artificial Sequence: Synthetic peptide
DEEEIRTTNPVSTEQYGGVGTNLQRGNR

SEQ ID NO: 9867 - protein, 29 aa, Artificial Sequence
  Description of Artificial Sequence: Synthetic peptide
DEEEIRTTNPVATEQYGSVSTELQERGNF

SEQ ID NO: 9868 - protein, 28 aa, Artificial Sequence
  Description of Artificial Sequence: Synthetic peptide
DEEEIRTTNPVATEQYGSVSTNLQFGDS

SEQ ID NO: 9869 - protein, 28 aa, Artificial Sequence
  Description of Artificial Sequence: Synthetic peptide
DEEEIRTTNPVATEQYGSVFTNLQRGED

SEQ ID NO: 9870 - protein, 28 aa, Artificial Sequence
  Description of Artificial Sequence: Synthetic peptide
DEYEINTTNPVATEQYGSVSTNLQRINR

SEQ ID NO: 9871 - protein, 28 aa, Artificial Sequence
  Description of Artificial Sequence: Synthetic peptide
DEEEIRTTNPVATEQYGSVSENLMRGNA

SEQ ID NO: 9872 - protein, 30 aa, Artificial Sequence
  Description of Artificial Sequence: Synthetic polypeptide
DEEEIRTTNPVSTEQYGSVSTNLQREGENR

SEQ ID NO: 9873 - protein, 28 aa, Artificial Sequence
  Description of Artificial Sequence: Synthetic peptide
DEEEIRTTNPVATEQYGSVETNLPAGNR

SEQ ID NO: 9874 - protein, 29 aa, Artificial Sequence
  Description of Artificial Sequence: Synthetic peptide
DEEEIRTTNPVATEQYGSVSTILQNQGNR

SEQ ID NO: 9875 - protein, 28 aa, Artificial Sequence
  Description of Artificial Sequence: Synthetic peptide
DEEIIRTTNPVATEQYGSVSTNLTRGNN

SEQ ID NO: 9876 - protein, 29 aa, Artificial Sequence
  Description of Artificial Sequence: Synthetic peptide
DEEEIRTTNPVATETYGSMSTNLQRSGNR

SEQ ID NO: 9877 - protein, 28 aa, Artificial Sequence
  Description of Artificial Sequence: Synthetic peptide
DEECIRTTNPVATEVYGDVSTNLQRGNR

SEQ ID NO: 9878 - protein, 29 aa, Artificial Sequence
  Description of Artificial Sequence: Synthetic peptide
DEEEIRTTNPTATEQFGSVSTNLQRGDNR

SEQ ID NO: 9879 - protein, 29 aa, Artificial Sequence
  Description of Artificial Sequence: Synthetic peptide
DEEEIRTTNPVATEQYGSVSTNLQDLGNI

SEQ ID NO: 9880 - protein, 28 aa, Artificial Sequence
  Description of Artificial Sequence: Synthetic peptide
DEEEIRTTNPVATFQYGSVSTNLQQGNF

SEQ ID NO: 9881 - protein, 30 aa, Artificial Sequence
  Description of Artificial Sequence: Synthetic polypeptide
MEEEIRTTNPVATEQYGSVSTNLQERGNDR

SEQ ID NO: 9882 - protein, 28 aa, Artificial Sequence
  Description of Artificial Sequence: Synthetic peptide
DEEEIRTTNPVATEQYGSVSTDLQHGNA

SEQ ID NO: 9883 - protein, 28 aa, Artificial Sequence
  Description of Artificial Sequence: Synthetic peptide
DEEEIRTTNPTATEQYGSVSTNLQVGND

SEQ ID NO: 9884 - protein, 28 aa, Artificial Sequence
  Description of Artificial Sequence: Synthetic peptide
DEEEIRCTNPVATEVYGSVSNNLQRGNR

SEQ ID NO: 9885 - protein, 28 aa, Artificial Sequence
  Description of Artificial Sequence: Synthetic peptide
DEDEIRATNPVATEQYGVVSTNLQRGNR

SEQ ID NO: 9886 - protein, 30 aa, Artificial Sequence
  Description of Artificial Sequence: Synthetic polypeptide
DEEEIRTTNPVATEQYGSMSTNLQRGDNER

SEQ ID NO: 9887 - protein, 29 aa, Artificial Sequence
  Description of Artificial Sequence: Synthetic peptide
DEEEIRTTNPVATEQYGSVSATDQQRGNR

SEQ ID NO: 9888 - protein, 30 aa, Artificial Sequence
  Description of Artificial Sequence: Synthetic polypeptide
DEEEIRTTNPVATEQYGSVSTNLQEREGNM

SEQ ID NO: 9889 - protein, 29 aa, Artificial Sequence
  Description of Artificial Sequence: Synthetic peptide
AEEEIATTNPVATEQYGSVSTNGLQRGNR

SEQ ID NO: 9890 - protein, 29 aa, Artificial Sequence
  Description of Artificial Sequence: Synthetic peptide
DEEEIRTTNPTATEQYGSVSTNPQRGDNR

SEQ ID NO: 9891 - protein, 28 aa, Artificial Sequence
  Description of Artificial Sequence: Synthetic peptide
DEEEIRTTNPVATEQYGSVSMELQRGER

SEQ ID NO: 9892 - protein, 29 aa, Artificial Sequence
  Description of Artificial Sequence: Synthetic peptide
DEEEIRTTNPVATEQYGSVSTELQRGDER

SEQ ID NO: 9893 - protein, 28 aa, Artificial Sequence
  Description of Artificial Sequence: Synthetic peptide
AEEEIRTVNPVATEQYGNVSTNLQRGNR

SEQ ID NO: 9894 - protein, 28 aa, Artificial Sequence
  Description of Artificial Sequence: Synthetic peptide
DEEEIRTTNPTATEQYGSVSTNLQQGNF

SEQ ID NO: 9895 - protein, 28 aa, Artificial Sequence
  Description of Artificial Sequence: Synthetic peptide
DEEEIRATNPVATEQYGVVGTNLQRGNR

SEQ ID NO: 9896 - protein, 29 aa, Artificial Sequence
  Description of Artificial Sequence: Synthetic peptide
DEEEIRTTNPVATEQYGSVSTENDQRGNQ

SEQ ID NO: 9897 - protein, 30 aa, Artificial Sequence
  Description of Artificial Sequence: Synthetic polypeptide
DEEEIRTTNPVATEQYGSVSMTDNLQRGND

SEQ ID NO: 9898 - protein, 28 aa, Artificial Sequence
  Description of Artificial Sequence: Synthetic peptide
DEEEIRTTNPVATEQYGSVSTNDERGER

SEQ ID NO: 9899 - protein, 28 aa, Artificial Sequence
  Description of Artificial Sequence: Synthetic peptide
DEEEIATTNPFATEQYGSVSTDLQRGNR

SEQ ID NO: 9900 - protein, 28 aa, Artificial Sequence
  Description of Artificial Sequence: Synthetic peptide
DEEEIATTNPVATEQYGSVSTNEQRGNE

SEQ ID NO: 9901 - protein, 30 aa, Artificial Sequence
  Description of Artificial Sequence: Synthetic polypeptide
DEEEIRTTNPVATECYGSVSTNGLQERGNR

SEQ ID NO: 9902 - protein, 28 aa, Artificial Sequence
  Description of Artificial Sequence: Synthetic peptide
DEQEIRTTNPVATEQYGSMSTNLQRGTR

SEQ ID NO: 9903 - protein, 28 aa, Artificial Sequence
  Description of Artificial Sequence: Synthetic peptide
DEEEIRTTNPVATEQYGSVSTDLQHGNW

SEQ ID NO: 9904 - protein, 30 aa, Artificial Sequence
  Description of Artificial Sequence: Synthetic polypeptide
DEEEIRTTNPVATEQYGSVSTCNPQRGENR

SEQ ID NO: 9905 - protein, 28 aa, Artificial Sequence
  Description of Artificial Sequence: Synthetic peptide
DEEEIRTTNPVATEQYGSVSTADQRGER

SEQ ID NO: 9906 - protein, 28 aa, Artificial Sequence
  Description of Artificial Sequence: Synthetic peptide
DEEEIRTTNPCATEQYGAVDTNLQRGNR

SEQ ID NO: 9907 - protein, 29 aa, Artificial Sequence
  Description of Artificial Sequence: Synthetic peptide
DEEEICTTNPVATEQYGSVSATNLQRGTR

SEQ ID NO: 9908 - protein, 28 aa, Artificial Sequence
  Description of Artificial Sequence: Synthetic peptide
DEEEIRATNPVATEMYGWVSTNLQRGNR

SEQ ID NO: 9909 - protein, 28 aa, Artificial Sequence
  Description of Artificial Sequence: Synthetic peptide
DEEEIRSTNPVASEQYGSVSTNLQRPNR

SEQ ID NO: 9910 - protein, 28 aa, Artificial Sequence
  Description of Artificial Sequence: Synthetic peptide
DEAEIRTTNPVATEMYGSVSCNLQRGNR

SEQ ID NO: 9911 - protein, 28 aa, Artificial Sequence
  Description of Artificial Sequence: Synthetic peptide
DEEEIRTTNPVATEQYGSWSDNLDRGNR

SEQ ID NO: 9912 - protein, 28 aa, Artificial Sequence
  Description of Artificial Sequence: Synthetic peptide
DEEEIRTTNPVATEQYGSVSTPLQVGNI

SEQ ID NO: 9913 - protein, 29 aa, Artificial Sequence
  Description of Artificial Sequence: Synthetic peptide
DEEEIRTTNPVATEQYGSVSATNSQRGMR

SEQ ID NO: 9914 - protein, 28 aa, Artificial Sequence
  Description of Artificial Sequence: Synthetic peptide
DEEEIRTTNPVATEQYGSVETNLEHGNR

SEQ ID NO: 9915 - protein, 30 aa, Artificial Sequence
  Description of Artificial Sequence: Synthetic polypeptide
DEEEIRTTNPVATEQYGSVDTMNLQRGNDR

SEQ ID NO: 9916 - protein, 28 aa, Artificial Sequence
  Description of Artificial Sequence: Synthetic peptide
DEEEIRTTNPVATEQYGSVDTNLQRGDG

SEQ ID NO: 9917 - protein, 28 aa, Artificial Sequence
  Description of Artificial Sequence: Synthetic peptide
DEQEIRTTNPVATEQYGSVSDNLQRGAR

SEQ ID NO: 9918 - protein, 28 aa, Artificial Sequence
  Description of Artificial Sequence: Synthetic peptide
DEEEIRTTNPVATEQYGSVETNLERGNI

SEQ ID NO: 9919 - protein, 30 aa, Artificial Sequence
  Description of Artificial Sequence: Synthetic polypeptide
DEEEIRTTNPVATEQYGSVEETNLQRGDNR

SEQ ID NO: 9920 - protein, 28 aa, Artificial Sequence
  Description of Artificial Sequence: Synthetic peptide
DDSEIRTTNPVASEQYGSVSTNLQRGNR

SEQ ID NO: 9921 - protein, 28 aa, Artificial Sequence
  Description of Artificial Sequence: Synthetic peptide
DEGEIRATNPVATEQYGGVSTNLQRGNR

SEQ ID NO: 9922 - protein, 31 aa, Artificial Sequence
  Description of Artificial Sequence: Synthetic polypeptide
DEEEIRTTNPVATEQYGSVSCTMNLQRGNDR

SEQ ID NO: 9923 - protein, 30 aa, Artificial Sequence
  Description of Artificial Sequence: Synthetic polypeptide
DEEEIRTTNPVATEQYGSVSTFNLQYRDNR

SEQ ID NO: 9924 - protein, 28 aa, Artificial Sequence
  Description of Artificial Sequence: Synthetic peptide
DEEEIRTTNPTATEQFGSVSTNWQRGNR

SEQ ID NO: 9925 - protein, 30 aa, Artificial Sequence
  Description of Artificial Sequence: Synthetic polypeptide
DEEEIRTTNPVATEQYGSVSTNLMARGDNR

SEQ ID NO: 9926 - protein, 28 aa, Artificial Sequence
  Description of Artificial Sequence: Synthetic peptide
DEEEIRTTNPTATEQYGSVSTNEQRGNN

SEQ ID NO: 9927 - protein, 28 aa, Artificial Sequence
  Description of Artificial Sequence: Synthetic peptide
DEEEIRTTNPEATEQYGSVSTNLQRENP

SEQ ID NO: 9928 - protein, 29 aa, Artificial Sequence
  Description of Artificial Sequence: Synthetic peptide
DEEEIRTTNPVATTQYGSVSTNLQIAGNR

SEQ ID NO: 9929 - protein, 28 aa, Artificial Sequence
  Description of Artificial Sequence: Synthetic peptide
DETEIASTNPVATEQYGSVSTNLQRGNR

SEQ ID NO: 9930 - protein, 28 aa, Artificial Sequence
  Description of Artificial Sequence: Synthetic peptide
MEEEIRTTNPVATEQYGSVSTNLQIGND

SEQ ID NO: 9931 - protein, 28 aa, Artificial Sequence
  Description of Artificial Sequence: Synthetic peptide
DEEEISTTNPVATEQYGSVSDELQRGNR

SEQ ID NO: 9932 - protein, 28 aa, Artificial Sequence
  Description of Artificial Sequence: Synthetic peptide
DEEEIVATNPVATEQYGWVSTNLQRGNR

SEQ ID NO: 9933 - protein, 29 aa, Artificial Sequence
  Description of Artificial Sequence: Synthetic peptide
DEEEIRTTNPVATEQYGSVSTNLQTGNDM

SEQ ID NO: 9934 - protein, 28 aa, Artificial Sequence
  Description of Artificial Sequence: Synthetic peptide
DEEEIRTTNPVATEQYGSVSTELQMGNI

SEQ ID NO: 9935 - protein, 29 aa, Artificial Sequence
  Description of Artificial Sequence: Synthetic peptide
DEEEIRTTNPVATEQWGSVSTNLQMRGNF

SEQ ID NO: 9936 - protein, 29 aa, Artificial Sequence
  Description of Artificial Sequence: Synthetic peptide
DSEEISTTNPVATEQYGSVSVTNLQRGNR

SEQ ID NO: 9937 - protein, 29 aa, Artificial Sequence
  Description of Artificial Sequence: Synthetic peptide
DEEEIRTTNPVATEQYGSVCSTNEQRGER

SEQ ID NO: 9938 - protein, 29 aa, Artificial Sequence
  Description of Artificial Sequence: Synthetic peptide
DEEEIRCTNPVATEQYGSVSTNLQRGNFL

SEQ ID NO: 9939 - protein, 28 aa, Artificial Sequence
  Description of Artificial Sequence: Synthetic peptide
DEEEIRTTNPVATEQYGSVSTCDQRGNS

SEQ ID NO: 9940 - protein, 28 aa, Artificial Sequence
  Description of Artificial Sequence: Synthetic peptide
DEEEIRTTNPVATEQYGSVETNLQDGNF

SEQ ID NO: 9941 - protein, 28 aa, Artificial Sequence
  Description of Artificial Sequence: Synthetic peptide
DEEEIRTTNPVATEQYGSVSTNFNRGNG

SEQ ID NO: 9942 - protein, 28 aa, Artificial Sequence
  Description of Artificial Sequence: Synthetic peptide
DEEEIRTTNPAATEQYGSVSDNLQRGNG

SEQ ID NO: 9943 - protein, 29 aa, Artificial Sequence
  Description of Artificial Sequence: Synthetic peptide
DEEEIRTTNPVATEQYGSVSTNLQLGNDN

SEQ ID NO: 9944 - protein, 28 aa, Artificial Sequence
  Description of Artificial Sequence: Synthetic peptide
DEEEIRTTNPMATEQYGSVSEALQRGNR

SEQ ID NO: 9945 - protein, 28 aa, Artificial Sequence
  Description of Artificial Sequence: Synthetic peptide
DEEEIRTTNPVATEQYGSVSTNEERGDR

SEQ ID NO: 9946 - protein, 28 aa, Artificial Sequence
  Description of Artificial Sequence: Synthetic peptide
AEEEIRTTNPVATEQYGSVSENLQRGER

SEQ ID NO: 9947 - protein, 31 aa, Artificial Sequence
  Description of Artificial Sequence: Synthetic polypeptide
DEEEIRTTNPVATEQYGQSVSTNYLQRGGNR

SEQ ID NO: 9948 - protein, 30 aa, Artificial Sequence
  Description of Artificial Sequence: Synthetic polypeptide
DEEEIRTTNPVATEQYGSVSTNLQERGANE

SEQ ID NO: 9949 - protein, 28 aa, Artificial Sequence
  Description of Artificial Sequence: Synthetic peptide
DEEEIRTTNPIATEQYGSVSTNLERGNE

SEQ ID NO: 9950 - protein, 28 aa, Artificial Sequence
  Description of Artificial Sequence: Synthetic peptide
DEESIRTTNPVATEQYGSVSTLLMRGNR

SEQ ID NO: 9951 - protein, 31 aa, Artificial Sequence
  Description of Artificial Sequence: Synthetic polypeptide
DEEEIRTTNPVATEQYGSVSTNPLQREGENR

SEQ ID NO: 9952 - protein, 30 aa, Artificial Sequence
  Description of Artificial Sequence: Synthetic polypeptide
DEEEIRTTNPVATEQYGSVSITNLQRENHR

SEQ ID NO: 9953 - protein, 28 aa, Artificial Sequence
  Description of Artificial Sequence: Synthetic peptide
DEEEIRTTNPVATEQYGSVSTTLQREER

SEQ ID NO: 9954 - protein, 29 aa, Artificial Sequence
  Description of Artificial Sequence: Synthetic peptide
DEEEIRATNPVATEQYGDVSATNLQRGNR

SEQ ID NO: 9955 - protein, 28 aa, Artificial Sequence
  Description of Artificial Sequence: Synthetic peptide
DEEEIRTTNPVATEQYGSVSTDLQHGER

SEQ ID NO: 9956 - protein, 29 aa, Artificial Sequence
  Description of Artificial Sequence: Synthetic peptide
SEEEIRTTNPVATELYGSVSTNLPQRGNR

SEQ ID NO: 9957 - protein, 28 aa, Artificial Sequence
  Description of Artificial Sequence: Synthetic peptide
DEEEIGTTNPVATEQFGSVSTALQRGNR

SEQ ID NO: 9958 - protein, 28 aa, Artificial Sequence
  Description of Artificial Sequence: Synthetic peptide
DEEEIRTTNPVATEQYGSWSTNPQRGNG

SEQ ID NO: 9959 - protein, 28 aa, Artificial Sequence
  Description of Artificial Sequence: Synthetic peptide
DEEEIRTTNPVSTEIYGSCSTNLQRGNR

SEQ ID NO: 9960 - protein, 28 aa, Artificial Sequence
  Description of Artificial Sequence: Synthetic peptide
DEEEIRTTNPVATEQYGSVDENLQWGNR

SEQ ID NO: 9961 - protein, 30 aa, Artificial Sequence
  Description of Artificial Sequence: Synthetic polypeptide
DEEEIRTTNPVATEMYGSVSTMNLQRGNTR

SEQ ID NO: 9962 - protein, 29 aa, Artificial Sequence
  Description of Artificial Sequence: Synthetic peptide
DEEEIRTTNPVATEQYGDVSTMNLQNGNR

SEQ ID NO: 9963 - protein, 29 aa, Artificial Sequence
  Description of Artificial Sequence: Synthetic peptide
DEEEIRATNPVATEQYGSVSTNLPQRGDR

SEQ ID NO: 9964 - protein, 28 aa, Artificial Sequence
  Description of Artificial Sequence: Synthetic peptide
DEEEIRTTNPVATEQYGSVSTNLQIDNW

SEQ ID NO: 9965 - protein, 28 aa, Artificial Sequence
  Description of Artificial Sequence: Synthetic peptide
DEEEIRTTNPVATEQYGSVSTNLQDGEA

SEQ ID NO: 9966 - protein, 28 aa, Artificial Sequence
  Description of Artificial Sequence: Synthetic peptide
DEEEIATTNPVASEQYGLVSTNLQRGNR

SEQ ID NO: 9967 - protein, 28 aa, Artificial Sequence
  Description of Artificial Sequence: Synthetic peptide
DEEEIATTNPVATEQYGSVSTNLERGNL

SEQ ID NO: 9968 - protein, 29 aa, Artificial Sequence
  Description of Artificial Sequence: Synthetic peptide
DEEEIATTNPVATEQYGSVSATNLQRGGR

SEQ ID NO: 9969 - protein, 28 aa, Artificial Sequence
  Description of Artificial Sequence: Synthetic peptide
KEEEIRTTNPVATEQYGSVFTNLQRGER

SEQ ID NO: 9970 - protein, 28 aa, Artificial Sequence
  Description of Artificial Sequence: Synthetic peptide
DEEEIRTTNPVATEQWGCVSTNLQRPNR

SEQ ID NO: 9971 - protein, 28 aa, Artificial Sequence
  Description of Artificial Sequence: Synthetic peptide
DEEEIRTTNPVATFQYGSVSTNLERGNP

SEQ ID NO: 9972 - protein, 28 aa, Artificial Sequence
  Description of Artificial Sequence: Synthetic peptide
DEEEIVTTNPVATELYGTVSTNLQRGNR

SEQ ID NO: 9973 - protein, 28 aa, Artificial Sequence
  Description of Artificial Sequence: Synthetic peptide
DEEEIRTTNPEATEQFGSVSTNWQRGNR

SEQ ID NO: 9974 - protein, 28 aa, Artificial Sequence
  Description of Artificial Sequence: Synthetic peptide
DEEEIRTTNPVATEQYGSVSTNVQWGNE

SEQ ID NO: 9975 - protein, 28 aa, Artificial Sequence
  Description of Artificial Sequence: Synthetic peptide
DEEEIRTTNPVATEIYGSVSTNLQRGEC

SEQ ID NO: 9976 - protein, 28 aa, Artificial Sequence
  Description of Artificial Sequence: Synthetic peptide
DEEEIRCTNPVATEQYGSVHTNLQRGNS

SEQ ID NO: 9977 - protein, 28 aa, Artificial Sequence
  Description of Artificial Sequence: Synthetic peptide
DEEEIRTTNPVATEQYGSVDTNDQRGNH

SEQ ID NO: 9978 - protein, 28 aa, Artificial Sequence
  Description of Artificial Sequence: Synthetic peptide
DEEEIRTVNPVATEQYGSMSTNLQRGDR

SEQ ID NO: 9979 - protein, 30 aa, Artificial Sequence
  Description of Artificial Sequence: Synthetic polypeptide
DEEEIRTTNPVATEQYGSVSGNLQTRGNVR

SEQ ID NO: 9980 - protein, 28 aa, Artificial Sequence
  Description of Artificial Sequence: Synthetic peptide
HEEEIRTTNPVATEQYGSASTNIQRGNR

SEQ ID NO: 9981 - protein, 28 aa, Artificial Sequence
  Description of Artificial Sequence: Synthetic peptide
DEEEIRTTNPVATEQYGSVSTDLQPGNY

SEQ ID NO: 9982 - protein, 29 aa, Artificial Sequence
  Description of Artificial Sequence: Synthetic peptide
DEEEIRTTNPVATEQYGSVSTENLEVGNR

SEQ ID NO: 9983 - protein, 28 aa, Artificial Sequence
  Description of Artificial Sequence: Synthetic peptide
DEEEIRTTNPVATEQWGSVSTELQRGNM

SEQ ID NO: 9984 - protein, 29 aa, Artificial Sequence
  Description of Artificial Sequence: Synthetic peptide
DEEEIRTTNPVATEQYGSVDSTNDQRGNP

SEQ ID NO: 9985 - protein, 28 aa, Artificial Sequence
  Description of Artificial Sequence: Synthetic peptide
DEEEIRTTNPVATEQYGSVDTNLERGDR

SEQ ID NO: 9986 - protein, 29 aa, Artificial Sequence
  Description of Artificial Sequence: Synthetic peptide
DEEEIRTTNPVATEQYGSVSTNLQNGDNS

SEQ ID NO: 9987 - protein, 28 aa, Artificial Sequence
  Description of Artificial Sequence: Synthetic peptide
DEMEIRTTNPVATEQYGDVSENLQRGNR

SEQ ID NO: 9988 - protein, 28 aa, Artificial Sequence
  Description of Artificial Sequence: Synthetic peptide
DEEEIVTTNPVATEQYGWVSTNLQRGNC

SEQ ID NO: 9989 - protein, 28 aa, Artificial Sequence
  Description of Artificial Sequence: Synthetic peptide
DEEEIRTTNPVATEQYGSVSTNEQNGNV

SEQ ID NO: 9990 - protein, 28 aa, Artificial Sequence
  Description of Artificial Sequence: Synthetic peptide
DEEEIRTTNPVATEQYGSVSTNLQMGEV

SEQ ID NO: 9991 - protein, 29 aa, Artificial Sequence
  Description of Artificial Sequence: Synthetic peptide
DPEEIRTTNPVATEQYGSVSTNLDERGNR

SEQ ID NO: 9992 - protein, 31 aa, Artificial Sequence
  Description of Artificial Sequence: Synthetic polypeptide
DEEEIRTTNPVATEQYGSVSTENLQDRGDNR

SEQ ID NO: 9993 - protein, 29 aa, Artificial Sequence
  Description of Artificial Sequence: Synthetic peptide
DEEEIRTTNPVATEQYGSVSTNLQIGNDI

SEQ ID NO: 9994 - protein, 28 aa, Artificial Sequence
  Description of Artificial Sequence: Synthetic peptide
DEEEITTTNPVATEQYGSVSTNLQLGNA

SEQ ID NO: 9995 - protein, 28 aa, Artificial Sequence
  Description of Artificial Sequence: Synthetic peptide
DEEEIRTTNPVATEQYGQVSTCLQRGNA

SEQ ID NO: 9996 - protein, 29 aa, Artificial Sequence
  Description of Artificial Sequence: Synthetic peptide
DEVEIRTTNPVATEQYGDVSTNLQRGNDR

SEQ ID NO: 9997 - protein, 28 aa, Artificial Sequence
  Description of Artificial Sequence: Synthetic peptide
DEEEIRTTNPVATEVYGCVGTNLQRGNR

SEQ ID NO: 9998 - protein, 29 aa, Artificial Sequence
  Description of Artificial Sequence: Synthetic peptide
DEEEIRTTNPVATEQYGSVSTNLCCTGNR

SEQ ID NO: 9999 - protein, 30 aa, Artificial Sequence
  Description of Artificial Sequence: Synthetic polypeptide
DEEEIRTTNPVATEQYGSVISTNLQQGINR

SEQ ID NO: 10000 - protein, 28 aa, Artificial Sequence
  Description of Artificial Sequence: Synthetic peptide
DEEEIRCTNPVATEVYGSVSMNLQRGNR

SEQ ID NO: 10001 - protein, 29 aa, Artificial Sequence
  Description of Artificial Sequence: Synthetic peptide
DEHEIRTTNPVATEQYGSVSTMNLQRGTR

SEQ ID NO: 10002 - protein, 29 aa, Artificial Sequence
  Description of Artificial Sequence: Synthetic peptide
DEEEIATTNPVATEQYGSVSTNLQERGDR

SEQ ID NO: 10003 - protein, 31 aa, Artificial Sequence
  Description of Artificial Sequence: Synthetic polypeptide
DEEEIRTTNPVATEQYGSSYVSTNLVQRGNR

SEQ ID NO: 10004 - protein, 28 aa, Artificial Sequence
  Description of Artificial Sequence: Synthetic peptide
DEEEIRTTNPVATEQYGVVSTNLQVGND

SEQ ID NO: 10005 - protein, 28 aa, Artificial Sequence
  Description of Artificial Sequence: Synthetic peptide
DEEEIRTTNPVATEQYGSVDTNDQRGNF

SEQ ID NO: 10006 - protein, 30 aa, Artificial Sequence
  Description of Artificial Sequence: Synthetic polypeptide
DEEEIRTTNPDATEQYGSVSTPNLQRGNDR

SEQ ID NO: 10007 - protein, 29 aa, Artificial Sequence
  Description of Artificial Sequence: Synthetic peptide
DEEEIRTTNPVATEQYGSVSTNLQEQGNM

SEQ ID NO: 10008 - protein, 28 aa, Artificial Sequence
  Description of Artificial Sequence: Synthetic peptide
DEEVIRTTNPVATEQYWSVSTNLQRGNN

SEQ ID NO: 10009 - protein, 28 aa, Artificial Sequence
  Description of Artificial Sequence: Synthetic peptide
DEEEIATTNPVATECYGSVSTNLERGNR

SEQ ID NO: 10010 - protein, 30 aa, Artificial Sequence
  Description of Artificial Sequence: Synthetic polypeptide
DEESIRTTNPVATEQYGSVSTNPLQRGDNR

SEQ ID NO: 10011 - protein, 28 aa, Artificial Sequence
  Description of Artificial Sequence: Synthetic peptide
DMEEIRTTNPVATEQYGSSSTNLQRGNN

SEQ ID NO: 10012 - protein, 28 aa, Artificial Sequence
  Description of Artificial Sequence: Synthetic peptide
DEEEIRTTNPVATEQYGSVSTPLQIGER

SEQ ID NO: 10013 - protein, 29 aa, Artificial Sequence
  Description of Artificial Sequence: Synthetic peptide
DEEEIRTTNPVCTEQYGSVSTNGLQRGNI

SEQ ID NO: 10014 - protein, 28 aa, Artificial Sequence
  Description of Artificial Sequence: Synthetic peptide
DEEEIRTTNPVSTETYGSVSTNLQRLNR

SEQ ID NO: 10015 - protein, 29 aa, Artificial Sequence
  Description of Artificial Sequence: Synthetic peptide
YEEEIRTTNPVATEQYGSVYTNLEQRGNR

SEQ ID NO: 10016 - protein, 28 aa, Artificial Sequence
  Description of Artificial Sequence: Synthetic peptide
DEEEIRTTNPVASEQYGSVSTNLQPGNA

SEQ ID NO: 10017 - protein, 28 aa, Artificial Sequence
  Description of Artificial Sequence: Synthetic peptide
DEEEIRTTNPFATEQYGSVSTNPDRGNR

SEQ ID NO: 10018 - protein, 30 aa, Artificial Sequence
  Description of Artificial Sequence: Synthetic polypeptide
DEEEIRTTNPVATEQYGSVSTMNLERGINR

SEQ ID NO: 10019 - protein, 28 aa, Artificial Sequence
  Description of Artificial Sequence: Synthetic peptide
NEEEIRTVNPVATEQYGSVSTNLQRLNR

SEQ ID NO: 10020 - protein, 30 aa, Artificial Sequence
  Description of Artificial Sequence: Synthetic polypeptide
DEEEIRTTNPVATEQYGSVDCTMNLQRGNR

SEQ ID NO: 10021 - protein, 30 aa, Artificial Sequence
  Description of Artificial Sequence: Synthetic polypeptide
DEYEIRTTNPVATEQYGSVSTNGLQRSGNR

SEQ ID NO: 10022 - protein, 28 aa, Artificial Sequence
  Description of Artificial Sequence: Synthetic peptide
MEEEIRTTNPVATEQYGSVSTNLQNGER

SEQ ID NO: 10023 - protein, 29 aa, Artificial Sequence
  Description of Artificial Sequence: Synthetic peptide
DEEEIRTTNPVASEIYGSVSATNLQRGNR

SEQ ID NO: 10024 - protein, 28 aa, Artificial Sequence
  Description of Artificial Sequence: Synthetic peptide
DEEEIRTTNPEATEQYGSVSTNLQGGNF

SEQ ID NO: 10025 - protein, 28 aa, Artificial Sequence
  Description of Artificial Sequence: Synthetic peptide
DEEEIRATNPVATEHYGTVSTNLQRGNR

SEQ ID NO: 10026 - protein, 28 aa, Artificial Sequence
  Description of Artificial Sequence: Synthetic peptide
DEEEIRTTNPVATEQYGSVSTNLEPGNE

SEQ ID NO: 10027 - protein, 29 aa, Artificial Sequence
  Description of Artificial Sequence: Synthetic peptide
DEEEIRTTNPVATEQYGSVSTNLEDRGNE

SEQ ID NO: 10028 - protein, 29 aa, Artificial Sequence
  Description of Artificial Sequence: Synthetic peptide
DEEEIRTTNPVATEQYGGCSTNLQSRGNR

SEQ ID NO: 10029 - protein, 28 aa, Artificial Sequence
  Description of Artificial Sequence: Synthetic peptide
DEEEIRCTNPVATEQYGYVSTNLQHGNR

SEQ ID NO: 10030 - protein, 28 aa, Artificial Sequence
  Description of Artificial Sequence: Synthetic peptide
QEEEIRTTNPVATEQYGSVSTDLQRGNH

SEQ ID NO: 10031 - protein, 29 aa, Artificial Sequence
  Description of Artificial Sequence: Synthetic peptide
DEEEIRTTNPVATEQYGFVSLTNLQDGNR

SEQ ID NO: 10032 - protein, 30 aa, Artificial Sequence
  Description of Artificial Sequence: Synthetic polypeptide
DEEEIRTTNPVATEQYGSVSTNLQLDGNDR

SEQ ID NO: 10033 - protein, 28 aa, Artificial Sequence
  Description of Artificial Sequence: Synthetic peptide
QEEEIRTTNPVSTEQYGSASTNLQRGNR

SEQ ID NO: 10034 - protein, 28 aa, Artificial Sequence
  Description of Artificial Sequence: Synthetic peptide
DENEIRQTNPVATEQYGSVSTNLQRGNL

SEQ ID NO: 10035 - protein, 29 aa, Artificial Sequence
  Description of Artificial Sequence: Synthetic peptide
YEEEIRTTNPVATEQYGSVSTNWQRGNDR

SEQ ID NO: 10036 - protein, 28 aa, Artificial Sequence
  Description of Artificial Sequence: Synthetic peptide
DEEEIRTTNPVATEQYGSVSTDLEDGNR

SEQ ID NO: 10037 - protein, 29 aa, Artificial Sequence
  Description of Artificial Sequence: Synthetic peptide
DEEEIRTTNPVATEIYGSVSTELQERGNR

SEQ ID NO: 10038 - protein, 28 aa, Artificial Sequence
  Description of Artificial Sequence: Synthetic peptide
DEEEIRTTNPVATEQYGSVSTNPQFGNN

SEQ ID NO: 10039 - protein, 29 aa, Artificial Sequence
  Description of Artificial Sequence: Synthetic peptide
DEEEIRTTNPVAWEQYGSVCTNMLQRGNR

SEQ ID NO: 10040 - protein, 29 aa, Artificial Sequence
  Description of Artificial Sequence: Synthetic peptide
DEEEIRTTNPFATEQYGSVSTNLQLPGNR

SEQ ID NO: 10041 - protein, 28 aa, Artificial Sequence
  Description of Artificial Sequence: Synthetic peptide
DEEEIRTTNPVATEQYGVWSTNLQRGER

SEQ ID NO: 10042 - protein, 28 aa, Artificial Sequence
  Description of Artificial Sequence: Synthetic peptide
DEEEIRTTNPVATEQYGSVQTNDQYGNR

SEQ ID NO: 10043 - protein, 28 aa, Artificial Sequence
  Description of Artificial Sequence: Synthetic peptide
DENEIRTTNPVATEQYGSVSENEQRGNR

SEQ ID NO: 10044 - protein, 28 aa, Artificial Sequence
  Description of Artificial Sequence: Synthetic peptide
DEEEIRCTNPVATEQYGCVSMNLQRGNR

SEQ ID NO: 10045 - protein, 30 aa, Artificial Sequence
  Description of Artificial Sequence: Synthetic polypeptide
DEEEIRTTNPVATEQYGSVDSITNEQRGNR

SEQ ID NO: 10046 - protein, 28 aa, Artificial Sequence
  Description of Artificial Sequence: Synthetic peptide
DEEEIRTTNPVATEQYGSVSTNLQGGET

SEQ ID NO: 10047 - protein, 28 aa, Artificial Sequence
  Description of Artificial Sequence: Synthetic peptide
DEGEIRTTNPVASELYGSVSTNLQRGNR

SEQ ID NO: 10048 - protein, 28 aa, Artificial Sequence
  Description of Artificial Sequence: Synthetic peptide
DEEEIRTTNPVATQQYGSVSTNDQNGNR

SEQ ID NO: 10049 - protein, 29 aa, Artificial Sequence
  Description of Artificial Sequence: Synthetic peptide
DEEEIRTTNPVATEQYGSVSTNEQMTGNR

SEQ ID NO: 10050 - protein, 28 aa, Artificial Sequence
  Description of Artificial Sequence: Synthetic peptide
NESEIRTVNPVATEQYGSVSTNLQRGNR

SEQ ID NO: 10051 - protein, 28 aa, Artificial Sequence
  Description of Artificial Sequence: Synthetic peptide
DEEEIRTTNPVATEQYGSVSTELQVGNV

SEQ ID NO: 10052 - protein, 28 aa, Artificial Sequence
  Description of Artificial Sequence: Synthetic peptide
DEEEIDTTNPVATEQYGSVSTNLQNGNA

SEQ ID NO: 10053 - protein, 28 aa, Artificial Sequence
  Description of Artificial Sequence: Synthetic peptide
DEEEIRTTNPFATEQYGSVSTNLQPGWR

SEQ ID NO: 10054 - protein, 28 aa, Artificial Sequence
  Description of Artificial Sequence: Synthetic peptide
DEGEVRTTNPVATEGYGSVSTNLQRGNR

SEQ ID NO: 10055 - protein, 28 aa, Artificial Sequence
  Description of Artificial Sequence: Synthetic peptide
DEEEIRTTNPEATEQYGSVSTNLEIGNR

SEQ ID NO: 10056 - protein, 30 aa, Artificial Sequence
  Description of Artificial Sequence: Synthetic polypeptide
DEEEIRQTNPVATEQYGSVSTNLPQMRGNR

SEQ ID NO: 10057 - protein, 28 aa, Artificial Sequence
  Description of Artificial Sequence: Synthetic peptide
DEEEIRTTNPVATEQYGSVSENLHRYNR

SEQ ID NO: 10058 - protein, 28 aa, Artificial Sequence
  Description of Artificial Sequence: Synthetic peptide
DEEEIACTNPVATEIYGSVSTNLQRGNR

SEQ ID NO: 10059 - protein, 31 aa, Artificial Sequence
  Description of Artificial Sequence: Synthetic polypeptide
DEEEIRTTNPVATEQYGSVSTNLVQRGDNPR

SEQ ID NO: 10060 - protein, 28 aa, Artificial Sequence
  Description of Artificial Sequence: Synthetic peptide
DEEIIRTTNPVATEQYGSVSTNNQQGNR

SEQ ID NO: 10061 - protein, 28 aa, Artificial Sequence
  Description of Artificial Sequence: Synthetic peptide
DEEEIRSTNPVSTEQYGSASTNLQRGNR

SEQ ID NO: 10062 - protein, 28 aa, Artificial Sequence
  Description of Artificial Sequence: Synthetic peptide
DEEEIRTTNPVATEQYGSVSTNLQHGDT

SEQ ID NO: 10063 - protein, 30 aa, Artificial Sequence
  Description of Artificial Sequence: Synthetic polypeptide
DEEEIRTTNPVATEQYGSVSTNLQAEGNDR

SEQ ID NO: 10064 - protein, 28 aa, Artificial Sequence
  Description of Artificial Sequence: Synthetic peptide
DEEEIRTTNPEATEQYGSVSTNLDNGNR

SEQ ID NO: 10065 - protein, 28 aa, Artificial Sequence
  Description of Artificial Sequence: Synthetic peptide
DEEEIRTTNPDAYEQYGSVSTNLQRGND

SEQ ID NO: 10066 - protein, 29 aa, Artificial Sequence
  Description of Artificial Sequence: Synthetic peptide
DEEEIRATNPVATEQYGSVDWTNLQRGNR

SEQ ID NO: 10067 - protein, 29 aa, Artificial Sequence
  Description of Artificial Sequence: Synthetic peptide
DEQEIRTTNPVATEQYGSVSLTNLQRGNP

SEQ ID NO: 10068 - protein, 29 aa, Artificial Sequence
  Description of Artificial Sequence: Synthetic peptide
DCEEIRTTNPVATEQYGSVSTNLQPGYNR

SEQ ID NO: 10069 - protein, 30 aa, Artificial Sequence
  Description of Artificial Sequence: Synthetic polypeptide
DEEEIRTTNPVATEQYGSVSTEPLQERGNR

SEQ ID NO: 10070 - protein, 28 aa, Artificial Sequence
  Description of Artificial Sequence: Synthetic peptide
NEEEISTTNPVATEQYGSVSTNLQRENR

SEQ ID NO: 10071 - protein, 28 aa, Artificial Sequence
  Description of Artificial Sequence: Synthetic peptide
QENEIRTTNPVATEQYGVVSTNLQRGNR

SEQ ID NO: 10072 - protein, 31 aa, Artificial Sequence
  Description of Artificial Sequence: Synthetic polypeptide
DEEEIRTTNPVATEQYGSVDSDTNLQRGNER

SEQ ID NO: 10073 - protein, 30 aa, Artificial Sequence
  Description of Artificial Sequence: Synthetic polypeptide
DEEEITTTNPVATEQYGSVSATNLQRGNDR

SEQ ID NO: 10074 - protein, 28 aa, Artificial Sequence
  Description of Artificial Sequence: Synthetic peptide
DEEEIRTTNPVATEQYGSVSTNLQHGES

SEQ ID NO: 10075 - protein, 28 aa, Artificial Sequence
  Description of Artificial Sequence: Synthetic peptide
DEEEIRTTNPVATEQYGSVSTDLQGGDR

SEQ ID NO: 10076 - protein, 28 aa, Artificial Sequence
  Description of Artificial Sequence: Synthetic peptide
DESEIRTTNPVATEIYGSVATNLQRGNR

SEQ ID NO: 10077 - protein, 28 aa, Artificial Sequence
  Description of Artificial Sequence: Synthetic peptide
DEEEIRTTNPVATECYGSVSTNLERGNL

SEQ ID NO: 10078 - protein, 28 aa, Artificial Sequence
  Description of Artificial Sequence: Synthetic peptide
DESEIRTTNPVCTEQYGSVSTNLQRGNC

SEQ ID NO: 10079 - protein, 28 aa, Artificial Sequence
  Description of Artificial Sequence: Synthetic peptide
VEEEVRTTNPVATEQYGSVSNNLQRGNR

SEQ ID NO: 10080 - protein, 28 aa, Artificial Sequence
  Description of Artificial Sequence: Synthetic peptide
DEECIRTTNPFATEQYGSVSTNPQRGNR

SEQ ID NO: 10081 - protein, 29 aa, Artificial Sequence
  Description of Artificial Sequence: Synthetic peptide
DEEEIRTTNPVATEQYGSVSTNLQEVGNE

SEQ ID NO: 10082 - protein, 29 aa, Artificial Sequence
  Description of Artificial Sequence: Synthetic peptide
DEEEIATTNPVATEQYGSVSADNLQRGNR

SEQ ID NO: 10083 - protein, 28 aa, Artificial Sequence
  Description of Artificial Sequence: Synthetic peptide
DEEEIRTTNPVATEQYGSASTCLQRENR

SEQ ID NO: 10084 - protein, 28 aa, Artificial Sequence
  Description of Artificial Sequence: Synthetic peptide
DDEEIRTTNPIATEMYGSVSTNLQRGNR

SEQ ID NO: 10085 - protein, 28 aa, Artificial Sequence
  Description of Artificial Sequence: Synthetic peptide
DEEEIRATNPEATEQYGSVSTNLQRGNG

SEQ ID NO: 10086 - protein, 28 aa, Artificial Sequence
  Description of Artificial Sequence: Synthetic peptide
DEEEIRTTNPVATEQYGSVSTNLEQGNE

SEQ ID NO: 10087 - protein, 28 aa, Artificial Sequence
  Description of Artificial Sequence: Synthetic peptide
DEEEIRTTNPVASEQYGSVSTQLQRNNR

SEQ ID NO: 10088 - protein, 29 aa, Artificial Sequence
  Description of Artificial Sequence: Synthetic peptide
CEEEIRTTNPVATEIYGSVSATNLQRGNR

SEQ ID NO: 10089 - protein, 28 aa, Artificial Sequence
  Description of Artificial Sequence: Synthetic peptide
DEEEIRTTNPEATEQYGSVSTNLQRENF

SEQ ID NO: 10090 - protein, 29 aa, Artificial Sequence
  Description of Artificial Sequence: Synthetic peptide
DEEEIRTTNPVATEQYGSVSTDLQRGEDR

SEQ ID NO: 10091 - protein, 29 aa, Artificial Sequence
  Description of Artificial Sequence: Synthetic peptide
DEEEIRTTNPFATEQYGSVSTMNLQAGNR

SEQ ID NO: 10092 - protein, 28 aa, Artificial Sequence
  Description of Artificial Sequence: Synthetic peptide
DEEEIRTVNPVATEQYGSVSTNLQREER

SEQ ID NO: 10093 - protein, 29 aa, Artificial Sequence
  Description of Artificial Sequence: Synthetic peptide
DEEEIRTTNPVATEQYGSVSENLQERGER

SEQ ID NO: 10094 - protein, 30 aa, Artificial Sequence
  Description of Artificial Sequence: Synthetic polypeptide
DEEEIRTTNPVATEQYGSVSTNLEVRGNDR

SEQ ID NO: 10095 - protein, 29 aa, Artificial Sequence
  Description of Artificial Sequence: Synthetic peptide
DLEEIRTTNPVAWEQYGSVSTNGLQRGNR

SEQ ID NO: 10096 - protein, 28 aa, Artificial Sequence
  Description of Artificial Sequence: Synthetic peptide
DEEAIRTTNLVATEQYGSVSTNLQEGNR

SEQ ID NO: 10097 - protein, 30 aa, Artificial Sequence
  Description of Artificial Sequence: Synthetic polypeptide
DEEEIRTTNPVATEQYGSVSCTMNLQRGNT

SEQ ID NO: 10098 - protein, 28 aa, Artificial Sequence
  Description of Artificial Sequence: Synthetic peptide
DEEEIRTVNPVATEGYGSVGTNLQRGNR

SEQ ID NO: 10099 - protein, 31 aa, Artificial Sequence
  Description of Artificial Sequence: Synthetic polypeptide
DEEEIRTTNPVATEQYGSVDSVTNPLQRGNR

SEQ ID NO: 10100 - protein, 29 aa, Artificial Sequence
  Description of Artificial Sequence: Synthetic peptide
DENEIRTTNPVATEQYGSASATNLQRGNR

SEQ ID NO: 10101 - protein, 30 aa, Artificial Sequence
  Description of Artificial Sequence: Synthetic polypeptide
DEEEIRTTNPVATEQYGSVETNLQREGENR

SEQ ID NO: 10102 - protein, 30 aa, Artificial Sequence
  Description of Artificial Sequence: Synthetic polypeptide
DEEEIATTNPVATEQYGSVASTNLQRGENR

SEQ ID NO: 10103 - protein, 28 aa, Artificial Sequence
  Description of Artificial Sequence: Synthetic peptide
DEEEIRTTNPVATEQYGFVSTNLQQGNC

SEQ ID NO: 10104 - protein, 28 aa, Artificial Sequence
  Description of Artificial Sequence: Synthetic peptide
DEEEIRTTNPVATEQYGSVSTDLQYGND

SEQ ID NO: 10105 - protein, 29 aa, Artificial Sequence
  Description of Artificial Sequence: Synthetic peptide
DEEEIRTTNPEATEQYGSVSTNLQVRGND

SEQ ID NO: 10106 - protein, 28 aa, Artificial Sequence
  Description of Artificial Sequence: Synthetic peptide
DEEEIRTTNPVATEQYGSVSTPLQWGER

SEQ ID NO: 10107 - protein, 28 aa, Artificial Sequence
  Description of Artificial Sequence: Synthetic peptide
DEIEIRTTNPVATEQYGSVSTNLQRGEW

SEQ ID NO: 10108 - protein, 30 aa, Artificial Sequence
  Description of Artificial Sequence: Synthetic polypeptide
DEEEIRTTNPDATEQYGSVSTNNLQRGNDR

SEQ ID NO: 10109 - protein, 28 aa, Artificial Sequence
  Description of Artificial Sequence: Synthetic peptide
DEEEIRTTNPTATEQYGSVSTNPQRGNQ

SEQ ID NO: 10110 - protein, 28 aa, Artificial Sequence
  Description of Artificial Sequence: Synthetic peptide
DEEEIRTTNPVATDQYGSVFTNLQRGPR

SEQ ID NO: 10111 - protein, 30 aa, Artificial Sequence
  Description of Artificial Sequence: Synthetic polypeptide
DEEEIRTTNPVATEQYGSVSGNLQTRGNNR

SEQ ID NO: 10112 - protein, 28 aa, Artificial Sequence
  Description of Artificial Sequence: Synthetic peptide
DEEEIRTTNPDATEQYGSVSTPEQRGNR

SEQ ID NO: 10113 - protein, 28 aa, Artificial Sequence
  Description of Artificial Sequence: Synthetic peptide
DEEEIRTTNPVATEQYGSVSTNLQNGET

SEQ ID NO: 10114 - protein, 30 aa, Artificial Sequence
  Description of Artificial Sequence: Synthetic polypeptide
DEEEIRTTNPVATEQYGSVSTELQIRKGNR

SEQ ID NO: 10115 - protein, 31 aa, Artificial Sequence
  Description of Artificial Sequence: Synthetic polypeptide
DEEEIRTTNPVATEQYGSVESETNLQRGENR

SEQ ID NO: 10116 - protein, 28 aa, Artificial Sequence
  Description of Artificial Sequence: Synthetic peptide
AEAEIRTTNPVASEQYGSVSTNLQRGNR

SEQ ID NO: 10117 - protein, 28 aa, Artificial Sequence
  Description of Artificial Sequence: Synthetic peptide
DEEEIRTTNPVATEQYGSVSTNLQAGDN

SEQ ID NO: 10118 - protein, 30 aa, Artificial Sequence
  Description of Artificial Sequence: Synthetic polypeptide
DEEEIRTTNPVATEQYGSVSTMDLQRGNDR

SEQ ID NO: 10119 - protein, 29 aa, Artificial Sequence
  Description of Artificial Sequence: Synthetic peptide
DEPEIRTTNPVATEQYGSVTSTNLQRGNE

SEQ ID NO: 10120 - protein, 28 aa, Artificial Sequence
  Description of Artificial Sequence: Synthetic peptide
DEEEIRTTNPVATEQYGCVSTGLQVGNR

SEQ ID NO: 10121 - protein, 28 aa, Artificial Sequence
  Description of Artificial Sequence: Synthetic peptide
DEMEIRTTNPVATEQYGSVSENLQRGQR

SEQ ID NO: 10122 - protein, 28 aa, Artificial Sequence
  Description of Artificial Sequence: Synthetic peptide
DEEEIRTTNPVATEQYGSVDTNLERGNQ

SEQ ID NO: 10123 - protein, 28 aa, Artificial Sequence
  Description of Artificial Sequence: Synthetic peptide
DEEEIRTTNPVATEQYGSVETDDQRGNR

SEQ ID NO: 10124 - protein, 30 aa, Artificial Sequence
  Description of Artificial Sequence: Synthetic polypeptide
DEEEIRTTNPVATEQYGSVSETVELQRGNR

SEQ ID NO: 10125 - protein, 29 aa, Artificial Sequence
  Description of Artificial Sequence: Synthetic peptide
DEEEIRTTNPVATEQYGSVSTNLQEQGDR

SEQ ID NO: 10126 - protein, 28 aa, Artificial Sequence
  Description of Artificial Sequence: Synthetic peptide
DEEEIRSTNPVATEVYGVVSTNLQRGNR

SEQ ID NO: 10127 - protein, 28 aa, Artificial Sequence
  Description of Artificial Sequence: Synthetic peptide
DEEEIRTTNPYATEQYGSVSTNLQRGDP

SEQ ID NO: 10128 - protein, 30 aa, Artificial Sequence
  Description of Artificial Sequence: Synthetic polypeptide
DEEEIRTTNPVATEQYGSVSTVNLQSTGNR

SEQ ID NO: 10129 - protein, 30 aa, Artificial Sequence
  Description of Artificial Sequence: Synthetic polypeptide
DEEEIRTTNPVATEQYGSVDSTTNLQVGNR

SEQ ID NO: 10130 - protein, 28 aa, Artificial Sequence
  Description of Artificial Sequence: Synthetic peptide
DEEEIRTTNPVAGEQYGSVHTNLQRGND

SEQ ID NO: 10131 - protein, 29 aa, Artificial Sequence
  Description of Artificial Sequence: Synthetic peptide
DEEEIRTTNPVATEQYGSVDTNLQEHGNR

SEQ ID NO: 10132 - protein, 31 aa, Artificial Sequence
  Description of Artificial Sequence: Synthetic polypeptide
DEEEIRTTNPVATEQYGSVSTNLQRKGDNPR

SEQ ID NO: 10133 - protein, 28 aa, Artificial Sequence
  Description of Artificial Sequence: Synthetic peptide
DEEEIRATNPVATEQYGAVSNNLQRGNR

SEQ ID NO: 10134 - protein, 30 aa, Artificial Sequence
  Description of Artificial Sequence: Synthetic polypeptide
DEEEIRTTNPVATEQFGSVSTNGLQRGDNR

SEQ ID NO: 10135 - protein, 28 aa, Artificial Sequence
  Description of Artificial Sequence: Synthetic peptide
DEEEIRTTNPEATEQYGSVSTNLQRDNH

SEQ ID NO: 10136 - protein, 30 aa, Artificial Sequence
  Description of Artificial Sequence: Synthetic polypeptide
DPEEIRTTNPVATEQYGSVSTQNLQRGNER

SEQ ID NO: 10137 - protein, 28 aa, Artificial Sequence
  Description of Artificial Sequence: Synthetic peptide
DEEEIRTTNPVATEQYGSVSTNLQEGEI

SEQ ID NO: 10138 - protein, 28 aa, Artificial Sequence
  Description of Artificial Sequence: Synthetic peptide
DEEEIRSTNPVASEQYGSVSTELQRGNR

SEQ ID NO: 10139 - protein, 28 aa, Artificial Sequence
  Description of Artificial Sequence: Synthetic peptide
NEEEIRTTNPVCTEQYGAVSTNLQRGNR

SEQ ID NO: 10140 - protein, 30 aa, Artificial Sequence
  Description of Artificial Sequence: Synthetic polypeptide
DEREIRTTNPVATEQYGSVSTNELQMRGNR

SEQ ID NO: 10141 - protein, 28 aa, Artificial Sequence
  Description of Artificial Sequence: Synthetic peptide
DEEAIRTTNPVATEQWGSVSTNEQRGNR

SEQ ID NO: 10142 - protein, 30 aa, Artificial Sequence
  Description of Artificial Sequence: Synthetic polypeptide
DTEEIRTTNPVATEQYGSVSTNPLQIRGNR

SEQ ID NO: 10143 - protein, 28 aa, Artificial Sequence
  Description of Artificial Sequence: Synthetic peptide
DEEELRSTNPVASEQYGSVSTNLQRGNR

SEQ ID NO: 10144 - protein, 28 aa, Artificial Sequence
  Description of Artificial Sequence: Synthetic peptide
DEEEIRTTNPFATEQYGSVSTNQQSGNR

SEQ ID NO: 10145 - protein, 29 aa, Artificial Sequence
  Description of Artificial Sequence: Synthetic peptide
DEEEIRTTNPVATEQYGSVDTNLQERGDR

SEQ ID NO: 10146 - protein, 28 aa, Artificial Sequence
  Description of Artificial Sequence: Synthetic peptide
DEEEIRTTNPVATEQYGSVDTNLQIGNM

SEQ ID NO: 10147 - protein, 28 aa, Artificial Sequence
  Description of Artificial Sequence: Synthetic peptide
DEEEIATTNPVATESYGSASTNLQRGNR

SEQ ID NO: 10148 - protein, 28 aa, Artificial Sequence
  Description of Artificial Sequence: Synthetic peptide
DEEEIRTTNPVATEQYGSVSTNLQFGEY

SEQ ID NO: 10149 - protein, 29 aa, Artificial Sequence
  Description of Artificial Sequence: Synthetic peptide
DEEEIRTTNPVATEIYGSVSTNLQRGDND

SEQ ID NO: 10150 - protein, 31 aa, Artificial Sequence
  Description of Artificial Sequence: Synthetic polypeptide
DEEEIRTTNPVATEQYGCSYVSTNLQRGDNR

SEQ ID NO: 10151 - protein, 28 aa, Artificial Sequence
  Description of Artificial Sequence: Synthetic peptide
DEEEIRTTNPSATEQYGETSTNLQRGNR

SEQ ID NO: 10152 - protein, 29 aa, Artificial Sequence
  Description of Artificial Sequence: Synthetic peptide
SEEEIRTTNPVATEQYGSVISTNLQRGNF

SEQ ID NO: 10153 - protein, 31 aa, Artificial Sequence
  Description of Artificial Sequence: Synthetic polypeptide
DEEEIRTTNPVATEQYGSVSETNLQSRNGNR

SEQ ID NO: 10154 - protein, 31 aa, Artificial Sequence
  Description of Artificial Sequence: Synthetic polypeptide
DEEEIRTTNPVATEQYGSVSTQNGLQERGNR

SEQ ID NO: 10155 - protein, 28 aa, Artificial Sequence
  Description of Artificial Sequence: Synthetic peptide
DEEEIRTTNPVATEQYGSVSTDLQQGND

SEQ ID NO: 10156 - protein, 29 aa, Artificial Sequence
  Description of Artificial Sequence: Synthetic peptide
DEEEIRTTNPEATEQYGSVSETNDQRGNR

SEQ ID NO: 10157 - protein, 28 aa, Artificial Sequence
  Description of Artificial Sequence: Synthetic peptide
DEEEIRTTNPVATEQYGSVSTNLQDGED

SEQ ID NO: 10158 - protein, 28 aa, Artificial Sequence
  Description of Artificial Sequence: Synthetic peptide
DGEEIRTTNPVATEQYGSVSTNPQRGNG

SEQ ID NO: 10159 - protein, 28 aa, Artificial Sequence
  Description of Artificial Sequence: Synthetic peptide
DEEEIRSTNPVATEQYGSVATGLQRGNR

SEQ ID NO: 10160 - protein, 28 aa, Artificial Sequence
  Description of Artificial Sequence: Synthetic peptide
DEEEIRTTNPVATEQYGSVSTNLQDGDN

SEQ ID NO: 10161 - protein, 29 aa, Artificial Sequence
  Description of Artificial Sequence: Synthetic peptide
DEEEISTTNPVATEQYGSVSTNLQRGFNL

SEQ ID NO: 10162 - protein, 28 aa, Artificial Sequence
  Description of Artificial Sequence: Synthetic peptide
DEEEIRTTNPVATECYGSVSTNLQVGNL

SEQ ID NO: 10163 - protein, 28 aa, Artificial Sequence
  Description of Artificial Sequence: Synthetic peptide
DEEEIRTTNPFATEQYGSVSTNLDRGER

SEQ ID NO: 10164 - protein, 28 aa, Artificial Sequence
  Description of Artificial Sequence: Synthetic peptide
REEEIATTNPVATEWYGSVSTNLQRGNR

SEQ ID NO: 10165 - protein, 28 aa, Artificial Sequence
  Description of Artificial Sequence: Synthetic peptide
DEGEIRTTNPVATEQYGSVSTNPQRGTR

SEQ ID NO: 10166 - protein, 28 aa, Artificial Sequence
  Description of Artificial Sequence: Synthetic peptide
GEDEVRTTNPVATEQYGSVSTNLQRGNR

SEQ ID NO: 10167 - protein, 28 aa, Artificial Sequence
  Description of Artificial Sequence: Synthetic peptide
DEAEIATTNPVATEQWGSVSTNLQRGNR

SEQ ID NO: 10168 - protein, 29 aa, Artificial Sequence
  Description of Artificial Sequence: Synthetic peptide
DEEEIRTTNPEATEQYGSVSTGNLQVGNR

SEQ ID NO: 10169 - protein, 31 aa, Artificial Sequence
  Description of Artificial Sequence: Synthetic polypeptide
DEEEIRTTNPVATEQYGSVISTNLPQRGDNR

SEQ ID NO: 10170 - protein, 31 aa, Artificial Sequence
  Description of Artificial Sequence: Synthetic polypeptide
DEEEIRTTNPVATEQYGSTVSTMNLQQRGNR

SEQ ID NO: 10171 - protein, 28 aa, Artificial Sequence
  Description of Artificial Sequence: Synthetic peptide
DEEEIRTTNPFATEQYGSVSTGLDRGNR

SEQ ID NO: 10172 - protein, 29 aa, Artificial Sequence
  Description of Artificial Sequence: Synthetic peptide
DEEEIRTTNPVATEQYGSVSTNLQTVGND

SEQ ID NO: 10173 - protein, 28 aa, Artificial Sequence
  Description of Artificial Sequence: Synthetic peptide
DEEEIRTTNPVATEQYGSVSTNQERGND

SEQ ID NO: 10174 - protein, 30 aa, Artificial Sequence
  Description of Artificial Sequence: Synthetic polypeptide
DEEEIVTTNPVATEQYGSVSTMNLQDRGNR

SEQ ID NO: 10175 - protein, 28 aa, Artificial Sequence
  Description of Artificial Sequence: Synthetic peptide
DEEEIRTTNPVATEQYGSVSTNLQHGEA

SEQ ID NO: 10176 - protein, 28 aa, Artificial Sequence
  Description of Artificial Sequence: Synthetic peptide
DEGEIRGTNPVATEQYGSVSTNLQRGTR

SEQ ID NO: 10177 - protein, 29 aa, Artificial Sequence
  Description of Artificial Sequence: Synthetic peptide
DEEEIRTTNPVATEQYGSVISMNLQRGNQ

SEQ ID NO: 10178 - protein, 28 aa, Artificial Sequence
  Description of Artificial Sequence: Synthetic peptide
DEEEIRTTNPTATEQYGSVSTNPQRGNA

SEQ ID NO: 10179 - protein, 30 aa, Artificial Sequence
  Description of Artificial Sequence: Synthetic polypeptide
DEEEIRTTNPVATEQYGSVSTNLQLIGVNR

SEQ ID NO: 10180 - protein, 29 aa, Artificial Sequence
  Description of Artificial Sequence: Synthetic peptide
DEEEIRTTNPVCYEQYGSVQSTNLQRGNR

SEQ ID NO: 10181 - protein, 28 aa, Artificial Sequence
  Description of Artificial Sequence: Synthetic peptide
DEEEIRTTNPVATEQYGSVSTNLQAGED

SEQ ID NO: 10182 - protein, 28 aa, Artificial Sequence
  Description of Artificial Sequence: Synthetic peptide
DEEEIRTTNPVATENYGGVSTNLQRLNR

SEQ ID NO: 10183 - protein, 28 aa, Artificial Sequence
  Description of Artificial Sequence: Synthetic peptide
DEEEIRTTNPTATEQFGSVNTNLQRGNR

SEQ ID NO: 10184 - protein, 28 aa, Artificial Sequence
  Description of Artificial Sequence: Synthetic peptide
DEEEIRTTNPVATEQYGSVSTNLEQGNH

SEQ ID NO: 10185 - protein, 30 aa, Artificial Sequence
  Description of Artificial Sequence: Synthetic polypeptide
DEEEIRTTNPVATEQYGSVSATNLQNRGER

SEQ ID NO: 10186 - protein, 28 aa, Artificial Sequence
  Description of Artificial Sequence: Synthetic peptide
DEEEIRTTNPHATEQWGSVSENLQRGNR

SEQ ID NO: 10187 - protein, 29 aa, Artificial Sequence
  Description of Artificial Sequence: Synthetic peptide
DEEEIRTTNPVATEQYGSVSTNGLQDGNE

SEQ ID NO: 10188 - protein, 28 aa, Artificial Sequence
  Description of Artificial Sequence: Synthetic peptide
DEEEIYTTNPVATEQYGSVSENLQRGNI

SEQ ID NO: 10189 - protein, 29 aa, Artificial Sequence
  Description of Artificial Sequence: Synthetic peptide
DEEEIRTTNPVATEQYGSVCWTPLQRGNR

SEQ ID NO: 10190 - protein, 28 aa, Artificial Sequence
  Description of Artificial Sequence: Synthetic peptide
DEEVIRTTNPEATEQYGSVSTNLERGNR

SEQ ID NO: 10191 - protein, 29 aa, Artificial Sequence
  Description of Artificial Sequence: Synthetic peptide
DEEEIRTTNPVATEQYGSVSCTNLCNGNR

SEQ ID NO: 10192 - protein, 28 aa, Artificial Sequence
  Description of Artificial Sequence: Synthetic peptide
DEEEIYTTNPVATEQYGSVSTNLQLGNP

SEQ ID NO: 10193 - protein, 28 aa, Artificial Sequence
  Description of Artificial Sequence: Synthetic peptide
MEEEIRTTNPVATEQYGSVSTNLQAGNS

SEQ ID NO: 10194 - protein, 28 aa, Artificial Sequence
  Description of Artificial Sequence: Synthetic peptide
DPEEIRTTNPVATEQYGSVSYNDQRGNR

SEQ ID NO: 10195 - protein, 29 aa, Artificial Sequence
  Description of Artificial Sequence: Synthetic peptide
DEEEIRTTNPVATEQYGDVSTNLQREGER

SEQ ID NO: 10196 - protein, 28 aa, Artificial Sequence
  Description of Artificial Sequence: Synthetic peptide
DEEEIRTTNPVATEQYGSVDSNEQRGNR

SEQ ID NO: 10197 - protein, 29 aa, Artificial Sequence
  Description of Artificial Sequence: Synthetic peptide
DEEEIRTTNPVATEQYGSVDTNLQMRGNM

SEQ ID NO: 10198 - protein, 28 aa, Artificial Sequence
  Description of Artificial Sequence: Synthetic peptide
DEEEIATTNPVATEQYGSVSTNLEHGNR

SEQ ID NO: 10199 - protein, 29 aa, Artificial Sequence
  Description of Artificial Sequence: Synthetic peptide
DEEEIRTTNPVATEHYGSVSTNLQRGDNF

SEQ ID NO: 10200 - protein, 30 aa, Artificial Sequence
  Description of Artificial Sequence: Synthetic polypeptide
DEEEIRTTNPVATEQYGHSVSTNLQNRGNN

SEQ ID NO: 10201 - protein, 28 aa, Artificial Sequence
  Description of Artificial Sequence: Synthetic peptide
DEEEIRTTNPFATEQYGSVSTNPQRGNI

SEQ ID NO: 10202 - protein, 28 aa, Artificial Sequence
  Description of Artificial Sequence: Synthetic peptide
DEFEIRTTNPVATEQYGSVSENVQRGNR

SEQ ID NO: 10203 - protein, 28 aa, Artificial Sequence
  Description of Artificial Sequence: Synthetic peptide
YEEEIRTVNPVATEQYGSVSTELQRGNR

SEQ ID NO: 10204 - protein, 29 aa, Artificial Sequence
  Description of Artificial Sequence: Synthetic peptide
DEEEIRTTNPVATEQYGSVSCTNLQHGNC

SEQ ID NO: 10205 - protein, 30 aa, Artificial Sequence
  Description of Artificial Sequence: Synthetic polypeptide
DEEEIRTTNPVAEEQYGSVSTNLQERGHNR

SEQ ID NO: 10206 - protein, 30 aa, Artificial Sequence
  Description of Artificial Sequence: Synthetic polypeptide
DEEEIRTTNPVATEQYGFVSTWNLQRNGNR

SEQ ID NO: 10207 - protein, 28 aa, Artificial Sequence
  Description of Artificial Sequence: Synthetic peptide
DEEEITCTNPVATEQYGSVSTNLQRGTR

SEQ ID NO: 10208 - protein, 28 aa, Artificial Sequence
  Description of Artificial Sequence: Synthetic peptide
AEEEIRTVNPVATEQYGSASTNLQRGNR

SEQ ID NO: 10209 - protein, 28 aa, Artificial Sequence
  Description of Artificial Sequence: Synthetic peptide
DEEEIRTTNPVATEQYGSVSVNLQFGNF

SEQ ID NO: 10210 - protein, 28 aa, Artificial Sequence
  Description of Artificial Sequence: Synthetic peptide
DEQEIVTTNPVATEVYGSVSTNLQRGNR

SEQ ID NO: 10211 - protein, 31 aa, Artificial Sequence
  Description of Artificial Sequence: Synthetic polypeptide
DEEEIRTTNPVATEQYGSVSTNLQERDGDNR

SEQ ID NO: 10212 - protein, 28 aa, Artificial Sequence
  Description of Artificial Sequence: Synthetic peptide
DEEEIRTTNPVATEQYGSVSTNLQKGDT

SEQ ID NO: 10213 - protein, 28 aa, Artificial Sequence
  Description of Artificial Sequence: Synthetic peptide
DEQEIRTTNPVASEQYGSVSTNLERGNR

SEQ ID NO: 10214 - protein, 31 aa, Artificial Sequence
  Description of Artificial Sequence: Synthetic polypeptide
DEEEIRTTNPVATEQYGSVSTENLQERKGNR

SEQ ID NO: 10215 - protein, 31 aa, Artificial Sequence
  Description of Artificial Sequence: Synthetic polypeptide
DEEEIRTTNPVATEQYGSVDSETNLQRGNDR

SEQ ID NO: 10216 - protein, 30 aa, Artificial Sequence
  Description of Artificial Sequence: Synthetic polypeptide
DEEEIRTTNPVATEQYGSVSSATNLQPGNR

SEQ ID NO: 10217 - protein, 29 aa, Artificial Sequence
  Description of Artificial Sequence: Synthetic peptide
DEEEIRTTNPVATEMYGSVSTVNLQLGNR

SEQ ID NO: 10218 - protein, 29 aa, Artificial Sequence
  Description of Artificial Sequence: Synthetic peptide
DEEEIRTTNPVATEQYGSVSTDLDRGNDR

SEQ ID NO: 10219 - protein, 28 aa, Artificial Sequence
  Description of Artificial Sequence: Synthetic peptide
DEEEIRTTNPVATEQYGSVSTELQQGND

SEQ ID NO: 10220 - protein, 28 aa, Artificial Sequence
  Description of Artificial Sequence: Synthetic peptide
DEQEIVTTNPVATEMYGSVSTNLQRGNR

SEQ ID NO: 10221 - protein, 28 aa, Artificial Sequence
  Description of Artificial Sequence: Synthetic peptide
DEEEIRTTNSVATEQYGSVSTNLQRFND

SEQ ID NO: 10222 - protein, 28 aa, Artificial Sequence
  Description of Artificial Sequence: Synthetic peptide
DEEEIRTTNPVATEQCGSVSTNLQHGDR

SEQ ID NO: 10223 - protein, 30 aa, Artificial Sequence
  Description of Artificial Sequence: Synthetic polypeptide
DEEEIRTTNPVATEQYGSVSTENLEERGNR

SEQ ID NO: 10224 - protein, 28 aa, Artificial Sequence
  Description of Artificial Sequence: Synthetic peptide
QEEEIRTVNPVSTEQYGSVSTNLQRGNR

SEQ ID NO: 10225 - protein, 29 aa, Artificial Sequence
  Description of Artificial Sequence: Synthetic peptide
DEEEIRTTNPVATEQYGSVSTNLQIDGNI

SEQ ID NO: 10226 - protein, 28 aa, Artificial Sequence
  Description of Artificial Sequence: Synthetic peptide
AEEEIRTTNPFATEQYGSVSTNQQRGNR

SEQ ID NO: 10227 - protein, 30 aa, Artificial Sequence
  Description of Artificial Sequence: Synthetic polypeptide
CEEEIRTTNPVATEQYGSVSTNPLQQRGNR

SEQ ID NO: 10228 - protein, 30 aa, Artificial Sequence
  Description of Artificial Sequence: Synthetic polypeptide
DEEEIRTTNPVATEQYGSVSTNNLQLDGNR

SEQ ID NO: 10229 - protein, 28 aa, Artificial Sequence
  Description of Artificial Sequence: Synthetic peptide
DEEEIRTVNPVSTEQYGSVSTNLQRLNR

SEQ ID NO: 10230 - protein, 31 aa, Artificial Sequence
  Description of Artificial Sequence: Synthetic polypeptide
DEEEIRTTNPVATEQYGESVESTNLQRGNPR

SEQ ID NO: 10231 - protein, 28 aa, Artificial Sequence
  Description of Artificial Sequence: Synthetic peptide
DEEEINTVNPVATEQYGSVSTNLQRGDR

SEQ ID NO: 10232 - protein, 28 aa, Artificial Sequence
  Description of Artificial Sequence: Synthetic peptide
VEEEIRTTNPVASEQYGSVSTNLQRGPR

SEQ ID NO: 10233 - protein, 30 aa, Artificial Sequence
  Description of Artificial Sequence: Synthetic polypeptide
DEEEIRTTNPVATEQYGSVESDTNLQPGNR

SEQ ID NO: 10234 - protein, 29 aa, Artificial Sequence
  Description of Artificial Sequence: Synthetic peptide
DEEEIRTTNPVATEQYGSVSYTNLQHGNP

SEQ ID NO: 10235 - protein, 28 aa, Artificial Sequence
  Description of Artificial Sequence: Synthetic peptide
DEQEIVTTNPVATEIYGSVSTNLQRGNR

SEQ ID NO: 10236 - protein, 28 aa, Artificial Sequence
  Description of Artificial Sequence: Synthetic peptide
DEEEIRTTNPVATEQYGSWSTNLQRGEN

SEQ ID NO: 10237 - protein, 28 aa, Artificial Sequence
  Description of Artificial Sequence: Synthetic peptide
QEEEIRSTNPVSTEQYGSVSTNLQRGNR

SEQ ID NO: 10238 - protein, 29 aa, Artificial Sequence
  Description of Artificial Sequence: Synthetic peptide
DEEEIRTTNPVATEQYGSVSTNLQAGNDA

SEQ ID NO: 10239 - protein, 28 aa, Artificial Sequence
  Description of Artificial Sequence: Synthetic peptide
DEEEIRQTNPVATELYGSVSTNLQRGNQ

SEQ ID NO: 10240 - protein, 28 aa, Artificial Sequence
  Description of Artificial Sequence: Synthetic peptide
DTEEIRTTNPYATEQYGSVSTGLQRGNR

SEQ ID NO: 10241 - protein, 28 aa, Artificial Sequence
  Description of Artificial Sequence: Synthetic peptide
DEEEIRTTNPVATEQYGSVSMNLLRGND

SEQ ID NO: 10242 - protein, 28 aa, Artificial Sequence
  Description of Artificial Sequence: Synthetic peptide
DEEEIRTTNPEATEQYGSVSTNLQRGDA

SEQ ID NO: 10243 - protein, 28 aa, Artificial Sequence
  Description of Artificial Sequence: Synthetic peptide
DDEEIRTTNPVSTEQYGSVSTNLERGNR

SEQ ID NO: 10244 - protein, 28 aa, Artificial Sequence
  Description of Artificial Sequence: Synthetic peptide
DEEEIRCTNPVACEQYGSVSTNIQRGNR

SEQ ID NO: 10245 - protein, 28 aa, Artificial Sequence
  Description of Artificial Sequence: Synthetic peptide
DEEEIRTTNPVATEQYGSVETNDQLGNR

SEQ ID NO: 10246 - protein, 28 aa, Artificial Sequence
  Description of Artificial Sequence: Synthetic peptide
DEEEIRTTNPVCTEIYGSVSTNLERGNR

SEQ ID NO: 10247 - protein, 30 aa, Artificial Sequence
  Description of Artificial Sequence: Synthetic polypeptide
DEEEIRTTNPVATEQYGSVSTNLERKGVNR

SEQ ID NO: 10248 - protein, 31 aa, Artificial Sequence
  Description of Artificial Sequence: Synthetic polypeptide
DEEEIRTTNPVATEQYGSVSTINLQLREGNR

SEQ ID NO: 10249 - protein, 28 aa, Artificial Sequence
  Description of Artificial Sequence: Synthetic peptide
DEEEIATTNPVASEQYGSVATNLQRGNR

SEQ ID NO: 10250 - protein, 28 aa, Artificial Sequence
  Description of Artificial Sequence: Synthetic peptide
DEEEIRTTNPDATEQYGSVSTALQGGNR

SEQ ID NO: 10251 - protein, 29 aa, Artificial Sequence
  Description of Artificial Sequence: Synthetic peptide
VTEEIRTTNPVATEQYGSVSTNPLQRGNR

SEQ ID NO: 10252 - protein, 28 aa, Artificial Sequence
  Description of Artificial Sequence: Synthetic peptide
DEEEIRTTNPVATEQYGSVSTPLEEGNR

SEQ ID NO: 10253 - protein, 29 aa, Artificial Sequence
  Description of Artificial Sequence: Synthetic peptide
DEEEIRTTNPVATEQYGSVETNLQIGENR

SEQ ID NO: 10254 - protein, 31 aa, Artificial Sequence
  Description of Artificial Sequence: Synthetic polypeptide
DEEEIRTTNPVATEQYGSVESTNPLQRGDNR

SEQ ID NO: 10255 - protein, 29 aa, Artificial Sequence
  Description of Artificial Sequence: Synthetic peptide
DEEEIRTTNPVATEQYGSVSTDLQRGNDL

SEQ ID NO: 10256 - protein, 29 aa, Artificial Sequence
  Description of Artificial Sequence: Synthetic peptide
DEEEIRTTNPVCTEQYGSVSCTNLQHGNR

SEQ ID NO: 10257 - protein, 29 aa, Artificial Sequence
  Description of Artificial Sequence: Synthetic peptide
DEEEIRTTNPVATEQYGSVDTMNLQHGNR

SEQ ID NO: 10258 - protein, 30 aa, Artificial Sequence
  Description of Artificial Sequence: Synthetic polypeptide
DEEEIRTTNPDATEQYGSVSTNLQMRDGNR

SEQ ID NO: 10259 - protein, 30 aa, Artificial Sequence
  Description of Artificial Sequence: Synthetic polypeptide
DEEEIRTTNPVATEQYGSVSCTNLQCRGNI

SEQ ID NO: 10260 - protein, 28 aa, Artificial Sequence
  Description of Artificial Sequence: Synthetic peptide
DEEEIRTTNPVATEQYGSVSTNLDRLMR

SEQ ID NO: 10261 - protein, 30 aa, Artificial Sequence
  Description of Artificial Sequence: Synthetic polypeptide
DEEEIRTTNPVATEQYGSVSCTELQCRGNR

SEQ ID NO: 10262 - protein, 29 aa, Artificial Sequence
  Description of Artificial Sequence: Synthetic peptide
DEEEIRTTNPVATEQYGSVSTNLQEVGNM

SEQ ID NO: 10263 - protein, 28 aa, Artificial Sequence
  Description of Artificial Sequence: Synthetic peptide
DEEEIRTTNPVATENYGSVSTELQRGNW

SEQ ID NO: 10264 - protein, 28 aa, Artificial Sequence
  Description of Artificial Sequence: Synthetic peptide
DEEEIRTTNPVATEQYGSVSTNLQDGEE

SEQ ID NO: 10265 - protein, 29 aa, Artificial Sequence
  Description of Artificial Sequence: Synthetic peptide
DEEMIRTTNPVATEQYGSVSTNPLMRGNR

SEQ ID NO: 10266 - protein, 30 aa, Artificial Sequence
  Description of Artificial Sequence: Synthetic polypeptide
DEEEIRTTNPVATAQYGSVSTNPLQRGMNR

SEQ ID NO: 10267 - protein, 29 aa, Artificial Sequence
  Description of Artificial Sequence: Synthetic peptide
DEEEIRTVNPVATEQYGSVSMNLQQRGNR

SEQ ID NO: 10268 - protein, 30 aa, Artificial Sequence
  Description of Artificial Sequence: Synthetic polypeptide
DEEEIRTTNPVATEQYGGVSTNLQREGNDR

SEQ ID NO: 10269 - protein, 29 aa, Artificial Sequence
  Description of Artificial Sequence: Synthetic peptide
DEEEIRTTNPFATEQYGSVSTNLVQRGND

SEQ ID NO: 10270 - protein, 29 aa, Artificial Sequence
  Description of Artificial Sequence: Synthetic peptide
DEEEIRTTNPVATEQYGSVSTDLQREGNT

SEQ ID NO: 10271 - protein, 28 aa, Artificial Sequence
  Description of Artificial Sequence: Synthetic peptide
DEEEVRTTNPVATEQYGSVAMNLQRGNR

SEQ ID NO: 10272 - protein, 30 aa, Artificial Sequence
  Description of Artificial Sequence: Synthetic polypeptide
DEECIRTTNPVATEQYGSVESTNLQRDGNR

SEQ ID NO: 10273 - protein, 29 aa, Artificial Sequence
  Description of Artificial Sequence: Synthetic peptide
DEEEIRTTNPVATEQYGSVSTNLQTGNGP

SEQ ID NO: 10274 - protein, 29 aa, Artificial Sequence
  Description of Artificial Sequence: Synthetic peptide
DEEEIRTTNPFATEQYGSVSTNQQRGNDR

SEQ ID NO: 10275 - protein, 30 aa, Artificial Sequence
  Description of Artificial Sequence: Synthetic polypeptide
DEEVIRTTNPVATEQYGSVNSMTNLQRGNR

SEQ ID NO: 10276 - protein, 28 aa, Artificial Sequence
  Description of Artificial Sequence: Synthetic peptide
DEEEIRTTNPFATEQYGSVSTPLQRGNA

SEQ ID NO: 10277 - protein, 28 aa, Artificial Sequence
  Description of Artificial Sequence: Synthetic peptide
DEEEIRTTNPVATEQYGSVETNLDRGNT

SEQ ID NO: 10278 - protein, 30 aa, Artificial Sequence
  Description of Artificial Sequence: Synthetic polypeptide
DEEEIRTTNPVATEQYGSVSTNLEERGNDR

SEQ ID NO: 10279 - protein, 30 aa, Artificial Sequence
  Description of Artificial Sequence: Synthetic polypeptide
DEEEIRTTNPVATEQYGSVSTDLQEREGNR

SEQ ID NO: 10280 - protein, 29 aa, Artificial Sequence
  Description of Artificial Sequence: Synthetic peptide
DEEEIRTTNPVATEQYGSVSTNLQEVGNI

SEQ ID NO: 10281 - protein, 29 aa, Artificial Sequence
  Description of Artificial Sequence: Synthetic peptide
DEEEIRTTNPVATEQYGSVASTNDQRGNP

SEQ ID NO: 10282 - protein, 29 aa, Artificial Sequence
  Description of Artificial Sequence: Synthetic peptide
DEEEIRSTNPVATECYGSVSATNLQRGNR

SEQ ID NO: 10283 - protein, 28 aa, Artificial Sequence
  Description of Artificial Sequence: Synthetic peptide
DEEEIRTTNPCATEQYGSVSTELQRGNA

SEQ ID NO: 10284 - protein, 30 aa, Artificial Sequence
  Description of Artificial Sequence: Synthetic polypeptide
DEEEIRTTNPVATEQYGSVSETNLQRGDER

SEQ ID NO: 10285 - protein, 28 aa, Artificial Sequence
  Description of Artificial Sequence: Synthetic peptide
DEEEIRTTNPVATEQYGSVDTNQERGNR

SEQ ID NO: 10286 - protein, 28 aa, Artificial Sequence
  Description of Artificial Sequence: Synthetic peptide
DEEEIRCTNPVSTENYGSVSTNLQRGNR

SEQ ID NO: 10287 - protein, 28 aa, Artificial Sequence
  Description of Artificial Sequence: Synthetic peptide
DEEEIRGTNPVATSQYGSVSTNLQRENR

SEQ ID NO: 10288 - protein, 30 aa, Artificial Sequence
  Description of Artificial Sequence: Synthetic polypeptide
DEEEITTTNPVATEQYGSVSTENLQQRGNR

SEQ ID NO: 10289 - protein, 30 aa, Artificial Sequence
  Description of Artificial Sequence: Synthetic polypeptide
DEEEIRTTNPVATEQYGSVDSTNLQRGDNP

SEQ ID NO: 10290 - protein, 28 aa, Artificial Sequence
  Description of Artificial Sequence: Synthetic peptide
DEEEIRTTNPVATEIYGSYSTNLQRGTR

SEQ ID NO: 10291 - protein, 28 aa, Artificial Sequence
  Description of Artificial Sequence: Synthetic peptide
DEMEIRTTNPVATEQYGLVSTNLQRGGR

SEQ ID NO: 10292 - protein, 31 aa, Artificial Sequence
  Description of Artificial Sequence: Synthetic polypeptide
DEEEIRTTNPVATEQYGSVCSCTNLQRAGNR

SEQ ID NO: 10293 - protein, 29 aa, Artificial Sequence
  Description of Artificial Sequence: Synthetic peptide
DEEEIRTTNPVATEQYGSVSTNLETGENR

SEQ ID NO: 10294 - protein, 29 aa, Artificial Sequence
  Description of Artificial Sequence: Synthetic peptide
DEEEIRTTNPVATEQYGSVSENLQYGNGR

SEQ ID NO: 10295 - protein, 29 aa, Artificial Sequence
  Description of Artificial Sequence: Synthetic peptide
DEEEIRTTNPVATEQYGSVDTNLQRGNDY

SEQ ID NO: 10296 - protein, 28 aa, Artificial Sequence
  Description of Artificial Sequence: Synthetic peptide
QEQEIRTTNPVATEQYGDVSTNLQRGNR

SEQ ID NO: 10297 - protein, 29 aa, Artificial Sequence
  Description of Artificial Sequence: Synthetic peptide
DEEEIRSTNPVATEQYGSVSAFNLQRGNR

SEQ ID NO: 10298 - protein, 28 aa, Artificial Sequence
  Description of Artificial Sequence: Synthetic peptide
DEEEIRTTNPDATEIYGSVSTNLQPGNR

SEQ ID NO: 10299 - protein, 29 aa, Artificial Sequence
  Description of Artificial Sequence: Synthetic peptide
DEEEIRTTNPVATEQYGSVSTENLDRGNQ

SEQ ID NO: 10300 - protein, 28 aa, Artificial Sequence
  Description of Artificial Sequence: Synthetic peptide
DEEEIRCTNPVSTEQYGSASTNLQRGNR

SEQ ID NO: 10301 - protein, 31 aa, Artificial Sequence
  Description of Artificial Sequence: Synthetic polypeptide
DEEEIRTTNPVATEQYGSVVVSTNLIQRGNR

SEQ ID NO: 10302 - protein, 29 aa, Artificial Sequence
  Description of Artificial Sequence: Synthetic peptide
DEEEIRTTNPVATEQYGMSVSTNLMRGNA

SEQ ID NO: 10303 - protein, 29 aa, Artificial Sequence
  Description of Artificial Sequence: Synthetic peptide
DEDEIRTTNPVATEQYGSVSTNLWREGNR

SEQ ID NO: 10304 - protein, 30 aa, Artificial Sequence
  Description of Artificial Sequence: Synthetic polypeptide
DEEEIRTTNPVATEQYGSVSTELQDRGENR

SEQ ID NO: 10305 - protein, 28 aa, Artificial Sequence
  Description of Artificial Sequence: Synthetic peptide
DEEEIRTTNPVATQQYGSVSTNLDRLNR

SEQ ID NO: 10306 - protein, 30 aa, Artificial Sequence
  Description of Artificial Sequence: Synthetic polypeptide
DEEEIRTTNPVATEQYGSVSTNLQDREGNT

SEQ ID NO: 10307 - protein, 29 aa, Artificial Sequence
  Description of Artificial Sequence: Synthetic peptide
DEEEIRTTNPVSTEQYGSVADTNLQRGNR

SEQ ID NO: 10308 - protein, 29 aa, Artificial Sequence
  Description of Artificial Sequence: Synthetic peptide
DEEEIRTTNPVATEQYGLVSTLNLQFGNR

SEQ ID NO: 10309 - protein, 28 aa, Artificial Sequence
  Description of Artificial Sequence: Synthetic peptide
DEEEIRTTNPVAWAQYGSVSTNPQRGNR

SEQ ID NO: 10310 - protein, 28 aa, Artificial Sequence
  Description of Artificial Sequence: Synthetic peptide
DEEEIRTTNPVATEQWGDVSTNLMRGNR

SEQ ID NO: 10311 - protein, 28 aa, Artificial Sequence
  Description of Artificial Sequence: Synthetic peptide
DEEEIRTTNPVCTEQYGSVSMNLQRGNN

SEQ ID NO: 10312 - protein, 29 aa, Artificial Sequence
  Description of Artificial Sequence: Synthetic peptide
DEEEIRTTNPVATEQYGSVSTNEQVGNDR

SEQ ID NO: 10313 - protein, 28 aa, Artificial Sequence
  Description of Artificial Sequence: Synthetic peptide
DEEEIRTTNPVATEQYGSVSTNLQEGDM

SEQ ID NO: 10314 - protein, 28 aa, Artificial Sequence
  Description of Artificial Sequence: Synthetic peptide
DEEEIRCTNPVSTETYGSVSTNLQRGNR

SEQ ID NO: 10315 - protein, 28 aa, Artificial Sequence
  Description of Artificial Sequence: Synthetic peptide
DESEIRCTNPVATEVYGSVSTNLQRGNR

SEQ ID NO: 10316 - protein, 28 aa, Artificial Sequence
  Description of Artificial Sequence: Synthetic peptide
DEEEIRTTNPVATEQYGSVSTNEQPGNE

SEQ ID NO: 10317 - protein, 28 aa, Artificial Sequence
  Description of Artificial Sequence: Synthetic peptide
NEEEIRTTNPVATEQYGSVDTNLQRGNG

SEQ ID NO: 10318 - protein, 30 aa, Artificial Sequence
  Description of Artificial Sequence: Synthetic polypeptide
DEEEIRTTNPVATEQYGSVSTLELQIRGNR

SEQ ID NO: 10319 - protein, 29 aa, Artificial Sequence
  Description of Artificial Sequence: Synthetic peptide
DEEEIRTTNPVATEQYGSVSTNLQENGER

SEQ ID NO: 10320 - protein, 30 aa, Artificial Sequence
  Description of Artificial Sequence: Synthetic polypeptide
DEEEIRTTNPVATEQYGSVLSTNDNQRGNR

SEQ ID NO: 10321 - protein, 28 aa, Artificial Sequence
  Description of Artificial Sequence: Synthetic peptide
DEQEIRTTNPVATEQYGIVSTNLQRGNA

SEQ ID NO: 10322 - protein, 30 aa, Artificial Sequence
  Description of Artificial Sequence: Synthetic polypeptide
DEEEIRTTNPVATEQYGSVSCENLQRGNDR

SEQ ID NO: 10323 - protein, 28 aa, Artificial Sequence
  Description of Artificial Sequence: Synthetic peptide
DEEEIRTTNPVATEQYGSVETNLQDGER

SEQ ID NO: 10324 - protein, 28 aa, Artificial Sequence
  Description of Artificial Sequence: Synthetic peptide
DEVEIRTVNPVATEQYGSVSDNLQRGNR

SEQ ID NO: 10325 - protein, 29 aa, Artificial Sequence
  Description of Artificial Sequence: Synthetic peptide
QEEEIRTTNPVATEFYGSVSTNLQRGDNR

SEQ ID NO: 10326 - protein, 30 aa, Artificial Sequence
  Description of Artificial Sequence: Synthetic polypeptide
DEEEIRTTNPVATEQYGSVSTNLQRDGNED

SEQ ID NO: 10327 - protein, 28 aa, Artificial Sequence
  Description of Artificial Sequence: Synthetic peptide
DEQEIRTTNPVATEIYGVVSTNLQRGNR

SEQ ID NO: 10328 - protein, 30 aa, Artificial Sequence
  Description of Artificial Sequence: Synthetic polypeptide
DEEEIRTTNPVATEQYGSVISTANLQRGNF

SEQ ID NO: 10329 - protein, 28 aa, Artificial Sequence
  Description of Artificial Sequence: Synthetic peptide
DEVEIRTTNPVATEQFGSVSTNEQRGNR

SEQ ID NO: 10330 - protein, 28 aa, Artificial Sequence
  Description of Artificial Sequence: Synthetic peptide
DEQEIRTTNPVATENYGVVSTNLQRGNR

SEQ ID NO: 10331 - protein, 28 aa, Artificial Sequence
  Description of Artificial Sequence: Synthetic peptide
DEEEIRTTNPDATEQYGSVSTGLQPGNR

SEQ ID NO: 10332 - protein, 28 aa, Artificial Sequence
  Description of Artificial Sequence: Synthetic peptide
DEEEIRTTNPVAGEQYGSVSTNEQRGNF

SEQ ID NO: 10333 - protein, 28 aa, Artificial Sequence
  Description of Artificial Sequence: Synthetic peptide
DENEIVTTNPVATELYGSVSTNLQRGNR

SEQ ID NO: 10334 - protein, 29 aa, Artificial Sequence
  Description of Artificial Sequence: Synthetic peptide
DEEPIRTTNPVATESYGSVSTNLQRGSNR

SEQ ID NO: 10335 - protein, 31 aa, Artificial Sequence
  Description of Artificial Sequence: Synthetic polypeptide
DEEEIRTTNPVATEQYGSVSTGNLQREGDNR

SEQ ID NO: 10336 - protein, 29 aa, Artificial Sequence
  Description of Artificial Sequence: Synthetic peptide
DEEEIRTTNPVATCQYGSVSNTNGQRGNR

SEQ ID NO: 10337 - protein, 30 aa, Artificial Sequence
  Description of Artificial Sequence: Synthetic polypeptide
DEEEIRTTNPVATEQYGSVSTNTLQERGDR

SEQ ID NO: 10338 - protein, 28 aa, Artificial Sequence
  Description of Artificial Sequence: Synthetic peptide
DEEQIRTTNPVATEQYGSVSTPDQRGNR

SEQ ID NO: 10339 - protein, 28 aa, Artificial Sequence
  Description of Artificial Sequence: Synthetic peptide
DEDEIRTTNPVATEQYGSVSTNLQRGEW

SEQ ID NO: 10340 - protein, 28 aa, Artificial Sequence
  Description of Artificial Sequence: Synthetic peptide
DEEEIRTTNPDATEQYGSVSTNLERGER

SEQ ID NO: 10341 - protein, 28 aa, Artificial Sequence
  Description of Artificial Sequence: Synthetic peptide
NEEEIRTTNPVATESYGSVSTNLQRGNC

SEQ ID NO: 10342 - protein, 29 aa, Artificial Sequence
  Description of Artificial Sequence: Synthetic peptide
DEEEIRTTNPEATEQYGSVSTPLQRGNPR

SEQ ID NO: 10343 - protein, 28 aa, Artificial Sequence
  Description of Artificial Sequence: Synthetic peptide
DEEEIVTTNPVATECYGSVSTNLERGNR

SEQ ID NO: 10344 - protein, 28 aa, Artificial Sequence
  Description of Artificial Sequence: Synthetic peptide
MEEEIRTTNPVATEQYGSVSENLDRGNR

SEQ ID NO: 10345 - protein, 30 aa, Artificial Sequence
  Description of Artificial Sequence: Synthetic polypeptide
DEEEIRTTNPVATEQYGSVSTDNLQNGDNR

SEQ ID NO: 10346 - protein, 30 aa, Artificial Sequence
  Description of Artificial Sequence: Synthetic polypeptide
DECEIRTTNPVATEQYGSVSTMNLQERGNR

SEQ ID NO: 10347 - protein, 30 aa, Artificial Sequence
  Description of Artificial Sequence: Synthetic polypeptide
DEEEIRTTNPVATEQYGSVSCTNLQCRGNC

SEQ ID NO: 10348 - protein, 30 aa, Artificial Sequence
  Description of Artificial Sequence: Synthetic polypeptide
DEEEIRTTNPVATEQYGSVSTNLQRGENDF

SEQ ID NO: 10349 - protein, 29 aa, Artificial Sequence
  Description of Artificial Sequence: Synthetic peptide
DEEEIRTTNPVATECYGSVSTNLQLRGNA

SEQ ID NO: 10350 - protein, 28 aa, Artificial Sequence
  Description of Artificial Sequence: Synthetic peptide
DEEEIRTTNPVATEQYGSVSENEQRGDR

SEQ ID NO: 10351 - protein, 28 aa, Artificial Sequence
  Description of Artificial Sequence: Synthetic peptide
DEQEIATVNPVATEQYGSVSTNLQRGNR

SEQ ID NO: 10352 - protein, 28 aa, Artificial Sequence
  Description of Artificial Sequence: Synthetic peptide
DEGEIRTTNPVATEQYGSVSNNLQRLNR

SEQ ID NO: 10353 - protein, 28 aa, Artificial Sequence
  Description of Artificial Sequence: Synthetic peptide
DEEIIRTTNPVATEQYGSVSTNLIAGNR

SEQ ID NO: 10354 - protein, 29 aa, Artificial Sequence
  Description of Artificial Sequence: Synthetic peptide
DEEEIRTTNPVATEQYGSVSEWNLQWGNR

SEQ ID NO: 10355 - protein, 29 aa, Artificial Sequence
  Description of Artificial Sequence: Synthetic peptide
DEHEIRTTNPVATEQYGSVSEMNLQRGNR

SEQ ID NO: 10356 - protein, 28 aa, Artificial Sequence
  Description of Artificial Sequence: Synthetic peptide
DEEEIRTVNPVATEMYGSVSTNLQRPNR

SEQ ID NO: 10357 - protein, 30 aa, Artificial Sequence
  Description of Artificial Sequence: Synthetic polypeptide
DEEEIRTTNPVATEQYGESVSCTNLQRDNR

SEQ ID NO: 10358 - protein, 30 aa, Artificial Sequence
  Description of Artificial Sequence: Synthetic polypeptide
DEEEIRTTNPVATEQYGSVSETNLQEWGNR

SEQ ID NO: 10359 - protein, 28 aa, Artificial Sequence
  Description of Artificial Sequence: Synthetic peptide
DEECIRTTNPVATEQFGSVSTGLQRGNR

SEQ ID NO: 10360 - protein, 30 aa, Artificial Sequence
  Description of Artificial Sequence: Synthetic polypeptide
DEEEIRTTNPVATEQYGSVSTMNLQRGNDD

SEQ ID NO: 10361 - protein, 29 aa, Artificial Sequence
  Description of Artificial Sequence: Synthetic peptide
DEEEIRTTNPVATEQYGSVETDLQRNGNR

SEQ ID NO: 10362 - protein, 28 aa, Artificial Sequence
  Description of Artificial Sequence: Synthetic peptide
DEEEIRTTNPVATEQWGSVDTNLQRGTR

SEQ ID NO: 10363 - protein, 29 aa, Artificial Sequence
  Description of Artificial Sequence: Synthetic peptide
DPEEIRTTNPVATEQYGSVSTPNLQRGER

SEQ ID NO: 10364 - protein, 28 aa, Artificial Sequence
  Description of Artificial Sequence: Synthetic peptide
DEEEIRCTNPVATENYGSVATNLQRGNR

SEQ ID NO: 10365 - protein, 28 aa, Artificial Sequence
  Description of Artificial Sequence: Synthetic peptide
DEEEIRATNPTATEQYGSVSTNLQQGNR

SEQ ID NO: 10366 - protein, 29 aa, Artificial Sequence
  Description of Artificial Sequence: Synthetic peptide
DEEEIRTVNPVATEQYGSVSENLQRGNDR

SEQ ID NO: 10367 - protein, 30 aa, Artificial Sequence
  Description of Artificial Sequence: Synthetic polypeptide
DEEEIRTTNPVATEQYGSVSTEPLQVRGNR

SEQ ID NO: 10368 - protein, 28 aa, Artificial Sequence
  Description of Artificial Sequence: Synthetic peptide
YEEEIRTTNPVATEQYGAVSENLQRGNR

SEQ ID NO: 10369 - protein, 28 aa, Artificial Sequence
  Description of Artificial Sequence: Synthetic peptide
DEEEIRTTNPVATEQYGSVSTCPQHGNR

SEQ ID NO: 10370 - protein, 28 aa, Artificial Sequence
  Description of Artificial Sequence: Synthetic peptide
DEEEIRTTNPFATQQYGSVSTNLQRGND

SEQ ID NO: 10371 - protein, 28 aa, Artificial Sequence
  Description of Artificial Sequence: Synthetic peptide
DEEQIRTTNPVATEQYGSWSTNLQRGNP

SEQ ID NO: 10372 - protein, 31 aa, Artificial Sequence
  Description of Artificial Sequence: Synthetic polypeptide
DEEEIRTTNPVATEQYGSVSTENLPQRGNTR

SEQ ID NO: 10373 - protein, 30 aa, Artificial Sequence
  Description of Artificial Sequence: Synthetic polypeptide
DEEEIRTTNPVATEQYGSVSTMNLQREGNV

SEQ ID NO: 10374 - protein, 28 aa, Artificial Sequence
  Description of Artificial Sequence: Synthetic peptide
GEEEIRCTNPVATEQYGSASTNLQRGNR

SEQ ID NO: 10375 - protein, 29 aa, Artificial Sequence
  Description of Artificial Sequence: Synthetic peptide
DEEEIRTTNPVATEQYGSVSTNLMNRGNF

SEQ ID NO: 10376 - protein, 29 aa, Artificial Sequence
  Description of Artificial Sequence: Synthetic peptide
DEEEIRTTNPVAIEQYGSVLSTDLQRGNR

SEQ ID NO: 10377 - protein, 29 aa, Artificial Sequence
  Description of Artificial Sequence: Synthetic peptide
DENEIRTTNPVATEQYGSVSTDLQREGNR

SEQ ID NO: 10378 - protein, 28 aa, Artificial Sequence
  Description of Artificial Sequence: Synthetic peptide
DEEEIRTTNPDATEQYGSVSTNLDDGNR

SEQ ID NO: 10379 - protein, 30 aa, Artificial Sequence
  Description of Artificial Sequence: Synthetic polypeptide
DEEEIRTTNPVATEQYGSVSTANLQATGNR

SEQ ID NO: 10380 - protein, 30 aa, Artificial Sequence
  Description of Artificial Sequence: Synthetic polypeptide
DEEEIRTTNPVATEQYGSVSTENLQREENR

SEQ ID NO: 10381 - protein, 30 aa, Artificial Sequence
  Description of Artificial Sequence: Synthetic polypeptide
DEEEIRTTNPFATEQYGSVTSTNLQRGDNR

SEQ ID NO: 10382 - protein, 29 aa, Artificial Sequence
  Description of Artificial Sequence: Synthetic peptide
DEEEIRTTNPVATELYGSVSTNLPQFGNR

SEQ ID NO: 10383 - protein, 28 aa, Artificial Sequence
  Description of Artificial Sequence: Synthetic peptide
DEEEIRTTNPVATEQYGSVETCLDRGNR

SEQ ID NO: 10384 - protein, 28 aa, Artificial Sequence
  Description of Artificial Sequence: Synthetic peptide
DEEEIRTTNPVATEHYGSVSTGLQRGNG

SEQ ID NO: 10385 - protein, 28 aa, Artificial Sequence
  Description of Artificial Sequence: Synthetic peptide
DEEEIRTTNPDATEQYGSVSTNDQRGDR

SEQ ID NO: 10386 - protein, 28 aa, Artificial Sequence
  Description of Artificial Sequence: Synthetic peptide
DEEEIRTTNPVATEQYGSVSTNLQLGEN

SEQ ID NO: 10387 - protein, 28 aa, Artificial Sequence
  Description of Artificial Sequence: Synthetic peptide
DEEEIRTTNPVATEQYGSVSTNPQGGNE

SEQ ID NO: 10388 - protein, 30 aa, Artificial Sequence
  Description of Artificial Sequence: Synthetic polypeptide
DEEEIRTTNPVATEQYGSVSTNEQVRGDNR

SEQ ID NO: 10389 - protein, 28 aa, Artificial Sequence
  Description of Artificial Sequence: Synthetic peptide
DEEEITTTNPVATEVYGSVSTELQRGNR

SEQ ID NO: 10390 - protein, 28 aa, Artificial Sequence
  Description of Artificial Sequence: Synthetic peptide
DEEEIVTTNPVATEQYGSVSTNLERGER

SEQ ID NO: 10391 - protein, 28 aa, Artificial Sequence
  Description of Artificial Sequence: Synthetic peptide
DEESIRPTNPVATEQYGSVSTNLDRGNR

SEQ ID NO: 10392 - protein, 28 aa, Artificial Sequence
  Description of Artificial Sequence: Synthetic peptide
DEEEIRTTNPVATELYGSVSTNLERGNF

SEQ ID NO: 10393 - protein, 29 aa, Artificial Sequence
  Description of Artificial Sequence: Synthetic peptide
DEEEIRTTNPVATEQYGSVDSTDLQPGNR

SEQ ID NO: 10394 - protein, 31 aa, Artificial Sequence
  Description of Artificial Sequence: Synthetic polypeptide
DEEEIRTTNPVATEQYGSVSTANLQLREGNR

SEQ ID NO: 10395 - protein, 28 aa, Artificial Sequence
  Description of Artificial Sequence: Synthetic peptide
DEEEIRTTNPVATEQYGSVDTNLIRGNH

SEQ ID NO: 10396 - protein, 28 aa, Artificial Sequence
  Description of Artificial Sequence: Synthetic peptide
DEEEIRTTNPVATEIYGCVATNLQRGNR

SEQ ID NO: 10397 - protein, 28 aa, Artificial Sequence
  Description of Artificial Sequence: Synthetic peptide
DEEEIRTVNPVATECYGTVSTNLQRGNR

SEQ ID NO: 10398 - protein, 28 aa, Artificial Sequence
  Description of Artificial Sequence: Synthetic peptide
DCEEIRTTNPVATEQYGSVSTNLQRLNA

SEQ ID NO: 10399 - protein, 28 aa, Artificial Sequence
  Description of Artificial Sequence: Synthetic peptide
CEEEIRTTNPVATEQYGSCSTNLQRFNR

SEQ ID NO: 10400 - protein, 30 aa, Artificial Sequence
  Description of Artificial Sequence: Synthetic polypeptide
DEEEIRTTNPVATEQYGSGVISTNLDRGNR

SEQ ID NO: 10401 - protein, 30 aa, Artificial Sequence
  Description of Artificial Sequence: Synthetic polypeptide
DEGEIRTTNPVATEQYGSVSTMNLQRTGNR

SEQ ID NO: 10402 - protein, 29 aa, Artificial Sequence
  Description of Artificial Sequence: Synthetic peptide
DEECIRTTNPVATEQYGSVTSTNPQRGNR

SEQ ID NO: 10403 - protein, 28 aa, Artificial Sequence
  Description of Artificial Sequence: Synthetic peptide
SEEEIRTTNPVATEQYGSASTNLQEGNR

SEQ ID NO: 10404 - protein, 28 aa, Artificial Sequence
  Description of Artificial Sequence: Synthetic peptide
DEEELRATNPTATEQYGSVSTNLQRGNR

SEQ ID NO: 10405 - protein, 28 aa, Artificial Sequence
  Description of Artificial Sequence: Synthetic peptide
DEEEIRTTNPVACEHYGSVSTNLDRGNR

SEQ ID NO: 10406 - protein, 29 aa, Artificial Sequence
  Description of Artificial Sequence: Synthetic peptide
YEEEIRTTNPVATEQYGSVSTNLQSGDNR

SEQ ID NO: 10407 - protein, 28 aa, Artificial Sequence
  Description of Artificial Sequence: Synthetic peptide
DDVEIRTTNPVATEQYGSVSTNLQHGNR

SEQ ID NO: 10408 - protein, 28 aa, Artificial Sequence
  Description of Artificial Sequence: Synthetic peptide
DEEEIRTTNPVATEQYGSVSTNLQYGEC

SEQ ID NO: 10409 - protein, 29 aa, Artificial Sequence
  Description of Artificial Sequence: Synthetic peptide
DEEEIRTTNPVATEQYGSVSTNLERDGER

SEQ ID NO: 10410 - protein, 29 aa, Artificial Sequence
  Description of Artificial Sequence: Synthetic peptide
DEEEIRTTNPVAAEQYGSVSTNDQIRGNR

SEQ ID NO: 10411 - protein, 30 aa, Artificial Sequence
  Description of Artificial Sequence: Synthetic polypeptide
DEEEIRTTNPVATEQYGSVSTINPLQAGNR

SEQ ID NO: 10412 - protein, 29 aa, Artificial Sequence
  Description of Artificial Sequence: Synthetic peptide
DEEEIRTTNPVATEQYGSVSTDLQERGNN

SEQ ID NO: 10413 - protein, 28 aa, Artificial Sequence
  Description of Artificial Sequence: Synthetic peptide
DEEEIRTTNPVATAQYGSVDTNDQRGNR

SEQ ID NO: 10414 - protein, 28 aa, Artificial Sequence
  Description of Artificial Sequence: Synthetic peptide
DEEEIRQTNPVASEQYGVVSTNLQRGNR

SEQ ID NO: 10415 - protein, 28 aa, Artificial Sequence
  Description of Artificial Sequence: Synthetic peptide
KEEEIRTTNPVATEQYGSASENLQRGNR

SEQ ID NO: 10416 - protein, 28 aa, Artificial Sequence
  Description of Artificial Sequence: Synthetic peptide
DEEEIRTTNPVATEQYGSVSTNDQHGER

SEQ ID NO: 10417 - protein, 28 aa, Artificial Sequence
  Description of Artificial Sequence: Synthetic peptide
DEEEIRTTNPVATEQYGSVSTNPQDGND

SEQ ID NO: 10418 - protein, 28 aa, Artificial Sequence
  Description of Artificial Sequence: Synthetic peptide
DEEEIRTTNPVATEQYGSVSTNLDVGNQ

SEQ ID NO: 10419 - protein, 28 aa, Artificial Sequence
  Description of Artificial Sequence: Synthetic peptide
DEEEIRTTNPVATEQYGSVSTDLQYGNV

SEQ ID NO: 10420 - protein, 29 aa, Artificial Sequence
  Description of Artificial Sequence: Synthetic peptide
DEEEIRTTNPVATEQYGSVSTANLLLGNR

SEQ ID NO: 10421 - protein, 28 aa, Artificial Sequence
  Description of Artificial Sequence: Synthetic peptide
DEEEIRTTNPVATEQYGSVSPDLQTGNR

SEQ ID NO: 10422 - protein, 28 aa, Artificial Sequence
  Description of Artificial Sequence: Synthetic peptide
DEEEIRTTNPDATQQYGSVSTNLQRGNN

SEQ ID NO: 10423 - protein, 29 aa, Artificial Sequence
  Description of Artificial Sequence: Synthetic peptide
DEEEIRTTNPVATCQYGSVSTNLERGNTR

SEQ ID NO: 10424 - protein, 28 aa, Artificial Sequence
  Description of Artificial Sequence: Synthetic peptide
DEEEIRTTNPCSTEQYGSVSTNLDRGNR

SEQ ID NO: 10425 - protein, 28 aa, Artificial Sequence
  Description of Artificial Sequence: Synthetic peptide
MEEEIRTTNPVATEQYGSVSTNGQDGNR

SEQ ID NO: 10426 - protein, 28 aa, Artificial Sequence
  Description of Artificial Sequence: Synthetic peptide
KEEEIRTTNPVATEQYGSVSTNLQRGEW

SEQ ID NO: 10427 - protein, 28 aa, Artificial Sequence
  Description of Artificial Sequence: Synthetic peptide
DEEEIRTTNPFATEQYGSVSHNDQRGNR

SEQ ID NO: 10428 - protein, 28 aa, Artificial Sequence
  Description of Artificial Sequence: Synthetic peptide
DEEEIRTTNPVATEQYGSVSTNPQIGNI

SEQ ID NO: 10429 - protein, 28 aa, Artificial Sequence
  Description of Artificial Sequence: Synthetic peptide
DDEEIRTTNPVATEHFGSVSTNLQRGNR

SEQ ID NO: 10430 - protein, 28 aa, Artificial Sequence
  Description of Artificial Sequence: Synthetic peptide
DEEEIAQTNPVATEQYGSVSTNLERGNR

SEQ ID NO: 10431 - protein, 29 aa, Artificial Sequence
  Description of Artificial Sequence: Synthetic peptide
DEEEIRTTNPVATEQYGSVSSTNLLRGNP

SEQ ID NO: 10432 - protein, 29 aa, Artificial Sequence
  Description of Artificial Sequence: Synthetic peptide
DEEEIRTTNPAATEQYGSVSTNLQRGDTR

SEQ ID NO: 10433 - protein, 30 aa, Artificial Sequence
  Description of Artificial Sequence: Synthetic polypeptide
DEEEIRTTNPVATEQYGSVSCTMNLQRGNC

SEQ ID NO: 10434 - protein, 30 aa, Artificial Sequence
  Description of Artificial Sequence: Synthetic polypeptide
DEEEIRTTNPVATEQYGSVSTNLQERGNDN

SEQ ID NO: 10435 - protein, 29 aa, Artificial Sequence
  Description of Artificial Sequence: Synthetic peptide
DEEEIRTTNPVATEQYGSVDTNLQRGNDA

SEQ ID NO: 10436 - protein, 28 aa, Artificial Sequence
  Description of Artificial Sequence: Synthetic peptide
VEEEIRSTNPVCTEQYGSVSTNLQRGNR

SEQ ID NO: 10437 - protein, 28 aa, Artificial Sequence
  Description of Artificial Sequence: Synthetic peptide
DENEIRQTNPVATEQYGSVSTDLQRGNR

SEQ ID NO: 10438 - protein, 28 aa, Artificial Sequence
  Description of Artificial Sequence: Synthetic peptide
DEEEIGTTNPVATEQYGSVSEILQRGNR

SEQ ID NO: 10439 - protein, 28 aa, Artificial Sequence
  Description of Artificial Sequence: Synthetic peptide
DEEEIRTTNPVATEQYGSVSTELQRGEE

SEQ ID NO: 10440 - protein, 30 aa, Artificial Sequence
  Description of Artificial Sequence: Synthetic polypeptide
DEEEIRTTNPVATEQYGSVSTMNLQRGDNF

SEQ ID NO: 10441 - protein, 28 aa, Artificial Sequence
  Description of Artificial Sequence: Synthetic peptide
DEEEIRTTNPVATEQYGSVSTNLQLGDF

SEQ ID NO: 10442 - protein, 28 aa, Artificial Sequence
  Description of Artificial Sequence: Synthetic peptide
DEEEIRCTNPVATENYGVVSTNLQRGNR

SEQ ID NO: 10443 - protein, 30 aa, Artificial Sequence
  Description of Artificial Sequence: Synthetic polypeptide
DEEEIRTTNPVATEQYGSASTMNLQQRGNR

SEQ ID NO: 10444 - protein, 28 aa, Artificial Sequence
  Description of Artificial Sequence: Synthetic peptide
DEEEITTTNPVATEQYGDVSENLQRGNR

SEQ ID NO: 10445 - protein, 29 aa, Artificial Sequence
  Description of Artificial Sequence: Synthetic peptide
DEEEIRTTNPVATFQYGSVSTNLYREGNR

SEQ ID NO: 10446 - protein, 28 aa, Artificial Sequence
  Description of Artificial Sequence: Synthetic peptide
REEEIRTTNPVATEQYGSVSTYLQEGNR

SEQ ID NO: 10447 - protein, 28 aa, Artificial Sequence
  Description of Artificial Sequence: Synthetic peptide
DEEEIRTTNPVATEQYGSVSTELQVGNL

SEQ ID NO: 10448 - protein, 28 aa, Artificial Sequence
  Description of Artificial Sequence: Synthetic peptide
DEEEIVTTNPVATEQYGWVSENLQRGNR

SEQ ID NO: 10449 - protein, 28 aa, Artificial Sequence
  Description of Artificial Sequence: Synthetic peptide
DEEEIRTTNPVATEQYGSVSTNLQQGEA

SEQ ID NO: 10450 - protein, 29 aa, Artificial Sequence
  Description of Artificial Sequence: Synthetic peptide
DEEEIRTTNPVATEQYGSVSTNGLQTGNA

SEQ ID NO: 10451 - protein, 28 aa, Artificial Sequence
  Description of Artificial Sequence: Synthetic peptide
DENEIRTTNPVATEQWGSVSTNLMRGNR

SEQ ID NO: 10452 - protein, 30 aa, Artificial Sequence
  Description of Artificial Sequence: Synthetic polypeptide
DEEEIRTTNPVATEQYGSVFSTNLQRTGER

SEQ ID NO: 10453 - protein, 31 aa, Artificial Sequence
  Description of Artificial Sequence: Synthetic polypeptide
DEEEIRTTNPVATEQYGSVSTNLQLRNGENR

SEQ ID NO: 10454 - protein, 28 aa, Artificial Sequence
  Description of Artificial Sequence: Synthetic peptide
DEEEIRTTNPVATEQYGSVSTNLQPGHQ

SEQ ID NO: 10455 - protein, 28 aa, Artificial Sequence
  Description of Artificial Sequence: Synthetic peptide
KENEIRTTNPVATEQYGSVSTDLQRGNR

SEQ ID NO: 10456 - protein, 28 aa, Artificial Sequence
  Description of Artificial Sequence: Synthetic peptide
DEEEIRTTNPVATECYGSVGTNLERGNR

SEQ ID NO: 10457 - protein, 30 aa, Artificial Sequence
  Description of Artificial Sequence: Synthetic polypeptide
DEEEIRTTNPVATECYGISVSTNLQREGNR

SEQ ID NO: 10458 - protein, 28 aa, Artificial Sequence
  Description of Artificial Sequence: Synthetic peptide
DEEEIRTTNPVGTEQYGSVSENDQRGNR

SEQ ID NO: 10459 - protein, 28 aa, Artificial Sequence
  Description of Artificial Sequence: Synthetic peptide
DEEEIRTTNPVATEQYGSVDTNLMRGNS

SEQ ID NO: 10460 - protein, 28 aa, Artificial Sequence
  Description of Artificial Sequence: Synthetic peptide
DEEEIRTTNPVATEQYGSVSTNLQIGEI

SEQ ID NO: 10461 - protein, 28 aa, Artificial Sequence
  Description of Artificial Sequence: Synthetic peptide
DEEEIRTTNPVATDQYGSVSTNLQIGNV

SEQ ID NO: 10462 - protein, 30 aa, Artificial Sequence
  Description of Artificial Sequence: Synthetic polypeptide
DEEEIRTTNPLATEQYGSVSETNLQERGNR

SEQ ID NO: 10463 - protein, 29 aa, Artificial Sequence
  Description of Artificial Sequence: Synthetic peptide
DEEEIRTTNPVATEQYGSVSTNLQEGGNM

SEQ ID NO: 10464 - protein, 28 aa, Artificial Sequence
  Description of Artificial Sequence: Synthetic peptide
DEQEIRTTNPVATEQYGSVSTPLQRGNP

SEQ ID NO: 10465 - protein, 29 aa, Artificial Sequence
  Description of Artificial Sequence: Synthetic peptide
DEEEIRTTNPVATEQYGSVSTNLQEIGNV

SEQ ID NO: 10466 - protein, 28 aa, Artificial Sequence
  Description of Artificial Sequence: Synthetic peptide
DEEEIRTTNPVATECYGSVSYNLQRFNR

SEQ ID NO: 10467 - protein, 31 aa, Artificial Sequence
  Description of Artificial Sequence: Synthetic polypeptide
DEEEIRTTNPVATEQYGSVSLTMNLVQRGNR

SEQ ID NO: 10468 - protein, 30 aa, Artificial Sequence
  Description of Artificial Sequence: Synthetic polypeptide
DEEEIRTTNPVATEQYGSVSTDNLQVGNER

SEQ ID NO: 10469 - protein, 29 aa, Artificial Sequence
  Description of Artificial Sequence: Synthetic peptide
DEEEIRTTNPVATEPYYGSVSTNLQRGNQ

SEQ ID NO: 10470 - protein, 28 aa, Artificial Sequence
  Description of Artificial Sequence: Synthetic peptide
MEEEIRTTNPVATECYGAVSTNLQRGNR

SEQ ID NO: 10471 - protein, 29 aa, Artificial Sequence
  Description of Artificial Sequence: Synthetic peptide
MEEEIRTTNPVATEQYGSVSCTNLQNGNR

SEQ ID NO: 10472 - protein, 28 aa, Artificial Sequence
  Description of Artificial Sequence: Synthetic peptide
DEEEVRTTNPVATEIYGSVSTNLQRGNF

SEQ ID NO: 10473 - protein, 28 aa, Artificial Sequence
  Description of Artificial Sequence: Synthetic peptide
DEEEIRTTNPVATEQYGSVSTELEDGNR

SEQ ID NO: 10474 - protein, 31 aa, Artificial Sequence
  Description of Artificial Sequence: Synthetic polypeptide
DEEEIRTTNPVATEQYGSVSTNLVQIRGNPR

SEQ ID NO: 10475 - protein, 30 aa, Artificial Sequence
  Description of Artificial Sequence: Synthetic polypeptide
DEEEIRTTNPVATEQYGSVSCENLQCRGNR

SEQ ID NO: 10476 - protein, 29 aa, Artificial Sequence
  Description of Artificial Sequence: Synthetic peptide
DEEEIRTVNPVATECYGSVSTENLQRGNR

SEQ ID NO: 10477 - protein, 28 aa, Artificial Sequence
  Description of Artificial Sequence: Synthetic peptide
DEEEIRTTNPVATEQYGSVSTNLQIGDE

SEQ ID NO: 10478 - protein, 28 aa, Artificial Sequence
  Description of Artificial Sequence: Synthetic peptide
DEEEIRTTNPVATEQYGSVSDDPQRGNR

SEQ ID NO: 10479 - protein, 28 aa, Artificial Sequence
  Description of Artificial Sequence: Synthetic peptide
DEEEIRTTNPAATEQYGSVSTNGARGNR

SEQ ID NO: 10480 - protein, 28 aa, Artificial Sequence
  Description of Artificial Sequence: Synthetic peptide
DEEEIRTTNPVATEQYGSVSTNLQFGES

SEQ ID NO: 10481 - protein, 29 aa, Artificial Sequence
  Description of Artificial Sequence: Synthetic peptide
DEEEIRTTNPVATEQYGSVSTPNEQRGNV

SEQ ID NO: 10482 - protein, 28 aa, Artificial Sequence
  Description of Artificial Sequence: Synthetic peptide
DEEEIRTTNPVATEQYGSVSTNLQVGET

SEQ ID NO: 10483 - protein, 30 aa, Artificial Sequence
  Description of Artificial Sequence: Synthetic polypeptide
DEEEIRTTNPVATWQYGSVSQTNLQRGNDR

SEQ ID NO: 10484 - protein, 28 aa, Artificial Sequence
  Description of Artificial Sequence: Synthetic peptide
DEEEIRTTNPVATEQYGSVSTNLQEGEP

SEQ ID NO: 10485 - protein, 30 aa, Artificial Sequence
  Description of Artificial Sequence: Synthetic polypeptide
DEEEIRTTNPVATEQYGSACSTNPLQRGNR

SEQ ID NO: 10486 - protein, 29 aa, Artificial Sequence
  Description of Artificial Sequence: Synthetic peptide
DEEEIRTTNPVGTEQFGSVSTNLQARGNR

SEQ ID NO: 10487 - protein, 30 aa, Artificial Sequence
  Description of Artificial Sequence: Synthetic polypeptide
DEEEIRTTNPVATEQYGSVSETELQRGNER

SEQ ID NO: 10488 - protein, 29 aa, Artificial Sequence
  Description of Artificial Sequence: Synthetic peptide
MEEEIRTTNPVATEQYGSVSENLQREGNR

SEQ ID NO: 10489 - protein, 28 aa, Artificial Sequence
  Description of Artificial Sequence: Synthetic peptide
DEEEIRTTNPVATEVYGSVSINVQRGNR

SEQ ID NO: 10490 - protein, 29 aa, Artificial Sequence
  Description of Artificial Sequence: Synthetic peptide
DEEEIRTTNPVATEQYGSVSTNLDAGVNR

SEQ ID NO: 10491 - protein, 28 aa, Artificial Sequence
  Description of Artificial Sequence: Synthetic peptide
DEEEIRTTNPVATEQYGSVSTMDQRGNH

SEQ ID NO: 10492 - protein, 28 aa, Artificial Sequence
  Description of Artificial Sequence: Synthetic peptide
DEEELRTTNPTATEQYGSVPTNLQRGNR

SEQ ID NO: 10493 - protein, 28 aa, Artificial Sequence
  Description of Artificial Sequence: Synthetic peptide
DEEEIRTVNPVATEQYGSVSTNPQRGLR

SEQ ID NO: 10494 - protein, 29 aa, Artificial Sequence
  Description of Artificial Sequence: Synthetic peptide
DEEEIRTTNPVATEQYGASVSYNLQRGNQ

SEQ ID NO: 10495 - protein, 28 aa, Artificial Sequence
  Description of Artificial Sequence: Synthetic peptide
DEEEIRTTNPDATEWYGSVSTNLQRMNR

SEQ ID NO: 10496 - protein, 30 aa, Artificial Sequence
  Description of Artificial Sequence: Synthetic polypeptide
DEEEIRTTNPVATEQYGSVSDTNLQLFGNR

SEQ ID NO: 10497 - protein, 28 aa, Artificial Sequence
  Description of Artificial Sequence: Synthetic peptide
DEQEIRTTNPCATEQYGSVATNLQRGNR

SEQ ID NO: 10498 - protein, 28 aa, Artificial Sequence
  Description of Artificial Sequence: Synthetic peptide
DEEEIRTTNPVATELYGSVGTNLQRLNR

SEQ ID NO: 10499 - protein, 28 aa, Artificial Sequence
  Description of Artificial Sequence: Synthetic peptide
DDEEIRTTNPVATEQYGSIGTNLQRGNR

SEQ ID NO: 10500 - protein, 29 aa, Artificial Sequence
  Description of Artificial Sequence: Synthetic peptide
DEEEIRTTNPVATEQYGSVSTDNLQMGNF

SEQ ID NO: 10501 - protein, 28 aa, Artificial Sequence
  Description of Artificial Sequence: Synthetic peptide
DEQEIRTTNPVATEQWGSVSENLQRGNR

SEQ ID NO: 10502 - protein, 28 aa, Artificial Sequence
  Description of Artificial Sequence: Synthetic peptide
DEEEIRTTNPVATEQYGSVSTNPQYGNE

SEQ ID NO: 10503 - protein, 29 aa, Artificial Sequence
  Description of Artificial Sequence: Synthetic peptide
DEEEIRTTNPVATEQYGSYVSTNPQRGNM

SEQ ID NO: 10504 - protein, 30 aa, Artificial Sequence
  Description of Artificial Sequence: Synthetic polypeptide
DEEEIRTTNPVATEQYGSVSTNLQDQGNDR

SEQ ID NO: 10505 - protein, 28 aa, Artificial Sequence
  Description of Artificial Sequence: Synthetic peptide
DEQEIRTTNPVATEQYGSVDENLQRGNR

SEQ ID NO: 10506 - protein, 28 aa, Artificial Sequence
  Description of Artificial Sequence: Synthetic peptide
DEEEITTTNPVATEMYGIVSTNLQRGNR

SEQ ID NO: 10507 - protein, 28 aa, Artificial Sequence
  Description of Artificial Sequence: Synthetic peptide
DEEYIRTTNPVATEQYGSVSTNLQPGQR

SEQ ID NO: 10508 - protein, 29 aa, Artificial Sequence
  Description of Artificial Sequence: Synthetic peptide
DEEEIRTTNPCATEQYGSVSTNIQRGNDR

SEQ ID NO: 10509 - protein, 28 aa, Artificial Sequence
  Description of Artificial Sequence: Synthetic peptide
DEEEIRTTNPVATQQYGSVSTPDQRGNR

SEQ ID NO: 10510 - protein, 28 aa, Artificial Sequence
  Description of Artificial Sequence: Synthetic peptide
VEEEIRTTNPVATEHFGSVSTNLQRGNR

SEQ ID NO: 10511 - protein, 28 aa, Artificial Sequence
  Description of Artificial Sequence: Synthetic peptide
VEEEIRTTNPCATEQWGSVSTNLQRGNR

SEQ ID NO: 10512 - protein, 31 aa, Artificial Sequence; identical to SEQ ID NO: 9864
  Description of Artificial Sequence: Synthetic polypeptide

SEQ ID NO: 10513 - protein, 29 aa, Artificial Sequence
  Description of Artificial Sequence: Synthetic peptide
DEEEIRTTNPVATEQYGSVSTNLQMDENR

SEQ ID NO: 10514 - protein, 28 aa, Artificial Sequence
  Description of Artificial Sequence: Synthetic peptide
DHEEIRTTNPVATEQYGSVSTGLQPGNR

SEQ ID NO: 10515 - protein, 29 aa, Artificial Sequence
  Description of Artificial Sequence: Synthetic peptide
DEEEIRTTNPVATEQYGSVSETNLDRGNP

SEQ ID NO: 10516 - protein, 28 aa, Artificial Sequence
  Description of Artificial Sequence: Synthetic peptide
SEEEIRTTNPVATEQYGSVSTNLQRQTR

SEQ ID NO: 10517 - protein, 28 aa, Artificial Sequence
  Description of Artificial Sequence: Synthetic peptide
DEEEIRTTNPVATEQYGSVSTNQQDGNI

SEQ ID NO: 10518 - protein, 30 aa, Artificial Sequence
  Description of Artificial Sequence: Synthetic polypeptide
DEEEIRTTNPVATEQYGSVSTNPQLREGNR

SEQ ID NO: 10519 - protein, 29 aa, Artificial Sequence
  Description of Artificial Sequence: Synthetic peptide
DEEEIRTTNPVATEQYGSVSLTDPQRGNR

SEQ ID NO: 10520 - protein, 28 aa, Artificial Sequence
  Description of Artificial Sequence: Synthetic peptide
DEEEIRTTNPEATEQYGSVSTDLERGNR

SEQ ID NO: 10521 - protein, 28 aa, Artificial Sequence
  Description of Artificial Sequence: Synthetic peptide
DEEEIETTNPVATEQFGSVSTNLQRGNQ

SEQ ID NO: 10522 - protein, 28 aa, Artificial Sequence
  Description of Artificial Sequence: Synthetic peptide
DEEEIRTTNPVATECYGSVSTNLQIGND

SEQ ID NO: 10523 - protein, 31 aa, Artificial Sequence
  Description of Artificial Sequence: Synthetic polypeptide
DEEEIRTTNPVATEQYGSVSETNLQERGENR

SEQ ID NO: 10524 - protein, 28 aa, Artificial Sequence
  Description of Artificial Sequence: Synthetic peptide
DEEEIRTTNPVATEQYGSVSTNLQAGEN

SEQ ID NO: 10525 - protein, 29 aa, Artificial Sequence
  Description of Artificial Sequence: Synthetic peptide
DEEEIRTTNPVCTEQYGSVSTNLWQSGNR

SEQ ID NO: 10526 - protein, 29 aa, Artificial Sequence
  Description of Artificial Sequence: Synthetic peptide
DEEEIRTTNPVATEQYGSVSTQNLQTGNL

SEQ ID NO: 10527 - protein, 28 aa, Artificial Sequence
  Description of Artificial Sequence: Synthetic peptide
SEEEIRQTNPVATEQYGSVSTNLQRFNR

SEQ ID NO: 10528 - protein, 29 aa, Artificial Sequence
  Description of Artificial Sequence: Synthetic peptide
DEEEIRTTNPVCTEQYGSVSTMDLQRGNR

SEQ ID NO: 10529 - protein, 30 aa, Artificial Sequence
  Description of Artificial Sequence: Synthetic polypeptide
NEEEIRTTNPVATEQYGSVSGTLNLQRGNR

SEQ ID NO: 10530 - protein, 28 aa, Artificial Sequence
  Description of Artificial Sequence: Synthetic peptide
NEEEIRTVNPVATEVYGSVSTNLQRGNR

SEQ ID NO: 10531 - protein, 30 aa, Artificial Sequence
  Description of Artificial Sequence: Synthetic polypeptide
DEEEIRTTNPVATEQYGSVSTNGLVLRGNR

SEQ ID NO: 10532 - protein, 28 aa, Artificial Sequence
  Description of Artificial Sequence: Synthetic peptide
SEEEIRTTNPTATEQYGGVSTNLQRGNR

SEQ ID NO: 10533 - protein, 30 aa, Artificial Sequence
  Description of Artificial Sequence: Synthetic polypeptide
DEEEIWTTNPVATEQYGSVSVTNLQRGPNR

SEQ ID NO: 10534 - protein, 28 aa, Artificial Sequence
  Description of Artificial Sequence: Synthetic peptide
NEEEIRTVNPVATEQYGNVSTNLQRGNR

SEQ ID NO: 10535 - protein, 28 aa, Artificial Sequence
  Description of Artificial Sequence: Synthetic peptide
DEEEIRTTNPVATEQYGSVSTNEQVGNQ

SEQ ID NO: 10536 - protein, 28 aa, Artificial Sequence
  Description of Artificial Sequence: Synthetic peptide
DEEEIRTTNPVATEQYGSVSTDLEQGNR

SEQ ID NO: 10537 - protein, 29 aa, Artificial Sequence
  Description of Artificial Sequence: Synthetic peptide
DEEEIRTTNPVATEQYGSVSTNLQEFGER

SEQ ID NO: 10538 - protein, 29 aa, Artificial Sequence
  Description of Artificial Sequence: Synthetic peptide
DEEEIRTTNPVATEQYGSVSTDLQDRGNE

SEQ ID NO: 10539 - protein, 30 aa, Artificial Sequence
  Description of Artificial Sequence: Synthetic polypeptide
DEEEIRTTNPVATEQYGSWSTNLPQRGNPR

SEQ ID NO: 10540 - protein, 30 aa, Artificial Sequence
  Description of Artificial Sequence: Synthetic polypeptide
DEEEIRTTNPVATEQYGSVEETNLQRGENR

SEQ ID NO: 10541 - protein, 30 aa, Artificial Sequence
  Description of Artificial Sequence: Synthetic polypeptide
DEEEIRTTNPVATEQYGSVSTNLQREGNDS

SEQ ID NO: 10542 - protein, 29 aa, Artificial Sequence
  Description of Artificial Sequence: Synthetic peptide
DEEEIRTTNPVATEQYGSVSTMNLQQGNI

SEQ ID NO: 10543 - protein, 29 aa, Artificial Sequence
  Description of Artificial Sequence: Synthetic peptide
DEEEIRTTNPEATEQYGSVSTNDQDRGNR

SEQ ID NO: 10544 - protein, 29 aa, Artificial Sequence
  Description of Artificial Sequence: Synthetic peptide
YEEEIRTTNPVATEQYGSVSTNLQIRGNP

SEQ ID NO: 10545 - protein, 29 aa, Artificial Sequence
  Description of Artificial Sequence: Synthetic peptide
DEECIRTTNPVATEQYGSVSTNLQLRGLR

SEQ ID NO: 10546 - protein, 30 aa, Artificial Sequence
  Description of Artificial Sequence: Synthetic polypeptide
DEEEIRTTNPVATEQYGSVSTPPLQRGENR

SEQ ID NO: 10547 - protein, 28 aa, Artificial Sequence
  Description of Artificial Sequence: Synthetic peptide
DEEEIRTVNPVATEHYGSVDTNLQRGNR

SEQ ID NO: 10548 - protein, 28 aa, Artificial Sequence
  Description of Artificial Sequence: Synthetic peptide
DEEEIRATNPVATEVYGWVSTNLQRGNR

SEQ ID NO: 10549 - protein, 28 aa, Artificial Sequence
  Description of Artificial Sequence: Synthetic peptide
DEEEIRTTNPCATEQYGTVHTNLQRGNR

SEQ ID NO: 10550 - protein, 30 aa, Artificial Sequence
  Description of Artificial Sequence: Synthetic polypeptide
DEEEIRTTNPVATEQYGSVSTQNLNLRGNR

SEQ ID NO: 10551 - protein, 28 aa, Artificial Sequence
  Description of Artificial Sequence: Synthetic peptide
VEEEIRTTNPVATEQYGNVSTNLQRLNR

SEQ ID NO: 10552 - protein, 30 aa, Artificial Sequence
  Description of Artificial Sequence: Synthetic polypeptide
DEEEIRTTNPVATEQYGSVSTNPLQRGDNY

SEQ ID NO: 10553 - protein, 28 aa, Artificial Sequence
  Description of Artificial Sequence: Synthetic peptide
DEEEIRTTNPVATEIYGAVCTNLQRGNR

SEQ ID NO: 10554 - protein, 28 aa, Artificial Sequence
  Description of Artificial Sequence: Synthetic peptide
DEEEIRTTNPVATENYGSVSTNLQRLTR

SEQ ID NO: 10555 - protein, 28 aa, Artificial Sequence
  Description of Artificial Sequence: Synthetic peptide
DEEEIRTTNPTATEQYGSVSTNLQNGNA

SEQ ID NO: 10556 - protein, 29 aa, Artificial Sequence
  Description of Artificial Sequence: Synthetic peptide
DEEEIRTTNPVATEQYGSVSTNLQENGNY

SEQ ID NO: 10557 - protein, 29 aa, Artificial Sequence
  Description of Artificial Sequence: Synthetic peptide
DEEEIRTTNPVATEDYGSVSTMLQRGENR

SEQ ID NO: 10558 - protein, 28 aa, Artificial Sequence
  Description of Artificial Sequence: Synthetic peptide
DEEEIRTTNPDATEQYGSVSTNLDRGNA

SEQ ID NO: 10559 - protein, 28 aa, Artificial Sequence
  Description of Artificial Sequence: Synthetic peptide
DEEEIRTTNPVATEQYGSVSTNLLIGNP

SEQ ID NO: 10560 - protein, 31 aa, Artificial Sequence
  Description of Artificial Sequence: Synthetic polypeptide
DEEEIRTTNPVATEQYGSVSATNLQREGNDR

SEQ ID NO: 10561 - protein, 28 aa, Artificial Sequence
  Description of Artificial Sequence: Synthetic peptide
DEEEICTTNPVATEQYGSVSTNEERGNR

SEQ ID NO: 10562 - protein, 30 aa, Artificial Sequence
  Description of Artificial Sequence: Synthetic polypeptide
DEEEIRATNPVATEQYGSVQSTNLQRGNMR

SEQ ID NO: 10563 - protein, 28 aa, Artificial Sequence
  Description of Artificial Sequence: Synthetic peptide
DEEEIRTTNPVATEIYGSVSNNLERGNR

SEQ ID NO: 10564 - protein, 29 aa, Artificial Sequence
  Description of Artificial Sequence: Synthetic peptide
DEEEIYTTNPVATEQYGSVSTNLQRGVNI

SEQ ID NO: 10565 - protein, 31 aa, Artificial Sequence
  Description of Artificial Sequence: Synthetic polypeptide
DEEEIRTTNPVATEQYGSVESCTNLQRGNER

SEQ ID NO: 10566 - protein, 28 aa, Artificial Sequence
  Description of Artificial Sequence: Synthetic peptide
DEEEIRTVNPVGYEQYGSVSTNLQRGNR

SEQ ID NO: 10567 - protein, 30 aa, Artificial Sequence
  Description of Artificial Sequence: Synthetic polypeptide
DEEEIRTTNPVSTEQYGSVSTPNPLQRGNR

SEQ ID NO: 10568 - protein, 30 aa, Artificial Sequence
  Description of Artificial Sequence: Synthetic polypeptide
DEEEIRTTNPVATEQYGSVSITNLERGENR

SEQ ID NO: 10569 - protein, 28 aa, Artificial Sequence
  Description of Artificial Sequence: Synthetic peptide
DEEEIRTTNPVATEWYGCVSNNLQRGNR

SEQ ID NO: 10570 - protein, 31 aa, Artificial Sequence
  Description of Artificial Sequence: Synthetic polypeptide
DEEEIRTTNPVATEQYGMSVSTNLQRGDNPR

SEQ ID NO: 10571 - protein, 28 aa, Artificial Sequence
  Description of Artificial Sequence: Synthetic peptide
DEEEIRTTNPVATEQYSSVATNLQRPNR

SEQ ID NO: 10572 - protein, 28 aa, Artificial Sequence
  Description of Artificial Sequence: Synthetic peptide
DEEEIRTTNPVATELWGSVSTQLQRGNR

SEQ ID NO: 10573 - protein, 29 aa, Artificial Sequence
  Description of Artificial Sequence: Synthetic peptide
DEEEIRTTNPVATEQYGSVSTNEQRGDNF

SEQ ID NO: 10574 - protein, 28 aa, Artificial Sequence
  Description of Artificial Sequence: Synthetic peptide
GEQEIATTNPVATEQYGSVSTNLQRGNR

SEQ ID NO: 10575 - protein, 30 aa, Artificial Sequence
  Description of Artificial Sequence: Synthetic polypeptide
DEEEIRTTNPVATEQYGSVSATNLQVGENR

SEQ ID NO: 10576 - protein, 29 aa, Artificial Sequence
  Description of Artificial Sequence: Synthetic peptide
DEEEIRTTNPVATEQYGSVSTNLERKGER

SEQ ID NO: 10577 - protein, 29 aa, Artificial Sequence
  Description of Artificial Sequence: Synthetic peptide
DEEEIRTTNPVATEQYGSVSTVNLQYGNI

SEQ ID NO: 10578 - protein, 28 aa, Artificial Sequence
  Description of Artificial Sequence: Synthetic peptide
DEEEIRPTNPVATENYGSVSTNGQRGNR

SEQ ID NO: 10579 - protein, 29 aa, Artificial Sequence
  Description of Artificial Sequence: Synthetic peptide
QEQEIRTTNPVATEQYGSVSATNLQRGNR

SEQ ID NO: 10580 - protein, 29 aa, Artificial Sequence
  Description of Artificial Sequence: Synthetic peptide
DEEEIRTTNPVATEQYGSVSTNLQQGNDS

SEQ ID NO: 10581 - protein, 28 aa, Artificial Sequence
  Description of Artificial Sequence: Synthetic peptide
DEEEIATTNPVATEQYGSVSTDLQRGDR

SEQ ID NO: 10582 - protein, 28 aa, Artificial Sequence
  Description of Artificial Sequence: Synthetic peptide
DEEEIRTTNPCCTEQYGSVSMNLQRGNR

SEQ ID NO: 10583 - protein, 30 aa, Artificial Sequence
  Description of Artificial Sequence: Synthetic polypeptide
DEEEIRTTNPVATEQYGSVSTPNLERTGNR

SEQ ID NO: 10584 - protein, 29 aa, Artificial Sequence
  Description of Artificial Sequence: Synthetic peptide
DEEEISTTNPVATEQYGSVSTINLERGNR

SEQ ID NO: 10585 - protein, 28 aa, Artificial Sequence
  Description of Artificial Sequence: Synthetic peptide
DEEEIRTTNPVATEQYGSVSTNLQLGEV

SEQ ID NO: 10586 - protein, 30 aa, Artificial Sequence
  Description of Artificial Sequence: Synthetic polypeptide
DEEEIRTTNPVATEQYGSVSQTNLNQEGNR

SEQ ID NO: 10587 - protein, 28 aa, Artificial Sequence
  Description of Artificial Sequence: Synthetic peptide
DEEEIRTTNPDATEQYGSVSTNLLIGNR

SEQ ID NO: 10588 - protein, 29 aa, Artificial Sequence
  Description of Artificial Sequence: Synthetic peptide
DEEEIRTTNPVATEQYGSVSTNLTSMGNR

SEQ ID NO: 10589 - protein, 29 aa, Artificial Sequence
  Description of Artificial Sequence: Synthetic peptide
DEEEIRTTNPVATEQYGSVSTNLQIDGER

SEQ ID NO: 10590 - protein, 28 aa, Artificial Sequence
  Description of Artificial Sequence: Synthetic peptide
DEEEIRTTNPVATMQYGSVSMNLQRGNN

SEQ ID NO: 10591 - protein, 28 aa, Artificial Sequence
  Description of Artificial Sequence: Synthetic peptide
DEEEIRTTNPEATEQYGSVSTNEQRGND

SEQ ID NO: 10592 - protein, 28 aa, Artificial Sequence
  Description of Artificial Sequence: Synthetic peptide
DEEEIRSTNPVATENYGSVGTNLQRGNR

SEQ ID NO: 10593 - protein, 29 aa, Artificial Sequence
  Description of Artificial Sequence: Synthetic peptide
DEEEIRTTNPVATECYGSVGSTNLQIGNR

SEQ ID NO: 10594 - protein, 28 aa, Artificial Sequence
  Description of Artificial Sequence: Synthetic peptide
DEEEIEATNPVATEQYGWVSTNLQRGNR

SEQ ID NO: 10595 - protein, 28 aa, Artificial Sequence
  Description of Artificial Sequence: Synthetic peptide
DEEQIRTTNPVATEQYGSWSTNLQRGER

SEQ ID NO: 10596 - protein, 28 aa, Artificial Sequence
  Description of Artificial Sequence: Synthetic peptide
DEEEVRTVNPVATEQYGSVSTNLERGNR

SEQ ID NO: 10597 - protein, 29 aa, Artificial Sequence
  Description of Artificial Sequence: Synthetic peptide
DEEEIRTTNPVATEQYGSVSTNLQEIGNF

SEQ ID NO: 10598 - protein, 31 aa, Artificial Sequence
  Description of Artificial Sequence: Synthetic polypeptide
DEEEIRTTNPVATEQYGSVDSTNLPQVRGNR

SEQ ID NO: 10599 - protein, 30 aa, Artificial Sequence
  Description of Artificial Sequence: Synthetic polypeptide
DEEEIRTTNPVATEQYGCVSATNLQRNGNR

SEQ ID NO: 10600 - protein, 29 aa, Artificial Sequence
  Description of Artificial Sequence: Synthetic peptide
DENEIRTTNPVATEQYGSVSAENLQRGNR

SEQ ID NO: 10601 - protein, 29 aa, Artificial Sequence
  Description of Artificial Sequence: Synthetic peptide
DEEEIWTTNPVATEQYGSVSTNLQRDGMR

SEQ ID NO: 10602 - protein, 29 aa, Artificial Sequence
  Description of Artificial Sequence: Synthetic peptide
SEEEIRTTNPVATEQYGWVSATNLQRGNR

SEQ ID NO: 10603 - protein, 28 aa, Artificial Sequence
  Description of Artificial Sequence: Synthetic peptide
DEEEIRTTNPVATEQYGSVETNLLRGNY

SEQ ID NO: 10604 - protein, 29 aa, Artificial Sequence
  Description of Artificial Sequence: Synthetic peptide
DCEEIRTTNPVATEQYGSWSTNLNQRGNR

SEQ ID NO: 10605 - protein, 30 aa, Artificial Sequence
  Description of Artificial Sequence: Synthetic polypeptide
DEEEIRTTNPVATEQYGQVSTQNLQLRGNR

SEQ ID NO: 10606 - protein, 28 aa, Artificial Sequence
  Description of Artificial Sequence: Synthetic peptide
YEEEIRTTNPVAGEQYGVVSTNLQRGNR

SEQ ID NO: 10607 - protein, 28 aa, Artificial Sequence
  Description of Artificial Sequence: Synthetic peptide
EEEEIRTTNPVATEQYGSVSTNLQYGNC

SEQ ID NO: 10608 - protein, 30 aa, Artificial Sequence
  Description of Artificial Sequence: Synthetic polypeptide
DEEEIRTTNPVATEQYGSVSTNDVQRGNPR

SEQ ID NO: 10609 - protein, 28 aa, Artificial Sequence
  Description of Artificial Sequence: Synthetic peptide
DEEEIRTTNPAATEQYGSVSTNEQRGNN

SEQ ID NO: 10610 - protein, 28 aa, Artificial Sequence
  Description of Artificial Sequence: Synthetic peptide
DEEEIRTTNPVATEQYGSVDTNLQAGNI

SEQ ID NO: 10611 - protein, 28 aa, Artificial Sequence
  Description of Artificial Sequence: Synthetic peptide
DEEEIRSTNPVATENYGTVSTNLQRGNR

SEQ ID NO: 10612 - protein, 30 aa, Artificial Sequence
  Description of Artificial Sequence: Synthetic polypeptide
DEEEIRATNPVATEQYGSVSTNLQREGNER

SEQ ID NO: 10613 - protein, 31 aa, Artificial Sequence
  Description of Artificial Sequence: Synthetic polypeptide
DEEEIRTTNPVATEQYGSVSITNLVQRGDNR

SEQ ID NO: 10614 - protein, 30 aa, Artificial Sequence
  Description of Artificial Sequence: Synthetic polypeptide
DEEEIRTTNPVATEQYGSVDSTDLQRGNDR

SEQ ID NO: 10615 - protein, 29 aa, Artificial Sequence
  Description of Artificial Sequence: Synthetic peptide
DEEEIRTTNPVATEQYWGSVSTNDQRMNR

SEQ ID NO: 10616 - protein, 28 aa, Artificial Sequence
  Description of Artificial Sequence: Synthetic peptide
DEEEIRATNPVATETYGSVATNLQRGNR

SEQ ID NO: 10617 - protein, 28 aa, Artificial Sequence
  Description of Artificial Sequence: Synthetic peptide
DEEEVVTTNPVATEQYGSVSTNLQRGTR

SEQ ID NO: 10618 - protein, 28 aa, Artificial Sequence
  Description of Artificial Sequence: Synthetic peptide
DEEEIRTTNPDATEQYGSVSTEEQRGNR

SEQ ID NO: 10619 - protein, 29 aa, Artificial Sequence
  Description of Artificial Sequence: Synthetic peptide
DEEEISTTNPVATEQYGSVSDNGLQRGNR

SEQ ID NO: 10620 - protein, 28 aa, Artificial Sequence
  Description of Artificial Sequence: Synthetic peptide
DEEEINGTNPVATEQYGEVSTNLQRGNR

SEQ ID NO: 10621 - protein, 28 aa, Artificial Sequence
  Description of Artificial Sequence: Synthetic peptide
DENEIATTNPVATEMYGSVSTNLQRGNR

SEQ ID NO: 10622 - protein, 30 aa, Artificial Sequence
  Description of Artificial Sequence: Synthetic polypeptide
DEEEIRTTNPVATEQYGSVSTNLQEDKGNR

SEQ ID NO: 10623 - protein, 28 aa, Artificial Sequence
  Description of Artificial Sequence: Synthetic peptide
DEEELVTTNPVATEQYGSVSQNLQRGNR

SEQ ID NO: 10624 - protein, 28 aa, Artificial Sequence
  Description of Artificial Sequence: Synthetic peptide
DENEIRTTNPVATEQYGSVSTNDQRGNA

SEQ ID NO: 10625 - protein, 28 aa, Artificial Sequence
  Description of Artificial Sequence: Synthetic peptide
DEEEIRTTNPVATEQYGSVSTDLQRGDL

SEQ ID NO: 10626 - protein, 28 aa, Artificial Sequence
  Description of Artificial Sequence: Synthetic peptide
DEEEIRTTNPVATEQYGSVSTELQEGNQ

SEQ ID NO: 10627 - protein, 28 aa, Artificial Sequence
  Description of Artificial Sequence: Synthetic peptide
DDEEIRTTNPVATEQYGSTSTNLQRLNR

SEQ ID NO: 10628 - protein, 28 aa, Artificial Sequence
  Description of Artificial Sequence: Synthetic peptide
DEEEISTTNPVATEQYGSVSTNLTRGND

SEQ ID NO: 10629 - protein, 28 aa, Artificial Sequence
  Description of Artificial Sequence: Synthetic peptide
DEEEIRTTNPVATEQYGSVSTNLQFGEW

SEQ ID NO: 10630 - protein, 28 aa, Artificial Sequence
  Description of Artificial Sequence: Synthetic peptide
DEQEIRTVNPVATEQYGSVSTVLQRGNR

SEQ ID NO: 10631 - protein, 28 aa, Artificial Sequence
  Description of Artificial Sequence: Synthetic peptide
DEEEIRTTNPVATEQYGSVSTDDQRENR

SEQ ID NO: 10632 - protein, 28 aa, Artificial Sequence
  Description of Artificial Sequence: Synthetic peptide
DEEEIRTTNPVATEQWGSVDTNLQIGNR

SEQ ID NO: 10633 - protein, 29 aa, Artificial Sequence
  Description of Artificial Sequence: Synthetic peptide
DEEEIRTTNPVATEQYGSVSTNLCCGGNR

SEQ ID NO: 10634 - protein, 29 aa, Artificial Sequence
  Description of Artificial Sequence: Synthetic peptide
DEEEIRTTNPVATEQYGSVSTNLPQQGNF

SEQ ID NO: 10635 - protein, 28 aa, Artificial Sequence
  Description of Artificial Sequence: Synthetic peptide
DEEEIFTTNPVATESYGSVSTNLQRGNN

SEQ ID NO: 10636 - protein, 29 aa, Artificial Sequence
  Description of Artificial Sequence: Synthetic peptide
DEEEIATTNPVATEQYGSVSTNEQDRGNR

SEQ ID NO: 10637 - protein, 28 aa, Artificial Sequence
  Description of Artificial Sequence: Synthetic peptide
DEEEIRTTNPVATEQYGSVSTNDENGNR

SEQ ID NO: 10638 - protein, 29 aa, Artificial Sequence
  Description of Artificial Sequence: Synthetic peptide
DEEEIRTTNPVATEPYGQSVSTNLQTGNR

SEQ ID NO: 10639 - protein, 28 aa, Artificial Sequence
  Description of Artificial Sequence: Synthetic peptide
DEEEINTTNPVATEQYGEVSCNLQRGNR

SEQ ID NO: 10640 - protein, 28 aa, Artificial Sequence
  Description of Artificial Sequence: Synthetic peptide
DEEEIRTTNPVATEQYGSVSTPLQRDNH

SEQ ID NO: 10641 - protein, 29 aa, Artificial Sequence
  Description of Artificial Sequence: Synthetic peptide
DEEEIRTTNPVATEQYGSVSTNEQLLGNR

SEQ ID NO: 10642 - protein, 31 aa, Artificial Sequence
  Description of Artificial Sequence: Synthetic polypeptide
DEEEIRTTNPVATEQYGSQVSTNLEQRSGNR

SEQ ID NO: 10643 - protein, 29 aa, Artificial Sequence
  Description of Artificial Sequence: Synthetic peptide
DEEEIATTNPVATEQYGSVSTNLQNEGNR

SEQ ID NO: 10644 - protein, 29 aa, Artificial Sequence
  Description of Artificial Sequence: Synthetic peptide
DEEEIRTTNPVATEQYGIVSENLQWRGNR

SEQ ID NO: 10645 - protein, 28 aa, Artificial Sequence
  Description of Artificial Sequence: Synthetic peptide
DEEEIRTTNPVASECYGAVSTNLQRGNR

SEQ ID NO: 10646 - protein, 28 aa, Artificial Sequence
  Description of Artificial Sequence: Synthetic peptide
DEEEIRTTNPVATEQYGSVSTNLQTGET

SEQ ID NO: 10647 - protein, 28 aa, Artificial Sequence
  Description of Artificial Sequence: Synthetic peptide
DEEEIRTTNPVSTEQYGSVSTNLEPGNR

SEQ ID NO: 10648 - protein, 29 aa, Artificial Sequence
  Description of Artificial Sequence: Synthetic peptide
DEEEIRTTNPVATEQYGSVSTNLQRGEDQ

SEQ ID NO: 10649 - protein, 28 aa, Artificial Sequence
  Description of Artificial Sequence: Synthetic peptide
DEEEIRTTNPVATEQYGSVSTNLEAGND

SEQ ID NO: 10650 - protein, 28 aa, Artificial Sequence
  Description of Artificial Sequence: Synthetic peptide
DEEEIRQTNPVATEQYGSVPTNPQRGNR

SEQ ID NO: 10651 - protein, 28 aa, Artificial Sequence
  Description of Artificial Sequence: Synthetic peptide
DEEEIRTTNPVATEQYGSVSENLQNGNC

SEQ ID NO: 10652 - protein, 29 aa, Artificial Sequence
  Description of Artificial Sequence: Synthetic peptide
DEEEIRTTNPVATEQYGSVSTNDQGGENR

SEQ ID NO: 10653 - protein, 28 aa, Artificial Sequence
  Description of Artificial Sequence: Synthetic peptide
DEHEIRTTNPCATEQYGSVSTNLQRENR

SEQ ID NO: 10654 - protein, 28 aa, Artificial Sequence
  Description of Artificial Sequence: Synthetic peptide
DEEEIRATNPVAWEQYGSVSTNLQRGLR

SEQ ID NO: 10655 - protein, 29 aa, Artificial Sequence
  Description of Artificial Sequence: Synthetic peptide
DEEEIRTTNPVATEQYGSVSTDLQRGNME

SEQ ID NO: 10656 - protein, 28 aa, Artificial Sequence
  Description of Artificial Sequence: Synthetic peptide
GEEEIRTTNPVATEQYGSVATNLQPGNR

SEQ ID NO: 10657 - protein, 28 aa, Artificial Sequence
  Description of Artificial Sequence: Synthetic peptide
DEEEIRTTNPVATEQYGSVSTDQERGNR

SEQ ID NO: 10658 - protein, 28 aa, Artificial Sequence
  Description of Artificial Sequence: Synthetic peptide
DEEEIRTTNPAATEQYGSVSTNLQLGDR

SEQ ID NO: 10659 - protein, 29 aa, Artificial Sequence
  Description of Artificial Sequence: Synthetic peptide
DEEEIRTTNPVATEQYGSVSTLDDQRGNR

SEQ ID NO: 10660 - protein, 28 aa, Artificial Sequence
  Description of Artificial Sequence: Synthetic peptide
DENEIVTTNPVATEIYGSVSTNLQRGNR

SEQ ID NO: 10661 - protein, 29 aa, Artificial Sequence
  Description of Artificial Sequence: Synthetic peptide
DEEEIRTTNPVATEQYGSVSDTNLDPGNR

SEQ ID NO: 10662 - protein, 28 aa, Artificial Sequence
  Description of Artificial Sequence: Synthetic peptide
DEEEIRTTNPVATEQYGSVSTGLENGNR

SEQ ID NO: 10663 - protein, 29 aa, Artificial Sequence
  Description of Artificial Sequence: Synthetic peptide
DEEEIRTTNPVATETYGSVSTMNLQMGNR

SEQ ID NO: 10664 - protein, 28 aa, Artificial Sequence
  Description of Artificial Sequence: Synthetic peptide
DETEIVCTNPVATEQYGSVSTNLQRGNR

SEQ ID NO: 10665 - protein, 28 aa, Artificial Sequence
  Description of Artificial Sequence: Synthetic peptide
DEQEIRTTNPVATEVYGAVSTNLQRGNR

SEQ ID NO: 10666 - protein, 28 aa, Artificial Sequence
  Description of Artificial Sequence: Synthetic peptide
DEEEIRTTNPVATEQYGSVSNNGTRGNR

SEQ ID NO: 10667 - protein, 29 aa, Artificial Sequence
  Description of Artificial Sequence: Synthetic peptide
DEEEIRTTNPEATEQYGSVSTNLDRTGNR

SEQ ID NO: 10668 - protein, 30 aa, Artificial Sequence
  Description of Artificial Sequence: Synthetic polypeptide
DEEEIRTTNPAATEQYGSVSTNLQREGANR

SEQ ID NO: 10669 - protein, 29 aa, Artificial Sequence
  Description of Artificial Sequence: Synthetic peptide
DEEEIRTTNPVATEQYGSVSTNLQETGNN

SEQ ID NO: 10670 - protein, 29 aa, Artificial Sequence
  Description of Artificial Sequence: Synthetic peptide
DEEEIRTTNPVATEQYGSVSTNLQDRGEL

SEQ ID NO: 10671 - protein, 29 aa, Artificial Sequence
  Description of Artificial Sequence: Synthetic peptide
DEVEISTTNPVATEQYGSVISTNLQRGNR

SEQ ID NO: 10672 - protein, 28 aa, Artificial Sequence
  Description of Artificial Sequence: Synthetic peptide
DEEEIRTTNPCATEQYGCVATNLQRGNR

SEQ ID NO: 10673 - protein, 29 aa, Artificial Sequence
  Description of Artificial Sequence: Synthetic peptide
DEEEIRTTNPAATEQYGSVISTNLQNGNR

SEQ ID NO: 10674 - protein, 30 aa, Artificial Sequence
  Description of Artificial Sequence: Synthetic polypeptide
DEEEIRTTNPTATEQYGSVSPTNLEQRGNR

SEQ ID NO: 10675 - protein, 28 aa, Artificial Sequence
  Description of Artificial Sequence: Synthetic peptide
YEEEIRTTNPCASEQYGSVSTNLQRGNR

SEQ ID NO: 10676 - protein, 28 aa, Artificial Sequence
  Description of Artificial Sequence: Synthetic peptide
DEEEVRTTNPVATEQYGSVSTNLEVGNR

SEQ ID NO: 10677 - protein, 28 aa, Artificial Sequence
  Description of Artificial Sequence: Synthetic peptide
DEEEIRTTNPVATEQYGSVSTELQIGNA

SEQ ID NO: 10678 - protein, 28 aa, Artificial Sequence
  Description of Artificial Sequence: Synthetic peptide
DEEEIRTTNPVATEQYGSVSTNLERGEQ

SEQ ID NO: 10679 - protein, 28 aa, Artificial Sequence
  Description of Artificial Sequence: Synthetic peptide
DEEEIATVNPVSTEQYGSVSTNLQRGNR

SEQ ID NO: 10680 - protein, 28 aa, Artificial Sequence
  Description of Artificial Sequence: Synthetic peptide
DHEEIRTTNPVATEQYGSVSYNLQRGNQ

SEQ ID NO: 10681 - protein, 30 aa, Artificial Sequence
  Description of Artificial Sequence: Synthetic polypeptide
DEEEIRTTNPVATEQYGSVSTNLQETGNDR

SEQ ID NO: 10682 - protein, 29 aa, Artificial Sequence
  Description of Artificial Sequence: Synthetic peptide
DEEEIRTTNPVATEQYGSVSTNLQVGNDA

SEQ ID NO: 10683 - protein, 28 aa, Artificial Sequence
  Description of Artificial Sequence: Synthetic peptide
DEEEIRCTNPVATEVYGAVSTNLQRGNR

SEQ ID NO: 10684 - protein, 29 aa, Artificial Sequence
  Description of Artificial Sequence: Synthetic peptide
DEEEIRTTNPTATEQYGSVSTNLQQEGNR

SEQ ID NO: 10685 - protein, 28 aa, Artificial Sequence
  Description of Artificial Sequence: Synthetic peptide
DEEEIRCTNPVATEQYGSVDTNEQRGNR

SEQ ID NO: 10686 - protein, 28 aa, Artificial Sequence
  Description of Artificial Sequence: Synthetic peptide
SEEEIRTTNPTATEQYGSVSTNPQRGNR

SEQ ID NO: 10687 - protein, 28 aa, Artificial Sequence
  Description of Artificial Sequence: Synthetic peptide
DEEEIRTTNPMATAQYGSVSTNLQRGNG

SEQ ID NO: 10688 - protein, 30 aa, Artificial Sequence
  Description of Artificial Sequence: Synthetic polypeptide
DEEEIRTTNPVATEQYGSVSTNPLQRGDER

SEQ ID NO: 10689 - protein, 28 aa, Artificial Sequence
  Description of Artificial Sequence: Synthetic peptide
DEEEIRTTNPVATEQYGSVSTDLQAGND

SEQ ID NO: 10690 - protein, 28 aa, Artificial Sequence
  Description of Artificial Sequence: Synthetic peptide
DEEEIRTTNPVATEQYGSVSTNLQLGDQ

SEQ ID NO: 10691 - protein, 28 aa, Artificial Sequence
  Description of Artificial Sequence: Synthetic peptide
DEEEIRTTNPVATEQYGCVSTNLQRGDQ

SEQ ID NO: 10692 - protein, 28 aa, Artificial Sequence
  Description of Artificial Sequence: Synthetic peptide
DEEEIRTTNPVSTEQYGGVSTNLQRGNF

SEQ ID NO: 10693 - protein, 29 aa, Artificial Sequence
  Description of Artificial Sequence: Synthetic peptide
DEEEIATTNPVATEQFGSVSATNLQRGNR

SEQ ID NO: 10694 - protein, 29 aa, Artificial Sequence
  Description of Artificial Sequence: Synthetic peptide
DEEEIRTTNPVATEQYGNVSTNLERGENR

SEQ ID NO: 10695 - protein, 30 aa, Artificial Sequence
  Description of Artificial Sequence: Synthetic polypeptide
DEEEIRTTNPVATEQYGSVSTNLQERGNDW

SEQ ID NO: 10696 - protein, 28 aa, Artificial Sequence
  Description of Artificial Sequence: Synthetic peptide
DEEEIRTTNPVATEQYGSVSTNPQHGNA

SEQ ID NO: 10697 - protein, 30 aa, Artificial Sequence
  Description of Artificial Sequence: Synthetic polypeptide
DEEEIRTTNPVATEQYGSVSTENLQQQGNR

SEQ ID NO: 10698 - protein, 29 aa, Artificial Sequence
  Description of Artificial Sequence: Synthetic peptide
DEEEIRTTNPVATEQYGSYVSTNLETGNR

SEQ ID NO: 10699 - protein, 28 aa, Artificial Sequence
  Description of Artificial Sequence: Synthetic peptide
DEEEIRTTNPVAGECYGSVSTNIQRGNR

SEQ ID NO: 10700 - protein, 28 aa, Artificial Sequence
  Description of Artificial Sequence: Synthetic peptide
DEVEIRTTNPVATEQYGSVDTNLQLGNR

SEQ ID NO: 10701 - protein, 28 aa, Artificial Sequence
  Description of Artificial Sequence: Synthetic peptide
DEEEIRTTNPTATEQYGSVSTNEQIGNR

SEQ ID NO: 10702 - protein, 30 aa, Artificial Sequence
  Description of Artificial Sequence: Synthetic polypeptide
DEEEIRTTNPVATEQYGSVSTNLQDVGNDR

SEQ ID NO: 10703 - protein, 29 aa, Artificial Sequence
  Description of Artificial Sequence: Synthetic peptide
DEEEIRCTNPVATEIYGSVSATNLQRGNR

SEQ ID NO: 10704 - protein, 28 aa, Artificial Sequence
  Description of Artificial Sequence: Synthetic peptide
DEQEIRTTNPVATEQYGSVSTNLERGND

SEQ ID NO: 10705 - protein, 28 aa, Artificial Sequence
  Description of Artificial Sequence: Synthetic peptide
DEEEIRTTNPVATEQYGSVSTNLEHGNM

SEQ ID NO: 10706 - protein, 28 aa, Artificial Sequence
  Description of Artificial Sequence: Synthetic peptide
DEEEIRSTNPVAYEMYGSVSTNLQRGNR

SEQ ID NO: 10707 - protein, 30 aa, Artificial Sequence
  Description of Artificial Sequence: Synthetic polypeptide
DEEEIRTTNPEATEQYGSVSTPNLQRGNDR

SEQ ID NO: 10708 - protein, 30 aa, Artificial Sequence
  Description of Artificial Sequence: Synthetic polypeptide
DEEEIRTTNPVATCQYGSVSTCNLQRGENR

SEQ ID NO: 10709 - protein, 28 aa, Artificial Sequence
  Description of Artificial Sequence: Synthetic peptide
DEEEIRTTNPVATEQYGSVSTELQWGDR

SEQ ID NO: 10710 - protein, 28 aa, Artificial Sequence
  Description of Artificial Sequence: Synthetic peptide
DEEEIRTTNPVACEQYGSVSNNLQRLNR

SEQ ID NO: 10711 - protein, 28 aa, Artificial Sequence
  Description of Artificial Sequence: Synthetic peptide
DEEEIRTTNPVATQIYGSVSTGLQRGNR

SEQ ID NO: 10712 - protein, 28 aa, Artificial Sequence
  Description of Artificial Sequence: Synthetic peptide
DEEEIRTTNPVGTEQYGQVSTNLQRGNT

SEQ ID NO: 10713 - protein, 28 aa, Artificial Sequence
  Description of Artificial Sequence: Synthetic peptide
QEEEIRTVNPVATEQYGSVSTNLQHGNR

SEQ ID NO: 10714 - protein, 29 aa, Artificial Sequence
  Description of Artificial Sequence: Synthetic peptide
DEEEIRTTNPIATEQYGSVSTNLQGVGNR

SEQ ID NO: 10715 - protein, 28 aa, Artificial Sequence
  Description of Artificial Sequence: Synthetic peptide
DEEEIRTTNIVATEVYGSVSTNEQRGNR

SEQ ID NO: 10716 - protein, 29 aa, Artificial Sequence
  Description of Artificial Sequence: Synthetic peptide
DEEEIRTTNPVATEQYGSVSTNPQERGNL

SEQ ID NO: 10717 - protein, 28 aa, Artificial Sequence
  Description of Artificial Sequence: Synthetic peptide
QEEEIATTNPVATEQYGSVSTNLQRGER

SEQ ID NO: 10718 - protein, 30 aa, Artificial Sequence
  Description of Artificial Sequence: Synthetic polypeptide
DEEEIRTTNPVATEQYGCSVESTDLQRGNR

SEQ ID NO: 10719 - protein, 28 aa, Artificial Sequence
  Description of Artificial Sequence: Synthetic peptide
DEEEIRTTNPVASENYGYVSTNLQRGNR

SEQ ID NO: 10720 - protein, 29 aa, Artificial Sequence
  Description of Artificial Sequence: Synthetic peptide
DEEEIRTTNPVATEQYGSVSEMNEQRGNR

SEQ ID NO: 10721 - protein, 28 aa, Artificial Sequence
  Description of Artificial Sequence: Synthetic peptide
DEGEIRTTNPVATEQYGSVSTNLQQGNA

SEQ ID NO: 10722 - protein, 28 aa, Artificial Sequence
  Description of Artificial Sequence: Synthetic peptide
DEEEIRTTNIVATEQYGSVSEALQRGNR

SEQ ID NO: 10723 - protein, 28 aa, Artificial Sequence
  Description of Artificial Sequence: Synthetic peptide
DEEEIRTTNPVATEQYGSVSTNPQHGER

SEQ ID NO: 10724 - protein, 28 aa, Artificial Sequence
  Description of Artificial Sequence: Synthetic peptide
DEEEIRTTNPVATEQFGSVSANLQRGDR

SEQ ID NO: 10725 - protein, 28 aa, Artificial Sequence
  Description of Artificial Sequence: Synthetic peptide
DEEEIRGTNPVATEQYGSVGTNLQQGNR

SEQ ID NO: 10726 - protein, 30 aa, Artificial Sequence
  Description of Artificial Sequence: Synthetic polypeptide
DEEEIRTTNPVATEQYGTVSTNLQRDGNER

SEQ ID NO: 10727 - protein, 28 aa, Artificial Sequence
  Description of Artificial Sequence: Synthetic peptide
MEEEIRTTNPVATECYGSVSENLQRGNR

SEQ ID NO: 10728 - protein, 28 aa, Artificial Sequence
  Description of Artificial Sequence: Synthetic peptide
DEEEVRTTNPVATEQYGTVSTNLQRGDR

SEQ ID NO: 10729 - protein, 28 aa, Artificial Sequence
  Description of Artificial Sequence: Synthetic peptide
DEGEIRTTNPVCTEQYGEVSTNLQRGNR

SEQ ID NO: 10730 - protein, 28 aa, Artificial Sequence
  Description of Artificial Sequence: Synthetic peptide
DEEEIRTTNPVATEIYGSVSTNLQHGNS

SEQ ID NO: 10731 - protein, 29 aa, Artificial Sequence
  Description of Artificial Sequence: Synthetic peptide
QEQEIRTTNPVATEQYGSVSTNLQRGNDR

SEQ ID NO: 10732 - protein, 29 aa, Artificial Sequence
  Description of Artificial Sequence: Synthetic peptide
DEEEIRTTNPVATEQYGSVSTNEQNIGNR

SEQ ID NO: 10733 - protein, 28 aa, Artificial Sequence
  Description of Artificial Sequence: Synthetic peptide
DEEEIRATNPVATEQYGVVSTNLQPGNR

SEQ ID NO: 10734 - protein, 28 aa, Artificial Sequence
  Description of Artificial Sequence: Synthetic peptide
DEEEIASTNPVATELYGSVSTNLQRGNR

SEQ ID NO: 10735 - protein, 28 aa, Artificial Sequence
  Description of Artificial Sequence: Synthetic peptide
DEEEIRTTNPVATEQYGSVSTNPQNGNE

SEQ ID NO: 10736 - protein, 28 aa, Artificial Sequence
  Description of Artificial Sequence: Synthetic peptide
DEGEIRQTNPVATEGYGSVSTNLQRGNR

SEQ ID NO: 10737 - protein, 28 aa, Artificial Sequence
  Description of Artificial Sequence: Synthetic peptide
DEEEIRTTNPVATEIYGVVSTNLQLGNR

SEQ ID NO: 10738 - protein, 28 aa, Artificial Sequence
  Description of Artificial Sequence: Synthetic peptide
DEEEIRTTNPVATEQYGSVSENLQNGNY

SEQ ID NO: 10739 - protein, 28 aa, Artificial Sequence
  Description of Artificial Sequence: Synthetic peptide
DEEEIAATNPVATEQYGSVSTNLQRGER

SEQ ID NO: 10740 - protein, 28 aa, Artificial Sequence
  Description of Artificial Sequence: Synthetic peptide
DEEEIRTTNIVATEQYGWVSTNLQTGNR

SEQ ID NO: 10741 - protein, 28 aa, Artificial Sequence
  Description of Artificial Sequence: Synthetic peptide
QEEEISTTNPVATEQYGSASTNLQRGNR

SEQ ID NO: 10742 - protein, 29 aa, Artificial Sequence
  Description of Artificial Sequence: Synthetic peptide
DEEEIRTTNPVATEQYGSVSTNLQNGDNF

SEQ ID NO: 10743 - protein, 28 aa, Artificial Sequence
  Description of Artificial Sequence: Synthetic peptide
DEEEIRTTNPVATEQYGSVSDNPQRGNQ

SEQ ID NO: 10744 - protein, 29 aa, Artificial Sequence
  Description of Artificial Sequence: Synthetic peptide
DEEEIRTTNPVATEQYGCVSMNLQRNGNR

SEQ ID NO: 10745 - protein, 28 aa, Artificial Sequence
  Description of Artificial Sequence: Synthetic peptide
DEEEIRTTNPVATEVYGCVSTNLERGNR

SEQ ID NO: 10746 - protein, 28 aa, Artificial Sequence
  Description of Artificial Sequence: Synthetic peptide
DEEEIRTTNPVATEMYGSVSTNLQQGTR

SEQ ID NO: 10747 - protein, 29 aa, Artificial Sequence
  Description of Artificial Sequence: Synthetic peptide
KEEEIRTTNPVATEQYGSVSTNLQDRGNM

SEQ ID NO: 10748 - protein, 28 aa, Artificial Sequence
  Description of Artificial Sequence: Synthetic peptide
SEEEIRTTNIVATEQYGSVSTNLQKGNR

SEQ ID NO: 10749 - protein, 29 aa, Artificial Sequence
  Description of Artificial Sequence: Synthetic peptide
DEEEIRTTNPVATEQYGSVSTNDQQRGNM

SEQ ID NO: 10750 - protein, 30 aa, Artificial Sequence
  Description of Artificial Sequence: Synthetic polypeptide
DEQEIRTTNPVATEQYGSVSTNLQREGNDR

SEQ ID NO: 10751 - protein, 28 aa, Artificial Sequence
  Description of Artificial Sequence: Synthetic peptide
DEEEIRTVNPVATEGYGSVSDNLQRGNR

SEQ ID NO: 10752 - protein, 28 aa, Artificial Sequence
  Description of Artificial Sequence: Synthetic peptide
DEEEIRTTNPVSTEQYGSVSDNLQRGNM

SEQ ID NO: 10753 - protein, 30 aa, Artificial Sequence
  Description of Artificial Sequence: Synthetic polypeptide
DEEEIRTTNPVATEQYGSVSETNLQNNGNR

SEQ ID NO: 10754 - protein, 28 aa, Artificial Sequence
  Description of Artificial Sequence: Synthetic peptide
DENEIRTTNPVATENYGTVSTNLQRGNR

SEQ ID NO: 10755 - protein, 28 aa, Artificial Sequence
  Description of Artificial Sequence: Synthetic peptide
DEEEISTTNPCATEQYGSVSTNLQQGNR

SEQ ID NO: 10756 - protein, 28 aa, Artificial Sequence
  Description of Artificial Sequence: Synthetic peptide
DENEIRTTNPVATECYGSVSTNLQHGNR

SEQ ID NO: 10757 - protein, 28 aa, Artificial Sequence
  Description of Artificial Sequence: Synthetic peptide
DEEEIRTTNPVATENYGSVSTNIQGGNR

SEQ ID NO: 10758 - protein, 28 aa, Artificial Sequence
  Description of Artificial Sequence: Synthetic peptide
DEEEIRCTNPVATEQYGSVSTNLIVGNR

SEQ ID NO: 10759 - protein, 28 aa, Artificial Sequence
  Description of Artificial Sequence: Synthetic peptide
DEEEIRTTNPVATEQYGDVDTNWQRGNR

SEQ ID NO: 10760 - protein, 28 aa, Artificial Sequence
  Description of Artificial Sequence: Synthetic peptide
DEEEIRTTNPVATEQYGSVSTDLQQGER

SEQ ID NO: 10761 - protein, 28 aa, Artificial Sequence
  Description of Artificial Sequence: Synthetic peptide
DEEEIRTTNPVSTEQYGSVSTNLQHFNR

SEQ ID NO: 10762 - protein, 28 aa, Artificial Sequence
  Description of Artificial Sequence: Synthetic peptide
DEEEIRTTNPVAYEQYGSVSTNLDRGNA

SEQ ID NO: 10763 - protein, 28 aa, Artificial Sequence
  Description of Artificial Sequence: Synthetic peptide
DEQEIRTTNPVATEQYGSVSTDLQRGNM

SEQ ID NO: 10764 - protein, 28 aa, Artificial Sequence
  Description of Artificial Sequence: Synthetic peptide
DEEEITTTNPVATEQYGSVSTNLQRGTA

SEQ ID NO: 10765 - protein, 28 aa, Artificial Sequence
  Description of Artificial Sequence: Synthetic peptide
MEEEISTTNPVATEQYGSVSTNLQRGNM

SEQ ID NO: 10766 - protein, 29 aa, Artificial Sequence
  Description of Artificial Sequence: Synthetic peptide
AEEEIRTTNPVATEQYGSVSETNLQRGND

SEQ ID NO: 10767 - protein, 28 aa, Artificial Sequence
  Description of Artificial Sequence: Synthetic peptide
DEEEIRTTNPTATEQYGSVSTNLQHGNF

SEQ ID NO: 10768 - protein, 28 aa, Artificial Sequence
  Description of Artificial Sequence: Synthetic peptide
YEEEIRTTNPVATEQYGSVSENLQRGNQ

SEQ ID NO: 10769 - protein, 28 aa, Artificial Sequence
  Description of Artificial Sequence: Synthetic peptide
DEQEIRTTNPVATEQYGSVSTDLQRGNF

SEQ ID NO: 10770 - protein, 28 aa, Artificial Sequence
  Description of Artificial Sequence: Synthetic peptide
DEEEIRTTNPVATECYGSVSTNLERGNN

SEQ ID NO: 10771 - protein, 28 aa, Artificial Sequence
  Description of Artificial Sequence: Synthetic peptide
DEEEIRTTNPVATEQYGSVSTNLENGER

SEQ ID NO: 10772 - protein, 28 aa, Artificial Sequence
  Description of Artificial Sequence: Synthetic peptide
DEEEIRATNPVATEQYGWVSTNLQRGER

SEQ ID NO: 10773 - protein, 29 aa, Artificial Sequence
  Description of Artificial Sequence: Synthetic peptide
DEGEIRTTNPVATEQYGSVSTNLQQRGNT

SEQ ID NO: 10774 - protein, 28 aa, Artificial Sequence
  Description of Artificial Sequence: Synthetic peptide
DEEEIRSTNPVATEQYGSVSMNLQRGTR

SEQ ID NO: 10775 - protein, 28 aa, Artificial Sequence
  Description of Artificial Sequence: Synthetic peptide
DEEEVRSTNPVSTEQYGSVSTNLQRGNR

SEQ ID NO: 10776 - protein, 30 aa, Artificial Sequence
  Description of Artificial Sequence: Synthetic polypeptide
DEEEIRTTNPVATEQYGSVSDNLQSRGNYR

SEQ ID NO: 10777 - protein, 28 aa, Artificial Sequence
  Description of Artificial Sequence: Synthetic peptide
DEEEIRTTNPVATECYGSVSTNLQHGTR

SEQ ID NO: 10778 - protein, 28 aa, Artificial Sequence
  Description of Artificial Sequence: Synthetic peptide
DEEEIRATNPVATEMYGSVSTELQRGNR

SEQ ID NO: 10779 - protein, 28 aa, Artificial Sequence
  Description of Artificial Sequence: Synthetic peptide
DENEIRTTNPVATEQYGSVSEQLQRGNR

SEQ ID NO: 10780 - protein, 28 aa, Artificial Sequence
  Description of Artificial Sequence: Synthetic peptide
DEEEIRTTNPVATEQYGSVSTDLQIGER

SEQ ID NO: 10781 - protein, 28 aa, Artificial Sequence
  Description of Artificial Sequence: Synthetic peptide
DEEEIRTTNPVATEQYWSWSTGLQRGNR

SEQ ID NO: 10782 - protein, 28 aa, Artificial Sequence
  Description of Artificial Sequence: Synthetic peptide
DEEEIRTTNPVATECYGSASTNLQRGNY

SEQ ID NO: 10783 - protein, 28 aa, Artificial Sequence
  Description of Artificial Sequence: Synthetic peptide
DEEEIVGTNPVATEQYGDVSTNLQRGNR

SEQ ID NO: 10784 - protein, 30 aa, Artificial Sequence
  Description of Artificial Sequence: Synthetic polypeptide
DEEEIRTTNPVATEMYGSVSTMNLPQRGNR

SEQ ID NO: 10785 - protein, 28 aa, Artificial Sequence
  Description of Artificial Sequence: Synthetic peptide
DEEEIRTTNCVATEQYGSVSTNLQQGMR

SEQ ID NO: 10786 - protein, 28 aa, Artificial Sequence
  Description of Artificial Sequence: Synthetic peptide
DEEEIRTTNPVATEQYGSVSDNLQMGNN

SEQ ID NO: 10787 - protein, 28 aa, Artificial Sequence
  Description of Artificial Sequence: Synthetic peptide
DEEEIYTTNPVATEQYGSVGTNLQRGNT

SEQ ID NO: 10788 - protein, 28 aa, Artificial Sequence
  Description of Artificial Sequence: Synthetic peptide
DEEEIRTTNPVATERYGSVSTNLQAGNH

SEQ ID NO: 10789 - protein, 28 aa, Artificial Sequence
  Description of Artificial Sequence: Synthetic peptide
DEEELRTTNPVCTEQYGSVSTNLQPGNR

SEQ ID NO: 10790 - protein, 29 aa, Artificial Sequence
  Description of Artificial Sequence: Synthetic peptide
MEEEIRTTNPVATECYGSVSTNLQRGNDR

SEQ ID NO: 10791 - protein, 28 aa, Artificial Sequence
  Description of Artificial Sequence: Synthetic peptide
DEEEIRTTNPVATEQYGSVSTNWQQGNL

SEQ ID NO: 10792 - protein, 28 aa, Artificial Sequence
  Description of Artificial Sequence: Synthetic peptide
DEEEIRQTNPVATEHYGSVSTNLQRGMR

SEQ ID NO: 10793 - protein, 28 aa, Artificial Sequence
  Description of Artificial Sequence: Synthetic peptide
DEEEIRTTNPVATEQYGVVSTDLQRGNQ

SEQ ID NO: 10794 - protein, 28 aa, Artificial Sequence
  Description of Artificial Sequence: Synthetic peptide
DEEEIRSTNPVATEQYGSVSTNLQVGNN

SEQ ID NO: 10795 - protein, 30 aa, Artificial Sequence
  Description of Artificial Sequence: Synthetic polypeptide
DEEEIRTTNPVATEQYGSVSATNLQHAGNR

SEQ ID NO: 10796 - protein, 28 aa, Artificial Sequence
  Description of Artificial Sequence: Synthetic peptide
DEEEIRTTNIVCTEQYGSVSTNLERGNR

SEQ ID NO: 10797 - protein, 28 aa, Artificial Sequence
  Description of Artificial Sequence: Synthetic peptide
DEEEIRTTNIGATEQYGSVSTNEQRGNR

SEQ ID NO: 10798 - protein, 28 aa, Artificial Sequence
  Description of Artificial Sequence: Synthetic peptide
DEEEIRTTNPVATECYGSVSTNLQQGNS

SEQ ID NO: 10799 - protein, 28 aa, Artificial Sequence
  Description of Artificial Sequence: Synthetic peptide
DEEEIRTTNPVCTEQYGDVSTNLQRGND

SEQ ID NO: 10800 - protein, 29 aa, Artificial Sequence
  Description of Artificial Sequence: Synthetic peptide
DEEEIRTVNPVATEQYGSVSTNLQEHGNR

SEQ ID NO: 10801 - protein, 28 aa, Artificial Sequence
  Description of Artificial Sequence: Synthetic peptide
DEEEIRTTNIVATEQYGETSTNLQRGNR

SEQ ID NO: 10802 - protein, 28 aa, Artificial Sequence
  Description of Artificial Sequence: Synthetic peptide
ADEEIRTTNPVATEQYGEVSTNLQRGNR

SEQ ID NO: 10803 - protein, 28 aa, Artificial Sequence
  Description of Artificial Sequence: Synthetic peptide
DEEEIRTTNPVATEQYGSVSTELQLDNR

SEQ ID NO: 10804 - protein, 28 aa, Artificial Sequence
  Description of Artificial Sequence: Synthetic peptide
QEEEIRTTNPVATEQYGSVSTNLQHGNQ

SEQ ID NO: 10805 - protein, 28 aa, Artificial Sequence
  Description of Artificial Sequence: Synthetic peptide
DEEEIRTTNPVATEQYGVVSTNIQIGNR

SEQ ID NO: 10806 - protein, 28 aa, Artificial Sequence
  Description of Artificial Sequence: Synthetic peptide
DEEEIRTTNPVATEQYGSVSTNLIQGNQ

SEQ ID NO: 10807 - protein, 28 aa, Artificial Sequence
  Description of Artificial Sequence: Synthetic peptide
DEEEIRTTNIVATEVYGSVSTNLQMGNR

SEQ ID NO: 10808 - protein, 29 aa, Artificial Sequence
  Description of Artificial Sequence: Synthetic peptide
MEEEIRTTNPVATEQYGSVSTNLQEHGNR

SEQ ID NO: 10809 - protein, 28 aa, Artificial Sequence
  Description of Artificial Sequence: Synthetic peptide
DEEEIRTTNPVATEQYGSVSENLQHGND

SEQ ID NO: 10810 - protein, 29 aa, Artificial Sequence
  Description of Artificial Sequence: Synthetic peptide
DEEEIRTTNPVATEMYGSVSTNLQEMGNR

SEQ ID NO: 10811 - protein, 28 aa, Artificial Sequence
  Description of Artificial Sequence: Synthetic peptide
DEEEIRTTNPVATEQYGSVSTNQERGNV

SEQ ID NO: 10812 - protein, 30 aa, Artificial Sequence
  Description of Artificial Sequence: Synthetic polypeptide
DEEEIRTTNPVATEQYGSVSETNGLERGNR

SEQ ID NO: 10813 - protein, 29 aa, Artificial Sequence
  Description of Artificial Sequence: Synthetic peptide
DEEEIRTTNPVATEQYGVVSTNDQRGNNR

SEQ ID NO: 10814 - protein, 28 aa, Artificial Sequence
  Description of Artificial Sequence: Synthetic peptide
DEEEIRTTNPVATEQYGSVSTPLQFGER

SEQ ID NO: 10815 - protein, 28 aa, Artificial Sequence
  Description of Artificial Sequence: Synthetic peptide
DEEEIRTCNPVATEQYGSVSTNLQQGNS

SEQ ID NO: 10816 - protein, 28 aa, Artificial Sequence
  Description of Artificial Sequence: Synthetic peptide
DEEEIRTTNPVATEQYGSVSENLQMGNA

SEQ ID NO: 10817 - protein, 28 aa, Artificial Sequence
  Description of Artificial Sequence: Synthetic peptide
DEEEIRTTNIVATEHYGSVSENLQRGNR

SEQ ID NO: 10818 - protein, 28 aa, Artificial Sequence
  Description of Artificial Sequence: Synthetic peptide
DEEEIRTTNPVATEQYGVVSTDLQRGNW

SEQ ID NO: 10819 - protein, 28 aa, Artificial Sequence
  Description of Artificial Sequence: Synthetic peptide
DEEEIRTTNPVATEQYGVVSTALQRGDR

SEQ ID NO: 10820 - protein, 28 aa, Artificial Sequence
  Description of Artificial Sequence: Synthetic peptide
DEEEIRTTNIVATEQYGSVSTELQRNNR

SEQ ID NO: 10821 - protein, 28 aa, Artificial Sequence
  Description of Artificial Sequence: Synthetic peptide
DEEEIRTTNPVATEQYGSVSTNLQLGDY

SEQ ID NO: 10822 - protein, 29 aa, Artificial Sequence
  Description of Artificial Sequence: Synthetic peptide
DEEEIRTTNPVATEQYGSVSTDLQDNGNR

SEQ ID NO: 10823 - protein, 28 aa, Artificial Sequence
  Description of Artificial Sequence: Synthetic peptide
DEEEIVTTNPVATEQYGTVSTNLQYGNR

SEQ ID NO: 10824 - protein, 30 aa, Artificial Sequence
  Description of Artificial Sequence: Synthetic polypeptide
DEEEIRTTNPVATEQYGSVSTNLVQRGNYG

SEQ ID NO: 10825 - protein, 28 aa, Artificial Sequence
  Description of Artificial Sequence: Synthetic peptide
DEEEIRTTNPVATEQYGSVSENLQNGNN

SEQ ID NO: 10826 - protein, 28 aa, Artificial Sequence
  Description of Artificial Sequence: Synthetic peptide
DEQEIATTNPVATEQYGSVSTNLQRGER

SEQ ID NO: 10827 - protein, 28 aa, Artificial Sequence
  Description of Artificial Sequence: Synthetic peptide
DEEEIRTTNPVATEVYGSASTNLQRGNA

SEQ ID NO: 10828 - protein, 29 aa, Artificial Sequence
  Description of Artificial Sequence: Synthetic peptide
DEEEIRTTNPVATEQYGSVSTNPQNGNTR

SEQ ID NO: 10829 - protein, 28 aa, Artificial Sequence
  Description of Artificial Sequence: Synthetic peptide
DEEEIRTTNIVATEQFGSVSTNLERGNR

SEQ ID NO: 10830 - protein, 30 aa, Artificial Sequence
  Description of Artificial Sequence: Synthetic polypeptide
DEEEIRTTNPVATEQYGSVSDTNLQRTGNM

SEQ ID NO: 10831 - protein, 28 aa, Artificial Sequence
  Description of Artificial Sequence: Synthetic peptide
DEVEIRTTNPVATEQYGSVSTNLQRGQL

SEQ ID NO: 10832 - protein, 28 aa, Artificial Sequence
  Description of Artificial Sequence: Synthetic peptide
DEEEIVTTNPVATEQYGSVSTELQQGNR

SEQ ID NO: 10833 - protein, 30 aa, Artificial Sequence
  Description of Artificial Sequence: Synthetic polypeptide
DEEEIRTTNPVATEQYGSVSTNLQRGVNTN

SEQ ID NO: 10834 - protein, 29 aa, Artificial Sequence
  Description of Artificial Sequence: Synthetic peptide
DEEEIRTTNPVATEQYGSVSDTPLDRGNR

SEQ ID NO: 10835 - protein, 28 aa, Artificial Sequence
  Description of Artificial Sequence: Synthetic peptide
DEEEIRTTNPVATEQYGSVSTNEQLGNQ

SEQ ID NO: 10836 - protein, 28 aa, Artificial Sequence
  Description of Artificial Sequence: Synthetic peptide
DEEEIRTTNPVATEQYGSVSCNLQGGNF

SEQ ID NO: 10837 - protein, 30 aa, Artificial Sequence
  Description of Artificial Sequence: Synthetic polypeptide
DEEEIATTNPVATEQYGSVSTNLQQRGNDR

SEQ ID NO: 10838 - protein, 28 aa, Artificial Sequence
  Description of Artificial Sequence: Synthetic peptide
DEEEIRTTNPVASENYGSVSTNLQRGNI

SEQ ID NO: 10839 - protein, 28 aa, Artificial Sequence
  Description of Artificial Sequence: Synthetic peptide
DEEEIRTTNPVATEQYGSVSTNEQLGNG

SEQ ID NO: 10840 - protein, 28 aa, Artificial Sequence
  Description of Artificial Sequence: Synthetic peptide
DENEIRATNPVATEQYGSVSTNLQLGNR

SEQ ID NO: 10841 - protein, 28 aa, Artificial Sequence
  Description of Artificial Sequence: Synthetic peptide
DEQEIATTNPVATEMYGSVSTNLQRGNR

SEQ ID NO: 10842 - protein, 28 aa, Artificial Sequence
  Description of Artificial Sequence: Synthetic peptide
DEEEIRTTNINATEQYGSVSTNLQRGNT

SEQ ID NO: 10843 - protein, 29 aa, Artificial Sequence
  Description of Artificial Sequence: Synthetic peptide
DETPIRTTNPVATEQYGSVSTNLQRGGNR

SEQ ID NO: 10844 - protein, 29 aa, Artificial Sequence
  Description of Artificial Sequence: Synthetic peptide
DEEEIRTTNPVATEQYGSVSETNPQGGNR

SEQ ID NO: 10845 - protein, 28 aa, Artificial Sequence
  Description of Artificial Sequence: Synthetic peptide
DEEEIRTTNIVATEQYGTVSENLQRGNR

SEQ ID NO: 10846 - protein, 28 aa, Artificial Sequence
  Description of Artificial Sequence: Synthetic peptide
DEEEIRTTNPVATEQYGSVSTALQRDNY

SEQ ID NO: 10847 - protein, 28 aa, Artificial Sequence
  Description of Artificial Sequence: Synthetic peptide
DEEEIRTTNPVATEQYGSVSTTPQRGNH

SEQ ID NO: 10848 - protein, 28 aa, Artificial Sequence
  Description of Artificial Sequence: Synthetic peptide
DEEEIRTTNPVATEQYGVVSTNLQSGNQ

SEQ ID NO: 10849 - protein, 28 aa, Artificial Sequence
  Description of Artificial Sequence: Synthetic peptide
DEEEIRTTNPVATEQYGYVSDILQRGNR

SEQ ID NO: 10850 - protein, 28 aa, Artificial Sequence
  Description of Artificial Sequence: Synthetic peptide
DEEEIRTTNPVATEQYGDVSENGQRGNR

SEQ ID NO: 10851 - protein, 28 aa, Artificial Sequence
  Description of Artificial Sequence: Synthetic peptide
DEEEIRATNPVATEMYGSVSTNLQNGNR

SEQ ID NO: 10852 - protein, 28 aa, Artificial Sequence
  Description of Artificial Sequence: Synthetic peptide
DEEEIRTTNPVATEQYGSVSTNEQIGNA

SEQ ID NO: 10853 - protein, 28 aa, Artificial Sequence
  Description of Artificial Sequence: Synthetic peptide
DEEEIRATNPVATEQYGSVSELLQRGNR

SEQ ID NO: 10854 - protein, 28 aa, Artificial Sequence
  Description of Artificial Sequence: Synthetic peptide
DEEEIRTTNPVATEQYGSVSTNLQVGDN

SEQ ID NO: 10855 - protein, 29 aa, Artificial Sequence
  Description of Artificial Sequence: Synthetic peptide
DEEEIRTTNPVATEQYGSVSTNEQNRGNM

SEQ ID NO: 10856 - protein, 28 aa, Artificial Sequence
  Description of Artificial Sequence: Synthetic peptide
DEEEIRTTNPVATEQYGSVSTELQFGDR

SEQ ID NO: 10857 - protein, 28 aa, Artificial Sequence
  Description of Artificial Sequence: Synthetic peptide
NEEEIGTTNPVATEQYGDVSTNLQRGNR

SEQ ID NO: 10858 - protein, 28 aa, Artificial Sequence
  Description of Artificial Sequence: Synthetic peptide
DEEEIRTTNPVATEQYGSVSENLQHGER

SEQ ID NO: 10859 - protein, 28 aa, Artificial Sequence
  Description of Artificial Sequence: Synthetic peptide
DEEEIRTTNPVATEQYGSVSYNLQQGNT

SEQ ID NO: 10860 - protein, 29 aa, Artificial Sequence
  Description of Artificial Sequence: Synthetic peptide
DEQEIRTTNPVATEQYGSVSATNLERGNR

SEQ ID NO: 10861 - protein, 28 aa, Artificial Sequence
  Description of Artificial Sequence: Synthetic peptide
DEEELATTNPVATEQYGSVSTNLQHGNR

SEQ ID NO: 10862 - protein, 28 aa, Artificial Sequence
  Description of Artificial Sequence: Synthetic peptide
DENEIRTTNPVATEQWGSVSTNLQIGNR

SEQ ID NO: 10863 - protein, 29 aa, Artificial Sequence
  Description of Artificial Sequence: Synthetic peptide
DEQEIRTTNPVATEQYGSVSTMNLQRGNA

SEQ ID NO: 10864 - protein, 28 aa, Artificial Sequence
  Description of Artificial Sequence: Synthetic peptide
DEEEIRTTNIVATEQYGCVSTNLQRGGR

SEQ ID NO: 10865 - protein, 28 aa, Artificial Sequence
  Description of Artificial Sequence: Synthetic peptide
DEQEIRTTNPVATEQYGSVSTDLQHGNR

SEQ ID NO: 10866 - protein, 28 aa, Artificial Sequence
  Description of Artificial Sequence: Synthetic peptide
DEEEIRTTNPVATEQYGSVSTGLEVGNR

SEQ ID NO: 10867 - protein, 28 aa, Artificial Sequence
  Description of Artificial Sequence: Synthetic peptide
DEEEITTTNPVATEQYGAVSTNLQFGNR

SEQ ID NO: 10868 - protein, 28 aa, Artificial Sequence
  Description of Artificial Sequence: Synthetic peptide
DEQEIRTTNPVATEQYGSVSTNLEIGNR

SEQ ID NO: 10869 - protein, 28 aa, Artificial Sequence
  Description of Artificial Sequence: Synthetic peptide
DEEEIATTNPVATEQYGSVSTNLQRGEY

SEQ ID NO: 10870 - protein, 28 aa, Artificial Sequence
  Description of Artificial Sequence: Synthetic peptide
DEEEICTTNPVATEQYGSVSANLQRGNY

SEQ ID NO: 10871 - protein, 28 aa, Artificial Sequence
  Description of Artificial Sequence: Synthetic peptide
DENEIRTTNPVATEQYGSVSENLMRGNR

SEQ ID NO: 10872 - protein, 28 aa, Artificial Sequence
  Description of Artificial Sequence: Synthetic peptide
DEEEIRTTNPVATEQYGSASTELQRGNA

SEQ ID NO: 10873 - protein, 28 aa, Artificial Sequence
  Description of Artificial Sequence: Synthetic peptide
DEEEIRTTNPVATEQYGTCSTLLQRGNR

SEQ ID NO: 10874 - protein, 28 aa, Artificial Sequence
  Description of Artificial Sequence: Synthetic peptide
DEEEIRTTNPVATEQYGSVSDTLQHGNR

SEQ ID NO: 10875 - protein, 28 aa, Artificial Sequence
  Description of Artificial Sequence: Synthetic peptide
DEEEIRATNPVATEQYGSVSTNGQRGNF

SEQ ID NO: 10876 - protein, 29 aa, Artificial Sequence
  Description of Artificial Sequence: Synthetic peptide
DEEEIRTTNPVATEQYGSVSTNLQHNGNG

SEQ ID NO: 10877 - protein, 28 aa, Artificial Sequence
  Description of Artificial Sequence: Synthetic peptide
DEEEIRTTNPVATEQYGSAPTNLQRGER

SEQ ID NO: 10878 - protein, 28 aa, Artificial Sequence
  Description of Artificial Sequence: Synthetic peptide
VEEEIRTTNPVATEIYGSVSTNLERGNR

SEQ ID NO: 10879 - protein, 28 aa, Artificial Sequence
  Description of Artificial Sequence: Synthetic peptide
DEEEIRTTNPVATEMFGSVSTNLQNGNR

SEQ ID NO: 10880 - protein, 29 aa, Artificial Sequence
  Description of Artificial Sequence: Synthetic peptide
NEEEIRATNPVATEQYGSVSTNLQRGNDR

SEQ ID NO: 10881 - protein, 28 aa, Artificial Sequence
  Description of Artificial Sequence: Synthetic peptide
SEEEIRTTNPVATEQFGSVSTNLQQGNR

SEQ ID NO: 10882 - protein, 28 aa, Artificial Sequence
  Description of Artificial Sequence: Synthetic peptide
DEEEIATTNPVATEQYGSVSTNLQNGTR

SEQ ID NO: 10883 - protein, 28 aa, Artificial Sequence
  Description of Artificial Sequence: Synthetic peptide
DEEEIRQTNPVATEQYGIVSTNQQRGNR

SEQ ID NO: 10884 - protein, 28 aa, Artificial Sequence
  Description of Artificial Sequence: Synthetic peptide
DEEEIRTTNPVATEQYGDVSTNLQHGNA

SEQ ID NO: 10885 - protein, 29 aa, Artificial Sequence
  Description of Artificial Sequence: Synthetic peptide
DEEEIRTTNPLATEQYGSVQTNLQRGMNR

SEQ ID NO: 10886 - protein, 28 aa, Artificial Sequence
  Description of Artificial Sequence: Synthetic peptide
DEEEIRTTNPVATEQYGSVSTNPQRGDQ

SEQ ID NO: 10887 - protein, 28 aa, Artificial Sequence
  Description of Artificial Sequence: Synthetic peptide
DEEEIRQTNPVATEQYGEVSTNLQRENR

SEQ ID NO: 10888 - protein, 28 aa, Artificial Sequence
  Description of Artificial Sequence: Synthetic peptide
DEEEIRTTNPVATEQYGSMSDNLQLGNR

SEQ ID NO: 10889 - protein, 29 aa, Artificial Sequence
  Description of Artificial Sequence: Synthetic peptide
MEEEIRTTNPVATEQYGSVSTNLQRGNDA

SEQ ID NO: 10890 - protein, 28 aa, Artificial Sequence
  Description of Artificial Sequence: Synthetic peptide
DEGEITTTNPVATEQYGSVSTNLQRGNQ

SEQ ID NO: 10891 - protein, 28 aa, Artificial Sequence
  Description of Artificial Sequence: Synthetic peptide
DEEEIRTTNPVATEQYGSVDTNLQYGNM

SEQ ID NO: 10892 - protein, 28 aa, Artificial Sequence
  Description of Artificial Sequence: Synthetic peptide
DEEEIRTTNPVATEQYGSASENLMRGNR

SEQ ID NO: 10893 - protein, 28 aa, Artificial Sequence
  Description of Artificial Sequence: Synthetic peptide
DEEELRTTNPVATECYGSVSTILQRGNR

SEQ ID NO: 10894 - protein, 29 aa, Artificial Sequence
  Description of Artificial Sequence: Synthetic peptide
SEEEIRTTNPVATEQYGSVSTNWQRNGNR

SEQ ID NO: 10895 - protein, 29 aa, Artificial Sequence
  Description of Artificial Sequence: Synthetic peptide
DDDEIRTTNPVATEQYGSVSTNLQREGNR

SEQ ID NO: 10896 - protein, 30 aa, Artificial Sequence
  Description of Artificial Sequence: Synthetic polypeptide
SEEEIRTTNPVATEQYGSVSTNLQDRGNTR

SEQ ID NO: 10897 - protein, 28 aa, Artificial Sequence
  Description of Artificial Sequence: Synthetic peptide
DEEEIRTTNPVATEQYGSVSENLQHGNH

SEQ ID NO: 10898 - protein, 28 aa, Artificial Sequence
  Description of Artificial Sequence: Synthetic peptide
DEEEIRTTNIVATEQYGSVDTALQRGNR

SEQ ID NO: 10899 - protein, 28 aa, Artificial Sequence
  Description of Artificial Sequence: Synthetic peptide
DEEEIRTTNPVATEQYGSVSEDLQHGNR

SEQ ID NO: 10900 - protein, 28 aa, Artificial Sequence
  Description of Artificial Sequence: Synthetic peptide
MEQEIRTTNPVATEQYGSVSTNLQRGNI

SEQ ID NO: 10901 - protein, 28 aa, Artificial Sequence
  Description of Artificial Sequence: Synthetic peptide
YEEEIRTTNPVATESYGSVSTNWQRGNR

SEQ ID NO: 10902 - protein, 29 aa, Artificial Sequence
  Description of Artificial Sequence: Synthetic peptide
DLEEIRTTNPVATEQYGSVSTNLDRGINR

SEQ ID NO: 10903 - protein, 28 aa, Artificial Sequence
  Description of Artificial Sequence: Synthetic peptide
DEEEIRTTNPVATEQYGEVATNLQRGGR

SEQ ID NO: 10904 - protein, 28 aa, Artificial Sequence
  Description of Artificial Sequence: Synthetic peptide
DEEEIRTTNPVATEQYGSVSTNGQRDER

SEQ ID NO: 10905 - protein, 30 aa, Artificial Sequence
  Description of Artificial Sequence: Synthetic polypeptide
DEEEIRTTNPVATEQYGSVSTNLQTVEGNR

SEQ ID NO: 10906 - protein, 28 aa, Artificial Sequence
  Description of Artificial Sequence: Synthetic peptide
NDEEIRTTNPVATEQYGSVATNLQRGNR

SEQ ID NO: 10907 - protein, 28 aa, Artificial Sequence
  Description of Artificial Sequence: Synthetic peptide
MEEEIRTTNPVATEQYGSVGDNLQRGNR

SEQ ID NO: 10908 - protein, 28 aa, Artificial Sequence
  Description of Artificial Sequence: Synthetic peptide
DEEEIRTTNPVATEQYGVVGTDLQRGNR

SEQ ID NO: 10909 - protein, 28 aa, Artificial Sequence
  Description of Artificial Sequence: Synthetic peptide
DEEEIATTNIVATEQYGSVSTVLQRGNR

SEQ ID NO: 10910 - protein, 28 aa, Artificial Sequence
  Description of Artificial Sequence: Synthetic peptide
DEQEIRTTNPVATEQYGSVSENLQRGNM

SEQ ID NO: 10911 - protein, 28 aa, Artificial Sequence
  Description of Artificial Sequence: Synthetic peptide
DEEEIRTVNPVATEQYGSASTNIQRGNR

SEQ ID NO: 10912 - protein, 29 aa, Artificial Sequence
  Description of Artificial Sequence: Synthetic peptide
DEEEIATTNPVATEQYGSVSITNLQRGNS

SEQ ID NO: 10913 - protein, 28 aa, Artificial Sequence
  Description of Artificial Sequence: Synthetic peptide
DEEEIRTTNPVATEQYGSVSTCEQRGNL

SEQ ID NO: 10914 - protein, 30 aa, Artificial Sequence
  Description of Artificial Sequence: Synthetic polypeptide
DEEEIRTTNPVATEQYGCVSTNLQQRGDNR

SEQ ID NO: 10915 - protein, 28 aa, Artificial Sequence
  Description of Artificial Sequence: Synthetic peptide
DEQEIVTTNPVATEQYGSVSTNLQRGTR

SEQ ID NO: 10916 - protein, 30 aa, Artificial Sequence
  Description of Artificial Sequence: Synthetic polypeptide
DEEEIRTTNPVATEQYGSVSTNDQRGVNDR

SEQ ID NO: 10917 - protein, 28 aa, Artificial Sequence
  Description of Artificial Sequence: Synthetic peptide
DEEEIRTTNIVATDQYGSVSTELQRGNR

SEQ ID NO: 10918 - protein, 29 aa, Artificial Sequence
  Description of Artificial Sequence: Synthetic peptide
DEEEIRTTNPVATEQYGSVSEALQWRGNR

SEQ ID NO: 10919 - protein, 28 aa, Artificial Sequence
  Description of Artificial Sequence: Synthetic peptide
QEEEITTTNPVATEQWGSVSTNLQRGNR

SEQ ID NO: 10920 - protein, 29 aa, Artificial Sequence
  Description of Artificial Sequence: Synthetic peptide
HEEEIRTTNPVATEQYGSVSTNLQSRGNS

SEQ ID NO: 10921 - protein, 28 aa, Artificial Sequence
  Description of Artificial Sequence: Synthetic peptide
DEEEVRTTNPVATEQYGSVSTALERGNR

SEQ ID NO: 10922 - protein, 28 aa, Artificial Sequence
  Description of Artificial Sequence: Synthetic peptide
DEVEIRTTNPVATEQYGEVSTNLQQGNR

SEQ ID NO: 10923 - protein, 28 aa, Artificial Sequence
  Description of Artificial Sequence: Synthetic peptide
MEEEIRTTNPVATEQYGSVSTNLQSGNT

SEQ ID NO: 10924 - protein, 28 aa, Artificial Sequence
  Description of Artificial Sequence: Synthetic peptide
DEEEIYTTNPVATEQYGEVSTNLQRGDR

SEQ ID NO: 10925 - protein, 29 aa, Artificial Sequence
  Description of Artificial Sequence: Synthetic peptide
DEEEIATTNPVATEQYGSVSTNLQRNGNL

SEQ ID NO: 10926 - protein, 30 aa, Artificial Sequence
  Description of Artificial Sequence: Synthetic polypeptide
DEEEIRTTNPVATEQYGSVSETNLQRNGNQ

SEQ ID NO: 10927 - protein, 28 aa, Artificial Sequence
  Description of Artificial Sequence: Synthetic peptide
DDEEIATTNPVATEQYGSVSTNLQRGNS

SEQ ID NO: 10928 - protein, 29 aa, Artificial Sequence
  Description of Artificial Sequence: Synthetic peptide
DEQEIRTTNPVATEQYGSVATNLQREGNR

SEQ ID NO: 10929 - protein, 28 aa, Artificial Sequence
  Description of Artificial Sequence: Synthetic peptide
DEEEIRTTNPVATEQYGDVSTNLQRGEN

SEQ ID NO: 10930 - protein, 28 aa, Artificial Sequence
  Description of Artificial Sequence: Synthetic peptide
DENEIRTTNPVATEQYGSVSTNLQRENA

SEQ ID NO: 10931 - protein, 28 aa, Artificial Sequence
  Description of Artificial Sequence: Synthetic peptide
DEEEIRTTNPVATECYGSVSTNLQNGNY

SEQ ID NO: 10932 - protein, 28 aa, Artificial Sequence
  Description of Artificial Sequence: Synthetic peptide
DDQEIRTTNPVATEQYGSVSTNLQRPNR

SEQ ID NO: 10933 - protein, 28 aa, Artificial Sequence
  Description of Artificial Sequence: Synthetic peptide
DEEEIRTTNPVATEQYGSVATNLQRGEA

SEQ ID NO: 10934 - protein, 28 aa, Artificial Sequence
  Description of Artificial Sequence: Synthetic peptide
DEEEIRTTNPVATEQYGSVSENLQVGDR

SEQ ID NO: 10935 - protein, 29 aa, Artificial Sequence
  Description of Artificial Sequence: Synthetic peptide
DEEEIRTTNPVATELYGSVSTNMQERGNR

SEQ ID NO: 10936 - protein, 28 aa, Artificial Sequence
  Description of Artificial Sequence: Synthetic peptide
NEEEIRTTNPVCTEQYGSVSTGLQRGNR

SEQ ID NO: 10937 - protein, 28 aa, Artificial Sequence
  Description of Artificial Sequence: Synthetic peptide
DDEEIMTTNPVATEQYGSVSTNLQRGNT

SEQ ID NO: 10938 - protein, 28 aa, Artificial Sequence
  Description of Artificial Sequence: Synthetic peptide
DEEEIRTTNPVATEQYGSYSTIEQRGNR

SEQ ID NO: 10939 - protein, 28 aa, Artificial Sequence
  Description of Artificial Sequence: Synthetic peptide
DEEEIRTTNIVATEQYGSVSTNLQLLNR

SEQ ID NO: 10940 - protein, 29 aa, Artificial Sequence
  Description of Artificial Sequence: Synthetic peptide
DEEEIRTTNPVATEQYGSTSTNLQVRGNV

SEQ ID NO: 10941 - protein, 28 aa, Artificial Sequence
  Description of Artificial Sequence: Synthetic peptide
FEELIRTTNPVATEQYGSVSHNLQRGNR

SEQ ID NO: 10942 - protein, 29 aa, Artificial Sequence
  Description of Artificial Sequence: Synthetic peptide
DEQEIRTTNPVATEQYGSVSTENLQRGNG

SEQ ID NO: 10943 - protein, 28 aa, Artificial Sequence
  Description of Artificial Sequence: Synthetic peptide
KEEEIRTTNPVATEQYGSVSTNLQTGND

SEQ ID NO: 10944 - protein, 28 aa, Artificial Sequence
  Description of Artificial Sequence: Synthetic peptide
DEESIRATNIVATEQYGSVSTNLQRGNR

SEQ ID NO: 10945 - protein, 29 aa, Artificial Sequence
  Description of Artificial Sequence: Synthetic peptide
DEEEIRTTNPVATEQYGSVSTNGLQRGEF

SEQ ID NO: 10946 - protein, 28 aa, Artificial Sequence
  Description of Artificial Sequence: Synthetic peptide
DEEEIRTTNPVATECYGSVSTDLQRGNL

SEQ ID NO: 10947 - protein, 29 aa, Artificial Sequence
  Description of Artificial Sequence: Synthetic peptide
DEEEIRTTNPVATEQYGSVSCTDQQRGNR

SEQ ID NO: 10948 - protein, 29 aa, Artificial Sequence
  Description of Artificial Sequence: Synthetic peptide
DEQEIVTTNPVATEQYGSVSTNLQQRGNR

SEQ ID NO: 10949 - protein, 28 aa, Artificial Sequence
  Description of Artificial Sequence: Synthetic peptide
DEEEIATTNIVATEQYGSASTNLQRGNR

SEQ ID NO: 10950 - protein, 29 aa, Artificial Sequence
  Description of Artificial Sequence: Synthetic peptide
DEQEIRTTNPVATEQYGSVSTNLQGFGNR

SEQ ID NO: 10951 - protein, 28 aa, Artificial Sequence
  Description of Artificial Sequence: Synthetic peptide
DEEEIRTTNIDATEQYGSVSTNLQRGNF

SEQ ID NO: 10952 - protein, 29 aa, Artificial Sequence
  Description of Artificial Sequence: Synthetic peptide
DEEEIRCTNPVATEQYGSVSTDLPQRGNR

SEQ ID NO: 10953 - protein, 28 aa, Artificial Sequence
  Description of Artificial Sequence: Synthetic peptide
DEEEIRTTNIVATEQYGSVSTILQRGNA

SEQ ID NO: 10954 - protein, 28 aa, Artificial Sequence
  Description of Artificial Sequence: Synthetic peptide
DEQEIRTTNPVATEQYGNVSTNLQRGNL

SEQ ID NO: 10955 - protein, 30 aa, Artificial Sequence
  Description of Artificial Sequence: Synthetic polypeptide
QEEEIRTTNPVATEQYGSVSCTNLQRGFNR

SEQ ID NO: 10956 - protein, 28 aa, Artificial Sequence
  Description of Artificial Sequence: Synthetic peptide
DEEEIRTTNPVATELYGSASTNLQHGNR

SEQ ID NO: 10957 - protein, 28 aa, Artificial Sequence
  Description of Artificial Sequence: Synthetic peptide
DEDEIRTTNPVATEGYGSVSTNLQHGNR

SEQ ID NO: 10958 - protein, 28 aa, Artificial Sequence
  Description of Artificial Sequence: Synthetic peptide
DEEEIRTTNPVATEQYGSVSTDDQYGNR

SEQ ID NO: 10959 - protein, 28 aa, Artificial Sequence
  Description of Artificial Sequence: Synthetic peptide
DEEEICTTNPVATELYGSVSTNLQRGNS

SEQ ID NO: 10960 - protein, 29 aa, Artificial Sequence
  Description of Artificial Sequence: Synthetic peptide
DEEEVRTTNPVATEIYGSVSATNLQRGNR

SEQ ID NO: 10961 - protein, 28 aa, Artificial Sequence
  Description of Artificial Sequence: Synthetic peptide
DEAWIRTTNPVATEQYGSVSTNLQRGNN

SEQ ID NO: 10962 - protein, 28 aa, Artificial Sequence
  Description of Artificial Sequence: Synthetic peptide
DEEEIRTTNPVATEQYGSVSENLQQGNQ

SEQ ID NO: 10963 - protein, 28 aa, Artificial Sequence
  Description of Artificial Sequence: Synthetic peptide
DEEEIRTTNPVCTEQYGSVSTDLQRGNA

SEQ ID NO: 10964 - protein, 28 aa, Artificial Sequence
  Description of Artificial Sequence: Synthetic peptide
DEEEIATVNPVATEQYGSVSTNLQRGNL

SEQ ID NO: 10965 - protein, 28 aa, Artificial Sequence
  Description of Artificial Sequence: Synthetic peptide
DEEEIRTTNPTATEQYGSVSTNPQFGNR

SEQ ID NO: 10966 - protein, 28 aa, Artificial Sequence
  Description of Artificial Sequence: Synthetic peptide
DEQEIRTTNPVATEMYGVVSTNLQRGNR

SEQ ID NO: 10967 - protein, 28 aa, Artificial Sequence
  Description of Artificial Sequence: Synthetic peptide
DENEIRTTNPVATECYGSVSTELQRGNR

SEQ ID NO: 10968 - protein, 28 aa, Artificial Sequence
  Description of Artificial Sequence: Synthetic peptide
DEEEINTTNPVATEQYGSVSENLQMGNR

SEQ ID NO: 10969 - protein, 28 aa, Artificial Sequence
  Description of Artificial Sequence: Synthetic peptide
DEEEIRTTNPVATEQYGSVDTNLQHGNT

SEQ ID NO: 10970 - protein, 28 aa, Artificial Sequence
  Description of Artificial Sequence: Synthetic peptide
DEEEIRTTNPVATEQYGSVSTELQYGNN

SEQ ID NO: 10971 - protein, 30 aa, Artificial Sequence
  Description of Artificial Sequence: Synthetic polypeptide
DEEEIRTTNPVATEQYGSVSTNLVEREGNR

SEQ ID NO: 10972 - protein, 28 aa, Artificial Sequence
  Description of Artificial Sequence: Synthetic peptide
DEEEIMTTNIEATEQYGSVSTNLQRGNR

SEQ ID NO: 10973 - protein, 28 aa, Artificial Sequence
  Description of Artificial Sequence: Synthetic peptide
DEEEIRTTNPVATEQYGSVSDNLQRGAN

SEQ ID NO: 10974 - protein, 28 aa, Artificial Sequence
  Description of Artificial Sequence: Synthetic peptide
DEEEIRTTNPVATEQYGAVSTNLQVGNT

SEQ ID NO: 10975 - protein, 28 aa, Artificial Sequence
  Description of Artificial Sequence: Synthetic peptide
DEEEIRTVNPVATEQYGSVSTNLQVGNM

SEQ ID NO: 10976 - protein, 28 aa, Artificial Sequence
  Description of Artificial Sequence: Synthetic peptide
DEEEIRTTNPVATEQYGSVSTNLQRLPQ

SEQ ID NO: 10977 - protein, 28 aa, Artificial Sequence
  Description of Artificial Sequence: Synthetic peptide
KEEEIRTTNPVATEQYGSVSTNLQHGNA

SEQ ID NO: 10978 - protein, 29 aa, Artificial Sequence
  Description of Artificial Sequence: Synthetic peptide
DEEEIRTTNPVATEQYGSVATCNEQRGNR

SEQ ID NO: 10979 - protein, 28 aa, Artificial Sequence
  Description of Artificial Sequence: Synthetic peptide
CEEEIRTTNPVSTEQYGSVSTNLQRGNQ

SEQ ID NO: 10980 - protein, 28 aa, Artificial Sequence
  Description of Artificial Sequence: Synthetic peptide
DEEEIRTTNPVATEQYGSVSTDLDRGNA

SEQ ID NO: 10981 - protein, 30 aa, Artificial Sequence
  Description of Artificial Sequence: Synthetic polypeptide
DEEEIRQTNPVATEQYGSVSTNLQRNGENR

SEQ ID NO: 10982 - protein, 28 aa, Artificial Sequence
  Description of Artificial Sequence: Synthetic peptide
DECEIRTTNPVATETYGSVSTELQRGNR

SEQ ID NO: 10983 - protein, 28 aa, Artificial Sequence
  Description of Artificial Sequence: Synthetic peptide
DEEEIRTTNPVATEQYGSVSTALQVGNA

SEQ ID NO: 10984 - protein, 29 aa, Artificial Sequence
  Description of Artificial Sequence: Synthetic peptide
DEEEIRTTNPVATEQYGEVSENLQRGDNR

SEQ ID NO: 10985 - protein, 28 aa, Artificial Sequence
  Description of Artificial Sequence: Synthetic peptide
DEEEIRTTNPVATEWYGSVDTNLQTGNR

SEQ ID NO: 10986 - protein, 28 aa, Artificial Sequence
  Description of Artificial Sequence: Synthetic peptide
DEEEIRTTNPVATEQWGSVSTNLQLGNF

SEQ ID NO: 10987 - protein, 29 aa, Artificial Sequence
  Description of Artificial Sequence: Synthetic peptide
DEEEIRTTNPCATEQYGCVSTNLQRGNDR

SEQ ID NO: 10988 - protein, 28 aa, Artificial Sequence
  Description of Artificial Sequence: Synthetic peptide
DEEEIRTTNPVATEQYGSVSTNWQRGDG

SEQ ID NO: 10989 - protein, 28 aa, Artificial Sequence
  Description of Artificial Sequence: Synthetic peptide
DEEEISTTNPTACEQYGSVSTNLQRGNR

SEQ ID NO: 10990 - protein, 28 aa, Artificial Sequence
  Description of Artificial Sequence: Synthetic peptide
DEEEIRTTNPVATEQYGSVSTNDQRENI

SEQ ID NO: 10991 - protein, 28 aa, Artificial Sequence
  Description of Artificial Sequence: Synthetic peptide
QENEIRTTNPVATEQYGSVSENLQRGNR

SEQ ID NO: 10992 - protein, 28 aa, Artificial Sequence
  Description of Artificial Sequence: Synthetic peptide
DEEETRTTNIVATEQYGSVSTNLQRGNA

SEQ ID NO: 10993 - protein, 28 aa, Artificial Sequence
  Description of Artificial Sequence: Synthetic peptide
DENEIRTTNPVATEQYGWVSDNLQRGNR

SEQ ID NO: 10994 - protein, 28 aa, Artificial Sequence
  Description of Artificial Sequence: Synthetic peptide
DEEEIRTTNPVATEQYGSVSTDLQHGNQ

SEQ ID NO: 10995 - protein, 28 aa, Artificial Sequence
  Description of Artificial Sequence: Synthetic peptide
DEEEIRTTNPVATEQYGSVSTDLQQGNM

SEQ ID NO: 10996 - protein, 28 aa, Artificial Sequence
  Description of Artificial Sequence: Synthetic peptide
DEEEIRTTNPVATELYGSVSTNEQIGNR

SEQ ID NO: 10997 - protein, 30 aa, Artificial Sequence
  Description of Artificial Sequence: Synthetic polypeptide
DEEEIRTTNPVATEQYGNVSTNLQDRKGNR

SEQ ID NO: 10998 - protein, 28 aa, Artificial Sequence
  Description of Artificial Sequence: Synthetic peptide
DDEEIRTTNPVATEQYGCVSTNLQRGMR

SEQ ID NO: 10999 - protein, 28 aa, Artificial Sequence
  Description of Artificial Sequence: Synthetic peptide
DEEEIRTTNPDATEDYGSVSTNLQRINR

SEQ ID NO: 11000 - protein, 28 aa, Artificial Sequence
  Description of Artificial Sequence: Synthetic peptide
DEEEIRTTNPVATEQYGWVSTNLQHGNI

SEQ ID NO: 11001 - protein, 28 aa, Artificial Sequence
  Description of Artificial Sequence: Synthetic peptide
DEEEIRCTNPVATEMYGSVSTNLQRGQR

SEQ ID NO: 11002 - protein, 28 aa, Artificial Sequence
  Description of Artificial Sequence: Synthetic peptide
DEEEICTTNIVATEQYGSVSNNLQRGNR

SEQ ID NO: 11003 - protein, 29 aa, Artificial Sequence
  Description of Artificial Sequence: Synthetic peptide
DEEEIRTTNPVATEQYGSVSTCPLQLGNR

SEQ ID NO: 11004 - protein, 28 aa, Artificial Sequence
  Description of Artificial Sequence: Synthetic peptide
DEEEIRCTNPVATEQWGSVSTNLQRGNA

SEQ ID NO: 11005 - protein, 28 aa, Artificial Sequence
  Description of Artificial Sequence: Synthetic peptide
DEEEIRTTNPVATEQYGVVSTELQRGNN

SEQ ID NO: 11006 - protein, 28 aa, Artificial Sequence
  Description of Artificial Sequence: Synthetic peptide
DEEEIRTTNPVATEQYGSVSTNLQNEPR

SEQ ID NO: 11007 - protein, 29 aa, Artificial Sequence
  Description of Artificial Sequence: Synthetic peptide
DEEEIRTTNPVATEQYGSVSTNQQQGPNR

SEQ ID NO: 11008 - protein, 28 aa, Artificial Sequence
  Description of Artificial Sequence: Synthetic peptide
DENEIRTTNPVATECYGSVSTNLQQGNR

SEQ ID NO: 11009 - protein, 28 aa, Artificial Sequence
  Description of Artificial Sequence: Synthetic peptide
DEQEIRCTNPVATEQYGSVSTNLERGNR

SEQ ID NO: 11010 - protein, 28 aa, Artificial Sequence
  Description of Artificial Sequence: Synthetic peptide
DEEEIRTTNPVATEQYGSVSTELQDGNC

SEQ ID NO: 11011 - protein, 28 aa, Artificial Sequence
  Description of Artificial Sequence: Synthetic peptide
DEEEIRTTNPVCTEQYGSVSTNLQAGNQ

SEQ ID NO: 11012 - protein, 28 aa, Artificial Sequence
  Description of Artificial Sequence: Synthetic peptide
DEEEIRTTNPVATEQYGIVSTNLQYGNS

SEQ ID NO: 11013 - protein, 28 aa, Artificial Sequence
  Description of Artificial Sequence: Synthetic peptide
DEEEIRTTNPVATEQYGSVSTNLEHGER

SEQ ID NO: 11014 - protein, 28 aa, Artificial Sequence
  Description of Artificial Sequence: Synthetic peptide
DEEEIRTTNIVATEQYGCVATNLQRGNR

SEQ ID NO: 11015 - protein, 30 aa, Artificial Sequence
  Description of Artificial Sequence: Synthetic polypeptide
DEEEIRTTNPCATEQYGSVSTNLQRNGDNR

SEQ ID NO: 11016 - protein, 28 aa, Artificial Sequence
  Description of Artificial Sequence: Synthetic peptide
DEEEIVTTNPVATELYGDVSTNLQRGNR

SEQ ID NO: 11017 - protein, 28 aa, Artificial Sequence
  Description of Artificial Sequence: Synthetic peptide
DEEEIAQTNPVATEQYGSVSTNLQRGGR

SEQ ID NO: 11018 - protein, 28 aa, Artificial Sequence
  Description of Artificial Sequence: Synthetic peptide
REEEIRTTNPVATEQYGSVSTPLQRGNT

SEQ ID NO: 11019 - protein, 28 aa, Artificial Sequence
  Description of Artificial Sequence: Synthetic peptide
DEEEIRATNPVATEQYGSVSTNLQHGGR

SEQ ID NO: 11020 - protein, 28 aa, Artificial Sequence
  Description of Artificial Sequence: Synthetic peptide
DEYEIRTTNPVATEQYGEVSTNLQRGNM

SEQ ID NO: 11021 - protein, 28 aa, Artificial Sequence
  Description of Artificial Sequence: Synthetic peptide
DEEEIRTTNPVATEQYGSVATNLQVGNL

SEQ ID NO: 11022 - protein, 28 aa, Artificial Sequence
  Description of Artificial Sequence: Synthetic peptide
DEEEIRTTNPTATEQYGSVSTNLQRENF

SEQ ID NO: 11023 - protein, 28 aa, Artificial Sequence
  Description of Artificial Sequence: Synthetic peptide
DEVEIRTTNPVATEQYGSVSDNLQRGNT

SEQ ID NO: 11024 - protein, 28 aa, Artificial Sequence
  Description of Artificial Sequence: Synthetic peptide
DEDEIRTTNPVATEQYGSVSENLQRGNS

SEQ ID NO: 11025 - protein, 29 aa, Artificial Sequence
  Description of Artificial Sequence: Synthetic peptide
DEEEIRTTNPVATEQYGSVPTNLQRGGNH

SEQ ID NO: 11026 - protein, 28 aa, Artificial Sequence
  Description of Artificial Sequence: Synthetic peptide
DEEEIRTTNPVSTEQYGDVSTNLQRENR

SEQ ID NO: 11027 - protein, 28 aa, Artificial Sequence
  Description of Artificial Sequence: Synthetic peptide
QEQEIRTTNPVATEQYGSVSENLQRGNR

SEQ ID NO: 11028 - protein, 28 aa, Artificial Sequence
  Description of Artificial Sequence: Synthetic peptide
DEEEIRTTNPVATEQYGSVSTNLQQGTS

SEQ ID NO: 11029 - protein, 29 aa, Artificial Sequence
  Description of Artificial Sequence: Synthetic peptide
DEEEIRTTNPVATEQYGSVSTNLQFMGDR

SEQ ID NO: 11030 - protein, 30 aa, Artificial Sequence
  Description of Artificial Sequence: Synthetic polypeptide
DEEEIRTTNPVATEQYGSVSTNPLPQRGNF

SEQ ID NO: 11031 - protein, 28 aa, Artificial Sequence
  Description of Artificial Sequence: Synthetic peptide
DEEEIRTTNPVATEIYGCVSTNLERGNR

SEQ ID NO: 11032 - protein, 28 aa, Artificial Sequence
  Description of Artificial Sequence: Synthetic peptide
SEEEIRTTNPIATEQYGSVSTNLQRGNF

SEQ ID NO: 11033 - protein, 29 aa, Artificial Sequence
  Description of Artificial Sequence: Synthetic peptide
DEEEIRTTNPVATEQYGSVSTNLHVRGNG

SEQ ID NO: 11034 - protein, 29 aa, Artificial Sequence
  Description of Artificial Sequence: Synthetic peptide
DEEEIRTTNPVATEQYGSVSTNPQRKGNQ

SEQ ID NO: 11035 - protein, 28 aa, Artificial Sequence
  Description of Artificial Sequence: Synthetic peptide
DEDEIRTTNPVATEQYGSVSTNLMRDNR

SEQ ID NO: 11036 - protein, 29 aa, Artificial Sequence
  Description of Artificial Sequence: Synthetic peptide
DEEEIATTNPVATEQYGSVSTNLQEDGNR

SEQ ID NO: 11037 - protein, 28 aa, Artificial Sequence
  Description of Artificial Sequence: Synthetic peptide
DEEEIRTTNPVATEQYGSVSTELQHGER

SEQ ID NO: 11038 - protein, 28 aa, Artificial Sequence
  Description of Artificial Sequence: Synthetic peptide
DEQEIRTTNPVCTEQYGSVSTNLQAGNR

SEQ ID NO: 11039 - protein, 28 aa, Artificial Sequence
  Description of Artificial Sequence: Synthetic peptide
DEEEIRTTNIVATELYGSVSTNLQTGNR

SEQ ID NO: 11040 - protein, 28 aa, Artificial Sequence
  Description of Artificial Sequence: Synthetic peptide
EEEEIRTTNPTATEQYGSVSTNLQRGNF

SEQ ID NO: 11041 - protein, 28 aa, Artificial Sequence
  Description of Artificial Sequence: Synthetic peptide
DEVEIRTTNPVATEQYGSVSTLLQRGDR

SEQ ID NO: 11042 - protein, 28 aa, Artificial Sequence
  Description of Artificial Sequence: Synthetic peptide
SEEEIATTNPVATELYGSVSTNLQRGNR

SEQ ID NO: 11043 - protein, 28 aa, Artificial Sequence
  Description of Artificial Sequence: Synthetic peptide
DEEEIRTTNPVATEQYGSVSTNLQLGPF

SEQ ID NO: 11044 - protein, 29 aa, Artificial Sequence
  Description of Artificial Sequence: Synthetic peptide
DEEEICTTNPVATEQYGSVSTNLQHGVNR

SEQ ID NO: 11045 - protein, 28 aa, Artificial Sequence
  Description of Artificial Sequence: Synthetic peptide
DEEEIRTTNPVATEQWGSVSTNEMRGNR

SEQ ID NO: 11046 - protein, 28 aa, Artificial Sequence
  Description of Artificial Sequence: Synthetic peptide
DEQEIRTTNPVATEQYGDVSTNLQHGNR

SEQ ID NO: 11047 - protein, 28 aa, Artificial Sequence
  Description of Artificial Sequence: Synthetic peptide
DEEEIRTTNIVATEQYGSVSSNLQWGNR

SEQ ID NO: 11048 - protein, 28 aa, Artificial Sequence
  Description of Artificial Sequence: Synthetic peptide
DEEEIRTTNPTATEQYGSVSTNLQIGNN

SEQ ID NO: 11049 - protein, 29 aa, Artificial Sequence
  Description of Artificial Sequence: Synthetic peptide
DEEEIRTTNPVSTEQYGSVSENLQRAGNR

SEQ ID NO: 11050 - protein, 28 aa, Artificial Sequence
  Description of Artificial Sequence: Synthetic peptide
DEEEIRTTNPVATECYGSVSTNLQYGNI

SEQ ID NO: 11051 - protein, 28 aa, Artificial Sequence
  Description of Artificial Sequence: Synthetic peptide
DVEEIRTTNPVATEQYGSVSVNGQRGNR

SEQ ID NO: 11052 - protein, 28 aa, Artificial Sequence
  Description of Artificial Sequence: Synthetic peptide
DEEEIRTTNPVSTEGYGSVSTQLQRGNR

SEQ ID NO: 11053 - protein, 28 aa, Artificial Sequence
  Description of Artificial Sequence: Synthetic peptide
DESEIRTTNPVATEVYGSVSTNLERGNR

SEQ ID NO: 11054 - protein, 28 aa, Artificial Sequence
  Description of Artificial Sequence: Synthetic peptide
DEEEIRTTNPVCTEQYGSVSTNLQQGNL

SEQ ID NO: 11055 - protein, 28 aa, Artificial Sequence
  Description of Artificial Sequence: Synthetic peptide
DEEEIRTTNPVATEQYGSVSTNPQSGPR

SEQ ID NO: 11056 - protein, 28 aa, Artificial Sequence
  Description of Artificial Sequence: Synthetic peptide
DETEIVTTNPVATEQYGVVSTNLQRGNR

SEQ ID NO: 11057 - protein, 28 aa, Artificial Sequence
  Description of Artificial Sequence: Synthetic peptide
DEFEIRTTNIVATEQYGSVSTNLQQGNR

SEQ ID NO: 11058 - protein, 28 aa, Artificial Sequence
  Description of Artificial Sequence: Synthetic peptide
DEQEIRTTNPVATEQYGSVSTNEQRGNF

SEQ ID NO: 11059 - protein, 29 aa, Artificial Sequence
  Description of Artificial Sequence: Synthetic peptide
DEEEIRTTNPVATEIYGAVSTNLQFRGNR

SEQ ID NO: 11060 - protein, 28 aa, Artificial Sequence
  Description of Artificial Sequence: Synthetic peptide
SEEEIRTTNIVATEQYGSVSTNLQRGGR

SEQ ID NO: 11061 - protein, 28 aa, Artificial Sequence
  Description of Artificial Sequence: Synthetic peptide
DEEEIRTTNPVATEQYGSVSTNLQYGEG

SEQ ID NO: 11062 - protein, 28 aa, Artificial Sequence
  Description of Artificial Sequence: Synthetic peptide
QEEEIRTTNPVATEQYGSASENLQRGNR

SEQ ID NO: 11063 - protein, 30 aa, Artificial Sequence
  Description of Artificial Sequence: Synthetic polypeptide
DENEIRTTNPVATEQYGSVSETNLQQRGNR

SEQ ID NO: 11064 - protein, 28 aa, Artificial Sequence
  Description of Artificial Sequence: Synthetic peptide
DEEEITTTNPVATEQYGSASTVLQRGNR

SEQ ID NO: 11065 - protein, 28 aa, Artificial Sequence
  Description of Artificial Sequence: Synthetic peptide
SEEEIRTTNPVATELYGSVSTNLQQGNR

SEQ ID NO: 11066 - protein, 28 aa, Artificial Sequence
  Description of Artificial Sequence: Synthetic peptide
DEEEIRTTNPIATEQYGYVSTNLQLGNR

SEQ ID NO: 11067 - protein, 29 aa, Artificial Sequence
  Description of Artificial Sequence: Synthetic peptide
DEEEIRTTNPVATECYGSVSTNLQEVGNR

SEQ ID NO: 11068 - protein, 28 aa, Artificial Sequence
  Description of Artificial Sequence: Synthetic peptide
DEEEIRTTNIDATEQYGSVSTNLQRGER

SEQ ID NO: 11069 - protein, 28 aa, Artificial Sequence
  Description of Artificial Sequence: Synthetic peptide
DEEEIRTTNPVATEQYGSVSTELDRGER

SEQ ID NO: 11070 - protein, 29 aa, Artificial Sequence
  Description of Artificial Sequence: Synthetic peptide
DEEEIRTTNPVATEMYGSVSTNEQRSGNR

SEQ ID NO: 11071 - protein, 28 aa, Artificial Sequence
  Description of Artificial Sequence: Synthetic peptide
DEEEISTTNPVATEQYGSVSENLQKGNR

SEQ ID NO: 11072 - protein, 28 aa, Artificial Sequence
  Description of Artificial Sequence: Synthetic peptide
DEEEIRTTNPVATEQYGSASTNDQMGNR

SEQ ID NO: 11073 - protein, 28 aa, Artificial Sequence
  Description of Artificial Sequence: Synthetic peptide
DENEIRATNPVATEQYGSVSTNLQRGDR

SEQ ID NO: 11074 - protein, 28 aa, Artificial Sequence
  Description of Artificial Sequence: Synthetic peptide
DEVEIRTTNPVATEQYGSVSENLQRGNF

SEQ ID NO: 11075 - protein, 30 aa, Artificial Sequence
  Description of Artificial Sequence: Synthetic polypeptide
DEEEIRTTNPVATEQYGSVSTNLQRPGNGH

SEQ ID NO: 11076 - protein, 28 aa, Artificial Sequence
  Description of Artificial Sequence: Synthetic peptide
DEEEIVTTNPVATEQYGSVSTDLQRGNF

SEQ ID NO: 11077 - protein, 28 aa, Artificial Sequence
  Description of Artificial Sequence: Synthetic peptide
DEEEIRTTNPVATEQYGSVSENLMRGDR

SEQ ID NO: 11078 - protein, 28 aa, Artificial Sequence
  Description of Artificial Sequence: Synthetic peptide
DEEEIRTTNPVATEQYGSVSTDEQRGNF

SEQ ID NO: 11079 - protein, 30 aa, Artificial Sequence
  Description of Artificial Sequence: Synthetic polypeptide
DEEEIRTTNPVATEQYGSVSTMNEQREGNR

SEQ ID NO: 11080 - protein, 28 aa, Artificial Sequence
  Description of Artificial Sequence: Synthetic peptide
DENEIRTTNPVATEQYGSVSENLQRGNM

SEQ ID NO: 11081 - protein, 28 aa, Artificial Sequence
  Description of Artificial Sequence: Synthetic peptide
DEEEIRTTNPVATNQYGAVSENLQRGNR

SEQ ID NO: 11082 - protein, 28 aa, Artificial Sequence
  Description of Artificial Sequence: Synthetic peptide
DEEEIRTTNPVATEFYGSVSTNLQQGNV

SEQ ID NO: 11083 - protein, 28 aa, Artificial Sequence
  Description of Artificial Sequence: Synthetic peptide
DEQEIRTTNIVATEQYGSVSTNLQRGER

SEQ ID NO: 11084 - protein, 28 aa, Artificial Sequence
  Description of Artificial Sequence: Synthetic peptide
DEEEIRTTNPVATEQYGSVSTNLTNGNT

SEQ ID NO: 11085 - protein, 28 aa, Artificial Sequence
  Description of Artificial Sequence: Synthetic peptide
DEEEIRCTNPVATEQYGAVSTNLERGNR

SEQ ID NO: 11086 - protein, 28 aa, Artificial Sequence
  Description of Artificial Sequence: Synthetic peptide
DDEEIRTTNPVATEQYGSVSTNLQRGEL

SEQ ID NO: 11087 - protein, 28 aa, Artificial Sequence
  Description of Artificial Sequence: Synthetic peptide
DEEEIRTTNPVATEQYGSVSTNGLQGER

SEQ ID NO: 11088 - protein, 28 aa, Artificial Sequence
  Description of Artificial Sequence: Synthetic peptide
DEEEIRTTNPVATEQYGSVSENEQQGNR

SEQ ID NO: 11089 - protein, 29 aa, Artificial Sequence
  Description of Artificial Sequence: Synthetic peptide
DEQEIRTTNPVATEIYGSVSTNLQRNGNR

SEQ ID NO: 11090 - protein, 28 aa, Artificial Sequence
  Description of Artificial Sequence: Synthetic peptide
DENEIRCTNPVATEQYGSVSTNLERGNR

SEQ ID NO: 11091 - protein, 29 aa, Artificial Sequence
  Description of Artificial Sequence: Synthetic peptide
DEEEIRTTNPVATEQYGSVSTNLQIHGNN

SEQ ID NO: 11092 - protein, 29 aa, Artificial Sequence
  Description of Artificial Sequence: Synthetic peptide
DEQEIRTTNPVATEQYGSVSTNLQERGNF

SEQ ID NO: 11093 - protein, 28 aa, Artificial Sequence
  Description of Artificial Sequence: Synthetic peptide
DEGEIRTTNPVATEQYGSVSDNLQRGER

SEQ ID NO: 11094 - protein, 28 aa, Artificial Sequence
  Description of Artificial Sequence: Synthetic peptide
DEEEIRTTNPVATEQYGSVSENLQVGND

SEQ ID NO: 11095 - protein, 28 aa, Artificial Sequence
  Description of Artificial Sequence: Synthetic peptide
DEEEIRTTNPVATEMYGSVSTNEQRGTR

SEQ ID NO: 11096 - protein, 28 aa, Artificial Sequence
  Description of Artificial Sequence: Synthetic peptide
DENEIRTTNPVATEQYGSVSENLQRGNA

SEQ ID NO: 11097 - protein, 28 aa, Artificial Sequence
  Description of Artificial Sequence: Synthetic peptide
DEQEIRTTNPVATEQYGWVSDNLQRGNR

SEQ ID NO: 11098 - protein, 28 aa, Artificial Sequence
  Description of Artificial Sequence: Synthetic peptide
DEGEIRTTNPVATEQYGEVSTNCQRGNR

SEQ ID NO: 11099 - protein, 28 aa, Artificial Sequence
  Description of Artificial Sequence: Synthetic peptide
DEEEVRTTNPVATEIYGCVSTNLQRGNR

SEQ ID NO: 11100 - protein, 28 aa, Artificial Sequence
  Description of Artificial Sequence: Synthetic peptide
DEEEIRTTNPVATEQYGSVTTNLQRLPR

SEQ ID NO: 11101 - protein, 29 aa, Artificial Sequence
  Description of Artificial Sequence: Synthetic peptide
DEEEIRTTNPVATEQYGSVPTNLQRAGNL

SEQ ID NO: 11102 - protein, 28 aa, Artificial Sequence
  Description of Artificial Sequence: Synthetic peptide
DEEEIRTVNPVATEQYGSVSTALQIGNR

SEQ ID NO: 11103 - protein, 30 aa, Artificial Sequence
  Description of Artificial Sequence: Synthetic polypeptide
DEQEIRTTNPVATEQYGSVSETNLQDRGNR

SEQ ID NO: 11104 - protein, 28 aa, Artificial Sequence
  Description of Artificial Sequence: Synthetic peptide
DEQEIRTTNPVATEQYGSVSTNPQRGNP

SEQ ID NO: 11105 - protein, 29 aa, Artificial Sequence
  Description of Artificial Sequence: Synthetic peptide
DEAEIRTTNPVATEQYGSVSTCLQQRGNR

SEQ ID NO: 11106 - protein, 28 aa, Artificial Sequence
  Description of Artificial Sequence: Synthetic peptide
DEEEIRSTNPVATEQYGSVSDNLQYGNR

SEQ ID NO: 11107 - protein, 28 aa, Artificial Sequence
  Description of Artificial Sequence: Synthetic peptide
DEEEICTTNPVATEQYGDVSDNLQRGNR

SEQ ID NO: 11108 - protein, 28 aa, Artificial Sequence
  Description of Artificial Sequence: Synthetic peptide
DEEEIRTTNPVATCQYGSVSTNLQYGNN

SEQ ID NO: 11109 - protein, 29 aa, Artificial Sequence
  Description of Artificial Sequence: Synthetic peptide
DEEEIRATNPVATECYGSVSTNLQIRGNR

SEQ ID NO: 11110 - protein, 28 aa, Artificial Sequence
  Description of Artificial Sequence: Synthetic peptide
DEEEIRTTNPVACEQYGSVSTLLWRGNR

SEQ ID NO: 11111 - protein, 28 aa, Artificial Sequence
  Description of Artificial Sequence: Synthetic peptide
DEEEIATTNPVATEMYGWVSTNLQRGNR

SEQ ID NO: 11112 - protein, 28 aa, Artificial Sequence
  Description of Artificial Sequence: Synthetic peptide
DEEEIRATNPVATEQYGSVSTNLQNGNI

SEQ ID NO: 11113 - protein, 28 aa, Artificial Sequence
  Description of Artificial Sequence: Synthetic peptide
DEEEIRTTNIVATEQYGSYSTNLQRGNG

SEQ ID NO: 11114 - protein, 29 aa, Artificial Sequence
  Description of Artificial Sequence: Synthetic peptide
DDEEIRTTNPVATEQYGSVSNNLQREGNR

SEQ ID NO: 11115 - protein, 28 aa, Artificial Sequence
  Description of Artificial Sequence: Synthetic peptide
DEEEIRTTNPVATECYGSVSTNLQRGEV

SEQ ID NO: 11116 - protein, 28 aa, Artificial Sequence
  Description of Artificial Sequence: Synthetic peptide
DEEEIRTVNPVATEQYGDVSTNLQRGNM

SEQ ID NO: 11117 - protein, 28 aa, Artificial Sequence
  Description of Artificial Sequence: Synthetic peptide
DEEEIRSTNPVATEQYGSVDTNLQRGDR

SEQ ID NO: 11118 - protein, 29 aa, Artificial Sequence
  Description of Artificial Sequence: Synthetic peptide
DEEEIRTTNPVATEQYGSVSTALQREGND

SEQ ID NO: 11119 - protein, 28 aa, Artificial Sequence
  Description of Artificial Sequence: Synthetic peptide
HEEEIRTCNPVATEQYGSVSENLQRGNR

SEQ ID NO: 11120 - protein, 30 aa, Artificial Sequence
  Description of Artificial Sequence: Synthetic polypeptide
DEEEIRTTNPVATEQYGSVSTNLQQVGNDR

SEQ ID NO: 11121 - protein, 28 aa, Artificial Sequence
  Description of Artificial Sequence: Synthetic peptide
DEQEIRTTNPVATEQYGSVSTDLQRGNA

SEQ ID NO: 11122 - protein, 28 aa, Artificial Sequence
  Description of Artificial Sequence: Synthetic peptide
DEDEIRTTNPVATEQYGYVSTNLQHGNR

SEQ ID NO: 11123 - protein, 28 aa, Artificial Sequence
  Description of Artificial Sequence: Synthetic peptide
DEEEIRTTNPVATEQYGSVSTELEYGNR

SEQ ID NO: 11124 - protein, 28 aa, Artificial Sequence
  Description of Artificial Sequence: Synthetic peptide
SEEEIRTTNPVATEQYGSVSVNLQRGNQ

SEQ ID NO: 11125 - protein, 28 aa, Artificial Sequence
  Description of Artificial Sequence: Synthetic peptide
DEEEIRTTNPVATEQYGSVPENLQTGNR

SEQ ID NO: 11126 - protein, 28 aa, Artificial Sequence
  Description of Artificial Sequence: Synthetic peptide
MEEEIRTTNPTATEQYGSVSDNLQRGNR

SEQ ID NO: 11127 - protein, 29 aa, Artificial Sequence
  Description of Artificial Sequence: Synthetic peptide
DEEEIRTTNPVATECYGSVSTNLQRGNDM

SEQ ID NO: 11128 - protein, 28 aa, Artificial Sequence
  Description of Artificial Sequence: Synthetic peptide
DEEEIRTTNIVATEQYGSVSTESQRGNR

SEQ ID NO: 11129 - protein, 29 aa, Artificial Sequence
  Description of Artificial Sequence: Synthetic peptide
DEEEIRTTNPVATEQYGSVEENLQRTGNR

SEQ ID NO: 11130 - protein, 28 aa, Artificial Sequence
  Description of Artificial Sequence: Synthetic peptide
DEEEIRTTNPVATEQYGSVSTNLQIGEF

SEQ ID NO: 11131 - protein, 28 aa, Artificial Sequence
  Description of Artificial Sequence: Synthetic peptide
DEEEIRTTNPVATEVYGSVSTVLQRGNK

SEQ ID NO: 11132 - protein, 29 aa, Artificial Sequence
  Description of Artificial Sequence: Synthetic peptide
DEEEIRTTNPVATELYGSVSTNDQRYGNR

SEQ ID NO: 11133 - protein, 29 aa, Artificial Sequence
  Description of Artificial Sequence: Synthetic peptide
DEQEIRTTNPVATEQYGSVSTINLWRGNR

SEQ ID NO: 11134 - protein, 28 aa, Artificial Sequence
  Description of Artificial Sequence: Synthetic peptide
DEQEIRTTNPVATEQYGSVSTNLQNGNN

SEQ ID NO: 11135 - protein, 29 aa, Artificial Sequence
  Description of Artificial Sequence: Synthetic peptide
DEEEIRTTNPVATEQYGSVSNCNLQNGNR

SEQ ID NO: 11136 - protein, 28 aa, Artificial Sequence
  Description of Artificial Sequence: Synthetic peptide
DEEEIRTTNIVATNQYGSVSTNLQNGNR

SEQ ID NO: 11137 - protein, 29 aa, Artificial Sequence
  Description of Artificial Sequence: Synthetic peptide
DEEEIRTTNPVATEQYGSVDTNLQRAGNE

SEQ ID NO: 11138 - protein, 28 aa, Artificial Sequence
  Description of Artificial Sequence: Synthetic peptide
DESEIRTTNPVATELYGSVSENLQRGNR

SEQ ID NO: 11139 - protein, 28 aa, Artificial Sequence
  Description of Artificial Sequence: Synthetic peptide
DEEEIATTNPVATEGYGSVSTNEQRGNR

SEQ ID NO: 11140 - protein, 28 aa, Artificial Sequence
  Description of Artificial Sequence: Synthetic peptide
DEWSIRTTNPVATEQYGSVSTNTQRGNR

SEQ ID NO: 11141 - protein, 28 aa, Artificial Sequence
  Description of Artificial Sequence: Synthetic peptide
DDEEIATTNPVATEQYGVVSTNLQRGNR

SEQ ID NO: 11142 - protein, 28 aa, Artificial Sequence
  Description of Artificial Sequence: Synthetic peptide
KEEEIRTTNPVATEQYGSVSTNLQLGNM

SEQ ID NO: 11143 - protein, 28 aa, Artificial Sequence
  Description of Artificial Sequence: Synthetic peptide
DEEEIRPTNPVATEQYGSVSTNQQRGND

SEQ ID NO: 11144 - protein, 28 aa, Artificial Sequence
  Description of Artificial Sequence: Synthetic peptide
DEEEIRTTNPVATEQYGSVSTNIQRENN

SEQ ID NO: 11145 - protein, 28 aa, Artificial Sequence
  Description of Artificial Sequence: Synthetic peptide
DEEEIRTTNIVATEQYGDVSTNLQRGER

SEQ ID NO: 11146 - protein, 28 aa, Artificial Sequence
  Description of Artificial Sequence: Synthetic peptide
DEEEIATTNPVATEQYGVVSTNLQRGNQ

SEQ ID NO: 11147 - protein, 28 aa, Artificial Sequence
  Description of Artificial Sequence: Synthetic peptide
MEEEIRTTNPVATEQYGSVSTNLQSGNN

SEQ ID NO: 11148 - protein, 28 aa, Artificial Sequence
  Description of Artificial Sequence: Synthetic peptide
DEEEIVTTNPVATEQFGSVSTNLQRGER

SEQ ID NO: 11149 - protein, 28 aa, Artificial Sequence
  Description of Artificial Sequence: Synthetic peptide
DEEEIRTTNPVATEQYGSVSCNLSRGER

SEQ ID NO: 11150 - protein, 28 aa, Artificial Sequence
  Description of Artificial Sequence: Synthetic peptide
DEEEIRTVNPVATELYGTVSTNLQRGNR

SEQ ID NO: 11151 - protein, 28 aa, Artificial Sequence
  Description of Artificial Sequence: Synthetic peptide
DEEEIITTNPVATEQYGSVSTNCQRGLR

SEQ ID NO: 11152 - protein, 29 aa, Artificial Sequence
  Description of Artificial Sequence: Synthetic peptide
DEEEIRTVNPVATEQYGSVSITNLQRGER

SEQ ID NO: 11153 - protein, 28 aa, Artificial Sequence
  Description of Artificial Sequence: Synthetic peptide
DEEEIRTTNPVATEQYGSVSTDLQRGEN

SEQ ID NO: 11154 - protein, 28 aa, Artificial Sequence
  Description of Artificial Sequence: Synthetic peptide
DEEEIVSTNPVATEQYGSVSTNLQRGNM

SEQ ID NO: 11155 - protein, 28 aa, Artificial Sequence
  Description of Artificial Sequence: Synthetic peptide
DEEEIRTTNPVATEQYGWVSTDLQRGNI

SEQ ID NO: 11156 - protein, 28 aa, Artificial Sequence
  Description of Artificial Sequence: Synthetic peptide
DEEEITTTNIVATEQYGSVSTNLQRGER

SEQ ID NO: 11157 - protein, 28 aa, Artificial Sequence
  Description of Artificial Sequence: Synthetic peptide
DEEEIRTTNPVATEQYGSVHTPLQRGNP

SEQ ID NO: 11158 - protein, 28 aa, Artificial Sequence
  Description of Artificial Sequence: Synthetic peptide
DEEEIRTTNIFATEQYGSVSTNLQRGND

SEQ ID NO: 11159 - protein, 28 aa, Artificial Sequence
  Description of Artificial Sequence: Synthetic peptide
CDGEIRTTNPVATEQYGSVSTNLQRGNR

SEQ ID NO: 11160 - protein, 28 aa, Artificial Sequence
  Description of Artificial Sequence: Synthetic peptide
DEEEIRTTNPVATECYGSMSTELQRGNR

SEQ ID NO: 11161 - protein, 28 aa, Artificial Sequence
  Description of Artificial Sequence: Synthetic peptide
DEEEIRTTNPVCTEQYGSVSENLQHGNR

SEQ ID NO: 11162 - protein, 31 aa, Artificial Sequence
  Description of Artificial Sequence: Synthetic polypeptide
DEEEIRTTNPVATEQYGSVSTNLQRKGDNDR

SEQ ID NO: 11163 - protein, 28 aa, Artificial Sequence
  Description of Artificial Sequence: Synthetic peptide
DESEIRSTNPVATEQYGSVSTNLQEGNR

SEQ ID NO: 11164 - protein, 28 aa, Artificial Sequence
  Description of Artificial Sequence: Synthetic peptide
SEEEIRTTNIVATEQYGSVSDNLQRGNR

SEQ ID NO: 11165 - protein, 28 aa, Artificial Sequence
  Description of Artificial Sequence: Synthetic peptide
DEEEIRGTNPVATEQYGSVSTNLQTGNS

SEQ ID NO: 11166 - protein, 28 aa, Artificial Sequence
  Description of Artificial Sequence: Synthetic peptide
DEEEIRTTNPVATEIYGSVSTNPQRGNQ

SEQ ID NO: 11167 - protein, 28 aa, Artificial Sequence
  Description of Artificial Sequence: Synthetic peptide
DEEEIRTTNPVATEQYGSVSTELQHGNH

SEQ ID NO: 11168 - protein, 28 aa, Artificial Sequence
  Description of Artificial Sequence: Synthetic peptide
DEEEIRTTNPVATECYGSVSTNLQQGNW

SEQ ID NO: 11169 - protein, 30 aa, Artificial Sequence
  Description of Artificial Sequence: Synthetic polypeptide
DEEEIRTTNPVATEQYGDVSTNLQRFGGNR

SEQ ID NO: 11170 - protein, 28 aa, Artificial Sequence
  Description of Artificial Sequence: Synthetic peptide
DEEEIRTTNPVATEQYGSVSTDLQYGNL

SEQ ID NO: 11171 - protein, 28 aa, Artificial Sequence
  Description of Artificial Sequence: Synthetic peptide
DEEEIRCTNPVATEQYGSVSENLQRGNF

SEQ ID NO: 11172 - protein, 28 aa, Artificial Sequence
  Description of Artificial Sequence: Synthetic peptide
DEEEIRTTNPVATEQWGSVDTNLQGGNR

SEQ ID NO: 11173 - protein, 28 aa, Artificial Sequence
  Description of Artificial Sequence: Synthetic peptide
DEEEIVTTNPVATEVYGSVSTNVQRGNR

SEQ ID NO: 11174 - protein, 28 aa, Artificial Sequence
  Description of Artificial Sequence: Synthetic peptide
DEEEIATTNPVADEQYGSVSTNCQRGNR

SEQ ID NO: 11175 - protein, 28 aa, Artificial Sequence
  Description of Artificial Sequence: Synthetic peptide
DEEEIRTTNPVATEQYGSVSTNLGNGNF

SEQ ID NO: 11176 - protein, 28 aa, Artificial Sequence
  Description of Artificial Sequence: Synthetic peptide
DEEEIRTTNPCATEQYGSTSTNLQRGND

SEQ ID NO: 11177 - protein, 28 aa, Artificial Sequence
  Description of Artificial Sequence: Synthetic peptide
DEEEIKTTNPVATEQYGSVSENLQRGGR

SEQ ID NO: 11178 - protein, 28 aa, Artificial Sequence
  Description of Artificial Sequence: Synthetic peptide
DEEEIRSTNPVATEQYGSVSTDLQQGNR

SEQ ID NO: 11179 - protein, 29 aa, Artificial Sequence
  Description of Artificial Sequence: Synthetic peptide
DEEEIRTTNPVATEQYWSVSDHNLQRGNR

SEQ ID NO: 11180 - protein, 28 aa, Artificial Sequence
  Description of Artificial Sequence: Synthetic peptide
DEEEIRTTNISATEQYGSVSTELQRGNR

SEQ ID NO: 11181 - protein, 28 aa, Artificial Sequence
  Description of Artificial Sequence: Synthetic peptide
CEEEIRTTNPVATEQYGEVSTQLQRGNR

SEQ ID NO: 11182 - protein, 29 aa, Artificial Sequence
  Description of Artificial Sequence: Synthetic peptide
DEEEIRTTNPVATEQYGSHSTNLSQRGWR

SEQ ID NO: 11183 - protein, 28 aa, Artificial Sequence
  Description of Artificial Sequence: Synthetic peptide
DEEEIATTNPVATEQYGSASTVLQRGNR

SEQ ID NO: 11184 - protein, 28 aa, Artificial Sequence
  Description of Artificial Sequence: Synthetic peptide
SEEEIRTTNPTATEQYGSVSTNLQLGNR

SEQ ID NO: 11185 - protein, 29 aa, Artificial Sequence
  Description of Artificial Sequence: Synthetic peptide
SEEEIRTTNPVATEVYGSVSTNLQRAGNR

SEQ ID NO: 11186 - protein, 28 aa, Artificial Sequence
  Description of Artificial Sequence: Synthetic peptide
QEEEIATTNPVATECYGSVSTNLQRGNR

SEQ ID NO: 11187 - protein, 28 aa, Artificial Sequence
  Description of Artificial Sequence: Synthetic peptide
DEEEIRTTNIVATEQYGSVSENLERGNR

SEQ ID NO: 11188 - protein, 28 aa, Artificial Sequence
  Description of Artificial Sequence: Synthetic peptide
DEEEIRTTNPVATEQYGSVDENLQRGNL

SEQ ID NO: 11189 - protein, 28 aa, Artificial Sequence
  Description of Artificial Sequence: Synthetic peptide
AEEEIRTTNPVATENYGSVSTNLQRGQR

SEQ ID NO: 11190 - protein, 28 aa, Artificial Sequence
  Description of Artificial Sequence: Synthetic peptide
DEEEIRTTNIAATEQYGSVSTNLQRGER

SEQ ID NO: 11191 - protein, 28 aa, Artificial Sequence
  Description of Artificial Sequence: Synthetic peptide
DEEEIRTTNPVSTEQYGSYSTNLQRGNQ

SEQ ID NO: 11192 - protein, 28 aa, Artificial Sequence
  Description of Artificial Sequence: Synthetic peptide
DEEEIRTTNPVATEQYGSASTADQRGNR

SEQ ID NO: 11193 - protein, 28 aa, Artificial Sequence
  Description of Artificial Sequence: Synthetic peptide
DEEEIRATNPVATEQYGSVSTNLQRGDF

SEQ ID NO: 11194 - protein, 28 aa, Artificial Sequence
  Description of Artificial Sequence: Synthetic peptide
DEQEIRTTNPVATEQWGSVSTNLQIGNR

SEQ ID NO: 11195 - protein, 29 aa, Artificial Sequence
  Description of Artificial Sequence: Synthetic peptide
DEEEIRTTNPVATEQYGSVSVMNLQFGNR

SEQ ID NO: 11196 - protein, 29 aa, Artificial Sequence
  Description of Artificial Sequence: Synthetic peptide
DEEEIRTTNPVATEQYGSVSTNLQELGNS

SEQ ID NO: 11197 - protein, 28 aa, Artificial Sequence
  Description of Artificial Sequence: Synthetic peptide
DEEEIGTTNPAATEQYGSVSENLQRGNR

SEQ ID NO: 11198 - protein, 30 aa, Artificial Sequence
  Description of Artificial Sequence: Synthetic polypeptide
DEEEIRTTNPVATEQYGSVSNNLQRGANPR

SEQ ID NO: 11199 - protein, 28 aa, Artificial Sequence
  Description of Artificial Sequence: Synthetic peptide
DEMEIRATNPVATEQYGSVSTNLQVGNR

SEQ ID NO: 11200 - protein, 28 aa, Artificial Sequence
  Description of Artificial Sequence: Synthetic peptide
DEEEIATTNIVATEQYGDVSTNLQRGNR

SEQ ID NO: 11201 - protein, 28 aa, Artificial Sequence
  Description of Artificial Sequence: Synthetic peptide
DEEEIRTTNPVATEQYGGVSTNLETGNR

SEQ ID NO: 11202 - protein, 29 aa, Artificial Sequence
  Description of Artificial Sequence: Synthetic peptide
DEEEIRTTNPVAYEQYGSVSTNPLQRGER

SEQ ID NO: 11203 - protein, 28 aa, Artificial Sequence
  Description of Artificial Sequence: Synthetic peptide
DEEEIRTTNIVATEVYGSVSTNDQRGNR

SEQ ID NO: 11204 - protein, 28 aa, Artificial Sequence
  Description of Artificial Sequence: Synthetic peptide
DEEEIRTTNPVATEQYGDVSTNLQFGER

SEQ ID NO: 11205 - protein, 28 aa, Artificial Sequence
  Description of Artificial Sequence: Synthetic peptide
DEEEIRTTNPVATECYGSVSENLQQGNR

SEQ ID NO: 11206 - protein, 28 aa, Artificial Sequence
  Description of Artificial Sequence: Synthetic peptide
DEEEIRTTNPVATEQYGSVDENLQHGNR

SEQ ID NO: 11207 - protein, 29 aa, Artificial Sequence
  Description of Artificial Sequence: Synthetic peptide
DEQEIRTTNPNATEQYGSVSTNLQRGNDR

SEQ ID NO: 11208 - protein, 28 aa, Artificial Sequence
  Description of Artificial Sequence: Synthetic peptide
DEEEIRTTNPVSTEQYGSVSTNLQQGNL

SEQ ID NO: 11209 - protein, 28 aa, Artificial Sequence
  Description of Artificial Sequence: Synthetic peptide
SEEEIRATNPVATEQFGSVSTNLQRGNR

SEQ ID NO: 11210 - protein, 28 aa, Artificial Sequence
  Description of Artificial Sequence: Synthetic peptide
DESEIRTTNPVATEQYGSMSTNLQYGNR

SEQ ID NO: 11211 - protein, 28 aa, Artificial Sequence
  Description of Artificial Sequence: Synthetic peptide
DESEIATTNPVATEQYGSVSTNLQRGNI

SEQ ID NO: 11212 - protein, 28 aa, Artificial Sequence
  Description of Artificial Sequence: Synthetic peptide
DEEEIRTTNPVATEQYGIVSTNLQLGTR

SEQ ID NO: 11213 - protein, 28 aa, Artificial Sequence
  Description of Artificial Sequence: Synthetic peptide
CEEEIRCTNPVATEQYGSVSDNLQRGNR

SEQ ID NO: 11214 - protein, 28 aa, Artificial Sequence
  Description of Artificial Sequence: Synthetic peptide
MEEEIRTTNPVATEQYGSVSTNLQWGNL

SEQ ID NO: 11215 - protein, 28 aa, Artificial Sequence
  Description of Artificial Sequence: Synthetic peptide
MEEEIRTTNPVATEQYGSVSTNLQQGNS

SEQ ID NO: 11216 - protein, 28 aa, Artificial Sequence
  Description of Artificial Sequence: Synthetic peptide
DEEEIRTTNPVATEQWGSVSENEQRGNR

SEQ ID NO: 11217 - protein, 28 aa, Artificial Sequence
  Description of Artificial Sequence: Synthetic peptide
DEEEIGTTNPVATEQYGSVSTMLQRGNQ

SEQ ID NO: 11218 - protein, 28 aa, Artificial Sequence
  Description of Artificial Sequence: Synthetic peptide
DEEEIATTNPVATEQYGSVSTNLQTGNM

SEQ ID NO: 11219 - protein, 29 aa, Artificial Sequence
  Description of Artificial Sequence: Synthetic peptide
DEGEIRTTNPVATEQYGSVSTGNLQRGNF

SEQ ID NO: 11220 - protein, 28 aa, Artificial Sequence
  Description of Artificial Sequence: Synthetic peptide
DEEEIRTTNPVATEQYGSVSTNLQTGDM

SEQ ID NO: 11221 - protein, 28 aa, Artificial Sequence
  Description of Artificial Sequence: Synthetic peptide
DEQEIVTTNPVATEQYGSVGTNLQRGNR

SEQ ID NO: 11222 - protein, 28 aa, Artificial Sequence
  Description of Artificial Sequence: Synthetic peptide
DEHEIRTTNPVATEQYGSVSTELQRGNL

SEQ ID NO: 11223 - protein, 28 aa, Artificial Sequence
  Description of Artificial Sequence: Synthetic peptide
DEEEIRTTNPVATEQFGSVSTNLARGNS

SEQ ID NO: 11224 - protein, 28 aa, Artificial Sequence
  Description of Artificial Sequence: Synthetic peptide
DEEEIRQTNPVATEQYGSVSTALQRGNQ

SEQ ID NO: 11225 - protein, 28 aa, Artificial Sequence
  Description of Artificial Sequence: Synthetic peptide
DENEIRTTNPVATEQYGSVSTNEQRGTR

SEQ ID NO: 11226 - protein, 29 aa, Artificial Sequence
  Description of Artificial Sequence: Synthetic peptide
DEGEIRTTNPVATEQYGSVSTNLQRGGNK

SEQ ID NO: 11227 - protein, 28 aa, Artificial Sequence
  Description of Artificial Sequence: Synthetic peptide
DEEEIRTTNPVATEQYGWVSTNLQHGNF

SEQ ID NO: 11228 - protein, 28 aa, Artificial Sequence
  Description of Artificial Sequence: Synthetic peptide
DEEEIRTTNPVATEQYGSVSEDLQRGNA

SEQ ID NO: 11229 - protein, 28 aa, Artificial Sequence
  Description of Artificial Sequence: Synthetic peptide
DEQEIATTNPVATEQYGEVSTNLQRGNR

SEQ ID NO: 11230 - protein, 28 aa, Artificial Sequence
  Description of Artificial Sequence: Synthetic peptide
DEEEIRTTNIVATEIYGSVSTNLQRGNT

SEQ ID NO: 11231 - protein, 28 aa, Artificial Sequence
  Description of Artificial Sequence: Synthetic peptide
DEEEIRTTNPVATEQYGSVSTEGQRGNM

SEQ ID NO: 11232 - protein, 28 aa, Artificial Sequence
  Description of Artificial Sequence: Synthetic peptide
DEEEIATTNPVATEQYGSVSTNLQIGNH

SEQ ID NO: 11233 - protein, 28 aa, Artificial Sequence
  Description of Artificial Sequence: Synthetic peptide
SEEEIRTTNPVATEQYGSYSTNLQVGNR

SEQ ID NO: 11234 - protein, 28 aa, Artificial Sequence
  Description of Artificial Sequence: Synthetic peptide
DEEEIRTTNICATEQWGSVSTNLQRGNR

SEQ ID NO: 11235 - protein, 28 aa, Artificial Sequence
  Description of Artificial Sequence: Synthetic peptide
DEEEIRTTNPVATEQYGSVSTGLEPGNR

SEQ ID NO: 11236 - protein, 29 aa, Artificial Sequence
  Description of Artificial Sequence: Synthetic peptide
QEEEIRTTNPVATEQYGSVSDNLQQRGNR

SEQ ID NO: 11237 - protein, 30 aa, Artificial Sequence
  Description of Artificial Sequence: Synthetic polypeptide
DEEEIRTTNPVATEQYGSVSENLQRAGDNR

SEQ ID NO: 11238 - protein, 28 aa, Artificial Sequence
  Description of Artificial Sequence: Synthetic peptide
DEEEIRTTNIVATEQYGSVSTALQRGNI

SEQ ID NO: 11239 - protein, 28 aa, Artificial Sequence
  Description of Artificial Sequence: Synthetic peptide
DEEEIRTTNPVATEQYGSVSTNLQHGTI

SEQ ID NO: 11240 - protein, 29 aa, Artificial Sequence
  Description of Artificial Sequence: Synthetic peptide
DEEEIRATNPVATEQYGSVSEMNLQRGNR

SEQ ID NO: 11241 - protein, 28 aa, Artificial Sequence
  Description of Artificial Sequence: Synthetic peptide
DEEEIRTTNIVATEQYGSVDTNLQRGNL

SEQ ID NO: 11242 - protein, 29 aa, Artificial Sequence
  Description of Artificial Sequence: Synthetic peptide
DEEEIRTTNPVATEIYGSVSTNLQRNGNM

SEQ ID NO: 11243 - protein, 28 aa, Artificial Sequence
  Description of Artificial Sequence: Synthetic peptide
DEEEIRTTNPVATLQWGSWSTNLQRGNR

SEQ ID NO: 11244 - protein, 30 aa, Artificial Sequence
  Description of Artificial Sequence: Synthetic polypeptide
DEEEIRTTNPVATEQYGSVSTNPQERGNTR

SEQ ID NO: 11245 - protein, 28 aa, Artificial Sequence
  Description of Artificial Sequence: Synthetic peptide
DEEEIRTTNPVATECWGSVSTNLQRGNA

SEQ ID NO: 11246 - protein, 29 aa, Artificial Sequence
  Description of Artificial Sequence: Synthetic peptide
QEEEIRTTNPVATEQYGSVSTELQRFGNR

SEQ ID NO: 11247 - protein, 30 aa, Artificial Sequence
  Description of Artificial Sequence: Synthetic polypeptide
DEEEIRTTNPVATEQYGSVSSITNLQRGER

SEQ ID NO: 11248 - protein, 30 aa, Artificial Sequence
  Description of Artificial Sequence: Synthetic polypeptide
DEEEIRTTNPVATEQYGSVSTNLQFSNGNR

SEQ ID NO: 11249 - protein, 28 aa, Artificial Sequence
  Description of Artificial Sequence: Synthetic peptide
DEEEIRTTNIVATEQYGCVSTNLDRGNR

SEQ ID NO: 11250 - protein, 28 aa, Artificial Sequence
  Description of Artificial Sequence: Synthetic peptide
DEEEIRQTNPVATEQYGQVSTCLQRGNR

SEQ ID NO: 11251 - protein, 28 aa, Artificial Sequence
  Description of Artificial Sequence: Synthetic peptide
DEEEIATTNPVATEQYGSVSTNLQQGER

SEQ ID NO: 11252 - protein, 28 aa, Artificial Sequence
  Description of Artificial Sequence: Synthetic peptide
DEEEIRATNIVATEQYGSVSTDLQRGNR

SEQ ID NO: 11253 - protein, 28 aa, Artificial Sequence
  Description of Artificial Sequence: Synthetic peptide
DEEEIRTTNPVATECYGYVSTNLQRGNN

SEQ ID NO: 11254 - protein, 28 aa, Artificial Sequence
  Description of Artificial Sequence: Synthetic peptide
DEEEIRTTNPVATEQYGSISTVLQRGDR

SEQ ID NO: 11255 - protein, 28 aa, Artificial Sequence
  Description of Artificial Sequence: Synthetic peptide
DEEEIRTTNPVATEQYGSVSTELQIGNF

SEQ ID NO: 11256 - protein, 28 aa, Artificial Sequence
  Description of Artificial Sequence: Synthetic peptide
DEEEIRTTNPVATEQYGSVSTNDQRGES

SEQ ID NO: 11257 - protein, 28 aa, Artificial Sequence
  Description of Artificial Sequence: Synthetic peptide
DEEEIRTTNPVATEQYGSVSTDLQRGEQ

SEQ ID NO: 11258 - protein, 28 aa, Artificial Sequence
  Description of Artificial Sequence: Synthetic peptide
DEEEIRTTNPVATECYGAVETNLQRGNR

SEQ ID NO: 11259 - protein, 28 aa, Artificial Sequence
  Description of Artificial Sequence: Synthetic peptide
DEEEIRTTNPVATEQYGSVSTDLQGGNL

SEQ ID NO: 11260 - protein, 28 aa, Artificial Sequence
  Description of Artificial Sequence: Synthetic peptide
DEEEIRTTNPVATELYGGVSENLQRGNR

SEQ ID NO: 11261 - protein, 28 aa, Artificial Sequence
  Description of Artificial Sequence: Synthetic peptide
DEEEIRSTNPVATENYGFVSTNLQRGNR

SEQ ID NO: 11262 - protein, 28 aa, Artificial Sequence
  Description of Artificial Sequence: Synthetic peptide
DEMEIRTTNPVATEQYGSVSTNVQRGNL

SEQ ID NO: 11263 - protein, 28 aa, Artificial Sequence
  Description of Artificial Sequence: Synthetic peptide
DEVEIRTTNPVATEQFGSVSTNLQRGNF

SEQ ID NO: 11264 - protein, 28 aa, Artificial Sequence
  Description of Artificial Sequence: Synthetic peptide
DEEEITTTNPVATEHYGSVSDNLQRGNR

SEQ ID NO: 11265 - protein, 28 aa, Artificial Sequence
  Description of Artificial Sequence: Synthetic peptide
DEEEIRTTNPVATEQYGSVSTNEQLGNH

SEQ ID NO: 11266 - protein, 28 aa, Artificial Sequence
  Description of Artificial Sequence: Synthetic peptide
DEEEIRTTNPVATEQYGSVSTNLQLGEC

SEQ ID NO: 11267 - protein, 31 aa, Artificial Sequence
  Description of Artificial Sequence: Synthetic polypeptide
DEEEIRTTNPVATEQYGSVSCTMNLQCRGNR

SEQ ID NO: 11268 - protein, 28 aa, Artificial Sequence
  Description of Artificial Sequence: Synthetic peptide
VEEEIRTTNPVATEQYGSVSTNLQRGTQ

SEQ ID NO: 11269 - protein, 28 aa, Artificial Sequence
  Description of Artificial Sequence: Synthetic peptide
DEEEIRTTNPVATEQYGSVSTNLQTVNL

SEQ ID NO: 11270 - protein, 28 aa, Artificial Sequence
  Description of Artificial Sequence: Synthetic peptide
DEEEIRTTNPVATEQYGDVSTNLQRENG

SEQ ID NO: 11271 - protein, 28 aa, Artificial Sequence
  Description of Artificial Sequence: Synthetic peptide
DEEEIRTTNPVATECYGSVSHNLQPGNR

SEQ ID NO: 11272 - protein, 28 aa, Artificial Sequence
  Description of Artificial Sequence: Synthetic peptide
DEEEIRTTNIVATEQYGSVSSNLQRGNY

SEQ ID NO: 11273 - protein, 28 aa, Artificial Sequence
  Description of Artificial Sequence: Synthetic peptide
DEEEIRTTNPVSTEQYGSVSTNGQGGNR

SEQ ID NO: 11274 - protein, 31 aa, Artificial Sequence
  Description of Artificial Sequence: Synthetic polypeptide
DEEEIRTTNPVATEQYGSVDSTNLQLRGNDR

SEQ ID NO: 11275 - protein, 29 aa, Artificial Sequence
  Description of Artificial Sequence: Synthetic peptide
DEEEIRTTNPVATEQYGVVSTNLQRGENW

SEQ ID NO: 11276 - protein, 29 aa, Artificial Sequence
  Description of Artificial Sequence: Synthetic peptide
DEEEIRTTNPVATEQYGDVSENLQRHGNR

SEQ ID NO: 11277 - protein, 28 aa, Artificial Sequence
  Description of Artificial Sequence: Synthetic peptide
DEEEIAQTNPVATEQYGSVSTNLMRGNR

SEQ ID NO: 11278 - protein, 30 aa, Artificial Sequence
  Description of Artificial Sequence: Synthetic polypeptide
DEEEIRTTNPVATECYGSVSTNLQRDGNDR

SEQ ID NO: 11279 - protein, 28 aa, Artificial Sequence
  Description of Artificial Sequence: Synthetic peptide
DEEEIRATNPVATEQYGSVPTNLQRGNF

SEQ ID NO: 11280 - protein, 31 aa, Artificial Sequence
  Description of Artificial Sequence: Synthetic polypeptide
DEEEIRTTNPVATEQYGDSVSTNNLQRGNER

SEQ ID NO: 11281 - protein, 28 aa, Artificial Sequence
  Description of Artificial Sequence: Synthetic peptide
DEEEIRTTNPVATECYGSVSTNEMRGNR

SEQ ID NO: 11282 - protein, 29 aa, Artificial Sequence
  Description of Artificial Sequence: Synthetic peptide
DEEEIRTTNPVATEQYGSVSTEPLQRGNV

SEQ ID NO: 11283 - protein, 28 aa, Artificial Sequence
  Description of Artificial Sequence: Synthetic peptide
SEEEIRTTNPVATEQYGSVSTNLQVGNA

SEQ ID NO: 11284 - protein, 28 aa, Artificial Sequence
  Description of Artificial Sequence: Synthetic peptide
DEEEIRTTNPVATEQYGSVSTNDEPGNR

SEQ ID NO: 11285 - protein, 28 aa, Artificial Sequence
  Description of Artificial Sequence: Synthetic peptide
DEMEIRTTNIVATEQYGSVSTNLQAGNR

SEQ ID NO: 11286 - protein, 28 aa, Artificial Sequence
  Description of Artificial Sequence: Synthetic peptide
DEEEIATTNPVATEQYGDVSTNLQSGNR

SEQ ID NO: 11287 - protein, 29 aa, Artificial Sequence
  Description of Artificial Sequence: Synthetic peptide
DEEEIRTTNPVATEQYGSVSTDLQRKGER

SEQ ID NO: 11288 - protein, 28 aa, Artificial Sequence
  Description of Artificial Sequence: Synthetic peptide
DEEEIRTTNPVATEQYGSVSTNPQQGNV

SEQ ID NO: 11289 - protein, 28 aa, Artificial Sequence
  Description of Artificial Sequence: Synthetic peptide
MEEEIRTTNPVATEQYGSVSTNLQHGNI

SEQ ID NO: 11290 - protein, 28 aa, Artificial Sequence
  Description of Artificial Sequence: Synthetic peptide
DEQEIATTNPVATEQYGSVDTNLQRGNR

SEQ ID NO: 11291 - protein, 28 aa, Artificial Sequence
  Description of Artificial Sequence: Synthetic peptide
DEEEIRTTNPVATEQYGVVSTELQRGER

SEQ ID NO: 11292 - protein, 28 aa, Artificial Sequence
  Description of Artificial Sequence: Synthetic peptide
DEEEIRTTNPVATEQYGSGSYNLQRFNR

SEQ ID NO: 11293 - protein, 28 aa, Artificial Sequence
  Description of Artificial Sequence: Synthetic peptide
DEEEISTTNPVATEQYGDVGTNLQRGNR

SEQ ID NO: 11294 - protein, 28 aa, Artificial Sequence
  Description of Artificial Sequence: Synthetic peptide
DESEIRTTNPVSTEQYGSVGTNLQRGNR

SEQ ID NO: 11295 - protein, 29 aa, Artificial Sequence
  Description of Artificial Sequence: Synthetic peptide
DEEEIRTTNPVATEQYGSVSTNDQFNGNR

SEQ ID NO: 11296 - protein, 28 aa, Artificial Sequence
  Description of Artificial Sequence: Synthetic peptide
GEEEIRTTNPVATEQYGSVATNLQVGNR

SEQ ID NO: 11297 - protein, 30 aa, Artificial Sequence
  Description of Artificial Sequence: Synthetic polypeptide
DEQEIRTTNPVATEQYGSVSTTNNLQRGNR

SEQ ID NO: 11298 - protein, 28 aa, Artificial Sequence
  Description of Artificial Sequence: Synthetic peptide
DESEIRTTNPVATEQYGSVSTNLESGNR

SEQ ID NO: 11299 - protein, 28 aa, Artificial Sequence
  Description of Artificial Sequence: Synthetic peptide
DEEEIRTTNPVCTEQYGSVDTNLQRGNN

SEQ ID NO: 11300 - protein, 28 aa, Artificial Sequence
  Description of Artificial Sequence: Synthetic peptide
DEEEIRTTNPVATEQYGIVSTNLQQGNL

SEQ ID NO: 11301 - protein, 28 aa, Artificial Sequence
  Description of Artificial Sequence: Synthetic peptide
DEQEIRTTNPVATEQYGSVSTNEQRGNW

SEQ ID NO: 11302 - protein, 28 aa, Artificial Sequence
  Description of Artificial Sequence: Synthetic peptide
DEEEIRTTNPVATEQYGSVSDVLQRGNW

SEQ ID NO: 11303 - protein, 29 aa, Artificial Sequence
  Description of Artificial Sequence: Synthetic peptide
DEEEIRTTNPVATEQYGSVSTNPLQRGDA

SEQ ID NO: 11304 - protein, 28 aa, Artificial Sequence
  Description of Artificial Sequence: Synthetic peptide
DEEEIRSTNIVATEQYGEVSTNLQRGNR

SEQ ID NO: 11305 - protein, 29 aa, Artificial Sequence
  Description of Artificial Sequence: Synthetic peptide
DEEEIRTTNPVATEQYGSYSTNLQRGDNQ

SEQ ID NO: 11306 - protein, 28 aa, Artificial Sequence
  Description of Artificial Sequence: Synthetic peptide
DEEEIRTTNPVATEMYGSVSTNLQSGNN

SEQ ID NO: 11307 - protein, 28 aa, Artificial Sequence
  Description of Artificial Sequence: Synthetic peptide
DEEEIRTTNPVATEWWGSVSTNLQRGNF

SEQ ID NO: 11308 - protein, 28 aa, Artificial Sequence
  Description of Artificial Sequence: Synthetic peptide
DEEEIATTNPVCTEQYGSVSTNQQRGNR

SEQ ID NO: 11309 - protein, 28 aa, Artificial Sequence
  Description of Artificial Sequence: Synthetic peptide
DEEEIRTTNIVATEQYGSVSTILQRGNG

SEQ ID NO: 11310 - protein, 28 aa, Artificial Sequence
  Description of Artificial Sequence: Synthetic peptide
SEEEIRTTNPVATEMYGSVSTNLQRGTR

SEQ ID NO: 11311 - protein, 28 aa, Artificial Sequence
  Description of Artificial Sequence: Synthetic peptide
DEEEIRSTNPVAYEQYGSVSTNLQPGNR

SEQ ID NO: 11312 - protein, 28 aa, Artificial Sequence
  Description of Artificial Sequence: Synthetic peptide
DEEEIRTTNPVATEQYGSVSENLQRGEN

SEQ ID NO: 11313 - protein, 30 aa, Artificial Sequence
  Description of Artificial Sequence: Synthetic polypeptide
DEEEIRTVNPVATEQYGSVSTNLQRGVNDR

SEQ ID NO: 11314 - protein, 28 aa, Artificial Sequence
  Description of Artificial Sequence: Synthetic peptide
DEEEIRTTNPVATEQYGSVSTNEQLGNI

SEQ ID NO: 11315 - protein, 28 aa, Artificial Sequence
  Description of Artificial Sequence: Synthetic peptide
DENEIRCTNPVATEQYGSVSENLQRGNR

SEQ ID NO: 11316 - protein, 28 aa, Artificial Sequence
  Description of Artificial Sequence: Synthetic peptide
DEDEIRTTNPVATEIYGSVSTNLERGNR

SEQ ID NO: 11317 - protein, 28 aa, Artificial Sequence
  Description of Artificial Sequence: Synthetic peptide
DEEEIRTTNPVATECYGSVSTELQHGNR

SEQ ID NO: 11318 - protein, 28 aa, Artificial Sequence
  Description of Artificial Sequence: Synthetic peptide
DEEEIRTTNPVATEQYGSVSDNLQHENR

SEQ ID NO: 11319 - protein, 28 aa, Artificial Sequence
  Description of Artificial Sequence: Synthetic peptide
DEEEIRTTNPVATTNYGSVSTNLQRGNS

SEQ ID NO: 11320 - protein, 28 aa, Artificial Sequence
  Description of Artificial Sequence: Synthetic peptide
DEEEIRTTNPVATEQYGSVSENLQHGNQ

SEQ ID NO: 11321 - protein, 28 aa, Artificial Sequence
  Description of Artificial Sequence: Synthetic peptide
DEEEIRTTNPVATEIYGAVSTNLERGNR

SEQ ID NO: 11322 - protein, 28 aa, Artificial Sequence
  Description of Artificial Sequence: Synthetic peptide
DEEEIRTTNIVATEQYGNVSTNLQIGNR

SEQ ID NO: 11323 - protein, 28 aa, Artificial Sequence
  Description of Artificial Sequence: Synthetic peptide
DEEEIRTVNPVATEQYGSVSENIQRGNR

SEQ ID NO: 11324 - protein, 28 aa, Artificial Sequence
  Description of Artificial Sequence: Synthetic peptide
DENEIRTTNPVATEQYGSVSTNLQHGER

SEQ ID NO: 11325 - protein, 28 aa, Artificial Sequence
  Description of Artificial Sequence: Synthetic peptide
DEEEVRTVNPVATEQYGWVSTNLQRGNR

SEQ ID NO: 11326 - protein, 29 aa, Artificial Sequence
  Description of Artificial Sequence: Synthetic peptide
SEEEIRTTNPVATEQYGSVSTNLQRGNNW

SEQ ID NO: 11327 - protein, 28 aa, Artificial Sequence
  Description of Artificial Sequence: Synthetic peptide
DEEEIKTTNPVATEQYGSVSENLQRGNH

SEQ ID NO: 11328 - protein, 28 aa, Artificial Sequence
  Description of Artificial Sequence: Synthetic peptide
SEEEIRCTNPVATEQYGSVSTNLQRGDR

SEQ ID NO: 11329 - protein, 28 aa, Artificial Sequence
  Description of Artificial Sequence: Synthetic peptide
DEEEIRTTNPVATEQYGSVSTNLQGGDN

SEQ ID NO: 11330 - protein, 28 aa, Artificial Sequence
  Description of Artificial Sequence: Synthetic peptide
DEEEIRQTNPVATEQYGSVSTNLQYGER

SEQ ID NO: 11331 - protein, 31 aa, Artificial Sequence
  Description of Artificial Sequence: Synthetic polypeptide
DEEEIRTTNPVATWEQYGSVSTPNLQRGENR

SEQ ID NO: 11332 - protein, 28 aa, Artificial Sequence
  Description of Artificial Sequence: Synthetic peptide
DEEEIRTTNPVATEQYGSVSTDLQIGNM

SEQ ID NO: 11333 - protein, 28 aa, Artificial Sequence
  Description of Artificial Sequence: Synthetic peptide
DEEEIRTTNIVATEQYGSVSTNLLRGNS

SEQ ID NO: 11334 - protein, 28 aa, Artificial Sequence
  Description of Artificial Sequence: Synthetic peptide
SEVEIRTTNPVATEQYGSVSTNEQRGNR

SEQ ID NO: 11335 - protein, 29 aa, Artificial Sequence
  Description of Artificial Sequence: Synthetic peptide
DEQEIRTTNPVATEQYGSVSTNLQRGDNF

SEQ ID NO: 11336 - protein, 29 aa, Artificial Sequence
  Description of Artificial Sequence: Synthetic peptide
DEQEIRTTNPVATEQYGSVSTNLQEHGNR

SEQ ID NO: 11337 - protein, 28 aa, Artificial Sequence
  Description of Artificial Sequence: Synthetic peptide
DEEEIRTTNPVATELYGSVSTNLQAGNI

SEQ ID NO: 11338 - protein, 28 aa, Artificial Sequence
  Description of Artificial Sequence: Synthetic peptide
DEEEIRTTNPVATEQYGSVSENLESGNR

SEQ ID NO: 11339 - protein, 28 aa, Artificial Sequence
  Description of Artificial Sequence: Synthetic peptide
DEEEIRTTNPVATEQYGIVSTNLTRGNV

SEQ ID NO: 11340 - protein, 28 aa, Artificial Sequence
  Description of Artificial Sequence: Synthetic peptide
DEQEIRATNPVATELYGSVSTNLQRGNR

SEQ ID NO: 11341 - protein, 28 aa, Artificial Sequence
  Description of Artificial Sequence: Synthetic peptide
VEEEIRTTNPVATEQYGSVSDNLQQGNR

SEQ ID NO: 11342 - protein, 28 aa, Artificial Sequence
  Description of Artificial Sequence: Synthetic peptide
DEEEIRTTNIVATEQYGSTSENLQRGNR

SEQ ID NO: 11343 - protein, 28 aa, Artificial Sequence
  Description of Artificial Sequence: Synthetic peptide
DEQEVRTTNPVATEQYGSVSMNLQRGNR

SEQ ID NO: 11344 - protein, 28 aa, Artificial Sequence
  Description of Artificial Sequence: Synthetic peptide
DENEIRTTNPVATEQYGSVSTNLMIGNR

SEQ ID NO: 11345 - protein, 28 aa, Artificial Sequence
  Description of Artificial Sequence: Synthetic peptide
DEEEIRTTNPVATEQYGSVSTNLQHMNQ

SEQ ID NO: 11346 - protein, 28 aa, Artificial Sequence
  Description of Artificial Sequence: Synthetic peptide
DEEEIRTVNPVATEQYGSVCDNLQRGNR

SEQ ID NO: 11347 - protein, 29 aa, Artificial Sequence
  Description of Artificial Sequence: Synthetic peptide
DENEIRTTNPVATEQYGDVSTNLQRGNDR

SEQ ID NO: 11348 - protein, 31 aa, Artificial Sequence
  Description of Artificial Sequence: Synthetic polypeptide
DEEEIRTTNPVATEQYGVSVSCTNLQRGINR

SEQ ID NO: 11349 - protein, 28 aa, Artificial Sequence
  Description of Artificial Sequence: Synthetic peptide
DEQEIRTTNPVATEQWGSVSTNLQRGNA

SEQ ID NO: 11350 - protein, 28 aa, Artificial Sequence
  Description of Artificial Sequence: Synthetic peptide
DEEEINTTNPVATEQYGEVSTNLQRPNR

SEQ ID NO: 11351 - protein, 29 aa, Artificial Sequence
  Description of Artificial Sequence: Synthetic peptide
DEEEIRTTNPVATECYGDSVSTNLQRGDR

SEQ ID NO: 11352 - protein, 29 aa, Artificial Sequence
  Description of Artificial Sequence: Synthetic peptide
DEEEIRTTNPVATEQYGAVSENLQREGNR

SEQ ID NO: 11353 - protein, 28 aa, Artificial Sequence
  Description of Artificial Sequence: Synthetic peptide
HEEEIATTNPVASEQYGSVSTNLQRGNR

SEQ ID NO: 11354 - protein, 28 aa, Artificial Sequence
  Description of Artificial Sequence: Synthetic peptide
DEEEIMTTNPVATEQYGECSTNLQRGNR

SEQ ID NO: 11355 - protein, 28 aa, Artificial Sequence
  Description of Artificial Sequence: Synthetic peptide
DEEEIRQTNPVATEQYGSVSTPLQHGNR

SEQ ID NO: 11356 - protein, 30 aa, Artificial Sequence
  Description of Artificial Sequence: Synthetic polypeptide
DENEIRTTNPVATEQYGSVSTNLQDRGNDR

SEQ ID NO: 11357 - protein, 28 aa, Artificial Sequence
  Description of Artificial Sequence: Synthetic peptide
DECEIRTTNPVATEQYGSVSTNLWRGND

SEQ ID NO: 11358 - protein, 29 aa, Artificial Sequence
  Description of Artificial Sequence: Synthetic peptide
DEEEIRTTNPVATEQYGSVSEVLQRGINR

SEQ ID NO: 11359 - protein, 28 aa, Artificial Sequence
  Description of Artificial Sequence: Synthetic peptide
DEEEIRTTNIVATEFYGSVSTNDQRGNR

SEQ ID NO: 11360 - protein, 29 aa, Artificial Sequence
  Description of Artificial Sequence: Synthetic peptide
DEEEVRTTNPVATEPYGSVSATNLQRGNR

SEQ ID NO: 11361 - protein, 28 aa, Artificial Sequence
  Description of Artificial Sequence: Synthetic peptide
DEEELRTTNPVATEQYGSVSTNLQSGNF

SEQ ID NO: 11362 - protein, 28 aa, Artificial Sequence
  Description of Artificial Sequence: Synthetic peptide
DEEEIRQTNPVATEQYGSVSTNDQNGNR

SEQ ID NO: 11363 - protein, 29 aa, Artificial Sequence
  Description of Artificial Sequence: Synthetic peptide
DEEEIRTTNPVATEVYGSVSTNIQVRGNR

SEQ ID NO: 11364 - protein, 28 aa, Artificial Sequence
  Description of Artificial Sequence: Synthetic peptide
DEEEIRTTNIVSTEQYGSVSTNLDRGNR

SEQ ID NO: 11365 - protein, 28 aa, Artificial Sequence
  Description of Artificial Sequence: Synthetic peptide
DEEEIRTTNIVATEQYGEVSTNLQRGNW

SEQ ID NO: 11366 - protein, 28 aa, Artificial Sequence
  Description of Artificial Sequence: Synthetic peptide
DEEEIRTTNPVATEQYGSVSENLMVGNR

SEQ ID NO: 11367 - protein, 29 aa, Artificial Sequence
  Description of Artificial Sequence: Synthetic peptide
DENEIRTTNPVATEQYGSVSTNLQRGNDM

SEQ ID NO: 11368 - protein, 28 aa, Artificial Sequence
  Description of Artificial Sequence: Synthetic peptide
DEEEIRTTNIEATEQYGSVSENLQRGNR

SEQ ID NO: 11369 - protein, 28 aa, Artificial Sequence
  Description of Artificial Sequence: Synthetic peptide
DEQEIRTTNPVATEQYGSVSTNLQTGNH

SEQ ID NO: 11370 - protein, 29 aa, Artificial Sequence
  Description of Artificial Sequence: Synthetic peptide
QEEEIRTTNPVATEQYGSVGTNLQRAGNR

SEQ ID NO: 11371 - protein, 28 aa, Artificial Sequence
  Description of Artificial Sequence: Synthetic peptide
DEEEIRTTNIVATEQYGSVSTNLIQGNR

SEQ ID NO: 11372 - protein, 28 aa, Artificial Sequence
  Description of Artificial Sequence: Synthetic peptide
DENEIRTTNPVATEQYGSVSTNLQSGNV

SEQ ID NO: 11373 - protein, 28 aa, Artificial Sequence
  Description of Artificial Sequence: Synthetic peptide
DETEISTTNPVATEQYGSCSTNLQRGNR

SEQ ID NO: 11374 - protein, 29 aa, Artificial Sequence
  Description of Artificial Sequence: Synthetic peptide
DEEEIRTTNPVATEQWGSVSTNLQDRGNG

SEQ ID NO: 11375 - protein, 28 aa, Artificial Sequence
  Description of Artificial Sequence: Synthetic peptide
DEEEIRTTNIVATEMYGSVSTNLQMGNR

SEQ ID NO: 11376 - protein, 28 aa, Artificial Sequence
  Description of Artificial Sequence: Synthetic peptide
QEEEIRQTNPVATEQYGSASTNLQRGNR

SEQ ID NO: 11377 - protein, 28 aa, Artificial Sequence
  Description of Artificial Sequence: Synthetic peptide
DEEEIRTTNPVSCEQYGSVSTDLQRGNR

SEQ ID NO: 11378 - protein, 28 aa, Artificial Sequence
  Description of Artificial Sequence: Synthetic peptide
DENEIRTTNPVATEQYGSVSTNLQHGNQ

SEQ ID NO: 11379 - protein, 28 aa, Artificial Sequence
  Description of Artificial Sequence: Synthetic peptide
DEEEIRTTNPVATEQYGSVSENLQMGNS

SEQ ID NO: 11380 - protein, 28 aa, Artificial Sequence
  Description of Artificial Sequence: Synthetic peptide
DEEEIRTTNPVATEQYGDASTELQRGNR

SEQ ID NO: 11381 - protein, 28 aa, Artificial Sequence
  Description of Artificial Sequence: Synthetic peptide
DEEEIRTTNIVATEQYGSVSENLQRGNK

SEQ ID NO: 11382 - protein, 29 aa, Artificial Sequence
  Description of Artificial Sequence: Synthetic peptide
DEQEIRTTNPVATEQYGSVSENLQRGNDR

SEQ ID NO: 11383 - protein, 28 aa, Artificial Sequence
  Description of Artificial Sequence: Synthetic peptide
DEEEIRTTNPVATECYGSVSTNLQYGNS

SEQ ID NO: 11384 - protein, 28 aa, Artificial Sequence
  Description of Artificial Sequence: Synthetic peptide
DEDEIRCTNPVATEQYGSASTNLQRGNR

SEQ ID NO: 11385 - protein, 28 aa, Artificial Sequence
  Description of Artificial Sequence: Synthetic peptide
DEEEIRTTNPVATEQYGSVATNLQIGNF

SEQ ID NO: 11386 - protein, 28 aa, Artificial Sequence
  Description of Artificial Sequence: Synthetic peptide
DEEEIRTTNPVATEQYGDVSENLQRGNM

SEQ ID NO: 11387 - protein, 28 aa, Artificial Sequence
  Description of Artificial Sequence: Synthetic peptide
DEEEIRTTNPVATEIYGSVSTALQRGDR

SEQ ID NO: 11388 - protein, 28 aa, Artificial Sequence
  Description of Artificial Sequence: Synthetic peptide
CEEEIRTTNPVASEQYGSVSENLQRGNR

SEQ ID NO: 11389 - protein, 31 aa, Artificial Sequence
  Description of Artificial Sequence: Synthetic polypeptide
DEEEIRTTNPVATEQYGSVSITTNLQRGDNR

SEQ ID NO: 11390 - protein, 28 aa, Artificial Sequence
  Description of Artificial Sequence: Synthetic peptide
DEEEIRTTNPVATEQYGSVGTNIQRGGR

SEQ ID NO: 11391 - protein, 28 aa, Artificial Sequence
  Description of Artificial Sequence: Synthetic peptide
DEEEIVTTNPVATEQYGSVSTDLQHGNR

SEQ ID NO: 11392 - protein, 30 aa, Artificial Sequence
  Description of Artificial Sequence: Synthetic polypeptide
DEEEISTTNPVATEQYGSVSTNLQGRGNDR

SEQ ID NO: 11393 - protein, 28 aa, Artificial Sequence
  Description of Artificial Sequence: Synthetic peptide
DEEEIRTVNPVATETYGSVSTNLQQGNR

SEQ ID NO: 11394 - protein, 28 aa, Artificial Sequence
  Description of Artificial Sequence: Synthetic peptide
DEEEIRTTNPVATEQYGSVSTELQIGER

SEQ ID NO: 11395 - protein, 28 aa, Artificial Sequence
  Description of Artificial Sequence: Synthetic peptide
DEEEIRTTNPVSTELYGSVSTNLQTGNR

SEQ ID NO: 11396 - protein, 28 aa, Artificial Sequence
  Description of Artificial Sequence: Synthetic peptide
DEEEIGTTNPVATEQYGSVPENLQRGNR

SEQ ID NO: 11397 - protein, 28 aa, Artificial Sequence
  Description of Artificial Sequence: Synthetic peptide
DEEEIRTTNPVATEQYGVVSTALQRGNE

SEQ ID NO: 11398 - protein, 28 aa, Artificial Sequence
  Description of Artificial Sequence: Synthetic peptide
DEEEIRTTNIVATEQYGSVHTDLQRGNR

SEQ ID NO: 11399 - protein, 28 aa, Artificial Sequence
  Description of Artificial Sequence: Synthetic peptide
NEEEIRCTNPVATEQYGSVSTNLQRGND

SEQ ID NO: 11400 - protein, 28 aa, Artificial Sequence
  Description of Artificial Sequence: Synthetic peptide
DEEEIRTTNPVATEQYGSVSTNLEEGNG

SEQ ID NO: 11401 - protein, 28 aa, Artificial Sequence
  Description of Artificial Sequence: Synthetic peptide
DEEEIRTTNPVAVEQYGSVSENLDRGNR

SEQ ID NO: 11402 - protein, 28 aa, Artificial Sequence
  Description of Artificial Sequence: Synthetic peptide
DESEICTTNPVATEQYGSVSTELQRGNR

SEQ ID NO: 11403 - protein, 30 aa, Artificial Sequence
  Description of Artificial Sequence: Synthetic polypeptide
DEEEICTTNPVATEQYGSVSTNLQRNGNER

SEQ ID NO: 11404 - protein, 28 aa, Artificial Sequence
  Description of Artificial Sequence: Synthetic peptide
DEEEIRSTNPVATEQYGAVSTNLQRGND

SEQ ID NO: 11405 - protein, 28 aa, Artificial Sequence
  Description of Artificial Sequence: Synthetic peptide
DEEEIRATNPVATECYGSVSTNLQYGNR

SEQ ID NO: 11406 - protein, 28 aa, Artificial Sequence
  Description of Artificial Sequence: Synthetic peptide
DEEEIRTTNPVATELWGSVSTNLQRGNS

SEQ ID NO: 11407 - protein, 29 aa, Artificial Sequence
  Description of Artificial Sequence: Synthetic peptide
DEEEIRTTNPVATEQYGSVSTNLQERGTA

SEQ ID NO: 11408 - protein, 28 aa, Artificial Sequence
  Description of Artificial Sequence: Synthetic peptide
DEEEIRTVNPVATEQYGSVSTDLQMGNR

SEQ ID NO: 11409 - protein, 28 aa, Artificial Sequence
  Description of Artificial Sequence: Synthetic peptide
DEEEIRCTNPVATECYGSVSTNLQVGNR

SEQ ID NO: 11410 - protein, 29 aa, Artificial Sequence
  Description of Artificial Sequence: Synthetic peptide
DEEEICTTNPVATEQYGSVSTNLQQNGNR

SEQ ID NO: 11411 - protein, 29 aa, Artificial Sequence
  Description of Artificial Sequence: Synthetic peptide
DENEIRTTNPVATEQYGSVSDFNLQRGNR

SEQ ID NO: 11412 - protein, 28 aa, Artificial Sequence
  Description of Artificial Sequence: Synthetic peptide
DEEEIRTVNPVSTEQYGSVSTNLQRGNI

SEQ ID NO: 11413 - protein, 28 aa, Artificial Sequence
  Description of Artificial Sequence: Synthetic peptide
DEEECRTTNIVATEEYGSVSTNLQRGNR

SEQ ID NO: 11414 - protein, 28 aa, Artificial Sequence
  Description of Artificial Sequence: Synthetic peptide
DEEEIRTTNPVATEQYGSVSTNLMGGNL

SEQ ID NO: 11415 - protein, 28 aa, Artificial Sequence
  Description of Artificial Sequence: Synthetic peptide
DEGEIRTTNPVATEQYGSVSDNLQTGNR

SEQ ID NO: 11416 - protein, 29 aa, Artificial Sequence
  Description of Artificial Sequence: Synthetic peptide
DEEEIRTTNPVSTEQYGSVSTNLQNKGNR

SEQ ID NO: 11417 - protein, 28 aa, Artificial Sequence
  Description of Artificial Sequence: Synthetic peptide
DEEEIRQTNPVATEQYGSVSTDLQRGND

SEQ ID NO: 11418 - protein, 28 aa, Artificial Sequence
  Description of Artificial Sequence: Synthetic peptide
QEEEIRTTNPVATEQYGSVSTNLQYGNN

SEQ ID NO: 11419 - protein, 28 aa, Artificial Sequence
  Description of Artificial Sequence: Synthetic peptide
DEEEIRTTNPCATEQYGSVSTPLQRGDR

SEQ ID NO: 11420 - protein, 28 aa, Artificial Sequence
  Description of Artificial Sequence: Synthetic peptide
DENEIATTNPVATEQYGSVSTNLQTGNR

SEQ ID NO: 11421 - protein, 28 aa, Artificial Sequence
  Description of Artificial Sequence: Synthetic peptide
DEEEIRTTNIVATEQIGSVSTNLQHGNR

SEQ ID NO: 11422 - protein, 28 aa, Artificial Sequence
  Description of Artificial Sequence: Synthetic peptide
DCEEIRTTNPVATEQYGSVSTNLTRGNM

SEQ ID NO: 11423 - protein, 28 aa, Artificial Sequence
  Description of Artificial Sequence: Synthetic peptide
DEEEITTTNPVATEQYGSVSTNWQRGNQ

SEQ ID NO: 11424 - protein, 28 aa, Artificial Sequence
  Description of Artificial Sequence: Synthetic peptide
DEEEIRTTNPVATECYGSVSTELQRGND

SEQ ID NO: 11425 - protein, 29 aa, Artificial Sequence
  Description of Artificial Sequence: Synthetic peptide
DEEEIRATNPVATEQYGSVSTNLQREGNQ

SEQ ID NO: 11426 - protein, 28 aa, Artificial Sequence
  Description of Artificial Sequence: Synthetic peptide
DEEEIRGTNPVATEQYGFVSTNLQQGNR

SEQ ID NO: 11427 - protein, 28 aa, Artificial Sequence
  Description of Artificial Sequence: Synthetic peptide
DEEEIRTTNPVATEQFGVVSTNLQRGNF

SEQ ID NO: 11428 - protein, 28 aa, Artificial Sequence
  Description of Artificial Sequence: Synthetic peptide
DEEEIRTTNPVATEQYGSVSTDLQGGNS

SEQ ID NO: 11429 - protein, 28 aa, Artificial Sequence
  Description of Artificial Sequence: Synthetic peptide
DEEEIRTTNIYATEQYGSVSTNLQTGNR

SEQ ID NO: 11430 - protein, 28 aa, Artificial Sequence
  Description of Artificial Sequence: Synthetic peptide
HEEEIRTTNPVATEQYGSVSANLQRGNF

SEQ ID NO: 11431 - protein, 29 aa, Artificial Sequence
  Description of Artificial Sequence: Synthetic peptide
DEEEIVTTNPVATEQYGSVSTNLQGKGNR

SEQ ID NO: 11432 - protein, 28 aa, Artificial Sequence
  Description of Artificial Sequence: Synthetic peptide
DEEEIRTTNPVATEQYGSVSTNVQRGDF

SEQ ID NO: 11433 - protein, 29 aa, Artificial Sequence
  Description of Artificial Sequence: Synthetic peptide
DEEEIAATNPVATEQYGSVSTNLQRGNDR

SEQ ID NO: 11434 - protein, 28 aa, Artificial Sequence
  Description of Artificial Sequence: Synthetic peptide
DEEEIRTTNPVATEQYGSVSENEQLGNR

SEQ ID NO: 11435 - protein, 28 aa, Artificial Sequence
  Description of Artificial Sequence: Synthetic peptide
DEEEIRTTNPVATEQYGSVSENLQQGNI

SEQ ID NO: 11436 - protein, 28 aa, Artificial Sequence
  Description of Artificial Sequence: Synthetic peptide
DEEEIRQTNPVATEQYGSVSTNLQVGER

SEQ ID NO: 11437 - protein, 28 aa, Artificial Sequence
  Description of Artificial Sequence: Synthetic peptide
DEEEITTTNIVATEQYGNVSTNLQRGNR

SEQ ID NO: 11438 - protein, 28 aa, Artificial Sequence
  Description of Artificial Sequence: Synthetic peptide
DEEEIRTTNPVATEQWGSVSTNLERGNW

SEQ ID NO: 11439 - protein, 29 aa, Artificial Sequence
  Description of Artificial Sequence: Synthetic peptide
DENEIRTTNPVATEQWGSVSTNLQIRGNR

SEQ ID NO: 11440 - protein, 30 aa, Artificial Sequence
  Description of Artificial Sequence: Synthetic polypeptide
DEEEIRTTNPVATEQYGSVSANLPQREGNR

SEQ ID NO: 11441 - protein, 28 aa, Artificial Sequence
  Description of Artificial Sequence: Synthetic peptide
DEQEIRTTNPVATEQYGSVSTNLQAGER

SEQ ID NO: 11442 - protein, 28 aa, Artificial Sequence
  Description of Artificial Sequence: Synthetic peptide
DEEEIRTTNIVATEQYGGVSTDLQRGNR

SEQ ID NO: 11443 - protein, 30 aa, Artificial Sequence
  Description of Artificial Sequence: Synthetic polypeptide
MEEEIRTTNPVATEQYGSVSTNLQEREGNR

SEQ ID NO: 11444 - protein, 28 aa, Artificial Sequence
  Description of Artificial Sequence: Synthetic peptide
AEEEIRTTNPVATEQYGSVSENLQRGND

SEQ ID NO: 11445 - protein, 28 aa, Artificial Sequence
  Description of Artificial Sequence: Synthetic peptide
DEEEIATTNPVATECYGSVSTNLQRGNA

SEQ ID NO: 11446 - protein, 28 aa, Artificial Sequence
  Description of Artificial Sequence: Synthetic peptide
DEEEIRTTNPVATEQYGSVSTNEQLGER

SEQ ID NO: 11447 - protein, 31 aa, Artificial Sequence
  Description of Artificial Sequence: Synthetic polypeptide
DEEEIRTTNPVATEQYGSSLVSTNLQRYGNR

SEQ ID NO: 11448 - protein, 28 aa, Artificial Sequence
  Description of Artificial Sequence: Synthetic peptide
AENEIRCTNPVATEQYGSVSTNLQRGNR

SEQ ID NO: 11449 - protein, 29 aa, Artificial Sequence
  Description of Artificial Sequence: Synthetic peptide
QENEIRTTNPVATEQYGSVSTNLQIRGNR

SEQ ID NO: 11450 - protein, 29 aa, Artificial Sequence
  Description of Artificial Sequence: Synthetic peptide
DEEEIRTTNPVATEQYGSVSTEELQRENR

SEQ ID NO: 11451 - protein, 28 aa, Artificial Sequence
  Description of Artificial Sequence: Synthetic peptide
DEEEIRTTNPVATEVYGSVSTDLQRGNW

SEQ ID NO: 11452 - protein, 30 aa, Artificial Sequence
  Description of Artificial Sequence: Synthetic polypeptide
DEEEIRTTNPTATEQYGSVSTNLQREGNTR

SEQ ID NO: 11453 - protein, 28 aa, Artificial Sequence
  Description of Artificial Sequence: Synthetic peptide
DEEEIRTTNPVATELWGSVSTNLQRGNM

SEQ ID NO: 11454 - protein, 28 aa, Artificial Sequence
  Description of Artificial Sequence: Synthetic peptide
DEENIATTNIVATEQYGSVSTNLQRGNR

SEQ ID NO: 11455 - protein, 28 aa, Artificial Sequence
  Description of Artificial Sequence: Synthetic peptide
DEEEIGTTNPVATEQYGSVCDNLQRGNR

SEQ ID NO: 11456 - protein, 28 aa, Artificial Sequence
  Description of Artificial Sequence: Synthetic peptide
DEEEIRTTNPVATEQYGSVSENEMRGNR

SEQ ID NO: 11457 - protein, 28 aa, Artificial Sequence
  Description of Artificial Sequence: Synthetic peptide
KEEEIATTNPVATEQYGVVSTNLQRGNR

SEQ ID NO: 11458 - protein, 28 aa, Artificial Sequence
  Description of Artificial Sequence: Synthetic peptide
DEEEIRTTNPVATEQFGSVSTNPQRGLR

SEQ ID NO: 11459 - protein, 28 aa, Artificial Sequence
  Description of Artificial Sequence: Synthetic peptide
DEEEIRTTNPVATEQYGSVSTNPQQGNS

SEQ ID NO: 11460 - protein, 28 aa, Artificial Sequence
  Description of Artificial Sequence: Synthetic peptide
DEEEIRTTNPVATEQYGSVSTNPQRGPA

SEQ ID NO: 11461 - protein, 28 aa, Artificial Sequence
  Description of Artificial Sequence: Synthetic peptide
DEEEICCTNPVATEQYGSVSTNLQQGNR

SEQ ID NO: 11462 - protein, 28 aa, Artificial Sequence
  Description of Artificial Sequence: Synthetic peptide
DEEEIRTTNCVATEQYGSVSTNQGRGNR

SEQ ID NO: 11463 - protein, 28 aa, Artificial Sequence
  Description of Artificial Sequence: Synthetic peptide
DEEEIRTTNPVATEQYGSVPTDLQRGNM

SEQ ID NO: 11464 - protein, 28 aa, Artificial Sequence
  Description of Artificial Sequence: Synthetic peptide
DEEEIRTTNPVSTEQYGSVSTDLQQGNR

SEQ ID NO: 11465 - protein, 29 aa, Artificial Sequence
  Description of Artificial Sequence: Synthetic peptide
QEEEIRTTNPVATEQYGCVSTENLQRGNR

SEQ ID NO: 11466 - protein, 28 aa, Artificial Sequence
  Description of Artificial Sequence: Synthetic peptide
DEEEIRTTNPVATEQYGSVSTELQYGNL

SEQ ID NO: 11467 - protein, 28 aa, Artificial Sequence
  Description of Artificial Sequence: Synthetic peptide
DEEEIRTTNPVATEQYGSVSTDDQNGNR

SEQ ID NO: 11468 - protein, 29 aa, Artificial Sequence
  Description of Artificial Sequence: Synthetic peptide
DENEIRTTNPVATEQYGSVSTNLQERGNN

SEQ ID NO: 11469 - protein, 28 aa, Artificial Sequence
  Description of Artificial Sequence: Synthetic peptide
DEDEIRTTNPVATEQYGSVSNNLQRGNF

SEQ ID NO: 11470 - protein, 28 aa, Artificial Sequence
  Description of Artificial Sequence: Synthetic peptide
DEEEIRTTNPVSTEQYGSVSDVLQRGNR

SEQ ID NO: 11471 - protein, 30 aa, Artificial Sequence
  Description of Artificial Sequence: Synthetic polypeptide
DEEEIRTTNPVATEQYGSVNDITNLQRGNR

SEQ ID NO: 11472 - protein, 28 aa, Artificial Sequence
  Description of Artificial Sequence: Synthetic peptide
DEEEIRTTNPVATEQYGSVSTNLQMGEH

SEQ ID NO: 11473 - protein, 28 aa, Artificial Sequence
  Description of Artificial Sequence: Synthetic peptide
DEEEIRTTNPVATEVYGSASTNLQHGNR

SEQ ID NO: 11474 - protein, 28 aa, Artificial Sequence
  Description of Artificial Sequence: Synthetic peptide
DEEEIRTTNPVATEQYGSVSTNEQLGNL

SEQ ID NO: 11475 - protein, 28 aa, Artificial Sequence
  Description of Artificial Sequence: Synthetic peptide
DESEIRTTNPVATEQYGNVSTNLQRGQR

SEQ ID NO: 11476 - protein, 28 aa, Artificial Sequence
  Description of Artificial Sequence: Synthetic peptide
DEEEIRTTNPVATEQYGSVSTDLQVGNN

SEQ ID NO: 11477 - protein, 28 aa, Artificial Sequence
  Description of Artificial Sequence: Synthetic peptide
DEEEIRTTNIVATEQYGSVSDNLQRMNR

SEQ ID NO: 11478 - protein, 28 aa, Artificial Sequence
  Description of Artificial Sequence: Synthetic peptide
DEEEIRTTNPVATEQYGSVSTNLETGNI

SEQ ID NO: 11479 - protein, 28 aa, Artificial Sequence
  Description of Artificial Sequence: Synthetic peptide
DEEEIRCTNPVATEQYGCVSTNLERGNR

SEQ ID NO: 11480 - protein, 28 aa, Artificial Sequence
  Description of Artificial Sequence: Synthetic peptide
DEEEIRTTNPVATECYGSVSTNLQRGDS

SEQ ID NO: 11481 - protein, 29 aa, Artificial Sequence
  Description of Artificial Sequence: Synthetic peptide
SEEEIRTTNPVATEQYGSVSTMNPQRGNR

SEQ ID NO: 11482 - protein, 28 aa, Artificial Sequence
  Description of Artificial Sequence: Synthetic peptide
REEEIRTTNPVATEQYGSVSTNLERGNV

SEQ ID NO: 11483 - protein, 28 aa, Artificial Sequence
  Description of Artificial Sequence: Synthetic peptide
DEEEIRTVNPVATEQYGSVETNLQRGNQ

SEQ ID NO: 11484 - protein, 28 aa, Artificial Sequence
  Description of Artificial Sequence: Synthetic peptide
DDEEIRTTNIVATEQYGSVSTNLQIGNR

SEQ ID NO: 11485 - protein, 29 aa, Artificial Sequence
  Description of Artificial Sequence: Synthetic peptide
DEEEIRTTNPVATEQWGSVSTNLMMRGNR

SEQ ID NO: 11486 - protein, 28 aa, Artificial Sequence
  Description of Artificial Sequence: Synthetic peptide
DEEEIYTTNPVATEQYGSVSTNLQRGDS

SEQ ID NO: 11487 - protein, 29 aa, Artificial Sequence
  Description of Artificial Sequence: Synthetic peptide
DEEEIRTTNPVATEQYGTVSTNLQRAGMR

SEQ ID NO: 11488 - protein, 29 aa, Artificial Sequence
  Description of Artificial Sequence: Synthetic peptide
DEEEIRTTNPVATEQYGSVSTMDLQAGNR

SEQ ID NO: 11489 - protein, 28 aa, Artificial Sequence
  Description of Artificial Sequence: Synthetic peptide
DEEEIRTTNPVATEQYGSVSTDPQRGNQ

SEQ ID NO: 11490 - protein, 28 aa, Artificial Sequence
  Description of Artificial Sequence: Synthetic peptide
DEEEIRTTNPTATEQYGSVSENLQNGNR

SEQ ID NO: 11491 - protein, 30 aa, Artificial Sequence
  Description of Artificial Sequence: Synthetic polypeptide
DEEEIRTTNPVATEQYGSVSTNLQEHKGNR

SEQ ID NO: 11492 - protein, 30 aa, Artificial Sequence
  Description of Artificial Sequence: Synthetic polypeptide
DEEEIRTTNPVATEQYGCVSTNLQREGNTR

SEQ ID NO: 11493 - protein, 28 aa, Artificial Sequence
  Description of Artificial Sequence: Synthetic peptide
DENEIRTTNPVATEQYGSVSTNLIRGND

SEQ ID NO: 11494 - protein, 28 aa, Artificial Sequence
  Description of Artificial Sequence: Synthetic peptide
QEQEIRTTNPVATEQYGSVSTNLQYGNR

SEQ ID NO: 11495 - protein, 28 aa, Artificial Sequence
  Description of Artificial Sequence: Synthetic peptide
DEEEIRTTNPVATEQYGSVSTDLQVGDR

SEQ ID NO: 11496 - protein, 28 aa, Artificial Sequence
  Description of Artificial Sequence: Synthetic peptide
DEEEITTTNPVATEQYGEVSTNLQRGNF

SEQ ID NO: 11497 - protein, 29 aa, Artificial Sequence
  Description of Artificial Sequence: Synthetic peptide
DEDEIRTTNPVATEQFGSVSTNLQRGPNR

SEQ ID NO: 11498 - protein, 28 aa, Artificial Sequence
  Description of Artificial Sequence: Synthetic peptide
DDEEIATTNPVATEQYGSVSTNLQGGNR

SEQ ID NO: 11499 - protein, 28 aa, Artificial Sequence
  Description of Artificial Sequence: Synthetic peptide
DEEEIRTTNPVATEQYGSVSTNDQTGNE

SEQ ID NO: 11500 - protein, 28 aa, Artificial Sequence
  Description of Artificial Sequence: Synthetic peptide
DEFEIRTTNPVATEQYGSVSDNLQRGNA

SEQ ID NO: 11501 - protein, 28 aa, Artificial Sequence
  Description of Artificial Sequence: Synthetic peptide
DEQEIRTTNPVATEQYGSVSENLQRGNA

SEQ ID NO: 11502 - protein, 28 aa, Artificial Sequence
  Description of Artificial Sequence: Synthetic peptide
DEEEIRTTNPVATEQYGSVSADLQRGTR

SEQ ID NO: 11503 - protein, 28 aa, Artificial Sequence
  Description of Artificial Sequence: Synthetic peptide
DEEEIRTTNPVATEIYGEVSTNLQRGMR

SEQ ID NO: 11504 - protein, 28 aa, Artificial Sequence
  Description of Artificial Sequence: Synthetic peptide
DEEEIRMTNPVATEQYGSVPDNLQRGNR

SEQ ID NO: 11505 - protein, 28 aa, Artificial Sequence
  Description of Artificial Sequence: Synthetic peptide
DEEEIRTTNPVATEQYGDVSTQLQRNNR

SEQ ID NO: 11506 - protein, 29 aa, Artificial Sequence
  Description of Artificial Sequence: Synthetic peptide
DEEEIRTTNPVATEQYGEVSENLQRAGNR

SEQ ID NO: 11507 - protein, 28 aa, Artificial Sequence
  Description of Artificial Sequence: Synthetic peptide
DEEEIRTTNPVATEQYGDVSENLQSGNR

SEQ ID NO: 11508 - protein, 28 aa, Artificial Sequence
  Description of Artificial Sequence: Synthetic peptide
DEEEIRTTNPVATECYGSVSTDLQRGNW

SEQ ID NO: 11509 - protein, 28 aa, Artificial Sequence
  Description of Artificial Sequence: Synthetic peptide
DEEEIRTTNPVATEQYGSVSTNLQRAFM

SEQ ID NO: 11510 - protein, 28 aa, Artificial Sequence
  Description of Artificial Sequence: Synthetic peptide
DEEEIRTTNPVATEQWGSVSTNLQHGNN

SEQ ID NO: 11511 - protein, 28 aa, Artificial Sequence
  Description of Artificial Sequence: Synthetic peptide
DEEEIRTTNPVATEQYGEVSENLQNGNR

SEQ ID NO: 11512 - protein, 28 aa, Artificial Sequence
  Description of Artificial Sequence: Synthetic peptide
DEEEIRATNPVATEQYGSVSTNLQHGNM

SEQ ID NO: 11513 - protein, 28 aa, Artificial Sequence
  Description of Artificial Sequence: Synthetic peptide
DEEEIRTTNPVATELYGSVSTNLMQGNR

SEQ ID NO: 11514 - protein, 28 aa, Artificial Sequence
  Description of Artificial Sequence: Synthetic peptide
DEEEIRTTNPVATEQYGIVSTNLQLGNT

SEQ ID NO: 11515 - protein, 28 aa, Artificial Sequence
  Description of Artificial Sequence: Synthetic peptide
DEEEIRTTNIVATEQLGSVSTNLQRGNI

SEQ ID NO: 11516 - protein, 28 aa, Artificial Sequence
  Description of Artificial Sequence: Synthetic peptide
KEEEIRTTNIVATEQYGSVSTNLQRGNI

SEQ ID NO: 11517 - protein, 28 aa, Artificial Sequence
  Description of Artificial Sequence: Synthetic peptide
DEEEIATTNPVATEQYGSVSTNEQRGTR

SEQ ID NO: 11518 - protein, 28 aa, Artificial Sequence
  Description of Artificial Sequence: Synthetic peptide
DEEAIRTTNPVAIEQYGSVSFNLQRGNR

SEQ ID NO: 11519 - protein, 28 aa, Artificial Sequence
  Description of Artificial Sequence: Synthetic peptide
DEEEIRTTNPVATEQYGSVSTGGDRGNR

SEQ ID NO: 11520 - protein, 28 aa, Artificial Sequence
  Description of Artificial Sequence: Synthetic peptide
DEEEIRTTNPVATEVYGSVSTDLQHGNR

SEQ ID NO: 11521 - protein, 28 aa, Artificial Sequence
  Description of Artificial Sequence: Synthetic peptide
DENEIRTTNPVATECYGSVSTNLQRGER

SEQ ID NO: 11522 - protein, 28 aa, Artificial Sequence
  Description of Artificial Sequence: Synthetic peptide
MEEEIRTTNPVATEQYGSVSTDLQRGNA

SEQ ID NO: 11523 - protein, 29 aa, Artificial Sequence
  Description of Artificial Sequence: Synthetic peptide
DEEEIRTTNPVATEQYGTVSTNLQLVGNR

SEQ ID NO: 11524 - protein, 28 aa, Artificial Sequence
  Description of Artificial Sequence: Synthetic peptide
DEEEIKTTNPVATEVYGEVSTNLQRGNR

SEQ ID NO: 11525 - protein, 28 aa, Artificial Sequence
  Description of Artificial Sequence: Synthetic peptide
DEEEIRATNPVATEQYGEVSTVLQRGNR

SEQ ID NO: 11526 - protein, 28 aa, Artificial Sequence
  Description of Artificial Sequence: Synthetic peptide
DEEEIRTTNPVATEQYGSVPTNLQRGDF

SEQ ID NO: 11527 - protein, 28 aa, Artificial Sequence
  Description of Artificial Sequence: Synthetic peptide
DEQEITTTNPVATEQYGSVSTNLQRGNQ

SEQ ID NO: 11528 - protein, 28 aa, Artificial Sequence
  Description of Artificial Sequence: Synthetic peptide
DENEIRTTNPVATEQYGVVSTELQRGNR

SEQ ID NO: 11529 - protein, 29 aa, Artificial Sequence
  Description of Artificial Sequence: Synthetic peptide
DEEEIRTTNPVATEQYGVVSTNLQARGNA

SEQ ID NO: 11530 - protein, 28 aa, Artificial Sequence
  Description of Artificial Sequence: Synthetic peptide
DEEEIRTTNPVATECYGSVSTNLQRGEI

SEQ ID NO: 11531 - protein, 28 aa, Artificial Sequence
  Description of Artificial Sequence: Synthetic peptide
DEEEIATTNPVATECYGSVSTNLQRGER

SEQ ID NO: 11532 - protein, 28 aa, Artificial Sequence
  Description of Artificial Sequence: Synthetic peptide
DEEEIRTTNIVATEQYGSVSTDLQRGIR

SEQ ID NO: 11533 - protein, 28 aa, Artificial Sequence
  Description of Artificial Sequence: Synthetic peptide
SEEEIRTTNPVATEMYGSVSTNLQQGNR

SEQ ID NO: 11534 - protein, 30 aa, Artificial Sequence
  Description of Artificial Sequence: Synthetic polypeptide
DEEEIRTTNPVATEQYGSVDTNLQSRGNDR

SEQ ID NO: 11535 - protein, 28 aa, Artificial Sequence
  Description of Artificial Sequence: Synthetic peptide
VEEEIATTNPVATEMYGSVSTNLQRGNR

SEQ ID NO: 11536 - protein, 28 aa, Artificial Sequence
  Description of Artificial Sequence: Synthetic peptide
MEEEIRTTNPVATECYGSVSTNLQRGNA

SEQ ID NO: 11537 - protein, 30 aa, Artificial Sequence
  Description of Artificial Sequence: Synthetic polypeptide
DEEEIRTTNPVATEQYGSVSCTDLQCRGNR

SEQ ID NO: 11538 - protein, 28 aa, Artificial Sequence
  Description of Artificial Sequence: Synthetic peptide
DEEEIRTTNPVATEQYGAVSTNVQRGER

SEQ ID NO: 11539 - protein, 28 aa, Artificial Sequence
  Description of Artificial Sequence: Synthetic peptide
DEEEIRTTNPVATEQYGSVSTEDDRGNR

SEQ ID NO: 11540 - protein, 28 aa, Artificial Sequence
  Description of Artificial Sequence: Synthetic peptide
DEEEIATTNPVATEQYGSVSTNQQRPNR

SEQ ID NO: 11541 - protein, 28 aa, Artificial Sequence
  Description of Artificial Sequence: Synthetic peptide
DEDEIRTTNPVACEQYGSVSTNLQRGPR

SEQ ID NO: 11542 - protein, 28 aa, Artificial Sequence
  Description of Artificial Sequence: Synthetic peptide
DEEEIRTTNPVATEQYGSVSTNEQNGNA

SEQ ID NO: 11543 - protein, 28 aa, Artificial Sequence
  Description of Artificial Sequence: Synthetic peptide
DEEEIRTTNIVACEQYGSVSTNLQRGNF

SEQ ID NO: 11544 - protein, 28 aa, Artificial Sequence
  Description of Artificial Sequence: Synthetic peptide
DEEEIRTTNPVSTEQYGSVSTELQRGNY

SEQ ID NO: 11545 - protein, 28 aa, Artificial Sequence
  Description of Artificial Sequence: Synthetic peptide
NEEEIRTTNPVATEQYGSVSTNLQVGNN

SEQ ID NO: 11546 - protein, 29 aa, Artificial Sequence
  Description of Artificial Sequence: Synthetic peptide
DEEEIRTTNPVATEMYGSVSTNLQQEGNR

SEQ ID NO: 11547 - protein, 29 aa, Artificial Sequence
  Description of Artificial Sequence: Synthetic peptide
DEEEIRTTNPVSTEQYGSVSAENLQRGNR

SEQ ID NO: 11548 - protein, 28 aa, Artificial Sequence
  Description of Artificial Sequence: Synthetic peptide
QEEEIRTTNPVATEQYGSASTVLQRGNR

SEQ ID NO: 11549 - protein, 28 aa, Artificial Sequence
  Description of Artificial Sequence: Synthetic peptide
NEEEIRTTNPVCTEQYGSVSTNLQYGNR

SEQ ID NO: 11550 - protein, 30 aa, Artificial Sequence
  Description of Artificial Sequence: Synthetic polypeptide
DEEEIRTTNPVATEQYGEVSTNLQRNGPNR

SEQ ID NO: 11551 - protein, 28 aa, Artificial Sequence
  Description of Artificial Sequence: Synthetic peptide
DEEEIATTNPVATEVYGWVSTNLQRGNR

SEQ ID NO: 11552 - protein, 29 aa, Artificial Sequence
  Description of Artificial Sequence: Synthetic peptide
DEEEIRTTNPVATECYGSVSTNLQRGEDR

SEQ ID NO: 11553 - protein, 28 aa, Artificial Sequence
  Description of Artificial Sequence: Synthetic peptide
QEEEIRTTNPVATEQYGSVSTNLQLGNM

SEQ ID NO: 11554 - protein, 28 aa, Artificial Sequence
  Description of Artificial Sequence: Synthetic peptide
DEEEIRTTNPVATEQYGSVDTNLQNGNQ

SEQ ID NO: 11555 - protein, 28 aa, Artificial Sequence
  Description of Artificial Sequence: Synthetic peptide
DEEEIRTTNPVATEQYGEVSTNPQRGLR

SEQ ID NO: 11556 - protein, 28 aa, Artificial Sequence
  Description of Artificial Sequence: Synthetic peptide
DEEEIRTTNPVATEQYGSVSTDLQTGNE

SEQ ID NO: 11557 - protein, 28 aa, Artificial Sequence
  Description of Artificial Sequence: Synthetic peptide
DEEEIRTTNPVATEQYGSVSTDLQTGNF

SEQ ID NO: 11558 - protein, 28 aa, Artificial Sequence
  Description of Artificial Sequence: Synthetic peptide
DEEEIRTTNPVATEQYGSVEHNLQRGLR

SEQ ID NO: 11559 - protein, 28 aa, Artificial Sequence
  Description of Artificial Sequence: Synthetic peptide
DEEEIRTTNPVATEQYGNVSENEQRGNR

SEQ ID NO: 11560 - protein, 29 aa, Artificial Sequence
  Description of Artificial Sequence: Synthetic peptide
DEEEIRTTNPVATEQWGSVSENLQNRGNR

SEQ ID NO: 11561 - protein, 30 aa, Artificial Sequence
  Description of Artificial Sequence: Synthetic polypeptide
DEEEIRATNPVATEQYGMSVSTNLQRGFNR

SEQ ID NO: 11562 - protein, 28 aa, Artificial Sequence
  Description of Artificial Sequence: Synthetic peptide
DENEIRTTNPVATEVYGSVSTNLQQGNR

SEQ ID NO: 11563 - protein, 28 aa, Artificial Sequence
  Description of Artificial Sequence: Synthetic peptide
DEEEIRTVNPVATEQYGSVSTELQRGER

SEQ ID NO: 11564 - protein, 28 aa, Artificial Sequence
  Description of Artificial Sequence: Synthetic peptide
DEEEIRCTNPVATEQYGSVSENLQRGLR

SEQ ID NO: 11565 - protein, 28 aa, Artificial Sequence
  Description of Artificial Sequence: Synthetic peptide
DEAEIRTTNPVATEQYGVVSTNLQRGNQ

SEQ ID NO: 11566 - protein, 30 aa, Artificial Sequence
  Description of Artificial Sequence: Synthetic polypeptide
DEEEIRTTNPVATEQYGSVSCTMNLQHGNR

SEQ ID NO: 11567 - protein, 28 aa, Artificial Sequence
  Description of Artificial Sequence: Synthetic peptide
DEEEIRTTNPVSTEQYGSVSTNLMRGNQ

SEQ ID NO: 11568 - protein, 28 aa, Artificial Sequence
  Description of Artificial Sequence: Synthetic peptide
DETEIRTTNPVATEQYGSVSTNLQIGNQ

SEQ ID NO: 11569 - protein, 28 aa, Artificial Sequence
  Description of Artificial Sequence: Synthetic peptide
DNEEIRTTNPVVTEQYGSVSTNLQRVNR

SEQ ID NO: 11570 - protein, 28 aa, Artificial Sequence
  Description of Artificial Sequence: Synthetic peptide
DEEEIRTTNPVATEQYGIVSEPLQRGNR

SEQ ID NO: 11571 - protein, 28 aa, Artificial Sequence
  Description of Artificial Sequence: Synthetic peptide
DEEEIRTTNPVATEQYGTVSENLQVGNR

SEQ ID NO: 11572 - protein, 29 aa, Artificial Sequence
  Description of Artificial Sequence: Synthetic peptide
DEEEIATTNPVATEQYGDVSATNLQRGNR

SEQ ID NO: 11573 - protein, 28 aa, Artificial Sequence
  Description of Artificial Sequence: Synthetic peptide
DEEEIRTTNPVATEMFGSVSTNLQRGNG

SEQ ID NO: 11574 - protein, 29 aa, Artificial Sequence
  Description of Artificial Sequence: Synthetic peptide
DEEEIRTTNPVATEQYGSVASTALQRGNN

SEQ ID NO: 11575 - protein, 28 aa, Artificial Sequence
  Description of Artificial Sequence: Synthetic peptide
DEEELRTTNPVATEQYGWVSDNLQRGNR

SEQ ID NO: 11576 - protein, 28 aa, Artificial Sequence
  Description of Artificial Sequence: Synthetic peptide
DEEEIRTTNPVATECYGSVSEELQRGNR

SEQ ID NO: 11577 - protein, 28 aa, Artificial Sequence
  Description of Artificial Sequence: Synthetic peptide
DEEEIRTTNPCATEQYGSVSEELQRGNR

SEQ ID NO: 11578 - protein, 28 aa, Artificial Sequence
  Description of Artificial Sequence: Synthetic peptide
DEEEIRTTNPVATEQWGSVSTNEQRGNS

SEQ ID NO: 11579 - protein, 28 aa, Artificial Sequence
  Description of Artificial Sequence: Synthetic peptide
DEEEIRTTNPVATEQYGSVSTNIQNGNA

SEQ ID NO: 11580 - protein, 28 aa, Artificial Sequence
  Description of Artificial Sequence: Synthetic peptide
DEEEIRTTNIVATEQYGSVACNLQRGNR

SEQ ID NO: 11581 - protein, 29 aa, Artificial Sequence
  Description of Artificial Sequence: Synthetic peptide
DEEEIRTTNPVATEQYGSVSTNLQRKGEN

SEQ ID NO: 11582 - protein, 28 aa, Artificial Sequence
  Description of Artificial Sequence: Synthetic peptide
DEEEITTTNPVATECYGSVSTNLQRGNQ

SEQ ID NO: 11583 - protein, 28 aa, Artificial Sequence
  Description of Artificial Sequence: Synthetic peptide
DEEEIRTTNPVAYEMYGSVSTNLERGNR

SEQ ID NO: 11584 - protein, 28 aa, Artificial Sequence
  Description of Artificial Sequence: Synthetic peptide
DEEEIATTNPVATEQYGSVSTELQAGNR

SEQ ID NO: 11585 - protein, 28 aa, Artificial Sequence
  Description of Artificial Sequence: Synthetic peptide
DEEEIRCTNPVASEQYGSVSTNLQHGNR

SEQ ID NO: 11586 - protein, 30 aa, Artificial Sequence
  Description of Artificial Sequence: Synthetic polypeptide
DEEEIRTTNPTATEQYGSVSTGNLQRGDNR

SEQ ID NO: 11587 - protein, 29 aa, Artificial Sequence
  Description of Artificial Sequence: Synthetic peptide
DENEIRTTNPVATEQYGSVSENLQRAGNR

SEQ ID NO: 11588 - protein, 28 aa, Artificial Sequence
  Description of Artificial Sequence: Synthetic peptide
DEEEIRTTNIVATECYGSVSTNQQRGNR

SEQ ID NO: 11589 - protein, 30 aa, Artificial Sequence
  Description of Artificial Sequence: Synthetic polypeptide
DEEEIRTTNPVATECYGSVSTNLQDRGNDR

SEQ ID NO: 11590 - protein, 28 aa, Artificial Sequence
  Description of Artificial Sequence: Synthetic peptide
DEEEVRTTNIVATEQYGSVSTNLQIGNR

SEQ ID NO: 11591 - protein, 28 aa, Artificial Sequence
  Description of Artificial Sequence: Synthetic peptide
DEEEIRTTNPVATEQYGSVSTNEMRGNF

SEQ ID NO: 11592 - protein, 28 aa, Artificial Sequence
  Description of Artificial Sequence: Synthetic peptide
DEEEIRTTNPVATEQYGSVSTELQYGER

SEQ ID NO: 11593 - protein, 28 aa, Artificial Sequence
  Description of Artificial Sequence: Synthetic peptide
DEEEIRTTNPVATEQYGVVSNNLQQGNR

SEQ ID NO: 11594 - protein, 28 aa, Artificial Sequence
  Description of Artificial Sequence: Synthetic peptide
DEEEIRTTNPVATECYGSVSTNLQHGNL

SEQ ID NO: 11595 - protein, 28 aa, Artificial Sequence
  Description of Artificial Sequence: Synthetic peptide
DEEEIRTTNPVATEQWGSVSTNEQRGNM

SEQ ID NO: 11596 - protein, 28 aa, Artificial Sequence
  Description of Artificial Sequence: Synthetic peptide
DEEEIRTTNPVATEQYGSVPTTLQRMNR

SEQ ID NO: 11597 - protein, 28 aa, Artificial Sequence
  Description of Artificial Sequence: Synthetic peptide
DEEEIRTTNPVATEQYGSVSTNEMLGNR

SEQ ID NO: 11598 - protein, 28 aa, Artificial Sequence
  Description of Artificial Sequence: Synthetic peptide
DETEIRTTNPVATEQYGSVSTNWQRGNS

SEQ ID NO: 11599 - protein, 29 aa, Artificial Sequence
  Description of Artificial Sequence: Synthetic peptide
DENEIRTTNPVATEQYGSVSENLQMRGNR

SEQ ID NO: 11600 - protein, 30 aa, Artificial Sequence
  Description of Artificial Sequence: Synthetic polypeptide
DEEEIRTTNPVATEQYGSVSTNLQERGNTI

SEQ ID NO: 11601 - protein, 28 aa, Artificial Sequence
  Description of Artificial Sequence: Synthetic peptide
SEEEISTTNPVATEQYGSVSTNLQRGNS

SEQ ID NO: 11602 - protein, 28 aa, Artificial Sequence
  Description of Artificial Sequence: Synthetic peptide
DEEEIRTTNPVGTEQYGSVSTNLQLGND

SEQ ID NO: 11603 - protein, 29 aa, Artificial Sequence
  Description of Artificial Sequence: Synthetic peptide
DEEEIRTTNPVATEQYGSVSTNLQNGNTE

SEQ ID NO: 11604 - protein, 28 aa, Artificial Sequence
  Description of Artificial Sequence: Synthetic peptide
DEEEIRTTNPVATEMWGSVSENLQRGNR

SEQ ID NO: 11605 - protein, 28 aa, Artificial Sequence
  Description of Artificial Sequence: Synthetic peptide
DEEEIRTTNPVATEQYGSVSTNLEHGNL

SEQ ID NO: 11606 - protein, 30 aa, Artificial Sequence
  Description of Artificial Sequence: Synthetic polypeptide
DEEEIRTTNPVATEQYGSVSTNPLNLRGNR

SEQ ID NO: 11607 - protein, 31 aa, Artificial Sequence
  Description of Artificial Sequence: Synthetic polypeptide
DEEEIRTTNPVATEQYGSVSTNLQREGENDR

SEQ ID NO: 11608 - protein, 28 aa, Artificial Sequence
  Description of Artificial Sequence: Synthetic peptide
DEVEIATTNIVATEQYGSVSTNLQRGNR

SEQ ID NO: 11609 - protein, 28 aa, Artificial Sequence
  Description of Artificial Sequence: Synthetic peptide
DEEEICTTNPVATEQYGWASTNLQRGNR

SEQ ID NO: 11610 - protein, 28 aa, Artificial Sequence
  Description of Artificial Sequence: Synthetic peptide
SEEEIRTTNPVATEQYGSVSENLQQGNR

SEQ ID NO: 11611 - protein, 28 aa, Artificial Sequence
  Description of Artificial Sequence: Synthetic peptide
DEEEIRTTNPVATEQYGSVSTELQTGNF

SEQ ID NO: 11612 - protein, 28 aa, Artificial Sequence
  Description of Artificial Sequence: Synthetic peptide
DEEEIRTTNPVATEQFGSVSTNLQSGNN

SEQ ID NO: 11613 - protein, 28 aa, Artificial Sequence
  Description of Artificial Sequence: Synthetic peptide
DENEIRTVNPVATEQYGSVSENLQRGNR

SEQ ID NO: 11614 - protein, 29 aa, Artificial Sequence
  Description of Artificial Sequence: Synthetic peptide
DEEEIRTTNPVATEQYGDVSTNLQERGNQ

SEQ ID NO: 11615 - protein, 29 aa, Artificial Sequence
  Description of Artificial Sequence: Synthetic peptide
DEEEIRTTNPVATEQYGGVSTANLQRGNQ

SEQ ID NO: 11616 - protein, 29 aa, Artificial Sequence
  Description of Artificial Sequence: Synthetic peptide
DEQEIRTTNPVATEQYGSVSVTNLQRGNI

SEQ ID NO: 11617 - protein, 28 aa, Artificial Sequence
  Description of Artificial Sequence: Synthetic peptide
DEEEIATTNPVATEQYGDVSTNLQRGNY

SEQ ID NO: 11618 - protein, 28 aa, Artificial Sequence
  Description of Artificial Sequence: Synthetic peptide
DEEEIRTTNPVATEQFGCVSTNLQRGPR

SEQ ID NO: 11619 - protein, 28 aa, Artificial Sequence
  Description of Artificial Sequence: Synthetic peptide
DEEEIRTTNPVATEQYGSVSTDLQQGNL

SEQ ID NO: 11620 - protein, 28 aa, Artificial Sequence
  Description of Artificial Sequence: Synthetic peptide
DEEEIRTTNIVATEQVGSVSTNLQRGNQ

SEQ ID NO: 11621 - protein, 28 aa, Artificial Sequence
  Description of Artificial Sequence: Synthetic peptide
DEEEICTTNPVATEQYGIVSENLQRGNR

SEQ ID NO: 11622 - protein, 28 aa, Artificial Sequence
  Description of Artificial Sequence: Synthetic peptide
DEEEISTVNPVSTEQYGSVSTNLQRGNR

SEQ ID NO: 11623 - protein, 30 aa, Artificial Sequence
  Description of Artificial Sequence: Synthetic polypeptide
DEEEIRTTNPVATEQYGSVSTNLVQRGDER

SEQ ID NO: 11624 - protein, 28 aa, Artificial Sequence
  Description of Artificial Sequence: Synthetic peptide
DEEEIRTTNPVATEQYGSVDTNLQPGER

SEQ ID NO: 11625 - protein, 28 aa, Artificial Sequence
  Description of Artificial Sequence: Synthetic peptide
DEEEIRTTNIVSTEQYGSVSTNAQRGNR

SEQ ID NO: 11626 - protein, 28 aa, Artificial Sequence
  Description of Artificial Sequence: Synthetic peptide
MEEEIRTTNPVATEQYGSVSTNLQVGNA

SEQ ID NO: 11627 - protein, 28 aa, Artificial Sequence
  Description of Artificial Sequence: Synthetic peptide
DEEEIVTTNPVATEQYGEVSENLQRGNR

SEQ ID NO: 11628 - protein, 28 aa, Artificial Sequence
  Description of Artificial Sequence: Synthetic peptide
DEEEIRTTNPVATEQYGSVSTNLANGTR

SEQ ID NO: 11629 - protein, 28 aa, Artificial Sequence
  Description of Artificial Sequence: Synthetic peptide
DEIEIRTTNPVATEQYGSVSENLQRGND

SEQ ID NO: 11630 - protein, 28 aa, Artificial Sequence
  Description of Artificial Sequence: Synthetic peptide
DEEEIRTTNIVATEQYGSVSTGLCRGNR

SEQ ID NO: 11631 - protein, 28 aa, Artificial Sequence
  Description of Artificial Sequence: Synthetic peptide
DEEEIATTNPVATEQYGSVSTDLQRGNL

SEQ ID NO: 11632 - protein, 28 aa, Artificial Sequence
  Description of Artificial Sequence: Synthetic peptide
HEEEIRTTNPVATECYGSVSTNLQRENR

SEQ ID NO: 11633 - protein, 28 aa, Artificial Sequence
  Description of Artificial Sequence: Synthetic peptide
DEQEIYTTNPVATEQYGSVSTNLQRGNF

SEQ ID NO: 11634 - protein, 28 aa, Artificial Sequence
  Description of Artificial Sequence: Synthetic peptide
DEEEIRTTNPVATEMYGNVSTNLQRGNQ

SEQ ID NO: 11635 - protein, 28 aa, Artificial Sequence
  Description of Artificial Sequence: Synthetic peptide
QEEEIRTTNPVATEQYGSVSTNLMRGNC

SEQ ID NO: 11636 - protein, 28 aa, Artificial Sequence
  Description of Artificial Sequence: Synthetic peptide
DEEEIRTTNIVATEQYGEVSTHLQRGNR

SEQ ID NO: 11637 - protein, 28 aa, Artificial Sequence
  Description of Artificial Sequence: Synthetic peptide
DEEEIRTTNPVATEQYGMVTHNLQRGNR

SEQ ID NO: 11638 - protein, 28 aa, Artificial Sequence
  Description of Artificial Sequence: Synthetic peptide
KEEEIRTTNIVATEQYGSVSTNLQQGNR

SEQ ID NO: 11639 - protein, 28 aa, Artificial Sequence
  Description of Artificial Sequence: Synthetic peptide
DEVEIRTTNPVATEQYGSVSTNLQWGNQ

SEQ ID NO: 11640 - protein, 28 aa, Artificial Sequence
  Description of Artificial Sequence: Synthetic peptide
DEEEIRTTNIVATEQYGWVSTNLQRGNQ

SEQ ID NO: 11641 - protein, 28 aa, Artificial Sequence
  Description of Artificial Sequence: Synthetic peptide
DEEEIRTTNPVATEQFGSVSENLQRGNF

SEQ ID NO: 11642 - protein, 30 aa, Artificial Sequence
  Description of Artificial Sequence: Synthetic polypeptide
DEEEIRTTNPVATEQYGSVSVTLNLLRGNR

SEQ ID NO: 11643 - protein, 28 aa, Artificial Sequence
  Description of Artificial Sequence: Synthetic peptide
DEEEIRTTNPVATEVYGSVSTNLQHGNF

SEQ ID NO: 11644 - protein, 28 aa, Artificial Sequence
  Description of Artificial Sequence: Synthetic peptide
DEEEIRTTNPVATELWGSVSTNLQRGNA

SEQ ID NO: 11645 - protein, 28 aa, Artificial Sequence
  Description of Artificial Sequence: Synthetic peptide
DENEIRTTNPVATEQYGSVSTNDQRGNW

SEQ ID NO: 11646 - protein, 28 aa, Artificial Sequence
  Description of Artificial Sequence: Synthetic peptide
DEESIRGTNPVATEQYGSVSTNLQRGTR

SEQ ID NO: 11647 - protein, 28 aa, Artificial Sequence
  Description of Artificial Sequence: Synthetic peptide
TEEEIRCTNPVATEQYGEVSTNLQRGNR

SEQ ID NO: 11648 - protein, 29 aa, Artificial Sequence
  Description of Artificial Sequence: Synthetic peptide
DEEEIRTTNPVATEQYGSVSTNLQRGLDA

SEQ ID NO: 11649 - protein, 28 aa, Artificial Sequence
  Description of Artificial Sequence: Synthetic peptide
DESEIRTTNPVATEQYGWVSTNLQHGNR

SEQ ID NO: 11650 - protein, 28 aa, Artificial Sequence
  Description of Artificial Sequence: Synthetic peptide
DEEEIKTTNPVATEQYGDVGTNLQRGNR

SEQ ID NO: 11651 - protein, 28 aa, Artificial Sequence
  Description of Artificial Sequence: Synthetic peptide
DEQEIRTTNPVATEQWGSVSTNEQRGNR

SEQ ID NO: 11652 - protein, 28 aa, Artificial Sequence
  Description of Artificial Sequence: Synthetic peptide
DEEEIRQTNPVATEQYGSVSTDLQRENR

SEQ ID NO: 11653 - protein, 28 aa, Artificial Sequence
  Description of Artificial Sequence: Synthetic peptide
DEEEIRTTNPVATEQYGDVSENLQYGNR

SEQ ID NO: 11654 - protein, 29 aa, Artificial Sequence
  Description of Artificial Sequence: Synthetic peptide
DEEEIRTTNPVATEQYGGVSTNLQERGNT

SEQ ID NO: 11655 - protein, 28 aa, Artificial Sequence
  Description of Artificial Sequence: Synthetic peptide
DEEEIRTTNPCATEQYGSVSTDLQHGNR

SEQ ID NO: 11656 - protein, 29 aa, Artificial Sequence
  Description of Artificial Sequence: Synthetic peptide
DEEEIRTTNPVATEQWGSVSTNPLQPGNR

SEQ ID NO: 11657 - protein, 28 aa, Artificial Sequence
  Description of Artificial Sequence: Synthetic peptide
DEEEIRTTNPVATEQYGSVSELLQRGGR

SEQ ID NO: 11658 - protein, 28 aa, Artificial Sequence
  Description of Artificial Sequence: Synthetic peptide
MEEEIRTTNPVATEQYGSVSTNLQNGNE

SEQ ID NO: 11659 - protein, 28 aa, Artificial Sequence
  Description of Artificial Sequence: Synthetic peptide
DEEEIRTTNPEATETYGSVSTNLQRGNQ

SEQ ID NO: 11660 - protein, 28 aa, Artificial Sequence
  Description of Artificial Sequence: Synthetic peptide
DEEEIRTTNPVATEQYGDVSTNLQNGNQ

SEQ ID NO: 11661 - protein, 28 aa, Artificial Sequence
  Description of Artificial Sequence: Synthetic peptide
DEEEIYTTNPAATEQYGSVSTNEQRGNR

SEQ ID NO: 11662 - protein, 28 aa, Artificial Sequence
  Description of Artificial Sequence: Synthetic peptide
DEEEIRTTNPTATEVYGSVSTNLQRGNF

SEQ ID NO: 11663 - protein, 28 aa, Artificial Sequence
  Description of Artificial Sequence: Synthetic peptide
SEEEIRCTNPVATEQYGLVSTNLQRGNR

SEQ ID NO: 11664 - protein, 28 aa, Artificial Sequence
  Description of Artificial Sequence: Synthetic peptide
DEGEIRTTNPCATEQYGSVSTNLQRGNQ

SEQ ID NO: 11665 - protein, 28 aa, Artificial Sequence
  Description of Artificial Sequence: Synthetic peptide
GEEEIRTTNIVATEQYGSVSTNLQQGNR

SEQ ID NO: 11666 - protein, 28 aa, Artificial Sequence
  Description of Artificial Sequence: Synthetic peptide
DEEEIATTNPVATEQYGSVSTNWQRGND

SEQ ID NO: 11667 - protein, 29 aa, Artificial Sequence
  Description of Artificial Sequence: Synthetic peptide
DEEEIRTTNPVATEQYGSVDEENLQRGNR

SEQ ID NO: 11668 - protein, 28 aa, Artificial Sequence
  Description of Artificial Sequence: Synthetic peptide
DEEEIATTNPVSTEQYGSVSENLQRGNR

SEQ ID NO: 11669 - protein, 28 aa, Artificial Sequence
  Description of Artificial Sequence: Synthetic peptide
DEEEIRTTNPVATEQYGSVSENLQAGNA

SEQ ID NO: 11670 - protein, 28 aa, Artificial Sequence
  Description of Artificial Sequence: Synthetic peptide
DEEEIRTTNPVATEQWGSVSTNLQQGNQ

SEQ ID NO: 11671 - protein, 29 aa, Artificial Sequence
  Description of Artificial Sequence: Synthetic peptide
DEEEIRTTNPVATEQYGEVSTMNLHRGNR

SEQ ID NO: 11672 - protein, 29 aa, Artificial Sequence
  Description of Artificial Sequence: Synthetic peptide
DEEEIKTTNPVATEQYGSVSTNLQRGNDA

SEQ ID NO: 11673 - protein, 28 aa, Artificial Sequence
  Description of Artificial Sequence: Synthetic peptide
DEEEIATTNPVATEQYGEASTNLQRGNR

SEQ ID NO: 11674 - protein, 28 aa, Artificial Sequence
  Description of Artificial Sequence: Synthetic peptide
DEEEIRTTNPVCTEQYGSVSTNLQVGNH

SEQ ID NO: 11675 - protein, 28 aa, Artificial Sequence
  Description of Artificial Sequence: Synthetic peptide
DEQEIRTTNPVSTEQYGSVSTNLQRGNQ

SEQ ID NO: 11676 - protein, 29 aa, Artificial Sequence
  Description of Artificial Sequence: Synthetic peptide
DEEEIRTTNPVATEQYGSVSTNEQRGNTG

SEQ ID NO: 11677 - protein, 29 aa, Artificial Sequence
  Description of Artificial Sequence: Synthetic peptide
DEEEIRTTNPVATEHYGSVSTNLQRGENF

SEQ ID NO: 11678 - protein, 29 aa, Artificial Sequence
  Description of Artificial Sequence: Synthetic peptide
DEEEIRPTNPVATEQYGSVSTGLQRNGNR

SEQ ID NO: 11679 - protein, 28 aa, Artificial Sequence
  Description of Artificial Sequence: Synthetic peptide
DEEEIRTTNPVATEQWGSVSTNLMRGNF

SEQ ID NO: 11680 - protein, 29 aa, Artificial Sequence
  Description of Artificial Sequence: Synthetic peptide
DEEEIRTTNPVATEQYGSTATNLQIRGNR

SEQ ID NO: 11681 - protein, 28 aa, Artificial Sequence
  Description of Artificial Sequence: Synthetic peptide
DEEEIRTTNTVATEQYGSVSTNNQRQNR

SEQ ID NO: 11682 - protein, 28 aa, Artificial Sequence
  Description of Artificial Sequence: Synthetic peptide
DEEEIRTTNPVATEQWGSVSTNLQQGNM

SEQ ID NO: 11683 - protein, 28 aa, Artificial Sequence
  Description of Artificial Sequence: Synthetic peptide
DEEGIRTTNIVATEQYGSVSTNLQYGNR

SEQ ID NO: 11684 - protein, 28 aa, Artificial Sequence
  Description of Artificial Sequence: Synthetic peptide
QEEEIRTVNPVATEQYGEVSTNLQRGNR

SEQ ID NO: 11685 - protein, 28 aa, Artificial Sequence
  Description of Artificial Sequence: Synthetic peptide
DEEEIRTTNPVATEQYGFVSTNLQRFNE

SEQ ID NO: 11686 - protein, 28 aa, Artificial Sequence
  Description of Artificial Sequence: Synthetic peptide
DEEEIRTTNPVATEQYGIASDNLQRGNR

SEQ ID NO: 11687 - protein, 29 aa, Artificial Sequence
  Description of Artificial Sequence: Synthetic peptide
DEEEIRTTNPVATEIYGSVSTNLQLGNDR

SEQ ID NO: 11688 - protein, 29 aa, Artificial Sequence
  Description of Artificial Sequence: Synthetic peptide
DEEEIRTTNPVATEQYGSVPTNLPQRGQR

SEQ ID NO: 11689 - protein, 28 aa, Artificial Sequence
  Description of Artificial Sequence: Synthetic peptide
DEEEIRTTNPVATEQYGSVSENLMRGNM

SEQ ID NO: 11690 - protein, 28 aa, Artificial Sequence
  Description of Artificial Sequence: Synthetic peptide
DEEEIRTTNPVATECYGSVSTNLQLGNA

SEQ ID NO: 11691 - protein, 30 aa, Artificial Sequence
  Description of Artificial Sequence: Synthetic polypeptide
DEEEIRTTNPVATEQYGSVSTINLQPRGNA

SEQ ID NO: 11692 - protein, 28 aa, Artificial Sequence
  Description of Artificial Sequence: Synthetic peptide
DEEEIATTNPVATEQYGSVSDILQRGNR

SEQ ID NO: 11693 - protein, 28 aa, Artificial Sequence
  Description of Artificial Sequence: Synthetic peptide
DEQEIRTTNPVATEQYGSVGTNLQQGNR

SEQ ID NO: 11694 - protein, 28 aa, Artificial Sequence
  Description of Artificial Sequence: Synthetic peptide
DEAEIRTTNPVATEQYGVVSTELQRGNR

SEQ ID NO: 11695 - protein, 28 aa, Artificial Sequence
  Description of Artificial Sequence: Synthetic peptide
DEEEIRTTNPVATECYGSVSTVLQRGNL

SEQ ID NO: 11696 - protein, 28 aa, Artificial Sequence
  Description of Artificial Sequence: Synthetic peptide
DEQEIATTNPVATEQYGNVSTNLQRGNR

SEQ ID NO: 11697 - protein, 28 aa, Artificial Sequence
  Description of Artificial Sequence: Synthetic peptide
DEQEIRTTNPVATEMYGSVSTNLQVGNR

SEQ ID NO: 11698 - protein, 28 aa, Artificial Sequence
  Description of Artificial Sequence: Synthetic peptide
DEEEIRTTNPVATEQYGSVSTDLQHGNS

SEQ ID NO: 11699 - protein, 28 aa, Artificial Sequence
  Description of Artificial Sequence: Synthetic peptide
DEEEIRTTNPVATEQYGSASTNLCRGNQ

SEQ ID NO: 11700 - protein, 28 aa, Artificial Sequence
  Description of Artificial Sequence: Synthetic peptide
DEEEIRTTNIVATEQYGSNSTNIQRGNR

SEQ ID NO: 11701 - protein, 28 aa, Artificial Sequence
  Description of Artificial Sequence: Synthetic peptide
DEHEIYTTNPVATEQYGEVSTNLQRGNR

SEQ ID NO: 11702 - protein, 28 aa, Artificial Sequence
  Description of Artificial Sequence: Synthetic peptide
DEEEIRTTNPVATEQYGSYSTNLQHGNA

SEQ ID NO: 11703 - protein, 28 aa, Artificial Sequence
  Description of Artificial Sequence: Synthetic peptide
DEEEIYTTNIVATEQYGSVSTNLQIGNR

SEQ ID NO: 11704 - protein, 28 aa, Artificial Sequence
  Description of Artificial Sequence: Synthetic peptide
DEEEIRTTNPVATEQYGSVSTDLQLGNS

SEQ ID NO: 11705 - protein, 29 aa, Artificial Sequence
  Description of Artificial Sequence: Synthetic peptide
DEQEIRTTNPVATEQYGSVDSTCLQRGNR

SEQ ID NO: 11706 - protein, 28 aa, Artificial Sequence
  Description of Artificial Sequence: Synthetic peptide
DEEEIRATNPVATEQYGSVSTNLQRGEY

SEQ ID NO: 11707 - protein, 28 aa, Artificial Sequence
  Description of Artificial Sequence: Synthetic peptide
DEQEIRTTNPVATECYGSVSTNLQRGER

SEQ ID NO: 11708 - protein, 28 aa, Artificial Sequence
  Description of Artificial Sequence: Synthetic peptide
DEEEIRTTNPVATEQYGSVSDNLMQGNR

SEQ ID NO: 11709 - protein, 28 aa, Artificial Sequence
  Description of Artificial Sequence: Synthetic peptide
DEEEIRTVNPVATEQYGSVTVNLQRGNR

SEQ ID NO: 11710 - protein, 28 aa, Artificial Sequence
  Description of Artificial Sequence: Synthetic peptide
DEEEIRTTNPVATEQYGSVSEDLQRGNQ

SEQ ID NO: 11711 - protein, 28 aa, Artificial Sequence
  Description of Artificial Sequence: Synthetic peptide
DESEIRTTNPVATEQYGSFSTNLQRGFR

SEQ ID NO: 11712 - protein, 28 aa, Artificial Sequence
  Description of Artificial Sequence: Synthetic peptide
DEEEIRTTNPVATEQYGSVSTNLMRGTI

SEQ ID NO: 11713 - protein, 29 aa, Artificial Sequence
  Description of Artificial Sequence: Synthetic peptide
MEEEIRTTNPVATEQYGSVSTDLQRGNDR

SEQ ID NO: 11714 - protein, 28 aa, Artificial Sequence
  Description of Artificial Sequence: Synthetic peptide
DEEEIRTTNPVATEQYGSVSDNLQAGNP

SEQ ID NO: 11715 - protein, 28 aa, Artificial Sequence
  Description of Artificial Sequence: Synthetic peptide
DEEEIRTTNPVATEQYGSVSEVLQRGGR

SEQ ID NO: 11716 - protein, 28 aa, Artificial Sequence
  Description of Artificial Sequence: Synthetic peptide
DEEEIRATNPVATEIYGSVSTNLQGGNR

SEQ ID NO: 11717 - protein, 28 aa, Artificial Sequence
  Description of Artificial Sequence: Synthetic peptide
SEEEIRTTNPVASEQYGAVSTNLQRGNR

SEQ ID NO: 11718 - protein, 28 aa, Artificial Sequence
  Description of Artificial Sequence: Synthetic peptide
SEEEIRTTNPVATEVYGSVSTNLERGNR

SEQ ID NO: 11719 - protein, 28 aa, Artificial Sequence
  Description of Artificial Sequence: Synthetic peptide
DEEELRTTNPVSTEQYGSVSTNLQHGNR

SEQ ID NO: 11720 - protein, 28 aa, Artificial Sequence
  Description of Artificial Sequence: Synthetic peptide
MEEEIRTTNPVATEQYGSVSTDLQNGNR

SEQ ID NO: 11721 - protein, 28 aa, Artificial Sequence
  Description of Artificial Sequence: Synthetic peptide
DEEEIRTTNIVATEVYGDVSTNLQRGNR

SEQ ID NO: 11722 - protein, 28 aa, Artificial Sequence
  Description of Artificial Sequence: Synthetic peptide
DEEEITGTNPVATEQYGSVSCNLQRGNR

SEQ ID NO: 11723 - protein, 28 aa, Artificial Sequence
  Description of Artificial Sequence: Synthetic peptide
DEEEICCTNPVATEQYGIVSTNLQRGNR

SEQ ID NO: 11724 - protein, 29 aa, Artificial Sequence
  Description of Artificial Sequence: Synthetic peptide
AEEEIRTTNPVATEQYGSVSTTNLQIGNR

SEQ ID NO: 11725 - protein, 29 aa, Artificial Sequence
  Description of Artificial Sequence: Synthetic peptide
DEEEIRTTNPTATEQYGSVSTNLQRGTTR

SEQ ID NO: 11726 - protein, 28 aa, Artificial Sequence
  Description of Artificial Sequence: Synthetic peptide
DEEEIRTTNPVATEVYGSVSTGLQRGTR

SEQ ID NO: 11727 - protein, 28 aa, Artificial Sequence
  Description of Artificial Sequence: Synthetic peptide
DEEEIRTTNPVATEQYGSVSENLQQGNT

SEQ ID NO: 11728 - protein, 28 aa, Artificial Sequence
  Description of Artificial Sequence: Synthetic peptide
DEEEIRTTNPVATEQYGSVETNLQRGES

SEQ ID NO: 11729 - protein, 28 aa, Artificial Sequence
  Description of Artificial Sequence: Synthetic peptide
KEEEIRTTNPVATEQYGSASTNLQHGNR

SEQ ID NO: 11730 - protein, 28 aa, Artificial Sequence
  Description of Artificial Sequence: Synthetic peptide
DEEEIRTTNPVSTEQYGSVSTDLQRLNR

SEQ ID NO: 11731 - protein, 28 aa, Artificial Sequence
  Description of Artificial Sequence: Synthetic peptide
DEEEIRTTNPVATEQYASVSTNLQDTNR

SEQ ID NO: 11732 - protein, 28 aa, Artificial Sequence
  Description of Artificial Sequence: Synthetic peptide
DEEEIRTTNPVATEQYGSVSQNEQHGNR

SEQ ID NO: 11733 - protein, 28 aa, Artificial Sequence
  Description of Artificial Sequence: Synthetic peptide
DEEEISTTNPVATEQYGSVSTELQRGNM

SEQ ID NO: 11734 - protein, 29 aa, Artificial Sequence
  Description of Artificial Sequence: Synthetic peptide
DEEEIRTTNPVATEQYGSVSAENQQRGNR

SEQ ID NO: 11735 - protein, 28 aa, Artificial Sequence
  Description of Artificial Sequence: Synthetic peptide
DEEEIRQTNIVATEQYGSVSTNLQHGNR

SEQ ID NO: 11736 - protein, 29 aa, Artificial Sequence
  Description of Artificial Sequence: Synthetic peptide
DEEEIRTTNPVATEQYGSVSTNLQEAGNL

SEQ ID NO: 11737 - protein, 28 aa, Artificial Sequence
  Description of Artificial Sequence: Synthetic peptide
DEEEIRTTNPVATEQYGSVSENLQQGNF

SEQ ID NO: 11738 - protein, 28 aa, Artificial Sequence
  Description of Artificial Sequence: Synthetic peptide
DEEEIRTTNPVATEQYGSVETALERGNR

SEQ ID NO: 11739 - protein, 29 aa, Artificial Sequence
  Description of Artificial Sequence: Synthetic peptide
DEEEIRTTNPVATEQYGSVSENEQMRGNR

SEQ ID NO: 11740 - protein, 28 aa, Artificial Sequence
  Description of Artificial Sequence: Synthetic peptide
DEEEIRTTNPVSTEQYGSVSANLQRGDR

SEQ ID NO: 11741 - protein, 28 aa, Artificial Sequence
  Description of Artificial Sequence: Synthetic peptide
DEEEIRATNPVATFQYGSVGTNLQRGNR

SEQ ID NO: 11742 - protein, 28 aa, Artificial Sequence
  Description of Artificial Sequence: Synthetic peptide
DEEEIRTTNPVATEQFGSVSENLQMGNR

SEQ ID NO: 11743 - protein, 28 aa, Artificial Sequence
  Description of Artificial Sequence: Synthetic peptide
DEEEIATTNPVATETYGSVSTNLQNGNR

SEQ ID NO: 11744 - protein, 29 aa, Artificial Sequence
  Description of Artificial Sequence: Synthetic peptide
DEEEIRTTNPVADEQYGSVSTLLQRQGNR

SEQ ID NO: 11745 - protein, 28 aa, Artificial Sequence
  Description of Artificial Sequence: Synthetic peptide
DEEEIRTTNIVATEQYGEVSTALQRGNR

SEQ ID NO: 11746 - protein, 28 aa, Artificial Sequence
  Description of Artificial Sequence: Synthetic peptide
DEEEIRTTNPVATEQYGSVSENLQRGEM

SEQ ID NO: 11747 - protein, 28 aa, Artificial Sequence
  Description of Artificial Sequence: Synthetic peptide
DEEEVRTTNPVATEQYGSVATNLQHGNR

SEQ ID NO: 11748 - protein, 28 aa, Artificial Sequence
  Description of Artificial Sequence: Synthetic peptide
DEEEIRQTNPVATEQYGVVSTNLERGNR

SEQ ID NO: 11749 - protein, 28 aa, Artificial Sequence
  Description of Artificial Sequence: Synthetic peptide
DEEEIRTTNPVATEQFGSVSEVLQRGNR

SEQ ID NO: 11750 - protein, 28 aa, Artificial Sequence
  Description of Artificial Sequence: Synthetic peptide
DEEEIRTTNPVATAIYGSVSTNLQRGQR

SEQ ID NO: 11751 - protein, 28 aa, Artificial Sequence
  Description of Artificial Sequence: Synthetic peptide
DEEEIRTTNPVAIEQYGSVSENLQIGNR

SEQ ID NO: 11752 - protein, 28 aa, Artificial Sequence
  Description of Artificial Sequence: Synthetic peptide
DEEEIRTTNIVACEQYGSVSENLQRGNR

SEQ ID NO: 11753 - protein, 28 aa, Artificial Sequence
  Description of Artificial Sequence: Synthetic peptide
DEEEISTTNIVATEQYGSVATNLQRGNR

SEQ ID NO: 11754 - protein, 30 aa, Artificial Sequence
  Description of Artificial Sequence: Synthetic polypeptide
DEEEIRTTNPVATEQYNGSVSDRNLQRGNR

SEQ ID NO: 11755 - protein, 28 aa, Artificial Sequence
  Description of Artificial Sequence: Synthetic peptide
DDEELRTTNPVATEQYGSVSTNPQRGNR

SEQ ID NO: 11756 - protein, 28 aa, Artificial Sequence
  Description of Artificial Sequence: Synthetic peptide
DEEEIRTTNPVATEQYGSVSTLLQHGGR

SEQ ID NO: 11757 - protein, 28 aa, Artificial Sequence
  Description of Artificial Sequence: Synthetic peptide
DEEEIRTVNPVCTEQYGTVSTNLQRGNR

SEQ ID NO: 11758 - protein, 29 aa, Artificial Sequence
  Description of Artificial Sequence: Synthetic peptide
DEEEIRTTNPVATEQGGSVSTNGEQRGNR

SEQ ID NO: 11759 - protein, 28 aa, Artificial Sequence
  Description of Artificial Sequence: Synthetic peptide
DEEEIRTTNPVATEQYWSVSTDPQRGNR

SEQ ID NO: 11760 - protein, 29 aa, Artificial Sequence
  Description of Artificial Sequence: Synthetic peptide
DEEEIRTTNPVATEQYGSVSTNLDHGNER

SEQ ID NO: 11761 - protein, 29 aa, Artificial Sequence
  Description of Artificial Sequence: Synthetic peptide
DENEIRTTNPVATEQYGIVSTNLQMRGNR

SEQ ID NO: 11762 - protein, 28 aa, Artificial Sequence
  Description of Artificial Sequence: Synthetic peptide
DEEEIRTTNIVATEQYGSVSDNLMRGNR

SEQ ID NO: 11763 - protein, 28 aa, Artificial Sequence
  Description of Artificial Sequence: Synthetic peptide
DEEEIRTTNPVATEQYGSVSTNLERGEF

SEQ ID NO: 11764 - protein, 28 aa, Artificial Sequence
  Description of Artificial Sequence: Synthetic peptide
DEEEIRTTNPVATEQYGDVSTVLQRGMR

SEQ ID NO: 11765 - protein, 29 aa, Artificial Sequence
  Description of Artificial Sequence: Synthetic peptide
DEEEIRTTNPVATEVYGCVSTNLQRNGNR

SEQ ID NO: 11766 - protein, 28 aa, Artificial Sequence
  Description of Artificial Sequence: Synthetic peptide
DEEEIVTTNPVATEQYGSVSTNVQRGNV

SEQ ID NO: 11767 - protein, 28 aa, Artificial Sequence
  Description of Artificial Sequence: Synthetic peptide
DEEEIRTTNPVATECYGSVSTNLQHGNF

SEQ ID NO: 11768 - protein, 28 aa, Artificial Sequence
  Description of Artificial Sequence: Synthetic peptide
NEEEIRTTNPVATEQYGSVSTNLQLGQR

SEQ ID NO: 11769 - protein, 28 aa, Artificial Sequence
  Description of Artificial Sequence: Synthetic peptide
DEEEIRTTNPVATEQYGSVSTPEQRGER

SEQ ID NO: 11770 - protein, 28 aa, Artificial Sequence
  Description of Artificial Sequence: Synthetic peptide
MEQEIRTTNPVATEQYGSVSTNLQRGNM

SEQ ID NO: 11771 - protein, 29 aa, Artificial Sequence
  Description of Artificial Sequence: Synthetic peptide
DEEEIAATNPVATEQYGSVSTNLQREGNR

SEQ ID NO: 11772 - protein, 28 aa, Artificial Sequence
  Description of Artificial Sequence: Synthetic peptide
DEEEIRTTNPVATEQYGSVSTNLMNGNY

SEQ ID NO: 11773 - protein, 29 aa, Artificial Sequence
  Description of Artificial Sequence: Synthetic peptide
DEEEIRATNPVATEQYGSVSTNLQRSGDR

SEQ ID NO: 11774 - protein, 31 aa, Artificial Sequence
  Description of Artificial Sequence: Synthetic polypeptide
DEEEIRTTNPVATEQYGSVSTTNLVQRGENR

SEQ ID NO: 11775 - protein, 30 aa, Artificial Sequence
  Description of Artificial Sequence: Synthetic polypeptide
DEEEIRTTNPVATEQYGSVSETNLERKGNR

SEQ ID NO: 11776 - protein, 28 aa, Artificial Sequence
  Description of Artificial Sequence: Synthetic peptide
DEQEIRTTNIVATEQYGSVSTNDQRGNR

SEQ ID NO: 11777 - protein, 29 aa, Artificial Sequence
  Description of Artificial Sequence: Synthetic peptide
DEQEIRTTNPVATEQYGSVSTNLQYGENR

SEQ ID NO: 11778 - protein, 29 aa, Artificial Sequence
  Description of Artificial Sequence: Synthetic peptide
DEEEIRTTNPVATEQYGSWSTNLQFGINR

SEQ ID NO: 11779 - protein, 29 aa, Artificial Sequence
  Description of Artificial Sequence: Synthetic peptide
DEEEIRTTNPVATEQYGSVSTNEQMQGNR

SEQ ID NO: 11780 - protein, 28 aa, Artificial Sequence
  Description of Artificial Sequence: Synthetic peptide
DEEEIRTTNPVATEQYGVVPTNLQRGNQ

SEQ ID NO: 11781 - protein, 28 aa, Artificial Sequence
  Description of Artificial Sequence: Synthetic peptide
DEGEIVTTNPVATEQYGSVSTNLQRENR

SEQ ID NO: 11782 - protein, 29 aa, Artificial Sequence
  Description of Artificial Sequence: Synthetic peptide
DEEEIRTTNPVATEQYGDVSTNLQDMGNR

SEQ ID NO: 11783 - protein, 31 aa, Artificial Sequence
  Description of Artificial Sequence: Synthetic polypeptide
DEEEIRTTNPVATEQYGSVSDTNLQREGENR

SEQ ID NO: 11784 - protein, 29 aa, Artificial Sequence
  Description of Artificial Sequence: Synthetic peptide
DEEEIRTTNPVATEQYGSVSTNLQTMGNA

SEQ ID NO: 11785 - protein, 28 aa, Artificial Sequence
  Description of Artificial Sequence: Synthetic peptide
DEEEIETTNIVATEQYGSVSTNTQRGNR

SEQ ID NO: 11786 - protein, 28 aa, Artificial Sequence
  Description of Artificial Sequence: Synthetic peptide
DEEEIRTTNPVATEGYGSVSETLQRGNR

SEQ ID NO: 11787 - protein, 28 aa, Artificial Sequence
  Description of Artificial Sequence: Synthetic peptide
SEEEIRTTNPVATEQYGSVSTNLQRGTE

SEQ ID NO: 11788 - protein, 28 aa, Artificial Sequence
  Description of Artificial Sequence: Synthetic peptide
DEEEIRTTNPVATEQYGAVSTNLQNGNS

SEQ ID NO: 11789 - protein, 28 aa, Artificial Sequence
  Description of Artificial Sequence: Synthetic peptide
DEEEIRTTNPIATEQYGSVSENLQVGNR

SEQ ID NO: 11790 - protein, 28 aa, Artificial Sequence
  Description of Artificial Sequence: Synthetic peptide
DEEEIRTTNWVATEQYGSVSTNLQQGNQ

SEQ ID NO: 11791 - protein, 28 aa, Artificial Sequence
  Description of Artificial Sequence: Synthetic peptide
DEEEIRTTNIVATEQYGSVSMNLDRGNR

SEQ ID NO: 11792 - protein, 28 aa, Artificial Sequence
  Description of Artificial Sequence: Synthetic peptide
DEEEIRTTNPVATEQYGIVSTNLQRGTS

SEQ ID NO: 11793 - protein, 28 aa, Artificial Sequence
  Description of Artificial Sequence: Synthetic peptide
DEEEIRCTNPVATEQYGSASMNLQRGNR

SEQ ID NO: 11794 - protein, 28 aa, Artificial Sequence
  Description of Artificial Sequence: Synthetic peptide
SEEEIRTTNPVATEQYGSVSTAEQRGNR

SEQ ID NO: 11795 - protein, 28 aa, Artificial Sequence
  Description of Artificial Sequence: Synthetic peptide
REEEIRTTNPVATEQYGSVSTALERGNR

SEQ ID NO: 11796 - protein, 29 aa, Artificial Sequence
  Description of Artificial Sequence: Synthetic peptide
DEEEIRTTNPVATEQYGSVSTNPLTRGNQ

SEQ ID NO: 11797 - protein, 28 aa, Artificial Sequence
  Description of Artificial Sequence: Synthetic peptide
DEEEIRTTNPVATEQYGSVSTNEQQGNA

SEQ ID NO: 11798 - protein, 28 aa, Artificial Sequence
  Description of Artificial Sequence: Synthetic peptide
DEEEIRTTNPVATESYGCVSTNLQRGND

SEQ ID NO: 11799 - protein, 28 aa, Artificial Sequence
  Description of Artificial Sequence: Synthetic peptide
DEEEIRTTNIVATAQYGSVSTNLQHGNR

SEQ ID NO: 11800 - protein, 28 aa, Artificial Sequence
  Description of Artificial Sequence: Synthetic peptide
NEEEIATTNPVATEQYGSVSTNLERGNR

SEQ ID NO: 11801 - protein, 29 aa, Artificial Sequence
  Description of Artificial Sequence: Synthetic peptide
DEEEIRTTNPVATEQYGSVSTNLQEIGNC

SEQ ID NO: 11802 - protein, 30 aa, Artificial Sequence
  Description of Artificial Sequence: Synthetic polypeptide
DEEEIRTTNPVATEQYGSYVSTCCLQRGNR

SEQ ID NO: 11803 - protein, 29 aa, Artificial Sequence
  Description of Artificial Sequence: Synthetic peptide
DEEEIRTTNPVATECYGSVSTNLQRKGNE

SEQ ID NO: 11804 - protein, 28 aa, Artificial Sequence
  Description of Artificial Sequence: Synthetic peptide
DEEEIRTTNPVATEQYGSVSELEQRGNR

SEQ ID NO: 11805 - protein, 28 aa, Artificial Sequence
  Description of Artificial Sequence: Synthetic peptide
DEEEIRTTNPVATEQYGSVSTNLLYGNV

SEQ ID NO: 11806 - protein, 29 aa, Artificial Sequence
  Description of Artificial Sequence: Synthetic peptide
DEEEIRTTNPVATETYGSVSTCNLQRGNN

SEQ ID NO: 11807 - protein, 28 aa, Artificial Sequence
  Description of Artificial Sequence: Synthetic peptide
DEEEIAQTNPVATEIYGSVSTNLQRGNR

SEQ ID NO: 11808 - protein, 28 aa, Artificial Sequence
  Description of Artificial Sequence: Synthetic peptide
DEEEIRTTNPVATEQYGSVSENEQRGNF

SEQ ID NO: 11809 - protein, 29 aa, Artificial Sequence
  Description of Artificial Sequence: Synthetic peptide
DEQEIRTTNPVATEQYGCVSTNLQREGNR

SEQ ID NO: 11810 - protein, 28 aa, Artificial Sequence
  Description of Artificial Sequence: Synthetic peptide
TEEEIRTTNPVATEQYGSVSTELQRGIR

SEQ ID NO: 11811 - protein, 31 aa, Artificial Sequence
  Description of Artificial Sequence: Synthetic polypeptide
DEEEIRTTNPVATEQYGSVSTNLQLREGQNR

SEQ ID NO: 11812 - protein, 28 aa, Artificial Sequence
  Description of Artificial Sequence: Synthetic peptide
DEEEIRTTNPAATETFGSVSTNLQRGNR

SEQ ID NO: 11813 - protein, 28 aa, Artificial Sequence
  Description of Artificial Sequence: Synthetic peptide
DEEEIRTTNIIATEQYGSVSTELQRGNR

SEQ ID NO: 11814 - protein, 29 aa, Artificial Sequence
  Description of Artificial Sequence: Synthetic peptide
SEEEIRTTNPVATEQYGSVSTNLQQRGNF

SEQ ID NO: 11815 - protein, 28 aa, Artificial Sequence
  Description of Artificial Sequence: Synthetic peptide
NEEEIRTTNPCATEVYGSVSTNLQRGNR

SEQ ID NO: 11816 - protein, 29 aa, Artificial Sequence
  Description of Artificial Sequence: Synthetic peptide
DEEEIRTTNPVATEQYGSVSTNLQELGNN

SEQ ID NO: 11817 - protein, 28 aa, Artificial Sequence
  Description of Artificial Sequence: Synthetic peptide
DEEEIRTTNPCATEQYGWVSDNLQRGNR

SEQ ID NO: 11818 - protein, 28 aa, Artificial Sequence
  Description of Artificial Sequence: Synthetic peptide
DEEEIATTNIFATEQYGSVSTNLQRGNR

SEQ ID NO: 11819 - protein, 28 aa, Artificial Sequence
  Description of Artificial Sequence: Synthetic peptide
DEVEIRCTNPVATEQYGSVSDNLQRGNR

SEQ ID NO: 11820 - protein, 28 aa, Artificial Sequence
  Description of Artificial Sequence: Synthetic peptide
DEEEIRATNPVATEQYGVVSTDLQRGNR

SEQ ID NO: 11821 - protein, 28 aa, Artificial Sequence
  Description of Artificial Sequence: Synthetic peptide
SEEEIRTTNPVATEMYGSVSTDLQRGNR

SEQ ID NO: 11822 - protein, 28 aa, Artificial Sequence
  Description of Artificial Sequence: Synthetic peptide
REEEIRTTNPVATECYGSVSTDLQRGNR

SEQ ID NO: 11823 - protein, 29 aa, Artificial Sequence
  Description of Artificial Sequence: Synthetic peptide
DEEEIRTTNPVATEQYGSVSENLQMRGNF

SEQ ID NO: 11824 - protein, 28 aa, Artificial Sequence
  Description of Artificial Sequence: Synthetic peptide
DEEEIRTTNPVATEQYGDASTNLQRGQR

SEQ ID NO: 11825 - protein, 28 aa, Artificial Sequence
  Description of Artificial Sequence: Synthetic peptide
KEEEIRTTNPVATEQYGSVMTNLQRGIR

SEQ ID NO: 11826 - protein, 28 aa, Artificial Sequence
  Description of Artificial Sequence: Synthetic peptide
FEEEIRTTNPVATEQYGSVSCNLQRGNH

SEQ ID NO: 11827 - protein, 28 aa, Artificial Sequence
  Description of Artificial Sequence: Synthetic peptide
DEEEIVTTNPVATEQYGSVSTNLQNGNF

SEQ ID NO: 11828 - protein, 28 aa, Artificial Sequence
  Description of Artificial Sequence: Synthetic peptide
DEEEICTTNPVATEQYGSVSENLNRGNR

SEQ ID NO: 11829 - protein, 28 aa, Artificial Sequence
  Description of Artificial Sequence: Synthetic peptide
AEEEIRTTNPVATEQYGSVSTNDQIGNR

SEQ ID NO: 11830 - protein, 28 aa, Artificial Sequence
  Description of Artificial Sequence: Synthetic peptide
DEEEIRTTNPVATEHYGSVSTNLQLGNF

SEQ ID NO: 11831 - protein, 28 aa, Artificial Sequence
  Description of Artificial Sequence: Synthetic peptide
DEEEIATTNPVATEQYGSVSTNLQRGPP

SEQ ID NO: 11832 - protein, 28 aa, Artificial Sequence
  Description of Artificial Sequence: Synthetic peptide
DEEEIRTTNIVATEQYGSVSTCLQRGNT

SEQ ID NO: 11833 - protein, 28 aa, Artificial Sequence
  Description of Artificial Sequence: Synthetic peptide
DEEEIRTTNPVATEQYGSVSTNPQNGNN

SEQ ID NO: 11834 - protein, 28 aa, Artificial Sequence
  Description of Artificial Sequence: Synthetic peptide
DEEEIATTNPTATEQYGGVSTNLQRGNR

SEQ ID NO: 11835 - protein, 28 aa, Artificial Sequence
  Description of Artificial Sequence: Synthetic peptide
DEEEIRTTNPVAYGQYGSVSTNDQRGNR

SEQ ID NO: 11836 - protein, 29 aa, Artificial Sequence
  Description of Artificial Sequence: Synthetic peptide
DEEEIRTTNPVATEQYGDVSENLQCRGNR

SEQ ID NO: 11837 - protein, 28 aa, Artificial Sequence
  Description of Artificial Sequence: Synthetic peptide
DEEEIRTTNPVACEQYGSVSENLQWGNR

SEQ ID NO: 11838 - protein, 28 aa, Artificial Sequence
  Description of Artificial Sequence: Synthetic peptide
DEEEIRTTNPVAHEQYGSVATNLQRGNY

SEQ ID NO: 11839 - protein, 28 aa, Artificial Sequence
  Description of Artificial Sequence: Synthetic peptide
QEEEIRATNPVATEQYGSVSTNLQRGMR

SEQ ID NO: 11840 - protein, 28 aa, Artificial Sequence
  Description of Artificial Sequence: Synthetic peptide
DEEEIRTTNPVATEQYGSVSTGDDRGNR

SEQ ID NO: 11841 - protein, 28 aa, Artificial Sequence
  Description of Artificial Sequence: Synthetic peptide
DEEEIRTTNPVATEIYGDVSTNPQRGNR

SEQ ID NO: 11842 - protein, 28 aa, Artificial Sequence
  Description of Artificial Sequence: Synthetic peptide
REEEICTTNPVATEQYGSVSENLQRGNR

SEQ ID NO: 11843 - protein, 28 aa, Artificial Sequence
  Description of Artificial Sequence: Synthetic peptide
YEEEIATTNPVATEQYGSVSTALQRGNR

SEQ ID NO: 11844 - protein, 28 aa, Artificial Sequence
  Description of Artificial Sequence: Synthetic peptide
DENEIRTTNPVATEQWGSVSTNLQRGNA

SEQ ID NO: 11845 - protein, 28 aa, Artificial Sequence
  Description of Artificial Sequence: Synthetic peptide
DEEEIRTTNPVATEQYGSVSTPLQNGER

SEQ ID NO: 11846 - protein, 28 aa, Artificial Sequence
  Description of Artificial Sequence: Synthetic peptide
DEEETRTTNPVATEQYGCTSTNLQRGNR

SEQ ID NO: 11847 - protein, 28 aa, Artificial Sequence
  Description of Artificial Sequence: Synthetic peptide
DEEEITTTNIVATEQYGSVSTNEQRGNR

SEQ ID NO: 11848 - protein, 28 aa, Artificial Sequence
  Description of Artificial Sequence: Synthetic peptide
DEVEIRTTNPVATEQYGSVSTNEQNGNR

SEQ ID NO: 11849 - protein, 30 aa, Artificial Sequence
  Description of Artificial Sequence: Synthetic polypeptide
DEEEIRTTNPVATEQYGSVSFENLQRSGNR

SEQ ID NO: 11850 - protein, 28 aa, Artificial Sequence
  Description of Artificial Sequence: Synthetic peptide
DENEIRTTNPVATEQYGSVSTNLQLGNQ

SEQ ID NO: 11851 - protein, 28 aa, Artificial Sequence
  Description of Artificial Sequence: Synthetic peptide
DEEEIRTTNPVATEQYGSVDENLQQGNR

SEQ ID NO: 11852 - protein, 28 aa, Artificial Sequence
  Description of Artificial Sequence: Synthetic peptide
AEEEIRQTNPVATEQYGSVDTNLQRGNR

SEQ ID NO: 11853 - protein, 28 aa, Artificial Sequence
  Description of Artificial Sequence: Synthetic peptide
DEEEIRTTNPVATEQYGVVSENLQRGND

SEQ ID NO: 11854 - protein, 28 aa, Artificial Sequence
  Description of Artificial Sequence: Synthetic peptide
DEEEIRTTNPVATEQYGSVATNLQLGNS

SEQ ID NO: 11855 - protein, 28 aa, Artificial Sequence
  Description of Artificial Sequence: Synthetic peptide
DEEEIRTTNPVATEQYGVVGTNEQRGNR

SEQ ID NO: 11856 - protein, 28 aa, Artificial Sequence
  Description of Artificial Sequence: Synthetic peptide
DEEEIRSTNPVATEMYGVVSTNLQRGNR

SEQ ID NO: 11857 - protein, 28 aa, Artificial Sequence
  Description of Artificial Sequence: Synthetic peptide
DEEEIRTTNPVATECYGSVSTNLQLGNS

SEQ ID NO: 11858 - protein, 28 aa, Artificial Sequence
  Description of Artificial Sequence: Synthetic peptide
DEEEIRTTNPVSYELYGSVSTNLQRGNR

SEQ ID NO: 11859 - protein, 28 aa, Artificial Sequence
  Description of Artificial Sequence: Synthetic peptide
DEEEIRTTNPVATEQYGWVSENLQRGER

SEQ ID NO: 11860 - protein, 28 aa, Artificial Sequence
  Description of Artificial Sequence: Synthetic peptide
QEEEIRTTNPVATEMYGSVSENLQRGNR

SEQ ID NO: 11861 - protein, 28 aa, Artificial Sequence
  Description of Artificial Sequence: Synthetic peptide
DDEEIRTTNPVATEQYGSVSTNLQRLQR

SEQ ID NO: 11862 - protein, 28 aa, Artificial Sequence
  Description of Artificial Sequence: Synthetic peptide
DEEEIRTTNPVATEQYGSVSTNEQIGNF

SEQ ID NO: 11863 - protein, 28 aa, Artificial Sequence
  Description of Artificial Sequence: Synthetic peptide
DEEEIRTTNPVATEQYGSVSENLQYGNA

SEQ ID NO: 11864 - protein, 28 aa, Artificial Sequence
  Description of Artificial Sequence: Synthetic peptide
DEEEIRCTNPVATEVYGVVSTNLQRGNR

SEQ ID NO: 11865 - protein, 28 aa, Artificial Sequence
  Description of Artificial Sequence: Synthetic peptide
DEEEIRTTNIVATEQYGSVSTNLQRLNY

SEQ ID NO: 11866 - protein, 28 aa, Artificial Sequence
  Description of Artificial Sequence: Synthetic peptide
KEEEIRTTNPVATEQYGSVSTNLQHGER

SEQ ID NO: 11867 - protein, 30 aa, Artificial Sequence
  Description of Artificial Sequence: Synthetic polypeptide
DEEEIRTTNPVATEQYGSVSVTDLQRGINR

SEQ ID NO: 11868 - protein, 28 aa, Artificial Sequence
  Description of Artificial Sequence: Synthetic peptide
DEEEIRTTNPVATEGYGSVSTNLQTGER

SEQ ID NO: 11869 - protein, 28 aa, Artificial Sequence
  Description of Artificial Sequence: Synthetic peptide
KEEEIRTTNPVATEQYGSVSENLQRGNS

SEQ ID NO: 11870 - protein, 29 aa, Artificial Sequence
  Description of Artificial Sequence: Synthetic peptide
DEQEIRTTNPVATEQYGSVSTNLQDNGNR

SEQ ID NO: 11871 - protein, 28 aa, Artificial Sequence
  Description of Artificial Sequence: Synthetic peptide
DEEEIRTTNIVATEIYGSVSDNLQRGNR

SEQ ID NO: 11872 - protein, 28 aa, Artificial Sequence
  Description of Artificial Sequence: Synthetic peptide
DEEEIRTTNPVATEQYGQVSTNLQRGGD

SEQ ID NO: 11873 - protein, 29 aa, Artificial Sequence
  Description of Artificial Sequence: Synthetic peptide
DEEEIRTTNPVATEQYGSVSTNLQVPGNI

SEQ ID NO: 11874 - protein, 28 aa, Artificial Sequence
  Description of Artificial Sequence: Synthetic peptide
DEEEIRTTNPVATEQYGIVSTNLQRGDS

SEQ ID NO: 11875 - protein, 28 aa, Artificial Sequence
  Description of Artificial Sequence: Synthetic peptide
DEEEIRTTNPVATEQFGSVSNNLQHGNR

SEQ ID NO: 11876 - protein, 28 aa, Artificial Sequence
  Description of Artificial Sequence: Synthetic peptide
DEEEIRTTNPVATEQYGEVSENLQRGNF

SEQ ID NO: 11877 - protein, 28 aa, Artificial Sequence
  Description of Artificial Sequence: Synthetic peptide
DEEEIRPTNPVATEQYGCWSTNLQRGNR

SEQ ID NO: 11878 - protein, 29 aa, Artificial Sequence
  Description of Artificial Sequence: Synthetic peptide
DEEEIRTTNPVATEQWGSVSTNDQWRGNR

SEQ ID NO: 11879 - protein, 29 aa, Artificial Sequence
  Description of Artificial Sequence: Synthetic peptide
DEEEIRTTNPVCTEQYGSVSTNLQRGPNF

SEQ ID NO: 11880 - protein, 28 aa, Artificial Sequence
  Description of Artificial Sequence: Synthetic peptide
DEEEIRTTNPVATEQYGSVSTNEMQGNR

SEQ ID NO: 11881 - protein, 28 aa, Artificial Sequence
  Description of Artificial Sequence: Synthetic peptide
CEEEIRTTNPVATEVYGSVSTNLQRENR

SEQ ID NO: 11882 - protein, 28 aa, Artificial Sequence
  Description of Artificial Sequence: Synthetic peptide
DEEEIRTTNPVATECYGSVSTNLQSGNS

SEQ ID NO: 11883 - protein, 28 aa, Artificial Sequence
  Description of Artificial Sequence: Synthetic peptide
DEEEIRTTNPTATEQYGSVSTNLQFGTR

SEQ ID NO: 11884 - protein, 28 aa, Artificial Sequence
  Description of Artificial Sequence: Synthetic peptide
DEEEIRTTNPVATEQYGSVSENLQNGNA

SEQ ID NO: 11885 - protein, 28 aa, Artificial Sequence
  Description of Artificial Sequence: Synthetic peptide
DEEEIRTTNPVATEQYGSVSTELQMGNN

SEQ ID NO: 11886 - protein, 28 aa, Artificial Sequence
  Description of Artificial Sequence: Synthetic peptide
MEEEIATTNPVATEQYGSVSENLQRGNR

SEQ ID NO: 11887 - protein, 28 aa, Artificial Sequence
  Description of Artificial Sequence: Synthetic peptide
NEEEIRTTNPVCTEQYGSVSTNLQRGND

SEQ ID NO: 11888 - protein, 28 aa, Artificial Sequence
  Description of Artificial Sequence: Synthetic peptide
DEEEIRTTNPVATEQYGSVSTNLERGEL

SEQ ID NO: 11889 - protein, 28 aa, Artificial Sequence
  Description of Artificial Sequence: Synthetic peptide
DEQEIRTTNPVATEQYGSVSTNDQHGNR

SEQ ID NO: 11890 - protein, 28 aa, Artificial Sequence
  Description of Artificial Sequence: Synthetic peptide
DEEEIRTVNPVACEQYGSVSTNLYRGNR

SEQ ID NO: 11891 - protein, 28 aa, Artificial Sequence
  Description of Artificial Sequence: Synthetic peptide
DEEEIRTTNPVATEVYGDVSDNLQRGNR

SEQ ID NO: 11892 - protein, 28 aa, Artificial Sequence
  Description of Artificial Sequence: Synthetic peptide
DEEEIRTTNPVAYEQYGSVSENLQRGNS

SEQ ID NO: 11893 - protein, 28 aa, Artificial Sequence
  Description of Artificial Sequence: Synthetic peptide
DEEEIRTTNPVSTEQYGSVSENLQRMNR

SEQ ID NO: 11894 - protein, 28 aa, Artificial Sequence
  Description of Artificial Sequence: Synthetic peptide
DEEEIRTTNPTATEQYGSVSTNLQQGNV

SEQ ID NO: 11895 - protein, 30 aa, Artificial Sequence
  Description of Artificial Sequence: Synthetic polypeptide
DEEEIRTTNPVATEIYGSVSTNLQLREGNR

SEQ ID NO: 11896 - protein, 28 aa, Artificial Sequence
  Description of Artificial Sequence: Synthetic peptide
DEEEIRTTNPVATEQYGSVSTNEQNGNS

SEQ ID NO: 11897 - protein, 28 aa, Artificial Sequence
  Description of Artificial Sequence: Synthetic peptide
SEEEIRTTNPVATEQFGSVSENLQRGNR

SEQ ID NO: 11898 - protein, 28 aa, Artificial Sequence
  Description of Artificial Sequence: Synthetic peptide
DEFEIRTTNPVATEQYGSVSTNLEHGNR

SEQ ID NO: 11899 - protein, 28 aa, Artificial Sequence
  Description of Artificial Sequence: Synthetic peptide
DENEIRTTNPVATEQYGSVSTNLQTGNT

SEQ ID NO: 11900 - protein, 28 aa, Artificial Sequence
  Description of Artificial Sequence: Synthetic peptide
DEEEIRSTNPVATEQYGSVATNLQRGER

SEQ ID NO: 11901 - protein, 28 aa, Artificial Sequence
  Description of Artificial Sequence: Synthetic peptide
DEEEIRTTNIVATEQYGSVSTILQRGNQ

SEQ ID NO: 11902 - protein, 28 aa, Artificial Sequence
  Description of Artificial Sequence: Synthetic peptide
DEEEIRTTNPVATEQYGSVSTPLQRGES

SEQ ID NO: 11903 - protein, 29 aa, Artificial Sequence
  Description of Artificial Sequence: Synthetic peptide
DEEEIRTTNPVATEQYGSVSTNLQRKGEL

SEQ ID NO: 11904 - protein, 28 aa, Artificial Sequence
  Description of Artificial Sequence: Synthetic peptide
DEEEIRTTNPVATEQYGSVSTNLQVGEN

SEQ ID NO: 11905 - protein, 28 aa, Artificial Sequence
  Description of Artificial Sequence: Synthetic peptide
DEEEIRTTNPVATELYGSVSTNLQQGNM

SEQ ID NO: 11906 - protein, 29 aa, Artificial Sequence
  Description of Artificial Sequence: Synthetic peptide
DEEEIRTTNPVATEQYGSVSVNLQLGNLR

SEQ ID NO: 11907 - protein, 29 aa, Artificial Sequence
  Description of Artificial Sequence: Synthetic peptide
DEEEIRTTNPVATEQYGDVSAENLQRGNR

SEQ ID NO: 11908 - protein, 28 aa, Artificial Sequence
  Description of Artificial Sequence: Synthetic peptide
DEEEIATTNPVATEQYGSVSTNLQNGNS

SEQ ID NO: 11909 - protein, 28 aa, Artificial Sequence
  Description of Artificial Sequence: Synthetic peptide
DEEEIRTTNPVATEQYGSVSTNLIQGNF

SEQ ID NO: 11910 - protein, 28 aa, Artificial Sequence
  Description of Artificial Sequence: Synthetic peptide
DENEIRTTNPVATEQYGSVSENLQQGNR

SEQ ID NO: 11911 - protein, 28 aa, Artificial Sequence
  Description of Artificial Sequence: Synthetic peptide
DETEIRTTNPVATEQYGSVSENLQRFNR

SEQ ID NO: 11912 - protein, 29 aa, Artificial Sequence
  Description of Artificial Sequence: Synthetic peptide
DEEEVRSTNPVATEQYGSVSSTNLQRGNR

SEQ ID NO: 11913 - protein, 28 aa, Artificial Sequence
  Description of Artificial Sequence: Synthetic peptide
DEEEIATTNPVADEQYGSVSTNLQRGNK

SEQ ID NO: 11914 - protein, 28 aa, Artificial Sequence
  Description of Artificial Sequence: Synthetic peptide
DEEEIRATNPVATEQYGSASTNLQRGND

SEQ ID NO: 11915 - protein, 28 aa, Artificial Sequence
  Description of Artificial Sequence: Synthetic peptide
DEEEISTTNPVATEQYGWVSDNLQRGNR

SEQ ID NO: 11916 - protein, 28 aa, Artificial Sequence
  Description of Artificial Sequence: Synthetic peptide
DEEEIRTTNPVATETYGSVSTNLQRGTS

SEQ ID NO: 11917 - protein, 28 aa, Artificial Sequence
  Description of Artificial Sequence: Synthetic peptide
DEEEVRTTNPVATEQYGSVSTNLQMGNL

SEQ ID NO: 11918 - protein, 28 aa, Artificial Sequence
  Description of Artificial Sequence: Synthetic peptide
DEEEIRQTNPVATECYGSVSDNLQRGNR

SEQ ID NO: 11919 - protein, 28 aa, Artificial Sequence
  Description of Artificial Sequence: Synthetic peptide
DEDEISTTNPVATEQYGWVSTNLQRGNR

SEQ ID NO: 11920 - protein, 28 aa, Artificial Sequence
  Description of Artificial Sequence: Synthetic peptide
DEEEIRTTNPVATEMYGVVSTNLQRGNF

SEQ ID NO: 11921 - protein, 29 aa, Artificial Sequence
  Description of Artificial Sequence: Synthetic peptide
DEEEIRTTNPVATEWYGSVDTNLQNRGNR

SEQ ID NO: 11922 - protein, 28 aa, Artificial Sequence
  Description of Artificial Sequence: Synthetic peptide
DEEEIRTTNPVATEQYGSVSTNLQNGEL

SEQ ID NO: 11923 - protein, 28 aa, Artificial Sequence
  Description of Artificial Sequence: Synthetic peptide
QEEEIRTTNIVATEQYGSVSTNLQRGNC

SEQ ID NO: 11924 - protein, 30 aa, Artificial Sequence
  Description of Artificial Sequence: Synthetic polypeptide
DEEEIRTTNPVATEQYGSVTSTALQRDGNR

SEQ ID NO: 11925 - protein, 28 aa, Artificial Sequence
  Description of Artificial Sequence: Synthetic peptide
DEEEIRTTNPVATEQYGSVSEPLQRENR

SEQ ID NO: 11926 - protein, 30 aa, Artificial Sequence
  Description of Artificial Sequence: Synthetic polypeptide
DEEEIRTTNPVATEQYGSVSTMNLQLKGNR

SEQ ID NO: 11927 - protein, 29 aa, Artificial Sequence
  Description of Artificial Sequence: Synthetic peptide
DEEEIRTTNPVATEQYGSTSTNLQRKGND

SEQ ID NO: 11928 - protein, 28 aa, Artificial Sequence
  Description of Artificial Sequence: Synthetic peptide
MEEEIRTTNPVATEQYGSVSTDLQRGNI

SEQ ID NO: 11929 - protein, 28 aa, Artificial Sequence
  Description of Artificial Sequence: Synthetic peptide
DEEEIRTTNPVASEVYGTVSTNLQRGNR

SEQ ID NO: 11930 - protein, 28 aa, Artificial Sequence
  Description of Artificial Sequence: Synthetic peptide
DEEEVRTTNPVATEQYGCVSTNLERGNR

SEQ ID NO: 11931 - protein, 28 aa, Artificial Sequence
  Description of Artificial Sequence: Synthetic peptide
DEEEIRTTNPVATEQYGSVSTNLQVGEF

SEQ ID NO: 11932 - protein, 30 aa, Artificial Sequence
  Description of Artificial Sequence: Synthetic polypeptide
DEEEIRTTNPVAWEQYGMSVSTNLQLRGNR

SEQ ID NO: 11933 - protein, 28 aa, Artificial Sequence
  Description of Artificial Sequence: Synthetic peptide
DEEEIRATNPVATEQFGSVSTNLQRGNF

SEQ ID NO: 11934 - protein, 28 aa, Artificial Sequence
  Description of Artificial Sequence: Synthetic peptide
AEEEIRTTNIVATEQYGSVSTNDQRGNR

SEQ ID NO: 11935 - protein, 28 aa, Artificial Sequence
  Description of Artificial Sequence: Synthetic peptide
QEEEIRTTNPVATEQYGSVSENLQRGNF

SEQ ID NO: 11936 - protein, 28 aa, Artificial Sequence
  Description of Artificial Sequence: Synthetic peptide
DEEEIRTTNPVAYELYGSVSTNLQRGNP

SEQ ID NO: 11937 - protein, 29 aa, Artificial Sequence
  Description of Artificial Sequence: Synthetic peptide
DEEEIRTTNPVATEQYGCVATNLQREGNR

SEQ ID NO: 11938 - protein, 29 aa, Artificial Sequence
  Description of Artificial Sequence: Synthetic peptide
DEETIRTTNPVATEQYGSVSSTNLQLGNR

SEQ ID NO: 11939 - protein, 28 aa, Artificial Sequence
  Description of Artificial Sequence: Synthetic peptide
DEEEIRTTNPVATEQYGSVSTDLERGND

SEQ ID NO: 11940 - protein, 31 aa, Artificial Sequence
  Description of Artificial Sequence: Synthetic polypeptide
DEEEIRTTNPVATEQYGSVSETNLVQRGENR

SEQ ID NO: 11941 - protein, 28 aa, Artificial Sequence
  Description of Artificial Sequence: Synthetic peptide
DEEEIRTTNPVATEQYGSVSTAPERGNR

SEQ ID NO: 11942 - protein, 28 aa, Artificial Sequence
  Description of Artificial Sequence: Synthetic peptide
DEEEIRTTNIVCTEQYGSVSTNLQLGNR

SEQ ID NO: 11943 - protein, 28 aa, Artificial Sequence
  Description of Artificial Sequence: Synthetic peptide
DEEEIRTTNPVATEQYGSVSTNLEPGNA

SEQ ID NO: 11944 - protein, 28 aa, Artificial Sequence
  Description of Artificial Sequence: Synthetic peptide
DEEEIRTTNPVATEQYGSVSTNLQHFQR

SEQ ID NO: 11945 - protein, 28 aa, Artificial Sequence
  Description of Artificial Sequence: Synthetic peptide
DEEEIRTTNPVATEQYGSVSENLQYGNL

SEQ ID NO: 11946 - protein, 28 aa, Artificial Sequence
  Description of Artificial Sequence: Synthetic peptide
DEEEIRTTNPVATEQYGSVSTNPQVGNV

SEQ ID NO: 11947 - protein, 30 aa, Artificial Sequence
  Description of Artificial Sequence: Synthetic polypeptide
DEEEIRTTNPVATEQYGSVSTNLQDRGNTA

SEQ ID NO: 11948 - protein, 28 aa, Artificial Sequence
  Description of Artificial Sequence: Synthetic peptide
DEEEIRTTNPCATEQYGSVSTNLNVGNR

SEQ ID NO: 11949 - protein, 28 aa, Artificial Sequence
  Description of Artificial Sequence: Synthetic peptide
DEEEIRTTNPVATEQYGSVSTNLTGGNY

SEQ ID NO: 11950 - protein, 30 aa, Artificial Sequence
  Description of Artificial Sequence: Synthetic polypeptide
DEEEIRTTNPVATEQYGSVSTNLQERGEDR

SEQ ID NO: 11951 - protein, 28 aa, Artificial Sequence
  Description of Artificial Sequence: Synthetic peptide
DEEEIRTTNPVSSEQYGSVSTNLQHGNR

SEQ ID NO: 11952 - protein, 28 aa, Artificial Sequence
  Description of Artificial Sequence: Synthetic peptide
DEEEIATTNPVATEQYGSVSTNEQRGNI

SEQ ID NO: 11953 - protein, 29 aa, Artificial Sequence
  Description of Artificial Sequence: Synthetic peptide
DEEEIRCTNPVATEQYGSVSTNLQSRGNL

SEQ ID NO: 11954 - protein, 28 aa, Artificial Sequence
  Description of Artificial Sequence: Synthetic peptide
DENEIRTTNPVATEQYGSVSTNLQLGND

SEQ ID NO: 11955 - protein, 28 aa, Artificial Sequence
  Description of Artificial Sequence: Synthetic peptide
SEEEIRTTNPVATEQYGSVSTNEQRGTR

SEQ ID NO: 11956 - protein, 28 aa, Artificial Sequence
  Description of Artificial Sequence: Synthetic peptide
DPEEIRTTNPVAWEQYGSVSTNLQRGLR

SEQ ID NO: 11957 - protein, 28 aa, Artificial Sequence
  Description of Artificial Sequence: Synthetic peptide
DENEIRTTNPVATEQWGSVSENLQRGNR

SEQ ID NO: 11958 - protein, 28 aa, Artificial Sequence
  Description of Artificial Sequence: Synthetic peptide
DEEEIRTTNPVATEQYGSVSENLQAGNL

SEQ ID NO: 11959 - protein, 28 aa, Artificial Sequence
  Description of Artificial Sequence: Synthetic peptide
DEEEIRTTNPDATQQYGSVSTPLQRGNR

SEQ ID NO: 11960 - protein, 28 aa, Artificial Sequence
  Description of Artificial Sequence: Synthetic peptide
DEEEIRTTNIVATEQYGSVLTNLQHGNR

SEQ ID NO: 11961 - protein, 28 aa, Artificial Sequence
  Description of Artificial Sequence: Synthetic peptide
DEQEIRTTNPVATEQYGSVSTNLQPGNI

SEQ ID NO: 11962 - protein, 28 aa, Artificial Sequence
  Description of Artificial Sequence: Synthetic peptide
DEEEIATTNPVATEQYGSVSTNLQHGER

SEQ ID NO: 11963 - protein, 28 aa, Artificial Sequence
  Description of Artificial Sequence: Synthetic peptide
DEEEIRTTNPVATEQYGDVSTILQRGER

SEQ ID NO: 11964 - protein, 28 aa, Artificial Sequence
  Description of Artificial Sequence: Synthetic peptide
DEEEIRTTNPVATEQYGSVSENLQRMDR

SEQ ID NO: 11965 - protein, 29 aa, Artificial Sequence
  Description of Artificial Sequence: Synthetic peptide
DEEEIRTTNPVATEQYGSVSTNLQINGNA

SEQ ID NO: 11966 - protein, 28 aa, Artificial Sequence
  Description of Artificial Sequence: Synthetic peptide
DEGEIRTTNPVATEQYGSVSTNLQRGMM

SEQ ID NO: 11967 - protein, 28 aa, Artificial Sequence
  Description of Artificial Sequence: Synthetic peptide
DEEEIRTTNPVATEQYGDASTNLQRPNR

SEQ ID NO: 11968 - protein, 31 aa, Artificial Sequence
  Description of Artificial Sequence: Synthetic polypeptide
DEEEIRTTNPVATEQYGSVCSTENLQRGENR

SEQ ID NO: 11969 - protein, 30 aa, Artificial Sequence
  Description of Artificial Sequence: Synthetic polypeptide
DEEEIRTTNPVATEQYGSVDSTNQQRGENR

SEQ ID NO: 11970 - protein, 28 aa, Artificial Sequence
  Description of Artificial Sequence: Synthetic peptide
DEEEIGTTNPVATEQYGDVSTNLQRGNT

SEQ ID NO: 11971 - protein, 29 aa, Artificial Sequence
  Description of Artificial Sequence: Synthetic peptide
DEEEIRTTNPVATEIYGSVSATNLERGNR

SEQ ID NO: 11972 - protein, 28 aa, Artificial Sequence
  Description of Artificial Sequence: Synthetic peptide
DEEEIATTNIVATEQYGSVSTNLQRGTR

SEQ ID NO: 11973 - protein, 28 aa, Artificial Sequence
  Description of Artificial Sequence: Synthetic peptide
DEEEIRTTNPCATEQYGSVSENLQRGNA

SEQ ID NO: 11974 - protein, 29 aa, Artificial Sequence
  Description of Artificial Sequence: Synthetic peptide
DEEEIRTTNPVATEQWGSVSTNLQNIGNR

SEQ ID NO: 11975 - protein, 28 aa, Artificial Sequence
  Description of Artificial Sequence: Synthetic peptide
DEEEIRCTNPVATEQFGVVSTNLQRGNR

SEQ ID NO: 11976 - protein, 28 aa, Artificial Sequence
  Description of Artificial Sequence: Synthetic peptide
DEVEIRTTNIVATEQYGSVSTNLQRGNL

SEQ ID NO: 11977 - protein, 29 aa, Artificial Sequence
  Description of Artificial Sequence: Synthetic peptide
DEEEIRTTNPVATEQYYGSVSTNLQYGNH

SEQ ID NO: 11978 - protein, 28 aa, Artificial Sequence
  Description of Artificial Sequence: Synthetic peptide
DEEEIRTTNPVATEVYGSVATNLQRGNW

SEQ ID NO: 11979 - protein, 28 aa, Artificial Sequence
  Description of Artificial Sequence: Synthetic peptide
DEQEITTTNPVATEQYGSVSENLQRGNR

SEQ ID NO: 11980 - protein, 30 aa, Artificial Sequence
  Description of Artificial Sequence: Synthetic polypeptide
DEEEIRTTNPVATEQYGSVSTNLQRGDTTR

SEQ ID NO: 11981 - protein, 29 aa, Artificial Sequence
  Description of Artificial Sequence: Synthetic peptide
DEEEIRTTNPVATEQWGSVSTNLQMRGNM

SEQ ID NO: 11982 - protein, 28 aa, Artificial Sequence
  Description of Artificial Sequence: Synthetic peptide
SEEEIRTTNPVATEQYGSVSTNLQSGNA

SEQ ID NO: 11983 - protein, 28 aa, Artificial Sequence
  Description of Artificial Sequence: Synthetic peptide
DEEEIRTTNPVGTEQYGSVSDNLQRGNQ

SEQ ID NO: 11984 - protein, 28 aa, Artificial Sequence
  Description of Artificial Sequence: Synthetic peptide
DEEEIRATNPVATENYGVVSTNLQRGNR

SEQ ID NO: 11985 - protein, 28 aa, Artificial Sequence
  Description of Artificial Sequence: Synthetic peptide
DEEEIRATNPVATEQYGIVSTNLQRGNA

SEQ ID NO: 11986 - protein, 29 aa, Artificial Sequence
  Description of Artificial Sequence: Synthetic peptide
DEEEIRTTNPVATEQYGSVSTNLQSNGER

SEQ ID NO: 11987 - protein, 29 aa, Artificial Sequence
  Description of Artificial Sequence: Synthetic peptide
DEVEIRTTNPVATEQYGSVSTTNLQNGNR

SEQ ID NO: 11988 - protein, 29 aa, Artificial Sequence
  Description of Artificial Sequence: Synthetic peptide
DEEEIRTTNPVATECYGSVSTNLQRNGNV

SEQ ID NO: 11989 - protein, 28 aa, Artificial Sequence
  Description of Artificial Sequence: Synthetic peptide
DENEIRTTNPVATECYGSVSTNEQRGNR

SEQ ID NO: 11990 - protein, 28 aa, Artificial Sequence
  Description of Artificial Sequence: Synthetic peptide
DEEEIRTTNIVATEQYGSVSTILQRGER

SEQ ID NO: 11991 - protein, 28 aa, Artificial Sequence
  Description of Artificial Sequence: Synthetic peptide
DEEEIRTTNPVATEQYGSVSECLQRENR

SEQ ID NO: 11992 - protein, 28 aa, Artificial Sequence
  Description of Artificial Sequence: Synthetic peptide
DEEEIRTTNIVATEQYGEVSTNLQRGMR

SEQ ID NO: 11993 - protein, 30 aa, Artificial Sequence
  Description of Artificial Sequence: Synthetic polypeptide
DEEEIRTTNPVATEQYGSVSTGNLQREGNA

SEQ ID NO: 11994 - protein, 28 aa, Artificial Sequence
  Description of Artificial Sequence: Synthetic peptide
DEEEIRTTNPVATELYGSVSANLQHGNR

SEQ ID NO: 11995 - protein, 28 aa, Artificial Sequence
  Description of Artificial Sequence: Synthetic peptide
DEEEIRTTNPVATEQYGSVSTPDQRGNV

SEQ ID NO: 11996 - protein, 28 aa, Artificial Sequence
  Description of Artificial Sequence: Synthetic peptide
DEEEIRTTNIVATEQYGLVSTNLQRGNI

SEQ ID NO: 11997 - protein, 29 aa, Artificial Sequence
  Description of Artificial Sequence: Synthetic peptide
DEEEIRTTNPVATEQYGSVSTNLQIHGNM

SEQ ID NO: 11998 - protein, 28 aa, Artificial Sequence
  Description of Artificial Sequence: Synthetic peptide
SEEEIRTTNIVATEEYGSVSTNLQRGNR

SEQ ID NO: 11999 - protein, 28 aa, Artificial Sequence
  Description of Artificial Sequence: Synthetic peptide
SEEEIRTTNPVATEQYGSVETNLQQGNR

SEQ ID NO: 12000 - protein, 28 aa, Artificial Sequence
  Description of Artificial Sequence: Synthetic peptide
DEEEIRSTNPVATEQYGSVSSDLQRGNR

SEQ ID NO: 12001 - protein, 28 aa, Artificial Sequence
  Description of Artificial Sequence: Synthetic peptide
DEQEIRCTNPVATEQYGSVATNLQRGNR

SEQ ID NO: 12002 - protein, 28 aa, Artificial Sequence
  Description of Artificial Sequence: Synthetic peptide
DEHEIRTTNPVCTEQYGSVSTNLQRGNQ

SEQ ID NO: 12003 - protein, 28 aa, Artificial Sequence
  Description of Artificial Sequence: Synthetic peptide
DEEEIRTTNPVATEQYGSVSTDLQNGNT

SEQ ID NO: 12004 - protein, 28 aa, Artificial Sequence
  Description of Artificial Sequence: Synthetic peptide
SEEEIRTTNPVATELYGSVSTNLQRGDR

SEQ ID NO: 12005 - protein, 28 aa, Artificial Sequence
  Description of Artificial Sequence: Synthetic peptide
TEEPIRTTNPVACEQYGSVSTNLQRGNR

SEQ ID NO: 12006 - protein, 28 aa, Artificial Sequence
  Description of Artificial Sequence: Synthetic peptide
DEEEIRTTNPVATECYGSVSTNLQVGER

SEQ ID NO: 12007 - protein, 29 aa, Artificial Sequence
  Description of Artificial Sequence: Synthetic peptide
DEEAIRTTNPVATEIYGSVSTNLQRWGNR

SEQ ID NO: 12008 - protein, 29 aa, Artificial Sequence
  Description of Artificial Sequence: Synthetic peptide
DEEEIRTTNPVATEQYGCSVSTNQQNGNR

SEQ ID NO: 12009 - protein, 28 aa, Artificial Sequence
  Description of Artificial Sequence: Synthetic peptide
DEEEIRTTNPVATEQYGSISTNLQLGNS

SEQ ID NO: 12010 - protein, 28 aa, Artificial Sequence
  Description of Artificial Sequence: Synthetic peptide
MEEEIRTTNPVATECYGSVSTNLQRGNQ

SEQ ID NO: 12011 - protein, 29 aa, Artificial Sequence
  Description of Artificial Sequence: Synthetic peptide
DEEEIRTTNPVATEQYGVVDTTNLQRGNR

SEQ ID NO: 12012 - protein, 28 aa, Artificial Sequence
  Description of Artificial Sequence: Synthetic peptide
DEEEIRTTNPVATEQYGSVSDNLQFGNF

SEQ ID NO: 12013 - protein, 29 aa, Artificial Sequence
  Description of Artificial Sequence: Synthetic peptide
DEGEIRTTNPVATEQYGSVSATNLQRGNQ

SEQ ID NO: 12014 - protein, 28 aa, Artificial Sequence
  Description of Artificial Sequence: Synthetic peptide
GEGEIRTTNPVATEQYGSVGTNLQRGNR

SEQ ID NO: 12015 - protein, 28 aa, Artificial Sequence
  Description of Artificial Sequence: Synthetic peptide
DEEEIRTTNPVATEQYGSVSTDLQWGER

SEQ ID NO: 12016 - protein, 30 aa, Artificial Sequence
  Description of Artificial Sequence: Synthetic polypeptide
DEEEIRTTNPVATEQYGSVSTNLQRGDNTF

SEQ ID NO: 12017 - protein, 28 aa, Artificial Sequence
  Description of Artificial Sequence: Synthetic peptide
DEEEIRTTNPVATEQYGWASTNLQRGGR

SEQ ID NO: 12018 - protein, 29 aa, Artificial Sequence
  Description of Artificial Sequence: Synthetic peptide
DEEEIRTTNPVATEQYGSVSTDLQRGNDF

SEQ ID NO: 12019 - protein, 28 aa, Artificial Sequence
  Description of Artificial Sequence: Synthetic peptide
DEEEIRTTNPVATEQYGVVSTNLQPGNV

SEQ ID NO: 12020 - protein, 28 aa, Artificial Sequence
  Description of Artificial Sequence: Synthetic peptide
DEEEIRTTNPVATEQFGSVSTNLQHGDR

SEQ ID NO: 12021 - protein, 30 aa, Artificial Sequence
  Description of Artificial Sequence: Synthetic polypeptide
DEEEIRTTNPVATEQYGSVSTNLQREGNDQ

SEQ ID NO: 12022 - protein, 28 aa, Artificial Sequence
  Description of Artificial Sequence: Synthetic peptide
KEEEIRTTNPVATEQYGSVSTNLQQGNS

SEQ ID NO: 12023 - protein, 30 aa, Artificial Sequence
  Description of Artificial Sequence: Synthetic polypeptide
DEEEIRTTNPVATEQYGSVSTGNLQQGNDR

SEQ ID NO: 12024 - protein, 28 aa, Artificial Sequence
  Description of Artificial Sequence: Synthetic peptide
GEEEIRTTNPVATEQYGTVSTNLQVGNR

SEQ ID NO: 12025 - protein, 28 aa, Artificial Sequence
  Description of Artificial Sequence: Synthetic peptide
DEEEIATTNPVCTEQYGSVSTNLQRGNL

SEQ ID NO: 12026 - protein, 28 aa, Artificial Sequence
  Description of Artificial Sequence: Synthetic peptide
DEEEIRTTNPVATEQYGSVSTNPIRGNT

SEQ ID NO: 12027 - protein, 29 aa, Artificial Sequence
  Description of Artificial Sequence: Synthetic peptide
DEEEIRTTNPVATEQYGDVSDNLQQRGNR

SEQ ID NO: 12028 - protein, 28 aa, Artificial Sequence
  Description of Artificial Sequence: Synthetic peptide
DEEEIRTTNPVATEQYGSTSTLLQRGNQ

SEQ ID NO: 12029 - protein, 28 aa, Artificial Sequence
  Description of Artificial Sequence: Synthetic peptide
DEEEIRTTNPVATEQYGSVSENLQMGNL

SEQ ID NO: 12030 - protein, 28 aa, Artificial Sequence
  Description of Artificial Sequence: Synthetic peptide
DEEEIRTTNPVATEQWGSVSTNLQAGNT

SEQ ID NO: 12031 - protein, 28 aa, Artificial Sequence
  Description of Artificial Sequence: Synthetic peptide
DEEEIRTTNIVATEQWGCVSTNLQRGNR

SEQ ID NO: 12032 - protein, 28 aa, Artificial Sequence
  Description of Artificial Sequence: Synthetic peptide
DEEEIRTTNPEATEVYGSVSTNLQRGNQ

SEQ ID NO: 12033 - protein, 28 aa, Artificial Sequence
  Description of Artificial Sequence: Synthetic peptide
DEEEIRTTNPVATEQYGSVSTELQGGNW

SEQ ID NO: 12034 - protein, 29 aa, Artificial Sequence
  Description of Artificial Sequence: Synthetic peptide
DEEEIRCTNPVATEQYGSVSATNDQRGNR

SEQ ID NO: 12035 - protein, 28 aa, Artificial Sequence
  Description of Artificial Sequence: Synthetic peptide
DEEEIRTTNPVATEQYGSVSTELQTGNN

SEQ ID NO: 12036 - protein, 28 aa, Artificial Sequence
  Description of Artificial Sequence: Synthetic peptide
DEEEIATTNPVATEQYGSVSTNLQHGNY

SEQ ID NO: 12037 - protein, 28 aa, Artificial Sequence
  Description of Artificial Sequence: Synthetic peptide
DEEEIATTNPVATEQYGSMSDNLQRGNR

SEQ ID NO: 12038 - protein, 28 aa, Artificial Sequence
  Description of Artificial Sequence: Synthetic peptide
DEEEIRTTNIVCTEQYGSVSTNNQRGNR

SEQ ID NO: 12039 - protein, 28 aa, Artificial Sequence
  Description of Artificial Sequence: Synthetic peptide
DEEEIVTTNIVATEQYGSVSTNLQLGNR

SEQ ID NO: 12040 - protein, 28 aa, Artificial Sequence
  Description of Artificial Sequence: Synthetic peptide
DEEEIRTTNPVATEQYGSVSDNLQRGPF

SEQ ID NO: 12041 - protein, 28 aa, Artificial Sequence
  Description of Artificial Sequence: Synthetic peptide
DDEEIRTTNPVATEQYGEVSENLQRGNR

SEQ ID NO: 12042 - protein, 29 aa, Artificial Sequence
  Description of Artificial Sequence: Synthetic peptide
DESEIRTTNPVATEQYGSVFTNLQRDGNR

SEQ ID NO: 12043 - protein, 28 aa, Artificial Sequence
  Description of Artificial Sequence: Synthetic peptide
DEEEIRTTNPVATEQYGSVSTNLQKGEY

SEQ ID NO: 12044 - protein, 29 aa, Artificial Sequence
  Description of Artificial Sequence: Synthetic peptide
QEEEIRTTNPVATEQYGSVSTNLQDKGNR

SEQ ID NO: 12045 - protein, 28 aa, Artificial Sequence
  Description of Artificial Sequence: Synthetic peptide
SEEEIATTNPTATEQYGSVSTNLQRGNR

SEQ ID NO: 12046 - protein, 28 aa, Artificial Sequence
  Description of Artificial Sequence: Synthetic peptide
DEQEIRTTNPVATEGYGSVSENLQRGNR

SEQ ID NO: 12047 - protein, 29 aa, Artificial Sequence
  Description of Artificial Sequence: Synthetic peptide
DEEEIRTTNPVATEQYGSVSTDLQERGNI

SEQ ID NO: 12048 - protein, 28 aa, Artificial Sequence
  Description of Artificial Sequence: Synthetic peptide
DEQEIRTTNPVATECYGSVSTNLQQGNR

SEQ ID NO: 12049 - protein, 28 aa, Artificial Sequence
  Description of Artificial Sequence: Synthetic peptide
DEEEIRTTNPVATEQYGSVSTNENAGNR

SEQ ID NO: 12050 - protein, 28 aa, Artificial Sequence
  Description of Artificial Sequence: Synthetic peptide
DEEEITTTNIVATEQYGSVSENLQRGNR

SEQ ID NO: 12051 - protein, 28 aa, Artificial Sequence
  Description of Artificial Sequence: Synthetic peptide
DEEEIRATNPVATEQYGSVSTDLQLGNR

SEQ ID NO: 12052 - protein, 28 aa, Artificial Sequence
  Description of Artificial Sequence: Synthetic peptide
DEEEIRTTNPVATEQYGLVSENLQRGQR

SEQ ID NO: 12053 - protein, 28 aa, Artificial Sequence
  Description of Artificial Sequence: Synthetic peptide
DDEEIRTVNPVATEQYGSVSTNLQRGNT

SEQ ID NO: 12054 - protein, 28 aa, Artificial Sequence
  Description of Artificial Sequence: Synthetic peptide
AEEEIRTTNIVATEQYGSVSTNEQRGNR

SEQ ID NO: 12055 - protein, 28 aa, Artificial Sequence
  Description of Artificial Sequence: Synthetic peptide
DENEIRTTNPVATEQYGSVSTNLQHGNV

SEQ ID NO: 12056 - protein, 28 aa, Artificial Sequence
  Description of Artificial Sequence: Synthetic peptide
DEEEIYTTNPVATEQYGSVSTNGQQGNR

SEQ ID NO: 12057 - protein, 28 aa, Artificial Sequence
  Description of Artificial Sequence: Synthetic peptide
DEEEIRTTNPVATEQYGSVSTDLQRGEY

SEQ ID NO: 12058 - protein, 30 aa, Artificial Sequence
  Description of Artificial Sequence: Synthetic polypeptide
DEEEIRTTNPVATEQYGSYVETNGLQRGNR

SEQ ID NO: 12059 - protein, 28 aa, Artificial Sequence
  Description of Artificial Sequence: Synthetic peptide
DEQEIRTTNPVATENYGTVSTNLQRGNR

SEQ ID NO: 12060 - protein, 29 aa, Artificial Sequence
  Description of Artificial Sequence: Synthetic peptide
DEEEIRTTNPVATEQYGSVSTNEQIRGNS

SEQ ID NO: 12061 - protein, 28 aa, Artificial Sequence
  Description of Artificial Sequence: Synthetic peptide
DEQEIRTTNPVATEQYGSVSTNLQYGNE

SEQ ID NO: 12062 - protein, 29 aa, Artificial Sequence
  Description of Artificial Sequence: Synthetic peptide
DEEEIRTTNPVATEVYGSVCSTNLQRGNY

SEQ ID NO: 12063 - protein, 28 aa, Artificial Sequence
  Description of Artificial Sequence: Synthetic peptide
DEQEIRTTNIVATEQYGSVSTNLQVGNR

SEQ ID NO: 12064 - protein, 29 aa, Artificial Sequence
  Description of Artificial Sequence: Synthetic peptide
DEEEIRTTNPVATEQYGSVSTNLQIGDTR

SEQ ID NO: 12065 - protein, 29 aa, Artificial Sequence
  Description of Artificial Sequence: Synthetic peptide
DEEEIRTTNPVATECYGSVSTNLQSEGNR

SEQ ID NO: 12066 - protein, 28 aa, Artificial Sequence
  Description of Artificial Sequence: Synthetic peptide
DEEEIRTTNPVATEQYGSVSTNEQHGNF

SEQ ID NO: 12067 - protein, 29 aa, Artificial Sequence
  Description of Artificial Sequence: Synthetic peptide
DEEEIRTTNPVATEPYGSVSEMNLQRGNR

SEQ ID NO: 12068 - protein, 28 aa, Artificial Sequence
  Description of Artificial Sequence: Synthetic peptide
DEEEIRTTNPVATEQYGSVSTNLMIGNM

SEQ ID NO: 12069 - protein, 28 aa, Artificial Sequence
  Description of Artificial Sequence: Synthetic peptide
DEEEIRTTNPVATEQYGSVSTDLQNGNI

SEQ ID NO: 12070 - protein, 28 aa, Artificial Sequence
  Description of Artificial Sequence: Synthetic peptide
DEEEIRTTNPVATEQYGDVSENLMRGNR

SEQ ID NO: 12071 - protein, 29 aa, Artificial Sequence
  Description of Artificial Sequence: Synthetic peptide
DEEEIRTTNPVATEQYGWVVATNLQRGNR

SEQ ID NO: 12072 - protein, 28 aa, Artificial Sequence
  Description of Artificial Sequence: Synthetic peptide
DEEEIATTNPVATEQYGSVSENLQRGER

SEQ ID NO: 12073 - protein, 28 aa, Artificial Sequence
  Description of Artificial Sequence: Synthetic peptide
DEQEIRTTNPVATEQYGSVSTDLQRGNL

SEQ ID NO: 12074 - protein, 29 aa, Artificial Sequence
  Description of Artificial Sequence: Synthetic peptide
DEEEIRTTNPVATEQYGSVSEENLQAGNR

SEQ ID NO: 12075 - protein, 28 aa, Artificial Sequence
  Description of Artificial Sequence: Synthetic peptide
DEEEIVTTNPVATECYGSVSTNLQLGNR

SEQ ID NO: 12076 - protein, 28 aa, Artificial Sequence
  Description of Artificial Sequence: Synthetic peptide
SEEEIRTTNPVATEQYGSVSTNPQRGNG

SEQ ID NO: 12077 - protein, 28 aa, Artificial Sequence
  Description of Artificial Sequence: Synthetic peptide
DEEEIRTTNPVATEQYGSADTNEQRGNR

SEQ ID NO: 12078 - protein, 29 aa, Artificial Sequence
  Description of Artificial Sequence: Synthetic peptide
DEEEIRTTNPVSTEQYGSVSTNLQREPNR

SEQ ID NO: 12079 - protein, 28 aa, Artificial Sequence
  Description of Artificial Sequence: Synthetic peptide
DEEEIRTTNPVATEQYGSVSTEQQRGNQ

SEQ ID NO: 12080 - protein, 28 aa, Artificial Sequence
  Description of Artificial Sequence: Synthetic peptide
DEEEIRCTNPVATEQYGSVSTNPQRGNS

SEQ ID NO: 12081 - protein, 28 aa, Artificial Sequence
  Description of Artificial Sequence: Synthetic peptide
NEEEIRTVNPVATEQYGSVSTNLQRGNM

SEQ ID NO: 12082 - protein, 28 aa, Artificial Sequence
  Description of Artificial Sequence: Synthetic peptide
DEEEIRTTNPVATEQYGSVSTNWQNGNI

SEQ ID NO: 12083 - protein, 28 aa, Artificial Sequence
  Description of Artificial Sequence: Synthetic peptide
QEEEIRTTNPVATEQYGSVSTDLQHGNR

SEQ ID NO: 12084 - protein, 28 aa, Artificial Sequence
  Description of Artificial Sequence: Synthetic peptide
DEEEICTTNPTATEQYGSVSTNLQHGNR

SEQ ID NO: 12085 - protein, 30 aa, Artificial Sequence
  Description of Artificial Sequence: Synthetic polypeptide
DEEEIRTTNPVATEQYGSVSETDLQRGNDR

SEQ ID NO: 12086 - protein, 28 aa, Artificial Sequence
  Description of Artificial Sequence: Synthetic peptide
DDEEIRTTNPVATEQYGDVSTNLQRGNQ

SEQ ID NO: 12087 - protein, 28 aa, Artificial Sequence
  Description of Artificial Sequence: Synthetic peptide
DEQEIRTTNIVATEQYGSVSTNLQRGNQ

SEQ ID NO: 12088 - protein, 28 aa, Artificial Sequence
  Description of Artificial Sequence: Synthetic peptide
AEEEIRTTNPVATEQYGSVATNLQRGGR

SEQ ID NO: 12089 - protein, 31 aa, Artificial Sequence
  Description of Artificial Sequence: Synthetic polypeptide
DEEEIRTTNPVATEQYGSVSETQNLQRDGNR

SEQ ID NO: 12090 - protein, 28 aa, Artificial Sequence
  Description of Artificial Sequence: Synthetic peptide
DEEEIATTNPVATEQYGSASDNLQRGNR

SEQ ID NO: 12091 - protein, 29 aa, Artificial Sequence
  Description of Artificial Sequence: Synthetic peptide
DEEELRTTNPVATEQYGSVSNNLQRAGNR

SEQ ID NO: 12092 - protein, 28 aa, Artificial Sequence
  Description of Artificial Sequence: Synthetic peptide
DEEEIRTTNPTATEQYGSVATNLQHGNR

SEQ ID NO: 12093 - protein, 28 aa, Artificial Sequence
  Description of Artificial Sequence: Synthetic peptide
DEQEIVTTNPVATEQYGWVSTNLQRGNR

SEQ ID NO: 12094 - protein, 28 aa, Artificial Sequence
  Description of Artificial Sequence: Synthetic peptide
DEEEIRTTNIVATEQYGSVSTNLQFGNA

SEQ ID NO: 12095 - protein, 28 aa, Artificial Sequence
  Description of Artificial Sequence: Synthetic peptide
DEEEIRTTNIVATEQYGSVSENLQNGNR

SEQ ID NO: 12096 - protein, 28 aa, Artificial Sequence
  Description of Artificial Sequence: Synthetic peptide
DEEEIRTTNIVATECYGSVSTNLQRGNG

SEQ ID NO: 12097 - protein, 29 aa, Artificial Sequence
  Description of Artificial Sequence: Synthetic peptide
DEEEIRSTNPVATEQYGSVCSTNLQRGER

SEQ ID NO: 12098 - protein, 28 aa, Artificial Sequence
  Description of Artificial Sequence: Synthetic peptide
DENEIRTTNPVATECYGSVSTNLQRGNW

SEQ ID NO: 12099 - protein, 28 aa, Artificial Sequence
  Description of Artificial Sequence: Synthetic peptide
DEEEIRTTNPVATEQYGSVSTELQYGNT

SEQ ID NO: 12100 - protein, 28 aa, Artificial Sequence
  Description of Artificial Sequence: Synthetic peptide
DEEEIRTTNIVATEQYGSVSTDLQRGNL

SEQ ID NO: 12101 - protein, 29 aa, Artificial Sequence
  Description of Artificial Sequence: Synthetic peptide
DEEEIRTTNPVATEQYGFVSTNLQRGNTE

SEQ ID NO: 12102 - protein, 29 aa, Artificial Sequence
  Description of Artificial Sequence: Synthetic peptide
DEEEIRTTNPVATEIYGSVATDNLQRGNR

SEQ ID NO: 12103 - protein, 28 aa, Artificial Sequence
  Description of Artificial Sequence: Synthetic peptide
DEEEIRATNPVATEQYGSVSTNLQYGNA

SEQ ID NO: 12104 - protein, 28 aa, Artificial Sequence
  Description of Artificial Sequence: Synthetic peptide
DEEEIRTTNPVATEQYGSVSGNLQRLND

SEQ ID NO: 12105 - protein, 28 aa, Artificial Sequence
  Description of Artificial Sequence: Synthetic peptide
SEEEIRATNPVATEQYGSVSTNLQRGNM

SEQ ID NO: 12106 - protein, 28 aa, Artificial Sequence
  Description of Artificial Sequence: Synthetic peptide
DEEEIRTTNPVATEQYGEVTTNLQRGER

SEQ ID NO: 12107 - protein, 28 aa, Artificial Sequence
  Description of Artificial Sequence: Synthetic peptide
DEEEIRTTNPVATEQYGDVSTNPQRGNF

SEQ ID NO: 12108 - protein, 28 aa, Artificial Sequence
  Description of Artificial Sequence: Synthetic peptide
DEEEIRTTNITATEQYGSVSTNLQTGNR

SEQ ID NO: 12109 - protein, 28 aa, Artificial Sequence
  Description of Artificial Sequence: Synthetic peptide
DENEIATTNPVATEQYGSVSTNLERGNR

SEQ ID NO: 12110 - protein, 28 aa, Artificial Sequence
  Description of Artificial Sequence: Synthetic peptide
DEEEIRCTNPVCTEQYGSVSTNLQHGNR

SEQ ID NO: 12111 - protein, 28 aa, Artificial Sequence
  Description of Artificial Sequence: Synthetic peptide
DEEEIRTTNPVATEQYGIVSENLQRGQR

SEQ ID NO: 12112 - protein, 28 aa, Artificial Sequence
  Description of Artificial Sequence: Synthetic peptide
DEEEIRTTNIVATEQYGSVSTNLDRGNS

SEQ ID NO: 12113 - protein, 28 aa, Artificial Sequence
  Description of Artificial Sequence: Synthetic peptide
DEEEIRTTNIVATEQYGSVGTNLQGGNR

SEQ ID NO: 12114 - protein, 28 aa, Artificial Sequence
  Description of Artificial Sequence: Synthetic peptide
DEEEIRTTNPVATELYGSVSTNLMRGNL

SEQ ID NO: 12115 - protein, 28 aa, Artificial Sequence
  Description of Artificial Sequence: Synthetic peptide
DEEEVRTTNPVATEQYGVVSNNLQRGNR

SEQ ID NO: 12116 - protein, 28 aa, Artificial Sequence
  Description of Artificial Sequence: Synthetic peptide
DEEEIRTTNPVATEQYGSVSENLQMGNM

SEQ ID NO: 12117 - protein, 28 aa, Artificial Sequence
  Description of Artificial Sequence: Synthetic peptide
DEEEIRQTNIVATEQYGSVSTNLQDGNR

SEQ ID NO: 12118 - protein, 28 aa, Artificial Sequence
  Description of Artificial Sequence: Synthetic peptide
DEEEIRTTNPTATEFYGSVSTNLQRGNV

SEQ ID NO: 12119 - protein, 28 aa, Artificial Sequence
  Description of Artificial Sequence: Synthetic peptide
DEEEIRTTNIDATEQYGSVSTNLQNGNR

SEQ ID NO: 12120 - protein, 28 aa, Artificial Sequence
  Description of Artificial Sequence: Synthetic peptide
DEVEIRTTNPVATEQYGDVSTNLQGGNR

SEQ ID NO: 12121 - protein, 28 aa, Artificial Sequence
  Description of Artificial Sequence: Synthetic peptide
DEEEIRTTNPVATEQWGSVSTNLMRGNA

SEQ ID NO: 12122 - protein, 28 aa, Artificial Sequence
  Description of Artificial Sequence: Synthetic peptide
DEEEIRTTNPVATECWGSVSTNLQRGNQ

SEQ ID NO: 12123 - protein, 29 aa, Artificial Sequence
  Description of Artificial Sequence: Synthetic peptide
DEEEIRTTNPVATECYGSVSTNLQIRGNW

SEQ ID NO: 12124 - protein, 28 aa, Artificial Sequence
  Description of Artificial Sequence: Synthetic peptide
DEHEIRTTNPVSTEQYGSVSTNLQHGNR

SEQ ID NO: 12125 - protein, 28 aa, Artificial Sequence
  Description of Artificial Sequence: Synthetic peptide
DEEEIRTTNPIATEQYGSVSTALQRGMR

SEQ ID NO: 12126 - protein, 28 aa, Artificial Sequence
  Description of Artificial Sequence: Synthetic peptide
DEEEIRTTNPVATEQYGSVSTVLQHGMR

SEQ ID NO: 12127 - protein, 28 aa, Artificial Sequence
  Description of Artificial Sequence: Synthetic peptide
DEEEIRTTNPVATEQFGSVATNLQIGNR

SEQ ID NO: 12128 - protein, 28 aa, Artificial Sequence
  Description of Artificial Sequence: Synthetic peptide
DENEIRTTNPVATEQYGSVSTNLQNGNM

SEQ ID NO: 12129 - protein, 28 aa, Artificial Sequence
  Description of Artificial Sequence: Synthetic peptide
DEEEIRTTNPVATEQYGDVSENLQGGNR

SEQ ID NO: 12130 - protein, 28 aa, Artificial Sequence
  Description of Artificial Sequence: Synthetic peptide
DEEEIRTTNPVATEQWGDVSTNLQRGDR

SEQ ID NO: 12131 - protein, 28 aa, Artificial Sequence
  Description of Artificial Sequence: Synthetic peptide
DEEEIRTTNPVATEQFGSVSTNEQRGTR

SEQ ID NO: 12132 - protein, 28 aa, Artificial Sequence
  Description of Artificial Sequence: Synthetic peptide
SEDEIRTTNPVATEQYGSVSTNLQTGNR

SEQ ID NO: 12133 - protein, 28 aa, Artificial Sequence
  Description of Artificial Sequence: Synthetic peptide
DEEEIRTTNPVATEQYGSVSTNLMAGNF

SEQ ID NO: 12134 - protein, 28 aa, Artificial Sequence
  Description of Artificial Sequence: Synthetic peptide
DESEIRTTNIVATEHYGSVSTNLQRGNR

SEQ ID NO: 12135 - protein, 28 aa, Artificial Sequence
  Description of Artificial Sequence: Synthetic peptide
DEEEIRTTNPVATEQWGSVSTNLQTGNQ

SEQ ID NO: 12136 - protein, 28 aa, Artificial Sequence
  Description of Artificial Sequence: Synthetic peptide
DENEIRTTNPVATEQYGNVSTNLQRENR

SEQ ID NO: 12137 - protein, 28 aa, Artificial Sequence
  Description of Artificial Sequence: Synthetic peptide
DEEEIRTTNPVATEQYGSVSTNQQNGNE

SEQ ID NO: 12138 - protein, 28 aa, Artificial Sequence
  Description of Artificial Sequence: Synthetic peptide
HEWEIRTTNPVATEQYGEVSTNLQRGNR

SEQ ID NO: 12139 - protein, 28 aa, Artificial Sequence
  Description of Artificial Sequence: Synthetic peptide
HEEEIRTTNIVATEQYGSVSTNLQTGNR

SEQ ID NO: 12140 - protein, 28 aa, Artificial Sequence
  Description of Artificial Sequence: Synthetic peptide
DESEIRTTNPVATEQYGSVATNLERGNR

SEQ ID NO: 12141 - protein, 28 aa, Artificial Sequence
  Description of Artificial Sequence: Synthetic peptide
DEEEIGTTNIVATEQYGSVSTNLQGGNR

SEQ ID NO: 12142 - protein, 30 aa, Artificial Sequence
  Description of Artificial Sequence: Synthetic polypeptide
DEGEIRTTNPVATEQYGSVSTNLQRGDNNR

SEQ ID NO: 12143 - protein, 29 aa, Artificial Sequence
  Description of Artificial Sequence: Synthetic peptide
DEEEIRTTNPVATEQYGSVCSTNPQRGDR

SEQ ID NO: 12144 - protein, 28 aa, Artificial Sequence
  Description of Artificial Sequence: Synthetic peptide
DEEEIRTTNIVATEIYGSVSTNLQTGNR

SEQ ID NO: 12145 - protein, 28 aa, Artificial Sequence
  Description of Artificial Sequence: Synthetic peptide
AEEEITTTNPVATEQYGSVSTNLQRGNH

SEQ ID NO: 12146 - protein, 28 aa, Artificial Sequence
  Description of Artificial Sequence: Synthetic peptide
DEAEIRTTNPVATEQYGSVSENLQRGNF

SEQ ID NO: 12147 - protein, 28 aa, Artificial Sequence
  Description of Artificial Sequence: Synthetic peptide
DEEEIRTTNPVATEQYGSVSTALIRGER

SEQ ID NO: 12148 - protein, 29 aa, Artificial Sequence
  Description of Artificial Sequence: Synthetic peptide
DEEEIRTTNPVATECYGSVSTDLQRNGNR

SEQ ID NO: 12149 - protein, 28 aa, Artificial Sequence
  Description of Artificial Sequence: Synthetic peptide
DEEEIRTTNIVATEQYGSVSDNLQRGNQ

SEQ ID NO: 12150 - protein, 28 aa, Artificial Sequence
  Description of Artificial Sequence: Synthetic peptide
DEEEIRTTNPVATEVYGSVSTELQRGDR

SEQ ID NO: 12151 - protein, 29 aa, Artificial Sequence
  Description of Artificial Sequence: Synthetic peptide
SEEEIRCTNPVATEQYGSVSTNLQRGNTR

SEQ ID NO: 12152 - protein, 28 aa, Artificial Sequence
  Description of Artificial Sequence: Synthetic peptide
DEEEIRQTNPVATEQYGTVSTNLQRENR

SEQ ID NO: 12153 - protein, 28 aa, Artificial Sequence
  Description of Artificial Sequence: Synthetic peptide
DEEEIATTNPVATEQYGDVATNLQRGNR

SEQ ID NO: 12154 - protein, 28 aa, Artificial Sequence
  Description of Artificial Sequence: Synthetic peptide
DENEIRTTNPVATEQWGSVSTNLQRGNM

SEQ ID NO: 12155 - protein, 28 aa, Artificial Sequence
  Description of Artificial Sequence: Synthetic peptide
DETEIRTTNPVATEQYGSVSTNLQHGNE

SEQ ID NO: 12156 - protein, 28 aa, Artificial Sequence
  Description of Artificial Sequence: Synthetic peptide
DEEEIRTTNPCATEVYGFVSTNLQRGNR

SEQ ID NO: 12157 - protein, 28 aa, Artificial Sequence
  Description of Artificial Sequence: Synthetic peptide
DEEEIRCTNIVATEQYGSVSTNLQRGNQ

SEQ ID NO: 12158 - protein, 28 aa, Artificial Sequence
  Description of Artificial Sequence: Synthetic peptide
DEEEIRTTNPVATEQYGEVSTNDQRGNV

SEQ ID NO: 12159 - protein, 28 aa, Artificial Sequence
  Description of Artificial Sequence: Synthetic peptide
QEEEIRTTNPVCTEQYGSVSTNLQRGNA

SEQ ID NO: 12160 - protein, 30 aa, Artificial Sequence
  Description of Artificial Sequence: Synthetic polypeptide
DEEEIRTTNPVATEQYGSVSEVNLQRGFNR

SEQ ID NO: 12161 - protein, 28 aa, Artificial Sequence
  Description of Artificial Sequence: Synthetic peptide
DEEEIRTTNPVATEQYGSVSTNVLRGNH

SEQ ID NO: 12162 - protein, 28 aa, Artificial Sequence
  Description of Artificial Sequence: Synthetic peptide
SEEEIRTTNPVCSEQYGSVSTNLQRGNR

SEQ ID NO: 12163 - protein, 28 aa, Artificial Sequence
  Description of Artificial Sequence: Synthetic peptide
DEEEIRTTNIVATEQYGSVSSNLQRGNI

SEQ ID NO: 12164 - protein, 28 aa, Artificial Sequence
  Description of Artificial Sequence: Synthetic peptide
DEEEIRTTNPVATEQYGSVSTNLQAGEH

SEQ ID NO: 12165 - protein, 28 aa, Artificial Sequence
  Description of Artificial Sequence: Synthetic peptide
DEVEIRTTNPVATEQYGSVSTNLQRGDF

SEQ ID NO: 12166 - protein, 30 aa, Artificial Sequence
  Description of Artificial Sequence: Synthetic polypeptide
DEEEIRTTNPVATEQYGSVSTNLQDKGNDR

SEQ ID NO: 12167 - protein, 28 aa, Artificial Sequence
  Description of Artificial Sequence: Synthetic peptide
DEEEIRTTNPVATEQYGSVSTGPQRGNA

SEQ ID NO: 12168 - protein, 28 aa, Artificial Sequence
  Description of Artificial Sequence: Synthetic peptide
DEEEIRTTNPVATEQYGSVSENLQMGNQ

SEQ ID NO: 12169 - protein, 28 aa, Artificial Sequence
  Description of Artificial Sequence: Synthetic peptide
DEEEIATTNPVATEQYGSVSTGLQRENR

SEQ ID NO: 12170 - protein, 28 aa, Artificial Sequence
  Description of Artificial Sequence: Synthetic peptide
DEEEIRTTNPVATEQYGSVSENLMRGQR

SEQ ID NO: 12171 - protein, 28 aa, Artificial Sequence
  Description of Artificial Sequence: Synthetic peptide
DEEEIRTTNPVATETYGSVSTNLQIGNG

SEQ ID NO: 12172 - protein, 28 aa, Artificial Sequence
  Description of Artificial Sequence: Synthetic peptide
DEEEIRTTNPVATEQYGSVSTNEQIGNN

SEQ ID NO: 12173 - protein, 28 aa, Artificial Sequence
  Description of Artificial Sequence: Synthetic peptide
DEEEIRTTNIVATEHYGSVSTNEQRGNR

SEQ ID NO: 12174 - protein, 28 aa, Artificial Sequence
  Description of Artificial Sequence: Synthetic peptide
DEEEIATTNPVATEMYGVVSTNLQRGNR

SEQ ID NO: 12175 - protein, 30 aa, Artificial Sequence
  Description of Artificial Sequence: Synthetic polypeptide
DEEEIRTTNPVATEQYGSVSTMNPQRGNDR

SEQ ID NO: 12176 - protein, 28 aa, Artificial Sequence
  Description of Artificial Sequence: Synthetic peptide
DEEEIRTTNIVATEQYGSVSTNLERGNQ

SEQ ID NO: 12177 - protein, 28 aa, Artificial Sequence
  Description of Artificial Sequence: Synthetic peptide
DEEEIRTTNPVATEQYGSVSTNLIDGNV

SEQ ID NO: 12178 - protein, 28 aa, Artificial Sequence
  Description of Artificial Sequence: Synthetic peptide
DEEEIRTTNPVATEQYGSVATAWQRGNR

SEQ ID NO: 12179 - protein, 29 aa, Artificial Sequence
  Description of Artificial Sequence: Synthetic peptide
DEEEIRTTNPVATEQYGSVSTMNEQNGNR

SEQ ID NO: 12180 - protein, 28 aa, Artificial Sequence
  Description of Artificial Sequence: Synthetic peptide
DEVEIRTTNPVATECYGSVSTNLQRGDR

SEQ ID NO: 12181 - protein, 28 aa, Artificial Sequence
  Description of Artificial Sequence: Synthetic peptide
DEEEIRTTNPVATEYYGSVSTNLQRANS

SEQ ID NO: 12182 - protein, 28 aa, Artificial Sequence
  Description of Artificial Sequence: Synthetic peptide
DEQEIYTTNPVATEQYGSVSTNLQRGDR

SEQ ID NO: 12183 - protein, 28 aa, Artificial Sequence
  Description of Artificial Sequence: Synthetic peptide
DEEEIRTTNIVATEQYGSVSTNLQQGTR

SEQ ID NO: 12184 - protein, 28 aa, Artificial Sequence
  Description of Artificial Sequence: Synthetic peptide
DEEEIRTTNPVATEQYGSVSDSLQRGNW

SEQ ID NO: 12185 - protein, 28 aa, Artificial Sequence
  Description of Artificial Sequence: Synthetic peptide
DEEEIATTNIVATEQYGSVSTNLQRGNF

SEQ ID NO: 12186 - protein, 28 aa, Artificial Sequence
  Description of Artificial Sequence: Synthetic peptide
DEEEIRTTNPVATEQYGSVATDLQRGNM

SEQ ID NO: 12187 - protein, 28 aa, Artificial Sequence
  Description of Artificial Sequence: Synthetic peptide
DEEEIRTTNIVATEQYGSVSTNLQRGEF

SEQ ID NO: 12188 - protein, 28 aa, Artificial Sequence
  Description of Artificial Sequence: Synthetic peptide
DEEEIRTTNPVATEQFGSVSTNLQFGNG

SEQ ID NO: 12189 - protein, 29 aa, Artificial Sequence
  Description of Artificial Sequence: Synthetic peptide
DEEEIRTTNPVSTEQYGSVSENLQREGNR

SEQ ID NO: 12190 - protein, 28 aa, Artificial Sequence
  Description of Artificial Sequence: Synthetic peptide
DEEEIRTTNIVATEQYGSVSTNLQRGGA

SEQ ID NO: 12191 - protein, 28 aa, Artificial Sequence
  Description of Artificial Sequence: Synthetic peptide
DEEEIRTTNPVATEQYGSVSTDLQVGER

SEQ ID NO: 12192 - protein, 28 aa, Artificial Sequence
  Description of Artificial Sequence: Synthetic peptide
DEEEIRTTNPVATEQYGSVSTNLHRGEI

SEQ ID NO: 12193 - protein, 28 aa, Artificial Sequence
  Description of Artificial Sequence: Synthetic peptide
GEEEIRTTNPVATECYGSVSTDLQRGNR

SEQ ID NO: 12194 - protein, 28 aa, Artificial Sequence
  Description of Artificial Sequence: Synthetic peptide
KEEEIRTTNPVATEQYGSVSTDLQYGNR

SEQ ID NO: 12195 - protein, 28 aa, Artificial Sequence
  Description of Artificial Sequence: Synthetic peptide
DEEELRTTNPVATEQYGSVSENLQRLNR

SEQ ID NO: 12196 - protein, 28 aa, Artificial Sequence
  Description of Artificial Sequence: Synthetic peptide
DEEEIRTTNPVATEQFGSVSTNLQQGNN

SEQ ID NO: 12197 - protein, 28 aa, Artificial Sequence
  Description of Artificial Sequence: Synthetic peptide
DEQEIRTTNIVATEQYGSVSTNLQRGND

SEQ ID NO: 12198 - protein, 28 aa, Artificial Sequence
  Description of Artificial Sequence: Synthetic peptide
DEGEIRTTNIVATEQYGSVSTNLQVGNR

SEQ ID NO: 12199 - protein, 28 aa, Artificial Sequence
  Description of Artificial Sequence: Synthetic peptide
DEEEIRTTNIVATEQYGEVSTNNQRGNR

SEQ ID NO: 12200 - protein, 28 aa, Artificial Sequence
  Description of Artificial Sequence: Synthetic peptide
DEEEISTTNIVATEQYGSVSTNLQRGNA

SEQ ID NO: 12201 - protein, 28 aa, Artificial Sequence
  Description of Artificial Sequence: Synthetic peptide
DEEEIRTTNITATEQYGSVSTNLQRGNM

SEQ ID NO: 12202 - protein, 28 aa, Artificial Sequence
  Description of Artificial Sequence: Synthetic peptide
SEEEIRTTNPVATEQYGAVSTNLQRGND

SEQ ID NO: 12203 - protein, 28 aa, Artificial Sequence
  Description of Artificial Sequence: Synthetic peptide
DEEEIRTTNITATEQYGSVSTNLQRGER

SEQ ID NO: 12204 - protein, 28 aa, Artificial Sequence
  Description of Artificial Sequence: Synthetic peptide
DEEEIRTTNIVATEQYGSVSTNLQHGNF

SEQ ID NO: 12205 - protein, 28 aa, Artificial Sequence
  Description of Artificial Sequence: Synthetic peptide
DEEEIRTTNPVATEQYGSVSTDPQRGER

SEQ ID NO: 12206 - protein, 28 aa, Artificial Sequence
  Description of Artificial Sequence: Synthetic peptide
DEEEIGTTNPVATEQYGGVATNLQRGNR

SEQ ID NO: 12207 - protein, 29 aa, Artificial Sequence
  Description of Artificial Sequence: Synthetic peptide
MEQEIRTTNPVATEQYGSVSTNLQREGNR

SEQ ID NO: 12208 - protein, 28 aa, Artificial Sequence
  Description of Artificial Sequence: Synthetic peptide
DEEEIRTTNPVATEQYGVVSTNLQRENF

SEQ ID NO: 12209 - protein, 28 aa, Artificial Sequence
  Description of Artificial Sequence: Synthetic peptide
DEEEIRTTNPVATEQYGSVSTNLQFGDH

SEQ ID NO: 12210 - protein, 28 aa, Artificial Sequence
  Description of Artificial Sequence: Synthetic peptide
DEEEIRTTNPVATEQYGSVSENLERGTR

SEQ ID NO: 12211 - protein, 28 aa, Artificial Sequence
  Description of Artificial Sequence: Synthetic peptide
DENEIRTTNPVATEQWGSVSTNLERGNR

SEQ ID NO: 12212 - protein, 28 aa, Artificial Sequence
  Description of Artificial Sequence: Synthetic peptide
DEEEIRTTNPVATEQYGSVSTELQYGNQ

SEQ ID NO: 12213 - protein, 31 aa, Artificial Sequence
  Description of Artificial Sequence: Synthetic polypeptide
DEEEIRTTNPVATEQYGSVGSTNLQRNGVNR

SEQ ID NO: 12214 - protein, 28 aa, Artificial Sequence
  Description of Artificial Sequence: Synthetic peptide
DEEEIRTTNPVATEQYGSVSENLQYGNN

SEQ ID NO: 12215 - protein, 30 aa, Artificial Sequence
  Description of Artificial Sequence: Synthetic polypeptide
DEQEIRTTNPVATEQYGSVSTNLQREGENR

SEQ ID NO: 12216 - protein, 28 aa, Artificial Sequence
  Description of Artificial Sequence: Synthetic peptide
DEHEIRTTNPVATEQYGSVSTNLQHGNF

SEQ ID NO: 12217 - protein, 28 aa, Artificial Sequence
  Description of Artificial Sequence: Synthetic peptide
DEEEIATTNIVATEQYGSVSTNLQLGNR

SEQ ID NO: 12218 - protein, 28 aa, Artificial Sequence
  Description of Artificial Sequence: Synthetic peptide
DEEEIVTTNPVATEIYGSVSTNLQRGER

SEQ ID NO: 12219 - protein, 28 aa, Artificial Sequence
  Description of Artificial Sequence: Synthetic peptide
DEEEIRTTNPVATEQYGSVSENLTHGNR

SEQ ID NO: 12220 - protein, 29 aa, Artificial Sequence
  Description of Artificial Sequence: Synthetic peptide
DEEEIRTTNPVATEQYGSVSENLQNGINR

SEQ ID NO: 12221 - protein, 30 aa, Artificial Sequence
  Description of Artificial Sequence: Synthetic polypeptide
DEEEIRCTNPVATEQYGSVSTNNLQRGNER

SEQ ID NO: 12222 - protein, 28 aa, Artificial Sequence
  Description of Artificial Sequence: Synthetic peptide
DEEEIRTTNPVATEQYGDVSTNVQTGNR

SEQ ID NO: 12223 - protein, 29 aa, Artificial Sequence
  Description of Artificial Sequence: Synthetic peptide
DEEEIRTTNPVATECYGSVSTNLQRGNDL

SEQ ID NO: 12224 - protein, 28 aa, Artificial Sequence
  Description of Artificial Sequence: Synthetic peptide
DEEEIRTTNPVATEQYGSVSTELQSGNA

SEQ ID NO: 12225 - protein, 28 aa, Artificial Sequence
  Description of Artificial Sequence: Synthetic peptide
DEEEIRTTNPVATEQYGSVSTDLQFGNV

SEQ ID NO: 12226 - protein, 28 aa, Artificial Sequence
  Description of Artificial Sequence: Synthetic peptide
DEEEIRTTNPAATEQYGSVSTNLQRLNG

SEQ ID NO: 12227 - protein, 28 aa, Artificial Sequence
  Description of Artificial Sequence: Synthetic peptide
DEEEIRSTNPVSTEQYGSVATNLQRGNR

SEQ ID NO: 12228 - protein, 29 aa, Artificial Sequence
  Description of Artificial Sequence: Synthetic peptide
DEEEICTTNPVATEQYGSVSENLQRSGNR

SEQ ID NO: 12229 - protein, 28 aa, Artificial Sequence
  Description of Artificial Sequence: Synthetic peptide
DEEEIRTTNPVATECYGSVSTNLERGER

SEQ ID NO: 12230 - protein, 28 aa, Artificial Sequence
  Description of Artificial Sequence: Synthetic peptide
DEEEIRTTNPVATEQYGSVSTNLQSGEM

SEQ ID NO: 12231 - protein, 28 aa, Artificial Sequence
  Description of Artificial Sequence: Synthetic peptide
DEEEIRTTNPVSTEVYGSVSTNLQHGNR

SEQ ID NO: 12232 - protein, 28 aa, Artificial Sequence
  Description of Artificial Sequence: Synthetic peptide
SEEEIRTTNPVATEQYGSVSVNLQGGNR

SEQ ID NO: 12233 - protein, 28 aa, Artificial Sequence
  Description of Artificial Sequence: Synthetic peptide
DEEEIRTTNPVATEQYGGVSTNEQQGNR

SEQ ID NO: 12234 - protein, 28 aa, Artificial Sequence
  Description of Artificial Sequence: Synthetic peptide
DEEEIRTTNPVATEQYGAVSTNLQQGNF

SEQ ID NO: 12235 - protein, 28 aa, Artificial Sequence
  Description of Artificial Sequence: Synthetic peptide
DEEEICTTNPVATEQYGSVSNNLQRGDR

SEQ ID NO: 12236 - protein, 29 aa, Artificial Sequence
  Description of Artificial Sequence: Synthetic peptide
DEEEIRTTNPVATEQYGSVSENLQNRGNM

SEQ ID NO: 12237 - protein, 28 aa, Artificial Sequence
  Description of Artificial Sequence: Synthetic peptide
DEEEIRTTNPVATEQWGSVSTNLQQGNF

SEQ ID NO: 12238 - protein, 28 aa, Artificial Sequence
  Description of Artificial Sequence: Synthetic peptide
DEEEIRTTNIVATEQYGAVSTNLQQGNR

SEQ ID NO: 12239 - protein, 28 aa, Artificial Sequence
  Description of Artificial Sequence: Synthetic peptide
DEEEIRTTNPVATEQYGMVSTQLQRGMR

SEQ ID NO: 12240 - protein, 28 aa, Artificial Sequence
  Description of Artificial Sequence: Synthetic peptide
DEQEIRTTNPVATEQYGSVSTNLQGGNQ

SEQ ID NO: 12241 - protein, 28 aa, Artificial Sequence
  Description of Artificial Sequence: Synthetic peptide
DENEIRTTNPVATEQYGSVSTNLQQGNA

SEQ ID NO: 12242 - protein, 28 aa, Artificial Sequence
  Description of Artificial Sequence: Synthetic peptide
DEEEIRTTNPVATEQYGSVSTNDQQGNV

SEQ ID NO: 12243 - protein, 28 aa, Artificial Sequence
  Description of Artificial Sequence: Synthetic peptide
DEEEIRTTNIVATEQYGSASTNLQDGNR

SEQ ID NO: 12244 - protein, 28 aa, Artificial Sequence
  Description of Artificial Sequence: Synthetic peptide
DEEEIRTTNPVATEQYGSMSENLQRGNQ

SEQ ID NO: 12245 - protein, 28 aa, Artificial Sequence
  Description of Artificial Sequence: Synthetic peptide
DEEEIRATNIVATEQYGSVSTNLQRGNL

SEQ ID NO: 12246 - protein, 28 aa, Artificial Sequence
  Description of Artificial Sequence: Synthetic peptide
DEEEIRATNPVATEQYGSVSTNLQGGNE

SEQ ID NO: 12247 - protein, 28 aa, Artificial Sequence
  Description of Artificial Sequence: Synthetic peptide
DEEEIRTTNIVATEQYGSVSTGDQRGNR

SEQ ID NO: 12248 - protein, 28 aa, Artificial Sequence
  Description of Artificial Sequence: Synthetic peptide
DEEEIRTTNIVATEQYGSVSTNVQRGNT

SEQ ID NO: 12249 - protein, 29 aa, Artificial Sequence
  Description of Artificial Sequence: Synthetic peptide
DEEEIRTTNPVATEQYGSVSDNLQRKGNN

SEQ ID NO: 12250 - protein, 28 aa, Artificial Sequence
  Description of Artificial Sequence: Synthetic peptide
DENEIRTTNPVATEQYGSVSTIEQRGNR

SEQ ID NO: 12251 - protein, 28 aa, Artificial Sequence
  Description of Artificial Sequence: Synthetic peptide
DEEEIRTTNPVATEQYGVVSTNLQQGER

SEQ ID NO: 12252 - protein, 29 aa, Artificial Sequence
  Description of Artificial Sequence: Synthetic peptide
DENEIRTTNPVATEQYGSVSTNLQRAMNR

SEQ ID NO: 12253 - protein, 28 aa, Artificial Sequence
  Description of Artificial Sequence: Synthetic peptide
DEEEIRTTNPVATECYGSVSTTLQRENR

SEQ ID NO: 12254 - protein, 28 aa, Artificial Sequence
  Description of Artificial Sequence: Synthetic peptide
QEEEIRTTNIVATEQYGSVSTNLQRGNT

SEQ ID NO: 12255 - protein, 28 aa, Artificial Sequence
  Description of Artificial Sequence: Synthetic peptide
DEEEIRTTNPVATEQYGSLSTNLQTGNM

SEQ ID NO: 12256 - protein, 29 aa, Artificial Sequence
  Description of Artificial Sequence: Synthetic peptide
DEEEIRTTNPVATEQYGSVSTELQRNGNN

SEQ ID NO: 12257 - protein, 29 aa, Artificial Sequence
  Description of Artificial Sequence: Synthetic peptide
DEEEIRTTNPVASEQYGSVATNLQRNGNR

SEQ ID NO: 12258 - protein, 28 aa, Artificial Sequence
  Description of Artificial Sequence: Synthetic peptide
DEEEIRTTNPVATEQWGSVSTNLQIGNL

SEQ ID NO: 12259 - protein, 30 aa, Artificial Sequence
  Description of Artificial Sequence: Synthetic polypeptide
DEEEIATTNPVATEQYGSVSTNLQDRGDNR

SEQ ID NO: 12260 - protein, 28 aa, Artificial Sequence
  Description of Artificial Sequence: Synthetic peptide
DEEEIRTTNPVATEVYGSVSANLQRGPR

SEQ ID NO: 12261 - protein, 28 aa, Artificial Sequence
  Description of Artificial Sequence: Synthetic peptide
DEEEIRTTNPCATELYGSVSTNLQRGNH

SEQ ID NO: 12262 - protein, 28 aa, Artificial Sequence
  Description of Artificial Sequence: Synthetic peptide
DEEEIRTTNPCATEQYGSVSENLQRGER

SEQ ID NO: 12263 - protein, 29 aa, Artificial Sequence
  Description of Artificial Sequence: Synthetic peptide
DENEIRTTNPVATEQYGSVSTDLQRGNDR

SEQ ID NO: 12264 - protein, 28 aa, Artificial Sequence
  Description of Artificial Sequence: Synthetic peptide
DEEEIRTTNIVATEQYGSVSTNLQRGTI

SEQ ID NO: 12265 - protein, 29 aa, Artificial Sequence
  Description of Artificial Sequence: Synthetic peptide
DEAEIRCTNPVATEQYGSVSTNLQRGNFR

SEQ ID NO: 12266 - protein, 28 aa, Artificial Sequence
  Description of Artificial Sequence: Synthetic peptide
DEEEIATTNIVATEQYGSVSTNLQRGNN

SEQ ID NO: 12267 - protein, 29 aa, Artificial Sequence
  Description of Artificial Sequence: Synthetic peptide
NEEEIRTTNPVATEQYGSVSVTNLQRGNA

SEQ ID NO: 12268 - protein, 28 aa, Artificial Sequence
  Description of Artificial Sequence: Synthetic peptide
DEEEIRTTNIVATEQYGSVSTNEQSGNR

SEQ ID NO: 12269 - protein, 28 aa, Artificial Sequence
  Description of Artificial Sequence: Synthetic peptide
DEEEIATTNIVATEQYGSVSTNLQRGNA

SEQ ID NO: 12270 - protein, 28 aa, Artificial Sequence
  Description of Artificial Sequence: Synthetic peptide
DEEEIRTTNIVATEQYGSVSTNLQYGND

SEQ ID NO: 12271 - protein, 28 aa, Artificial Sequence
  Description of Artificial Sequence: Synthetic peptide
DEEEIRTTNIVATEQYGSVGTNLQNGNR

SEQ ID NO: 12272 - protein, 28 aa, Artificial Sequence
  Description of Artificial Sequence: Synthetic peptide
DEEEIRQTNPVATEQYGSVSTNEQRGNF

SEQ ID NO: 12273 - protein, 28 aa, Artificial Sequence
  Description of Artificial Sequence: Synthetic peptide
DEEEIRTTNPVATEQYGSVSTDLQYGNS

SEQ ID NO: 12274 - protein, 31 aa, Artificial Sequence; identical to SEQ ID NO: 11774
  Description of Artificial Sequence: Synthetic polypeptide

SEQ ID NO: 12275 - protein, 28 aa, Artificial Sequence
  Description of Artificial Sequence: Synthetic peptide
DEEEIRCTNPVSTEQYGSVSTNDQRGNR

SEQ ID NO: 12276 - protein, 28 aa, Artificial Sequence
  Description of Artificial Sequence: Synthetic peptide
DEEEIRTTNCVATEQWGSVSTNLQRGNF

SEQ ID NO: 12277 - protein, 28 aa, Artificial Sequence
  Description of Artificial Sequence: Synthetic peptide
DEEEIRTTNPVATEQYGSVSENPQFGNR

SEQ ID NO: 12278 - protein, 28 aa, Artificial Sequence
  Description of Artificial Sequence: Synthetic peptide
DEEEIRTTNPVATEQYGAVSNNLERGNR

SEQ ID NO: 12279 - protein, 28 aa, Artificial Sequence
  Description of Artificial Sequence: Synthetic peptide
DENEIRTTNIVATEQYGSVSTNLQRGNQ

SEQ ID NO: 12280 - protein, 30 aa, Artificial Sequence
  Description of Artificial Sequence: Synthetic polypeptide
DEEEIRTTNPVATEQYGSVSTNLERDGDNR

SEQ ID NO: 12281 - protein, 28 aa, Artificial Sequence
  Description of Artificial Sequence: Synthetic peptide
DEEEIRTTNPVATEVYGLVSTNLQRGLR

SEQ ID NO: 12282 - protein, 28 aa, Artificial Sequence
  Description of Artificial Sequence: Synthetic peptide
DEEEIRTTNILATEQYGSVSTNLQDGNR

SEQ ID NO: 12283 - protein, 28 aa, Artificial Sequence
  Description of Artificial Sequence: Synthetic peptide
DEEEIRTTNIVATEQYGSVATNLQYGNR

SEQ ID NO: 12284 - protein, 28 aa, Artificial Sequence
  Description of Artificial Sequence: Synthetic peptide
DECEIRTTNPVATEQYGSVSTNLLRGNP

SEQ ID NO: 12285 - protein, 28 aa, Artificial Sequence
  Description of Artificial Sequence: Synthetic peptide
SEEEIRTTNIVATEQYGSVSTNLQRGNS

SEQ ID NO: 12286 - protein, 28 aa, Artificial Sequence
  Description of Artificial Sequence: Synthetic peptide
DEEEIATTNIVATEQYGSVSTNLQRGNS

SEQ ID NO: 12287 - protein, 28 aa, Artificial Sequence
  Description of Artificial Sequence: Synthetic peptide
DEEEIRTTNPVYTEQYGSVSTNHQRGNA

SEQ ID NO: 12288 - protein, 30 aa, Artificial Sequence
  Description of Artificial Sequence: Synthetic polypeptide
YEEEIRTTNPVATEQYGSVSTNLQQRGNDR

SEQ ID NO: 12289 - protein, 28 aa, Artificial Sequence
  Description of Artificial Sequence: Synthetic peptide
DEEEIRTTNPVATEQYGSVSTDLQQGNN

SEQ ID NO: 12290 - protein, 28 aa, Artificial Sequence
  Description of Artificial Sequence: Synthetic peptide
DEEEIRTTNPVATEQYGSYSENLQRGDR

SEQ ID NO: 12291 - protein, 28 aa, Artificial Sequence
  Description of Artificial Sequence: Synthetic peptide
DEEEIRTTNIVATEQYGSVSTELQVGNR

SEQ ID NO: 12292 - protein, 28 aa, Artificial Sequence
  Description of Artificial Sequence: Synthetic peptide
DENEIRTTNPVATEQYGSVSTLLQHGNR

SEQ ID NO: 12293 - protein, 28 aa, Artificial Sequence
  Description of Artificial Sequence: Synthetic peptide
DEEEIRTTNIVATECYGSVSTNLQHGNR

SEQ ID NO: 12294 - protein, 29 aa, Artificial Sequence
  Description of Artificial Sequence: Synthetic peptide
DDEEIRTTNPVATECYGSVSTNLQDRGNR

SEQ ID NO: 12295 - protein, 28 aa, Artificial Sequence
  Description of Artificial Sequence: Synthetic peptide
DEEEIRCTNIVATEQYGSVSTNLQTGNR

SEQ ID NO: 12296 - protein, 28 aa, Artificial Sequence
  Description of Artificial Sequence: Synthetic peptide
DEEEIRTTNPVATEQYGSVSTDLQQGNV

SEQ ID NO: 12297 - protein, 28 aa, Artificial Sequence
  Description of Artificial Sequence: Synthetic peptide
DEEEIRTTNPVATECYGSVSTDLQYGNR

SEQ ID NO: 12298 - protein, 28 aa, Artificial Sequence
  Description of Artificial Sequence: Synthetic peptide
DEEEIHTTNPVATEQYGEVSTNLQQGNR

SEQ ID NO: 12299 - protein, 28 aa, Artificial Sequence
  Description of Artificial Sequence: Synthetic peptide
SEEEIRTTNPVATEQYGSVSTNEQRGNS

SEQ ID NO: 12300 - protein, 28 aa, Artificial Sequence
  Description of Artificial Sequence: Synthetic peptide
DEEEIRTTNPVATEQYGSVSTGLQTENR

SEQ ID NO: 12301 - protein, 28 aa, Artificial Sequence
  Description of Artificial Sequence: Synthetic peptide
DEEEIRTTNPVATEQYGSVETELQVGNR

SEQ ID NO: 12302 - protein, 28 aa, Artificial Sequence
  Description of Artificial Sequence: Synthetic peptide
DEEEIRTTNIEATEQYGSVSTNLQRGER

SEQ ID NO: 12303 - protein, 28 aa, Artificial Sequence
  Description of Artificial Sequence: Synthetic peptide
DEEEIRTTNIVATEQYGSVSMNLQSGNR

SEQ ID NO: 12304 - protein, 28 aa, Artificial Sequence
  Description of Artificial Sequence: Synthetic peptide
DENEIRTTNPVATEQYGIVSENLQRGNR

SEQ ID NO: 12305 - protein, 28 aa, Artificial Sequence
  Description of Artificial Sequence: Synthetic peptide
QEEEIGTTNPVATEQYGSVSTNLQNGNR

SEQ ID NO: 12306 - protein, 28 aa, Artificial Sequence
  Description of Artificial Sequence: Synthetic peptide
DEEEIVTTNIVATEQYGSVSTNLQRGNT

SEQ ID NO: 12307 - protein, 28 aa, Artificial Sequence
  Description of Artificial Sequence: Synthetic peptide
DEEEIRTTNPVATEQYGSMSEDLQRGNR

SEQ ID NO: 12308 - protein, 28 aa, Artificial Sequence
  Description of Artificial Sequence: Synthetic peptide
DEFEIRTTNPVATEQYGSVSENLQRGNT

SEQ ID NO: 12309 - protein, 28 aa, Artificial Sequence
  Description of Artificial Sequence: Synthetic peptide
DEEEIRTTNPVATEQYGSVSTNEQWGER

SEQ ID NO: 12310 - protein, 28 aa, Artificial Sequence
  Description of Artificial Sequence: Synthetic peptide
DEDEIRTTNPVATEQYGSVSTNLQVGNF

SEQ ID NO: 12311 - protein, 28 aa, Artificial Sequence
  Description of Artificial Sequence: Synthetic peptide
DEEEIRTTNPVATEQYGSVSTYLNRGND

SEQ ID NO: 12312 - protein, 28 aa, Artificial Sequence
  Description of Artificial Sequence: Synthetic peptide
QEEEIRATNPVATEQYGSVSTNLQHGNR

SEQ ID NO: 12313 - protein, 29 aa, Artificial Sequence
  Description of Artificial Sequence: Synthetic peptide
DEEEIRTTNPVATEQYGCVSNNLQRGNFR

SEQ ID NO: 12314 - protein, 28 aa, Artificial Sequence
  Description of Artificial Sequence: Synthetic peptide
DEEEIRTTNPVATEQYGSVSENLQAGNS

SEQ ID NO: 12315 - protein, 28 aa, Artificial Sequence
  Description of Artificial Sequence: Synthetic peptide
DEEEIRTTNPVATEQYGSVDTNLQRPNN

SEQ ID NO: 12316 - protein, 28 aa, Artificial Sequence
  Description of Artificial Sequence: Synthetic peptide
DEQEIRTTNPVATEIYGSVSTNLERGNR

SEQ ID NO: 12317 - protein, 29 aa, Artificial Sequence
  Description of Artificial Sequence: Synthetic peptide
DEHEIRTTNPVATEQYGSVSENLQRNGNR

SEQ ID NO: 12318 - protein, 28 aa, Artificial Sequence
  Description of Artificial Sequence: Synthetic peptide
DEEEIRTTNPVASEIYGSVSTNLERGNR

SEQ ID NO: 12319 - protein, 28 aa, Artificial Sequence
  Description of Artificial Sequence: Synthetic peptide
DEEEIRTTNPVATEPYGSVSTNLQNGNQ

SEQ ID NO: 12320 - protein, 28 aa, Artificial Sequence
  Description of Artificial Sequence: Synthetic peptide
DEEEIRTTNPVATEQYGSVSENLQNGER

SEQ ID NO: 12321 - protein, 28 aa, Artificial Sequence
  Description of Artificial Sequence: Synthetic peptide
DEEEIRTTNPVATEQYGSVSDALQRGNY

SEQ ID NO: 12322 - protein, 29 aa, Artificial Sequence
  Description of Artificial Sequence: Synthetic peptide
DEEEVATTNPVATEQYGSVSTNLQREGNR

SEQ ID NO: 12323 - protein, 28 aa, Artificial Sequence
  Description of Artificial Sequence: Synthetic peptide
DEEEIRTTNIVATEQYGSVSENLQHGNR

SEQ ID NO: 12324 - protein, 29 aa, Artificial Sequence
  Description of Artificial Sequence: Synthetic peptide
DEEEIRTTNPVATEQYGSVSTELQRTANR

SEQ ID NO: 12325 - protein, 29 aa, Artificial Sequence
  Description of Artificial Sequence: Synthetic peptide
DEQEIRTTNPVATEVYGSVSATNLQRGNR

SEQ ID NO: 12326 - protein, 29 aa, Artificial Sequence
  Description of Artificial Sequence: Synthetic peptide
LEEEIRTTNPVATEQYGSVSTNLQRGGNH

SEQ ID NO: 12327 - protein, 28 aa, Artificial Sequence
  Description of Artificial Sequence: Synthetic peptide
DEEEIRTTNIVATEQYGSVSTQLQSGNR

SEQ ID NO: 12328 - protein, 28 aa, Artificial Sequence
  Description of Artificial Sequence: Synthetic peptide
DEEEIRTTNIVATEQYGSVSMNLQRGND

SEQ ID NO: 12329 - protein, 28 aa, Artificial Sequence
  Description of Artificial Sequence: Synthetic peptide
DEEEIRTTNIVATEQYGSVSTDLQHGNR

SEQ ID NO: 12330 - protein, 28 aa, Artificial Sequence
  Description of Artificial Sequence: Synthetic peptide
DEEEIRGTNPVATEQYGSVSTNLQHGMR

SEQ ID NO: 12331 - protein, 29 aa, Artificial Sequence
  Description of Artificial Sequence: Synthetic peptide
DEEEIRTTNPVATEQYGSVSCEDLQRGNR

SEQ ID NO: 12332 - protein, 28 aa, Artificial Sequence
  Description of Artificial Sequence: Synthetic peptide
QEEEIATTNPVATEQYGSVSTNLQSGNR

SEQ ID NO: 12333 - protein, 28 aa, Artificial Sequence
  Description of Artificial Sequence: Synthetic peptide
DEFEIYTTNPVATEQYGSVSTNLQRGNE

SEQ ID NO: 12334 - protein, 28 aa, Artificial Sequence
  Description of Artificial Sequence: Synthetic peptide
DEEEIRTTNPVATEQYGDAGTNLQRGNR

SEQ ID NO: 12335 - protein, 28 aa, Artificial Sequence
  Description of Artificial Sequence: Synthetic peptide
DEEEIRTTNIVATEQYGSVSDNLQRGNG

SEQ ID NO: 12336 - protein, 28 aa, Artificial Sequence
  Description of Artificial Sequence: Synthetic peptide
DEEEIRTTNPVATECYGSVSMNLERGNR

SEQ ID NO: 12337 - protein, 28 aa, Artificial Sequence
  Description of Artificial Sequence: Synthetic peptide
DEEEIRATNPVATECYGSVSTNLQSGNR

SEQ ID NO: 12338 - protein, 28 aa, Artificial Sequence
  Description of Artificial Sequence: Synthetic peptide
DENEIRTTNIVATEQYGSVSTNLQQGNR

SEQ ID NO: 12339 - protein, 29 aa, Artificial Sequence
  Description of Artificial Sequence: Synthetic peptide
DEEEVRTTNPVATEQYGSVATNLQRNGNR

SEQ ID NO: 12340 - protein, 28 aa, Artificial Sequence
  Description of Artificial Sequence: Synthetic peptide
DEEEIVTTNPVATEQYGSVSTNLQAGNM

SEQ ID NO: 12341 - protein, 28 aa, Artificial Sequence
  Description of Artificial Sequence: Synthetic peptide
DENEIRTTNPVATEQYGSVSTNLQGGTR

SEQ ID NO: 12342 - protein, 28 aa, Artificial Sequence
  Description of Artificial Sequence: Synthetic peptide
DEEEIRTTNPVATEQYGSVSENLMRMNR

SEQ ID NO: 12343 - protein, 28 aa, Artificial Sequence
  Description of Artificial Sequence: Synthetic peptide
DEEEIVTTNPVATEQYGSCSTNLQRGTR

SEQ ID NO: 12344 - protein, 28 aa, Artificial Sequence
  Description of Artificial Sequence: Synthetic peptide
DEEEIRTTNPVATEQWGSVSTNLQQGNA

SEQ ID NO: 12345 - protein, 28 aa, Artificial Sequence
  Description of Artificial Sequence: Synthetic peptide
DEEEIRTTNPVATEQYGVVSENLQVGNR

SEQ ID NO: 12346 - protein, 28 aa, Artificial Sequence
  Description of Artificial Sequence: Synthetic peptide
DEEEIRTTNPVATEQYGSVSTNEQQGNH

SEQ ID NO: 12347 - protein, 28 aa, Artificial Sequence
  Description of Artificial Sequence: Synthetic peptide
DEEEIRTTNPVATEQYGVVATNLERGNR

SEQ ID NO: 12348 - protein, 28 aa, Artificial Sequence
  Description of Artificial Sequence: Synthetic peptide
DEEEVRTTNPVATEQYGSVSTNLQRENY

SEQ ID NO: 12349 - protein, 28 aa, Artificial Sequence
  Description of Artificial Sequence: Synthetic peptide
DEVEIRTTNIVATEQYGSVSTNLQNGNR

SEQ ID NO: 12350 - protein, 28 aa, Artificial Sequence
  Description of Artificial Sequence: Synthetic peptide
DEEEIRCTNPVATEQYGSADTNLQRGNR

SEQ ID NO: 12351 - protein, 28 aa, Artificial Sequence
  Description of Artificial Sequence: Synthetic peptide
DEEEIRTTNPVATEQYGSVSTELQQGNM

SEQ ID NO: 12352 - protein, 29 aa, Artificial Sequence
  Description of Artificial Sequence: Synthetic peptide
DEEEIRTTNPVATELYGSVSTNLQMRGNA

SEQ ID NO: 12353 - protein, 28 aa, Artificial Sequence
  Description of Artificial Sequence: Synthetic peptide
DEEEIRTTNPVATEQYGSVSTNEAQGNR

SEQ ID NO: 12354 - protein, 28 aa, Artificial Sequence
  Description of Artificial Sequence: Synthetic peptide
DEEEIRTTNPTATEQFGSVSTNLQRGNL

SEQ ID NO: 12355 - protein, 28 aa, Artificial Sequence
  Description of Artificial Sequence: Synthetic peptide
DEEEIRTTNPVATEQYGVVSTNLQYGER

SEQ ID NO: 12356 - protein, 28 aa, Artificial Sequence
  Description of Artificial Sequence: Synthetic peptide
DEEEIRTTNPVATEQYGSVSTNLMQGDR

SEQ ID NO: 12357 - protein, 28 aa, Artificial Sequence
  Description of Artificial Sequence: Synthetic peptide
DEEEIRTTNPVATECYGSVSTNLQQGER

SEQ ID NO: 12358 - protein, 28 aa, Artificial Sequence
  Description of Artificial Sequence: Synthetic peptide
DEQEIRTTNPVATEQYGSVSTNLQQGNQ

SEQ ID NO: 12359 - protein, 28 aa, Artificial Sequence
  Description of Artificial Sequence: Synthetic peptide
DEGEIRTTNPVATEMYGSVSENLQRGNR

SEQ ID NO: 12360 - protein, 28 aa, Artificial Sequence
  Description of Artificial Sequence: Synthetic peptide
DEEEIRQTNPVATEQYGSVSTNQQNGNR

SEQ ID NO: 12361 - protein, 28 aa, Artificial Sequence
  Description of Artificial Sequence: Synthetic peptide
DEGEIRTTNPVATEQYGSVPDNLQRGNR

SEQ ID NO: 12362 - protein, 28 aa, Artificial Sequence
  Description of Artificial Sequence: Synthetic peptide
DEEEIRATNPVATEMYGSVSTNLQSGNR

SEQ ID NO: 12363 - protein, 29 aa, Artificial Sequence
  Description of Artificial Sequence: Synthetic peptide
DEEEIRTTNPVATEQYGSVSTNQQREGNH

SEQ ID NO: 12364 - protein, 29 aa, Artificial Sequence
  Description of Artificial Sequence: Synthetic peptide
DEEEIRTTNPVATEQYGSVSTNLQFKGDR

SEQ ID NO: 12365 - protein, 28 aa, Artificial Sequence
  Description of Artificial Sequence: Synthetic peptide
DEEEIRTTNPVATEQYGSVSTELQMGNL

SEQ ID NO: 12366 - protein, 28 aa, Artificial Sequence
  Description of Artificial Sequence: Synthetic peptide
DEEEIATTNPVATEQYGSVSTNEQIGNR

SEQ ID NO: 12367 - protein, 28 aa, Artificial Sequence
  Description of Artificial Sequence: Synthetic peptide
DEEEIATTNPVATEQYGSVSTNLQNGNL

SEQ ID NO: 12368 - protein, 28 aa, Artificial Sequence
  Description of Artificial Sequence: Synthetic peptide
DEEEIRTTNPVATESYGSVSTNLQHENR

SEQ ID NO: 12369 - protein, 29 aa, Artificial Sequence
  Description of Artificial Sequence: Synthetic peptide
DEEEIRTTNPVATEQYGSVSTNLQHGNDA

SEQ ID NO: 12370 - protein, 28 aa, Artificial Sequence
  Description of Artificial Sequence: Synthetic peptide
DEEEIRTTNPVATEQYGQVSTNGQIGNR

SEQ ID NO: 12371 - protein, 28 aa, Artificial Sequence
  Description of Artificial Sequence: Synthetic peptide
DEEEIRTTNPVATEQYGCVSTNLQHGNN

SEQ ID NO: 12372 - protein, 28 aa, Artificial Sequence
  Description of Artificial Sequence: Synthetic peptide
DEEEIRCTNPVATELYGSVSTNLQRGNA

SEQ ID NO: 12373 - protein, 28 aa, Artificial Sequence
  Description of Artificial Sequence: Synthetic peptide
SEEEIRPTNPVATEQYGSVSTNDQRGNR

SEQ ID NO: 12374 - protein, 28 aa, Artificial Sequence
  Description of Artificial Sequence: Synthetic peptide
AEEEIATTNPVATEQYGSVSTNLQHGNR

SEQ ID NO: 12375 - protein, 28 aa, Artificial Sequence
  Description of Artificial Sequence: Synthetic peptide
DEQEIRTTNPVATEQYGSVSTNLQHGNN

SEQ ID NO: 12376 - protein, 28 aa, Artificial Sequence
  Description of Artificial Sequence: Synthetic peptide
MEEEIRTTNPVATEQYGSVSTNLQIGNQ

SEQ ID NO: 12377 - protein, 28 aa, Artificial Sequence
  Description of Artificial Sequence: Synthetic peptide
DEEEIRTTNPIATETYGSVSENLQRGNR

SEQ ID NO: 12378 - protein, 28 aa, Artificial Sequence
  Description of Artificial Sequence: Synthetic peptide
MENEIRTTNPVATEQYGSVSTNLQRGNA

SEQ ID NO: 12379 - protein, 28 aa, Artificial Sequence
  Description of Artificial Sequence: Synthetic peptide
DEEEIRTTNPVATELYGSVSTNLQRGDF

SEQ ID NO: 12380 - protein, 28 aa, Artificial Sequence
  Description of Artificial Sequence: Synthetic peptide
DEEEIATTNPVAHEQYGSVSTNLQRGNF

SEQ ID NO: 12381 - protein, 28 aa, Artificial Sequence
  Description of Artificial Sequence: Synthetic peptide
KEEEIRTTNPVATEQYGSVSTNLQRGEV

SEQ ID NO: 12382 - protein, 29 aa, Artificial Sequence
  Description of Artificial Sequence: Synthetic peptide
DEEEIRTTNPVATEQYGSVSENLQQRGNA

SEQ ID NO: 12383 - protein, 28 aa, Artificial Sequence
  Description of Artificial Sequence: Synthetic peptide
DEEEIRTTNPVATEQYGEVSTALQMGNR

SEQ ID NO: 12384 - protein, 28 aa, Artificial Sequence
  Description of Artificial Sequence: Synthetic peptide
DEEEICTTNPVATEPYGSVDTNLQRGNR

SEQ ID NO: 12385 - protein, 28 aa, Artificial Sequence
  Description of Artificial Sequence: Synthetic peptide
DEEEIRTTNPVATEMYGTVSTNLQRGER

SEQ ID NO: 12386 - protein, 28 aa, Artificial Sequence
  Description of Artificial Sequence: Synthetic peptide
DEEEIRTTNIVATEQYGSVSTDLQDGNR

SEQ ID NO: 12387 - protein, 28 aa, Artificial Sequence
  Description of Artificial Sequence: Synthetic peptide
DEEEIRQTNPVATEQYGSVSANLQRGND

SEQ ID NO: 12388 - protein, 29 aa, Artificial Sequence
  Description of Artificial Sequence: Synthetic peptide
DEEEIRTTNPVATEQYGSVSTNLQNGNTA

SEQ ID NO: 12389 - protein, 28 aa, Artificial Sequence
  Description of Artificial Sequence: Synthetic peptide
DEEEIRTTNIVATEQYGSVSTNLQFGND

SEQ ID NO: 12390 - protein, 28 aa, Artificial Sequence
  Description of Artificial Sequence: Synthetic peptide
NEEEIRCTNPVATEQYGSVSTNLERGNR

SEQ ID NO: 12391 - protein, 28 aa, Artificial Sequence
  Description of Artificial Sequence: Synthetic peptide
DEEEIRTTNIVATDQYGSVSTNLQNGNR

SEQ ID NO: 12392 - protein, 29 aa, Artificial Sequence
  Description of Artificial Sequence: Synthetic peptide
LEEEIRTTNPVATEQYGSVSENLQSRGNR

SEQ ID NO: 12393 - protein, 29 aa, Artificial Sequence
  Description of Artificial Sequence: Synthetic peptide
DEEEIRTTNPCATEQYGSVSTNLQRGMER

SEQ ID NO: 12394 - protein, 28 aa, Artificial Sequence
  Description of Artificial Sequence: Synthetic peptide
DEEEIRQTNPVATEQYGWVSTNLQDGNR

SEQ ID NO: 12395 - protein, 28 aa, Artificial Sequence
  Description of Artificial Sequence: Synthetic peptide
DEEEIRTTNIVATEQYGSVSTNLQREDR

SEQ ID NO: 12396 - protein, 28 aa, Artificial Sequence
  Description of Artificial Sequence: Synthetic peptide
DEEEIATTNPVCTEQYGSVSTNDQRGNR

SEQ ID NO: 12397 - protein, 28 aa, Artificial Sequence
  Description of Artificial Sequence: Synthetic peptide
DEEEIRTTNPVATEQYGSVSTAEERGNR

SEQ ID NO: 12398 - protein, 28 aa, Artificial Sequence
  Description of Artificial Sequence: Synthetic peptide
QEEEIRTTNPVATEQYGSVSTNLQRGQA

SEQ ID NO: 12399 - protein, 28 aa, Artificial Sequence
  Description of Artificial Sequence: Synthetic peptide
DEEEIRTTNIVATTQYGSVSTNLQGGNR

SEQ ID NO: 12400 - protein, 28 aa, Artificial Sequence
  Description of Artificial Sequence: Synthetic peptide
DEEEIRTTNIVATEQYGSVSTNVQRGNQ

SEQ ID NO: 12401 - protein, 28 aa, Artificial Sequence
  Description of Artificial Sequence: Synthetic peptide
DEEEIRTTNPVATETYGSVSENLQRGNE

SEQ ID NO: 12402 - protein, 28 aa, Artificial Sequence
  Description of Artificial Sequence: Synthetic peptide
DEEEIRTTNPVATECYGSVSYNLQRGNF

SEQ ID NO: 12403 - protein, 30 aa, Artificial Sequence
  Description of Artificial Sequence: Synthetic polypeptide
DEEEIRTTNPVATEQYGSVSMNLQVREGNR

SEQ ID NO: 12404 - protein, 28 aa, Artificial Sequence
  Description of Artificial Sequence: Synthetic peptide
DEEEIRTTNPVATEMYGSVSTDQQRGNR

SEQ ID NO: 12405 - protein, 28 aa, Artificial Sequence
  Description of Artificial Sequence: Synthetic peptide
DEEEIVTTNPVATEQYGNVSTNLQRGNL

SEQ ID NO: 12406 - protein, 28 aa, Artificial Sequence
  Description of Artificial Sequence: Synthetic peptide
DEEEIRTTNIVATEQYGSVSTDLQRENR

SEQ ID NO: 12407 - protein, 28 aa, Artificial Sequence
  Description of Artificial Sequence: Synthetic peptide
DEEEIRTTNIVATEQYGCVSTNLQRGER

SEQ ID NO: 12408 - protein, 28 aa, Artificial Sequence
  Description of Artificial Sequence: Synthetic peptide
DEEEIRTTNIVATEQYGSVSTNLQLGNH

SEQ ID NO: 12409 - protein, 28 aa, Artificial Sequence
  Description of Artificial Sequence: Synthetic peptide
DEEEIATTNPVATEMYGSVSTVLQRGNR

SEQ ID NO: 12410 - protein, 28 aa, Artificial Sequence
  Description of Artificial Sequence: Synthetic peptide
SEEEIRTTNPTATEQFGSVSTNLQRGNR

SEQ ID NO: 12411 - protein, 28 aa, Artificial Sequence
  Description of Artificial Sequence: Synthetic peptide
DEEEIATTNPTATEQYGSVSTNLQRGNF

SEQ ID NO: 12412 - protein, 28 aa, Artificial Sequence
  Description of Artificial Sequence: Synthetic peptide
DECEIRTTNIVATEQYGSVSTNLQVGNR

SEQ ID NO: 12413 - protein, 28 aa, Artificial Sequence
  Description of Artificial Sequence: Synthetic peptide
DEEEIRTTNPVATEQYGSVSDNDQRENR

SEQ ID NO: 12414 - protein, 28 aa, Artificial Sequence
  Description of Artificial Sequence: Synthetic peptide
DEEEIRTTNPCATEQYGSVSTNDQFGNR

SEQ ID NO: 12415 - protein, 28 aa, Artificial Sequence
  Description of Artificial Sequence: Synthetic peptide
DEEEIRTTNIVATEQYGSVSTNGQNGNR

SEQ ID NO: 12416 - protein, 28 aa, Artificial Sequence
  Description of Artificial Sequence: Synthetic peptide
DEEEVRTTNPVATEQYGSVSTNLQQMNR

SEQ ID NO: 12417 - protein, 28 aa, Artificial Sequence
  Description of Artificial Sequence: Synthetic peptide
DEEEIRTTNPVATEMYGSVSTNLQHGNL

SEQ ID NO: 12418 - protein, 28 aa, Artificial Sequence
  Description of Artificial Sequence: Synthetic peptide
DEEEIRTTNPVATEQYGVVSTNLQQGNN

SEQ ID NO: 12419 - protein, 28 aa, Artificial Sequence
  Description of Artificial Sequence: Synthetic peptide
DEEEIRTTNPVATEQYGSVSDELQRGNQ

SEQ ID NO: 12420 - protein, 28 aa, Artificial Sequence
  Description of Artificial Sequence: Synthetic peptide
DEEEIRTTNPVATEQYGSVSTNLESGVR

SEQ ID NO: 12421 - protein, 28 aa, Artificial Sequence
  Description of Artificial Sequence: Synthetic peptide
DEEEIRTTNPVATECYGSVSENLQRGER

SEQ ID NO: 12422 - protein, 28 aa, Artificial Sequence
  Description of Artificial Sequence: Synthetic peptide
DEMEIRTTNPVATEQYGSVSENLQNGNR

SEQ ID NO: 12423 - protein, 28 aa, Artificial Sequence
  Description of Artificial Sequence: Synthetic peptide
DEEEIRTTNPVSTEQYGVVSTNLQRLNR

SEQ ID NO: 12424 - protein, 28 aa, Artificial Sequence
  Description of Artificial Sequence: Synthetic peptide
DEEEIRTTNPVATEQYGSVSTGLQGGNL

SEQ ID NO: 12425 - protein, 28 aa, Artificial Sequence
  Description of Artificial Sequence: Synthetic peptide
DEEEIRTTNIVATEQYGSVSTNDQFGNR

SEQ ID NO: 12426 - protein, 30 aa, Artificial Sequence
  Description of Artificial Sequence: Synthetic polypeptide
DEEEIRTTNPVATEQYGSVSTNLQRNEINR

SEQ ID NO: 12427 - protein, 28 aa, Artificial Sequence
  Description of Artificial Sequence: Synthetic peptide
DEEEIRTTNIVATEQYGSVSTELQNGNR

SEQ ID NO: 12428 - protein, 28 aa, Artificial Sequence
  Description of Artificial Sequence: Synthetic peptide
DEEEIRQTNPVATEQYGSVSEGLQRGNR

SEQ ID NO: 12429 - protein, 28 aa, Artificial Sequence
  Description of Artificial Sequence: Synthetic peptide
DEEEIRTTNPVATEQYGSVSCVLQRGNL

SEQ ID NO: 12430 - protein, 29 aa, Artificial Sequence
  Description of Artificial Sequence: Synthetic peptide
DEEEIRTTNPVATEQYGSVSENLQDRGNF

SEQ ID NO: 12431 - protein, 29 aa, Artificial Sequence
  Description of Artificial Sequence: Synthetic peptide
DEEEIRTTNPVATECYGSVSTNLQYGNDR

SEQ ID NO: 12432 - protein, 28 aa, Artificial Sequence
  Description of Artificial Sequence: Synthetic peptide
DEEEIRTTNPVATEQYGNVSTNLQRGTQ

SEQ ID NO: 12433 - protein, 31 aa, Artificial Sequence
  Description of Artificial Sequence: Synthetic polypeptide
DEEEIRTTNPVATEQYGSVSTNLQEREGENR

SEQ ID NO: 12434 - protein, 28 aa, Artificial Sequence
  Description of Artificial Sequence: Synthetic peptide
DEEEIRTTNIVATEQYGSVSTNEQHGNR

SEQ ID NO: 12435 - protein, 28 aa, Artificial Sequence
  Description of Artificial Sequence: Synthetic peptide
DEEEIRTTNPTATELYGSVSTDLQRGNR

SEQ ID NO: 12436 - protein, 28 aa, Artificial Sequence
  Description of Artificial Sequence: Synthetic peptide
DEEEIRTTNPVATEQYGSVSTNPQEGNH

SEQ ID NO: 12437 - protein, 28 aa, Artificial Sequence
  Description of Artificial Sequence: Synthetic peptide
DEEEIRTTNPVATEQYGSVSTDLQRGEF

SEQ ID NO: 12438 - protein, 28 aa, Artificial Sequence
  Description of Artificial Sequence: Synthetic peptide
DEEEIRTTNPVATECYGSVSTELQRGNQ

SEQ ID NO: 12439 - protein, 28 aa, Artificial Sequence
  Description of Artificial Sequence: Synthetic peptide
DEEEIRTTNIVATEQYGSVSTDLQRGNN

SEQ ID NO: 12440 - protein, 28 aa, Artificial Sequence
  Description of Artificial Sequence: Synthetic peptide
DEEEIRTTNPVATECYGSVSANLQRGPR

SEQ ID NO: 12441 - protein, 28 aa, Artificial Sequence
  Description of Artificial Sequence: Synthetic peptide
DENEIRTTNPVATEQYGSVSTELERGNR

SEQ ID NO: 12442 - protein, 28 aa, Artificial Sequence
  Description of Artificial Sequence: Synthetic peptide
DEEEIRATNPVATEQYGSVSTNLIQGNR

SEQ ID NO: 12443 - protein, 28 aa, Artificial Sequence
  Description of Artificial Sequence: Synthetic peptide
DEAEIRTTNPVATEQYGSVSTALQRGND

SEQ ID NO: 12444 - protein, 28 aa, Artificial Sequence
  Description of Artificial Sequence: Synthetic peptide
AEEEIRTTNPVATEQYGWVSENLQRGNR

SEQ ID NO: 12445 - protein, 29 aa, Artificial Sequence
  Description of Artificial Sequence: Synthetic peptide
DEEEIRTTNPVATEQYGSVSTNLQWFGIR

SEQ ID NO: 12446 - protein, 28 aa, Artificial Sequence
  Description of Artificial Sequence: Synthetic peptide
DEEEIRTTNIVATEQYGSVSTELQRGND

SEQ ID NO: 12447 - protein, 30 aa, Artificial Sequence
  Description of Artificial Sequence: Synthetic polypeptide
QEEEIRTTNPVATEQYGSVSTNLQDRGDNR

SEQ ID NO: 12448 - protein, 28 aa, Artificial Sequence
  Description of Artificial Sequence: Synthetic peptide
NEEEIRTTNIVATEQYGSVSTNLQRGNS

SEQ ID NO: 12449 - protein, 28 aa, Artificial Sequence
  Description of Artificial Sequence: Synthetic peptide
DEEEIRTTNIVATEQYGSVSTNEQRGER

SEQ ID NO: 12450 - protein, 28 aa, Artificial Sequence
  Description of Artificial Sequence: Synthetic peptide
DEEEIRTTNIVATEQYGVVSTNLQRENR

SEQ ID NO: 12451 - protein, 28 aa, Artificial Sequence
  Description of Artificial Sequence: Synthetic peptide
DEEEIRTTNPVATEQYGSVSENLQGGER

SEQ ID NO: 12452 - protein, 29 aa, Artificial Sequence
  Description of Artificial Sequence: Synthetic peptide
DEQEIRTTNPVATEQYGSVSTNLQRAGNG

SEQ ID NO: 12453 - protein, 28 aa, Artificial Sequence
  Description of Artificial Sequence: Synthetic peptide
DEEEIRTTNPVATECYGSVSTNLERGNQ

SEQ ID NO: 12454 - protein, 28 aa, Artificial Sequence
  Description of Artificial Sequence: Synthetic peptide
DEEEIRTTNIVATEQYGSVSTNLQREER

SEQ ID NO: 12455 - protein, 28 aa, Artificial Sequence
  Description of Artificial Sequence: Synthetic peptide
DEEEIRTTNPVATEMYGSVSTNDQRGNY

SEQ ID NO: 12456 - protein, 28 aa, Artificial Sequence
  Description of Artificial Sequence: Synthetic peptide
DEEEIRTTNPVATEQYGSVSENPQRGNF

SEQ ID NO: 12457 - protein, 28 aa, Artificial Sequence
  Description of Artificial Sequence: Synthetic peptide
DENEIRTTNPVATEQYGSVSTDLQRGNM

SEQ ID NO: 12458 - protein, 28 aa, Artificial Sequence
  Description of Artificial Sequence: Synthetic peptide
DEEEIRTTNIVATETYGSVSTNLQRGNE

SEQ ID NO: 12459 - protein, 28 aa, Artificial Sequence
  Description of Artificial Sequence: Synthetic peptide
DEEEIRTTNIVSTEQYGSVSTNLQRGDR

SEQ ID NO: 12460 - protein, 28 aa, Artificial Sequence
  Description of Artificial Sequence: Synthetic peptide
DEEEIRTTNPVATEQYGSVSTNCQHGNH

SEQ ID NO: 12461 - protein, 28 aa, Artificial Sequence
  Description of Artificial Sequence: Synthetic peptide
DEEEIRTTNPVATEQWGSVSENLQRGNH

SEQ ID NO: 12462 - protein, 28 aa, Artificial Sequence
  Description of Artificial Sequence: Synthetic peptide
DEEEIATTNPVATEHYGSVSTNLQRGNF

SEQ ID NO: 12463 - protein, 28 aa, Artificial Sequence
  Description of Artificial Sequence: Synthetic peptide
DEEEIRTTNPVATEQYGSVSTELQAGNN

SEQ ID NO: 12464 - protein, 28 aa, Artificial Sequence
  Description of Artificial Sequence: Synthetic peptide
DEEEIRTTNPVATECYGIVSTNLQHGNR

SEQ ID NO: 12465 - protein, 28 aa, Artificial Sequence
  Description of Artificial Sequence: Synthetic peptide
DEEEIRTTNPVATEQYGGVSENLQRGNH

SEQ ID NO: 12466 - protein, 28 aa, Artificial Sequence
  Description of Artificial Sequence: Synthetic peptide
DEEEIRTTNPCATEQYGSVSTDLQRGNQ

SEQ ID NO: 12467 - protein, 28 aa, Artificial Sequence
  Description of Artificial Sequence: Synthetic peptide
DEEEIRTTNPTATEQYGGVSTNLQQGNR

SEQ ID NO: 12468 - protein, 28 aa, Artificial Sequence
  Description of Artificial Sequence: Synthetic peptide
DEEEIRTTNPVATEQYGSVSTNEQLGTR

SEQ ID NO: 12469 - protein, 28 aa, Artificial Sequence
  Description of Artificial Sequence: Synthetic peptide
DEEEVATTNPVATEQYGSVSTDLQRGNR

SEQ ID NO: 12470 - protein, 28 aa, Artificial Sequence
  Description of Artificial Sequence: Synthetic peptide
DEEEIAATNPVATEQYGWVSTNLQRGNR

SEQ ID NO: 12471 - protein, 28 aa, Artificial Sequence
  Description of Artificial Sequence: Synthetic peptide
DEEEIRTTNPVATEFYGSVSTNLEHGNR

SEQ ID NO: 12472 - protein, 28 aa, Artificial Sequence
  Description of Artificial Sequence: Synthetic peptide
DEEEIRTTNIVATEQYGSVSTELQRGNG

SEQ ID NO: 12473 - protein, 28 aa, Artificial Sequence
  Description of Artificial Sequence: Synthetic peptide
DEEEIRTTNPVATEQFGSVSTNLQSGTR

SEQ ID NO: 12474 - protein, 28 aa, Artificial Sequence
  Description of Artificial Sequence: Synthetic peptide
AEEEIRTTNPVATEQYGTVSTNLQRGGR

SEQ ID NO: 12475 - protein, 28 aa, Artificial Sequence
  Description of Artificial Sequence: Synthetic peptide
DEEEIRTTNPVATEQYGSVSTELQHGNY

SEQ ID NO: 12476 - protein, 28 aa, Artificial Sequence
  Description of Artificial Sequence: Synthetic peptide
DEEEIRTTNPVATEVYGSVSTELDRGNR

SEQ ID NO: 12477 - protein, 28 aa, Artificial Sequence
  Description of Artificial Sequence: Synthetic peptide
DEEEIRCTNPVATEQYGSVSTNLQRGDY

SEQ ID NO: 12478 - protein, 28 aa, Artificial Sequence
  Description of Artificial Sequence: Synthetic peptide
DEEEIRTTNPVATEQYGSVSTNPQHGNF

SEQ ID NO: 12479 - protein, 28 aa, Artificial Sequence
  Description of Artificial Sequence: Synthetic peptide
DEEEIRTTNIVATETYGSVSTNLQEGNR

SEQ ID NO: 12480 - protein, 28 aa, Artificial Sequence
  Description of Artificial Sequence: Synthetic peptide
DEEEIRTTNPVATEQYGSMSTDLQRGNF

SEQ ID NO: 12481 - protein, 28 aa, Artificial Sequence
  Description of Artificial Sequence: Synthetic peptide
DEEEIRTTNIEATECYGSVSTNLQRGNR

SEQ ID NO: 12482 - protein, 28 aa, Artificial Sequence
  Description of Artificial Sequence: Synthetic peptide
DEEEIRTTNPVATEQYGSASENLQRGNT

SEQ ID NO: 12483 - protein, 28 aa, Artificial Sequence
  Description of Artificial Sequence: Synthetic peptide
DEEEIRTTNPVAFEQYGSVSENLQRGER

SEQ ID NO: 12484 - protein, 29 aa, Artificial Sequence
  Description of Artificial Sequence: Synthetic peptide
DEEEIRTTNPTATEQYGGVSTNLQDRGNR

SEQ ID NO: 12485 - protein, 28 aa, Artificial Sequence
  Description of Artificial Sequence: Synthetic peptide
DEEEIMTTNPVATEQYGSVSTNWQQGNR

SEQ ID NO: 12486 - protein, 28 aa, Artificial Sequence
  Description of Artificial Sequence: Synthetic peptide
DEEEIRTTNIVATEQYGSVSTNDQRGNN

SEQ ID NO: 12487 - protein, 28 aa, Artificial Sequence
  Description of Artificial Sequence: Synthetic peptide
DEQEIATTNPVATEQYGSCSTNLQRGNR

SEQ ID NO: 12488 - protein, 28 aa, Artificial Sequence
  Description of Artificial Sequence: Synthetic peptide
DEEEIRTTNPVATEWYGDVSTNLQRGNV

SEQ ID NO: 12489 - protein, 29 aa, Artificial Sequence
  Description of Artificial Sequence: Synthetic peptide
DEEEIRTTNPVSTEQYGSVSTNLQRNGND

SEQ ID NO: 12490 - protein, 28 aa, Artificial Sequence
  Description of Artificial Sequence: Synthetic peptide
DEEEIRTTNPVATEQYGSVSTNPQHGNG

SEQ ID NO: 12491 - protein, 28 aa, Artificial Sequence
  Description of Artificial Sequence: Synthetic peptide
DEEEIRTTNPVATEVYGSVCTNEQRGNR

SEQ ID NO: 12492 - protein, 28 aa, Artificial Sequence
  Description of Artificial Sequence: Synthetic peptide
GEEEIGTTNPCATEQYGSVSTNLQRGNR

SEQ ID NO: 12493 - protein, 28 aa, Artificial Sequence
  Description of Artificial Sequence: Synthetic peptide
DEEEIRTTNPVATEQYGNASTQLQRGNR

SEQ ID NO: 12494 - protein, 28 aa, Artificial Sequence
  Description of Artificial Sequence: Synthetic peptide
DEEEIRTTNPVATEVYGSVSTNLQSGNI

SEQ ID NO: 12495 - protein, 28 aa, Artificial Sequence
  Description of Artificial Sequence: Synthetic peptide
DEQEIRTTNPVATEQYGSVSTNLDRGNP

SEQ ID NO: 12496 - protein, 28 aa, Artificial Sequence
  Description of Artificial Sequence: Synthetic peptide
DDEEIRTTNPVATEQYGSASTNLQQGNR

SEQ ID NO: 12497 - protein, 28 aa, Artificial Sequence
  Description of Artificial Sequence: Synthetic peptide
DEEEIRTTNPVATEQYGDVSTNLQHGNQ

SEQ ID NO: 12498 - protein, 28 aa, Artificial Sequence
  Description of Artificial Sequence: Synthetic peptide
DEEEIRTTNPVATEQYGSVSTDLQTGNH

SEQ ID NO: 12499 - protein, 28 aa, Artificial Sequence
  Description of Artificial Sequence: Synthetic peptide
DEEEIRTTNPVATECYGDVSTNLQRENR

SEQ ID NO: 12500 - protein, 28 aa, Artificial Sequence
  Description of Artificial Sequence: Synthetic peptide
DEQEIRTTNPVATEQYGSVSTNLQWGNV

SEQ ID NO: 12501 - protein, 28 aa, Artificial Sequence
  Description of Artificial Sequence: Synthetic peptide
DEEELRTTNPVATEQYGSVSTNLQRENA

SEQ ID NO: 12502 - protein, 28 aa, Artificial Sequence
  Description of Artificial Sequence: Synthetic peptide
DEEEIRATNPVATEQYGSVGTNLQYGNR

SEQ ID NO: 12503 - protein, 28 aa, Artificial Sequence
  Description of Artificial Sequence: Synthetic peptide
DEVEIRTTNPVATEQYGTVSTNLQTGNR

SEQ ID NO: 12504 - protein, 28 aa, Artificial Sequence
  Description of Artificial Sequence: Synthetic peptide
CEEEIRTTNPVATEQYGSVSTNLMRGND

SEQ ID NO: 12505 - protein, 29 aa, Artificial Sequence
  Description of Artificial Sequence: Synthetic peptide
DEEEIRTTNPVATEQFGSVSTNLQDRGTR

SEQ ID NO: 12506 - protein, 28 aa, Artificial Sequence
  Description of Artificial Sequence: Synthetic peptide
DENEIRTTNPVATEQYGSVSTNLQTGNA

SEQ ID NO: 12507 - protein, 28 aa, Artificial Sequence
  Description of Artificial Sequence: Synthetic peptide
DEEEIRTTNIVATEQYGSVSTDLQRGDR

SEQ ID NO: 12508 - protein, 28 aa, Artificial Sequence
  Description of Artificial Sequence: Synthetic peptide
DEEEIRTTNPVATEVYGSVDTNLQHGNR

SEQ ID NO: 12509 - protein, 28 aa, Artificial Sequence
  Description of Artificial Sequence: Synthetic peptide
DEEEIRTTNPVATEQYGSVSDNLQRGEA

SEQ ID NO: 12510 - protein, 28 aa, Artificial Sequence
  Description of Artificial Sequence: Synthetic peptide
NEEEIRTTNIVATEQYGSVSTNLQMGNR

SEQ ID NO: 12511 - protein, 28 aa, Artificial Sequence
  Description of Artificial Sequence: Synthetic peptide
DEEEIATTNPVATEQYGSVSENLQGGNR

SEQ ID NO: 12512 - protein, 28 aa, Artificial Sequence
  Description of Artificial Sequence: Synthetic peptide
DEEEIATTNPVATECYGSVSTNLQRGNN

SEQ ID NO: 12513 - protein, 28 aa, Artificial Sequence
  Description of Artificial Sequence: Synthetic peptide
DEQEIRTTNPVATELYGSVSTNLQSGNR

SEQ ID NO: 12514 - protein, 29 aa, Artificial Sequence
  Description of Artificial Sequence: Synthetic peptide
DENEIRTTNPVATEQYGSVSTNLQRGENN

SEQ ID NO: 12515 - protein, 28 aa, Artificial Sequence
  Description of Artificial Sequence: Synthetic peptide
DEEEIATTNPVATEMYGSVSTALQRGNR

SEQ ID NO: 12516 - protein, 28 aa, Artificial Sequence
  Description of Artificial Sequence: Synthetic peptide
DENEIRTTNPVATEQYGSVSTNEMRGNR

SEQ ID NO: 12517 - protein, 28 aa, Artificial Sequence
  Description of Artificial Sequence: Synthetic peptide
DEEEIRQTNPVATEQYGSVSTGLQRGNN

SEQ ID NO: 12518 - protein, 29 aa, Artificial Sequence
  Description of Artificial Sequence: Synthetic peptide
DENEIRTTNPVATEQYGSVSTNLQRGMDR

SEQ ID NO: 12519 - protein, 28 aa, Artificial Sequence
  Description of Artificial Sequence: Synthetic peptide
DEEEIRTTNPVATEQYGSCSTQLQRGNL

SEQ ID NO: 12520 - protein, 30 aa, Artificial Sequence
  Description of Artificial Sequence: Synthetic polypeptide
DEEEIRTTNPVATEQYGSVSTNLQDTKGNR

SEQ ID NO: 12521 - protein, 28 aa, Artificial Sequence
  Description of Artificial Sequence: Synthetic peptide
DEEEIRTTNPVATETYGSVSDDLQRGNR

SEQ ID NO: 12522 - protein, 29 aa, Artificial Sequence
  Description of Artificial Sequence: Synthetic peptide
DEQEIRTTNPVATEQYGSVSTNLQRNGNM

SEQ ID NO: 12523 - protein, 28 aa, Artificial Sequence
  Description of Artificial Sequence: Synthetic peptide
DEEEIRTTNPVATEQYGSVSTGLERGNS

SEQ ID NO: 12524 - protein, 28 aa, Artificial Sequence
  Description of Artificial Sequence: Synthetic peptide
DEEEIRTTNPVATEQYGSVSTNGQSGNL

SEQ ID NO: 12525 - protein, 29 aa, Artificial Sequence
  Description of Artificial Sequence: Synthetic peptide
DEEEIRTTNPVATEQYGSVSTDLQRKGNS

SEQ ID NO: 12526 - protein, 28 aa, Artificial Sequence
  Description of Artificial Sequence: Synthetic peptide
DEEEIRTTNPVATEQYGSVSTNEQWGNL

SEQ ID NO: 12527 - protein, 28 aa, Artificial Sequence
  Description of Artificial Sequence: Synthetic peptide
DEEEICTTNPVATECYGSVSTNLQTGNR

SEQ ID NO: 12528 - protein, 28 aa, Artificial Sequence
  Description of Artificial Sequence: Synthetic peptide
AEEEIRTTNPVATEQYGSVSTNPQRGER

SEQ ID NO: 12529 - protein, 28 aa, Artificial Sequence
  Description of Artificial Sequence: Synthetic peptide
DEEEIRTTNPVATEQYGSVSTNEQLGNN

SEQ ID NO: 12530 - protein, 28 aa, Artificial Sequence
  Description of Artificial Sequence: Synthetic peptide
DEEEIRSTNIVATEQYGSVSTNLQRGND

SEQ ID NO: 12531 - protein, 28 aa, Artificial Sequence
  Description of Artificial Sequence: Synthetic peptide
DEEEIATTNPVSTEQYGSVSTNLQQGNR

SEQ ID NO: 12532 - protein, 29 aa, Artificial Sequence
  Description of Artificial Sequence: Synthetic peptide
DEEEIRTTNPVATEQYGSVATNLQRGLER

SEQ ID NO: 12533 - protein, 28 aa, Artificial Sequence
  Description of Artificial Sequence: Synthetic peptide
DEEEIRTTNPVSTEQYGSVATNLQRGGR

SEQ ID NO: 12534 - protein, 28 aa, Artificial Sequence
  Description of Artificial Sequence: Synthetic peptide
DEEEIRTTNPVATEQYGSVAEVLQRGNR

SEQ ID NO: 12535 - protein, 28 aa, Artificial Sequence
  Description of Artificial Sequence: Synthetic peptide
DEEEIRTTNPCCTEQYGSVSTDLQRGNR

SEQ ID NO: 12536 - protein, 28 aa, Artificial Sequence
  Description of Artificial Sequence: Synthetic peptide
DEAEIRTTNPVATEQYGSVSMNLQVGNR

SEQ ID NO: 12537 - protein, 28 aa, Artificial Sequence
  Description of Artificial Sequence: Synthetic peptide
DEEEVRTTNPVATEQYGSVSDNLQSGNR

SEQ ID NO: 12538 - protein, 28 aa, Artificial Sequence
  Description of Artificial Sequence: Synthetic peptide
DEEEIRCTNPVATEQYGDVSTILQRGNR

SEQ ID NO: 12539 - protein, 28 aa, Artificial Sequence
  Description of Artificial Sequence: Synthetic peptide
DEEEVRTTNPVATECYGSVSTNLQRGNI

SEQ ID NO: 12540 - protein, 28 aa, Artificial Sequence
  Description of Artificial Sequence: Synthetic peptide
DENEIRTTNPVATEQYGGVSTNLQRGNF

SEQ ID NO: 12541 - protein, 29 aa, Artificial Sequence
  Description of Artificial Sequence: Synthetic peptide
DEEEIRTTNPVATEIYGSVSTNPQRGENR

SEQ ID NO: 12542 - protein, 28 aa, Artificial Sequence
  Description of Artificial Sequence: Synthetic peptide
DEEEIRQTNPIATEQYGSVSTNLQRGNT

SEQ ID NO: 12543 - protein, 28 aa, Artificial Sequence
  Description of Artificial Sequence: Synthetic peptide
DENEIRTTNPVATEQYGSVSENLQRGNW

SEQ ID NO: 12544 - protein, 29 aa, Artificial Sequence
  Description of Artificial Sequence: Synthetic peptide
DEEEIRTTNPVATEQYGSVSTLLQMRGNG

SEQ ID NO: 12545 - protein, 31 aa, Artificial Sequence
  Description of Artificial Sequence: Synthetic polypeptide
DEEEIRTTNPVATEQYGSVSSTPNLQRGNDR

SEQ ID NO: 12546 - protein, 28 aa, Artificial Sequence
  Description of Artificial Sequence: Synthetic peptide
DEEEIRTTNPVATEQYGSVSTNEQGGNQ

SEQ ID NO: 12547 - protein, 28 aa, Artificial Sequence
  Description of Artificial Sequence: Synthetic peptide
DEEEIRTTNIVATEIYGSVSTNLQGGNR

SEQ ID NO: 12548 - protein, 28 aa, Artificial Sequence
  Description of Artificial Sequence: Synthetic peptide
DEEEIRTTNPVACEQYGCVSTNLQRGMR

SEQ ID NO: 12549 - protein, 29 aa, Artificial Sequence
  Description of Artificial Sequence: Synthetic peptide
DEEEIRPTNPVATEQYGSVSTNLQIKGNR

SEQ ID NO: 12550 - protein, 28 aa, Artificial Sequence
  Description of Artificial Sequence: Synthetic peptide
AEEEIRTTNIVATEQYGSVSTNLQMGNR

SEQ ID NO: 12551 - protein, 28 aa, Artificial Sequence
  Description of Artificial Sequence: Synthetic peptide
DEQEIRTTNPVATEQYGDVSENLQRGNR

SEQ ID NO: 12552 - protein, 28 aa, Artificial Sequence
  Description of Artificial Sequence: Synthetic peptide
DEEEIRTTNPVATELYGSVSTNLQRGEM

SEQ ID NO: 12553 - protein, 28 aa, Artificial Sequence
  Description of Artificial Sequence: Synthetic peptide
DENEIRTTNPVATEQYGSVSTNLQAGNV

SEQ ID NO: 12554 - protein, 30 aa, Artificial Sequence
  Description of Artificial Sequence: Synthetic polypeptide
DENEIRTTNPVATEQYGSVSATNLQRGENR

SEQ ID NO: 12555 - protein, 28 aa, Artificial Sequence
  Description of Artificial Sequence: Synthetic peptide
DEEEIRTTNPVATEQYGSVSTNPQHGNN

SEQ ID NO: 12556 - protein, 28 aa, Artificial Sequence
  Description of Artificial Sequence: Synthetic peptide
DEEEIRTTNPVATEGYGSVSTVVQRGNR

SEQ ID NO: 12557 - protein, 28 aa, Artificial Sequence
  Description of Artificial Sequence: Synthetic peptide
DEEEIRTTNIVATEQYGSVSENLQQGNR

SEQ ID NO: 12558 - protein, 31 aa, Artificial Sequence
  Description of Artificial Sequence: Synthetic polypeptide
DEEEIRTTNPVATEQYGSVSETNPLQRGDNR

SEQ ID NO: 12559 - protein, 28 aa, Artificial Sequence
  Description of Artificial Sequence: Synthetic peptide
DEEEIRATNPVATEQYGSVSTNLQNGER

SEQ ID NO: 12560 - protein, 28 aa, Artificial Sequence
  Description of Artificial Sequence: Synthetic peptide
DEEEIRTTNPVATEQFGSVSTNLQQGNA

SEQ ID NO: 12561 - protein, 28 aa, Artificial Sequence
  Description of Artificial Sequence: Synthetic peptide
DEEEIRTTNPVATEHFGSVSTNDQRGNR

SEQ ID NO: 12562 - protein, 29 aa, Artificial Sequence
  Description of Artificial Sequence: Synthetic peptide
DEEEIRATNPVATEQYGAVSTNLQREGNR

SEQ ID NO: 12563 - protein, 28 aa, Artificial Sequence
  Description of Artificial Sequence: Synthetic peptide
DEEEIRTTNPVATEQYGDVSTGLQRGER

SEQ ID NO: 12564 - protein, 29 aa, Artificial Sequence
  Description of Artificial Sequence: Synthetic peptide
DEEEIRTTNPVATEQYGSVSENLQNQGNR

SEQ ID NO: 12565 - protein, 28 aa, Artificial Sequence
  Description of Artificial Sequence: Synthetic peptide
DEEEIRTTNIVATEQYGAVSTNLQRGND

SEQ ID NO: 12566 - protein, 28 aa, Artificial Sequence
  Description of Artificial Sequence: Synthetic peptide
DEEEIRTTNPCATEQYGSVSSNLQMGNR

SEQ ID NO: 12567 - protein, 28 aa, Artificial Sequence
  Description of Artificial Sequence: Synthetic peptide
DEEEIRTTNIVATEQYGSVSTNLQIGER

SEQ ID NO: 12568 - protein, 28 aa, Artificial Sequence
  Description of Artificial Sequence: Synthetic peptide
DEEEIRTTNPVAYEQYGSVSHNDQRGNR

SEQ ID NO: 12569 - protein, 28 aa, Artificial Sequence
  Description of Artificial Sequence: Synthetic peptide
SEEEIRTTNPVATEQYGSVSTNLQRGDM

SEQ ID NO: 12570 - protein, 28 aa, Artificial Sequence
  Description of Artificial Sequence: Synthetic peptide
DEEEIRTTNIVATEQYGSCSTNLQRGDR

SEQ ID NO: 12571 - protein, 28 aa, Artificial Sequence
  Description of Artificial Sequence: Synthetic peptide
DEQEIVTTNPVATEQYGVVSTNLQRGNR

SEQ ID NO: 12572 - protein, 28 aa, Artificial Sequence
  Description of Artificial Sequence: Synthetic peptide
DEEEIRTTNPVATEQYGIVSTNLQRGTQ

SEQ ID NO: 12573 - protein, 29 aa, Artificial Sequence
  Description of Artificial Sequence: Synthetic peptide
IEEEIRTTNPVATEQYGSVSTNLQWHGNR

SEQ ID NO: 12574 - protein, 28 aa, Artificial Sequence
  Description of Artificial Sequence: Synthetic peptide
DEEEIRTTNPVATEQYGSVSENLQRENN

SEQ ID NO: 12575 - protein, 28 aa, Artificial Sequence
  Description of Artificial Sequence: Synthetic peptide
DEEEIRATNPVATELYGSVSTNEQRGNR

SEQ ID NO: 12576 - protein, 28 aa, Artificial Sequence
  Description of Artificial Sequence: Synthetic peptide
DEEEIRTTNIVATEQYGSVSTNDQRGER

SEQ ID NO: 12577 - protein, 28 aa, Artificial Sequence
  Description of Artificial Sequence: Synthetic peptide
DEEEIRTTNPVATECYGSVSTNEQRGTR

SEQ ID NO: 12578 - protein, 28 aa, Artificial Sequence
  Description of Artificial Sequence: Synthetic peptide
DEEEIRTTNIVATEQYGVVSTNLQRGNA

SEQ ID NO: 12579 - protein, 28 aa, Artificial Sequence
  Description of Artificial Sequence: Synthetic peptide
DEEEIRTTNPVATEQYGSVSTGLERGNM

SEQ ID NO: 12580 - protein, 28 aa, Artificial Sequence
  Description of Artificial Sequence: Synthetic peptide
DEEEIRTTNPVATEQYGLVSDNLQRGNL

SEQ ID NO: 12581 - protein, 28 aa, Artificial Sequence
  Description of Artificial Sequence: Synthetic peptide
DEEEIRTTNPVATEQYGSVSTDLEHGNR

SEQ ID NO: 12582 - protein, 28 aa, Artificial Sequence
  Description of Artificial Sequence: Synthetic peptide
DEEEIRTTNIVATEQYGSVSTNDQRGNL

SEQ ID NO: 12583 - protein, 28 aa, Artificial Sequence
  Description of Artificial Sequence: Synthetic peptide
DEEEIRTVNPVATEQYGSVSTDLQRGER

SEQ ID NO: 12584 - protein, 28 aa, Artificial Sequence
  Description of Artificial Sequence: Synthetic peptide
QEQEIRTTNPVATEQYGSVSTNLQHGNR

SEQ ID NO: 12585 - protein, 28 aa, Artificial Sequence
  Description of Artificial Sequence: Synthetic peptide
DEEEIRTTNPVATEQYGSVSDNLQHGND

SEQ ID NO: 12586 - protein, 28 aa, Artificial Sequence
  Description of Artificial Sequence: Synthetic peptide
DEEEIRTTNPVATEQYGSVSTNEQQGNI

SEQ ID NO: 12587 - protein, 28 aa, Artificial Sequence
  Description of Artificial Sequence: Synthetic peptide
DEEMIRTTNIVATEQYGSVSTNLQNGNR

SEQ ID NO: 12588 - protein, 28 aa, Artificial Sequence
  Description of Artificial Sequence: Synthetic peptide
DEEEIRTTNPVATEQYGSVSTNLQRPHA

SEQ ID NO: 12589 - protein, 28 aa, Artificial Sequence
  Description of Artificial Sequence: Synthetic peptide
DEEEIRTTNIVATEQYGCVSTNLQLGNR

SEQ ID NO: 12590 - protein, 28 aa, Artificial Sequence
  Description of Artificial Sequence: Synthetic peptide
DEEEIRTTNIVATEQYGSVSTNLQIGNV

SEQ ID NO: 12591 - protein, 28 aa, Artificial Sequence
  Description of Artificial Sequence: Synthetic peptide
DEEEIRATNPVATEQYGSVSVNLQRGNQ

SEQ ID NO: 12592 - protein, 28 aa, Artificial Sequence
  Description of Artificial Sequence: Synthetic peptide
QEQEIRTTNPVATEQYGSVSTNLQRGNN

SEQ ID NO: 12593 - protein, 28 aa, Artificial Sequence
  Description of Artificial Sequence: Synthetic peptide
DENEIRTTNPVATEQYGSVSTNEQRGNF

SEQ ID NO: 12594 - protein, 28 aa, Artificial Sequence
  Description of Artificial Sequence: Synthetic peptide
DEEEIRTTNPVATECYGSVSTNLQSGNI

SEQ ID NO: 12595 - protein, 28 aa, Artificial Sequence
  Description of Artificial Sequence: Synthetic peptide
VEEEIRTTNCVATEQYGSVSTNLQRGNI

SEQ ID NO: 12596 - protein, 28 aa, Artificial Sequence
  Description of Artificial Sequence: Synthetic peptide
DEEEIRTTNIVATEQYGSVGTNLQHGNR

SEQ ID NO: 12597 - protein, 28 aa, Artificial Sequence
  Description of Artificial Sequence: Synthetic peptide
DENEIRTTNPVATEQYGSVSTNEQRGNM

SEQ ID NO: 12598 - protein, 28 aa, Artificial Sequence
  Description of Artificial Sequence: Synthetic peptide
DEEEIRTVNPVSTEQYGSVSTNLQRGNM

SEQ ID NO: 12599 - protein, 28 aa, Artificial Sequence
  Description of Artificial Sequence: Synthetic peptide
DEEEIRTVNPVATEMYGSVSTNLQTGNR

SEQ ID NO: 12600 - protein, 28 aa, Artificial Sequence
  Description of Artificial Sequence: Synthetic peptide
DEEEIRTTNPVATEQYGSVSENPQQGNR

SEQ ID NO: 12601 - protein, 29 aa, Artificial Sequence
  Description of Artificial Sequence: Synthetic peptide
DEEEIATTNPVATEQYGSVSTNLQYEGNR

SEQ ID NO: 12602 - protein, 28 aa, Artificial Sequence
  Description of Artificial Sequence: Synthetic peptide
DEEEIRTTNPVATEQYGVVSTNEQRGNF

SEQ ID NO: 12603 - protein, 28 aa, Artificial Sequence
  Description of Artificial Sequence: Synthetic peptide
DEQEIRTTNPVATEQYGSVSTNLQYGER

SEQ ID NO: 12604 - protein, 29 aa, Artificial Sequence
  Description of Artificial Sequence: Synthetic peptide
DEEEIRTTNPVATEQYGSVSTNLQPQGNG

SEQ ID NO: 12605 - protein, 29 aa, Artificial Sequence
  Description of Artificial Sequence: Synthetic peptide
DEEEIRTTNPVATEQYGDASTNLQRGNDR

SEQ ID NO: 12606 - protein, 28 aa, Artificial Sequence
  Description of Artificial Sequence: Synthetic peptide
SDEEIRTTNPVATEQYGDVSTNLQRGNR

SEQ ID NO: 12607 - protein, 28 aa, Artificial Sequence
  Description of Artificial Sequence: Synthetic peptide
DEVEIRTTNPVATEQYGSVSENLQTGNR

SEQ ID NO: 12608 - protein, 28 aa, Artificial Sequence
  Description of Artificial Sequence: Synthetic peptide
DEEEIRTTNPVATEQYGSVSTDLILGNR

SEQ ID NO: 12609 - protein, 28 aa, Artificial Sequence
  Description of Artificial Sequence: Synthetic peptide
DEEEIRTTNPVATEQYGSVSENLQLGNV

SEQ ID NO: 12610 - protein, 28 aa, Artificial Sequence
  Description of Artificial Sequence: Synthetic peptide
DEEEIRCTNPVATEQYGSYSENLQRGNR

SEQ ID NO: 12611 - protein, 28 aa, Artificial Sequence
  Description of Artificial Sequence: Synthetic peptide
DEEEIRTTNPVATEQYGSVSTELQHGNT

SEQ ID NO: 12612 - protein, 29 aa, Artificial Sequence
  Description of Artificial Sequence: Synthetic peptide
DEEEIRTTNPVATELYGSVSTNLQNRGNF

SEQ ID NO: 12613 - protein, 28 aa, Artificial Sequence
  Description of Artificial Sequence: Synthetic peptide
DEEEIRTTNPVATECYGSVSTNLQSGNM

SEQ ID NO: 12614 - protein, 28 aa, Artificial Sequence
  Description of Artificial Sequence: Synthetic peptide
DEEEIRTTNPVATEQYGTVSTDLQQGNR

SEQ ID NO: 12615 - protein, 28 aa, Artificial Sequence
  Description of Artificial Sequence: Synthetic peptide
DEEEIRTTNPVATEQYGNVSENLQRGNS

SEQ ID NO: 12616 - protein, 28 aa, Artificial Sequence
  Description of Artificial Sequence: Synthetic peptide
DEQEIRTTNPVATEQYGSVSTNLQDGNL

SEQ ID NO: 12617 - protein, 28 aa, Artificial Sequence
  Description of Artificial Sequence: Synthetic peptide
DEEEIRTTNIVATEQYGSVSTNLEQGNR

SEQ ID NO: 12618 - protein, 29 aa, Artificial Sequence
  Description of Artificial Sequence: Synthetic peptide
DEEEIRTTNPVATEQYGSVSTNLQIHGNT

SEQ ID NO: 12619 - protein, 28 aa, Artificial Sequence
  Description of Artificial Sequence: Synthetic peptide
MEEEIRSTNPVATEQYGSVSTNLQRGNM

SEQ ID NO: 12620 - protein, 28 aa, Artificial Sequence
  Description of Artificial Sequence: Synthetic peptide
DDEEIRTTNPVATEQYGSVSTDQQRGNR

SEQ ID NO: 12621 - protein, 28 aa, Artificial Sequence
  Description of Artificial Sequence: Synthetic peptide
QEEEIRTTNIVATEQYGSVSTNLQAGNR

SEQ ID NO: 12622 - protein, 28 aa, Artificial Sequence
  Description of Artificial Sequence: Synthetic peptide
DEEEIRTTNPVATEQYGSVDTNLQGGNM

SEQ ID NO: 12623 - protein, 28 aa, Artificial Sequence
  Description of Artificial Sequence: Synthetic peptide
DEEEIRTTNPVATEQYGSVSTNLENGNM

SEQ ID NO: 12624 - protein, 29 aa, Artificial Sequence
  Description of Artificial Sequence: Synthetic peptide
DEEEVRTTNPVATEQYGCVSTNLQRNGNR

SEQ ID NO: 12625 - protein, 28 aa, Artificial Sequence
  Description of Artificial Sequence: Synthetic peptide
DEEEIRTTNPVATECYGSVATNLQRGND

SEQ ID NO: 12626 - protein, 28 aa, Artificial Sequence
  Description of Artificial Sequence: Synthetic peptide
SEEEIRTTNPVATECYGSVSTNLQRGNN

SEQ ID NO: 12627 - protein, 29 aa, Artificial Sequence
  Description of Artificial Sequence: Synthetic peptide
DEEEIRTTNPVATEQYGSVSEMNPQRGNR

SEQ ID NO: 12628 - protein, 28 aa, Artificial Sequence
  Description of Artificial Sequence: Synthetic peptide
QEEEIRTTNPVATEQYGSASDNLQRGNR

SEQ ID NO: 12629 - protein, 28 aa, Artificial Sequence
  Description of Artificial Sequence: Synthetic peptide
KEEEIATTNPVATEQYGSVSTNLQRGNM

SEQ ID NO: 12630 - protein, 28 aa, Artificial Sequence
  Description of Artificial Sequence: Synthetic peptide
DENEIRTTNPVATEQYGVVSTNLERGNR

SEQ ID NO: 12631 - protein, 29 aa, Artificial Sequence
  Description of Artificial Sequence: Synthetic peptide
DEEEIRTTNPVATEQYGSVSTNWQRGNDE

SEQ ID NO: 12632 - protein, 28 aa, Artificial Sequence
  Description of Artificial Sequence: Synthetic peptide
DEQEIRTTNPVATEQYGSVSTNLQLGNL

SEQ ID NO: 12633 - protein, 28 aa, Artificial Sequence
  Description of Artificial Sequence: Synthetic peptide
DEEEIRTTNIVATEQYGSVSTNEQRGNQ

SEQ ID NO: 12634 - protein, 28 aa, Artificial Sequence
  Description of Artificial Sequence: Synthetic peptide
DEQEIRTTNPVATEQYGEVSTNLQRGNM

SEQ ID NO: 12635 - protein, 28 aa, Artificial Sequence
  Description of Artificial Sequence: Synthetic peptide
DEEEIRTTNIVATEQYGSVSTGLQRGNF

SEQ ID NO: 12636 - protein, 28 aa, Artificial Sequence
  Description of Artificial Sequence: Synthetic peptide
DEEEIRTTNPVATEQYGSVSTNPQFGNA

SEQ ID NO: 12637 - protein, 28 aa, Artificial Sequence
  Description of Artificial Sequence: Synthetic peptide
DEEEIRTTNPVATEQYGSVSTELQIGNM

SEQ ID NO: 12638 - protein, 28 aa, Artificial Sequence
  Description of Artificial Sequence: Synthetic peptide
DEEEIRTTNIVATEQYGSVSTNLQIGDR

SEQ ID NO: 12639 - protein, 28 aa, Artificial Sequence
  Description of Artificial Sequence: Synthetic peptide
DELEIATTNPVATEQYGSVSDNLQRGNR

SEQ ID NO: 12640 - protein, 28 aa, Artificial Sequence
  Description of Artificial Sequence: Synthetic peptide
DEEEIRTTNPVATEQYGSVDENLQNGNR

SEQ ID NO: 12641 - protein, 28 aa, Artificial Sequence
  Description of Artificial Sequence: Synthetic peptide
DEEEIATTNPVATEQFGSTSTNLQRGNR

SEQ ID NO: 12642 - protein, 28 aa, Artificial Sequence
  Description of Artificial Sequence: Synthetic peptide
DEEEIRTTNIVATEQYGSVSSNLQRGNS

SEQ ID NO: 12643 - protein, 28 aa, Artificial Sequence
  Description of Artificial Sequence: Synthetic peptide
DEEEIRTTNPVATEQWGVVSTNLQIGNR

SEQ ID NO: 12644 - protein, 28 aa, Artificial Sequence
  Description of Artificial Sequence: Synthetic peptide
DEDEIRTTNIVATEQYGSVSTNLQRGNN

SEQ ID NO: 12645 - protein, 28 aa, Artificial Sequence
  Description of Artificial Sequence: Synthetic peptide
DEQEIRTTNPVATEQYGSVSTNLQRGPQ

SEQ ID NO: 12646 - protein, 28 aa, Artificial Sequence
  Description of Artificial Sequence: Synthetic peptide
DEEEIRTTNPVATEQWGSNSTNLQRGNF

SEQ ID NO: 12647 - protein, 28 aa, Artificial Sequence
  Description of Artificial Sequence: Synthetic peptide
DEEEIATTNPVATEQYGSVSTNLQHGNN

SEQ ID NO: 12648 - protein, 28 aa, Artificial Sequence
  Description of Artificial Sequence: Synthetic peptide
DEEEIRTTNPVATECYGSVSTNLQAGNE

SEQ ID NO: 12649 - protein, 28 aa, Artificial Sequence
  Description of Artificial Sequence: Synthetic peptide
DEEEIRTTNIVATEQYGSVSTNEQEGNR

SEQ ID NO: 12650 - protein, 28 aa, Artificial Sequence
  Description of Artificial Sequence: Synthetic peptide
DEEEIRTTNPVATECYGSVSTDLQRGNF

SEQ ID NO: 12651 - protein, 28 aa, Artificial Sequence
  Description of Artificial Sequence: Synthetic peptide
DEEEIRTVNPVATEQYGSVSTNEQVGNR

SEQ ID NO: 12652 - protein, 28 aa, Artificial Sequence
  Description of Artificial Sequence: Synthetic peptide
DEEEIRTTNPVATEQYGSVSTNPQHGNV

SEQ ID NO: 12653 - protein, 28 aa, Artificial Sequence
  Description of Artificial Sequence: Synthetic peptide
DENEIRTTNPVATEQWGSVSTNLQRGNF

SEQ ID NO: 12654 - protein, 30 aa, Artificial Sequence
  Description of Artificial Sequence: Synthetic polypeptide
DEVEIRTTNPVATEQYGSVSTNLQRGDNQR

SEQ ID NO: 12655 - protein, 28 aa, Artificial Sequence
  Description of Artificial Sequence: Synthetic peptide
DEEEIRTTNPVATETYGSVSTNLQHGNF

SEQ ID NO: 12656 - protein, 28 aa, Artificial Sequence
  Description of Artificial Sequence: Synthetic peptide
DEEEIRTTNPVCTEQYGSVSENEQRGNR

SEQ ID NO: 12657 - protein, 28 aa, Artificial Sequence
  Description of Artificial Sequence: Synthetic peptide
DEEEIRTTNPVATEQYGEVSTNLQHGNH

SEQ ID NO: 12658 - protein, 28 aa, Artificial Sequence
  Description of Artificial Sequence: Synthetic peptide
DEEEIRTTNPVATEQYGSVSENLQAGNI

SEQ ID NO: 12659 - protein, 29 aa, Artificial Sequence
  Description of Artificial Sequence: Synthetic peptide
DEEEIRTTNPVATEQYGSVSENLQRYGNQ

SEQ ID NO: 12660 - protein, 28 aa, Artificial Sequence
  Description of Artificial Sequence: Synthetic peptide
DEEEIRTTNIVATEQYGEVSTNLQRGNA

SEQ ID NO: 12661 - protein, 28 aa, Artificial Sequence
  Description of Artificial Sequence: Synthetic peptide
DEEEIRSTNPVATEQYGSVSDNIQRGNR

SEQ ID NO: 12662 - protein, 30 aa, Artificial Sequence
  Description of Artificial Sequence: Synthetic polypeptide
DEEEIRTTNPVATEQYGSVSTVNPLQNGNR

SEQ ID NO: 12663 - protein, 29 aa, Artificial Sequence
  Description of Artificial Sequence: Synthetic peptide
DEEEIATTNPVATEQYGSVSTNLQQNGNR

SEQ ID NO: 12664 - protein, 28 aa, Artificial Sequence
  Description of Artificial Sequence: Synthetic peptide
DEEEIRTTNPVATEQYGSVSTNEQNGNL

SEQ ID NO: 12665 - protein, 28 aa, Artificial Sequence
  Description of Artificial Sequence: Synthetic peptide
DEEEIRTTNPVATEVYGSVSTDLQAGNR

SEQ ID NO: 12666 - protein, 28 aa, Artificial Sequence
  Description of Artificial Sequence: Synthetic peptide
DEEEIRTTNIVATECYGSVSTNLQRGNA

SEQ ID NO: 12667 - protein, 28 aa, Artificial Sequence
  Description of Artificial Sequence: Synthetic peptide
DEEEIRTTNPVSTEQYGSVSENLQRGGR

SEQ ID NO: 12668 - protein, 29 aa, Artificial Sequence
  Description of Artificial Sequence: Synthetic peptide
DEEEIATTNPVATEQYGSVSTNLQVNGNR

SEQ ID NO: 12669 - protein, 28 aa, Artificial Sequence
  Description of Artificial Sequence: Synthetic peptide
DEEEIRTTNPVSTEGYGSVSENLQRGNR

SEQ ID NO: 12670 - protein, 28 aa, Artificial Sequence
  Description of Artificial Sequence: Synthetic peptide
DEEEIRATNPVATEQYGSVSTNLQEGNS

SEQ ID NO: 12671 - protein, 28 aa, Artificial Sequence
  Description of Artificial Sequence: Synthetic peptide
AEEEIRTTNPVATEQYGSVSENLQRGNA

SEQ ID NO: 12672 - protein, 30 aa, Artificial Sequence
  Description of Artificial Sequence: Synthetic polypeptide
DEEEIRTTNPVATEQYGSVSTMNLQMGGNR

SEQ ID NO: 12673 - protein, 28 aa, Artificial Sequence
  Description of Artificial Sequence: Synthetic peptide
DEEEIATTNPVATEQWGSVSTNLQHGNR

SEQ ID NO: 12674 - protein, 28 aa, Artificial Sequence
  Description of Artificial Sequence: Synthetic peptide
DEEEIRTTNPVATEQYGSVSTGLQGGER

SEQ ID NO: 12675 - protein, 28 aa, Artificial Sequence
  Description of Artificial Sequence: Synthetic peptide
DEEEIRTTNPVATEQYGSVSTNLERGDM

SEQ ID NO: 12676 - protein, 28 aa, Artificial Sequence
  Description of Artificial Sequence: Synthetic peptide
DEEEIRTTNPVATEQYGSVSTDPQRGNS

SEQ ID NO: 12677 - protein, 29 aa, Artificial Sequence
  Description of Artificial Sequence: Synthetic peptide
DEEEIRTTNPVATEQYGSVSTNLQNQGNA

SEQ ID NO: 12678 - protein, 28 aa, Artificial Sequence
  Description of Artificial Sequence: Synthetic peptide
DEEEIRTTNIVATEQYGSVSTDLQRGNS

SEQ ID NO: 12679 - protein, 29 aa, Artificial Sequence
  Description of Artificial Sequence: Synthetic peptide
QEEEIATTNPVATEQYGSVSTNLQRGNDR

SEQ ID NO: 12680 - protein, 28 aa, Artificial Sequence
  Description of Artificial Sequence: Synthetic peptide
DEEEIRTTNIVATEQYGSVSTNDQRGNA

SEQ ID NO: 12681 - protein, 28 aa, Artificial Sequence
  Description of Artificial Sequence: Synthetic peptide
DEEEIRTTNPVATEQYGSVSTDLQAGNL

SEQ ID NO: 12682 - protein, 28 aa, Artificial Sequence
  Description of Artificial Sequence: Synthetic peptide
SEEEIRTTNPVATEQYGSVSANLQIGNR

SEQ ID NO: 12683 - protein, 28 aa, Artificial Sequence
  Description of Artificial Sequence: Synthetic peptide
GEEEIATTNPVATEQYGVVSTNLQRGNR

SEQ ID NO: 12684 - protein, 28 aa, Artificial Sequence
  Description of Artificial Sequence: Synthetic peptide
DEEELTTTNPVATEQYGSVSTNLQRGMR

SEQ ID NO: 12685 - protein, 29 aa, Artificial Sequence
  Description of Artificial Sequence: Synthetic peptide
DEEEIRTTNPVATEQYGSVSTPPLQNGNR

SEQ ID NO: 12686 - protein, 28 aa, Artificial Sequence
  Description of Artificial Sequence: Synthetic peptide
DEEEIRTVNPVATEQYGSVSTDLQRGTR

SEQ ID NO: 12687 - protein, 28 aa, Artificial Sequence
  Description of Artificial Sequence: Synthetic peptide
DEEEIRTTNPVATEQYGSVSTNLQFGTG

SEQ ID NO: 12688 - protein, 28 aa, Artificial Sequence
  Description of Artificial Sequence: Synthetic peptide
DEEEIRTTNPVATEQYGSVSTDLQHGNI

SEQ ID NO: 12689 - protein, 28 aa, Artificial Sequence
  Description of Artificial Sequence: Synthetic peptide
DEEEIRTTNPVATEQYGSVSDNLQGFNR

SEQ ID NO: 12690 - protein, 28 aa, Artificial Sequence
  Description of Artificial Sequence: Synthetic peptide
DEEEIRTTNPCATEQYGSVDTNLQRENR

SEQ ID NO: 12691 - protein, 28 aa, Artificial Sequence
  Description of Artificial Sequence: Synthetic peptide
DEEEIRTTNIVATEQYGSVSTNDQAGNR

SEQ ID NO: 12692 - protein, 28 aa, Artificial Sequence
  Description of Artificial Sequence: Synthetic peptide
DEEEIRTTNTVATECYGSVSTNLDRGNR

SEQ ID NO: 12693 - protein, 28 aa, Artificial Sequence
  Description of Artificial Sequence: Synthetic peptide
DEEEIRCTNPVATEQYGSVSTELQRGNF

SEQ ID NO: 12694 - protein, 29 aa, Artificial Sequence
  Description of Artificial Sequence: Synthetic peptide
DEEEIRTTNPVATEQYGSVSDTELQRGNN

SEQ ID NO: 12695 - protein, 28 aa, Artificial Sequence
  Description of Artificial Sequence: Synthetic peptide
DEEEIRTTNIVATEQYGSVSTDLQRGNA

SEQ ID NO: 12696 - protein, 28 aa, Artificial Sequence
  Description of Artificial Sequence: Synthetic peptide
DEEEIRTTNPVATEQYGSVSTNLQGGEF

SEQ ID NO: 12697 - protein, 28 aa, Artificial Sequence
  Description of Artificial Sequence: Synthetic peptide
DEEEIRSTNPVATEQYGSVSTNLQTGNA

SEQ ID NO: 12698 - protein, 28 aa, Artificial Sequence
  Description of Artificial Sequence: Synthetic peptide
DEEEIRTTNPVATEQYGVVSTNLQNGNW

SEQ ID NO: 12699 - protein, 28 aa, Artificial Sequence
  Description of Artificial Sequence: Synthetic peptide
DEEEIRTTNPVAVECYGSVSTNLQRGER

SEQ ID NO: 12700 - protein, 28 aa, Artificial Sequence
  Description of Artificial Sequence: Synthetic peptide
DEEEIRTTNPVATEQYGSVSENLQQGNM

SEQ ID NO: 12701 - protein, 28 aa, Artificial Sequence
  Description of Artificial Sequence: Synthetic peptide
DENEIRTTNPVATECYGSVSTNLQIGNR

SEQ ID NO: 12702 - protein, 28 aa, Artificial Sequence
  Description of Artificial Sequence: Synthetic peptide
DEEEIRTTNPVATEQYGSVNDNLQAGNR

SEQ ID NO: 12703 - protein, 28 aa, Artificial Sequence
  Description of Artificial Sequence: Synthetic peptide
DEEEIRTTNPVATEQYGSVSTDLQLGNM

SEQ ID NO: 12704 - protein, 28 aa, Artificial Sequence
  Description of Artificial Sequence: Synthetic peptide
DEEEIRTTNPVATELFGSVSTNEQRGNR

SEQ ID NO: 12705 - protein, 29 aa, Artificial Sequence
  Description of Artificial Sequence: Synthetic peptide
DEEEIRTTNPTATEQYGVVSTNLQREGNR

SEQ ID NO: 12706 - protein, 28 aa, Artificial Sequence
  Description of Artificial Sequence: Synthetic peptide
DENEIRTTNPVATEQYGSVSTNLQTGNM

SEQ ID NO: 12707 - protein, 30 aa, Artificial Sequence
  Description of Artificial Sequence: Synthetic polypeptide
DEEEIRTTNPVATEQYGSVSETDLQREGNR

SEQ ID NO: 12708 - protein, 28 aa, Artificial Sequence
  Description of Artificial Sequence: Synthetic peptide
DEEEIRTTNPVATEQYGSVSDNLQGGNV

SEQ ID NO: 12709 - protein, 29 aa, Artificial Sequence
  Description of Artificial Sequence: Synthetic peptide
DEEEIRTTNPVATEQYGSASTNLQRGFNN

SEQ ID NO: 12710 - protein, 28 aa, Artificial Sequence
  Description of Artificial Sequence: Synthetic peptide
DEQEIRTTNPVATEQYGSVSTNEQRGNN

SEQ ID NO: 12711 - protein, 29 aa, Artificial Sequence
  Description of Artificial Sequence: Synthetic peptide
MEEEIRTTNPVATEQYGSVSTNLQENGNR

SEQ ID NO: 12712 - protein, 28 aa, Artificial Sequence
  Description of Artificial Sequence: Synthetic peptide
DEEEIRTTNIVATEQYGDVSTNLQDGNR

SEQ ID NO: 12713 - protein, 29 aa, Artificial Sequence
  Description of Artificial Sequence: Synthetic peptide
DEEEIRTTNPVATEQWGSVSTNLQIGGNR

SEQ ID NO: 12714 - protein, 28 aa, Artificial Sequence
  Description of Artificial Sequence: Synthetic peptide
SEEEIRTTNPVATEQYGSVSTNEQRGNI

SEQ ID NO: 12715 - protein, 28 aa, Artificial Sequence
  Description of Artificial Sequence: Synthetic peptide
DEEEIRTTNIVATEQWGSVSENLQRGNR

SEQ ID NO: 12716 - protein, 28 aa, Artificial Sequence
  Description of Artificial Sequence: Synthetic peptide
DENEIATTNPVATEQYGWVSTNLQRGNR

SEQ ID NO: 12717 - protein, 28 aa, Artificial Sequence
  Description of Artificial Sequence: Synthetic peptide
MEEEIRTTNPVATEQYGSVSTNLQNGNS

SEQ ID NO: 12718 - protein, 29 aa, Artificial Sequence
  Description of Artificial Sequence: Synthetic peptide
DEEEIRTTNPVATEQYGSMSTNLQENGNR

SEQ ID NO: 12719 - protein, 28 aa, Artificial Sequence
  Description of Artificial Sequence: Synthetic peptide
DENEIRTTNIVATEQYGSVSTNLQRGND

SEQ ID NO: 12720 - protein, 28 aa, Artificial Sequence
  Description of Artificial Sequence: Synthetic peptide
DEEEIRTTNPVATEQYGSVSENLQMGNN

SEQ ID NO: 12721 - protein, 28 aa, Artificial Sequence
  Description of Artificial Sequence: Synthetic peptide
DEEEIRTTNPVATEQYGDVSTNLQNGNM

SEQ ID NO: 12722 - protein, 28 aa, Artificial Sequence
  Description of Artificial Sequence: Synthetic peptide
DEEEIRTTNPVATEQWGSVSTNLMIGNR

SEQ ID NO: 12723 - protein, 28 aa, Artificial Sequence
  Description of Artificial Sequence: Synthetic peptide
DEEEIRTTNPVAYEQYGSVSTNLDVGNR

SEQ ID NO: 12724 - protein, 28 aa, Artificial Sequence
  Description of Artificial Sequence: Synthetic peptide
DENEIRTTNPVATEQYGSVSTNLERGER

SEQ ID NO: 12725 - protein, 28 aa, Artificial Sequence
  Description of Artificial Sequence: Synthetic peptide
DENEIRTTNPVATEQYGSVSTNLQRGTF

SEQ ID NO: 12726 - protein, 28 aa, Artificial Sequence
  Description of Artificial Sequence: Synthetic peptide
DEEEIRTTNIVATEQYGSVSTELQRGDR

SEQ ID NO: 12727 - protein, 28 aa, Artificial Sequence
  Description of Artificial Sequence: Synthetic peptide
DDEEIRTTNPVATEQYGSVSENVQRGNR

SEQ ID NO: 12728 - protein, 28 aa, Artificial Sequence
  Description of Artificial Sequence: Synthetic peptide
DEEEIRTTNGVATEQYGSVSENWQRGNR

SEQ ID NO: 12729 - protein, 28 aa, Artificial Sequence
  Description of Artificial Sequence: Synthetic peptide
DEEEIATTNPVATEQYGSVSTNLQNGNQ

SEQ ID NO: 12730 - protein, 28 aa, Artificial Sequence
  Description of Artificial Sequence: Synthetic peptide
DEEEIRTTNIVATEQYGSVSTNIQRGNG

SEQ ID NO: 12731 - protein, 29 aa, Artificial Sequence
  Description of Artificial Sequence: Synthetic peptide
DEEEIRTTNPVATEQYGSVNSTNAQRGAR

SEQ ID NO: 12732 - protein, 28 aa, Artificial Sequence
  Description of Artificial Sequence: Synthetic peptide
DEQEIRTTNPVATEQYGSVCTNLQHGNR

SEQ ID NO: 12733 - protein, 29 aa, Artificial Sequence
  Description of Artificial Sequence: Synthetic peptide
DEEEIRTTNPVATEQYGSVSTELQHKGNR

SEQ ID NO: 12734 - protein, 28 aa, Artificial Sequence
  Description of Artificial Sequence: Synthetic peptide
DEEEIRTTNPVATEQYGSVSTNPQNGNQ

SEQ ID NO: 12735 - protein, 28 aa, Artificial Sequence
  Description of Artificial Sequence: Synthetic peptide
DEEEIRTTNPVATEQWGSVSTNLMQGNR

SEQ ID NO: 12736 - protein, 28 aa, Artificial Sequence
  Description of Artificial Sequence: Synthetic peptide
DEEEIRTTNIVATEQYGSVDTNLQDGNR

SEQ ID NO: 12737 - protein, 28 aa, Artificial Sequence
  Description of Artificial Sequence: Synthetic peptide
DEEEIRTTNPVATEWYGSVSTNLQRGDM

SEQ ID NO: 12738 - protein, 30 aa, Artificial Sequence
  Description of Artificial Sequence: Synthetic polypeptide
DEEEIRTTNPVATEQYGSVASTNLQRHDNR

SEQ ID NO: 12739 - protein, 28 aa, Artificial Sequence
  Description of Artificial Sequence: Synthetic peptide
DEEEIATTNPVATEQYGSVSTNLQRGTS

SEQ ID NO: 12740 - protein, 28 aa, Artificial Sequence
  Description of Artificial Sequence: Synthetic peptide
DEEEIRTTNPVATEQYGSVSTNPQLGNS

SEQ ID NO: 12741 - protein, 28 aa, Artificial Sequence
  Description of Artificial Sequence: Synthetic peptide
DEEEIATTNIVATEQYGSVSTNEQRGNR

SEQ ID NO: 12742 - protein, 28 aa, Artificial Sequence
  Description of Artificial Sequence: Synthetic peptide
DEEEIRTTNPVATEQWGSVSENLQRGNL

SEQ ID NO: 12743 - protein, 28 aa, Artificial Sequence
  Description of Artificial Sequence: Synthetic peptide
DEEEIATTNPVATEHYGWVSTNLQRGNR

SEQ ID NO: 12744 - protein, 28 aa, Artificial Sequence
  Description of Artificial Sequence: Synthetic peptide
DEVEIRTTNPVATEQYGSVSTALQRGNQ

SEQ ID NO: 12745 - protein, 28 aa, Artificial Sequence
  Description of Artificial Sequence: Synthetic peptide
DEEEINTTNIVATEQYGSVSTNLQRGNC

SEQ ID NO: 12746 - protein, 28 aa, Artificial Sequence
  Description of Artificial Sequence: Synthetic peptide
DEEEIRTTNPVATEQYGSVSTNEQREER

SEQ ID NO: 12747 - protein, 28 aa, Artificial Sequence
  Description of Artificial Sequence: Synthetic peptide
DEEEIRTTNPTATEQYGSVSTNPQRGNV

SEQ ID NO: 12748 - protein, 28 aa, Artificial Sequence
  Description of Artificial Sequence: Synthetic peptide
DEEEINTTNIVATEQYGSVSTNLQRGNN

SEQ ID NO: 12749 - protein, 28 aa, Artificial Sequence
  Description of Artificial Sequence: Synthetic peptide
DEEEIVTTNPVATEIYGTVSTNLQRGNR

SEQ ID NO: 12750 - protein, 29 aa, Artificial Sequence
  Description of Artificial Sequence: Synthetic peptide
DEVEIRTTNPVATEQYGSVCDTNLQRGNR

SEQ ID NO: 12751 - protein, 28 aa, Artificial Sequence
  Description of Artificial Sequence: Synthetic peptide
KEEEIRTTNPVATEQYGSVSTNLQGGNL

SEQ ID NO: 12752 - protein, 28 aa, Artificial Sequence
  Description of Artificial Sequence: Synthetic peptide
SEEEIRTTNPVATENYGSVSTNLQHGNR

SEQ ID NO: 12753 - protein, 28 aa, Artificial Sequence
  Description of Artificial Sequence: Synthetic peptide
DEEEIRTTNIVATEQYGSVSTNDQRGNE

SEQ ID NO: 12754 - protein, 28 aa, Artificial Sequence
  Description of Artificial Sequence: Synthetic peptide
DEEEIVTTNPVATEQYGVVGTNLQRGNR

SEQ ID NO: 12755 - protein, 28 aa, Artificial Sequence
  Description of Artificial Sequence: Synthetic peptide
DENEIRTTNPVATEQYGSVSTNLERGNF

SEQ ID NO: 12756 - protein, 29 aa, Artificial Sequence
  Description of Artificial Sequence: Synthetic peptide
DEEEIRTTNPVATEQYGSVSTELQRGENA

SEQ ID NO: 12757 - protein, 28 aa, Artificial Sequence
  Description of Artificial Sequence: Synthetic peptide
DEEEIRTTNIVATEQWGSVSTDLQRGNR

SEQ ID NO: 12758 - protein, 28 aa, Artificial Sequence
  Description of Artificial Sequence: Synthetic peptide
DEEEIRTTNPVATEQWGSVSTNDQRGNM

SEQ ID NO: 12759 - protein, 28 aa, Artificial Sequence
  Description of Artificial Sequence: Synthetic peptide
DEEEIRTTNPVATEQYGDVSEDLQRGNR

SEQ ID NO: 12760 - protein, 28 aa, Artificial Sequence
  Description of Artificial Sequence: Synthetic peptide
DEEEIRTTNPVATECYGVVSTNLQRGND

SEQ ID NO: 12761 - protein, 28 aa, Artificial Sequence
  Description of Artificial Sequence: Synthetic peptide
DEEEIRTTNPVATECYGSVSTNEQRGNA

SEQ ID NO: 12762 - protein, 28 aa, Artificial Sequence
  Description of Artificial Sequence: Synthetic peptide
DEEEIRTTNPVATEQYGSVSTGLELGNR

SEQ ID NO: 12763 - protein, 28 aa, Artificial Sequence
  Description of Artificial Sequence: Synthetic peptide
DEEEIRTTNIVATEQYGSVSTNEQRGAR

SEQ ID NO: 12764 - protein, 28 aa, Artificial Sequence
  Description of Artificial Sequence: Synthetic peptide
DEEEIRTTNPVATEQYGSVSTNLQNGLY

SEQ ID NO: 12765 - protein, 29 aa, Artificial Sequence
  Description of Artificial Sequence: Synthetic peptide
DEEEIRTTNPVATEIYGSVSNNLQRNGNR

SEQ ID NO: 12766 - protein, 29 aa, Artificial Sequence
  Description of Artificial Sequence: Synthetic peptide
SEEEIRTTNPVATEQYGSVSTNLQLRGDR

SEQ ID NO: 12767 - protein, 28 aa, Artificial Sequence
  Description of Artificial Sequence: Synthetic peptide
DEEEIRTTNPVATEQYGTVDENLQRGNR

SEQ ID NO: 12768 - protein, 28 aa, Artificial Sequence
  Description of Artificial Sequence: Synthetic peptide
DEQEIRTTNPVATEQWGSVSTNLQRGNM

SEQ ID NO: 12769 - protein, 28 aa, Artificial Sequence
  Description of Artificial Sequence: Synthetic peptide
DEEEIRTTNPVATEQYGSVSTDLQQGNF

SEQ ID NO: 12770 - protein, 28 aa, Artificial Sequence
  Description of Artificial Sequence: Synthetic peptide
DEEEICTTNPVATEQYGIVSDNLQRGNR

SEQ ID NO: 12771 - protein, 28 aa, Artificial Sequence
  Description of Artificial Sequence: Synthetic peptide
DEEEIRTTNPVATEQYGSVSTAPQRGER

SEQ ID NO: 12772 - protein, 28 aa, Artificial Sequence
  Description of Artificial Sequence: Synthetic peptide
DETEIRTTNPVATEQYGDVSENLQRGNR

SEQ ID NO: 12773 - protein, 28 aa, Artificial Sequence
  Description of Artificial Sequence: Synthetic peptide
DEEEIATTNPVATEQYGWVSENLQRGNR

SEQ ID NO: 12774 - protein, 28 aa, Artificial Sequence
  Description of Artificial Sequence: Synthetic peptide
DEEEISTTNPVSTEQYGSVSENLQRGNR

SEQ ID NO: 12775 - protein, 29 aa, Artificial Sequence
  Description of Artificial Sequence: Synthetic peptide
DEEEIRTTNPVATEQYGSVSTNLMNRGNW

SEQ ID NO: 12776 - protein, 28 aa, Artificial Sequence
  Description of Artificial Sequence: Synthetic peptide
DEEEIRTTNIVATEQYGSVSTNLRRGND

SEQ ID NO: 12777 - protein, 28 aa, Artificial Sequence
  Description of Artificial Sequence: Synthetic peptide
DEEEINTTNPVATEQYGSVSTNLQRKNT

SEQ ID NO: 12778 - protein, 31 aa, Artificial Sequence
  Description of Artificial Sequence: Synthetic polypeptide
DEEEIRTTNPVATEQYGSVSCTNLQQRGNDR

SEQ ID NO: 12779 - protein, 28 aa, Artificial Sequence
  Description of Artificial Sequence: Synthetic peptide
GEEEINTTNPVATEQYGTVSTNLQRGNR

SEQ ID NO: 12780 - protein, 29 aa, Artificial Sequence
  Description of Artificial Sequence: Synthetic peptide
DEEEIRTTNPCATEQYGSVSTMNLQHGNR

SEQ ID NO: 12781 - protein, 28 aa, Artificial Sequence
  Description of Artificial Sequence: Synthetic peptide
DEEEIRTTNPVATEQYGDVSTNLDRGIR

SEQ ID NO: 12782 - protein, 28 aa, Artificial Sequence
  Description of Artificial Sequence: Synthetic peptide
DEEEIRTTNPVATEQYGSVSTPDDRGNR

SEQ ID NO: 12783 - protein, 28 aa, Artificial Sequence
  Description of Artificial Sequence: Synthetic peptide
DEEEIATTNPVATEQYGSVSTDLQRGNA

SEQ ID NO: 12784 - protein, 28 aa, Artificial Sequence
  Description of Artificial Sequence: Synthetic peptide
DEEEIYTTNPVATEQYGEVSCNLQRGNR

SEQ ID NO: 12785 - protein, 28 aa, Artificial Sequence
  Description of Artificial Sequence: Synthetic peptide
DEEEIRTTNIVAYEQYGSVSTNLQRGNL

SEQ ID NO: 12786 - protein, 29 aa, Artificial Sequence
  Description of Artificial Sequence: Synthetic peptide
DEEEIRTTNPVATEQYGSVSTGLQRGNND

SEQ ID NO: 12787 - protein, 28 aa, Artificial Sequence
  Description of Artificial Sequence: Synthetic peptide
DEEEIRTTNPVATEQYGSVSTDLQRGEM

SEQ ID NO: 12788 - protein, 29 aa, Artificial Sequence
  Description of Artificial Sequence: Synthetic peptide
DEEEIRTTNPVATEPYGSCSTNLQREGNR

SEQ ID NO: 12789 - protein, 28 aa, Artificial Sequence
  Description of Artificial Sequence: Synthetic peptide
DEEEIRTTNPVATEQYGSVSENLQQGNN

SEQ ID NO: 12790 - protein, 28 aa, Artificial Sequence
  Description of Artificial Sequence: Synthetic peptide
DEQEIRTTNPVATEQYGSVSENLQRGNW

SEQ ID NO: 12791 - protein, 29 aa, Artificial Sequence
  Description of Artificial Sequence: Synthetic peptide
DEEEIRTTNPVATEQYGVVSTNLQITGNR

SEQ ID NO: 12792 - protein, 28 aa, Artificial Sequence
  Description of Artificial Sequence: Synthetic peptide
DEEEIRTTNPTATEQYGSVSTNEQVGNR

SEQ ID NO: 12793 - protein, 28 aa, Artificial Sequence
  Description of Artificial Sequence: Synthetic peptide
DEEEIRTTNPVATEQYGDVSTELQYGNR

SEQ ID NO: 12794 - protein, 28 aa, Artificial Sequence
  Description of Artificial Sequence: Synthetic peptide
DEEEIATTNPVATEQYGSVSTNLQNGNT

SEQ ID NO: 12795 - protein, 28 aa, Artificial Sequence
  Description of Artificial Sequence: Synthetic peptide
DEVEIRATNPVATEQYGSVSTNLQRGNQ

SEQ ID NO: 12796 - protein, 28 aa, Artificial Sequence
  Description of Artificial Sequence: Synthetic peptide
DEEEIRTTNPVATEQYGSVSTDLQGGNI

SEQ ID NO: 12797 - protein, 28 aa, Artificial Sequence
  Description of Artificial Sequence: Synthetic peptide
DEQEIATTNPVATEQYGSVSTNLERGNR

SEQ ID NO: 12798 - protein, 28 aa, Artificial Sequence
  Description of Artificial Sequence: Synthetic peptide
DEEEIRTTNIVATEQYGSVSTELDRGNR

SEQ ID NO: 12799 - protein, 28 aa, Artificial Sequence
  Description of Artificial Sequence: Synthetic peptide
DEEEIRTTNPVGTEQYGSVSTELQVGNR

SEQ ID NO: 12800 - protein, 28 aa, Artificial Sequence
  Description of Artificial Sequence: Synthetic peptide
DEEEIRTTNPVATEQYGSVSTDDERGNR

SEQ ID NO: 12801 - protein, 29 aa, Artificial Sequence
  Description of Artificial Sequence: Synthetic peptide
DEEEIRTTNPVATECYGSVSTNLQERGER

SEQ ID NO: 12802 - protein, 28 aa, Artificial Sequence
  Description of Artificial Sequence: Synthetic peptide
DENEIRTTNPVATEQYGEVSTNLQRGER

SEQ ID NO: 12803 - protein, 29 aa, Artificial Sequence
  Description of Artificial Sequence: Synthetic peptide
DEQEIRTTNPVATEQYGSVSETDLQRGNR

SEQ ID NO: 12804 - protein, 28 aa, Artificial Sequence
  Description of Artificial Sequence: Synthetic peptide
DEEEIRTTNPVATEQYGSVSENDQHGNR

SEQ ID NO: 12805 - protein, 28 aa, Artificial Sequence
  Description of Artificial Sequence: Synthetic peptide
DEEEIRTTNPVATEQYGSVSTDLQSGNH

SEQ ID NO: 12806 - protein, 28 aa, Artificial Sequence
  Description of Artificial Sequence: Synthetic peptide
DEEEIRTTNPVATEQCGSVSTNLRSGNR

SEQ ID NO: 12807 - protein, 28 aa, Artificial Sequence
  Description of Artificial Sequence: Synthetic peptide
DEEEIRTTNPVATEQYGIVSDNLQRGTR

SEQ ID NO: 12808 - protein, 28 aa, Artificial Sequence
  Description of Artificial Sequence: Synthetic peptide
DEEEIATTNPVATEQYGGVSTNLQQGNR

SEQ ID NO: 12809 - protein, 28 aa, Artificial Sequence
  Description of Artificial Sequence: Synthetic peptide
NEEEIRTTNPVATEQYGWVSTNLQRGNE

SEQ ID NO: 12810 - protein, 28 aa, Artificial Sequence
  Description of Artificial Sequence: Synthetic peptide
DEEEIRTTNPVATEGYGSAPTNLQRGNR

SEQ ID NO: 12811 - protein, 28 aa, Artificial Sequence
  Description of Artificial Sequence: Synthetic peptide
DEEEIATTNPVATEIYGVVSTNLQRGNR

SEQ ID NO: 12812 - protein, 28 aa, Artificial Sequence
  Description of Artificial Sequence: Synthetic peptide
DEGEIRTTNPTATEQYGSVSTNLQVGNR

SEQ ID NO: 12813 - protein, 29 aa, Artificial Sequence
  Description of Artificial Sequence: Synthetic peptide
DEEEIRATNPVATECYGSVSTNLQRGDNR

SEQ ID NO: 12814 - protein, 28 aa, Artificial Sequence
  Description of Artificial Sequence: Synthetic peptide
DEEEILTTNPVATEQYGSVVTNLQRENR

SEQ ID NO: 12815 - protein, 28 aa, Artificial Sequence
  Description of Artificial Sequence: Synthetic peptide
DEEEIRTTNPVATECYGSVSTNLQRGEH

SEQ ID NO: 12816 - protein, 28 aa, Artificial Sequence
  Description of Artificial Sequence: Synthetic peptide
DEEEIRTTNPVATEQFGSTSTNLQHGNR

SEQ ID NO: 12817 - protein, 28 aa, Artificial Sequence
  Description of Artificial Sequence: Synthetic peptide
DEEEIRQTNPVATEQYGSVSTNQQHGNR

SEQ ID NO: 12818 - protein, 28 aa, Artificial Sequence
  Description of Artificial Sequence: Synthetic peptide
DEQEIRTTNPVATEQYGSVSTNLQIGNA

SEQ ID NO: 12819 - protein, 28 aa, Artificial Sequence
  Description of Artificial Sequence: Synthetic peptide
DEQEIRTTNPVATEQYGSVSTNLQHGND

SEQ ID NO: 12820 - protein, 28 aa, Artificial Sequence
  Description of Artificial Sequence: Synthetic peptide
DEEEIRTTNPVATEQYGVVSTDDQRGNR

SEQ ID NO: 12821 - protein, 28 aa, Artificial Sequence
  Description of Artificial Sequence: Synthetic peptide
DENEIRSTNPVATEQYGSVSTELQRGNR

SEQ ID NO: 12822 - protein, 28 aa, Artificial Sequence
  Description of Artificial Sequence: Synthetic peptide
DEEEIRTTNPVATECWGSVSTNLQRGNF

SEQ ID NO: 12823 - protein, 28 aa, Artificial Sequence
  Description of Artificial Sequence: Synthetic peptide
DEEEIRTTNPVATEQYGSVSTDLQTGNQ

SEQ ID NO: 12824 - protein, 28 aa, Artificial Sequence
  Description of Artificial Sequence: Synthetic peptide
DEEEIRATNIVATEQYGSVSTNDQRGNR

SEQ ID NO: 12825 - protein, 28 aa, Artificial Sequence
  Description of Artificial Sequence: Synthetic peptide
DEVEIRTTNPVATEQYGSVSTDLQHGNR

SEQ ID NO: 12826 - protein, 28 aa, Artificial Sequence
  Description of Artificial Sequence: Synthetic peptide
DEEEIRTTNPVATEQYGSVSTNPQIGNH

SEQ ID NO: 12827 - protein, 28 aa, Artificial Sequence
  Description of Artificial Sequence: Synthetic peptide
DENEIRTTNPVATEQYGSVSTNEQRGAR

SEQ ID NO: 12828 - protein, 28 aa, Artificial Sequence
  Description of Artificial Sequence: Synthetic peptide
DEEEIATTNPVATEQYGSVSTNLQNGER

SEQ ID NO: 12829 - protein, 28 aa, Artificial Sequence
  Description of Artificial Sequence: Synthetic peptide
DEEEIRTTNPVATEQYGSVSTNLNHGNW

SEQ ID NO: 12830 - protein, 30 aa, Artificial Sequence
  Description of Artificial Sequence: Synthetic polypeptide
DEEEIRTTNPVATEQYGSVSTNWQLRGNDR

SEQ ID NO: 12831 - protein, 28 aa, Artificial Sequence
  Description of Artificial Sequence: Synthetic peptide
QEDEIRTTNPVATEQYGSVSTNLQRGNH

SEQ ID NO: 12832 - protein, 28 aa, Artificial Sequence
  Description of Artificial Sequence: Synthetic peptide
DEEEIRTTNPVATEQYGSVSTELQNGNW

SEQ ID NO: 12833 - protein, 28 aa, Artificial Sequence
  Description of Artificial Sequence: Synthetic peptide
DEEEIATTNPVATEQYGEVSTNLQRGGR

SEQ ID NO: 12834 - protein, 28 aa, Artificial Sequence
  Description of Artificial Sequence: Synthetic peptide
DEEEIRTTNPVATEQYGSVDTELQVGNR

SEQ ID NO: 12835 - protein, 28 aa, Artificial Sequence
  Description of Artificial Sequence: Synthetic peptide
DEEEIRTTNIVATEQYGSVSENLDRGNR

SEQ ID NO: 12836 - protein, 28 aa, Artificial Sequence
  Description of Artificial Sequence: Synthetic peptide
QEEEIRTTNPVATEVYGSVSTNLQHGNR

SEQ ID NO: 12837 - protein, 28 aa, Artificial Sequence
  Description of Artificial Sequence: Synthetic peptide
DEEEIAQTNPVATEQYGSVSTNLQRGNA

SEQ ID NO: 12838 - protein, 28 aa, Artificial Sequence
  Description of Artificial Sequence: Synthetic peptide
DEEEIRTTNPVATEQYGDASENLQRGNR

SEQ ID NO: 12839 - protein, 30 aa, Artificial Sequence
  Description of Artificial Sequence: Synthetic polypeptide
DENEIRTTNPVATEQYGSVSTNLQIRGENR

SEQ ID NO: 12840 - protein, 28 aa, Artificial Sequence
  Description of Artificial Sequence: Synthetic peptide
DEEEIRTTNPVATEIYGSCSTQLQRGNR

SEQ ID NO: 12841 - protein, 28 aa, Artificial Sequence
  Description of Artificial Sequence: Synthetic peptide
DENEIRTTNPVATEQYGSVSENLQRGND

SEQ ID NO: 12842 - protein, 28 aa, Artificial Sequence
  Description of Artificial Sequence: Synthetic peptide
DEEEIRTTNPVATEMFGSVSTNEQRGNR

SEQ ID NO: 12843 - protein, 28 aa, Artificial Sequence
  Description of Artificial Sequence: Synthetic peptide
DEEEIRTTNPIATEQYGSVGTNLQRGNI

SEQ ID NO: 12844 - protein, 28 aa, Artificial Sequence
  Description of Artificial Sequence: Synthetic peptide
DEEEIRTTNIDATEQYGSVSTNLERGNR

SEQ ID NO: 12845 - protein, 28 aa, Artificial Sequence
  Description of Artificial Sequence: Synthetic peptide
DEEEIATTNPVATEQYGSASTNLQRGNN

SEQ ID NO: 12846 - protein, 28 aa, Artificial Sequence
  Description of Artificial Sequence: Synthetic peptide
DEEEIRTTNPVATEQYGSVSNNLQQGPR

SEQ ID NO: 12847 - protein, 30 aa, Artificial Sequence
  Description of Artificial Sequence: Synthetic polypeptide
DEEEIRTTNPVATECYGSVSTNLQREGNTR

SEQ ID NO: 12848 - protein, 28 aa, Artificial Sequence
  Description of Artificial Sequence: Synthetic peptide
DEEEITTTNPVATEVYGSVSTNLQRGDR

SEQ ID NO: 12849 - protein, 28 aa, Artificial Sequence
  Description of Artificial Sequence: Synthetic peptide
DEIEIATTNPVATEQYGSVSTNLQMGNR

SEQ ID NO: 12850 - protein, 28 aa, Artificial Sequence
  Description of Artificial Sequence: Synthetic peptide
DENEIATTNPVATEQYGSVSTNLQRGNN

SEQ ID NO: 12851 - protein, 28 aa, Artificial Sequence
  Description of Artificial Sequence: Synthetic peptide
DEEEIRTTNPVATEQYGSVSTNDNRGDR

SEQ ID NO: 12852 - protein, 29 aa, Artificial Sequence
  Description of Artificial Sequence: Synthetic peptide
DEEEIRTTNPVATEQYGEVSTNLQRGDNT

SEQ ID NO: 12853 - protein, 28 aa, Artificial Sequence
  Description of Artificial Sequence: Synthetic peptide
DEQEIRTTNPVATEQYGIVSDNLQRGNR

SEQ ID NO: 12854 - protein, 28 aa, Artificial Sequence
  Description of Artificial Sequence: Synthetic peptide
DENEIMTTNPVATEQYGSVSTNLQRGNS

SEQ ID NO: 12855 - protein, 28 aa, Artificial Sequence
  Description of Artificial Sequence: Synthetic peptide
DENEIRTTNPVATEQYGSVSTNLMRGNM

SEQ ID NO: 12856 - protein, 28 aa, Artificial Sequence
  Description of Artificial Sequence: Synthetic peptide
DEEEIRTTNPVATEQYGSVSTDLQRGET

SEQ ID NO: 12857 - protein, 29 aa, Artificial Sequence
  Description of Artificial Sequence: Synthetic peptide
DEQEIRTTNPVATEQYGSVSTNLQMRGNA

SEQ ID NO: 12858 - protein, 28 aa, Artificial Sequence
  Description of Artificial Sequence: Synthetic peptide
DEEEIRTTNPVATEQYGSVSDNLQHGER

SEQ ID NO: 12859 - protein, 31 aa, Artificial Sequence
  Description of Artificial Sequence: Synthetic polypeptide
DEEEIRTTNPVATEQYGSVSDTENLVQRGNR

SEQ ID NO: 12860 - protein, 28 aa, Artificial Sequence
  Description of Artificial Sequence: Synthetic peptide
DEEEIRTTNIVATEQYGSVSTNLQSGNA

SEQ ID NO: 12861 - protein, 29 aa, Artificial Sequence
  Description of Artificial Sequence: Synthetic peptide
DEEEIRTTNPVATEQYGSVSTNLQDKGER

SEQ ID NO: 12862 - protein, 28 aa, Artificial Sequence
  Description of Artificial Sequence: Synthetic peptide
KETEIRTTNPVATEQYGEVSTNLQRGNR

SEQ ID NO: 12863 - protein, 28 aa, Artificial Sequence
  Description of Artificial Sequence: Synthetic peptide
SEEEIRTTNIVATEQYGSVSTNLQRGNE

SEQ ID NO: 12864 - protein, 28 aa, Artificial Sequence
  Description of Artificial Sequence: Synthetic peptide
DEEEIRTTNPVATEQYGSMSENLQRMNR

SEQ ID NO: 12865 - protein, 30 aa, Artificial Sequence
  Description of Artificial Sequence: Synthetic polypeptide
DEEEIRTTNPVATEQYGSVSTDLQDREGNR

SEQ ID NO: 12866 - protein, 29 aa, Artificial Sequence
  Description of Artificial Sequence: Synthetic peptide
DEEEIRTTNPVATECYGSVSTNLQSGENR

SEQ ID NO: 12867 - protein, 28 aa, Artificial Sequence
  Description of Artificial Sequence: Synthetic peptide
DEEEIRTTNPVATEQYGSVSMNDQRGPR

SEQ ID NO: 12868 - protein, 28 aa, Artificial Sequence
  Description of Artificial Sequence: Synthetic peptide
DEEEIRTTNPVATEQYGSASTNGQRGNI

SEQ ID NO: 12869 - protein, 28 aa, Artificial Sequence
  Description of Artificial Sequence: Synthetic peptide
DEEEIRTTNPVATECYGSVSTNLQQGND

SEQ ID NO: 12870 - protein, 28 aa, Artificial Sequence
  Description of Artificial Sequence: Synthetic peptide
DEEEIRTTNIVATEQYGSVSTNLQNGNH

SEQ ID NO: 12871 - protein, 28 aa, Artificial Sequence
  Description of Artificial Sequence: Synthetic peptide
DEEEIYTTNPVATDQYGSVSTNLQNGNR

SEQ ID NO: 12872 - protein, 29 aa, Artificial Sequence
  Description of Artificial Sequence: Synthetic peptide
DEEEIRTTNPVATEQWGSVSTNLQMRGNA

SEQ ID NO: 12873 - protein, 28 aa, Artificial Sequence
  Description of Artificial Sequence: Synthetic peptide
DEEEIRTTNPVSTEQYGSVSTDEQRGNR

SEQ ID NO: 12874 - protein, 28 aa, Artificial Sequence
  Description of Artificial Sequence: Synthetic peptide
QEEEIRTTNPVATEQYGSVATVLQRGNR

SEQ ID NO: 12875 - protein, 28 aa, Artificial Sequence
  Description of Artificial Sequence: Synthetic peptide
DEEEIATTNPVATEQYGSASENLQRGNR

SEQ ID NO: 12876 - protein, 28 aa, Artificial Sequence
  Description of Artificial Sequence: Synthetic peptide
DEEEIRTTNIVATEQYGSVSTNLQSGNL

SEQ ID NO: 12877 - protein, 28 aa, Artificial Sequence
  Description of Artificial Sequence: Synthetic peptide
DEEEIRTTNPVAYEQYGSVSTDLQRGNL

SEQ ID NO: 12878 - protein, 28 aa, Artificial Sequence
  Description of Artificial Sequence: Synthetic peptide
DEEEIRTTNIVATEQYGSVSTNLQDGNI

SEQ ID NO: 12879 - protein, 30 aa, Artificial Sequence
  Description of Artificial Sequence: Synthetic polypeptide
DEEEIRTTNPVATEQYGSVSDTNLQERGNP

SEQ ID NO: 12880 - protein, 28 aa, Artificial Sequence
  Description of Artificial Sequence: Synthetic peptide
DEEEIRTTNPVATENFGSVSTNLQVGNR

SEQ ID NO: 12881 - protein, 28 aa, Artificial Sequence
  Description of Artificial Sequence: Synthetic peptide
DEEEIRTTNIVATEQYGSVSTNLQDGNT

SEQ ID NO: 12882 - protein, 28 aa, Artificial Sequence
  Description of Artificial Sequence: Synthetic peptide
DEEEIRTTNIVATEQYGSVSTNLQNGNQ

SEQ ID NO: 12883 - protein, 28 aa, Artificial Sequence
  Description of Artificial Sequence: Synthetic peptide
DEEEIRTTNPVATEQYGSVSTNEQFGNG

SEQ ID NO: 12884 - protein, 28 aa, Artificial Sequence
  Description of Artificial Sequence: Synthetic peptide
DEEEIRTTNPVATEQYGSVSTNLQQGTA

SEQ ID NO: 12885 - protein, 28 aa, Artificial Sequence
  Description of Artificial Sequence: Synthetic peptide
DEEEIRTTNPVATEIYGSVSTNLQTGNA

SEQ ID NO: 12886 - protein, 28 aa, Artificial Sequence
  Description of Artificial Sequence: Synthetic peptide
MENEIRTTNPVATEQYGSVSTDLQRGNR

SEQ ID NO: 12887 - protein, 28 aa, Artificial Sequence
  Description of Artificial Sequence: Synthetic peptide
DEEEIRTTNPVATECYGSVSTDLQRGNI

SEQ ID NO: 12888 - protein, 28 aa, Artificial Sequence
  Description of Artificial Sequence: Synthetic peptide
DEEEIRTTNPVATEQYGDVSENLQAGNR

SEQ ID NO: 12889 - protein, 28 aa, Artificial Sequence
  Description of Artificial Sequence: Synthetic peptide
DEEEIRTTNPVATEQYGTVSTNLQQGNF

SEQ ID NO: 12890 - protein, 28 aa, Artificial Sequence
  Description of Artificial Sequence: Synthetic peptide
DEEEIRTTNIEATEQYGSVSTNLQVGNR

SEQ ID NO: 12891 - protein, 28 aa, Artificial Sequence
  Description of Artificial Sequence: Synthetic peptide
DEEEISTTNPVATEQYGSVSDNLQQGNR

SEQ ID NO: 12892 - protein, 28 aa, Artificial Sequence
  Description of Artificial Sequence: Synthetic peptide
DEVEIRTTNPVATEQYGCVSTNLQQGNR

SEQ ID NO: 12893 - protein, 28 aa, Artificial Sequence
  Description of Artificial Sequence: Synthetic peptide
DEQEIRTTNPVATEQYGSVSTNLGLGNR

SEQ ID NO: 12894 - protein, 28 aa, Artificial Sequence
  Description of Artificial Sequence: Synthetic peptide
DEEEIRTTNPVATEQYGSVSENLQRGDH

SEQ ID NO: 12895 - protein, 29 aa, Artificial Sequence
  Description of Artificial Sequence: Synthetic peptide
DEEEIATTNPVATEQYGSVSTNLQRQENR

SEQ ID NO: 12896 - protein, 28 aa, Artificial Sequence
  Description of Artificial Sequence: Synthetic peptide
DEEEIATTNPVATEQYGSVSTDLQRGER

SEQ ID NO: 12897 - protein, 28 aa, Artificial Sequence
  Description of Artificial Sequence: Synthetic peptide
DEEEIRTTNPVATEQYGSVATNVQRGDR

SEQ ID NO: 12898 - protein, 28 aa, Artificial Sequence
  Description of Artificial Sequence: Synthetic peptide
DEEEIATTNPVATEQYGSVSTDLQHGNR

SEQ ID NO: 12899 - protein, 29 aa, Artificial Sequence
  Description of Artificial Sequence: Synthetic peptide
DENEIRTTNPVATECYGSVSTNLQMRGNR

SEQ ID NO: 12900 - protein, 29 aa, Artificial Sequence
  Description of Artificial Sequence: Synthetic peptide
DEEEIATTNPVATEQYGSVSTNLQENGNR

SEQ ID NO: 12901 - protein, 28 aa, Artificial Sequence
  Description of Artificial Sequence: Synthetic peptide
DEEEIATTNPVATECYGSVSTNLQRGND

SEQ ID NO: 12902 - protein, 28 aa, Artificial Sequence
  Description of Artificial Sequence: Synthetic peptide
DEEEIRTTNPVATEQYGSVSTDLQQGNI

SEQ ID NO: 12903 - protein, 28 aa, Artificial Sequence
  Description of Artificial Sequence: Synthetic peptide
DEEEIRTTNPVATEQFGSVSVNLQRGDR

SEQ ID NO: 12904 - protein, 28 aa, Artificial Sequence
  Description of Artificial Sequence: Synthetic peptide
DEEEIRTTNPVATEQYGSVSTDLQHGNV

SEQ ID NO: 12905 - protein, 28 aa, Artificial Sequence
  Description of Artificial Sequence: Synthetic peptide
DEEEIRTTNPVATEQYGEVSTNLQIGNL

SEQ ID NO: 12906 - protein, 28 aa, Artificial Sequence
  Description of Artificial Sequence: Synthetic peptide
DENEIKTTNPVATEQYGSVSTNEQRGNR

SEQ ID NO: 12907 - protein, 28 aa, Artificial Sequence
  Description of Artificial Sequence: Synthetic peptide
DEEEIRTTNIVATEQYGSVDTNLQAGNR

SEQ ID NO: 12908 - protein, 28 aa, Artificial Sequence
  Description of Artificial Sequence: Synthetic peptide
DEEEIRTTNPVATEQYGSVSNNLERGSR

SEQ ID NO: 12909 - protein, 28 aa, Artificial Sequence
  Description of Artificial Sequence: Synthetic peptide
DEGEIRSTNPVATEQYGSVSENLQRGNR

SEQ ID NO: 12910 - protein, 28 aa, Artificial Sequence
  Description of Artificial Sequence: Synthetic peptide
DEEEIRTTNPVATEQYGSVSEVLQRDNR

SEQ ID NO: 12911 - protein, 28 aa, Artificial Sequence
  Description of Artificial Sequence: Synthetic peptide
DEEEIRTTNPVATEQYGSVSTDLQAGNH

SEQ ID NO: 12912 - protein, 28 aa, Artificial Sequence
  Description of Artificial Sequence: Synthetic peptide
QEEEIRTTNPVATEQYGSVATNLQRGNM

SEQ ID NO: 12913 - protein, 30 aa, Artificial Sequence
  Description of Artificial Sequence: Synthetic polypeptide
DEEEIRCTNPVATEQYGSVSATNLQREGNR

SEQ ID NO: 12914 - protein, 28 aa, Artificial Sequence
  Description of Artificial Sequence: Synthetic peptide
DEEEIRTTNIVAYEQYGSVSTNLQRGNT

SEQ ID NO: 12915 - protein, 28 aa, Artificial Sequence
  Description of Artificial Sequence: Synthetic peptide
DENEIRTTNPVATEQYGSVSTELQHGNR

SEQ ID NO: 12916 - protein, 28 aa, Artificial Sequence
  Description of Artificial Sequence: Synthetic peptide
DEEEIRTTNPVATEQYGDVSTDLQHGNR

SEQ ID NO: 12917 - protein, 28 aa, Artificial Sequence
  Description of Artificial Sequence: Synthetic peptide
DEEEIRTTNPVATEQYGSVSTNLMTGNF

SEQ ID NO: 12918 - protein, 29 aa, Artificial Sequence
  Description of Artificial Sequence: Synthetic peptide
DEEEIRTTNPVATEQFGSVSFTNEQRGNR

SEQ ID NO: 12919 - protein, 28 aa, Artificial Sequence
  Description of Artificial Sequence: Synthetic peptide
DEEEIRTTNPVATEQYGAVSTNLEPGNR

SEQ ID NO: 12920 - protein, 28 aa, Artificial Sequence
  Description of Artificial Sequence: Synthetic peptide
DENEIRTTNPVATEQYGSVSTELQRGER

SEQ ID NO: 12921 - protein, 28 aa, Artificial Sequence
  Description of Artificial Sequence: Synthetic peptide
DEEEIACTNPVATEQYGSVSTNLQRGNH

SEQ ID NO: 12922 - protein, 28 aa, Artificial Sequence
  Description of Artificial Sequence: Synthetic peptide
DESEIRTTNIVATEQYGSVSTNLQRGNI

SEQ ID NO: 12923 - protein, 28 aa, Artificial Sequence
  Description of Artificial Sequence: Synthetic peptide
DEEEIRTTNPVATEQYGDVSTNEQLGNR

SEQ ID NO: 12924 - protein, 28 aa, Artificial Sequence
  Description of Artificial Sequence: Synthetic peptide
DENEIRTTNPVATEQWGSVSTNLQRGNW

SEQ ID NO: 12925 - protein, 28 aa, Artificial Sequence
  Description of Artificial Sequence: Synthetic peptide
DEQEVRTTNPVATEQYGWVSTNLQRGNR

SEQ ID NO: 12926 - protein, 28 aa, Artificial Sequence
  Description of Artificial Sequence: Synthetic peptide
DEEEIRTTNPVAMEQWGSVSENLQRGNR

SEQ ID NO: 12927 - protein, 28 aa, Artificial Sequence
  Description of Artificial Sequence: Synthetic peptide
DEEEIRCTNPVATEQYGWVSTDLQRGNR

SEQ ID NO: 12928 - protein, 28 aa, Artificial Sequence
  Description of Artificial Sequence: Synthetic peptide
DEEEIRATNPVATEQYGSVSGNLQRGNL

SEQ ID NO: 12929 - protein, 28 aa, Artificial Sequence
  Description of Artificial Sequence: Synthetic peptide
DEEEVRSTNPVATEQYGSVSTNLQRGNQ

SEQ ID NO: 12930 - protein, 28 aa, Artificial Sequence
  Description of Artificial Sequence: Synthetic peptide
AEEEIRTTNPVATEQYGSVSTNLMRGNQ

SEQ ID NO: 12931 - protein, 28 aa, Artificial Sequence
  Description of Artificial Sequence: Synthetic peptide
DEEEIRTTNPEATEIYGSVSTNLQRGNQ

SEQ ID NO: 12932 - protein, 29 aa, Artificial Sequence
  Description of Artificial Sequence: Synthetic peptide
DEEEIRTTNPVATEQYGSVSTNWQRGNTY

SEQ ID NO: 12933 - protein, 28 aa, Artificial Sequence
  Description of Artificial Sequence: Synthetic peptide
DEEEIRTTNPVATEHYGSVSADLQRGNR

SEQ ID NO: 12934 - protein, 28 aa, Artificial Sequence
  Description of Artificial Sequence: Synthetic peptide
DEVEIRTTNPVATEQYGSVSTNPQRGNA

SEQ ID NO: 12935 - protein, 29 aa, Artificial Sequence
  Description of Artificial Sequence: Synthetic peptide
DENEIRTTNPVATEQYGSVSTNLQMRGNA

SEQ ID NO: 12936 - protein, 30 aa, Artificial Sequence
  Description of Artificial Sequence: Synthetic polypeptide
DEEEIRTTNPVATEQYGESVSTDLVQRGNR

SEQ ID NO: 12937 - protein, 28 aa, Artificial Sequence
  Description of Artificial Sequence: Synthetic peptide
DENEIRTTNPVATEQWGSVSTNEQRGNR

SEQ ID NO: 12938 - protein, 28 aa, Artificial Sequence
  Description of Artificial Sequence: Synthetic peptide
DEEEIRTTNPVATEQYGSVSTDLQSGNY

SEQ ID NO: 12939 - protein, 28 aa, Artificial Sequence
  Description of Artificial Sequence: Synthetic peptide
DEEEIRTTNIVATEQYGSVSTNEERGNR

SEQ ID NO: 12940 - protein, 28 aa, Artificial Sequence
  Description of Artificial Sequence: Synthetic peptide
DEEEIRTTNPVAVEQYGSVSTDLQRGNA

SEQ ID NO: 12941 - protein, 28 aa, Artificial Sequence
  Description of Artificial Sequence: Synthetic peptide
DEEEIRQTNPCATEQYGSVSCNLQRGNR

SEQ ID NO: 12942 - protein, 28 aa, Artificial Sequence
  Description of Artificial Sequence: Synthetic peptide
SEEEIRTTNPVATEQYGSVSTNLQRGTL

SEQ ID NO: 12943 - protein, 28 aa, Artificial Sequence
  Description of Artificial Sequence: Synthetic peptide
DEEEIRCTNPVATEQYGSVSTNVQRGTR

SEQ ID NO: 12944 - protein, 28 aa, Artificial Sequence
  Description of Artificial Sequence: Synthetic peptide
DEEEIRTTNPVATEQYGSYSTNLQGGNI

SEQ ID NO: 12945 - protein, 30 aa, Artificial Sequence
  Description of Artificial Sequence: Synthetic polypeptide
DEEEIRTTNPVATEQYGSVSSTNLVDRGNR

SEQ ID NO: 12946 - protein, 28 aa, Artificial Sequence
  Description of Artificial Sequence: Synthetic peptide
DEEEIRTTNPVATEQYGSVSTNPQLGNV

SEQ ID NO: 12947 - protein, 28 aa, Artificial Sequence
  Description of Artificial Sequence: Synthetic peptide
DEEEIRTTNPVATEGYGVVSTNLQRGGR

SEQ ID NO: 12948 - protein, 28 aa, Artificial Sequence
  Description of Artificial Sequence: Synthetic peptide
DEEEIRTTNPVATEQYGSVSTNDQYGNM

SEQ ID NO: 12949 - protein, 29 aa, Artificial Sequence
  Description of Artificial Sequence: Synthetic peptide
DEEEVRTTNPVATEQYGSVSTNLQFPGNR

SEQ ID NO: 12950 - protein, 28 aa, Artificial Sequence
  Description of Artificial Sequence: Synthetic peptide
DEQEIATTNPVATELYGSVSTNLQRGNR

SEQ ID NO: 12951 - protein, 30 aa, Artificial Sequence
  Description of Artificial Sequence: Synthetic polypeptide
DEEEIRTTNPVATECYGSVSATNLQDRGNR

SEQ ID NO: 12952 - protein, 28 aa, Artificial Sequence
  Description of Artificial Sequence: Synthetic peptide
DEEEIRTTNPVATEQFGCVSTNWQRGNR

SEQ ID NO: 12953 - protein, 28 aa, Artificial Sequence
  Description of Artificial Sequence: Synthetic peptide
DEEEIRTTNPVATECYGSVSTNLQIGNT

SEQ ID NO: 12954 - protein, 28 aa, Artificial Sequence
  Description of Artificial Sequence: Synthetic peptide
DENEIRTTNPVATEQYGSVSTNLQIGNA

SEQ ID NO: 12955 - protein, 28 aa, Artificial Sequence
  Description of Artificial Sequence: Synthetic peptide
NDEEIRTTNPVATEQYGSNSTNLQRGNR

SEQ ID NO: 12956 - protein, 29 aa, Artificial Sequence
  Description of Artificial Sequence: Synthetic peptide
DEEEIRTTNPVATEQYGSVSTNLQMRENT

SEQ ID NO: 12957 - protein, 28 aa, Artificial Sequence
  Description of Artificial Sequence: Synthetic peptide
DEEEIRTTNPVATEQYGDVSTNEQRGNF

SEQ ID NO: 12958 - protein, 29 aa, Artificial Sequence
  Description of Artificial Sequence: Synthetic peptide
DEEEIRTTNPVATEQYGSVSTNLQVGNDT

SEQ ID NO: 12959 - protein, 28 aa, Artificial Sequence
  Description of Artificial Sequence: Synthetic peptide
DECEIRTTNPCATEQYGSVSTNDQRGNR

SEQ ID NO: 12960 - protein, 28 aa, Artificial Sequence
  Description of Artificial Sequence: Synthetic peptide
DEEEIACTNPVATEQYGSVSTNLQRGNG

SEQ ID NO: 12961 - protein, 28 aa, Artificial Sequence
  Description of Artificial Sequence: Synthetic peptide
DEEEIRTTNIVATEQYGSVSNNEQRGNR

SEQ ID NO: 12962 - protein, 28 aa, Artificial Sequence
  Description of Artificial Sequence: Synthetic peptide
GEEEIRTTNPCATEQYGSVSENLQRGNR

SEQ ID NO: 12963 - protein, 28 aa, Artificial Sequence
  Description of Artificial Sequence: Synthetic peptide
DEEEIRSTNPVATEQYGSVSTNLARGNH

SEQ ID NO: 12964 - protein, 29 aa, Artificial Sequence
  Description of Artificial Sequence: Synthetic peptide
QEEEIRTTNPVATEQYGSVSTNLQHAGNR

SEQ ID NO: 12965 - protein, 28 aa, Artificial Sequence
  Description of Artificial Sequence: Synthetic peptide
DEEEIRTTNPVATEQWGSVSTNLQRGEH

SEQ ID NO: 12966 - protein, 28 aa, Artificial Sequence
  Description of Artificial Sequence: Synthetic peptide
DEEEIRCTNPVATEQYGAVSTNLQRGNA

SEQ ID NO: 12967 - protein, 28 aa, Artificial Sequence
  Description of Artificial Sequence: Synthetic peptide
DEEEIRTTNPVATEQYGSVSTDLERGNV

SEQ ID NO: 12968 - protein, 29 aa, Artificial Sequence
  Description of Artificial Sequence: Synthetic peptide
DEEEIRTTNPVATEQYGGVSTNLQRGDNF

SEQ ID NO: 12969 - protein, 28 aa, Artificial Sequence
  Description of Artificial Sequence: Synthetic peptide
DEEEIRTTNPVATECWGSVSTNLQLGNR

SEQ ID NO: 12970 - protein, 28 aa, Artificial Sequence
  Description of Artificial Sequence: Synthetic peptide
DEEEIRTTNPVATWQYGSVSDNDQRGNR

SEQ ID NO: 12971 - protein, 29 aa, Artificial Sequence
  Description of Artificial Sequence: Synthetic peptide
DEEEIRTTNPVATEQYGSVSTNLQHEGNF

SEQ ID NO: 12972 - protein, 30 aa, Artificial Sequence
  Description of Artificial Sequence: Synthetic polypeptide
DEEEIRTTNPVATEIYGSVSTNLQRKGDNR

SEQ ID NO: 12973 - protein, 28 aa, Artificial Sequence
  Description of Artificial Sequence: Synthetic peptide
DEEEIRTTNPVATEQYGDVSENLQRGNI

SEQ ID NO: 12974 - protein, 28 aa, Artificial Sequence
  Description of Artificial Sequence: Synthetic peptide
DEEEIRCTNPVATEQYGSVSNNGQRGNR

SEQ ID NO: 12975 - protein, 29 aa, Artificial Sequence
  Description of Artificial Sequence: Synthetic peptide
DEEEIRTTNPVATEMYGSVSATNEQRGNR

SEQ ID NO: 12976 - protein, 28 aa, Artificial Sequence
  Description of Artificial Sequence: Synthetic peptide
DEEEIRTTNPVATEQYGSVSTPDQRGNQ

SEQ ID NO: 12977 - protein, 28 aa, Artificial Sequence
  Description of Artificial Sequence: Synthetic peptide
DEEEIRTTNIVATEQYGQVSTNEQRGNR

SEQ ID NO: 12978 - protein, 28 aa, Artificial Sequence
  Description of Artificial Sequence: Synthetic peptide
DEEEIRCTNPVATEQYGGVSTNLQRGNF

SEQ ID NO: 12979 - protein, 28 aa, Artificial Sequence
  Description of Artificial Sequence: Synthetic peptide
DEEEIRTTNPVCTEQYGSVSTVLQNGNR

SEQ ID NO: 12980 - protein, 28 aa, Artificial Sequence
  Description of Artificial Sequence: Synthetic peptide
DEQELRTTNPVATEQYGSVSTNLQRGNQ

SEQ ID NO: 12981 - protein, 28 aa, Artificial Sequence
  Description of Artificial Sequence: Synthetic peptide
DEEEIRTTNPVATEQYGSVSTNLQLGES

SEQ ID NO: 12982 - protein, 29 aa, Artificial Sequence
  Description of Artificial Sequence: Synthetic peptide
DEEEIRTTNPTATEQYGSVSTCNLQRGDR

SEQ ID NO: 12983 - protein, 28 aa, Artificial Sequence
  Description of Artificial Sequence: Synthetic peptide
NDEEIRTTNPVATENYGSVSTNLQRGNR

SEQ ID NO: 12984 - protein, 28 aa, Artificial Sequence
  Description of Artificial Sequence: Synthetic peptide
DEEEIRTTNPVATEQYGSVSTDLQYGNQ

SEQ ID NO: 12985 - protein, 28 aa, Artificial Sequence
  Description of Artificial Sequence: Synthetic peptide
DEEEIRTTNPVATEQYGEVSTNLQRGEA

SEQ ID NO: 12986 - protein, 28 aa, Artificial Sequence
  Description of Artificial Sequence: Synthetic peptide
DEQEIRTTNPVATEQYGSVSENLMRGNR

SEQ ID NO: 12987 - protein, 28 aa, Artificial Sequence
  Description of Artificial Sequence: Synthetic peptide
DENEIRTTNPVATEQYGSASTNLDRGNR

SEQ ID NO: 12988 - protein, 28 aa, Artificial Sequence
  Description of Artificial Sequence: Synthetic peptide
REEEIRTTNPVATEQYGCVSENLQRGNR

SEQ ID NO: 12989 - protein, 28 aa, Artificial Sequence
  Description of Artificial Sequence: Synthetic peptide
DEEEIRTTNPVATEQYGSVSTGLEIGNR

SEQ ID NO: 12990 - protein, 29 aa, Artificial Sequence
  Description of Artificial Sequence: Synthetic peptide
DEEEIRTTNPVATEQYGSASATNLQRGER

SEQ ID NO: 12991 - protein, 28 aa, Artificial Sequence
  Description of Artificial Sequence: Synthetic peptide
DEEEIATTNPVATEQYGSVSTDLQLGNR

SEQ ID NO: 12992 - protein, 30 aa, Artificial Sequence
  Description of Artificial Sequence: Synthetic polypeptide
DEEEIRTTNPVATEQYGDVSETNLQRNGNR

SEQ ID NO: 12993 - protein, 28 aa, Artificial Sequence
  Description of Artificial Sequence: Synthetic peptide
DEEEIRTTNPVATEQYGIVSTNDERGNR

SEQ ID NO: 12994 - protein, 28 aa, Artificial Sequence
  Description of Artificial Sequence: Synthetic peptide
DESEIRTTNPVATEQYGSVSYNLQRGNI

SEQ ID NO: 12995 - protein, 28 aa, Artificial Sequence
  Description of Artificial Sequence: Synthetic peptide
DEEEIRTTNSVATEQYGSVSTNLQMRNR

SEQ ID NO: 12996 - protein, 28 aa, Artificial Sequence
  Description of Artificial Sequence: Synthetic peptide
DEEEIRTTNPVATEQYGSVSTSLMRQNR

SEQ ID NO: 12997 - protein, 28 aa, Artificial Sequence
  Description of Artificial Sequence: Synthetic peptide
DDEEVRTTNPVATEQYGSVGTNLQRGNR

SEQ ID NO: 12998 - protein, 28 aa, Artificial Sequence
  Description of Artificial Sequence: Synthetic peptide
DEEEIRTTNPVATEQYGWVSDDLQRGNR

SEQ ID NO: 12999 - protein, 28 aa, Artificial Sequence
  Description of Artificial Sequence: Synthetic peptide
DEEEIRTTNPVSTEGYGSVATNLQRGNR

SEQ ID NO: 13000 - protein, 29 aa, Artificial Sequence
  Description of Artificial Sequence: Synthetic peptide
DEEEIRTTNPVATEQYGSVSDVLQARGNR

SEQ ID NO: 13001 - protein, 28 aa, Artificial Sequence
  Description of Artificial Sequence: Synthetic peptide
DEEEIRTTNPVATEQYGSVATNLQYGND

SEQ ID NO: 13002 - protein, 28 aa, Artificial Sequence
  Description of Artificial Sequence: Synthetic peptide
DEEEITTTNIVATEQYGSVSTNLQRGNQ

SEQ ID NO: 13003 - protein, 28 aa, Artificial Sequence
  Description of Artificial Sequence: Synthetic peptide
DEMEICTTNPVATEQYGSVSTNLQRGGR

SEQ ID NO: 13004 - protein, 28 aa, Artificial Sequence
  Description of Artificial Sequence: Synthetic peptide
YEQEIRTTNPVATEQYGSVSTNLQMGNR

SEQ ID NO: 13005 - protein, 28 aa, Artificial Sequence
  Description of Artificial Sequence: Synthetic peptide
DEEEIRTTNPEATEQYGSVSTDLQNGNR

SEQ ID NO: 13006 - protein, 28 aa, Artificial Sequence
  Description of Artificial Sequence: Synthetic peptide
DEEEIRTTNPVATEQYGSASTNPQRGER

SEQ ID NO: 13007 - protein, 29 aa, Artificial Sequence
  Description of Artificial Sequence: Synthetic peptide
DEEEIRTTNPVATEQYGSVSTCLQIRENR

SEQ ID NO: 13008 - protein, 28 aa, Artificial Sequence
  Description of Artificial Sequence: Synthetic peptide
DEEEIRTTNPVATETFGSVSTNLQQGNR

SEQ ID NO: 13009 - protein, 28 aa, Artificial Sequence
  Description of Artificial Sequence: Synthetic peptide
KEEEIRTTNPVATEQYGSVSTNLDRGNN

SEQ ID NO: 13010 - protein, 28 aa, Artificial Sequence
  Description of Artificial Sequence: Synthetic peptide
DEEEIRTTNPVATDQYGSVSENLQRGNH

SEQ ID NO: 13011 - protein, 28 aa, Artificial Sequence
  Description of Artificial Sequence: Synthetic peptide
DEQEIRTTNPVATEQYGVVSTNLQRGNA

SEQ ID NO: 13012 - protein, 28 aa, Artificial Sequence
  Description of Artificial Sequence: Synthetic peptide
DEEEIRTTNPVADEPWGSVSTNLQRGNR

SEQ ID NO: 13013 - protein, 29 aa, Artificial Sequence
  Description of Artificial Sequence: Synthetic peptide
HEEEIRTVNPVATEQYGSVSTNLQRGNER

SEQ ID NO: 13014 - protein, 28 aa, Artificial Sequence
  Description of Artificial Sequence: Synthetic peptide
DENEIRTTNPVATEQYGTVSTNLQHGNR

SEQ ID NO: 13015 - protein, 29 aa, Artificial Sequence
  Description of Artificial Sequence: Synthetic peptide
DEEEIRTTNPVATEQYGSVSTNLQRNGEA

SEQ ID NO: 13016 - protein, 28 aa, Artificial Sequence
  Description of Artificial Sequence: Synthetic peptide
DEEEIRTTNPVATECYGSVSTDLQHGNR

SEQ ID NO: 13017 - protein, 28 aa, Artificial Sequence
  Description of Artificial Sequence: Synthetic peptide
DEEEIRTTNIVATEVYGSVSTNLQHGNR

SEQ ID NO: 13018 - protein, 28 aa, Artificial Sequence
  Description of Artificial Sequence: Synthetic peptide
DEQEIRTTNPVATECYGSVSTNLQRGNA

SEQ ID NO: 13019 - protein, 28 aa, Artificial Sequence
  Description of Artificial Sequence: Synthetic peptide
DEEEISTTNPVATEVYGSVSTNLERGNR

SEQ ID NO: 13020 - protein, 28 aa, Artificial Sequence
  Description of Artificial Sequence: Synthetic peptide
MEEEIRTTNPVATEQYGSASTNLQRPNR

SEQ ID NO: 13021 - protein, 28 aa, Artificial Sequence
  Description of Artificial Sequence: Synthetic peptide
DEEEIRTTNPVCTEQYGDVSTNLQRGNA

SEQ ID NO: 13022 - protein, 28 aa, Artificial Sequence
  Description of Artificial Sequence: Synthetic peptide
DEEEIRTTNIVATEQFGSVSTNLQRGNG

SEQ ID NO: 13023 - protein, 30 aa, Artificial Sequence
  Description of Artificial Sequence: Synthetic polypeptide
DEEEIRTTNPVATEQYGSVASTNLTQNGNR

SEQ ID NO: 13024 - protein, 29 aa, Artificial Sequence
  Description of Artificial Sequence: Synthetic peptide
DEEEIRTTNPVATEQYGSVSTGCLQNGNR

SEQ ID NO: 13025 - protein, 28 aa, Artificial Sequence
  Description of Artificial Sequence: Synthetic peptide
DEEEISTTNPIATEQYGSVSTNLQRGNF

SEQ ID NO: 13026 - protein, 29 aa, Artificial Sequence
  Description of Artificial Sequence: Synthetic peptide
DEEEIRTTNPCATEQYGSVSTNEQTRGNR

SEQ ID NO: 13027 - protein, 28 aa, Artificial Sequence
  Description of Artificial Sequence: Synthetic peptide
DEEEIRTTNIVATEQYGSVSTNLERGNY

SEQ ID NO: 13028 - protein, 28 aa, Artificial Sequence
  Description of Artificial Sequence: Synthetic peptide
DENEIRTTNPVATEQYGVVSTLLQRGNR

SEQ ID NO: 13029 - protein, 28 aa, Artificial Sequence
  Description of Artificial Sequence: Synthetic peptide
DEEEVRTTNPVATEVYGSVSTNQQRGNR

SEQ ID NO: 13030 - protein, 28 aa, Artificial Sequence
  Description of Artificial Sequence: Synthetic peptide
DEEEIRTTNPTATEQYGSVSANLQGGNR

SEQ ID NO: 13031 - protein, 28 aa, Artificial Sequence
  Description of Artificial Sequence: Synthetic peptide
DEEEIRTTNPVATEQYGSVSTNEQNGNQ

SEQ ID NO: 13032 - protein, 28 aa, Artificial Sequence
  Description of Artificial Sequence: Synthetic peptide
DEEEIRTTNPVATEQYGSVDTNLQRGDF

SEQ ID NO: 13033 - protein, 30 aa, Artificial Sequence
  Description of Artificial Sequence: Synthetic polypeptide
DEEEIRTTNPVATEQYGSVSTNQVQRGENR

SEQ ID NO: 13034 - protein, 28 aa, Artificial Sequence
  Description of Artificial Sequence: Synthetic peptide
SEEEIRTTNPVATEIYGSVSTNLQRGNG

SEQ ID NO: 13035 - protein, 28 aa, Artificial Sequence
  Description of Artificial Sequence: Synthetic peptide
MEEEIRTTNPVATEQYGSVSTNLQQGNA

SEQ ID NO: 13036 - protein, 28 aa, Artificial Sequence
  Description of Artificial Sequence: Synthetic peptide
DEEEIRTTNPVATEQYGSVSTNFSLGNR

SEQ ID NO: 13037 - protein, 28 aa, Artificial Sequence
  Description of Artificial Sequence: Synthetic peptide
DETEIRTTNPVATEQYGSVSTNLQVGNF

SEQ ID NO: 13038 - protein, 28 aa, Artificial Sequence
  Description of Artificial Sequence: Synthetic peptide
DEYEIRTTNPVATEQYGSVSTNLQRENH

SEQ ID NO: 13039 - protein, 28 aa, Artificial Sequence
  Description of Artificial Sequence: Synthetic peptide
DEEEIRTTNPVATEQFGSVSTNLQRGTG

SEQ ID NO: 13040 - protein, 28 aa, Artificial Sequence
  Description of Artificial Sequence: Synthetic peptide
CEEEISTTNPVATEQYGDVSTNLQRGNR

SEQ ID NO: 13041 - protein, 29 aa, Artificial Sequence
  Description of Artificial Sequence: Synthetic peptide
DEEEIRTTNPVATELYGSVSTNLQMRGNW

SEQ ID NO: 13042 - protein, 28 aa, Artificial Sequence
  Description of Artificial Sequence: Synthetic peptide
DEEEIRTTNPVATEQYGSVSTNPQRGTE

SEQ ID NO: 13043 - protein, 29 aa, Artificial Sequence
  Description of Artificial Sequence: Synthetic peptide
DEEEIRTTNPVATEQYGSVSTNGPQRGNE

SEQ ID NO: 13044 - protein, 29 aa, Artificial Sequence
  Description of Artificial Sequence: Synthetic peptide
DEEEIRTTNPVATEQYGSVSTPNLQRGDF

SEQ ID NO: 13045 - protein, 28 aa, Artificial Sequence
  Description of Artificial Sequence: Synthetic peptide
DEEEIRTTNPVATEQYGSVSTDLQAGNN

SEQ ID NO: 13046 - protein, 28 aa, Artificial Sequence
  Description of Artificial Sequence: Synthetic peptide
DECEIATTNPVATEQYGSVSNNLQRGNR

SEQ ID NO: 13047 - protein, 28 aa, Artificial Sequence
  Description of Artificial Sequence: Synthetic peptide
DEEEIRTTNPVATEQYGSVSTNLNSGNI

SEQ ID NO: 13048 - protein, 30 aa, Artificial Sequence
  Description of Artificial Sequence: Synthetic polypeptide
DEEEIHTTNPVATEQYGSVSCTNLQRGDNR

SEQ ID NO: 13049 - protein, 30 aa, Artificial Sequence
  Description of Artificial Sequence: Synthetic polypeptide
DENEIRTTNPVATEQYGSVSTNLQLRGENR

SEQ ID NO: 13050 - protein, 28 aa, Artificial Sequence
  Description of Artificial Sequence: Synthetic peptide
DEEEIATTNPVATEQYGSVSTNPQQGNR

SEQ ID NO: 13051 - protein, 28 aa, Artificial Sequence
  Description of Artificial Sequence: Synthetic peptide
DEEEIRTTNPVATEQYGGVSTEDQRGNR

SEQ ID NO: 13052 - protein, 28 aa, Artificial Sequence
  Description of Artificial Sequence: Synthetic peptide
DEEEIRTTNPVATEQWGSWSTNLQRGDR

SEQ ID NO: 13053 - protein, 28 aa, Artificial Sequence
  Description of Artificial Sequence: Synthetic peptide
DEEEIRTTNIVATEIYGSVSTNLQQGNR

SEQ ID NO: 13054 - protein, 28 aa, Artificial Sequence
  Description of Artificial Sequence: Synthetic peptide
DEEEIRTTNPVATEQYGSVSTDLQNGNV

SEQ ID NO: 13055 - protein, 28 aa, Artificial Sequence
  Description of Artificial Sequence: Synthetic peptide
DEEEIRTTNPVATEQYGSCSTPLQRGNG

SEQ ID NO: 13056 - protein, 28 aa, Artificial Sequence
  Description of Artificial Sequence: Synthetic peptide
DEEEIRTTNIVATEQYGSVSTVLQRGNQ

SEQ ID NO: 13057 - protein, 28 aa, Artificial Sequence
  Description of Artificial Sequence: Synthetic peptide
DEIEIRTTNPVATEQYGEVSTNLQRENR

SEQ ID NO: 13058 - protein, 28 aa, Artificial Sequence
  Description of Artificial Sequence: Synthetic peptide
DEVEIRTTNPVATEQYGSVPTNLQRGNI

SEQ ID NO: 13059 - protein, 28 aa, Artificial Sequence
  Description of Artificial Sequence: Synthetic peptide
DEEEIRTTNIVATEQYGSVSDNLQRGQR

SEQ ID NO: 13060 - protein, 28 aa, Artificial Sequence
  Description of Artificial Sequence: Synthetic peptide
AEEEIRTTNPVATEQYGSASTNLCRGNR

SEQ ID NO: 13061 - protein, 28 aa, Artificial Sequence
  Description of Artificial Sequence: Synthetic peptide
DEEEIRTTNPIATEQYGGVSTNLQIGNR

SEQ ID NO: 13062 - protein, 28 aa, Artificial Sequence
  Description of Artificial Sequence: Synthetic peptide
DEEEIRTTNPVATEQYGSVSTNDCHGNR

SEQ ID NO: 13063 - protein, 29 aa, Artificial Sequence
  Description of Artificial Sequence: Synthetic peptide
DEQEVRTTNPVATEQYGSVSTNLQRNGNR

SEQ ID NO: 13064 - protein, 28 aa, Artificial Sequence
  Description of Artificial Sequence: Synthetic peptide
DENEIRTTNPVATEQYGSVSTNLQRGES

SEQ ID NO: 13065 - protein, 28 aa, Artificial Sequence
  Description of Artificial Sequence: Synthetic peptide
DEEEIRATNPVATEQYGQVSTNLQDGNR

SEQ ID NO: 13066 - protein, 28 aa, Artificial Sequence
  Description of Artificial Sequence: Synthetic peptide
DEEEIRTTNPVATECYGSVSTELERGNR

SEQ ID NO: 13067 - protein, 28 aa, Artificial Sequence
  Description of Artificial Sequence: Synthetic peptide
DEDEVRTTNPVATEQYGSVSTNLQHGNR

SEQ ID NO: 13068 - protein, 28 aa, Artificial Sequence
  Description of Artificial Sequence: Synthetic peptide
DEEEIRTTNIVATEQYGGVSTNLQRGNA

SEQ ID NO: 13069 - protein, 28 aa, Artificial Sequence
  Description of Artificial Sequence: Synthetic peptide
DDEEIRTVNPVATEQYGSVSNNLQRGNR

SEQ ID NO: 13070 - protein, 28 aa, Artificial Sequence
  Description of Artificial Sequence: Synthetic peptide
DEEEIRTTNPVATECYGSVSTNLQLGNQ

SEQ ID NO: 13071 - protein, 29 aa, Artificial Sequence
  Description of Artificial Sequence: Synthetic peptide
DEEEIRTTNPVSTEQWGSVSTNLQLRGNR

SEQ ID NO: 13072 - protein, 28 aa, Artificial Sequence
  Description of Artificial Sequence: Synthetic peptide
DEEEIATTNPVATEQYGSVSTNLMRGER

SEQ ID NO: 13073 - protein, 28 aa, Artificial Sequence
  Description of Artificial Sequence: Synthetic peptide
DEEEIRTTNPVATECYGSVSDNLQSGNR

SEQ ID NO: 13074 - protein, 28 aa, Artificial Sequence
  Description of Artificial Sequence: Synthetic peptide
DEEEIRTTNPVATEQYGSVSVNLQNGTR

SEQ ID NO: 13075 - protein, 28 aa, Artificial Sequence
  Description of Artificial Sequence: Synthetic peptide
DEEEIRTTNIVATEQYGSVETNLQEGNR

SEQ ID NO: 13076 - protein, 28 aa, Artificial Sequence
  Description of Artificial Sequence: Synthetic peptide
DEEEIRCTNPVATEQYGSVSTAPQRGNR

SEQ ID NO: 13077 - protein, 28 aa, Artificial Sequence
  Description of Artificial Sequence: Synthetic peptide
DEMEIDTTNPVATEQYGSVSTNLQRFNR

SEQ ID NO: 13078 - protein, 28 aa, Artificial Sequence
  Description of Artificial Sequence: Synthetic peptide
DEEEIRTTNPVATEQYGSFSTELQRGNQ

SEQ ID NO: 13079 - protein, 28 aa, Artificial Sequence
  Description of Artificial Sequence: Synthetic peptide
DEEEIRTTNPVATEQYGSVSTELQQGER

SEQ ID NO: 13080 - protein, 28 aa, Artificial Sequence
  Description of Artificial Sequence: Synthetic peptide
DEEEIRTTNPVATETYGSVSIQLQRGNR

SEQ ID NO: 13081 - protein, 28 aa, Artificial Sequence
  Description of Artificial Sequence: Synthetic peptide
DEEEIRTTNPVATEQYGSVSTNLQHGME

SEQ ID NO: 13082 - protein, 28 aa, Artificial Sequence
  Description of Artificial Sequence: Synthetic peptide
MEEEIRTTNPVATEQYGGVSDNLQRGNR

SEQ ID NO: 13083 - protein, 30 aa, Artificial Sequence
  Description of Artificial Sequence: Synthetic polypeptide
DEEEIRTTNPVATEQYGSSVTSHNLQRGNR

SEQ ID NO: 13084 - protein, 28 aa, Artificial Sequence
  Description of Artificial Sequence: Synthetic peptide
DEEEIRTTNPCATEQYGSVSTNLQTGNH

SEQ ID NO: 13085 - protein, 28 aa, Artificial Sequence
  Description of Artificial Sequence: Synthetic peptide
DEEEIRTTNPVATEQYGSVSTNPQNGNS

SEQ ID NO: 13086 - protein, 28 aa, Artificial Sequence
  Description of Artificial Sequence: Synthetic peptide
DEQEIRTTNPVSTEQYGEVSTNLQRGNR

SEQ ID NO: 13087 - protein, 28 aa, Artificial Sequence
  Description of Artificial Sequence: Synthetic peptide
DEEEIRATNPVATEQYGSMSTNLQTGNR

SEQ ID NO: 13088 - protein, 28 aa, Artificial Sequence
  Description of Artificial Sequence: Synthetic peptide
DENEIRTTNPVATEQYGSVSTNLQVGNA

SEQ ID NO: 13089 - protein, 28 aa, Artificial Sequence
  Description of Artificial Sequence: Synthetic peptide
DEEEIWTTNPVATEQYGSVSENLQRGNA

SEQ ID NO: 13090 - protein, 29 aa, Artificial Sequence
  Description of Artificial Sequence: Synthetic peptide
DEEEIRTTNPVATEQYGSVSTNLQQVGNY

SEQ ID NO: 13091 - protein, 28 aa, Artificial Sequence
  Description of Artificial Sequence: Synthetic peptide
DEEEIRTTNPVATEQWGSVSTNEQRGNW

SEQ ID NO: 13092 - protein, 28 aa, Artificial Sequence
  Description of Artificial Sequence: Synthetic peptide
DEVEIRTTNPVATEQYGSVSTNEQRGNG

SEQ ID NO: 13093 - protein, 28 aa, Artificial Sequence
  Description of Artificial Sequence: Synthetic peptide
DEEEIRTTNPVAYECYGSVSTNLQDGNR

SEQ ID NO: 13094 - protein, 30 aa, Artificial Sequence
  Description of Artificial Sequence: Synthetic polypeptide
DEEEIRTTNPVATECYGSVSTNLQERGNDR

SEQ ID NO: 13095 - protein, 28 aa, Artificial Sequence
  Description of Artificial Sequence: Synthetic peptide
VEEEIRQTNPVATEQYGTVSTNLQRGNR

SEQ ID NO: 13096 - protein, 28 aa, Artificial Sequence
  Description of Artificial Sequence: Synthetic peptide
DEEEIRTTNPVATEMYGSVSTNPQRGNQ

SEQ ID NO: 13097 - protein, 28 aa, Artificial Sequence
  Description of Artificial Sequence: Synthetic peptide
DEEEIRTTNIVATEQYGSVSTNLQNGNA

SEQ ID NO: 13098 - protein, 28 aa, Artificial Sequence
  Description of Artificial Sequence: Synthetic peptide
DEEEIATTNPVASEQYGSVSTVLQRGNR

SEQ ID NO: 13099 - protein, 28 aa, Artificial Sequence
  Description of Artificial Sequence: Synthetic peptide
DEAEIRTTNIVATEQYGSVSTNLQRGNM

SEQ ID NO: 13100 - protein, 28 aa, Artificial Sequence
  Description of Artificial Sequence: Synthetic peptide
HEEEIRTTNPVATEQYGSVSENLQRGNS

SEQ ID NO: 13101 - protein, 28 aa, Artificial Sequence
  Description of Artificial Sequence: Synthetic peptide
DEEEIRTTNPTATEQYGSVSTNWQRGNI

SEQ ID NO: 13102 - protein, 28 aa, Artificial Sequence
  Description of Artificial Sequence: Synthetic peptide
DEEEIRTTNPVATEQYGDVSTNDQHGNR

SEQ ID NO: 13103 - protein, 29 aa, Artificial Sequence
  Description of Artificial Sequence: Synthetic peptide
DEEEIRTTNPVCTEQYGSVSTNWQQRGNR

SEQ ID NO: 13104 - protein, 29 aa, Artificial Sequence
  Description of Artificial Sequence: Synthetic peptide
DEEEIRATNPVATEQYGEVSTNLQSRGNR

SEQ ID NO: 13105 - protein, 28 aa, Artificial Sequence
  Description of Artificial Sequence: Synthetic peptide
DEQEIAATNPVATEQYGSVSTNLQRGNR

SEQ ID NO: 13106 - protein, 29 aa, Artificial Sequence
  Description of Artificial Sequence: Synthetic peptide
DENEIRTTNPVATEQYGSVSTNLQIRGNA

SEQ ID NO: 13107 - protein, 28 aa, Artificial Sequence
  Description of Artificial Sequence: Synthetic peptide
DEEEIRTTNPVATEQYGSVSEVLQRGNN

SEQ ID NO: 13108 - protein, 28 aa, Artificial Sequence
  Description of Artificial Sequence: Synthetic peptide
DDEEIRTTNIVATEQYGSVSTNLQQGNR

SEQ ID NO: 13109 - protein, 28 aa, Artificial Sequence
  Description of Artificial Sequence: Synthetic peptide
KEEEIRTTNPVATEMYGSVSTNLQRGER

SEQ ID NO: 13110 - protein, 28 aa, Artificial Sequence
  Description of Artificial Sequence: Synthetic peptide
DEEEIRTVNPVATEQYGVVSNNLQRGNR

SEQ ID NO: 13111 - protein, 28 aa, Artificial Sequence
  Description of Artificial Sequence: Synthetic peptide
SEEEIRTTNPVATEQYGSVSTNLQQGNY

SEQ ID NO: 13112 - protein, 28 aa, Artificial Sequence
  Description of Artificial Sequence: Synthetic peptide
DENEIRTTNPVATEVYGSVSTNEQRGNR

SEQ ID NO: 13113 - protein, 28 aa, Artificial Sequence
  Description of Artificial Sequence: Synthetic peptide
DEEEIRTTNPVATEQFGSVSTNLMSGNR

SEQ ID NO: 13114 - protein, 29 aa, Artificial Sequence
  Description of Artificial Sequence: Synthetic peptide
DEEEIRTTNPVCTEQYGSVSTNLQQQGNR

SEQ ID NO: 13115 - protein, 28 aa, Artificial Sequence
  Description of Artificial Sequence: Synthetic peptide
DEVEIATTNPVATEQYGSVSDNLQRGNR

SEQ ID NO: 13116 - protein, 30 aa, Artificial Sequence
  Description of Artificial Sequence: Synthetic polypeptide
DEEEIRTTNPVATEQYGSVSTNDTQRGINR

SEQ ID NO: 13117 - protein, 28 aa, Artificial Sequence
  Description of Artificial Sequence: Synthetic peptide
NDEEIRTTNPVATEQYGSVSTNLQRGTR

SEQ ID NO: 13118 - protein, 28 aa, Artificial Sequence
  Description of Artificial Sequence: Synthetic peptide
DECEIRCTNPVATEQYGSVSTNLQRGNA

SEQ ID NO: 13119 - protein, 28 aa, Artificial Sequence
  Description of Artificial Sequence: Synthetic peptide
DEEEIRTTNPVATEQYGSVSDVLQRFNR

SEQ ID NO: 13120 - protein, 29 aa, Artificial Sequence
  Description of Artificial Sequence: Synthetic peptide
DEEEIRTTNPVATEQYGSVSTNLQQQGNA

SEQ ID NO: 13121 - protein, 28 aa, Artificial Sequence
  Description of Artificial Sequence: Synthetic peptide
DEEEIRTTNPVATEQYGSVGENLQRGNG

SEQ ID NO: 13122 - protein, 28 aa, Artificial Sequence
  Description of Artificial Sequence: Synthetic peptide
AEEEINTTNPVATEQYGSVSTYLQRGNR

SEQ ID NO: 13123 - protein, 28 aa, Artificial Sequence
  Description of Artificial Sequence: Synthetic peptide
DEEEIRTTNPVATEQYGSVSTEDQRGNY

SEQ ID NO: 13124 - protein, 28 aa, Artificial Sequence
  Description of Artificial Sequence: Synthetic peptide
DEEEIRTTNPVATEQYGWVSTNLQHGNT

SEQ ID NO: 13125 - protein, 28 aa, Artificial Sequence
  Description of Artificial Sequence: Synthetic peptide
DEEEIRTTNPVATEWYGSVSTNLQGGNQ

SEQ ID NO: 13126 - protein, 28 aa, Artificial Sequence
  Description of Artificial Sequence: Synthetic peptide
DEEEIRTTNPVATENYGSVSTNLQRMND

SEQ ID NO: 13127 - protein, 28 aa, Artificial Sequence
  Description of Artificial Sequence: Synthetic peptide
DEEEIRTTNPVATEQYGSVSTNEQHGND

SEQ ID NO: 13128 - protein, 28 aa, Artificial Sequence
  Description of Artificial Sequence: Synthetic peptide
DEEEIRTTNPVATEQYGSFSENEQRGNR

SEQ ID NO: 13129 - protein, 31 aa, Artificial Sequence
  Description of Artificial Sequence: Synthetic polypeptide
DEEEIRTTNPVATEQYGSVSATNLQDRNGNR

SEQ ID NO: 13130 - protein, 28 aa, Artificial Sequence
  Description of Artificial Sequence: Synthetic peptide
DEEEIRTTNPVATEVYGSVSTNLQWGNH

SEQ ID NO: 13131 - protein, 28 aa, Artificial Sequence
  Description of Artificial Sequence: Synthetic peptide
DEVEIRTTNPVATEQYGSVSENLQYGNR

SEQ ID NO: 13132 - protein, 28 aa, Artificial Sequence
  Description of Artificial Sequence: Synthetic peptide
DEEEIRTTNPVATEQYGSVSENLQLGNS

SEQ ID NO: 13133 - protein, 28 aa, Artificial Sequence
  Description of Artificial Sequence: Synthetic peptide
DEEEISTTNICATEQYGSVSTNLQRGNR

SEQ ID NO: 13134 - protein, 28 aa, Artificial Sequence
  Description of Artificial Sequence: Synthetic peptide
DENEIRTTNPVATEQYGSVSTNLQNGNF

SEQ ID NO: 13135 - protein, 28 aa, Artificial Sequence
  Description of Artificial Sequence: Synthetic peptide
DEDEIRTTNPVATEQYGSVSTNLQYGDR

SEQ ID NO: 13136 - protein, 28 aa, Artificial Sequence
  Description of Artificial Sequence: Synthetic peptide
DEEEIRTTNPVATEQYGSVSTNLQGGQF

SEQ ID NO: 13137 - protein, 29 aa, Artificial Sequence
  Description of Artificial Sequence: Synthetic peptide
DEEEIATTNPVATEQYGSVSTDLQRGENR

SEQ ID NO: 13138 - protein, 28 aa, Artificial Sequence
  Description of Artificial Sequence: Synthetic peptide
DEHEIRTTNPVATEQYGSVSSNLQRGNT

SEQ ID NO: 13139 - protein, 29 aa, Artificial Sequence
  Description of Artificial Sequence: Synthetic peptide
DEEEIRTTNPVATEQWGSVSTNLQNRGNW

SEQ ID NO: 13140 - protein, 28 aa, Artificial Sequence
  Description of Artificial Sequence: Synthetic peptide
DEEEIRTTNIVATEQYGSVSTNLQLGNF

SEQ ID NO: 13141 - protein, 28 aa, Artificial Sequence
  Description of Artificial Sequence: Synthetic peptide
DDEEIRTTNPVASEQYGSVSTNLQRPNR

SEQ ID NO: 13142 - protein, 28 aa, Artificial Sequence
  Description of Artificial Sequence: Synthetic peptide
DEEEIRTTNPEATEQFGSVSTNLQNGNR

SEQ ID NO: 13143 - protein, 29 aa, Artificial Sequence
  Description of Artificial Sequence: Synthetic peptide
DEEEIRTTNPVATEQYGSVVTNLQRGNSP

SEQ ID NO: 13144 - protein, 28 aa, Artificial Sequence
  Description of Artificial Sequence: Synthetic peptide
DEEEIRTTNIVATEQYGSVSTNLQMGNT

SEQ ID NO: 13145 - protein, 28 aa, Artificial Sequence
  Description of Artificial Sequence: Synthetic peptide
DEEEIVTTNPVATEQYGDVSENLQRGNR

SEQ ID NO: 13146 - protein, 28 aa, Artificial Sequence
  Description of Artificial Sequence: Synthetic peptide
DEEEIRTTNPVATEQYGSVSTDLQQGNH

SEQ ID NO: 13147 - protein, 29 aa, Artificial Sequence
  Description of Artificial Sequence: Synthetic peptide
DEEEIGTTNPVATEQYGSVSTNLQSRGMR

SEQ ID NO: 13148 - protein, 28 aa, Artificial Sequence
  Description of Artificial Sequence: Synthetic peptide
DEEEIRTTNIVATEQYGSVSTNLQRGET

SEQ ID NO: 13149 - protein, 30 aa, Artificial Sequence
  Description of Artificial Sequence: Synthetic polypeptide
DEEEIRTTNPVATEQYGSVSATNLQRAGGR

SEQ ID NO: 13150 - protein, 28 aa, Artificial Sequence
  Description of Artificial Sequence: Synthetic peptide
DEEEIRTTNIVATEQYGSTSTNLQRGNL

SEQ ID NO: 13151 - protein, 28 aa, Artificial Sequence
  Description of Artificial Sequence: Synthetic peptide
DEVEIYTTNPVATEQYGSVSTNLQNGNR

SEQ ID NO: 13152 - protein, 28 aa, Artificial Sequence
  Description of Artificial Sequence: Synthetic peptide
DEREIRTTNPVATEQYGSVSEILQRGNR

SEQ ID NO: 13153 - protein, 28 aa, Artificial Sequence
  Description of Artificial Sequence: Synthetic peptide
DEEEIRTTNIVATECYGSVSTNLQVGNR

SEQ ID NO: 13154 - protein, 28 aa, Artificial Sequence
  Description of Artificial Sequence: Synthetic peptide
DENEIRTTNPVATEQYGSVSTNLQHGNF

SEQ ID NO: 13155 - protein, 28 aa, Artificial Sequence
  Description of Artificial Sequence: Synthetic peptide
DEEEIRTTNIVATEQYGSVSTNLGRGNA

SEQ ID NO: 13156 - protein, 28 aa, Artificial Sequence
  Description of Artificial Sequence: Synthetic peptide
DEEEIRTTNPVATEQYGSVSENLQWGNL

SEQ ID NO: 13157 - protein, 28 aa, Artificial Sequence
  Description of Artificial Sequence: Synthetic peptide
DEEEIRTTNIVATEQYGSVSTALQRGER

SEQ ID NO: 13158 - protein, 28 aa, Artificial Sequence
  Description of Artificial Sequence: Synthetic peptide
DEEEIRTTNPVATEQYGSVSTDLQIGNF

SEQ ID NO: 13159 - protein, 28 aa, Artificial Sequence
  Description of Artificial Sequence: Synthetic peptide
DEEEIRTTNPTATEQYGSVSTNEQRGNL

SEQ ID NO: 13160 - protein, 28 aa, Artificial Sequence
  Description of Artificial Sequence: Synthetic peptide
DESEIRTTNIVATEQYGSVSTNLQVGNR

SEQ ID NO: 13161 - protein, 28 aa, Artificial Sequence
  Description of Artificial Sequence: Synthetic peptide
DEEEIRTTNPVATEQYGSVSENLQIGNQ

SEQ ID NO: 13162 - protein, 29 aa, Artificial Sequence
  Description of Artificial Sequence: Synthetic peptide
DEEEIATTNPVATEQYGSASTNLQRAGNR

SEQ ID NO: 13163 - protein, 28 aa, Artificial Sequence
  Description of Artificial Sequence: Synthetic peptide
DEEEIATTNIVATEQYGSVSTNLQRGNT

SEQ ID NO: 13164 - protein, 29 aa, Artificial Sequence
  Description of Artificial Sequence: Synthetic peptide
DENEIRTTNPVATEQYGSVSTMNLERGNR

SEQ ID NO: 13165 - protein, 28 aa, Artificial Sequence
  Description of Artificial Sequence: Synthetic peptide
QEEEIRTTNPVATEQYGTVSTNLQRGMR

SEQ ID NO: 13166 - protein, 28 aa, Artificial Sequence
  Description of Artificial Sequence: Synthetic peptide
IEEEIRTTNPVATEQYGSVSDNIQRGNR

SEQ ID NO: 13167 - protein, 29 aa, Artificial Sequence
  Description of Artificial Sequence: Synthetic peptide
DEEEIRTTNPVATEMYGSVSTNLQERGLR

SEQ ID NO: 13168 - protein, 28 aa, Artificial Sequence
  Description of Artificial Sequence: Synthetic peptide
DEEEIRTTNPVATEGYGDVSTVLQRGNR

SEQ ID NO: 13169 - protein, 28 aa, Artificial Sequence
  Description of Artificial Sequence: Synthetic peptide
DEEEIRTTNPVATETFGSVSTNLQHGNR

SEQ ID NO: 13170 - protein, 28 aa, Artificial Sequence
  Description of Artificial Sequence: Synthetic peptide
DEEEIRTTNPVATENYGVVGTNLQRGNR

SEQ ID NO: 13171 - protein, 28 aa, Artificial Sequence
  Description of Artificial Sequence: Synthetic peptide
DEEEIRTTNIVATEQYGSVSTNEQIGNR

SEQ ID NO: 13172 - protein, 28 aa, Artificial Sequence
  Description of Artificial Sequence: Synthetic peptide
DEEEICTTNPVATEQYGSVSTNDQGGNR

SEQ ID NO: 13173 - protein, 28 aa, Artificial Sequence
  Description of Artificial Sequence: Synthetic peptide
DEEEIRTTNPVATECYGSVSTNLQQGNH

SEQ ID NO: 13174 - protein, 28 aa, Artificial Sequence
  Description of Artificial Sequence: Synthetic peptide
DEEEIRTTNPVATEQYGSVSTNLTNGNL

SEQ ID NO: 13175 - protein, 28 aa, Artificial Sequence
  Description of Artificial Sequence: Synthetic peptide
DEAEIRTTNIVATEQYGSVSTNLQRGNL

SEQ ID NO: 13176 - protein, 29 aa, Artificial Sequence
  Description of Artificial Sequence: Synthetic peptide
DENEIRTTNPVATEQYGSVSTNLQDRGNM

SEQ ID NO: 13177 - protein, 28 aa, Artificial Sequence
  Description of Artificial Sequence: Synthetic peptide
DEEEIRTTNPVATEQYGSVSTELQFGER

SEQ ID NO: 13178 - protein, 28 aa, Artificial Sequence
  Description of Artificial Sequence: Synthetic peptide
DEEEIRTTNIVATEQWGSVSTNDQRGNR

SEQ ID NO: 13179 - protein, 28 aa, Artificial Sequence
  Description of Artificial Sequence: Synthetic peptide
DEEEIRTTNPVATEQYGCVSTNLQYGNW

SEQ ID NO: 13180 - protein, 30 aa, Artificial Sequence
  Description of Artificial Sequence: Synthetic polypeptide
DEEEIRTTNPVATEQYGSVSTNLQREGNDM

SEQ ID NO: 13181 - protein, 28 aa, Artificial Sequence
  Description of Artificial Sequence: Synthetic peptide
DEEEIRTTNIVATEQYGDVSTNLQRGNT

SEQ ID NO: 13182 - protein, 29 aa, Artificial Sequence
  Description of Artificial Sequence: Synthetic peptide
DEEEIRTTNPVATEQYGSVSTNLQIKGER

SEQ ID NO: 13183 - protein, 28 aa, Artificial Sequence
  Description of Artificial Sequence: Synthetic peptide
DEEEIRTTNPVATEQYGSVSTNPQIGNA

SEQ ID NO: 13184 - protein, 28 aa, Artificial Sequence
  Description of Artificial Sequence: Synthetic peptide
DEEEIRCTNPVATEQYGGVSTNLQHGNR

SEQ ID NO: 13185 - protein, 28 aa, Artificial Sequence
  Description of Artificial Sequence: Synthetic peptide
REEEIRTTNPVATEQYGSVSENLQSGNR

SEQ ID NO: 13186 - protein, 29 aa, Artificial Sequence
  Description of Artificial Sequence: Synthetic peptide
DENEIRTTNPVATEQYGSVSTNLQDRGND

SEQ ID NO: 13187 - protein, 28 aa, Artificial Sequence
  Description of Artificial Sequence: Synthetic peptide
DEEEITATNPVATEQYGSVSDNLQRGNR

SEQ ID NO: 13188 - protein, 28 aa, Artificial Sequence
  Description of Artificial Sequence: Synthetic peptide
DEEEIRTTNIVATEQYGSVSTNLQSGER

SEQ ID NO: 13189 - protein, 28 aa, Artificial Sequence
  Description of Artificial Sequence: Synthetic peptide
DEEEIATTNIVATEQYGSVSTNLQRGND

SEQ ID NO: 13190 - protein, 28 aa, Artificial Sequence
  Description of Artificial Sequence: Synthetic peptide
DEEEIRTTNIVATEQYGSVSTNLLGGNR

SEQ ID NO: 13191 - protein, 28 aa, Artificial Sequence
  Description of Artificial Sequence: Synthetic peptide
DEEEIRTTNIVATEQYGSVSTELQRGNM

SEQ ID NO: 13192 - protein, 28 aa, Artificial Sequence
  Description of Artificial Sequence: Synthetic peptide
DEEEIATTNPVATEQFGSVSTALQRGNR

SEQ ID NO: 13193 - protein, 28 aa, Artificial Sequence
  Description of Artificial Sequence: Synthetic peptide
DEEEIRTTNPVATEQYGSVSENLQHGNM

SEQ ID NO: 13194 - protein, 28 aa, Artificial Sequence
  Description of Artificial Sequence: Synthetic peptide
DEDEIRTTNIVATEQYGSVSTNLQQGNR

SEQ ID NO: 13195 - protein, 29 aa, Artificial Sequence
  Description of Artificial Sequence: Synthetic peptide
DESEIRTTNPVATEQYGSVSTTNLQPGNR

SEQ ID NO: 13196 - protein, 28 aa, Artificial Sequence
  Description of Artificial Sequence: Synthetic peptide
DDEEIRTTNIVATEQYGSVSTNLQRGND

SEQ ID NO: 13197 - protein, 28 aa, Artificial Sequence
  Description of Artificial Sequence: Synthetic peptide
DEEEIRTTNPVATEQYGSVSTELQGGNI

SEQ ID NO: 13198 - protein, 28 aa, Artificial Sequence
  Description of Artificial Sequence: Synthetic peptide
DEEEIRTTNIVATEQYGSVSTNLQRGED

SEQ ID NO: 13199 - protein, 28 aa, Artificial Sequence
  Description of Artificial Sequence: Synthetic peptide
DEEEIRTTNPVATEQYGEVSTNLQVGNS

SEQ ID NO: 13200 - protein, 28 aa, Artificial Sequence
  Description of Artificial Sequence: Synthetic peptide
DEEEIRTTNPVATEQYGFVSTNLQHGNV

SEQ ID NO: 13201 - protein, 28 aa, Artificial Sequence
  Description of Artificial Sequence: Synthetic peptide
DEEEIRTTNPVATETYGSVSTNQQRGNQ

SEQ ID NO: 13202 - protein, 28 aa, Artificial Sequence
  Description of Artificial Sequence: Synthetic peptide
DEEEITTTNPVATEQYGAVSTNLQRGNH

SEQ ID NO: 13203 - protein, 28 aa, Artificial Sequence
  Description of Artificial Sequence: Synthetic peptide
DEEEIRTTNIVATEQYGSVSTNIQRGNL

SEQ ID NO: 13204 - protein, 28 aa, Artificial Sequence
  Description of Artificial Sequence: Synthetic peptide
DEEEIRTTNPVATELYGDVSTNLQRGQR

SEQ ID NO: 13205 - protein, 28 aa, Artificial Sequence
  Description of Artificial Sequence: Synthetic peptide
DEEEIRTTNPVATEQYGSVSTALSRGNH

SEQ ID NO: 13206 - protein, 28 aa, Artificial Sequence
  Description of Artificial Sequence: Synthetic peptide
DEEEIRATNPVATEQYGSVSTNLQVGNS

SEQ ID NO: 13207 - protein, 29 aa, Artificial Sequence
  Description of Artificial Sequence: Synthetic peptide
DEEEIRTTNPCATEQYGSVSTNLQRNGNI

SEQ ID NO: 13208 - protein, 29 aa, Artificial Sequence
  Description of Artificial Sequence: Synthetic peptide
KEEEIRTTNPVATEQYGSVSTNLQHGNDR

SEQ ID NO: 13209 - protein, 31 aa, Artificial Sequence
  Description of Artificial Sequence: Synthetic polypeptide
DEEEIRTTNPVATEQYGSVISTNLQSRGDNR

SEQ ID NO: 13210 - protein, 28 aa, Artificial Sequence
  Description of Artificial Sequence: Synthetic peptide
DEEEIVTTNPVATEQYGSVSTTLQQGNR

SEQ ID NO: 13211 - protein, 28 aa, Artificial Sequence
  Description of Artificial Sequence: Synthetic peptide
KEEEIRTTNPVATEQYGSVSTNLQNGNL

SEQ ID NO: 13212 - protein, 28 aa, Artificial Sequence
  Description of Artificial Sequence: Synthetic peptide
DEEEIRTTNIVATEQYGEVSTNLQRGNQ

SEQ ID NO: 13213 - protein, 28 aa, Artificial Sequence
  Description of Artificial Sequence: Synthetic peptide
GEEEIRTTNPVATECYGSVSTNLQRGNS

SEQ ID NO: 13214 - protein, 28 aa, Artificial Sequence
  Description of Artificial Sequence: Synthetic peptide
DEEEIATTNIVATEQYGSVSTNIQRGNR

SEQ ID NO: 13215 - protein, 29 aa, Artificial Sequence
  Description of Artificial Sequence: Synthetic peptide
DEEEIRTTNPVATEQYGSVSTNLQQNGNQ

SEQ ID NO: 13216 - protein, 28 aa, Artificial Sequence
  Description of Artificial Sequence: Synthetic peptide
AEEEIRTTNPVSTEQYGWVSTNLQRGNR

SEQ ID NO: 13217 - protein, 28 aa, Artificial Sequence
  Description of Artificial Sequence: Synthetic peptide
DENEIRTTNPVATESYGSVSENLQRGNR

SEQ ID NO: 13218 - protein, 28 aa, Artificial Sequence
  Description of Artificial Sequence: Synthetic peptide
SEEEIYTTNPVATEQYGSVSTNLQRGDR

SEQ ID NO: 13219 - protein, 28 aa, Artificial Sequence
  Description of Artificial Sequence: Synthetic peptide
DEEEIRTTNIVSTEQYGSVSTNLQQGNR

SEQ ID NO: 13220 - protein, 28 aa, Artificial Sequence
  Description of Artificial Sequence: Synthetic peptide
DEEEIRSTNIVATEQYGSVSTNLQRGNE

SEQ ID NO: 13221 - protein, 28 aa, Artificial Sequence
  Description of Artificial Sequence: Synthetic peptide
DEEEICTTNPVATETYGSVSTNLQTGNR

SEQ ID NO: 13222 - protein, 28 aa, Artificial Sequence
  Description of Artificial Sequence: Synthetic peptide
DEDEIRTTNIVATEQYGSVSTNLQRGNQ

SEQ ID NO: 13223 - protein, 28 aa, Artificial Sequence
  Description of Artificial Sequence: Synthetic peptide
DEYEIRTTNPVATEQYGSVSTNLQHGNG

SEQ ID NO: 13224 - protein, 28 aa, Artificial Sequence
  Description of Artificial Sequence: Synthetic peptide
DEEEIRTTNPVATEQYGSVSDNLQYGNV

SEQ ID NO: 13225 - protein, 28 aa, Artificial Sequence
  Description of Artificial Sequence: Synthetic peptide
DEEEIRTTNIVATEQYGSVSTNLQRGEL

SEQ ID NO: 13226 - protein, 28 aa, Artificial Sequence
  Description of Artificial Sequence: Synthetic peptide
DEEEIATTNPVATEQYGEVATNLQRGNR

SEQ ID NO: 13227 - protein, 29 aa, Artificial Sequence
  Description of Artificial Sequence: Synthetic peptide
DEEEIRTTNPVATEQYGIVSENLQMRGNR

SEQ ID NO: 13228 - protein, 29 aa, Artificial Sequence
  Description of Artificial Sequence: Synthetic peptide
DEEEIRTTNPVATEIYGCVSTNLQRNGNR

SEQ ID NO: 13229 - protein, 28 aa, Artificial Sequence
  Description of Artificial Sequence: Synthetic peptide
GEEEIRTTNPCATEQYGSVSTNLQRGNS

SEQ ID NO: 13230 - protein, 28 aa, Artificial Sequence
  Description of Artificial Sequence: Synthetic peptide
DEEEIRTTNIVATEQYGSVSENEQRGNR

SEQ ID NO: 13231 - protein, 29 aa, Artificial Sequence
  Description of Artificial Sequence: Synthetic peptide
DEEEIATTNPVATEQYGSVSTNLQVRGNH

SEQ ID NO: 13232 - protein, 28 aa, Artificial Sequence
  Description of Artificial Sequence: Synthetic peptide
DEEEIRTTNIVATEQYGSVSTNLQMGER

SEQ ID NO: 13233 - protein, 28 aa, Artificial Sequence
  Description of Artificial Sequence: Synthetic peptide
DEEEIRTTNPVATEQYGSVPTALQPGNR

SEQ ID NO: 13234 - protein, 28 aa, Artificial Sequence
  Description of Artificial Sequence: Synthetic peptide
DEEEIRTTNPVATEMYGSVSTNEQRGNF

SEQ ID NO: 13235 - protein, 28 aa, Artificial Sequence
  Description of Artificial Sequence: Synthetic peptide
DEEEIRTTNPVATEQYGWVSTNDQRGNM

SEQ ID NO: 13236 - protein, 29 aa, Artificial Sequence
  Description of Artificial Sequence: Synthetic peptide
DEEEIRTTNPVATEQYGSVSTNDQNGGNR

SEQ ID NO: 13237 - protein, 28 aa, Artificial Sequence
  Description of Artificial Sequence: Synthetic peptide
DEEEIVTTNPVATEQYGSASTNLQQGNR

SEQ ID NO: 13238 - protein, 28 aa, Artificial Sequence
  Description of Artificial Sequence: Synthetic peptide
DEEEIRTTNIVATEQYGSVSTIDQRGNR

SEQ ID NO: 13239 - protein, 28 aa, Artificial Sequence
  Description of Artificial Sequence: Synthetic peptide
QEEEIRTTNPVATEQYGSASTNLQRGER

SEQ ID NO: 13240 - protein, 28 aa, Artificial Sequence
  Description of Artificial Sequence: Synthetic peptide
DEEEIATTNIVATEQYGSVSTNLQHGNR

SEQ ID NO: 13241 - protein, 28 aa, Artificial Sequence
  Description of Artificial Sequence: Synthetic peptide
DEQEIRTTNIVATEQYGSVSTNLQNGNR

SEQ ID NO: 13242 - protein, 28 aa, Artificial Sequence
  Description of Artificial Sequence: Synthetic peptide
DEEEICTTNPVATELFGSVSTNLQRGNR

SEQ ID NO: 13243 - protein, 28 aa, Artificial Sequence
  Description of Artificial Sequence: Synthetic peptide
DEEEIRTTNPVATEQYGSVSTNEQHGNI

SEQ ID NO: 13244 - protein, 28 aa, Artificial Sequence
  Description of Artificial Sequence: Synthetic peptide
DEEEIRTTNPVATEQWGSVSTNIQRGNS

SEQ ID NO: 13245 - protein, 28 aa, Artificial Sequence
  Description of Artificial Sequence: Synthetic peptide
DEEEIRTTNPVATEQYGSVSTPLQRGEG

SEQ ID NO: 13246 - protein, 29 aa, Artificial Sequence
  Description of Artificial Sequence: Synthetic peptide
DEEEIRTTNPVATEQWGSVSENLQMRGNR

SEQ ID NO: 13247 - protein, 29 aa, Artificial Sequence
  Description of Artificial Sequence: Synthetic peptide
DEEEIRTTNPVATEQYGDVSENLQRGNDR

SEQ ID NO: 13248 - protein, 28 aa, Artificial Sequence
  Description of Artificial Sequence: Synthetic peptide
DEEEIRTTNPVATEQYGSVSTNLQIGHG

SEQ ID NO: 13249 - protein, 29 aa, Artificial Sequence
  Description of Artificial Sequence: Synthetic peptide
DEEEIATTNPVATEQYGSVSATNLQRGNL

SEQ ID NO: 13250 - protein, 28 aa, Artificial Sequence
  Description of Artificial Sequence: Synthetic peptide
DENEIATTNPVATEQYGSVSTDLQRGNR

SEQ ID NO: 13251 - protein, 28 aa, Artificial Sequence
  Description of Artificial Sequence: Synthetic peptide
DEEEIRTTNIVATEQYGSVSTNLQRENC

SEQ ID NO: 13252 - protein, 28 aa, Artificial Sequence
  Description of Artificial Sequence: Synthetic peptide
DEEEIRTTNPVATGQYGSVSTNLQSLNR

SEQ ID NO: 13253 - protein, 29 aa, Artificial Sequence
  Description of Artificial Sequence: Synthetic peptide
DEEEIRTTNPVATEQYGSVSTNWQRGNDQ

SEQ ID NO: 13254 - protein, 28 aa, Artificial Sequence
  Description of Artificial Sequence: Synthetic peptide
DEEEIRTTNPVATEQYGSVSENLQYGNM

SEQ ID NO: 13255 - protein, 29 aa, Artificial Sequence
  Description of Artificial Sequence: Synthetic peptide
DEEEIRTTNPVATEQYGSVSTNLQRVGEK

SEQ ID NO: 13256 - protein, 28 aa, Artificial Sequence
  Description of Artificial Sequence: Synthetic peptide
DEEEIRTTNIVATEQYGSLSTNLQSGNR

SEQ ID NO: 13257 - protein, 28 aa, Artificial Sequence
  Description of Artificial Sequence: Synthetic peptide
DEEEIRTTNPTATEQYGSVSTNPQRGNG

SEQ ID NO: 13258 - protein, 28 aa, Artificial Sequence
  Description of Artificial Sequence: Synthetic peptide
KEEEIRTTNPVATEQYGTVSTNLQRGNQ

SEQ ID NO: 13259 - protein, 28 aa, Artificial Sequence
  Description of Artificial Sequence: Synthetic peptide
SEEEIRCTNPVATEQYGSVSTDLQRGNR

SEQ ID NO: 13260 - protein, 28 aa, Artificial Sequence
  Description of Artificial Sequence: Synthetic peptide
DEEEICTTNIVATEQYGSVSTNLQRGNE

SEQ ID NO: 13261 - protein, 28 aa, Artificial Sequence
  Description of Artificial Sequence: Synthetic peptide
DEAEIRTTNPVATECYGSVSTNLQRGNF

SEQ ID NO: 13262 - protein, 28 aa, Artificial Sequence
  Description of Artificial Sequence: Synthetic peptide
DEEEIRTTNPVATEIYGSVSTNWERGNR

SEQ ID NO: 13263 - protein, 28 aa, Artificial Sequence
  Description of Artificial Sequence: Synthetic peptide
DEGEIRTTNPVATEQYGSVSTNDQRGNF

SEQ ID NO: 13264 - protein, 29 aa, Artificial Sequence
  Description of Artificial Sequence: Synthetic peptide
DEEEIATTNPVATEQYGSVSAENLQRGNR

SEQ ID NO: 13265 - protein, 28 aa, Artificial Sequence
  Description of Artificial Sequence: Synthetic peptide
KEEEIRTTNPVATEQYGSVATNLQAGNR

SEQ ID NO: 13266 - protein, 28 aa, Artificial Sequence
  Description of Artificial Sequence: Synthetic peptide
DEEEIRTTNIVATEQYGSVSTNLQQENR

SEQ ID NO: 13267 - protein, 28 aa, Artificial Sequence
  Description of Artificial Sequence: Synthetic peptide
DESEIRTTNPVATEQYGSVATDLQRGNR

SEQ ID NO: 13268 - protein, 28 aa, Artificial Sequence
  Description of Artificial Sequence: Synthetic peptide
DEEEIRTTNPVATEVYGLVSTNLQRGNA

SEQ ID NO: 13269 - protein, 28 aa, Artificial Sequence
  Description of Artificial Sequence: Synthetic peptide
DEEEIRTTNIVATEQWGSVSTNLQVGNR

SEQ ID NO: 13270 - protein, 28 aa, Artificial Sequence
  Description of Artificial Sequence: Synthetic peptide
DEEEIRTTNPVATEQYGSVSTNPQQENR

SEQ ID NO: 13271 - protein, 28 aa, Artificial Sequence
  Description of Artificial Sequence: Synthetic peptide
DEEEIRTTNIVATEQYGSVSTNLQHGNL

SEQ ID NO: 13272 - protein, 28 aa, Artificial Sequence
  Description of Artificial Sequence: Synthetic peptide
QEEEIRTTNPVATEQYGDVSDNLQRGNR

SEQ ID NO: 13273 - protein, 28 aa, Artificial Sequence
  Description of Artificial Sequence: Synthetic peptide
DEEEIRTTNPVATEQYGSVSTELQGGNL

SEQ ID NO: 13274 - protein, 28 aa, Artificial Sequence
  Description of Artificial Sequence: Synthetic peptide
DEEEIRTTNPVATEQYGTVSTELQMGNR

SEQ ID NO: 13275 - protein, 28 aa, Artificial Sequence
  Description of Artificial Sequence: Synthetic peptide
DEEEIRTTNIVATECYGSVSTNLERGNR

SEQ ID NO: 13276 - protein, 28 aa, Artificial Sequence
  Description of Artificial Sequence: Synthetic peptide
DEEEIRTTNIVATEQYGSVSDNLQRGER

SEQ ID NO: 13277 - protein, 29 aa, Artificial Sequence
  Description of Artificial Sequence: Synthetic peptide
DEEEIRTTNPVATMQYGSVSTNLQRLGNP

SEQ ID NO: 13278 - protein, 28 aa, Artificial Sequence
  Description of Artificial Sequence: Synthetic peptide
DEQEIRTTNPVATEQYGSVSTNLQHGNF

SEQ ID NO: 13279 - protein, 30 aa, Artificial Sequence
  Description of Artificial Sequence: Synthetic polypeptide
DEEEIRTTNPVATEQYGSVSTNNDQIRGNR

SEQ ID NO: 13280 - protein, 28 aa, Artificial Sequence
  Description of Artificial Sequence: Synthetic peptide
AEEEIRSTNPVATEQYGSVSTNLQRGQR

SEQ ID NO: 13281 - protein, 28 aa, Artificial Sequence
  Description of Artificial Sequence: Synthetic peptide
DEEEIATTNPVATEIYGWVSTNLQRGNR

SEQ ID NO: 13282 - protein, 28 aa, Artificial Sequence
  Description of Artificial Sequence: Synthetic peptide
DEEEIRTTNIVATEQYGTVSTNDQRGNR

SEQ ID NO: 13283 - protein, 30 aa, Artificial Sequence
  Description of Artificial Sequence: Synthetic polypeptide
GEEEIRTTNPVATEQYGSVSTMNGLQRGNR

SEQ ID NO: 13284 - protein, 28 aa, Artificial Sequence
  Description of Artificial Sequence: Synthetic peptide
DEEEIAQTNPVATEQYGSVSTNLQRGNQ

SEQ ID NO: 13285 - protein, 29 aa, Artificial Sequence
  Description of Artificial Sequence: Synthetic peptide
DEEEIRTTNPVATEQYGSVSTNLQRKGEH

SEQ ID NO: 13286 - protein, 28 aa, Artificial Sequence
  Description of Artificial Sequence: Synthetic peptide
DEEEIVTTNIVATEQYGSVSTNLQQGNR

SEQ ID NO: 13287 - protein, 28 aa, Artificial Sequence
  Description of Artificial Sequence: Synthetic peptide
DEEEIRTTNPVATEQYGSVSDNLQNGNI

SEQ ID NO: 13288 - protein, 28 aa, Artificial Sequence
  Description of Artificial Sequence: Synthetic peptide
DENEIRTTNPVATEQYGSVSTDLQHGNR

SEQ ID NO: 13289 - protein, 28 aa, Artificial Sequence
  Description of Artificial Sequence: Synthetic peptide
DEEEIRTTNPVATEQYGSVSTGLQRQNM

SEQ ID NO: 13290 - protein, 28 aa, Artificial Sequence
  Description of Artificial Sequence: Synthetic peptide
DEEEIRTTNPVATELYGSVSTNLMRGNM

SEQ ID NO: 13291 - protein, 28 aa, Artificial Sequence
  Description of Artificial Sequence: Synthetic peptide
DEEEIRTTNIVATEQYGSVSTDLQRGTR

SEQ ID NO: 13292 - protein, 29 aa, Artificial Sequence
  Description of Artificial Sequence: Synthetic peptide
DEEEIRTTNPVATEQYGEVSTNEQRGNDR

SEQ ID NO: 13293 - protein, 28 aa, Artificial Sequence
  Description of Artificial Sequence: Synthetic peptide
DEEEIRCTNPVATELYGEVSTNLQRGNR

SEQ ID NO: 13294 - protein, 28 aa, Artificial Sequence
  Description of Artificial Sequence: Synthetic peptide
DEEEIRTVNIVATEQYGSVSTNLQRGNT

SEQ ID NO: 13295 - protein, 28 aa, Artificial Sequence
  Description of Artificial Sequence: Synthetic peptide
DENEIRTTNPVATECYGSVSDNLQRGNR

SEQ ID NO: 13296 - protein, 28 aa, Artificial Sequence
  Description of Artificial Sequence: Synthetic peptide
DEEEIRATNPVATEQYGSVPTNVQRGNR

SEQ ID NO: 13297 - protein, 29 aa, Artificial Sequence
  Description of Artificial Sequence: Synthetic peptide
DEEEIRTTNPVATEQYGSVSTNLQVHGNV

SEQ ID NO: 13298 - protein, 28 aa, Artificial Sequence
  Description of Artificial Sequence: Synthetic peptide
DEEEIRTTNIVATEQYGSVSDNLERGNR

SEQ ID NO: 13299 - protein, 28 aa, Artificial Sequence
  Description of Artificial Sequence: Synthetic peptide
DEEEIRTTNPVATEQYGSVSTNLQNYNV

SEQ ID NO: 13300 - protein, 28 aa, Artificial Sequence
  Description of Artificial Sequence: Synthetic peptide
DEEEIATTNPVATEQYGSASTNLQRGER

SEQ ID NO: 13301 - protein, 29 aa, Artificial Sequence
  Description of Artificial Sequence: Synthetic peptide
DEQEIRTTNPVATEIYGSVSTNLQDRGNR

SEQ ID NO: 13302 - protein, 28 aa, Artificial Sequence
  Description of Artificial Sequence: Synthetic peptide
DEEEIRTTNPVASEQYGSCSTNLQRGNS

SEQ ID NO: 13303 - protein, 29 aa, Artificial Sequence
  Description of Artificial Sequence: Synthetic peptide
DEEEIRTTNPVATELYGSVSTNLQAAGNR

SEQ ID NO: 13304 - protein, 28 aa, Artificial Sequence
  Description of Artificial Sequence: Synthetic peptide
DEEEIRTTNIVATEQYGSVSTNLQTGNL

SEQ ID NO: 13305 - protein, 30 aa, Artificial Sequence
  Description of Artificial Sequence: Synthetic polypeptide
DEEEIRTTNPVATEQYGSVSTNLQLIGDNR

SEQ ID NO: 13306 - protein, 28 aa, Artificial Sequence
  Description of Artificial Sequence: Synthetic peptide
DEEEIRTTNIVSTEQYGSVSTNLQRGNL

SEQ ID NO: 13307 - protein, 28 aa, Artificial Sequence
  Description of Artificial Sequence: Synthetic peptide
DEEEIATTNPVATEVYGSTSTNLQRGNR

SEQ ID NO: 13308 - protein, 28 aa, Artificial Sequence
  Description of Artificial Sequence: Synthetic peptide
DEEEIRTTNIVATEQYGSVSTALQHGNR

SEQ ID NO: 13309 - protein, 28 aa, Artificial Sequence
  Description of Artificial Sequence: Synthetic peptide
DEEEIRTTNPVATEQYGVVSTALQRGNY

SEQ ID NO: 13310 - protein, 28 aa, Artificial Sequence
  Description of Artificial Sequence: Synthetic peptide
DENEIRTTNPVATEQYGSVSTNLQHGNS

SEQ ID NO: 13311 - protein, 29 aa, Artificial Sequence
  Description of Artificial Sequence: Synthetic peptide
DESEIRTTNPVATEQYGSVSTNLQRGNDN

SEQ ID NO: 13312 - protein, 28 aa, Artificial Sequence
  Description of Artificial Sequence: Synthetic peptide
DEQEIRTTNPVATEQYGDVSTNLQRGNA

SEQ ID NO: 13313 - protein, 28 aa, Artificial Sequence
  Description of Artificial Sequence: Synthetic peptide
DENEIATTNPVATEQYGVVSTNLQRGNR

SEQ ID NO: 13314 - protein, 28 aa, Artificial Sequence
  Description of Artificial Sequence: Synthetic peptide
DEEEIRQTNPVATEQYGSVSTNLQNGNT

SEQ ID NO: 13315 - protein, 28 aa, Artificial Sequence
  Description of Artificial Sequence: Synthetic peptide
DEEEISTTNPVATEQYGSVSTNQQRGNF

SEQ ID NO: 13316 - protein, 28 aa, Artificial Sequence
  Description of Artificial Sequence: Synthetic peptide
DEEEIRTTNPVATEQYGSVSTELQTGNQ

SEQ ID NO: 13317 - protein, 28 aa, Artificial Sequence
  Description of Artificial Sequence: Synthetic peptide
DEEEIRTTNIVATEQWGSVSTNLQEGNR

SEQ ID NO: 13318 - protein, 29 aa, Artificial Sequence
  Description of Artificial Sequence: Synthetic peptide
DEEEIRTTNPVATEQYGSVSTNDQRGFNA

SEQ ID NO: 13319 - protein, 28 aa, Artificial Sequence
  Description of Artificial Sequence: Synthetic peptide
DEEEIRTTNIVATEHYGSVSTNLQTGNR

SEQ ID NO: 13320 - protein, 28 aa, Artificial Sequence
  Description of Artificial Sequence: Synthetic peptide
DEEEIRPTNPVATEQYGSVSTNLQHLNR

SEQ ID NO: 13321 - protein, 28 aa, Artificial Sequence
  Description of Artificial Sequence: Synthetic peptide
DEEEIRTTNIVATEQYGSVSTNLQGGNA

SEQ ID NO: 13322 - protein, 28 aa, Artificial Sequence
  Description of Artificial Sequence: Synthetic peptide
DEEEIRTTNPVATEWWGSVSTNLIRGNR

SEQ ID NO: 13323 - protein, 28 aa, Artificial Sequence
  Description of Artificial Sequence: Synthetic peptide
DEQEIRTTNPVATEQYGSVSENEQRGNR

SEQ ID NO: 13324 - protein, 28 aa, Artificial Sequence
  Description of Artificial Sequence: Synthetic peptide
DEEEIRTTNIVATEQYGSVSENLQIGNR

SEQ ID NO: 13325 - protein, 28 aa, Artificial Sequence
  Description of Artificial Sequence: Synthetic peptide
DEEEIRTTNPVATECYGSVSTNLQAGNH

SEQ ID NO: 13326 - protein, 28 aa, Artificial Sequence
  Description of Artificial Sequence: Synthetic peptide
DEEEIRTTNPVATEQYGSVSQDLQRGNP

SEQ ID NO: 13327 - protein, 29 aa, Artificial Sequence
  Description of Artificial Sequence: Synthetic peptide
DEQEIRTTNPVATECYGSVSTNLQRGNDR

SEQ ID NO: 13328 - protein, 28 aa, Artificial Sequence
  Description of Artificial Sequence: Synthetic peptide
DENEIRTTNPVATEQYGSVSTNLQRGED

SEQ ID NO: 13329 - protein, 29 aa, Artificial Sequence
  Description of Artificial Sequence: Synthetic peptide
MEEEIRTTNPVATEQYGSVSTNLQRGNDT

SEQ ID NO: 13330 - protein, 28 aa, Artificial Sequence
  Description of Artificial Sequence: Synthetic peptide
DEEEIRTTNIVATEQYGEVSTNLQNGNR

SEQ ID NO: 13331 - protein, 28 aa, Artificial Sequence
  Description of Artificial Sequence: Synthetic peptide
DEEEIATTNPVATECYGSVSTNPQRGNR

SEQ ID NO: 13332 - protein, 28 aa, Artificial Sequence
  Description of Artificial Sequence: Synthetic peptide
DEEEIRTTNIVATEQYGSVSTNLQSGNT

SEQ ID NO: 13333 - protein, 28 aa, Artificial Sequence
  Description of Artificial Sequence: Synthetic peptide
DEEEIRTTNIVAYEQYGSVSTNLIRGNR

SEQ ID NO: 13334 - protein, 28 aa, Artificial Sequence
  Description of Artificial Sequence: Synthetic peptide
DEEEIRTTNPVATEQYGCVSTNLQQGNH

SEQ ID NO: 13335 - protein, 28 aa, Artificial Sequence
  Description of Artificial Sequence: Synthetic peptide
DEEEIRTTNPVASEQYGSVSTNLEPGNR

SEQ ID NO: 13336 - protein, 28 aa, Artificial Sequence
  Description of Artificial Sequence: Synthetic peptide
DEEEIATTNPVATEQYGSVSTELQRGNF

SEQ ID NO: 13337 - protein, 28 aa, Artificial Sequence
  Description of Artificial Sequence: Synthetic peptide
DENEIRTTNPVATECYGSVSTNLQRGNY

SEQ ID NO: 13338 - protein, 30 aa, Artificial Sequence
  Description of Artificial Sequence: Synthetic polypeptide
DEEEIRCTNPVATEQYGSVSTENLQQRGNR

SEQ ID NO: 13339 - protein, 28 aa, Artificial Sequence
  Description of Artificial Sequence: Synthetic peptide
DEEEIRTTNPVSTEQWGSVSTNLQRGNY

SEQ ID NO: 13340 - protein, 28 aa, Artificial Sequence
  Description of Artificial Sequence: Synthetic peptide
DEEEIRTTNPVATEQYGSVSTNLQQGEY

SEQ ID NO: 13341 - protein, 28 aa, Artificial Sequence
  Description of Artificial Sequence: Synthetic peptide
DEEEIRTTNPTATEQYGSVSTNEQRGNQ

SEQ ID NO: 13342 - protein, 29 aa, Artificial Sequence
  Description of Artificial Sequence: Synthetic peptide
DEEEIRTTNPVATEQYGSCSAENLQRGNR

SEQ ID NO: 13343 - protein, 29 aa, Artificial Sequence
  Description of Artificial Sequence: Synthetic peptide
DEEEIRTTNPVATECYGSVSTNLQREGER

SEQ ID NO: 13344 - protein, 28 aa, Artificial Sequence
  Description of Artificial Sequence: Synthetic peptide
DEQEIRTTNPVATEQYGSVSTNLQRGEL

SEQ ID NO: 13345 - protein, 28 aa, Artificial Sequence
  Description of Artificial Sequence: Synthetic peptide
DEEEIRTTNIDATEQYGSVSTNLQRGNN

SEQ ID NO: 13346 - protein, 28 aa, Artificial Sequence
  Description of Artificial Sequence: Synthetic peptide
DEEEIATTNIVATEQYGSVSTNLQNGNR

SEQ ID NO: 13347 - protein, 28 aa, Artificial Sequence
  Description of Artificial Sequence: Synthetic peptide
DEEEIRTTNIVATEQYGSVSTNLQNGER

SEQ ID NO: 13348 - protein, 28 aa, Artificial Sequence
  Description of Artificial Sequence: Synthetic peptide
DEEEIATTNPAATEQYGSVSTNLQRGNI

SEQ ID NO: 13349 - protein, 28 aa, Artificial Sequence
  Description of Artificial Sequence: Synthetic peptide
DEEEIRATNPVATEQYGSVSTNLQFGER

SEQ ID NO: 13350 - protein, 28 aa, Artificial Sequence
  Description of Artificial Sequence: Synthetic peptide
DEEEIRTTNPVGTEQYGSVSTNLQQGNL

SEQ ID NO: 13351 - protein, 28 aa, Artificial Sequence
  Description of Artificial Sequence: Synthetic peptide
DEEEIRTTNPVASEQYGSVSTNEQRGNF

SEQ ID NO: 13352 - protein, 29 aa, Artificial Sequence
  Description of Artificial Sequence: Synthetic peptide
DEEEIRTTNPVATEIYGCVSATNLQRGNR

SEQ ID NO: 13353 - protein, 28 aa, Artificial Sequence
  Description of Artificial Sequence: Synthetic peptide
DEEEIRTTNIVATEQYGSVSTNLDRGNF

SEQ ID NO: 13354 - protein, 28 aa, Artificial Sequence
  Description of Artificial Sequence: Synthetic peptide
DEEEIRCTNPVATEQYGSVSMNEQRGNR

SEQ ID NO: 13355 - protein, 28 aa, Artificial Sequence
  Description of Artificial Sequence: Synthetic peptide
DEEEIRTTNPVATEQWGSVSTNEQRGNA

SEQ ID NO: 13356 - protein, 28 aa, Artificial Sequence
  Description of Artificial Sequence: Synthetic peptide
SEEEIRTTNPTATEQYGEVSTNLQRGNR

SEQ ID NO: 13357 - protein, 29 aa, Artificial Sequence
  Description of Artificial Sequence: Synthetic peptide
DEEEIRTTNPVATEVYGSVSTNLQQRGNN

SEQ ID NO: 13358 - protein, 28 aa, Artificial Sequence
  Description of Artificial Sequence: Synthetic peptide
DEEEIRTTNIVATEQYGSVATNLQRGND

SEQ ID NO: 13359 - protein, 28 aa, Artificial Sequence
  Description of Artificial Sequence: Synthetic peptide
DEHEIRTTNPVCTEQYGSVSTNLQNGNR

SEQ ID NO: 13360 - protein, 28 aa, Artificial Sequence
  Description of Artificial Sequence: Synthetic peptide
DEDEIRATNPVATEQYGSVSTNLQRGNE

SEQ ID NO: 13361 - protein, 29 aa, Artificial Sequence
  Description of Artificial Sequence: Synthetic peptide
DEEEIRTTNPVATEQYGSVSTNLQMQGNM

SEQ ID NO: 13362 - protein, 28 aa, Artificial Sequence
  Description of Artificial Sequence: Synthetic peptide
DEEEIRTTNPVATEQYGSVSTELQVGNS

SEQ ID NO: 13363 - protein, 28 aa, Artificial Sequence
  Description of Artificial Sequence: Synthetic peptide
DEEEIRTTNIVATEQYGSVSTNLQGGDR

SEQ ID NO: 13364 - protein, 28 aa, Artificial Sequence
  Description of Artificial Sequence: Synthetic peptide
DEEEICCTNPVATEQYGSVSTNLQRGTR

SEQ ID NO: 13365 - protein, 30 aa, Artificial Sequence
  Description of Artificial Sequence: Synthetic polypeptide
DEEEIRTTNPVATEQYGEVSTNLQLREGNR

SEQ ID NO: 13366 - protein, 28 aa, Artificial Sequence
  Description of Artificial Sequence: Synthetic peptide
DEEEIRTTNIVATEQYGSASTNLQRGNM

SEQ ID NO: 13367 - protein, 29 aa, Artificial Sequence
  Description of Artificial Sequence: Synthetic peptide
DEEEIRTTNPVATEQYGSVSDELQRQGNR

SEQ ID NO: 13368 - protein, 28 aa, Artificial Sequence
  Description of Artificial Sequence: Synthetic peptide
DEEEIRTTNIVATEQYGSVSTNLQRGEI

SEQ ID NO: 13369 - protein, 28 aa, Artificial Sequence
  Description of Artificial Sequence: Synthetic peptide
DEEEIRTTNIVATEQYGSVSENLQVGNR

SEQ ID NO: 13370 - protein, 28 aa, Artificial Sequence
  Description of Artificial Sequence: Synthetic peptide
DEEEIRTTNPVATEQYGSVSENLQQGNV

SEQ ID NO: 13371 - protein, 28 aa, Artificial Sequence
  Description of Artificial Sequence: Synthetic peptide
KEEEIRTTNPVATEQYGSVSENLQDGNR

SEQ ID NO: 13372 - protein, 28 aa, Artificial Sequence
  Description of Artificial Sequence: Synthetic peptide
DEEEIRTTNPVATEQYGSVSTNEMRGNA

SEQ ID NO: 13373 - protein, 29 aa, Artificial Sequence
  Description of Artificial Sequence: Synthetic peptide
DEEEIRTTNPVATEQYGSVSATELQRGNH

SEQ ID NO: 13374 - protein, 28 aa, Artificial Sequence
  Description of Artificial Sequence: Synthetic peptide
DEEEIRTTNPVATEQYGSVSENLQYGNS

SEQ ID NO: 13375 - protein, 28 aa, Artificial Sequence
  Description of Artificial Sequence: Synthetic peptide
MEEEIRTTNPVATEQYGSVSTNLQQGNM

SEQ ID NO: 13376 - protein, 28 aa, Artificial Sequence
  Description of Artificial Sequence: Synthetic peptide
DENEIRTTNPVATEQYGDVSTNLQRGND

SEQ ID NO: 13377 - protein, 28 aa, Artificial Sequence
  Description of Artificial Sequence: Synthetic peptide
DEEEIRTTNIVATEQYGCVSTNLQIGNR

SEQ ID NO: 13378 - protein, 28 aa, Artificial Sequence
  Description of Artificial Sequence: Synthetic peptide
DEEEIRTTNIVASEQYGSVSTNLQRGNI

SEQ ID NO: 13379 - protein, 28 aa, Artificial Sequence
  Description of Artificial Sequence: Synthetic peptide
DEEEIATTNIVATEQYGSVSENLQRGNR

SEQ ID NO: 13380 - protein, 28 aa, Artificial Sequence
  Description of Artificial Sequence: Synthetic peptide
DEEEIRTTNPVATEMYGSVSTVLQAGNR

SEQ ID NO: 13381 - protein, 29 aa, Artificial Sequence
  Description of Artificial Sequence: Synthetic peptide
DEEEIRTTNPVATEQYGSYSTNLQRAGNA

SEQ ID NO: 13382 - protein, 28 aa, Artificial Sequence
  Description of Artificial Sequence: Synthetic peptide
DEQEIRSTNPVATEQYGSVSTNLQTGNR

SEQ ID NO: 13383 - protein, 28 aa, Artificial Sequence
  Description of Artificial Sequence: Synthetic peptide
DDEEIRATNPVATEQYGSVSTNLQRGNM

SEQ ID NO: 13384 - protein, 28 aa, Artificial Sequence
  Description of Artificial Sequence: Synthetic peptide
DENEIRTTNPVATEWYGSVSENLQRGNR

SEQ ID NO: 13385 - protein, 28 aa, Artificial Sequence
  Description of Artificial Sequence: Synthetic peptide
DEEEIRTTNPVATEQYGSVSENGQAGNR

SEQ ID NO: 13386 - protein, 28 aa, Artificial Sequence
  Description of Artificial Sequence: Synthetic peptide
DEEEIRTTNIVATEQYGSVSTNLQHGND

SEQ ID NO: 13387 - protein, 28 aa, Artificial Sequence
  Description of Artificial Sequence: Synthetic peptide
NEEEIRTTNPVATEQYGSVDTNLQMGNR

SEQ ID NO: 13388 - protein, 28 aa, Artificial Sequence
  Description of Artificial Sequence: Synthetic peptide
DEEEIRTTNPVATEQYGIVSTNEQLGNR

SEQ ID NO: 13389 - protein, 28 aa, Artificial Sequence
  Description of Artificial Sequence: Synthetic peptide
DEEEIRTTNPCATEQYGSASTNEQRGNR

SEQ ID NO: 13390 - protein, 28 aa, Artificial Sequence
  Description of Artificial Sequence: Synthetic peptide
DEQEIRTTNPVATEQYGSVSTNLQNGNS

SEQ ID NO: 13391 - protein, 28 aa, Artificial Sequence
  Description of Artificial Sequence: Synthetic peptide
MEEEIRTTNPVATEQYGSVSTNQQRGNT

SEQ ID NO: 13392 - protein, 29 aa, Artificial Sequence
  Description of Artificial Sequence: Synthetic peptide
DEEEIRTTNPVATEVYGSVSATVLQRGNR

SEQ ID NO: 13393 - protein, 28 aa, Artificial Sequence
  Description of Artificial Sequence: Synthetic peptide
DEEEIATTNIVATEQYGSVSTNLQRGNI

SEQ ID NO: 13394 - protein, 28 aa, Artificial Sequence
  Description of Artificial Sequence: Synthetic peptide
DEEEIRATNPVATEQYGSVSTNLQQGNS

SEQ ID NO: 13395 - protein, 28 aa, Artificial Sequence
  Description of Artificial Sequence: Synthetic peptide
DEEEIRTTNPVATETYGCVSTALQRGNR

SEQ ID NO: 13396 - protein, 28 aa, Artificial Sequence
  Description of Artificial Sequence: Synthetic peptide
KEEEIRTTNPVATEQYGSVSTNLQSGNS

SEQ ID NO: 13397 - protein, 28 aa, Artificial Sequence
  Description of Artificial Sequence: Synthetic peptide
DEEEIRTTNIVATEQYGCVSTNLQEGNR

SEQ ID NO: 13398 - protein, 28 aa, Artificial Sequence
  Description of Artificial Sequence: Synthetic peptide
DEEEIRTTNIVATEQYGSVSTNLQGGER

SEQ ID NO: 13399 - protein, 28 aa, Artificial Sequence
  Description of Artificial Sequence: Synthetic peptide
DEEEIRTTNIVATEQYGSVSTNLQTGNM

SEQ ID NO: 13400 - protein, 28 aa, Artificial Sequence
  Description of Artificial Sequence: Synthetic peptide
DEEEIRATNPVATEQYGSMSTDLQRGNR

SEQ ID NO: 13401 - protein, 28 aa, Artificial Sequence
  Description of Artificial Sequence: Synthetic peptide
DEQEIRTTNIVATEQYGSVSTNLQRGNS

SEQ ID NO: 13402 - protein, 28 aa, Artificial Sequence
  Description of Artificial Sequence: Synthetic peptide
KEEEIRATNPVATEQYGSVSTNLQRGNN

SEQ ID NO: 13403 - protein, 28 aa, Artificial Sequence
  Description of Artificial Sequence: Synthetic peptide
DEESIRTTNIVATEQYGSVSTNLQRGND

SEQ ID NO: 13404 - protein, 28 aa, Artificial Sequence
  Description of Artificial Sequence: Synthetic peptide
MEEEIRTTNPVATEQYGSVSTDLQRGNH

SEQ ID NO: 13405 - protein, 28 aa, Artificial Sequence
  Description of Artificial Sequence: Synthetic peptide
DEEEIRTTNIVATEQYGSVSTNLQNGNF

SEQ ID NO: 13406 - protein, 28 aa, Artificial Sequence
  Description of Artificial Sequence: Synthetic peptide
DEEEIRTTNPVATEQYGSVSTDLQHGNN

SEQ ID NO: 13407 - protein, 28 aa, Artificial Sequence
  Description of Artificial Sequence: Synthetic peptide
DEEEIRTTNPVATEQYGSASEVLQRGNR

SEQ ID NO: 13408 - protein, 29 aa, Artificial Sequence
  Description of Artificial Sequence: Synthetic peptide
DEEEIRTTNPVATEQYGSVSTDLQVRGNA

SEQ ID NO: 13409 - protein, 30 aa, Artificial Sequence
  Description of Artificial Sequence: Synthetic polypeptide
DEEEIATTNPVATEQYGSVSTNLQRNGENR

SEQ ID NO: 13410 - protein, 29 aa, Artificial Sequence
  Description of Artificial Sequence: Synthetic peptide
DEEEIRATNPVATEQYGSVSTNLQFRLNR

SEQ ID NO: 13411 - protein, 28 aa, Artificial Sequence
  Description of Artificial Sequence: Synthetic peptide
DEEEIRTTNPVATECYGDVSTNLQAGNR

SEQ ID NO: 13412 - protein, 29 aa, Artificial Sequence
  Description of Artificial Sequence: Synthetic peptide
DEEEIRCTNPVATEIYGSVSTNLQERGNR

SEQ ID NO: 13413 - protein, 28 aa, Artificial Sequence
  Description of Artificial Sequence: Synthetic peptide
DEEEIRTTNPVATEQYGSVSENLQTGER

SEQ ID NO: 13414 - protein, 29 aa, Artificial Sequence
  Description of Artificial Sequence: Synthetic peptide
DEEEIRTTNPVATEQWGSVSTNDQNRGNR

SEQ ID NO: 13415 - protein, 28 aa, Artificial Sequence
  Description of Artificial Sequence: Synthetic peptide
DEEEIATTNPVATEQFGSVSTNLQVGNR

SEQ ID NO: 13416 - protein, 28 aa, Artificial Sequence
  Description of Artificial Sequence: Synthetic peptide
GEEEVRTTNPVATEQYGSVSTNLQRGNQ

SEQ ID NO: 13417 - protein, 28 aa, Artificial Sequence
  Description of Artificial Sequence: Synthetic peptide
DEEEIRTTNPVATEQYGSVSTNDARGNT

SEQ ID NO: 13418 - protein, 28 aa, Artificial Sequence
  Description of Artificial Sequence: Synthetic peptide
DEEEIRTTNIVATEQYGSVSTNLQRGEE

SEQ ID NO: 13419 - protein, 28 aa, Artificial Sequence
  Description of Artificial Sequence: Synthetic peptide
DECEIRTTNPVATEQYGLASTNLQRGNR

SEQ ID NO: 13420 - protein, 28 aa, Artificial Sequence
  Description of Artificial Sequence: Synthetic peptide
DEEEIRTTNIVATEQYGSVSTNLELGNR

SEQ ID NO: 13421 - protein, 28 aa, Artificial Sequence
  Description of Artificial Sequence: Synthetic peptide
DEEEIRTTNPVATEQYGVVSTNLQMGER

SEQ ID NO: 13422 - protein, 28 aa, Artificial Sequence
  Description of Artificial Sequence: Synthetic peptide
DEEEIRTTNPVATEQYGEVSTPPQRGNR

SEQ ID NO: 13423 - protein, 29 aa, Artificial Sequence
  Description of Artificial Sequence: Synthetic peptide
DEEEIRTTNPVATEVYGSVSEMNLQRGNR

SEQ ID NO: 13424 - protein, 28 aa, Artificial Sequence
  Description of Artificial Sequence: Synthetic peptide
DTEEIRTTNIVATEQYGSVSTNLQRGNS

SEQ ID NO: 13425 - protein, 28 aa, Artificial Sequence
  Description of Artificial Sequence: Synthetic peptide
DEEEIRTTNPVATEQYGSVSMALQRGNH

SEQ ID NO: 13426 - protein, 28 aa, Artificial Sequence
  Description of Artificial Sequence: Synthetic peptide
DEEEIRTTNPVSTEQYGSVDTNLQAGNR

SEQ ID NO: 13427 - protein, 28 aa, Artificial Sequence
  Description of Artificial Sequence: Synthetic peptide
DEEEIRTTNIEATEQYGSVSTNEQRGNR

SEQ ID NO: 13428 - protein, 28 aa, Artificial Sequence
  Description of Artificial Sequence: Synthetic peptide
DEEEIRCTNPVATEQYGSVSTNLQRGDT

SEQ ID NO: 13429 - protein, 28 aa, Artificial Sequence
  Description of Artificial Sequence: Synthetic peptide
GEEEIRTTNPVATEQYGSMSTNLQGGNR

SEQ ID NO: 13430 - protein, 29 aa, Artificial Sequence
  Description of Artificial Sequence: Synthetic peptide
DEEEIATTNPVATECYGSVSTNLQDRGNR

SEQ ID NO: 13431 - protein, 29 aa, Artificial Sequence
  Description of Artificial Sequence: Synthetic peptide
DEQEIRTTNPVATEQYGSVSETNLQRGER

SEQ ID NO: 13432 - protein, 28 aa, Artificial Sequence
  Description of Artificial Sequence: Synthetic peptide
KEEEIRTTNPVATEQYGSVSTNLQSGNL

SEQ ID NO: 13433 - protein, 28 aa, Artificial Sequence
  Description of Artificial Sequence: Synthetic peptide
DEEEIRSTNPVATEQYGAVSTNLQTGNR

SEQ ID NO: 13434 - protein, 28 aa, Artificial Sequence
  Description of Artificial Sequence: Synthetic peptide
DEEEIRTTNPVATECYGSVSTNLQTGNL

SEQ ID NO: 13435 - protein, 28 aa, Artificial Sequence
  Description of Artificial Sequence: Synthetic peptide
DEEEIRTTNIVATEQYGEVSTELQRGNR

SEQ ID NO: 13436 - protein, 28 aa, Artificial Sequence
  Description of Artificial Sequence: Synthetic peptide
DEEEIRTTNPVATEQYGSVSENLQAGNQ

SEQ ID NO: 13437 - protein, 28 aa, Artificial Sequence
  Description of Artificial Sequence: Synthetic peptide
DEEEIRTTNPVATEQYGSVSTNEQRGTQ

SEQ ID NO: 13438 - protein, 28 aa, Artificial Sequence
  Description of Artificial Sequence: Synthetic peptide
QEEEIRTTNPVATECYGSVSTNLQRGNQ

SEQ ID NO: 13439 - protein, 28 aa, Artificial Sequence
  Description of Artificial Sequence: Synthetic peptide
DEEEIRTTNPVATECYGSVSTNLQNGND

SEQ ID NO: 13440 - protein, 29 aa, Artificial Sequence
  Description of Artificial Sequence: Synthetic peptide
DEEEIRTTNPVATEQYGSVSTTNQQDGNR

SEQ ID NO: 13441 - protein, 28 aa, Artificial Sequence
  Description of Artificial Sequence: Synthetic peptide
DEEEIRTVNIVATEQYGSVSTGLQRGNR

SEQ ID NO: 13442 - protein, 28 aa, Artificial Sequence
  Description of Artificial Sequence: Synthetic peptide
DEEEIVSTNPVATEMYGSVSTNLQRGNR

SEQ ID NO: 13443 - protein, 28 aa, Artificial Sequence
  Description of Artificial Sequence: Synthetic peptide
DEEEIRTTNPVATEQYGSVSTNLQYGDW

SEQ ID NO: 13444 - protein, 28 aa, Artificial Sequence
  Description of Artificial Sequence: Synthetic peptide
DESEIRTTNPVASEQYGSVSTNLQVGNR

SEQ ID NO: 13445 - protein, 28 aa, Artificial Sequence
  Description of Artificial Sequence: Synthetic peptide
DEEEIRTTNPVATEQYGSCSTNLFEGNR

SEQ ID NO: 13446 - protein, 28 aa, Artificial Sequence
  Description of Artificial Sequence: Synthetic peptide
DEEEIRTTNPVATEQYGDVSTNEQNGNR

SEQ ID NO: 13447 - protein, 29 aa, Artificial Sequence
  Description of Artificial Sequence: Synthetic peptide
DEEEIRTTNPVATEQYWSISTNLQRNGNR

SEQ ID NO: 13448 - protein, 28 aa, Artificial Sequence
  Description of Artificial Sequence: Synthetic peptide
DEDEISATNPVATEQYGSVSTNLQRGNR

SEQ ID NO: 13449 - protein, 28 aa, Artificial Sequence
  Description of Artificial Sequence: Synthetic peptide
DEEEIATTNPVATEQYGSVSENLQHGNR

SEQ ID NO: 13450 - protein, 28 aa, Artificial Sequence
  Description of Artificial Sequence: Synthetic peptide
DEEEIVTTNPVATEQYGEVSDNLQRGNR

SEQ ID NO: 13451 - protein, 28 aa, Artificial Sequence
  Description of Artificial Sequence: Synthetic peptide
DEEEIRTTNPVATEQYGSVSTNLANGER

SEQ ID NO: 13452 - protein, 28 aa, Artificial Sequence
  Description of Artificial Sequence: Synthetic peptide
DEEEIRTTNPVATEQYGSVSTNPNRGNG

SEQ ID NO: 13453 - protein, 28 aa, Artificial Sequence
  Description of Artificial Sequence: Synthetic peptide
DEEEIRSTNPVATEQYGSVSTNLQNGNA

SEQ ID NO: 13454 - protein, 28 aa, Artificial Sequence
  Description of Artificial Sequence: Synthetic peptide
AEDEITTTNPVATEQYGSVSTNLQRGNR

SEQ ID NO: 13455 - protein, 28 aa, Artificial Sequence
  Description of Artificial Sequence: Synthetic peptide
DEEEIATTNPVATEQYGSVSTNLQREER

SEQ ID NO: 13456 - protein, 29 aa, Artificial Sequence
  Description of Artificial Sequence: Synthetic peptide
DEEEIRTTNPVATEQYGSVSTEEQRGDNR

SEQ ID NO: 13457 - protein, 28 aa, Artificial Sequence
  Description of Artificial Sequence: Synthetic peptide
DEEEIRCTNPVATEQYGSTSTNLQRGNA

SEQ ID NO: 13458 - protein, 28 aa, Artificial Sequence
  Description of Artificial Sequence: Synthetic peptide
DEEEIRATNPVATEQWGSVSENLQRGNR

SEQ ID NO: 13459 - protein, 28 aa, Artificial Sequence
  Description of Artificial Sequence: Synthetic peptide
DENEIRTTNPVATELYGSVSTNLQRGNF

SEQ ID NO: 13460 - protein, 28 aa, Artificial Sequence
  Description of Artificial Sequence: Synthetic peptide
KENEIRTTNPVATEQYGSVSTNLQRGER

SEQ ID NO: 13461 - protein, 28 aa, Artificial Sequence
  Description of Artificial Sequence: Synthetic peptide
DEDEIATTNPVATEQYGEVSTNLQRGNR

SEQ ID NO: 13462 - protein, 28 aa, Artificial Sequence
  Description of Artificial Sequence: Synthetic peptide
QESEIRTTNPVATEQYGSVSTNLQRGNM

SEQ ID NO: 13463 - protein, 29 aa, Artificial Sequence
  Description of Artificial Sequence: Synthetic peptide
DEEEIRTTNPVATEQYGSVSTNEQEMGNR

SEQ ID NO: 13464 - protein, 28 aa, Artificial Sequence
  Description of Artificial Sequence: Synthetic peptide
DDEEIRTTNPVATETYGSVSMNLQRGNR

SEQ ID NO: 13465 - protein, 28 aa, Artificial Sequence
  Description of Artificial Sequence: Synthetic peptide
DEEEVRTTNPVATEQYGSVSTTLQHGNR

SEQ ID NO: 13466 - protein, 28 aa, Artificial Sequence
  Description of Artificial Sequence: Synthetic peptide
DEEEIRTTNPVATEQYGFVSTNLQRVNS

SEQ ID NO: 13467 - protein, 28 aa, Artificial Sequence
  Description of Artificial Sequence: Synthetic peptide
DEEEIRTVNPVATEQYGSVATNLQRGNQ

SEQ ID NO: 13468 - protein, 28 aa, Artificial Sequence
  Description of Artificial Sequence: Synthetic peptide
QEEEIRTTNPVATEQYGSVSTVLQHGNR

SEQ ID NO: 13469 - protein, 28 aa, Artificial Sequence
  Description of Artificial Sequence: Synthetic peptide
DEEEIRTTNPVSTEQYGSYSTNLQRGNT

SEQ ID NO: 13470 - protein, 28 aa, Artificial Sequence
  Description of Artificial Sequence: Synthetic peptide
AEEEIATTNPVATEQYGDVSTNLQRGNR

SEQ ID NO: 13471 - protein, 29 aa, Artificial Sequence
  Description of Artificial Sequence: Synthetic peptide
DEEEIRTTNPVATEQYGSVSTELQHNGNR

SEQ ID NO: 13472 - protein, 29 aa, Artificial Sequence
  Description of Artificial Sequence: Synthetic peptide
DEEEIRTTNPVATEQYGSVSTNLQQGNTG

SEQ ID NO: 13473 - protein, 28 aa, Artificial Sequence
  Description of Artificial Sequence: Synthetic peptide
DEEEIRTTNPVATEQYGDVSDVLQRGNR

SEQ ID NO: 13474 - protein, 28 aa, Artificial Sequence
  Description of Artificial Sequence: Synthetic peptide
DEEEIRATNPVATEQYGEVSENLQRGNR

SEQ ID NO: 13475 - protein, 28 aa, Artificial Sequence
  Description of Artificial Sequence: Synthetic peptide
DEGEIRTTNPVATEQYGSVSTNIQRGNF

SEQ ID NO: 13476 - protein, 28 aa, Artificial Sequence
  Description of Artificial Sequence: Synthetic peptide
DEEEIRTTNPVATEQYGSVSTDLQAGNQ

SEQ ID NO: 13477 - protein, 29 aa, Artificial Sequence
  Description of Artificial Sequence: Synthetic peptide
DEEEIRTTNPVATEQYGEASTNLQRAGNR

SEQ ID NO: 13478 - protein, 28 aa, Artificial Sequence
  Description of Artificial Sequence: Synthetic peptide
DEEEIRTTNPTATEQYGSVSTNLQQGNS

SEQ ID NO: 13479 - protein, 28 aa, Artificial Sequence
  Description of Artificial Sequence: Synthetic peptide
MEEEIRTTNPVATEQYGSVSTDLQRGNF

SEQ ID NO: 13480 - protein, 29 aa, Artificial Sequence
  Description of Artificial Sequence: Synthetic peptide
DEEEIRTTNPVATEQYGSVSTNLVQNGNQ

SEQ ID NO: 13481 - protein, 28 aa, Artificial Sequence
  Description of Artificial Sequence: Synthetic peptide
DEEEIRTTNPVATEQYGSVSTNLQLGTF

SEQ ID NO: 13482 - protein, 28 aa, Artificial Sequence
  Description of Artificial Sequence: Synthetic peptide
DENEIATTNPVATEQYGSVPTNLQRGNR

SEQ ID NO: 13483 - protein, 28 aa, Artificial Sequence
  Description of Artificial Sequence: Synthetic peptide
DEEEIRTTNPVATEQYGSVSTNPQNGNV

SEQ ID NO: 13484 - protein, 28 aa, Artificial Sequence
  Description of Artificial Sequence: Synthetic peptide
DEMEIRTTNPVATEQYGSVSTAVQRGNR

SEQ ID NO: 13485 - protein, 28 aa, Artificial Sequence
  Description of Artificial Sequence: Synthetic peptide
DEEEIRTTNPVATEQYGSVSEELQRGNN

SEQ ID NO: 13486 - protein, 28 aa, Artificial Sequence
  Description of Artificial Sequence: Synthetic peptide
DEEEIRTTNIVATEQYGSASTNLMRGNR

SEQ ID NO: 13487 - protein, 28 aa, Artificial Sequence
  Description of Artificial Sequence: Synthetic peptide
QEEEICTTNPVATEQYGSVSDNLQRGNR

SEQ ID NO: 13488 - protein, 28 aa, Artificial Sequence
  Description of Artificial Sequence: Synthetic peptide
DEEEIRTTNPTATEQYGSVSTNLQQGNA

SEQ ID NO: 13489 - protein, 30 aa, Artificial Sequence
  Description of Artificial Sequence: Synthetic polypeptide
DEEEIRTTNPVATEQYGSVSTTNPQREGNR

SEQ ID NO: 13490 - protein, 29 aa, Artificial Sequence
  Description of Artificial Sequence: Synthetic peptide
DEEEIRTTNPVATEQYGSVSATNLQSGNS

SEQ ID NO: 13491 - protein, 28 aa, Artificial Sequence
  Description of Artificial Sequence: Synthetic peptide
DEEEIRTTNPVATEQYGSVSTNLELGNA

SEQ ID NO: 13492 - protein, 28 aa, Artificial Sequence
  Description of Artificial Sequence: Synthetic peptide
DEEEIRTTNPFATEQYGSVSTELLRGNR

SEQ ID NO: 13493 - protein, 28 aa, Artificial Sequence
  Description of Artificial Sequence: Synthetic peptide
DEEEIRTTNPCAYEQYGSVSTNLERGNR

SEQ ID NO: 13494 - protein, 28 aa, Artificial Sequence
  Description of Artificial Sequence: Synthetic peptide
DEEEIRTTNPCATEQYGSVSSNLQRGNV

SEQ ID NO: 13495 - protein, 28 aa, Artificial Sequence
  Description of Artificial Sequence: Synthetic peptide
DEEEIRTTNPVATEQYGAVSTNLQMGNL

SEQ ID NO: 13496 - protein, 28 aa, Artificial Sequence
  Description of Artificial Sequence: Synthetic peptide
DEEEIRTTNPVATEMYGSVSENLQRGDR

SEQ ID NO: 13497 - protein, 28 aa, Artificial Sequence
  Description of Artificial Sequence: Synthetic peptide
DEEEIRTTNPVATEQYGSVSTNLERGED

SEQ ID NO: 13498 - protein, 28 aa, Artificial Sequence
  Description of Artificial Sequence: Synthetic peptide
MEEEIRTTNPVATEQYGSVSTNLQNGNF

SEQ ID NO: 13499 - protein, 28 aa, Artificial Sequence
  Description of Artificial Sequence: Synthetic peptide
DEVEIRTTNPVATEQYGSVSTNDQAGNR

SEQ ID NO: 13500 - protein, 28 aa, Artificial Sequence
  Description of Artificial Sequence: Synthetic peptide
DEEEIATTNCVATEQYGSVSENLQRGNR

SEQ ID NO: 13501 - protein, 28 aa, Artificial Sequence
  Description of Artificial Sequence: Synthetic peptide
DEEEIRTTNPVATEQYGSVSTNLEAGNM

SEQ ID NO: 13502 - protein, 29 aa, Artificial Sequence
  Description of Artificial Sequence: Synthetic peptide
DEEEIRTTNPVATEQFGSVSTNLQQGNFR

SEQ ID NO: 13503 - protein, 29 aa, Artificial Sequence
  Description of Artificial Sequence: Synthetic peptide
DEEEIRTTNPVATEQYGSVSTPNLQRGEY

SEQ ID NO: 13504 - protein, 28 aa, Artificial Sequence
  Description of Artificial Sequence: Synthetic peptide
DEEEIRTTNPVATEQWGSVHTNLMRGNR

SEQ ID NO: 13505 - protein, 28 aa, Artificial Sequence
  Description of Artificial Sequence: Synthetic peptide
DEEEIRTTNIVATEQYGLVSTNLQVGNR

SEQ ID NO: 13506 - protein, 28 aa, Artificial Sequence
  Description of Artificial Sequence: Synthetic peptide
DEEEIRTTNPVATEQYGEASTNLQRGNA

SEQ ID NO: 13507 - protein, 28 aa, Artificial Sequence
  Description of Artificial Sequence: Synthetic peptide
DEEEIRTTNPVATECYGSVSTELQRGNN

SEQ ID NO: 13508 - protein, 28 aa, Artificial Sequence
  Description of Artificial Sequence: Synthetic peptide
DEEEIRTTNPDATQQYGSVSTDLQRGNR

SEQ ID NO: 13509 - protein, 28 aa, Artificial Sequence
  Description of Artificial Sequence: Synthetic peptide
DEHEIRTTNPVSTEQYGSVSTNLQLGNR

SEQ ID NO: 13510 - protein, 28 aa, Artificial Sequence
  Description of Artificial Sequence: Synthetic peptide
DEEEIRTTNPVATEQYGSVSTDLQNGNY

SEQ ID NO: 13511 - protein, 28 aa, Artificial Sequence
  Description of Artificial Sequence: Synthetic peptide
DEEEVRCTNPVASEQYGSVSTNLQRGNR

SEQ ID NO: 13512 - protein, 28 aa, Artificial Sequence
  Description of Artificial Sequence: Synthetic peptide
SEEEIATTNPVATEQYGSVSTNLQVGNR

SEQ ID NO: 13513 - protein, 28 aa, Artificial Sequence
  Description of Artificial Sequence: Synthetic peptide
DECEIATTNPVATEQYGSVSTNLQRGNQ

SEQ ID NO: 13514 - protein, 28 aa, Artificial Sequence
  Description of Artificial Sequence: Synthetic peptide
DEEEIRTTNPVATEQYGSVSENLQQGNL

SEQ ID NO: 13515 - protein, 28 aa, Artificial Sequence
  Description of Artificial Sequence: Synthetic peptide
DEEEIRTTNPVAYEQYGMVSTNLQRGNP

SEQ ID NO: 13516 - protein, 28 aa, Artificial Sequence
  Description of Artificial Sequence: Synthetic peptide
DEEEIRTTNPVATQQYGSVHENLQRGNR

SEQ ID NO: 13517 - protein, 28 aa, Artificial Sequence
  Description of Artificial Sequence: Synthetic peptide
DEEEIRTTNPVATEQYGDVSENLQRGNA

SEQ ID NO: 13518 - protein, 28 aa, Artificial Sequence
  Description of Artificial Sequence: Synthetic peptide
KEEEIRTTNPVATEQYGSVSTNPDRGNR

SEQ ID NO: 13519 - protein, 28 aa, Artificial Sequence
  Description of Artificial Sequence: Synthetic peptide
DEEEIRTTNPVATEQYGSVETNEQRGNV

SEQ ID NO: 13520 - protein, 29 aa, Artificial Sequence
  Description of Artificial Sequence: Synthetic peptide
DEEEIRTTNPVATEQYGDVSTNLQQSGNR

SEQ ID NO: 13521 - protein, 28 aa, Artificial Sequence
  Description of Artificial Sequence: Synthetic peptide
DEEEITTTNPVATEQYGSVSTNLQVGNT

SEQ ID NO: 13522 - protein, 28 aa, Artificial Sequence
  Description of Artificial Sequence: Synthetic peptide
DEEEIRTTNPVATEQYGSVHTNLMRGNP

SEQ ID NO: 13523 - protein, 29 aa, Artificial Sequence
  Description of Artificial Sequence: Synthetic peptide
DENEIATTNPVATEQYGSVSTNLQRGNDR

SEQ ID NO: 13524 - protein, 28 aa, Artificial Sequence
  Description of Artificial Sequence: Synthetic peptide
DEEEIRTTNPVATEQYWSVSTGLQRGER

SEQ ID NO: 13525 - protein, 28 aa, Artificial Sequence
  Description of Artificial Sequence: Synthetic peptide
DETEIRTTNPVATEQYGSVSTNEQRGNF

SEQ ID NO: 13526 - protein, 28 aa, Artificial Sequence
  Description of Artificial Sequence: Synthetic peptide
DEEEIRTTNPVATEQYGSVSTELQRGED

SEQ ID NO: 13527 - protein, 28 aa, Artificial Sequence
  Description of Artificial Sequence: Synthetic peptide
DEEETRTTNPVATEQYGSVATNLQRQNR

SEQ ID NO: 13528 - protein, 28 aa, Artificial Sequence
  Description of Artificial Sequence: Synthetic peptide
DEEEIATTNPVATEQYGSVSTNLQDGND

SEQ ID NO: 13529 - protein, 30 aa, Artificial Sequence
  Description of Artificial Sequence: Synthetic polypeptide
DEEEIRTTNPVATEQYGSVNTNLQHRDGNR

SEQ ID NO: 13530 - protein, 28 aa, Artificial Sequence
  Description of Artificial Sequence: Synthetic peptide
DEEEIRTTNPVATECYGSVSDNLQYGNR

SEQ ID NO: 13531 - protein, 28 aa, Artificial Sequence
  Description of Artificial Sequence: Synthetic peptide
DENEISTTNIVATEQYGSVSTNLQRGNR

SEQ ID NO: 13532 - protein, 28 aa, Artificial Sequence
  Description of Artificial Sequence: Synthetic peptide
DEEEIRTTNPVATHQYGSVSTNLIRYNR

SEQ ID NO: 13533 - protein, 28 aa, Artificial Sequence
  Description of Artificial Sequence: Synthetic peptide
DEQEIRTTNPVATEQYGSVSTNLQHGNQ

SEQ ID NO: 13534 - protein, 29 aa, Artificial Sequence
  Description of Artificial Sequence: Synthetic peptide
DEEEIRTTNPVATEQYGVVSTNLQRGPTR

SEQ ID NO: 13535 - protein, 28 aa, Artificial Sequence
  Description of Artificial Sequence: Synthetic peptide
DEEEIRATNIVATEQYGSVSNNLQRGNR

SEQ ID NO: 13536 - protein, 28 aa, Artificial Sequence
  Description of Artificial Sequence: Synthetic peptide
DEEEIRTTNPVSTEQWGSVSENLQRGNR

SEQ ID NO: 13537 - protein, 29 aa, Artificial Sequence
  Description of Artificial Sequence: Synthetic peptide
DEEEIRTTNPVATETYGSVSTNLQRGVNF

SEQ ID NO: 13538 - protein, 28 aa, Artificial Sequence
  Description of Artificial Sequence: Synthetic peptide
DEEEIRTTNPVATEQYGDVSENLQRGQR

SEQ ID NO: 13539 - protein, 31 aa, Artificial Sequence
  Description of Artificial Sequence: Synthetic polypeptide
DEEEIRTTNPVATEQYGSVSTNLQRKGENDR

SEQ ID NO: 13540 - protein, 28 aa, Artificial Sequence
  Description of Artificial Sequence: Synthetic peptide
DEEEIWTTNPVATEQYGSVSDNLQRGNL

SEQ ID NO: 13541 - protein, 28 aa, Artificial Sequence
  Description of Artificial Sequence: Synthetic peptide
DEVEIRTTNPVATELYGSVSTNLQTGNR

SEQ ID NO: 13542 - protein, 28 aa, Artificial Sequence
  Description of Artificial Sequence: Synthetic peptide
DEEEIRTTNIVATFQYGSVSTNLQRGND

SEQ ID NO: 13543 - protein, 28 aa, Artificial Sequence
  Description of Artificial Sequence: Synthetic peptide
DEEEIRTTNPVATEQYGSVSTNPQHGNI

SEQ ID NO: 13544 - protein, 29 aa, Artificial Sequence
  Description of Artificial Sequence: Synthetic peptide
DEEEIRTTNPVATECYGSVSTNLQRGNDV

SEQ ID NO: 13545 - protein, 29 aa, Artificial Sequence
  Description of Artificial Sequence: Synthetic peptide
DEEEIRTTNPVATEQYGSVSTNEQREGNV

SEQ ID NO: 13546 - protein, 28 aa, Artificial Sequence
  Description of Artificial Sequence: Synthetic peptide
DEEEIRCTNPVATEQYGQVSENLQRGNR

SEQ ID NO: 13547 - protein, 30 aa, Artificial Sequence
  Description of Artificial Sequence: Synthetic polypeptide
DEEEIRTTNPVATEQYGSVSCSNLQCRGNR

SEQ ID NO: 13548 - protein, 29 aa, Artificial Sequence
  Description of Artificial Sequence: Synthetic peptide
DEEEIRTTNPSATEQYGSVSCTNYQRGNR

SEQ ID NO: 13549 - protein, 28 aa, Artificial Sequence
  Description of Artificial Sequence: Synthetic peptide
DEEEIRCTNIVATEQFGSVSTNLQRGNR

SEQ ID NO: 13550 - protein, 28 aa, Artificial Sequence
  Description of Artificial Sequence: Synthetic peptide
DEEEIRTTNPVATEQYGSVAENLQDGNR

SEQ ID NO: 13551 - protein, 28 aa, Artificial Sequence
  Description of Artificial Sequence: Synthetic peptide
DEEEIRTTNPVATECYGSVSTNLQVGNA

SEQ ID NO: 13552 - protein, 28 aa, Artificial Sequence
  Description of Artificial Sequence: Synthetic peptide
SEEEIRATNPVATEQYGSVSTNLQRGNQ

SEQ ID NO: 13553 - protein, 28 aa, Artificial Sequence
  Description of Artificial Sequence: Synthetic peptide
DEEEIYTTNPVATEQYGSVSTNLQDGNE

SEQ ID NO: 13554 - protein, 28 aa, Artificial Sequence
  Description of Artificial Sequence: Synthetic peptide
DEEEIRTTNPVATEQYGGVSENLQRTNR

SEQ ID NO: 13555 - protein, 28 aa, Artificial Sequence
  Description of Artificial Sequence: Synthetic peptide
DEEEICTTNPVATEPYGSVSTNLQRGNF

SEQ ID NO: 13556 - protein, 30 aa, Artificial Sequence
  Description of Artificial Sequence: Synthetic polypeptide
DEEEIRTTNPVATEQYGSVSTNLQVRDGDR

SEQ ID NO: 13557 - protein, 30 aa, Artificial Sequence
  Description of Artificial Sequence: Synthetic polypeptide
DEEEIRTTNPVATEQYGSVSTYNLQIRGNA

SEQ ID NO: 13558 - protein, 28 aa, Artificial Sequence
  Description of Artificial Sequence: Synthetic peptide
DEEEIRTTNPVATEQYGEVSDNLQHGNR

SEQ ID NO: 13559 - protein, 28 aa, Artificial Sequence
  Description of Artificial Sequence: Synthetic peptide
DEQEIATTNPVATEQYGSVSNNLQRGNR

SEQ ID NO: 13560 - protein, 28 aa, Artificial Sequence
  Description of Artificial Sequence: Synthetic peptide
DEHEIRTTNPVATEQYGSVSDNLQRGNQ

SEQ ID NO: 13561 - protein, 30 aa, Artificial Sequence
  Description of Artificial Sequence: Synthetic polypeptide
DEEEIRTTNPVATEQYGDVSTNLQARGENR

SEQ ID NO: 13562 - protein, 28 aa, Artificial Sequence
  Description of Artificial Sequence: Synthetic peptide
DEEEIRTTNPVATEQYGSVSTNLQAGEM

SEQ ID NO: 13563 - protein, 28 aa, Artificial Sequence
  Description of Artificial Sequence: Synthetic peptide
DEEEIRTTNPVATEQYGVVSTNLQRGDA

SEQ ID NO: 13564 - protein, 28 aa, Artificial Sequence
  Description of Artificial Sequence: Synthetic peptide
DEQEIVTTNPVATEQYGEVSTNLQRGNR

SEQ ID NO: 13565 - protein, 28 aa, Artificial Sequence
  Description of Artificial Sequence: Synthetic peptide
DEEEIRTTNPVATEQYGSVSTDLQSGNL

SEQ ID NO: 13566 - protein, 28 aa, Artificial Sequence
  Description of Artificial Sequence: Synthetic peptide
DEEEIRTTNPVATEQYGSASTNLQHGNI

SEQ ID NO: 13567 - protein, 28 aa, Artificial Sequence
  Description of Artificial Sequence: Synthetic peptide
DEEEITTTNPVATETYGSVSTNLQQGNR

SEQ ID NO: 13568 - protein, 29 aa, Artificial Sequence
  Description of Artificial Sequence: Synthetic peptide
DEEEIRTTNPVATEQYGSVSTNLQNIGNF

SEQ ID NO: 13569 - protein, 28 aa, Artificial Sequence
  Description of Artificial Sequence: Synthetic peptide
DEEEIRTTNPVATEQYGVVSENLQYGNR

SEQ ID NO: 13570 - protein, 31 aa, Artificial Sequence
  Description of Artificial Sequence: Synthetic polypeptide
DEEEIRTTNPVATEQYGCSVDSTNLQRGVNR

SEQ ID NO: 13571 - protein, 28 aa, Artificial Sequence
  Description of Artificial Sequence: Synthetic peptide
DEEEIRTTNPVATEQYGDVSTNLMQGNR

SEQ ID NO: 13572 - protein, 28 aa, Artificial Sequence
  Description of Artificial Sequence: Synthetic peptide
DEAEIATTNPVATEQYGSVSTNLQRGNY

SEQ ID NO: 13573 - protein, 29 aa, Artificial Sequence
  Description of Artificial Sequence: Synthetic peptide
DENEIRTTNPVATEQYGSVSENLQCRGNR

SEQ ID NO: 13574 - protein, 28 aa, Artificial Sequence
  Description of Artificial Sequence: Synthetic peptide
DEEEIRTTNPVATEQYGSVACNLQRGGR

SEQ ID NO: 13575 - protein, 28 aa, Artificial Sequence
  Description of Artificial Sequence: Synthetic peptide
DEEEIRTTNPVATECYGSVSTNLQDGNQ

SEQ ID NO: 13576 - protein, 28 aa, Artificial Sequence
  Description of Artificial Sequence: Synthetic peptide
DEEEIRTTNPVATEQYGSVSTNGQRGES

SEQ ID NO: 13577 - protein, 28 aa, Artificial Sequence
  Description of Artificial Sequence: Synthetic peptide
DEEEIRTTNPVATECYGIVSTNLQQGNR

SEQ ID NO: 13578 - protein, 28 aa, Artificial Sequence
  Description of Artificial Sequence: Synthetic peptide
MEEEIATTNPVATEQYGSVSTNLQRGNN

SEQ ID NO: 13579 - protein, 28 aa, Artificial Sequence
  Description of Artificial Sequence: Synthetic peptide
DEEEIRTTNPVATEQYGSVHTNLIRGNP

SEQ ID NO: 13580 - protein, 28 aa, Artificial Sequence
  Description of Artificial Sequence: Synthetic peptide
DEQEIRTTNPVATEQYGSVSTDLQRGER

SEQ ID NO: 13581 - protein, 29 aa, Artificial Sequence
  Description of Artificial Sequence: Synthetic peptide
DEEEIVTTNPVATEQYGSVSTNLQIKGNR

SEQ ID NO: 13582 - protein, 30 aa, Artificial Sequence
  Description of Artificial Sequence: Synthetic polypeptide
DEEEIRTTNPVATEQYGSVASTNLDLRGNR

SEQ ID NO: 13583 - protein, 28 aa, Artificial Sequence
  Description of Artificial Sequence: Synthetic peptide
DEEEIRTTNPVATEQYGSVSENLQYGDR

SEQ ID NO: 13584 - protein, 28 aa, Artificial Sequence
  Description of Artificial Sequence: Synthetic peptide
DEEEIATTNPVSTEQYGEVSTNLQRGNR

SEQ ID NO: 13585 - protein, 28 aa, Artificial Sequence
  Description of Artificial Sequence: Synthetic peptide
DEEEIRTTNPVATECYGSVSTNLQYGNA

SEQ ID NO: 13586 - protein, 28 aa, Artificial Sequence
  Description of Artificial Sequence: Synthetic peptide
DEEEICTTNPVATEQYGSVSENLQRGNA

SEQ ID NO: 13587 - protein, 28 aa, Artificial Sequence
  Description of Artificial Sequence: Synthetic peptide
DEEEIATTNPVATEIYGTVSTNLQRGNR

SEQ ID NO: 13588 - protein, 28 aa, Artificial Sequence
  Description of Artificial Sequence: Synthetic peptide
DEEEIRTTNPVATEQYGSVSTELQRGEF

SEQ ID NO: 13589 - protein, 28 aa, Artificial Sequence
  Description of Artificial Sequence: Synthetic peptide
DEEEIRTTNPVSTECYGSVSTELQRGNR

SEQ ID NO: 13590 - protein, 28 aa, Artificial Sequence
  Description of Artificial Sequence: Synthetic peptide
DEEEIATTNPVATEQYGEVSDNLQRGNR

SEQ ID NO: 13591 - protein, 28 aa, Artificial Sequence
  Description of Artificial Sequence: Synthetic peptide
DEEEIRTTNPVATENYGEVSTNCQRGNR

SEQ ID NO: 13592 - protein, 28 aa, Artificial Sequence
  Description of Artificial Sequence: Synthetic peptide
DEEEIRTTNPVATEQYGEVSENLQRGDR

SEQ ID NO: 13593 - protein, 28 aa, Artificial Sequence
  Description of Artificial Sequence: Synthetic peptide
DEEEIVTTNPVATEQYGSVSTNLQNGNG

SEQ ID NO: 13594 - protein, 28 aa, Artificial Sequence
  Description of Artificial Sequence: Synthetic peptide
DEEEIRTTNPVATEQYGDVSTNLQRGEK

SEQ ID NO: 13595 - protein, 28 aa, Artificial Sequence
  Description of Artificial Sequence: Synthetic peptide
DEEEIRPTNPVATEQYGSWSTNLQRGND

SEQ ID NO: 13596 - protein, 28 aa, Artificial Sequence
  Description of Artificial Sequence: Synthetic peptide
DEEEIRTTNPVATECYGSVSTNLMRGNA

SEQ ID NO: 13597 - protein, 28 aa, Artificial Sequence
  Description of Artificial Sequence: Synthetic peptide
DESEIRTTNPLATEQYGSVSTNLQTGNR

SEQ ID NO: 13598 - protein, 28 aa, Artificial Sequence
  Description of Artificial Sequence: Synthetic peptide
DEEEIRTTNIVATEQYLSVSTNLQRGNN

SEQ ID NO: 13599 - protein, 28 aa, Artificial Sequence
  Description of Artificial Sequence: Synthetic peptide
DEVEIRTTNIDATEQYGSVSTNLQRGNR

SEQ ID NO: 13600 - protein, 28 aa, Artificial Sequence
  Description of Artificial Sequence: Synthetic peptide
DEEEIRTTNPVATEQYGSVSNNGQRGDR

SEQ ID NO: 13601 - protein, 28 aa, Artificial Sequence
  Description of Artificial Sequence: Synthetic peptide
DEEEIRTVNPVATEQYGSVSTGLQRGNM

SEQ ID NO: 13602 - protein, 28 aa, Artificial Sequence
  Description of Artificial Sequence: Synthetic peptide
DEEEIATTNPVATEQYGSVSTNLQNGDR

SEQ ID NO: 13603 - protein, 28 aa, Artificial Sequence
  Description of Artificial Sequence: Synthetic peptide
DENEIATTNPVATEQYGSVSTNLQRGER

SEQ ID NO: 13604 - protein, 28 aa, Artificial Sequence
  Description of Artificial Sequence: Synthetic peptide
DEEEIRTTNPVATETYGTVSDNLQRGNR

SEQ ID NO: 13605 - protein, 29 aa, Artificial Sequence
  Description of Artificial Sequence: Synthetic peptide
DEEEIRTTNPVATEQYGSVSTNLQRGDDM

SEQ ID NO: 13606 - protein, 28 aa, Artificial Sequence
  Description of Artificial Sequence: Synthetic peptide
DEQEIRTTNPVATEQYGSVSTNLQHGER

SEQ ID NO: 13607 - protein, 30 aa, Artificial Sequence
  Description of Artificial Sequence: Synthetic polypeptide
DEEEIRTTNPVATEQYGSVSTNLQDRGEDR

SEQ ID NO: 13608 - protein, 28 aa, Artificial Sequence
  Description of Artificial Sequence: Synthetic peptide
DEEEIRTTNPVATEQYGTVSDNLQRLNR

SEQ ID NO: 13609 - protein, 28 aa, Artificial Sequence
  Description of Artificial Sequence: Synthetic peptide
DEQEIATTNPVATEQYGSVSTDLQRGNR

SEQ ID NO: 13610 - protein, 30 aa, Artificial Sequence
  Description of Artificial Sequence: Synthetic polypeptide
DEEEIRTTNPVATEQYGSASTNLQNRGPNR

SEQ ID NO: 13611 - protein, 28 aa, Artificial Sequence
  Description of Artificial Sequence: Synthetic peptide
DEQEIRTTNPVATQQYGSVSTNEQRGNR

SEQ ID NO: 13612 - protein, 28 aa, Artificial Sequence
  Description of Artificial Sequence: Synthetic peptide
DEEEIRCTNPVATEQWGSVSTNLQRGTR

SEQ ID NO: 13613 - protein, 28 aa, Artificial Sequence
  Description of Artificial Sequence: Synthetic peptide
SEEEIRTTNIVATEQYGSVSTALQRGNR

SEQ ID NO: 13614 - protein, 28 aa, Artificial Sequence
  Description of Artificial Sequence: Synthetic peptide
DEDEIRTTNPVSTEQYGSVSTNLQRGNI

SEQ ID NO: 13615 - protein, 28 aa, Artificial Sequence
  Description of Artificial Sequence: Synthetic peptide
DEEEIRTTNPVATEQYGSVSELLQAGNR

SEQ ID NO: 13616 - protein, 28 aa, Artificial Sequence
  Description of Artificial Sequence: Synthetic peptide
DEEEIRTTNPVATEQYGWVSENLQMGNR

SEQ ID NO: 13617 - protein, 28 aa, Artificial Sequence
  Description of Artificial Sequence: Synthetic peptide
DEQEIRATNPVATEIYGSVSTNLQRGNR

SEQ ID NO: 13618 - protein, 28 aa, Artificial Sequence
  Description of Artificial Sequence: Synthetic peptide
DEEEIRTTNPVATEQYGSVSTELQYGNY

SEQ ID NO: 13619 - protein, 28 aa, Artificial Sequence
  Description of Artificial Sequence: Synthetic peptide
DEEEICTTNPVATEQYGEVSTNLQRGPR

SEQ ID NO: 13620 - protein, 28 aa, Artificial Sequence
  Description of Artificial Sequence: Synthetic peptide
DENEIATTNPVATEQYGSVSTNLQRGNA

SEQ ID NO: 13621 - protein, 28 aa, Artificial Sequence
  Description of Artificial Sequence: Synthetic peptide
DEEEIRTTNPVCTEQYGEVSTNLQRGER

SEQ ID NO: 13622 - protein, 28 aa, Artificial Sequence
  Description of Artificial Sequence: Synthetic peptide
SEEEIRTTNPVATEQYGSVSTNLQHGTR

SEQ ID NO: 13623 - protein, 28 aa, Artificial Sequence
  Description of Artificial Sequence: Synthetic peptide
DEEEIRTTNPVATEQYGHVSTNLQVGNE

SEQ ID NO: 13624 - protein, 29 aa, Artificial Sequence
  Description of Artificial Sequence: Synthetic peptide
DEECIRTTNPVATEQYGSSVSTLLQRGNR

SEQ ID NO: 13625 - protein, 28 aa, Artificial Sequence
  Description of Artificial Sequence: Synthetic peptide
DEQEIRCTNPVATETYGSVSTNLQRGNR

SEQ ID NO: 13626 - protein, 28 aa, Artificial Sequence
  Description of Artificial Sequence: Synthetic peptide
YEEEIATTNPVATEQYGSVSTNLQHGNR

SEQ ID NO: 13627 - protein, 28 aa, Artificial Sequence
  Description of Artificial Sequence: Synthetic peptide
YEEEIRTTNPVGTEQYGSVSTNLQNGNR

SEQ ID NO: 13628 - protein, 28 aa, Artificial Sequence
  Description of Artificial Sequence: Synthetic peptide
DEEEIRTTNPVATEQWGSVSENLMRGNR

SEQ ID NO: 13629 - protein, 28 aa, Artificial Sequence
  Description of Artificial Sequence: Synthetic peptide
DEEEIRTTNPVATEQYGSVSEVLQHGNR

SEQ ID NO: 13630 - protein, 28 aa, Artificial Sequence
  Description of Artificial Sequence: Synthetic peptide
DEEEIRTTNPVATEWWGSVSENLQRGNR

SEQ ID NO: 13631 - protein, 28 aa, Artificial Sequence
  Description of Artificial Sequence: Synthetic peptide
DEEEIRTTNPVATECYGSVSTNLQRGDH

SEQ ID NO: 13632 - protein, 29 aa, Artificial Sequence
  Description of Artificial Sequence: Synthetic peptide
DEEEIRTTNPVATEQYGSVSTMNLQNGNI

SEQ ID NO: 13633 - protein, 28 aa, Artificial Sequence
  Description of Artificial Sequence: Synthetic peptide
DEEEIRTTNPEATEQYGSVSTNLFRGNG

SEQ ID NO: 13634 - protein, 30 aa, Artificial Sequence
  Description of Artificial Sequence: Synthetic polypeptide
DEEEIRTTNPVATEQYGSVSATNLQVNGNR

SEQ ID NO: 13635 - protein, 28 aa, Artificial Sequence
  Description of Artificial Sequence: Synthetic peptide
DEEEIRTTNPVATETFGSVSTNLQRGNI

SEQ ID NO: 13636 - protein, 28 aa, Artificial Sequence
  Description of Artificial Sequence: Synthetic peptide
DEEEIRTTNPVATEQYGSASENLQRDNR

SEQ ID NO: 13637 - protein, 28 aa, Artificial Sequence
  Description of Artificial Sequence: Synthetic peptide
KEEEIRTTNPVATEQYGSVSTNLQGGNM

SEQ ID NO: 13638 - protein, 28 aa, Artificial Sequence
  Description of Artificial Sequence: Synthetic peptide
DEEEIRTTNPVATETYGSVSDNLQSGNR

SEQ ID NO: 13639 - protein, 30 aa, Artificial Sequence
  Description of Artificial Sequence: Synthetic polypeptide
DEEEIRTTNPVATEQYGSVSTNGLQNGNDR

SEQ ID NO: 13640 - protein, 28 aa, Artificial Sequence
  Description of Artificial Sequence: Synthetic peptide
DEEEIRTTNPVAVEGYGSVSTNLQRGTR

SEQ ID NO: 13641 - protein, 28 aa, Artificial Sequence
  Description of Artificial Sequence: Synthetic peptide
DEEEVRTTNPVATEQYGSVSTNLQRLNL

SEQ ID NO: 13642 - protein, 29 aa, Artificial Sequence
  Description of Artificial Sequence: Synthetic peptide
DEEEIRTTNPVATEQYGYVSTNHQRMGNR

SEQ ID NO: 13643 - protein, 29 aa, Artificial Sequence
  Description of Artificial Sequence: Synthetic peptide
DEEEIRTTNPVATEQYGAVSNNLQRAGNR

SEQ ID NO: 13644 - protein, 28 aa, Artificial Sequence
  Description of Artificial Sequence: Synthetic peptide
DEEEIRTTNPVATEQYGSVSTNLQQGGF

SEQ ID NO: 13645 - protein, 28 aa, Artificial Sequence
  Description of Artificial Sequence: Synthetic peptide
DEEEIRTTNPVATEQWGSVSTNLQGGNF

SEQ ID NO: 13646 - protein, 28 aa, Artificial Sequence
  Description of Artificial Sequence: Synthetic peptide
GESEIRTTNPVATEQYGAVSTNLQRGNR

SEQ ID NO: 13647 - protein, 28 aa, Artificial Sequence
  Description of Artificial Sequence: Synthetic peptide
DEEEIRTTNPVATEQYGSVASNLQRGER

SEQ ID NO: 13648 - protein, 30 aa, Artificial Sequence
  Description of Artificial Sequence: Synthetic polypeptide
DEEEIRTTNPVATEQYGSVSTGLPQRGENR

SEQ ID NO: 13649 - protein, 28 aa, Artificial Sequence
  Description of Artificial Sequence: Synthetic peptide
DEEEIRTTNPVATECYGSVSENLQHGNR

SEQ ID NO: 13650 - protein, 28 aa, Artificial Sequence
  Description of Artificial Sequence: Synthetic peptide
DEEEIRTTNPVSTEQYGEVSTNWQRGNR

SEQ ID NO: 13651 - protein, 28 aa, Artificial Sequence
  Description of Artificial Sequence: Synthetic peptide
DEEEIRTTNPVATEQYGSCSTQLQNGNR

SEQ ID NO: 13652 - protein, 28 aa, Artificial Sequence
  Description of Artificial Sequence: Synthetic peptide
DEEEIATTNPVATEQYGIVSTNLQRGTR

SEQ ID NO: 13653 - protein, 28 aa, Artificial Sequence
  Description of Artificial Sequence: Synthetic peptide
DEEEIRCTNPVATEQYGSVSDNLQRGNS

SEQ ID NO: 13654 - protein, 29 aa, Artificial Sequence
  Description of Artificial Sequence: Synthetic peptide
DEEEIRTTNPVATEQYGESVSTDLQRGNF

SEQ ID NO: 13655 - protein, 29 aa, Artificial Sequence
  Description of Artificial Sequence: Synthetic peptide
DEEEIRTTNPVATEQYGSVSANLQRGINA

SEQ ID NO: 13656 - protein, 28 aa, Artificial Sequence
  Description of Artificial Sequence: Synthetic peptide
DEEEIRTVNPVATEQYGEVSTNLQVGNR

SEQ ID NO: 13657 - protein, 28 aa, Artificial Sequence
  Description of Artificial Sequence: Synthetic peptide
DEEEIRTTNPVATEQYGSVSTELQNGNN

SEQ ID NO: 13658 - protein, 30 aa, Artificial Sequence
  Description of Artificial Sequence: Synthetic polypeptide
DEQEIRTTNPVATEQYGSVSTMNLQRGNDR

SEQ ID NO: 13659 - protein, 28 aa, Artificial Sequence
  Description of Artificial Sequence: Synthetic peptide
DEEEIRSTNPVATESYGSVSTVLQRGNR

SEQ ID NO: 13660 - protein, 28 aa, Artificial Sequence
  Description of Artificial Sequence: Synthetic peptide
DEEEIRTTNPVATEQYGDVSTNLQRGGA

SEQ ID NO: 13661 - protein, 28 aa, Artificial Sequence
  Description of Artificial Sequence: Synthetic peptide
TEEEIRTTNPVATHQYGSVSTNLQIGNR

SEQ ID NO: 13662 - protein, 29 aa, Artificial Sequence
  Description of Artificial Sequence: Synthetic peptide
DEEEIRTTNPVATEQYGSVSTNLCDRGNC

SEQ ID NO: 13663 - protein, 28 aa, Artificial Sequence
  Description of Artificial Sequence: Synthetic peptide
QEEEIRTTNPVSTEQYGEVSTNLQRGNR

SEQ ID NO: 13664 - protein, 28 aa, Artificial Sequence
  Description of Artificial Sequence: Synthetic peptide
DEEEIRTTNPVATEQYGSVSTNLEVGNW

SEQ ID NO: 13665 - protein, 29 aa, Artificial Sequence
  Description of Artificial Sequence: Synthetic peptide
DEEEIRTVNPVATEQYGSVSTNLQHAGNR

SEQ ID NO: 13666 - protein, 28 aa, Artificial Sequence
  Description of Artificial Sequence: Synthetic peptide
DEEEIRTTNPVATEMYGSVSENLQRGNT

SEQ ID NO: 13667 - protein, 28 aa, Artificial Sequence
  Description of Artificial Sequence: Synthetic peptide
DEEEIRTTNPVATEQYGSVSTELQLGNE

SEQ ID NO: 13668 - protein, 28 aa, Artificial Sequence
  Description of Artificial Sequence: Synthetic peptide
DESEIRATNPVASEQYGSVSTNLQRGNR

SEQ ID NO: 13669 - protein, 28 aa, Artificial Sequence
  Description of Artificial Sequence: Synthetic peptide
DEEEIRTTNPVATECYGSVSTNLMQGNR

SEQ ID NO: 13670 - protein, 28 aa, Artificial Sequence
  Description of Artificial Sequence: Synthetic peptide
DEEEIRTTNPVATEQYGSVSTALERGER

SEQ ID NO: 13671 - protein, 28 aa, Artificial Sequence
  Description of Artificial Sequence: Synthetic peptide
DEEEIRTTNPVATEQYGSVSTNLQSGEL

SEQ ID NO: 13672 - protein, 29 aa, Artificial Sequence
  Description of Artificial Sequence: Synthetic peptide
DEEEIRTTNPVATEQYGSVSENLQHAGNR

SEQ ID NO: 13673 - protein, 28 aa, Artificial Sequence
  Description of Artificial Sequence: Synthetic peptide
DEEEIRTTNPVATEQYGSVATNLQYGER

SEQ ID NO: 13674 - protein, 29 aa, Artificial Sequence
  Description of Artificial Sequence: Synthetic peptide
DEEEIRTTNPVATEQYGSVSTNLEREGNF

SEQ ID NO: 13675 - protein, 28 aa, Artificial Sequence
  Description of Artificial Sequence: Synthetic peptide
DEEEIRTTNPVATEQWGSVSENLQRGNM

SEQ ID NO: 13676 - protein, 28 aa, Artificial Sequence
  Description of Artificial Sequence: Synthetic peptide
DEEEIRTTNPTATEQYGSVSTNPQRGNS

SEQ ID NO: 13677 - protein, 28 aa, Artificial Sequence
  Description of Artificial Sequence: Synthetic peptide
DEQEISTTNPVATEQYGGVSTNLQRGNR

SEQ ID NO: 13678 - protein, 28 aa, Artificial Sequence
  Description of Artificial Sequence: Synthetic peptide
AEEEIRATNPVATEQYGSVSTNLQHGNR

SEQ ID NO: 13679 - protein, 28 aa, Artificial Sequence
  Description of Artificial Sequence: Synthetic peptide
DEEEIRTTNPVATEVYGSVSENLQRGMR

SEQ ID NO: 13680 - protein, 28 aa, Artificial Sequence
  Description of Artificial Sequence: Synthetic peptide
DEEEIRTTNPVATEQYGSVSTNLQYGEM

SEQ ID NO: 13681 - protein, 28 aa, Artificial Sequence
  Description of Artificial Sequence: Synthetic peptide
DEDEIRTTNPVATEQYGSVSTNLQVGNW

SEQ ID NO: 13682 - protein, 28 aa, Artificial Sequence
  Description of Artificial Sequence: Synthetic peptide
DEEEIRTTNPVATEQYGEVGTVLQRGNR

SEQ ID NO: 13683 - protein, 28 aa, Artificial Sequence
  Description of Artificial Sequence: Synthetic peptide
MEEEIVTTNPVATEQYGEVSTNLQRGNR

SEQ ID NO: 13684 - protein, 28 aa, Artificial Sequence
  Description of Artificial Sequence: Synthetic peptide
DEEEIRTTNPVATEQYGEVSTNLQRGMD

SEQ ID NO: 13685 - protein, 29 aa, Artificial Sequence
  Description of Artificial Sequence: Synthetic peptide
DENEIRTTNPVATEQWGSVSTNLQMRGNR

SEQ ID NO: 13686 - protein, 29 aa, Artificial Sequence
  Description of Artificial Sequence: Synthetic peptide
NEEEIRTTNPVATELYGSVSTNLQRGNDR

SEQ ID NO: 13687 - protein, 28 aa, Artificial Sequence
  Description of Artificial Sequence: Synthetic peptide
DEEEIRTTNPVATEIYGVVSTNLQAGNR

SEQ ID NO: 13688 - protein, 28 aa, Artificial Sequence
  Description of Artificial Sequence: Synthetic peptide
DEEEITTTNPVATEMYGSVSTNLQSGNR

SEQ ID NO: 13689 - protein, 29 aa, Artificial Sequence
  Description of Artificial Sequence: Synthetic peptide
DELEIRTTNPVATEQYGSVSTANLQRGNI

SEQ ID NO: 13690 - protein, 28 aa, Artificial Sequence
  Description of Artificial Sequence: Synthetic peptide
DEEEISTTNPVATEQYGDVSTNLQRGER

SEQ ID NO: 13691 - protein, 28 aa, Artificial Sequence
  Description of Artificial Sequence: Synthetic peptide
DEEEIRTTNPVATEQYGSVSTALQNGND

SEQ ID NO: 13692 - protein, 28 aa, Artificial Sequence
  Description of Artificial Sequence: Synthetic peptide
DEDEIRTTNPVATEHYGSVSTNLQRGNF

SEQ ID NO: 13693 - protein, 28 aa, Artificial Sequence
  Description of Artificial Sequence: Synthetic peptide
DEEEIRATNPVATEQYGSMSTNLQRGNM

SEQ ID NO: 13694 - protein, 28 aa, Artificial Sequence
  Description of Artificial Sequence: Synthetic peptide
SEVEIRTTNPVATEQYGSVSTNLQRGNF

SEQ ID NO: 13695 - protein, 29 aa, Artificial Sequence
  Description of Artificial Sequence: Synthetic peptide
DEEEIRTTNPVATEQYGSVSTPGLQRGNL

SEQ ID NO: 13696 - protein, 28 aa, Artificial Sequence
  Description of Artificial Sequence: Synthetic peptide
DEEEIRTTNPVATEHYGSVSTNLQRPER

SEQ ID NO: 13697 - protein, 28 aa, Artificial Sequence
  Description of Artificial Sequence: Synthetic peptide
DEEEIATTNPVATEQYGSVSENLQRGNI

SEQ ID NO: 13698 - protein, 28 aa, Artificial Sequence
  Description of Artificial Sequence: Synthetic peptide
DEEEIRGTNPVATEQYGSVSSNLQRGNS

SEQ ID NO: 13699 - protein, 28 aa, Artificial Sequence
  Description of Artificial Sequence: Synthetic peptide
DEEEIRTTNPVATEQYGSVSENEQGGNR

SEQ ID NO: 13700 - protein, 28 aa, Artificial Sequence
  Description of Artificial Sequence: Synthetic peptide
DEEEIRTTNPVATEQYGSVSTNLQFGEQ

SEQ ID NO: 13701 - protein, 28 aa, Artificial Sequence
  Description of Artificial Sequence: Synthetic peptide
DEEEIRTTNIVATEQYGSVSTNLKRGNF

SEQ ID NO: 13702 - protein, 28 aa, Artificial Sequence
  Description of Artificial Sequence: Synthetic peptide
DEEEIRTTNPVASEQYGEVSTNLQRGGR

SEQ ID NO: 13703 - protein, 28 aa, Artificial Sequence
  Description of Artificial Sequence: Synthetic peptide
DEEEIRTTNPVATESYGSVSTNPQGGNR

SEQ ID NO: 13704 - protein, 28 aa, Artificial Sequence
  Description of Artificial Sequence: Synthetic peptide
DEEEIRTTNIVATDQFGSVSTNLQRGNR

SEQ ID NO: 13705 - protein, 28 aa, Artificial Sequence
  Description of Artificial Sequence: Synthetic peptide
DEEEIRTTNPVATEQYGSVSTDLQLGNT

SEQ ID NO: 13706 - protein, 29 aa, Artificial Sequence
  Description of Artificial Sequence: Synthetic peptide
DEEEIRTTNPVATEQYGSVSTNLQHGNDN

SEQ ID NO: 13707 - protein, 28 aa, Artificial Sequence
  Description of Artificial Sequence: Synthetic peptide
DEEEIRTTNPVATEQYGSVSTNLQHGDL

SEQ ID NO: 13708 - protein, 30 aa, Artificial Sequence
  Description of Artificial Sequence: Synthetic polypeptide
DEEEIRTTNPVATEQYWSYVSTNPLQRGNR

SEQ ID NO: 13709 - protein, 29 aa, Artificial Sequence
  Description of Artificial Sequence: Synthetic peptide
DEEEIRTTNPVATECYGVVCSTNLQRGNR

SEQ ID NO: 13710 - protein, 29 aa, Artificial Sequence
  Description of Artificial Sequence: Synthetic peptide
DEEEIRTTNPVATEQYGSQIMTNLQRGNR

SEQ ID NO: 13711 - protein, 28 aa, Artificial Sequence
  Description of Artificial Sequence: Synthetic peptide
DEQEIATTNPVATEQYGVVSTNLQRGNR

SEQ ID NO: 13712 - protein, 28 aa, Artificial Sequence
  Description of Artificial Sequence: Synthetic peptide
DEEEIRTTNPVATECYGSVSENLQRGQR

SEQ ID NO: 13713 - protein, 28 aa, Artificial Sequence
  Description of Artificial Sequence: Synthetic peptide
DENEIATTNPVATEQYGSVSTNLQQGNR

SEQ ID NO: 13714 - protein, 28 aa, Artificial Sequence
  Description of Artificial Sequence: Synthetic peptide
DEEEIRATNIVATETYGSVSTNLQRGNR

SEQ ID NO: 13715 - protein, 28 aa, Artificial Sequence
  Description of Artificial Sequence: Synthetic peptide
DEEEIRTTNPVATEQYGSVSTDLQHGNF

SEQ ID NO: 13716 - protein, 29 aa, Artificial Sequence
  Description of Artificial Sequence: Synthetic peptide
QEEEIRTTNPVATEQYGSVSTNLQIEGNR

SEQ ID NO: 13717 - protein, 28 aa, Artificial Sequence
  Description of Artificial Sequence: Synthetic peptide
DEEEITTTNIVATEQYGSVSTVLQRGNR

SEQ ID NO: 13718 - protein, 30 aa, Artificial Sequence
  Description of Artificial Sequence: Synthetic polypeptide
DEEEIRTTNPVATEQYGSVSQTNLQLRGNT

SEQ ID NO: 13719 - protein, 30 aa, Artificial Sequence
  Description of Artificial Sequence: Synthetic polypeptide
DEEEIRTTNPVATEQYGSVSENGLPQRGNR

SEQ ID NO: 13720 - protein, 29 aa, Artificial Sequence
  Description of Artificial Sequence: Synthetic peptide
DEEEIRTTNPVATECYGSVSTNLQREGDR

SEQ ID NO: 13721 - protein, 28 aa, Artificial Sequence
  Description of Artificial Sequence: Synthetic peptide
DEQEIRTTNIVATEQYGSVSENLQRGNR

SEQ ID NO: 13722 - protein, 29 aa, Artificial Sequence
  Description of Artificial Sequence: Synthetic peptide
DEEEIRTTNPVATEQYGSVSTPDQDRGNR

SEQ ID NO: 13723 - protein, 28 aa, Artificial Sequence
  Description of Artificial Sequence: Synthetic peptide
DEEEIRTTNPVATEQYGSVSDNLQQGER

SEQ ID NO: 13724 - protein, 30 aa, Artificial Sequence
  Description of Artificial Sequence: Synthetic polypeptide
DEEEIRTTNPVATEQYGSVSTNLQERNGNF

SEQ ID NO: 13725 - protein, 28 aa, Artificial Sequence
  Description of Artificial Sequence: Synthetic peptide
SEEEIRTTNPVATEQYGSVSENLQRGNF

SEQ ID NO: 13726 - protein, 28 aa, Artificial Sequence
  Description of Artificial Sequence: Synthetic peptide
IEEEIRTTNPVATEQYGSVSSNLQRGNF

SEQ ID NO: 13727 - protein, 28 aa, Artificial Sequence
  Description of Artificial Sequence: Synthetic peptide
DEEEIATTNPVCTEQYGSVSENLQRGNR

SEQ ID NO: 13728 - protein, 28 aa, Artificial Sequence
  Description of Artificial Sequence: Synthetic peptide
DEEEIATTNPVATEQYGSVSTNEQRGNA

SEQ ID NO: 13729 - protein, 28 aa, Artificial Sequence
  Description of Artificial Sequence: Synthetic peptide
DEEEIRTTNPVCTEQYGVVSTNLQRGNQ

SEQ ID NO: 13730 - protein, 28 aa, Artificial Sequence
  Description of Artificial Sequence: Synthetic peptide
DENEIRTTNPVATEQYGSVSTNLQQGER

SEQ ID NO: 13731 - protein, 28 aa, Artificial Sequence
  Description of Artificial Sequence: Synthetic peptide
DEEEIRTTNPVATEQYGSQSTYLQRGMR

SEQ ID NO: 13732 - protein, 28 aa, Artificial Sequence
  Description of Artificial Sequence: Synthetic peptide
DEEEIRTTNPVATEQYGLVSENLQRGPR

SEQ ID NO: 13733 - protein, 28 aa, Artificial Sequence
  Description of Artificial Sequence: Synthetic peptide
DEEEIRTTNPVATEQYGSVSTALQGGNP

SEQ ID NO: 13734 - protein, 28 aa, Artificial Sequence
  Description of Artificial Sequence: Synthetic peptide
DECEIRTTNPVATEQYGEVSTVLQRGNR

SEQ ID NO: 13735 - protein, 28 aa, Artificial Sequence
  Description of Artificial Sequence: Synthetic peptide
DEEEIRTTNVVATEQYGSVSTELQRGDR

SEQ ID NO: 13736 - protein, 29 aa, Artificial Sequence
  Description of Artificial Sequence: Synthetic peptide
DEEEIRTTNPVATEQYGTVSTNLQRNGNH

SEQ ID NO: 13737 - protein, 28 aa, Artificial Sequence
  Description of Artificial Sequence: Synthetic peptide
DEEEIRTTNPVATEQYGSVSTNEQNGNN

SEQ ID NO: 13738 - protein, 29 aa, Artificial Sequence
  Description of Artificial Sequence: Synthetic peptide
QEEEIRTTNPVATEQYGSVSTNLQRAGMR

SEQ ID NO: 13739 - protein, 28 aa, Artificial Sequence
  Description of Artificial Sequence: Synthetic peptide
DEEEIRTVNPVATEQYGSVSTELQFGNR

SEQ ID NO: 13740 - protein, 28 aa, Artificial Sequence
  Description of Artificial Sequence: Synthetic peptide
DEEEIRTTNPVATEQYGSVSTELQIGNW

SEQ ID NO: 13741 - protein, 28 aa, Artificial Sequence
  Description of Artificial Sequence: Synthetic peptide
DEQEISTTNPVATEQYGSVSTNLQRGNA

SEQ ID NO: 13742 - protein, 28 aa, Artificial Sequence
  Description of Artificial Sequence: Synthetic peptide
DEEEIKTTNPVSTEQYGAVSTNLQRGNR

SEQ ID NO: 13743 - protein, 30 aa, Artificial Sequence
  Description of Artificial Sequence: Synthetic polypeptide
DEEEIRTTNPVATEQYGSVSDTDLQRGDNR

SEQ ID NO: 13744 - protein, 28 aa, Artificial Sequence
  Description of Artificial Sequence: Synthetic peptide
DEEEIRTTNPVATEQYGSVSTDLQPGNT

SEQ ID NO: 13745 - protein, 28 aa, Artificial Sequence
  Description of Artificial Sequence: Synthetic peptide
DEEEIRTTNPEATEQYGSVSTNLQRDDR

SEQ ID NO: 13746 - protein, 28 aa, Artificial Sequence
  Description of Artificial Sequence: Synthetic peptide
DEDEIRTTNPVATEQYGSVATNLQRGND

SEQ ID NO: 13747 - protein, 28 aa, Artificial Sequence
  Description of Artificial Sequence: Synthetic peptide
DEEEIRTTNIVATEQYGSVATNLQRLNR

SEQ ID NO: 13748 - protein, 30 aa, Artificial Sequence
  Description of Artificial Sequence: Synthetic polypeptide
DEEEIRTTNPVATEQYGSVSTNLQDRGDNH

SEQ ID NO: 13749 - protein, 28 aa, Artificial Sequence
  Description of Artificial Sequence: Synthetic peptide
DEEEIRTTNPVATEQYGDVAINLQRGNR

SEQ ID NO: 13750 - protein, 28 aa, Artificial Sequence
  Description of Artificial Sequence: Synthetic peptide
DEEEIGTTNPVATEQYGDVSNNLQRGNR

SEQ ID NO: 13751 - protein, 28 aa, Artificial Sequence
  Description of Artificial Sequence: Synthetic peptide
DEEEIRTTNPVSSEQYGSVSTNLQRGNQ

SEQ ID NO: 13752 - protein, 28 aa, Artificial Sequence
  Description of Artificial Sequence: Synthetic peptide
DEQEIRTTNPVATEQYGSVSTNEQRGNP

SEQ ID NO: 13753 - protein, 28 aa, Artificial Sequence
  Description of Artificial Sequence: Synthetic peptide
DEVEIRTTNPVATEQYGSVSENWQRGNR

SEQ ID NO: 13754 - protein, 30 aa, Artificial Sequence
  Description of Artificial Sequence: Synthetic polypeptide
DTEEIRTTNPVATEQYGYSVSTNPLQRGNR

SEQ ID NO: 13755 - protein, 30 aa, Artificial Sequence
  Description of Artificial Sequence: Synthetic polypeptide
DEEEIRTTNPVATEQYGSNVSTNYLQRGGR

SEQ ID NO: 13756 - protein, 28 aa, Artificial Sequence
  Description of Artificial Sequence: Synthetic peptide
DEEEIATTNPVSTEQYGSVSTVLQRGNR

SEQ ID NO: 13757 - protein, 28 aa, Artificial Sequence
  Description of Artificial Sequence: Synthetic peptide
DEEEIRTTNPVATEPYGSASTDLQRGNR

SEQ ID NO: 13758 - protein, 28 aa, Artificial Sequence
  Description of Artificial Sequence: Synthetic peptide
DEEEIRTTNPVATEQYGWVSTNGQRGER

SEQ ID NO: 13759 - protein, 28 aa, Artificial Sequence
  Description of Artificial Sequence: Synthetic peptide
DEEEIRTTNPTATEQYGSVSTNPQRGNE

SEQ ID NO: 13760 - protein, 28 aa, Artificial Sequence
  Description of Artificial Sequence: Synthetic peptide
DEEEIRTTNPVATEQYGDVSENLQHGNR

SEQ ID NO: 13761 - protein, 28 aa, Artificial Sequence
  Description of Artificial Sequence: Synthetic peptide
DEEEIRTTNPVSTEWYGIVSTNLQRGNR

SEQ ID NO: 13762 - protein, 28 aa, Artificial Sequence
  Description of Artificial Sequence: Synthetic peptide
DEEEIRCTNPVATELYGSVSTNEQRGNR

SEQ ID NO: 13763 - protein, 28 aa, Artificial Sequence
  Description of Artificial Sequence: Synthetic peptide
DEEEIRTTNPVATECYGSVSTNLQSGNL

SEQ ID NO: 13764 - protein, 28 aa, Artificial Sequence
  Description of Artificial Sequence: Synthetic peptide
DEEEIRATNPVATEQFGSVSTNEQRGNR

SEQ ID NO: 13765 - protein, 29 aa, Artificial Sequence
  Description of Artificial Sequence: Synthetic peptide
MEEEIRTTNPVATEQYGSVSTNLQRGNDQ

SEQ ID NO: 13766 - protein, 28 aa, Artificial Sequence
  Description of Artificial Sequence: Synthetic peptide
DEEEIATTNPVATEQYGSVSTELQRGTR

SEQ ID NO: 13767 - protein, 28 aa, Artificial Sequence
  Description of Artificial Sequence: Synthetic peptide
DEEEIRTTNPVATEQYGIVSTNLMRGNQ

SEQ ID NO: 13768 - protein, 29 aa, Artificial Sequence
  Description of Artificial Sequence: Synthetic peptide
DEEEIRTTNPVATEQYGIVSTNDQRGNDR

SEQ ID NO: 13769 - protein, 28 aa, Artificial Sequence
  Description of Artificial Sequence: Synthetic peptide
DDGEIRGTNPVATEQYGSVSTNLQRGNR

SEQ ID NO: 13770 - protein, 31 aa, Artificial Sequence
  Description of Artificial Sequence: Synthetic polypeptide
DEEEIRTTNPVATEQYGSVSITPNLQLRGNR

SEQ ID NO: 13771 - protein, 28 aa, Artificial Sequence
  Description of Artificial Sequence: Synthetic peptide
SEEEIITTNPVATEQYGSVSENLQRGNR

SEQ ID NO: 13772 - protein, 29 aa, Artificial Sequence
  Description of Artificial Sequence: Synthetic peptide
DEEEIRCTNPVATEQYGIVSTNLQRGNDR

SEQ ID NO: 13773 - protein, 28 aa, Artificial Sequence
  Description of Artificial Sequence: Synthetic peptide
DEEEIRTTNPVATEQYGSVSTNLQAGEL

SEQ ID NO: 13774 - protein, 28 aa, Artificial Sequence
  Description of Artificial Sequence: Synthetic peptide
DEEEIRTTNPVATEQYGDVSTNDQRGNA

SEQ ID NO: 13775 - protein, 30 aa, Artificial Sequence
  Description of Artificial Sequence: Synthetic polypeptide
DEEEIRTTNPVATEQYGSVSTNLQWTGENR

SEQ ID NO: 13776 - protein, 28 aa, Artificial Sequence
  Description of Artificial Sequence: Synthetic peptide
DEEEIRTTNPVATEQYGSVSTELERGNG

SEQ ID NO: 13777 - protein, 28 aa, Artificial Sequence
  Description of Artificial Sequence: Synthetic peptide
DEEEIRTTNPIATEQYGSVSTNLQVGNQ

SEQ ID NO: 13778 - protein, 29 aa, Artificial Sequence
  Description of Artificial Sequence: Synthetic peptide
DEEEIRTTNPVATEQYGSVSTELPQRGER

SEQ ID NO: 13779 - protein, 28 aa, Artificial Sequence
  Description of Artificial Sequence: Synthetic peptide
DEEEIRTTNPVATEQYGSVSTNLQAGDQ

SEQ ID NO: 13780 - protein, 28 aa, Artificial Sequence
  Description of Artificial Sequence: Synthetic peptide
DEAEIRTTNPDATEQYGSVSTNDQRGNR

SEQ ID NO: 13781 - protein, 28 aa, Artificial Sequence
  Description of Artificial Sequence: Synthetic peptide
DEQEIRTTNPVATEQYGSVSTNEQRGNA

SEQ ID NO: 13782 - protein, 29 aa, Artificial Sequence
  Description of Artificial Sequence: Synthetic peptide
DLEEIRTTNPVATEQYGSVYTNLQRGENR

SEQ ID NO: 13783 - protein, 28 aa, Artificial Sequence
  Description of Artificial Sequence: Synthetic peptide
DEEEIRTTNPVSTEQYGSVGTNLQRLNR

SEQ ID NO: 13784 - protein, 30 aa, Artificial Sequence
  Description of Artificial Sequence: Synthetic polypeptide
DEEEIRTTNPVATEQYGSVSTMNLQRGNDA

SEQ ID NO: 13785 - protein, 29 aa, Artificial Sequence
  Description of Artificial Sequence: Synthetic peptide
DEDEIRTTNPQATEQYGSVSTNLQRNGNR

SEQ ID NO: 13786 - protein, 28 aa, Artificial Sequence
  Description of Artificial Sequence: Synthetic peptide
DEEEIRTTNPVATEHYGSVSENLQGGNR

SEQ ID NO: 13787 - protein, 28 aa, Artificial Sequence
  Description of Artificial Sequence: Synthetic peptide
NEEEIRTTNPVATEVYGSVSTNLQRGNV

SEQ ID NO: 13788 - protein, 28 aa, Artificial Sequence
  Description of Artificial Sequence: Synthetic peptide
AEEEIRTTNPVAFEQYGSVSENLQRGNR

SEQ ID NO: 13789 - protein, 28 aa, Artificial Sequence
  Description of Artificial Sequence: Synthetic peptide
DEEEIRCTNPVASEQYGSVSTNLERGNR

SEQ ID NO: 13790 - protein, 30 aa, Artificial Sequence
  Description of Artificial Sequence: Synthetic polypeptide
DEEEIRTTNPVATEQYGSVISTNPQDRGNR

SEQ ID NO: 13791 - protein, 28 aa, Artificial Sequence
  Description of Artificial Sequence: Synthetic peptide
DEEEIRTTNVVATEQYGSVSTNLRRGDR

SEQ ID NO: 13792 - protein, 28 aa, Artificial Sequence
  Description of Artificial Sequence: Synthetic peptide
DEEEIRTTNPVASELYGSVSTNLQRGNQ

SEQ ID NO: 13793 - protein, 28 aa, Artificial Sequence
  Description of Artificial Sequence: Synthetic peptide
DEEEVRCTNPVATEQYGSVATNLQRGNR

SEQ ID NO: 13794 - protein, 28 aa, Artificial Sequence
  Description of Artificial Sequence: Synthetic peptide
DEEEIRTTNPVATEQWGIVSTNLQQGNR

SEQ ID NO: 13795 - protein, 28 aa, Artificial Sequence
  Description of Artificial Sequence: Synthetic peptide
DENEIRTTNPVATEQYGSVSTNLQSGNQ

SEQ ID NO: 13796 - protein, 28 aa, Artificial Sequence
  Description of Artificial Sequence: Synthetic peptide
DEEEIRTTNPVATEQYGEASDNLQRGNR

SEQ ID NO: 13797 - protein, 29 aa, Artificial Sequence
  Description of Artificial Sequence: Synthetic peptide
DEEEIRTTNPVATEQYGVVSTNLDRNGNR

SEQ ID NO: 13798 - protein, 28 aa, Artificial Sequence
  Description of Artificial Sequence: Synthetic peptide
DEHEIATTNPVATEQYGDVSTNLQRGNR

SEQ ID NO: 13799 - protein, 28 aa, Artificial Sequence
  Description of Artificial Sequence: Synthetic peptide
DEEEIRTTNPVATEQYGDVSTNLQHGQR

SEQ ID NO: 13800 - protein, 28 aa, Artificial Sequence
  Description of Artificial Sequence: Synthetic peptide
DEEEIRTTNPVATEQYGDVSENLQKGNR

SEQ ID NO: 13801 - protein, 28 aa, Artificial Sequence
  Description of Artificial Sequence: Synthetic peptide
AEEEIRTTNIVATEQYGSVSTNIQRGNR

SEQ ID NO: 13802 - protein, 28 aa, Artificial Sequence
  Description of Artificial Sequence: Synthetic peptide
REEEIRATNPVATEQYGAVSTNLQRGNR

SEQ ID NO: 13803 - protein, 28 aa, Artificial Sequence
  Description of Artificial Sequence: Synthetic peptide
DEEEIRTVNPVATEQYGEVSTNLQRGMR

SEQ ID NO: 13804 - protein, 28 aa, Artificial Sequence
  Description of Artificial Sequence: Synthetic peptide
DEEEIRTTNPVATEQYGCVSNNLQMGNR

SEQ ID NO: 13805 - protein, 30 aa, Artificial Sequence
  Description of Artificial Sequence: Synthetic polypeptide
DEEEIRTTNPVATEQYGSVSATNLEDRGNR

SEQ ID NO: 13806 - protein, 28 aa, Artificial Sequence
  Description of Artificial Sequence: Synthetic peptide
DDEEIRTTNPVATEQYGSVSTDLERGNR

SEQ ID NO: 13807 - protein, 29 aa, Artificial Sequence
  Description of Artificial Sequence: Synthetic peptide
DEEEIRTTNPVATEQYGSVSTNLQIRGDI

SEQ ID NO: 13808 - protein, 29 aa, Artificial Sequence
  Description of Artificial Sequence: Synthetic peptide
DEQEITTTNPVATEQYGSVSCTNLQRGNR

SEQ ID NO: 13809 - protein, 29 aa, Artificial Sequence
  Description of Artificial Sequence: Synthetic peptide
DEEEIRTTNPVATEQYGGVSTDLPQRGNR

SEQ ID NO: 13810 - protein, 28 aa, Artificial Sequence
  Description of Artificial Sequence: Synthetic peptide
DEQEIRTTNPVATEQYGSVSTNLMRGNA

SEQ ID NO: 13811 - protein, 30 aa, Artificial Sequence
  Description of Artificial Sequence: Synthetic polypeptide
DEEEIRTTNPVATEQYGSVSTLLQTRAGNR

SEQ ID NO: 13812 - protein, 28 aa, Artificial Sequence
  Description of Artificial Sequence: Synthetic peptide
MEEEIRTTNPVATEQYGSVSENLQNGNR

SEQ ID NO: 13813 - protein, 28 aa, Artificial Sequence
  Description of Artificial Sequence: Synthetic peptide
QEEEIRGTNPVCTEQYGSVSTNLQRGNR

SEQ ID NO: 13814 - protein, 29 aa, Artificial Sequence
  Description of Artificial Sequence: Synthetic peptide
DEEEIATTNPVATECYGSVSTNLQIRGNR

SEQ ID NO: 13815 - protein, 28 aa, Artificial Sequence
  Description of Artificial Sequence: Synthetic peptide
DEEEIRCTNPVSTEQYGSVATNLQRGNR

SEQ ID NO: 13816 - protein, 29 aa, Artificial Sequence
  Description of Artificial Sequence: Synthetic peptide
DEEEIRTTNPVAGEQYWSVSTNLPQRGNR

SEQ ID NO: 13817 - protein, 28 aa, Artificial Sequence
  Description of Artificial Sequence: Synthetic peptide
DEEEIRTTNPVATEQYGSVDTELQNGNR

SEQ ID NO: 13818 - protein, 28 aa, Artificial Sequence
  Description of Artificial Sequence: Synthetic peptide
DEQEIRTTNPVATECYGVVSTNLQRGNR

SEQ ID NO: 13819 - protein, 28 aa, Artificial Sequence
  Description of Artificial Sequence: Synthetic peptide
DEEEIRTTNIVATEQYGSASTNLQRGMR

SEQ ID NO: 13820 - protein, 28 aa, Artificial Sequence
  Description of Artificial Sequence: Synthetic peptide
DEEEIRTTNPVCTEQYGDVSTNLQHGNR

SEQ ID NO: 13821 - protein, 28 aa, Artificial Sequence
  Description of Artificial Sequence: Synthetic peptide
REEEIRTTNPVATEMYGSVSTNLQRGNQ

SEQ ID NO: 13822 - protein, 28 aa, Artificial Sequence
  Description of Artificial Sequence: Synthetic peptide
DEHEIRTTNPVATEQYGEVSTNLQRLNR

SEQ ID NO: 13823 - protein, 28 aa, Artificial Sequence
  Description of Artificial Sequence: Synthetic peptide
DEEEIRTVNPVATEQYGEVSENLQRGNR

SEQ ID NO: 13824 - protein, 28 aa, Artificial Sequence
  Description of Artificial Sequence: Synthetic peptide
DENEIATTNPVATEQYGSVSTNLQNGNR

SEQ ID NO: 13825 - protein, 28 aa, Artificial Sequence
  Description of Artificial Sequence: Synthetic peptide
SEEEIYTTNPVATEQYGSVSENLQRGNR

SEQ ID NO: 13826 - protein, 28 aa, Artificial Sequence
  Description of Artificial Sequence: Synthetic peptide
DEEEIRTTNPVATEQYGSVSTNLEVGER

SEQ ID NO: 13827 - protein, 28 aa, Artificial Sequence
  Description of Artificial Sequence: Synthetic peptide
DEEEIRATNPVATEQYGSVSCNLQHGNR

SEQ ID NO: 13828 - protein, 29 aa, Artificial Sequence
  Description of Artificial Sequence: Synthetic peptide
KEEEIRTTNPVATEQYGSVSTNLQREGNL

SEQ ID NO: 13829 - protein, 28 aa, Artificial Sequence
  Description of Artificial Sequence: Synthetic peptide
DEEEIATTNPVATEQYGDVSDNLQRGNR

SEQ ID NO: 13830 - protein, 28 aa, Artificial Sequence
  Description of Artificial Sequence: Synthetic peptide
DEEEIRTTNPVATEQYGSVSTNEQIGNV

SEQ ID NO: 13831 - protein, 28 aa, Artificial Sequence
  Description of Artificial Sequence: Synthetic peptide
DEWEIRTTNPVATEQYGSVCTNTQRGNR

SEQ ID NO: 13832 - protein, 28 aa, Artificial Sequence
  Description of Artificial Sequence: Synthetic peptide
DEEEIRTTNPVATEQYGTMSTNLQQGNR

SEQ ID NO: 13833 - protein, 28 aa, Artificial Sequence
  Description of Artificial Sequence: Synthetic peptide
DEEEIGTTNPVATEQYGSLSTNYQRGNR

SEQ ID NO: 13834 - protein, 28 aa, Artificial Sequence
  Description of Artificial Sequence: Synthetic peptide
DEEEIRTTNPMATEQYGIVSTVLQRGNR

SEQ ID NO: 13835 - protein, 28 aa, Artificial Sequence
  Description of Artificial Sequence: Synthetic peptide
DEEEICTTNPVATEVYGEVSTNLQRGNR

SEQ ID NO: 13836 - protein, 28 aa, Artificial Sequence
  Description of Artificial Sequence: Synthetic peptide
DEEEIRTTNPVATEQYGSVSENLQSGNP

SEQ ID NO: 13837 - protein, 28 aa, Artificial Sequence
  Description of Artificial Sequence: Synthetic peptide
DEEEIRTTNPVATEMYGSVSTNDQRGND

SEQ ID NO: 13838 - protein, 28 aa, Artificial Sequence
  Description of Artificial Sequence: Synthetic peptide
DEDEIRTTNPVATEQYGSVSTALQRGNQ

SEQ ID NO: 13839 - protein, 28 aa, Artificial Sequence
  Description of Artificial Sequence: Synthetic peptide
DEAEIRTTNPVATEQYGVVSTNLQHGNR

SEQ ID NO: 13840 - protein, 28 aa, Artificial Sequence
  Description of Artificial Sequence: Synthetic peptide
DEEEIRTTNPVATEIYGTVSTNLQRGNA

SEQ ID NO: 13841 - protein, 28 aa, Artificial Sequence
  Description of Artificial Sequence: Synthetic peptide
DEEEVRTVNPVATEQYGSVSTNLQVGNR

SEQ ID NO: 13842 - protein, 28 aa, Artificial Sequence
  Description of Artificial Sequence: Synthetic peptide
DEEEIRTTNPVATEQYGEVSTNFQHGNR

SEQ ID NO: 13843 - protein, 28 aa, Artificial Sequence
  Description of Artificial Sequence: Synthetic peptide
DEEEIRTTNPVATEQWGSISTNLQRGNA

SEQ ID NO: 13844 - protein, 28 aa, Artificial Sequence
  Description of Artificial Sequence: Synthetic peptide
DDEEIRPTNPVATEQYGSMSTNLQRGNR

SEQ ID NO: 13845 - protein, 28 aa, Artificial Sequence
  Description of Artificial Sequence: Synthetic peptide
DEEEIRTTNPVATEMYGGVSENLQRGNR

SEQ ID NO: 13846 - protein, 29 aa, Artificial Sequence
  Description of Artificial Sequence: Synthetic peptide
DEEEIRTTNPVATEQYGSVSTPGLQRGNH

SEQ ID NO: 13847 - protein, 28 aa, Artificial Sequence
  Description of Artificial Sequence: Synthetic peptide
DEEEIRSTNPVSTEQYGSVSNNLQRGNR

SEQ ID NO: 13848 - protein, 30 aa, Artificial Sequence
  Description of Artificial Sequence: Synthetic polypeptide
DEEEIRTTNPVATEQYGSVSTNLQDRHPNR

SEQ ID NO: 13849 - protein, 28 aa, Artificial Sequence
  Description of Artificial Sequence: Synthetic peptide
DEEEIRTTNPVATEQYGSVSEELQRGNH

SEQ ID NO: 13850 - protein, 28 aa, Artificial Sequence
  Description of Artificial Sequence: Synthetic peptide
DEEEIRTTNPVATECYGVVSTNLQRGDR

SEQ ID NO: 13851 - protein, 30 aa, Artificial Sequence
  Description of Artificial Sequence: Synthetic polypeptide
DEEEIRTTNPVATEQYGSVSENLQRSGGNR

SEQ ID NO: 13852 - protein, 28 aa, Artificial Sequence
  Description of Artificial Sequence: Synthetic peptide
QEEEIRTTNPVATEQYGSVSTNLQRGGL

SEQ ID NO: 13853 - protein, 28 aa, Artificial Sequence
  Description of Artificial Sequence: Synthetic peptide
DEEEIRTTNPVATEQYGGVSENLQRGTR

SEQ ID NO: 13854 - protein, 28 aa, Artificial Sequence
  Description of Artificial Sequence: Synthetic peptide
DEEEIRTTNPVATEQYGSASENLQRGNI

SEQ ID NO: 13855 - protein, 29 aa, Artificial Sequence
  Description of Artificial Sequence: Synthetic peptide
DEEEIRTTNPVATEQYGSVSDNLQVGTNR

SEQ ID NO: 13856 - protein, 28 aa, Artificial Sequence
  Description of Artificial Sequence: Synthetic peptide
DEEEIRTTNPVAHEQYGDVSTNLQRGNT

SEQ ID NO: 13857 - protein, 30 aa, Artificial Sequence
  Description of Artificial Sequence: Synthetic polypeptide
DEEEIRTTNPVATEQYGSVSTNLQDDNGNR

SEQ ID NO: 13858 - protein, 30 aa, Artificial Sequence
  Description of Artificial Sequence: Synthetic polypeptide
DEEEIRTTNPAATEQYGSVHSTPNLQRGNR

SEQ ID NO: 13859 - protein, 28 aa, Artificial Sequence
  Description of Artificial Sequence: Synthetic peptide
QEEEIRTTNPVATECYGSVSTNLQRGNL

SEQ ID NO: 13860 - protein, 28 aa, Artificial Sequence
  Description of Artificial Sequence: Synthetic peptide
DEEEIRTTNPVATECYGSVSTNLQYGER

SEQ ID NO: 13861 - protein, 29 aa, Artificial Sequence
  Description of Artificial Sequence: Synthetic peptide
MEEEIRTTNPVATEQYGSVSTNLQRGNDI

SEQ ID NO: 13862 - protein, 29 aa, Artificial Sequence
  Description of Artificial Sequence: Synthetic peptide
DEEEIRTTNPVATEQYGSVSTNLARGPTR

SEQ ID NO: 13863 - protein, 29 aa, Artificial Sequence
  Description of Artificial Sequence: Synthetic peptide
DEEEIRTTNPVSTEQYGSVSTVLQRAGNR

SEQ ID NO: 13864 - protein, 28 aa, Artificial Sequence
  Description of Artificial Sequence: Synthetic peptide
DEEEISTTNPVATEQYGIVSENLQRGNR

SEQ ID NO: 13865 - protein, 28 aa, Artificial Sequence
  Description of Artificial Sequence: Synthetic peptide
DEEEIRTTNPVATEQYGSVSANLQLGNL

SEQ ID NO: 13866 - protein, 29 aa, Artificial Sequence
  Description of Artificial Sequence: Synthetic peptide
DENEIRTTNPVATEQYGSVSTNLQVGNDR

SEQ ID NO: 13867 - protein, 28 aa, Artificial Sequence
  Description of Artificial Sequence: Synthetic peptide
DEEEIRTTNPVATEQYGSVSENLQRELR

SEQ ID NO: 13868 - protein, 28 aa, Artificial Sequence
  Description of Artificial Sequence: Synthetic peptide
DEEEIKTTNPVATEQYGSVSTNLQQGNI

SEQ ID NO: 13869 - protein, 28 aa, Artificial Sequence
  Description of Artificial Sequence: Synthetic peptide
DEEEIRQTNPVATEQYGGVSENLQRGNR

SEQ ID NO: 13870 - protein, 29 aa, Artificial Sequence
  Description of Artificial Sequence: Synthetic peptide
DEEEIRTTNPVATEQYGSVSTNLQINGNQ

SEQ ID NO: 13871 - protein, 28 aa, Artificial Sequence
  Description of Artificial Sequence: Synthetic peptide
DEEEIRTTNPVATEQYGSVSTDLQVGNS

SEQ ID NO: 13872 - protein, 28 aa, Artificial Sequence
  Description of Artificial Sequence: Synthetic peptide
DEEEIRTTNIVATEQYGSVSTNLQQRNR

SEQ ID NO: 13873 - protein, 29 aa, Artificial Sequence
  Description of Artificial Sequence: Synthetic peptide
DEIEIRTTNPVATEQYGSVSTNLQQRGGR

SEQ ID NO: 13874 - protein, 28 aa, Artificial Sequence
  Description of Artificial Sequence: Synthetic peptide
DENEIRTTNPVATEQYGSVSTNLERGNE

SEQ ID NO: 13875 - protein, 28 aa, Artificial Sequence
  Description of Artificial Sequence: Synthetic peptide
DEEEIRTTNPVATEQYGSVSENLQHGNL

SEQ ID NO: 13876 - protein, 28 aa, Artificial Sequence
  Description of Artificial Sequence: Synthetic peptide
DEEEIRTTNPVATEQYGSVSTELQVGNF

SEQ ID NO: 13877 - protein, 28 aa, Artificial Sequence
  Description of Artificial Sequence: Synthetic peptide
DEEEIRTTNPVATEQYGSVSTDLQVGNV

SEQ ID NO: 13878 - protein, 28 aa, Artificial Sequence
  Description of Artificial Sequence: Synthetic peptide
DEQEIRTTNPVSTEQYGSVSTVLQRGNR

SEQ ID NO: 13879 - protein, 28 aa, Artificial Sequence
  Description of Artificial Sequence: Synthetic peptide
KEEEIRTTNPVATEQYGSVSTNLQNGNE

SEQ ID NO: 13880 - protein, 30 aa, Artificial Sequence
  Description of Artificial Sequence: Synthetic polypeptide
DEEEIRTTNPVATEQYGSVSTPPLQRGDNR

SEQ ID NO: 13881 - protein, 28 aa, Artificial Sequence
  Description of Artificial Sequence: Synthetic peptide
DEQEIATTNPVATEIYGSVSTNLQRGNR

SEQ ID NO: 13882 - protein, 28 aa, Artificial Sequence
  Description of Artificial Sequence: Synthetic peptide
DEEEIRTTNPVATEQYWSVSTNDQRGNQ

SEQ ID NO: 13883 - protein, 28 aa, Artificial Sequence
  Description of Artificial Sequence: Synthetic peptide
DEEEIRTTNPVATEQYGSVSTNLQAGET

SEQ ID NO: 13884 - protein, 28 aa, Artificial Sequence
  Description of Artificial Sequence: Synthetic peptide
DEKEIRTTNPVATEQYGSVSTHLQRGNG

SEQ ID NO: 13885 - protein, 28 aa, Artificial Sequence
  Description of Artificial Sequence: Synthetic peptide
DENEIATTNPVATEQYGSVSTNLQFGNR

SEQ ID NO: 13886 - protein, 28 aa, Artificial Sequence
  Description of Artificial Sequence: Synthetic peptide
DEEEIRTTNPVATEVYGSVSMELQRGNR

SEQ ID NO: 13887 - protein, 28 aa, Artificial Sequence
  Description of Artificial Sequence: Synthetic peptide
DEEEIRTTNPVATETYGSVSENLQRPNR

SEQ ID NO: 13888 - protein, 29 aa, Artificial Sequence
  Description of Artificial Sequence: Synthetic peptide
DEEEIRTTNPVATECYGSVSTNLQHGNDR

SEQ ID NO: 13889 - protein, 28 aa, Artificial Sequence
  Description of Artificial Sequence: Synthetic peptide
DEEEIRTTNPVATEQYGSVSTGLQRENF

SEQ ID NO: 13890 - protein, 29 aa, Artificial Sequence
  Description of Artificial Sequence: Synthetic peptide
DEEEIRCTNPVATEQWGSVSTNLQRGNDR

SEQ ID NO: 13891 - protein, 28 aa, Artificial Sequence
  Description of Artificial Sequence: Synthetic peptide
CEEEIRTTNPVATEQYGGVSTDLQRGNR

SEQ ID NO: 13892 - protein, 28 aa, Artificial Sequence
  Description of Artificial Sequence: Synthetic peptide
DEEEIRTTNPVATEQYGSWSTDLQRGQR

SEQ ID NO: 13893 - protein, 28 aa, Artificial Sequence
  Description of Artificial Sequence: Synthetic peptide
DEEEIATTNPVATEQYGSASTNLQRGQR

SEQ ID NO: 13894 - protein, 28 aa, Artificial Sequence
  Description of Artificial Sequence: Synthetic peptide
DEEEIRTTNPVATELYGSVSTNLQIGNM

SEQ ID NO: 13895 - protein, 29 aa, Artificial Sequence
  Description of Artificial Sequence: Synthetic peptide
DEEEIVTTNPVATEQYGSVSTNLQYEGNR

SEQ ID NO: 13896 - protein, 28 aa, Artificial Sequence
  Description of Artificial Sequence: Synthetic peptide
DEEEIRTTNPVATEQYGSVSEDLQRGNV

SEQ ID NO: 13897 - protein, 30 aa, Artificial Sequence
  Description of Artificial Sequence: Synthetic polypeptide
DEVEIRTTNPVATEQYGSVSTNLQDRGNTR

SEQ ID NO: 13898 - protein, 29 aa, Artificial Sequence
  Description of Artificial Sequence: Synthetic peptide
DEEEIRTTNPVATEQYGTVSTNLQRGAPR

SEQ ID NO: 13899 - protein, 29 aa, Artificial Sequence
  Description of Artificial Sequence: Synthetic peptide
DEEEIRTTNPVATEQYGHSVSTNLQQGDR

SEQ ID NO: 13900 - protein, 28 aa, Artificial Sequence
  Description of Artificial Sequence: Synthetic peptide
DEEEIRTTNPVATEHYGSVGTNLQHGNR

SEQ ID NO: 13901 - protein, 28 aa, Artificial Sequence
  Description of Artificial Sequence: Synthetic peptide
MEEEIRTTNPCATEQYGSVSTNLQQGNR

SEQ ID NO: 13902 - protein, 28 aa, Artificial Sequence
  Description of Artificial Sequence: Synthetic peptide
DEEEIRATNPVATEQYGVVSTNLQRGNN

SEQ ID NO: 13903 - protein, 28 aa, Artificial Sequence
  Description of Artificial Sequence: Synthetic peptide
DEEEIRTTNPVATEMFGSVSTNLQQGNR

SEQ ID NO: 13904 - protein, 28 aa, Artificial Sequence
  Description of Artificial Sequence: Synthetic peptide
DEEEIRTTNIVCTENYGSVSTNLQRGNR

SEQ ID NO: 13905 - protein, 28 aa, Artificial Sequence
  Description of Artificial Sequence: Synthetic peptide
DEEEIRTTNPVATEGYGSVSDNLQRGNE

SEQ ID NO: 13906 - protein, 28 aa, Artificial Sequence
  Description of Artificial Sequence: Synthetic peptide
DEVEIATTNPVATEQYGSVSTNLQQGNR

SEQ ID NO: 13907 - protein, 28 aa, Artificial Sequence
  Description of Artificial Sequence: Synthetic peptide
DEEEIRTTNPVATEQWGSVSENLQIGNR

SEQ ID NO: 13908 - protein, 29 aa, Artificial Sequence
  Description of Artificial Sequence: Synthetic peptide
DEEEIRTTNPVATEQYGCVSETNLQRGIR

SEQ ID NO: 13909 - protein, 28 aa, Artificial Sequence
  Description of Artificial Sequence: Synthetic peptide
DEEEIRTTNPVATECYGSVSTNLELGNR

SEQ ID NO: 13910 - protein, 28 aa, Artificial Sequence
  Description of Artificial Sequence: Synthetic peptide
DENEITTTNPVATEQYGSVSTNLQRGNH

SEQ ID NO: 13911 - protein, 28 aa, Artificial Sequence
  Description of Artificial Sequence: Synthetic peptide
DEEEIRTTNPVATEQYGSVSENLMIGNR

SEQ ID NO: 13912 - protein, 28 aa, Artificial Sequence
  Description of Artificial Sequence: Synthetic peptide
DEEEIRTTNPVATEQYGSVSTNEQQGNQ

SEQ ID NO: 13913 - protein, 28 aa, Artificial Sequence
  Description of Artificial Sequence: Synthetic peptide
DEEEIRTTNPVATEQYGSVSENLMRGNF

SEQ ID NO: 13914 - protein, 28 aa, Artificial Sequence
  Description of Artificial Sequence: Synthetic peptide
DENEIRTTNPVATECYGSVSTNLQVGNR

SEQ ID NO: 13915 - protein, 28 aa, Artificial Sequence
  Description of Artificial Sequence: Synthetic peptide
DEYEIRTTNIVATEQYGSVCTNLQRGNR

SEQ ID NO: 13916 - protein, 28 aa, Artificial Sequence
  Description of Artificial Sequence: Synthetic peptide
GEEEIRTVNPVATEQYGSVSMNLQRGNR

SEQ ID NO: 13917 - protein, 28 aa, Artificial Sequence
  Description of Artificial Sequence: Synthetic peptide
DEREIRTTNPVATEQYGSCSDNLQRGNR

SEQ ID NO: 13918 - protein, 28 aa, Artificial Sequence
  Description of Artificial Sequence: Synthetic peptide
DEQEIRTTNPVATEQYGSVSTNDERGNR

SEQ ID NO: 13919 - protein, 28 aa, Artificial Sequence
  Description of Artificial Sequence: Synthetic peptide
DEEEIRTTNPVATEQYGNASTNLQRGDR

SEQ ID NO: 13920 - protein, 29 aa, Artificial Sequence
  Description of Artificial Sequence: Synthetic peptide
DEEEIMTTNPVATEQYGSVSTNIQARGNR

SEQ ID NO: 13921 - protein, 28 aa, Artificial Sequence
  Description of Artificial Sequence: Synthetic peptide
DEEEIRTTNPVATEMYGSVSTNLQFGTR

SEQ ID NO: 13922 - protein, 28 aa, Artificial Sequence
  Description of Artificial Sequence: Synthetic peptide
DEEEIRTTNPVATEHYGFVSTNLQRGNQ

SEQ ID NO: 13923 - protein, 28 aa, Artificial Sequence
  Description of Artificial Sequence: Synthetic peptide
DEIEICTTNPVATEQYGSVSTNLQGGNR

SEQ ID NO: 13924 - protein, 28 aa, Artificial Sequence
  Description of Artificial Sequence: Synthetic peptide
NEEEIRTTNIVATEQYGTVSTNLQRGNR

SEQ ID NO: 13925 - protein, 28 aa, Artificial Sequence
  Description of Artificial Sequence: Synthetic peptide
DEEEIRTTNPVATEQYGSVSTELQVGNI

SEQ ID NO: 13926 - protein, 28 aa, Artificial Sequence
  Description of Artificial Sequence: Synthetic peptide
DEEEIRTTNPVATEQYGSVSTNLDIGNT

SEQ ID NO: 13927 - protein, 28 aa, Artificial Sequence
  Description of Artificial Sequence: Synthetic peptide
DEEEIRTTNPVATEMYGSVSTNLQIGNM

SEQ ID NO: 13928 - protein, 28 aa, Artificial Sequence
  Description of Artificial Sequence: Synthetic peptide
DEEEIRTTNPVATECYGSVSTNLQRGEL

SEQ ID NO: 13929 - protein, 28 aa, Artificial Sequence
  Description of Artificial Sequence: Synthetic peptide
DEQEIRTTNPVATEQYGSVSENLQRGDR

SEQ ID NO: 13930 - protein, 28 aa, Artificial Sequence
  Description of Artificial Sequence: Synthetic peptide
DEEEIRTTNPVATECYGSVSTNLQRGEA

SEQ ID NO: 13931 - protein, 28 aa, Artificial Sequence
  Description of Artificial Sequence: Synthetic peptide
DEEEIRTTNPVATEQYGSVSTNLEVGNM

SEQ ID NO: 13932 - protein, 28 aa, Artificial Sequence
  Description of Artificial Sequence: Synthetic peptide
DEQEIRTTNPVATEQWGSVSTNLQRGNS

SEQ ID NO: 13933 - protein, 28 aa, Artificial Sequence
  Description of Artificial Sequence: Synthetic peptide
DEEEIRTTNPVATEQYGSVSMNLQRLNQ

SEQ ID NO: 13934 - protein, 28 aa, Artificial Sequence
  Description of Artificial Sequence: Synthetic peptide
DEEEIRTTNIVASEQYGCVSTNLQRGNR

SEQ ID NO: 13935 - protein, 28 aa, Artificial Sequence
  Description of Artificial Sequence: Synthetic peptide
DEEEIRTTNPVATEQYGSVSTNLFDGER

SEQ ID NO: 13936 - protein, 30 aa, Artificial Sequence
  Description of Artificial Sequence: Synthetic polypeptide
DEEEIRTTNPVATEQYGSVSTNLQDIEGNR

SEQ ID NO: 13937 - protein, 28 aa, Artificial Sequence
  Description of Artificial Sequence: Synthetic peptide
DEEEIRTTNPVATEQYGSVSENLQNGNH

SEQ ID NO: 13938 - protein, 29 aa, Artificial Sequence
  Description of Artificial Sequence: Synthetic peptide
QEEEIRTTNPVATECYGSVSTNLQRNGNR

SEQ ID NO: 13939 - protein, 28 aa, Artificial Sequence
  Description of Artificial Sequence: Synthetic peptide
DEEEIVTTNPVATECYGSVSTNLQTGNR

SEQ ID NO: 13940 - protein, 31 aa, Artificial Sequence
  Description of Artificial Sequence: Synthetic polypeptide
DEEEIRTTNPVATEQYGSVSETNLQERNGNR

SEQ ID NO: 13941 - protein, 28 aa, Artificial Sequence
  Description of Artificial Sequence: Synthetic peptide
SEEEIRTTNPVATEQYGSVSENLQRGTR

SEQ ID NO: 13942 - protein, 29 aa, Artificial Sequence
  Description of Artificial Sequence: Synthetic peptide
DEEEIRTTNPVATEQYGSTSTNLQHRGYR

SEQ ID NO: 13943 - protein, 29 aa, Artificial Sequence
  Description of Artificial Sequence: Synthetic peptide
DEEEIRTTNPVATEQYGSVSTNLQDQGNA

SEQ ID NO: 13944 - protein, 28 aa, Artificial Sequence
  Description of Artificial Sequence: Synthetic peptide
DEEEIRTTNPVATEQYGSVSTELQVGNM

SEQ ID NO: 13945 - protein, 29 aa, Artificial Sequence
  Description of Artificial Sequence: Synthetic peptide
DEEEIRTTNPVATEQYGSVASTPLQRGNA

SEQ ID NO: 13946 - protein, 28 aa, Artificial Sequence
  Description of Artificial Sequence: Synthetic peptide
DEEEIRCTNIVATEQYGSVSTQLQRGNR

SEQ ID NO: 13947 - protein, 28 aa, Artificial Sequence
  Description of Artificial Sequence: Synthetic peptide
DENEIRATNPYATEQYGSVSTNLQRGNR

SEQ ID NO: 13948 - protein, 28 aa, Artificial Sequence
  Description of Artificial Sequence: Synthetic peptide
DEEEIATTNPVATEQYGEVSENLQRGNR

SEQ ID NO: 13949 - protein, 29 aa, Artificial Sequence
  Description of Artificial Sequence: Synthetic peptide
SEEEIRTTNPVATEQYGSVSTNLQNQGNR

SEQ ID NO: 13950 - protein, 28 aa, Artificial Sequence
  Description of Artificial Sequence: Synthetic peptide
DEEEIRTTNPVATEQYGWASDNLQRGNR

SEQ ID NO: 13951 - protein, 28 aa, Artificial Sequence
  Description of Artificial Sequence: Synthetic peptide
DEDEIRTTNPVATEQYGSVSTNLQFGNF

SEQ ID NO: 13952 - protein, 28 aa, Artificial Sequence
  Description of Artificial Sequence: Synthetic peptide
DEEEIRCTNIVATEQYGSVSTLLQRGNR

SEQ ID NO: 13953 - protein, 28 aa, Artificial Sequence
  Description of Artificial Sequence: Synthetic peptide
DEEEIRTTNPTATEQFGEVSTNLQRGNR

SEQ ID NO: 13954 - protein, 28 aa, Artificial Sequence
  Description of Artificial Sequence: Synthetic peptide
DENEIRTTNPVATEQYGSVSTNLQRGEL

SEQ ID NO: 13955 - protein, 29 aa, Artificial Sequence
  Description of Artificial Sequence: Synthetic peptide
DEEEIRTTNPVATEQYGSVSTNLEERGNI

SEQ ID NO: 13956 - protein, 29 aa, Artificial Sequence
  Description of Artificial Sequence: Synthetic peptide
DEEEIRTTNPVATEQYGSVSENLQRAGNM

SEQ ID NO: 13957 - protein, 28 aa, Artificial Sequence
  Description of Artificial Sequence: Synthetic peptide
DEEEIRTTNPVATEQYGSVSTNQQNGNV

SEQ ID NO: 13958 - protein, 28 aa, Artificial Sequence
  Description of Artificial Sequence: Synthetic peptide
DEEEIRTTNPVATEQFGSVSTNLQRGMM

SEQ ID NO: 13959 - protein, 28 aa, Artificial Sequence
  Description of Artificial Sequence: Synthetic peptide
DEEEIRTTNPVATEQYGVVSTNGQRGNQ

SEQ ID NO: 13960 - protein, 28 aa, Artificial Sequence
  Description of Artificial Sequence: Synthetic peptide
DEEEITTTNPVATEQYGCVSTNLQRGNF

SEQ ID NO: 13961 - protein, 28 aa, Artificial Sequence
  Description of Artificial Sequence: Synthetic peptide
GEEEIRTTNPVATEQYGWCSTNLQRGNR

SEQ ID NO: 13962 - protein, 28 aa, Artificial Sequence
  Description of Artificial Sequence: Synthetic peptide
DEQEIRTTNPVATEMYGTVSTNLQRGNR

SEQ ID NO: 13963 - protein, 28 aa, Artificial Sequence
  Description of Artificial Sequence: Synthetic peptide
DEEEIRTTNPVATEQYGVCSTNLQRGNM

SEQ ID NO: 13964 - protein, 28 aa, Artificial Sequence
  Description of Artificial Sequence: Synthetic peptide
DEEEIATTNPVATECYGSVSTNLQRGNI

SEQ ID NO: 13965 - protein, 28 aa, Artificial Sequence
  Description of Artificial Sequence: Synthetic peptide
SEEEIRTTNPVATEQYGSVSTNLQRGTF

SEQ ID NO: 13966 - protein, 28 aa, Artificial Sequence
  Description of Artificial Sequence: Synthetic peptide
FEEEIRTTNPVATEPYGSVSENLQRGNR

SEQ ID NO: 13967 - protein, 28 aa, Artificial Sequence
  Description of Artificial Sequence: Synthetic peptide
DETEIRTTNPVATEQYGSVSTNLCGGNR

SEQ ID NO: 13968 - protein, 28 aa, Artificial Sequence
  Description of Artificial Sequence: Synthetic peptide
DEEEIRTTNPVATENYGSVSTNLQRGTQ

SEQ ID NO: 13969 - protein, 29 aa, Artificial Sequence
  Description of Artificial Sequence: Synthetic peptide
DEEEIRTTNPVATEQYGSVSTNPQIRGNF

SEQ ID NO: 13970 - protein, 28 aa, Artificial Sequence
  Description of Artificial Sequence: Synthetic peptide
DEDEIRTTNIVATECYGSVSTNLQRGNR

SEQ ID NO: 13971 - protein, 28 aa, Artificial Sequence
  Description of Artificial Sequence: Synthetic peptide
DEEEIRATNPVATEQYGSVSNNLQPGNR

SEQ ID NO: 13972 - protein, 28 aa, Artificial Sequence
  Description of Artificial Sequence: Synthetic peptide
SEEEIRTTNPVATELYGWVSTNLQRGNR

SEQ ID NO: 13973 - protein, 28 aa, Artificial Sequence
  Description of Artificial Sequence: Synthetic peptide
DEEEIRTTNPVATEQYGSVSENLQLGNH

SEQ ID NO: 13974 - protein, 28 aa, Artificial Sequence
  Description of Artificial Sequence: Synthetic peptide
DEKEIRGTNPVATEQYGSVSTNLQTGNR

SEQ ID NO: 13975 - protein, 30 aa, Artificial Sequence
  Description of Artificial Sequence: Synthetic polypeptide
DEEEIRTTNPVATEQYGTVSTMNLQQRGNR

SEQ ID NO: 13976 - protein, 28 aa, Artificial Sequence
  Description of Artificial Sequence: Synthetic peptide
DEEEIRTTNIVATEIYGSVETNLQRGNR

SEQ ID NO: 13977 - protein, 28 aa, Artificial Sequence
  Description of Artificial Sequence: Synthetic peptide
DEQEITTTNPVATEQYGSVSDNLQRGNR

SEQ ID NO: 13978 - protein, 28 aa, Artificial Sequence
  Description of Artificial Sequence: Synthetic peptide
DEEEIRTTNPVATEIYGSVSTNDQRGNQ

SEQ ID NO: 13979 - protein, 29 aa, Artificial Sequence
  Description of Artificial Sequence: Synthetic peptide
DEEEIRTTNPVATECYGSVSTDLQRGNDR

SEQ ID NO: 13980 - protein, 30 aa, Artificial Sequence
  Description of Artificial Sequence: Synthetic polypeptide
DEEEIRTTNPVASEQYGSVSTNLQRNGNAR

SEQ ID NO: 13981 - protein, 28 aa, Artificial Sequence
  Description of Artificial Sequence: Synthetic peptide
DEEEIRATNPVATEQYGVVSTNLQRGNV

SEQ ID NO: 13982 - protein, 30 aa, Artificial Sequence
  Description of Artificial Sequence: Synthetic polypeptide
DEEEIRTTNPVATEQYGSVSTNLQQKGNDR

SEQ ID NO: 13983 - protein, 28 aa, Artificial Sequence
  Description of Artificial Sequence: Synthetic peptide
DENEIATTNPVATEQYGDVSTNLQRGNR

SEQ ID NO: 13984 - protein, 28 aa, Artificial Sequence
  Description of Artificial Sequence: Synthetic peptide
SEEEIRTTNPVATEQFGSVSTNLQRGTR

SEQ ID NO: 13985 - protein, 29 aa, Artificial Sequence
  Description of Artificial Sequence: Synthetic peptide
DEEVIRTTNPVATEQYTSVPSTNLQRGNR

SEQ ID NO: 13986 - protein, 28 aa, Artificial Sequence
  Description of Artificial Sequence: Synthetic peptide
DEQEIRTTNPDATEQYGSVSTNLQRGER

SEQ ID NO: 13987 - protein, 29 aa, Artificial Sequence
  Description of Artificial Sequence: Synthetic peptide
DEEEIATTNPVATEQYGSVSTNLQRGEDR

SEQ ID NO: 13988 - protein, 28 aa, Artificial Sequence
  Description of Artificial Sequence: Synthetic peptide
DEEEIVTTNPVATEQYGSVSTNWQNGNR

SEQ ID NO: 13989 - protein, 30 aa, Artificial Sequence
  Description of Artificial Sequence: Synthetic polypeptide
DEEEIRTTNPVATEQYGDVSTNLVQRGNDR

SEQ ID NO: 13990 - protein, 28 aa, Artificial Sequence
  Description of Artificial Sequence: Synthetic peptide
DEEEIRTTNPVATEQYGSVSTNPQIGNF

SEQ ID NO: 13991 - protein, 28 aa, Artificial Sequence
  Description of Artificial Sequence: Synthetic peptide
DEEEIRTTNPVATEQWGSVSTNLMRGNM

SEQ ID NO: 13992 - protein, 28 aa, Artificial Sequence
  Description of Artificial Sequence: Synthetic peptide
DEEEIRTTNPVATEVYGEVSTNLQHGNR

SEQ ID NO: 13993 - protein, 28 aa, Artificial Sequence
  Description of Artificial Sequence: Synthetic peptide
SEEEIATTNPVATEQYGSVSTNLQRGNF

SEQ ID NO: 13994 - protein, 29 aa, Artificial Sequence
  Description of Artificial Sequence: Synthetic peptide
DEEEIRTTNPVATEQYGSWSLTNLNRGNR

SEQ ID NO: 13995 - protein, 28 aa, Artificial Sequence
  Description of Artificial Sequence: Synthetic peptide
DEEEIRSTNPVATEQYGSVSTNLQVGNA

SEQ ID NO: 13996 - protein, 28 aa, Artificial Sequence
  Description of Artificial Sequence: Synthetic peptide
DEEEIRTTNPVATEQYGSVSTELDRGNW

SEQ ID NO: 13997 - protein, 28 aa, Artificial Sequence
  Description of Artificial Sequence: Synthetic peptide
DDEEIRSTNPVATEQYGSVSTNLQRGNS

SEQ ID NO: 13998 - protein, 29 aa, Artificial Sequence
  Description of Artificial Sequence: Synthetic peptide
DEEEIRTTNPVATEQYGAVSTNLQDRGNY

SEQ ID NO: 13999 - protein, 28 aa, Artificial Sequence
  Description of Artificial Sequence: Synthetic peptide
AEEEIRTTNPVATEQYGSVSTNLQRGGH

SEQ ID NO: 14000 - protein, 28 aa, Artificial Sequence
  Description of Artificial Sequence: Synthetic peptide
DEEEIRTTNPVATEQWGSVSTNEQRGTR

SEQ ID NO: 14001 - protein, 28 aa, Artificial Sequence
  Description of Artificial Sequence: Synthetic peptide
DEEEIRTTNPVATEMYGEVSANLQRGNR

SEQ ID NO: 14002 - protein, 28 aa, Artificial Sequence
  Description of Artificial Sequence: Synthetic peptide
DEEEIRTTNPVATEQWGSVSENLQRGNA

SEQ ID NO: 14003 - protein, 28 aa, Artificial Sequence
  Description of Artificial Sequence: Synthetic peptide
DETEIVTTNPVATEQYGSVSTNLQRLNR

SEQ ID NO: 14004 - protein, 29 aa, Artificial Sequence
  Description of Artificial Sequence: Synthetic peptide
SEEEIATTNPVATEQYGSVSTNLQRGDNR

SEQ ID NO: 14005 - protein, 28 aa, Artificial Sequence
  Description of Artificial Sequence: Synthetic peptide
DEEEIRTTNPVATEQYGSVSTGPQRGNG

SEQ ID NO: 14006 - protein, 30 aa, Artificial Sequence
  Description of Artificial Sequence: Synthetic polypeptide
DEEEIRTTNPVATEQYGSVSTNPGQERGNR

SEQ ID NO: 14007 - protein, 30 aa, Artificial Sequence
  Description of Artificial Sequence: Synthetic polypeptide
DEMEIRTTNPVATEQYGSVSTNLQLRGDNR

SEQ ID NO: 14008 - protein, 30 aa, Artificial Sequence
  Description of Artificial Sequence: Synthetic polypeptide
DEEEIRTTNPVATECYGSVSETNLQDRGNR

SEQ ID NO: 14009 - protein, 28 aa, Artificial Sequence
  Description of Artificial Sequence: Synthetic peptide
DEEEIRTTNPVSTEQYGEVGTNLQRGNR

SEQ ID NO: 14010 - protein, 28 aa, Artificial Sequence
  Description of Artificial Sequence: Synthetic peptide
DEEEIRTTNPVATEQFGSVSENLQRGQR

SEQ ID NO: 14011 - protein, 28 aa, Artificial Sequence
  Description of Artificial Sequence: Synthetic peptide
DDEEIATTNPVATEQYGSVSTNLQHGNR

SEQ ID NO: 14012 - protein, 29 aa, Artificial Sequence
  Description of Artificial Sequence: Synthetic peptide
DEEEIRTTNPVATEQYGSVSTNLQAGEDR

SEQ ID NO: 14013 - protein, 28 aa, Artificial Sequence
  Description of Artificial Sequence: Synthetic peptide
DEEEIRTTNPVASEQYGSVSTNIQRGPR

SEQ ID NO: 14014 - protein, 28 aa, Artificial Sequence
  Description of Artificial Sequence: Synthetic peptide
DEEEIRTTNPVATEQYGEVPTVLQRGNR

SEQ ID NO: 14015 - protein, 28 aa, Artificial Sequence
  Description of Artificial Sequence: Synthetic peptide
DEEEIRTTNPVATEQYGSVSTELQQGNQ

SEQ ID NO: 14016 - protein, 29 aa, Artificial Sequence
  Description of Artificial Sequence: Synthetic peptide
DEEEIRTTNPVATEQYGDVSTNLQNRGDR

SEQ ID NO: 14017 - protein, 28 aa, Artificial Sequence
  Description of Artificial Sequence: Synthetic peptide
DEEEITTTNPVATECYGSVSTNLQRGNF

SEQ ID NO: 14018 - protein, 28 aa, Artificial Sequence
  Description of Artificial Sequence: Synthetic peptide
DEEEIRTTNPVATEQYGSVSTNEQRGTS

SEQ ID NO: 14019 - protein, 28 aa, Artificial Sequence
  Description of Artificial Sequence: Synthetic peptide
DEEEIATVNIVATEQYGSVSTNLQRGNR

SEQ ID NO: 14020 - protein, 28 aa, Artificial Sequence
  Description of Artificial Sequence: Synthetic peptide
DEEEIRTTNPVATEQYGSVSEALQRENR

SEQ ID NO: 14021 - protein, 29 aa, Artificial Sequence
  Description of Artificial Sequence: Synthetic peptide
DEEEIRTTNPVATEQYGSVSENLQVFGNR

SEQ ID NO: 14022 - protein, 28 aa, Artificial Sequence
  Description of Artificial Sequence: Synthetic peptide
DESEIATTNPVATEQYGSVSDNLQRGNR

SEQ ID NO: 14023 - protein, 28 aa, Artificial Sequence
  Description of Artificial Sequence: Synthetic peptide
DEEEIRTTNPVSTEQYGEVSTNIQRGNR

SEQ ID NO: 14024 - protein, 28 aa, Artificial Sequence
  Description of Artificial Sequence: Synthetic peptide
DEEEISQTNPVATEQYGSVSENLQRGNR

SEQ ID NO: 14025 - protein, 28 aa, Artificial Sequence
  Description of Artificial Sequence: Synthetic peptide
MEEEIRTTNPVATEQYGSVSTNLQSGNW

SEQ ID NO: 14026 - protein, 28 aa, Artificial Sequence
  Description of Artificial Sequence: Synthetic peptide
REEEIRSTNPVATEQYGEVSTNLQRGNR

SEQ ID NO: 14027 - protein, 28 aa, Artificial Sequence
  Description of Artificial Sequence: Synthetic peptide
DENEIRTTNPVATEQYGEVSTNLQRENR

SEQ ID NO: 14028 - protein, 28 aa, Artificial Sequence
  Description of Artificial Sequence: Synthetic peptide
DEEEIVTTNPCATEQYGSVSTNLQQGNR

SEQ ID NO: 14029 - protein, 29 aa, Artificial Sequence
  Description of Artificial Sequence: Synthetic peptide
DEEEIRTTNPVATEQYGSVSENLQRGNPY

SEQ ID NO: 14030 - protein, 28 aa, Artificial Sequence
  Description of Artificial Sequence: Synthetic peptide
QEEEIRTTNPVATEQYGEVSTNLQHGNR

SEQ ID NO: 14031 - protein, 28 aa, Artificial Sequence
  Description of Artificial Sequence: Synthetic peptide
DEEEIRTTNPVATELYGSVSENLQRGNI

SEQ ID NO: 14032 - protein, 28 aa, Artificial Sequence
  Description of Artificial Sequence: Synthetic peptide
DEEEIRTTNPVATEQFGSVSTNVQRGNV

SEQ ID NO: 14033 - protein, 28 aa, Artificial Sequence
  Description of Artificial Sequence: Synthetic peptide
DEEEIRTTNPVATEQYGSVSEAWQRGNR

SEQ ID NO: 14034 - protein, 30 aa, Artificial Sequence
  Description of Artificial Sequence: Synthetic polypeptide
DEEEIRTTNPVATEQYGSVSTNLQRKGDNS

SEQ ID NO: 14035 - protein, 28 aa, Artificial Sequence
  Description of Artificial Sequence: Synthetic peptide
DEDEIRTTNPVATEQYGSVGTNLQQGNR

SEQ ID NO: 14036 - protein, 28 aa, Artificial Sequence
  Description of Artificial Sequence: Synthetic peptide
DEEEIRTTNPVATEQYGSVSTDLQSGNI

SEQ ID NO: 14037 - protein, 28 aa, Artificial Sequence
  Description of Artificial Sequence: Synthetic peptide
DEEEIATTNPVATEQYGSVSTNLQVGER

SEQ ID NO: 14038 - protein, 29 aa, Artificial Sequence
  Description of Artificial Sequence: Synthetic peptide
DEDEIRTTNPVATEQYGSVSTNLQRGENF

SEQ ID NO: 14039 - protein, 29 aa, Artificial Sequence
  Description of Artificial Sequence: Synthetic peptide
DEEEIRTTNPVATEQYGSVATNLQESGNR

SEQ ID NO: 14040 - protein, 28 aa, Artificial Sequence
  Description of Artificial Sequence: Synthetic peptide
DEEEIRTTNPVATEQYGIVSENLQFGNR

SEQ ID NO: 14041 - protein, 28 aa, Artificial Sequence
  Description of Artificial Sequence: Synthetic peptide
DEEEIRTTNPVATEQYGEMSTNLQRGQR

SEQ ID NO: 14042 - protein, 28 aa, Artificial Sequence
  Description of Artificial Sequence: Synthetic peptide
DEEEIRTTNPVATECYGSVSTELQYGNR

SEQ ID NO: 14043 - protein, 31 aa, Artificial Sequence
  Description of Artificial Sequence: Synthetic polypeptide
DEEEIRTTNPVATEQYGSVSTCNLQREGNSR

SEQ ID NO: 14044 - protein, 28 aa, Artificial Sequence
  Description of Artificial Sequence: Synthetic peptide
DEEEIRTTNIVATEQYGSVSENKQRGNR

SEQ ID NO: 14045 - protein, 28 aa, Artificial Sequence
  Description of Artificial Sequence: Synthetic peptide
DEEEIRTTNPVATEQYGSVSTDLQIGNN

SEQ ID NO: 14046 - protein, 28 aa, Artificial Sequence
  Description of Artificial Sequence: Synthetic peptide
DEEEIRTTNPVATEQYGSASTNEQHGNR

SEQ ID NO: 14047 - protein, 28 aa, Artificial Sequence
  Description of Artificial Sequence: Synthetic peptide
QEEEIRTTNPVATEQYGSVSTNLQHGER

SEQ ID NO: 14048 - protein, 28 aa, Artificial Sequence
  Description of Artificial Sequence: Synthetic peptide
DENEIRTTNPVATEQYGSVSTNLMRGNW

SEQ ID NO: 14049 - protein, 29 aa, Artificial Sequence
  Description of Artificial Sequence: Synthetic peptide
DEEEIRTTNPVATEQYGSVSENLQRGDNL

SEQ ID NO: 14050 - protein, 29 aa, Artificial Sequence
  Description of Artificial Sequence: Synthetic peptide
DEEEIRTTNPVATEQYGCVSTNLERNGNR

SEQ ID NO: 14051 - protein, 28 aa, Artificial Sequence
  Description of Artificial Sequence: Synthetic peptide
DEEEIRTTNPVATEQFGSVSTNWQRGNF

SEQ ID NO: 14052 - protein, 30 aa, Artificial Sequence
  Description of Artificial Sequence: Synthetic polypeptide
DEEEIRTTNPVATEQYGSVSTNLQERNGNE

SEQ ID NO: 14053 - protein, 28 aa, Artificial Sequence
  Description of Artificial Sequence: Synthetic peptide
DEEEIRTTNPVATEPYGSVSEELQRGNR

SEQ ID NO: 14054 - protein, 28 aa, Artificial Sequence
  Description of Artificial Sequence: Synthetic peptide
DENEIVTTNPVATEQYGSVSTNLQRGNF

SEQ ID NO: 14055 - protein, 29 aa, Artificial Sequence
  Description of Artificial Sequence: Synthetic peptide
SEEEIRTTNPVATEQYGSVSTNLPQRGPR

SEQ ID NO: 14056 - protein, 28 aa, Artificial Sequence
  Description of Artificial Sequence: Synthetic peptide
DEEEIRTTNPVATEQYGCMSENLQRGNR

SEQ ID NO: 14057 - protein, 30 aa, Artificial Sequence
  Description of Artificial Sequence: Synthetic polypeptide
DEEEIRTTNPVATEQYGSVSTGLQIRGDNR

SEQ ID NO: 14058 - protein, 30 aa, Artificial Sequence
  Description of Artificial Sequence: Synthetic polypeptide
DEEEIRTTNPVATEQYGSVSMNLQIRGNPR

SEQ ID NO: 14059 - protein, 28 aa, Artificial Sequence
  Description of Artificial Sequence: Synthetic peptide
DEQEIATTNPVATEQYGSVSTNLQRGTR

SEQ ID NO: 14060 - protein, 28 aa, Artificial Sequence
  Description of Artificial Sequence: Synthetic peptide
DEQEISTTNPVATEQYGSVSTNLQRGLR

SEQ ID NO: 14061 - protein, 28 aa, Artificial Sequence
  Description of Artificial Sequence: Synthetic peptide
DEEEIATTNPVATEQYGDVSENLQRGNR

SEQ ID NO: 14062 - protein, 28 aa, Artificial Sequence
  Description of Artificial Sequence: Synthetic peptide
KEEEIRTTNIVATEQYGSVSTNLQRGNL

SEQ ID NO: 14063 - protein, 28 aa, Artificial Sequence
  Description of Artificial Sequence: Synthetic peptide
DEQEIRTTNPVATEQYGSASTNLQHGNR

SEQ ID NO: 14064 - protein, 28 aa, Artificial Sequence
  Description of Artificial Sequence: Synthetic peptide
DEQEIRTTNPVATEQYGSVSENLQHGNR

SEQ ID NO: 14065 - protein, 28 aa, Artificial Sequence
  Description of Artificial Sequence: Synthetic peptide
NEEEIVTTNPVATEQYGAVSTNLQRGNR

SEQ ID NO: 14066 - protein, 28 aa, Artificial Sequence
  Description of Artificial Sequence: Synthetic peptide
DEEEIRTTNPVATEQYGSVSVDLQRGNQ

SEQ ID NO: 14067 - protein, 28 aa, Artificial Sequence
  Description of Artificial Sequence: Synthetic peptide
DEEEIRTTNIISTEQYGSVSTNLQRGNR

SEQ ID NO: 14068 - protein, 28 aa, Artificial Sequence
  Description of Artificial Sequence: Synthetic peptide
DEEEIRTTNIVSTEQYGSVSTSLQRGNR

SEQ ID NO: 14069 - protein, 29 aa, Artificial Sequence
  Description of Artificial Sequence: Synthetic peptide
DEEEIRTTNPVATEQYGSVSTNLQWFGND

SEQ ID NO: 14070 - protein, 28 aa, Artificial Sequence
  Description of Artificial Sequence: Synthetic peptide
DESEIRTTNPVATEQYGSVSTNLQYGNI

SEQ ID NO: 14071 - protein, 29 aa, Artificial Sequence
  Description of Artificial Sequence: Synthetic peptide
SEEEIRTTNPVATEQYGSVSTNLQERGNL

SEQ ID NO: 14072 - protein, 28 aa, Artificial Sequence
  Description of Artificial Sequence: Synthetic peptide
DEEEIRTTNPAATEQYGSVSTNWQRGTR

SEQ ID NO: 14073 - protein, 28 aa, Artificial Sequence
  Description of Artificial Sequence: Synthetic peptide
VEEEIRTTNPVATEQYGSVSHNLQRGNP

SEQ ID NO: 14074 - protein, 29 aa, Artificial Sequence
  Description of Artificial Sequence: Synthetic peptide
DEEEIRTTNPVATEQYGSVSTGPLDRGNR

SEQ ID NO: 14075 - protein, 28 aa, Artificial Sequence
  Description of Artificial Sequence: Synthetic peptide
EEEEIRTTNPVATEQYGSVSDNLQRGNS

SEQ ID NO: 14076 - protein, 28 aa, Artificial Sequence
  Description of Artificial Sequence: Synthetic peptide
DEAEIRTTNPCSTEQYGSVSTNLQRGNR

SEQ ID NO: 14077 - protein, 29 aa, Artificial Sequence
  Description of Artificial Sequence: Synthetic peptide
DEEEIRTTNPVATEQYGSVSTNLQNGDNQ

SEQ ID NO: 14078 - protein, 28 aa, Artificial Sequence
  Description of Artificial Sequence: Synthetic peptide
DEEEIRTTNIVATEQYGFVSTNLQRGNH

SEQ ID NO: 14079 - protein, 30 aa, Artificial Sequence
  Description of Artificial Sequence: Synthetic polypeptide
DEEEIRTTNPVATEQYGSVSTNLEEREGNR

SEQ ID NO: 14080 - protein, 29 aa, Artificial Sequence
  Description of Artificial Sequence: Synthetic peptide
DEEEIVTTNPVATEGYGSVSTNLQRAGNR

SEQ ID NO: 14081 - protein, 28 aa, Artificial Sequence
  Description of Artificial Sequence: Synthetic peptide
DENEIRTTNPVATEQYGSVSTNLQQGNW

SEQ ID NO: 14082 - protein, 28 aa, Artificial Sequence
  Description of Artificial Sequence: Synthetic peptide
DEEEIRTTNPVAWEQYGSWSTNGQRGNR

SEQ ID NO: 14083 - protein, 28 aa, Artificial Sequence
  Description of Artificial Sequence: Synthetic peptide
SEEEIRTTNPVATEQYGSVSENLQFGNR

SEQ ID NO: 14084 - protein, 28 aa, Artificial Sequence
  Description of Artificial Sequence: Synthetic peptide
DEEEIRTTNPVATEQYGSVSTDLQSGND

SEQ ID NO: 14085 - protein, 30 aa, Artificial Sequence
  Description of Artificial Sequence: Synthetic polypeptide
DEEEIRTTNPVATEQYGSVSTPLVQRGNPR

SEQ ID NO: 14086 - protein, 28 aa, Artificial Sequence
  Description of Artificial Sequence: Synthetic peptide
DEEEIRTTNPVATEVYGSVSDELQRGNR

SEQ ID NO: 14087 - protein, 28 aa, Artificial Sequence
  Description of Artificial Sequence: Synthetic peptide
AEEEIRTTNPVCTEQYGSVSTNLQRGND

SEQ ID NO: 14088 - protein, 28 aa, Artificial Sequence
  Description of Artificial Sequence: Synthetic peptide
DEEEIRTTNPVATEQYGSVSTNELRENR

SEQ ID NO: 14089 - protein, 28 aa, Artificial Sequence
  Description of Artificial Sequence: Synthetic peptide
DEEEIRTTNPVATEQWGSVSENLQRGNS

SEQ ID NO: 14090 - protein, 28 aa, Artificial Sequence
  Description of Artificial Sequence: Synthetic peptide
DEEEIRTTNPVATEQYGQVVTDLQRGNR

SEQ ID NO: 14091 - protein, 29 aa, Artificial Sequence
  Description of Artificial Sequence: Synthetic peptide
DEEEIRTTNPVATEQYGSVSTNLQCAGNN

SEQ ID NO: 14092 - protein, 28 aa, Artificial Sequence
  Description of Artificial Sequence: Synthetic peptide
DEEEIRTTNPVATEQYGSVSENLQFGNI

SEQ ID NO: 14093 - protein, 28 aa, Artificial Sequence
  Description of Artificial Sequence: Synthetic peptide
DEEEIRTTNIVAQEQYGSVSTNLQLGNR

SEQ ID NO: 14094 - protein, 28 aa, Artificial Sequence
  Description of Artificial Sequence: Synthetic peptide
DEEEIRTTNIVATEQYGCVSTNLQRMNR

SEQ ID NO: 14095 - protein, 29 aa, Artificial Sequence
  Description of Artificial Sequence: Synthetic peptide
DEEEIRTTNPVATEQYGSVSENELQRGNH

SEQ ID NO: 14096 - protein, 28 aa, Artificial Sequence
  Description of Artificial Sequence: Synthetic peptide
DEEEIRTTNPVATEQYGSVSTNLQYGEH

SEQ ID NO: 14097 - protein, 28 aa, Artificial Sequence
  Description of Artificial Sequence: Synthetic peptide
DEEEIRTTNPVATEQYGSVSNNLERGNH

SEQ ID NO: 14098 - protein, 28 aa, Artificial Sequence
  Description of Artificial Sequence: Synthetic peptide
DEEEIRTVNPVATEQYGSVSTNLQLGNF

SEQ ID NO: 14099 - protein, 28 aa, Artificial Sequence
  Description of Artificial Sequence: Synthetic peptide
DEEEIRTTNPVAMEQWGSVSTNEQRGNR

SEQ ID NO: 14100 - protein, 28 aa, Artificial Sequence
  Description of Artificial Sequence: Synthetic peptide
DEEEIRTTNPVATEQYGCVSTNYQRINR

SEQ ID NO: 14101 - protein, 29 aa, Artificial Sequence
  Description of Artificial Sequence: Synthetic peptide
DEEEIRTTNPVATEQFGSVSTANPQRGNR

SEQ ID NO: 14102 - protein, 28 aa, Artificial Sequence
  Description of Artificial Sequence: Synthetic peptide
DEEEIRTTNPVATENYGSVSTNPQRGNP

SEQ ID NO: 14103 - protein, 28 aa, Artificial Sequence
  Description of Artificial Sequence: Synthetic peptide
DEEEIRTTNPTATEQYGSVSTNLQFGDR

SEQ ID NO: 14104 - protein, 28 aa, Artificial Sequence
  Description of Artificial Sequence: Synthetic peptide
DEEEIRTTNPVATEQYGDVSTNLQRGTG

SEQ ID NO: 14105 - protein, 28 aa, Artificial Sequence
  Description of Artificial Sequence: Synthetic peptide
DEEEIRATNPVATEQYGVVSTNLQRGNT

SEQ ID NO: 14106 - protein, 28 aa, Artificial Sequence
  Description of Artificial Sequence: Synthetic peptide
DEEEIRTTNPVATEQYGCVSTNLQRGPI

SEQ ID NO: 14107 - protein, 28 aa, Artificial Sequence
  Description of Artificial Sequence: Synthetic peptide
DEEEIRTTNPVATETYGSVSTNLQRGTQ

SEQ ID NO: 14108 - protein, 28 aa, Artificial Sequence
  Description of Artificial Sequence: Synthetic peptide
DEEEIRTTNPTATEQYGSVSTNLQIGNQ

SEQ ID NO: 14109 - protein, 28 aa, Artificial Sequence
  Description of Artificial Sequence: Synthetic peptide
DEQEIRTTNPVATEQYGEVSYNLQRGNR

SEQ ID NO: 14110 - protein, 28 aa, Artificial Sequence
  Description of Artificial Sequence: Synthetic peptide
DEEEIRTTNPVATEQYGSVSEDDQRGNR

SEQ ID NO: 14111 - protein, 28 aa, Artificial Sequence
  Description of Artificial Sequence: Synthetic peptide
DEEEISTTNPVATEQYGSVSENLQRENR

SEQ ID NO: 14112 - protein, 28 aa, Artificial Sequence
  Description of Artificial Sequence: Synthetic peptide
DEEEIATTNPVATEQYGSVSEELQRGNR

SEQ ID NO: 14113 - protein, 28 aa, Artificial Sequence
  Description of Artificial Sequence: Synthetic peptide
DQEEIRTTNIVATEQYGSVSTNLQIGNR

SEQ ID NO: 14114 - protein, 28 aa, Artificial Sequence
  Description of Artificial Sequence: Synthetic peptide
DEEEIRTTNPVAYEQYGVVSTNLQVGNR

SEQ ID NO: 14115 - protein, 28 aa, Artificial Sequence
  Description of Artificial Sequence: Synthetic peptide
DEEEIRTTNPVATEQYGEVSCNLQRENR

SEQ ID NO: 14116 - protein, 28 aa, Artificial Sequence
  Description of Artificial Sequence: Synthetic peptide
DEEEIRTTNIVATEQYGGVSTNLQRGGR

SEQ ID NO: 14117 - protein, 28 aa, Artificial Sequence
  Description of Artificial Sequence: Synthetic peptide
DEEEIATTNPTATEQYGSVSTNLQRGNA

SEQ ID NO: 14118 - protein, 28 aa, Artificial Sequence
  Description of Artificial Sequence: Synthetic peptide
DEEEIATTNPVATEQYGEVSTNLQRGGR

SEQ ID NO: 14119 - protein, 28 aa, Artificial Sequence
  Description of Artificial Sequence: Synthetic peptide
DECEIRTTNPVATEQYGSVSDNLQRGER

SEQ ID NO: 14120 - protein, 28 aa, Artificial Sequence
  Description of Artificial Sequence: Synthetic peptide
DEEEIRTTNPVATENYGSVSTNEQRGDR

SEQ ID NO: 14121 - protein, 28 aa, Artificial Sequence
  Description of Artificial Sequence: Synthetic peptide
SEDEIRTTNPVATEQYGSVSENLQRGNR

SEQ ID NO: 14122 - protein, 28 aa, Artificial Sequence
  Description of Artificial Sequence: Synthetic peptide
DEEEIRTTNPVATEQYGSVSTNLQMGDL

SEQ ID NO: 14123 - protein, 28 aa, Artificial Sequence
  Description of Artificial Sequence: Synthetic peptide
DEEEIRTTEIVATEQYGSVSTELQRGNR

SEQ ID NO: 14124 - protein, 28 aa, Artificial Sequence
  Description of Artificial Sequence: Synthetic peptide
MEEEIRTTNIVATEQYGSVSTNLQRGNH

SEQ ID NO: 14125 - protein, 28 aa, Artificial Sequence
  Description of Artificial Sequence: Synthetic peptide
DEEEIRTTNPEATETYGSVSTNLQQGNR

SEQ ID NO: 14126 - protein, 28 aa, Artificial Sequence
  Description of Artificial Sequence: Synthetic peptide
DEEEIRTTNPVATEQYGSVSTNLQIGTP

SEQ ID NO: 14127 - protein, 28 aa, Artificial Sequence
  Description of Artificial Sequence: Synthetic peptide
DEEEICTTNPVATEQYGSVSTNLQGGNM

SEQ ID NO: 14128 - protein, 28 aa, Artificial Sequence
  Description of Artificial Sequence: Synthetic peptide
DEEEITTTNPVATEQYGWVSTNLQRGNC

SEQ ID NO: 14129 - protein, 28 aa, Artificial Sequence
  Description of Artificial Sequence: Synthetic peptide
DESEIRAVNPVATEQYGSVSTNLQRGNR

SEQ ID NO: 14130 - protein, 28 aa, Artificial Sequence
  Description of Artificial Sequence: Synthetic peptide
DEEEIRTTNPVATEQYGSVSTNPQNGNG

SEQ ID NO: 14131 - protein, 28 aa, Artificial Sequence
  Description of Artificial Sequence: Synthetic peptide
DEEEIVCTNPVATEHYGSVSTNLQRGNR

SEQ ID NO: 14132 - protein, 29 aa, Artificial Sequence
  Description of Artificial Sequence: Synthetic peptide
DEEEIRTTNPVATEVYGSVSTNLQRGDDR

SEQ ID NO: 14133 - protein, 28 aa, Artificial Sequence
  Description of Artificial Sequence: Synthetic peptide
DEEEIRATNPVATEQYGCVSTNLQRGNF

SEQ ID NO: 14134 - protein, 28 aa, Artificial Sequence
  Description of Artificial Sequence: Synthetic peptide
DEEEIATTNPVATELYGSASTNLQRGNR

SEQ ID NO: 14135 - protein, 30 aa, Artificial Sequence
  Description of Artificial Sequence: Synthetic polypeptide
DEEEIRTTNPVATEQYGSVSATNLEQRGDR

SEQ ID NO: 14136 - protein, 28 aa, Artificial Sequence
  Description of Artificial Sequence: Synthetic peptide
DEEEIRTTNPVSTEQYGSVSTNLQQGTR

SEQ ID NO: 14137 - protein, 28 aa, Artificial Sequence
  Description of Artificial Sequence: Synthetic peptide
DEEEIRTTNPVATEQYGSVSTVCQRGNK

SEQ ID NO: 14138 - protein, 28 aa, Artificial Sequence
  Description of Artificial Sequence: Synthetic peptide
DEEECRTTNPVATEQYGSVSTNLNRGNQ

SEQ ID NO: 14139 - protein, 29 aa, Artificial Sequence
  Description of Artificial Sequence: Synthetic peptide
DEEEIRTTNPVATEQYGSVSENLQMRGNQ

SEQ ID NO: 14140 - protein, 28 aa, Artificial Sequence
  Description of Artificial Sequence: Synthetic peptide
DEEEIRTTNPVATENYGSVSHNDQRGNR

SEQ ID NO: 14141 - protein, 28 aa, Artificial Sequence
  Description of Artificial Sequence: Synthetic peptide
QESEIRTVNPVATEQYGSVSTNLQRGNR

SEQ ID NO: 14142 - protein, 28 aa, Artificial Sequence
  Description of Artificial Sequence: Synthetic peptide
DEEEIRTTNPVATEQYGSVSTNLQTGEA

SEQ ID NO: 14143 - protein, 28 aa, Artificial Sequence
  Description of Artificial Sequence: Synthetic peptide
DEEEIRTTNPAATECYGSVSTNLQRGNT

SEQ ID NO: 14144 - protein, 29 aa, Artificial Sequence
  Description of Artificial Sequence: Synthetic peptide
DEEEIRTTNPVATELYGSVSTNLQCRGNC

SEQ ID NO: 14145 - protein, 28 aa, Artificial Sequence
  Description of Artificial Sequence: Synthetic peptide
DEEEIRTTNPVATEQYGSVSTNPQLGNG

SEQ ID NO: 14146 - protein, 28 aa, Artificial Sequence
  Description of Artificial Sequence: Synthetic peptide
DEEELRTTNPVATEQYGSVSTNFQRGDR

SEQ ID NO: 14147 - protein, 28 aa, Artificial Sequence
  Description of Artificial Sequence: Synthetic peptide
GEEEIRTTNPVATEQYGSAATNLQRGNR

SEQ ID NO: 14148 - protein, 28 aa, Artificial Sequence
  Description of Artificial Sequence: Synthetic peptide
DEEEIATTNPVATEQYGEVSTNLQRGTR

SEQ ID NO: 14149 - protein, 29 aa, Artificial Sequence
  Description of Artificial Sequence: Synthetic peptide
DEEEIRTTNPVATECYGSVSTNLQTGNDR

SEQ ID NO: 14150 - protein, 28 aa, Artificial Sequence
  Description of Artificial Sequence: Synthetic peptide
DEEEIRTTNPTATEQYGSVSTNPQQGNR

SEQ ID NO: 14151 - protein, 29 aa, Artificial Sequence
  Description of Artificial Sequence: Synthetic peptide
DEEEIRTTNPVATEQYGEASTNLQRGNDR

SEQ ID NO: 14152 - protein, 28 aa, Artificial Sequence
  Description of Artificial Sequence: Synthetic peptide
DEEEIRTTNPVATEQYGDYSTNLQQGNR

SEQ ID NO: 14153 - protein, 28 aa, Artificial Sequence
  Description of Artificial Sequence: Synthetic peptide
DEEEIRTTNPVATEQYGSCSTNLQRGQM

SEQ ID NO: 14154 - protein, 29 aa, Artificial Sequence
  Description of Artificial Sequence: Synthetic peptide
KEEEIRTTNPVATECYGSVSTNLQERGNR

SEQ ID NO: 14155 - protein, 28 aa, Artificial Sequence
  Description of Artificial Sequence: Synthetic peptide
DEEEIRTTNPVATEVYGSVSTNLPDGNR

SEQ ID NO: 14156 - protein, 28 aa, Artificial Sequence
  Description of Artificial Sequence: Synthetic peptide
DEEEIRTTNPVATEQYGSVSTNLQGGES

SEQ ID NO: 14157 - protein, 28 aa, Artificial Sequence
  Description of Artificial Sequence: Synthetic peptide
DEEEIRTTNPDATEQYGSVSTCLERGNR

SEQ ID NO: 14158 - protein, 29 aa, Artificial Sequence
  Description of Artificial Sequence: Synthetic peptide
DEEEIRTTNPVATEQYGSVSTNLQTGNDL

SEQ ID NO: 14159 - protein, 28 aa, Artificial Sequence
  Description of Artificial Sequence: Synthetic peptide
DEEEIGTTNPVATEQYGEVSTNLQRGNI

SEQ ID NO: 14160 - protein, 30 aa, Artificial Sequence
  Description of Artificial Sequence: Synthetic polypeptide
DEEEIRTTNPVATEQYGSVSTNLQETKGNR

SEQ ID NO: 14161 - protein, 28 aa, Artificial Sequence
  Description of Artificial Sequence: Synthetic peptide
DEEEICTTNPVATEQYGDASTNLQRGNR

SEQ ID NO: 14162 - protein, 28 aa, Artificial Sequence
  Description of Artificial Sequence: Synthetic peptide
DECEIRTTNPVATEQWGSVSENLQRGNR

SEQ ID NO: 14163 - protein, 28 aa, Artificial Sequence
  Description of Artificial Sequence: Synthetic peptide
DEDEIRTVNPVATEQYGSVSTNLQRGNL

SEQ ID NO: 14164 - protein, 29 aa, Artificial Sequence
  Description of Artificial Sequence: Synthetic peptide
DEEEIRTTNPVATEQYGSVATNLQQRLNR

SEQ ID NO: 14165 - protein, 28 aa, Artificial Sequence
  Description of Artificial Sequence: Synthetic peptide
DEEEIRTTNPVATEQYGSYSTNLQIGDR

SEQ ID NO: 14166 - protein, 28 aa, Artificial Sequence
  Description of Artificial Sequence: Synthetic peptide
DEEEIRTTNIVATETYGSVSTNVQRGNR

SEQ ID NO: 14167 - protein, 28 aa, Artificial Sequence
  Description of Artificial Sequence: Synthetic peptide
SEEEIRATNPVATEQYGSVSTNLQRGNF

SEQ ID NO: 14168 - protein, 28 aa, Artificial Sequence
  Description of Artificial Sequence: Synthetic peptide
DEVEIATTNPVATEQYGSVSTNLQNGNR

SEQ ID NO: 14169 - protein, 28 aa, Artificial Sequence
  Description of Artificial Sequence: Synthetic peptide
QEEEIVTTNPVATEQYGSVSTNLQRGNE

SEQ ID NO: 14170 - protein, 29 aa, Artificial Sequence
  Description of Artificial Sequence: Synthetic peptide
DEEEIRTTNPVATEQYGSVSTDLQEHGNR

SEQ ID NO: 14171 - protein, 28 aa, Artificial Sequence
  Description of Artificial Sequence: Synthetic peptide
DEEEIRTTNPVATEQYGSVSTEEDRGNR

SEQ ID NO: 14172 - protein, 28 aa, Artificial Sequence
  Description of Artificial Sequence: Synthetic peptide
DEEEISTTNPVATEQYGVVSTNLMRGNR

SEQ ID NO: 14173 - protein, 29 aa, Artificial Sequence
  Description of Artificial Sequence: Synthetic peptide
DEDEIRTTNPVATEQYGSVSTNLQDRGTR

SEQ ID NO: 14174 - protein, 29 aa, Artificial Sequence
  Description of Artificial Sequence: Synthetic peptide
FEPEIRTTNPVATEQYGSVSTNLQQRGNR

SEQ ID NO: 14175 - protein, 28 aa, Artificial Sequence
  Description of Artificial Sequence: Synthetic peptide
DEDEITTTNPVCTEQYGSVSTNLQRGNR

SEQ ID NO: 14176 - protein, 29 aa, Artificial Sequence
  Description of Artificial Sequence: Synthetic peptide
DEEEIRTTNPVATEQYGSVSTNLQNKGNA

SEQ ID NO: 14177 - protein, 28 aa, Artificial Sequence
  Description of Artificial Sequence: Synthetic peptide
DEQEIATTNPVATEQYGDVSTNLQRGNR

SEQ ID NO: 14178 - protein, 28 aa, Artificial Sequence
  Description of Artificial Sequence: Synthetic peptide
DEEEIRTVNPVATEQYGSVSTELQPGNR

SEQ ID NO: 14179 - protein, 28 aa, Artificial Sequence
  Description of Artificial Sequence: Synthetic peptide
DEEEIRTTNPVGTEQYGNVSTNLQRGNA

SEQ ID NO: 14180 - protein, 29 aa, Artificial Sequence
  Description of Artificial Sequence: Synthetic peptide
DEEEIRTTNPVATEQFGSVSTNLQNRGDR

SEQ ID NO: 14181 - protein, 28 aa, Artificial Sequence
  Description of Artificial Sequence: Synthetic peptide
DEEEIASTNPVATENYGSVSTNLQRGNR

SEQ ID NO: 14182 - protein, 28 aa, Artificial Sequence
  Description of Artificial Sequence: Synthetic peptide
DEEEIRTTNPVATEQYGSVSTNLMQGNF

SEQ ID NO: 14183 - protein, 28 aa, Artificial Sequence
  Description of Artificial Sequence: Synthetic peptide
DEEEIRTTNPVATEQYGEVSTQLQRGQR

SEQ ID NO: 14184 - protein, 28 aa, Artificial Sequence
  Description of Artificial Sequence: Synthetic peptide
DENEIAQTNPVATEQYGSVSTNLQRGNR

SEQ ID NO: 14185 - protein, 29 aa, Artificial Sequence
  Description of Artificial Sequence: Synthetic peptide
SEEEIVTTNPVATEQYGSVSTNLQNRGNR

SEQ ID NO: 14186 - protein, 28 aa, Artificial Sequence
  Description of Artificial Sequence: Synthetic peptide
DEEEIRTTNPVATEQYGIVSTNLQGGNY

SEQ ID NO: 14187 - protein, 28 aa, Artificial Sequence
  Description of Artificial Sequence: Synthetic peptide
DEEEIRTTNPLATEQYGSSSTNLQRGER

SEQ ID NO: 14188 - protein, 28 aa, Artificial Sequence
  Description of Artificial Sequence: Synthetic peptide
DEEEIRTTNIVATEQYGSVGTNLTRGNR

SEQ ID NO: 14189 - protein, 29 aa, Artificial Sequence
  Description of Artificial Sequence: Synthetic peptide
DEEEIRTTNPVATEQYGSCSTNLQRGDDR

SEQ ID NO: 14190 - protein, 29 aa, Artificial Sequence
  Description of Artificial Sequence: Synthetic peptide
DEEEIRTTNPVATEQYGSVSTTNLQRGPY

SEQ ID NO: 14191 - protein, 28 aa, Artificial Sequence
  Description of Artificial Sequence: Synthetic peptide
DEEEIRTTNIVATEQYGLVSTNLQIGNR

SEQ ID NO: 14192 - protein, 30 aa, Artificial Sequence
  Description of Artificial Sequence: Synthetic polypeptide
NEEEIRTTNPVATEQYGSVSTCNLQRNGNR

SEQ ID NO: 14193 - protein, 28 aa, Artificial Sequence
  Description of Artificial Sequence: Synthetic peptide
DDEEIRATNIVATEQYGSVSTNLQRGNR

SEQ ID NO: 14194 - protein, 28 aa, Artificial Sequence
  Description of Artificial Sequence: Synthetic peptide
DEEEIRTTNPVATELYGSASTNLQRGGR

SEQ ID NO: 14195 - protein, 31 aa, Artificial Sequence
  Description of Artificial Sequence: Synthetic polypeptide
DEEEIRTTNPVATEQYGSVSTNLQCRGVNTR

SEQ ID NO: 14196 - protein, 30 aa, Artificial Sequence
  Description of Artificial Sequence: Synthetic polypeptide
DEQEIRTTNPVATEQYGSVSTNLQRDGDNR

SEQ ID NO: 14197 - protein, 28 aa, Artificial Sequence
  Description of Artificial Sequence: Synthetic peptide
DEEEISTTNPVATEQYGSVSTNLCSGNR

SEQ ID NO: 14198 - protein, 29 aa, Artificial Sequence
  Description of Artificial Sequence: Synthetic peptide
DEEEIRTTNPVATEQYGGVSADNLQRGNR

SEQ ID NO: 14199 - protein, 28 aa, Artificial Sequence
  Description of Artificial Sequence: Synthetic peptide
DEEEISTTNPVATEQYGSVSTNLQIGDR

SEQ ID NO: 14200 - protein, 28 aa, Artificial Sequence
  Description of Artificial Sequence: Synthetic peptide
DEEEIRTTNPTATEQFGSVSENLQRGNR

SEQ ID NO: 14201 - protein, 29 aa, Artificial Sequence
  Description of Artificial Sequence: Synthetic peptide
SEEEIRTTNPVATEIYGSVSTNLQREGNR

SEQ ID NO: 14202 - protein, 28 aa, Artificial Sequence
  Description of Artificial Sequence: Synthetic peptide
DEEEIRQTNPVATEQYGSVSENPQRGNR

SEQ ID NO: 14203 - protein, 28 aa, Artificial Sequence
  Description of Artificial Sequence: Synthetic peptide
DEEEIRTTNPVATECYGSVSTNLENGNR

SEQ ID NO: 14204 - protein, 28 aa, Artificial Sequence
  Description of Artificial Sequence: Synthetic peptide
DEEEIRTTNPVATEQYGSVSEDLQAGNR

SEQ ID NO: 14205 - protein, 31 aa, Artificial Sequence
  Description of Artificial Sequence: Synthetic polypeptide
DEEEIRTTNPVATEQYGSVSTMNLVQRGNDR

SEQ ID NO: 14206 - protein, 28 aa, Artificial Sequence
  Description of Artificial Sequence: Synthetic peptide
DEEEIRTTNPVATEVYGSVSTNLQHGGR

SEQ ID NO: 14207 - protein, 29 aa, Artificial Sequence
  Description of Artificial Sequence: Synthetic peptide
DEEEIVTTNPVATEQYGSVSTNLQQRGNF

SEQ ID NO: 14208 - protein, 28 aa, Artificial Sequence
  Description of Artificial Sequence: Synthetic peptide
MEEEIRTTNPVATEQYGVVSTNLQRGNM

SEQ ID NO: 14209 - protein, 28 aa, Artificial Sequence
  Description of Artificial Sequence: Synthetic peptide
DEEEICTTNPVATEQYGTVSTNLQRGNI

SEQ ID NO: 14210 - protein, 28 aa, Artificial Sequence
  Description of Artificial Sequence: Synthetic peptide
DEEEIRTTNPVATECYGWVSTNLQRGNA

SEQ ID NO: 14211 - protein, 28 aa, Artificial Sequence
  Description of Artificial Sequence: Synthetic peptide
DEEEIRTTNPVASEIYGCVSTNLQRGNR

SEQ ID NO: 14212 - protein, 28 aa, Artificial Sequence
  Description of Artificial Sequence: Synthetic peptide
DEEEIRTTNPVATEQYGSVSTELQYGNF

SEQ ID NO: 14213 - protein, 28 aa, Artificial Sequence
  Description of Artificial Sequence: Synthetic peptide
DEEEIRTTNPVATEQYGSVSESLQRGGR

SEQ ID NO: 14214 - protein, 28 aa, Artificial Sequence
  Description of Artificial Sequence: Synthetic peptide
DEEEIRTTNPVATEQYGSVSTNEQFGNV

SEQ ID NO: 14215 - protein, 28 aa, Artificial Sequence
  Description of Artificial Sequence: Synthetic peptide
DEEEIVTTNPVATEIYGVVSTNLQRGNR

SEQ ID NO: 14216 - protein, 29 aa, Artificial Sequence
  Description of Artificial Sequence: Synthetic peptide
DEEEIRTTNPVATEQYGSVSTNLQVLGNV

SEQ ID NO: 14217 - protein, 29 aa, Artificial Sequence
  Description of Artificial Sequence: Synthetic peptide
DEEEIRTTNPVATEQYGSVSTNLQVYGNH

SEQ ID NO: 14218 - protein, 28 aa, Artificial Sequence
  Description of Artificial Sequence: Synthetic peptide
DEEEIRTTNPVATEQYWSVSTNLQRGEN

SEQ ID NO: 14219 - protein, 28 aa, Artificial Sequence
  Description of Artificial Sequence: Synthetic peptide
DEEEIRTTNPVCTEQYGSVSTELQRGNQ

SEQ ID NO: 14220 - protein, 30 aa, Artificial Sequence
  Description of Artificial Sequence: Synthetic polypeptide
DEEEIRTTNPVATEQYGSVSTNLQRNGEDR

SEQ ID NO: 14221 - protein, 28 aa, Artificial Sequence
  Description of Artificial Sequence: Synthetic peptide
DEEEIRTTNPVATEQYGSVSMNLQAGNE

SEQ ID NO: 14222 - protein, 28 aa, Artificial Sequence
  Description of Artificial Sequence: Synthetic peptide
DEEEIRTTNPVATECWGSVSTNLQIGNR

SEQ ID NO: 14223 - protein, 28 aa, Artificial Sequence
  Description of Artificial Sequence: Synthetic peptide
DEEEIRTVNPVSTEQYGSVSTPLQRGNR

SEQ ID NO: 14224 - protein, 28 aa, Artificial Sequence
  Description of Artificial Sequence: Synthetic peptide
DEEEIRTTNPVCTEQYGSVSTNLQTGNG

SEQ ID NO: 14225 - protein, 28 aa, Artificial Sequence
  Description of Artificial Sequence: Synthetic peptide
DEQEIGTTNIVATEQYGSVSTNLQRGNR

SEQ ID NO: 14226 - protein, 28 aa, Artificial Sequence
  Description of Artificial Sequence: Synthetic peptide
DEEEIRTTNIVATESYGSVSTNLLRGNR

SEQ ID NO: 14227 - protein, 29 aa, Artificial Sequence
  Description of Artificial Sequence: Synthetic peptide
DEEEIRTTNPVATEQYGSVSENLQQAGNR

SEQ ID NO: 14228 - protein, 28 aa, Artificial Sequence
  Description of Artificial Sequence: Synthetic peptide
DEQEIRTTNPVATEQYGSVSENLQQGNR

SEQ ID NO: 14229 - protein, 28 aa, Artificial Sequence
  Description of Artificial Sequence: Synthetic peptide
VEEEISTTNPVATEQYGSVGTNLQRGNR

SEQ ID NO: 14230 - protein, 29 aa, Artificial Sequence
  Description of Artificial Sequence: Synthetic peptide
QEEEIRTTNPVATEQYGSVSENLQRAGNR

SEQ ID NO: 14231 - protein, 29 aa, Artificial Sequence
  Description of Artificial Sequence: Synthetic peptide
SEEEIRTTNPVATEQYGSVSTNPQRGNTR

SEQ ID NO: 14232 - protein, 28 aa, Artificial Sequence
  Description of Artificial Sequence: Synthetic peptide
DEEELRTTNPVATEQYGSVGTNLQRGNW

SEQ ID NO: 14233 - protein, 28 aa, Artificial Sequence
  Description of Artificial Sequence: Synthetic peptide
DEEEIRTTNPVATEQWGSVSTNLQIGNA

SEQ ID NO: 14234 - protein, 28 aa, Artificial Sequence
  Description of Artificial Sequence: Synthetic peptide
DEEEISTTNPVATEQYGGVSENLQRGNR

SEQ ID NO: 14235 - protein, 28 aa, Artificial Sequence
  Description of Artificial Sequence: Synthetic peptide
DEEEIRTTNPVATENYGSVSTNLQRLNQ

SEQ ID NO: 14236 - protein, 29 aa, Artificial Sequence
  Description of Artificial Sequence: Synthetic peptide
DEEEIRTTNPVATEQWGSVSTNLQNRGNF

SEQ ID NO: 14237 - protein, 28 aa, Artificial Sequence
  Description of Artificial Sequence: Synthetic peptide
DEEEIVTTNPVATEQYGSVSTNWQRGNF

SEQ ID NO: 14238 - protein, 28 aa, Artificial Sequence
  Description of Artificial Sequence: Synthetic peptide
DEEEIRATNPVATEQYGSMSDNLQRGNR

SEQ ID NO: 14239 - protein, 28 aa, Artificial Sequence
  Description of Artificial Sequence: Synthetic peptide
DEEEIRTTNPVATEQYGSVSDNLCGGNR

SEQ ID NO: 14240 - protein, 28 aa, Artificial Sequence
  Description of Artificial Sequence: Synthetic peptide
DEEEIRTTNPVATEQYGSVSTNLQHENM

SEQ ID NO: 14241 - protein, 29 aa, Artificial Sequence
  Description of Artificial Sequence: Synthetic peptide
DEEEIRTTNPVATEVYGSVSTNLQHAGNR

SEQ ID NO: 14242 - protein, 31 aa, Artificial Sequence
  Description of Artificial Sequence: Synthetic polypeptide
DEEEIRTTNPVATEQYGSVSETGNLQIRGNR

SEQ ID NO: 14243 - protein, 30 aa, Artificial Sequence
  Description of Artificial Sequence: Synthetic polypeptide
DEEEIRTTNPVATEQYGSVSCTNLQDRGNC

SEQ ID NO: 14244 - protein, 28 aa, Artificial Sequence
  Description of Artificial Sequence: Synthetic peptide
DEEEIRTTNPVATEQYGSVSTNLQRFQQ

SEQ ID NO: 14245 - protein, 28 aa, Artificial Sequence
  Description of Artificial Sequence: Synthetic peptide
DEEEICTTNPVATEQFGSVSTNLQRGNQ

SEQ ID NO: 14246 - protein, 28 aa, Artificial Sequence
  Description of Artificial Sequence: Synthetic peptide
NEEEIRTTNPVATEHYGSVSTNIQRGNR

SEQ ID NO: 14247 - protein, 28 aa, Artificial Sequence
  Description of Artificial Sequence: Synthetic peptide
SDEEIRTTNPVATEQYGSVSDNLQRGNR

SEQ ID NO: 14248 - protein, 28 aa, Artificial Sequence
  Description of Artificial Sequence: Synthetic peptide
DEEEIRTVNPVATEVYGAVSTNLQRGNR

SEQ ID NO: 14249 - protein, 28 aa, Artificial Sequence
  Description of Artificial Sequence: Synthetic peptide
DEGEIRTTNPVATEGYGSVSTNLQRLNR

SEQ ID NO: 14250 - protein, 28 aa, Artificial Sequence
  Description of Artificial Sequence: Synthetic peptide
DEEEIATTNPVATECYGSVSTNLQRGNC

SEQ ID NO: 14251 - protein, 28 aa, Artificial Sequence
  Description of Artificial Sequence: Synthetic peptide
DEMEIRCTNPVATEQYGSVSTNLMRGNR

SEQ ID NO: 14252 - protein, 29 aa, Artificial Sequence
  Description of Artificial Sequence: Synthetic peptide
SEEEIRTTNPVATEQYGSVSTCNLQSGNR

SEQ ID NO: 14253 - protein, 28 aa, Artificial Sequence
  Description of Artificial Sequence: Synthetic peptide
DEGEIRTTNPVATEQYGCVSTNLQRGNN

SEQ ID NO: 14254 - protein, 28 aa, Artificial Sequence
  Description of Artificial Sequence: Synthetic peptide
DEEEIRTTNPVATEQYGSVSAALQRGLR

SEQ ID NO: 14255 - protein, 28 aa, Artificial Sequence
  Description of Artificial Sequence: Synthetic peptide
DEEEIRTTNPVATECYGSVSTNLEQGNR

SEQ ID NO: 14256 - protein, 28 aa, Artificial Sequence
  Description of Artificial Sequence: Synthetic peptide
DEEEIRTVNPVSTEQYGSVSANLQRGNR

SEQ ID NO: 14257 - protein, 28 aa, Artificial Sequence
  Description of Artificial Sequence: Synthetic peptide
GEEEIRTTNIVATEQYGSVSTELQRGNR

SEQ ID NO: 14258 - protein, 28 aa, Artificial Sequence
  Description of Artificial Sequence: Synthetic peptide
DEEEIRATNPVATEQYGDVSTGLQRGNR

SEQ ID NO: 14259 - protein, 28 aa, Artificial Sequence
  Description of Artificial Sequence: Synthetic peptide
DEEEICTTNPVATEQYGSASENLQRGNR

SEQ ID NO: 14260 - protein, 28 aa, Artificial Sequence
  Description of Artificial Sequence: Synthetic peptide
DEEEIATTNPVATEQYGSVSTELQYGNR

SEQ ID NO: 14261 - protein, 28 aa, Artificial Sequence
  Description of Artificial Sequence: Synthetic peptide
DEEEIRTVNCVATEQYGSVSTNLQRGNC

SEQ ID NO: 14262 - protein, 28 aa, Artificial Sequence
  Description of Artificial Sequence: Synthetic peptide
DEEEIRTTNPVATEQYGSVSTDLQVGNH

SEQ ID NO: 14263 - protein, 28 aa, Artificial Sequence
  Description of Artificial Sequence: Synthetic peptide
DEEEIRTTNPIATEQYGSVATNLQRGNF

SEQ ID NO: 14264 - protein, 28 aa, Artificial Sequence
  Description of Artificial Sequence: Synthetic peptide
DEEEIRTTNPVATEQYGSVSTNLQQGEH

SEQ ID NO: 14265 - protein, 28 aa, Artificial Sequence
  Description of Artificial Sequence: Synthetic peptide
DEEEIRTTNIVATENYGVVSTNLQRGNR

SEQ ID NO: 14266 - protein, 30 aa, Artificial Sequence
  Description of Artificial Sequence: Synthetic polypeptide
DEEEIRTTNPVATEQYGSVSTMELQRGNDR

SEQ ID NO: 14267 - protein, 28 aa, Artificial Sequence
  Description of Artificial Sequence: Synthetic peptide
DEEEIRATNPVATEQYGSVSEDLQRGNR

SEQ ID NO: 14268 - protein, 28 aa, Artificial Sequence
  Description of Artificial Sequence: Synthetic peptide
DENEIATTNPVATEQYGSVSTNLQRGNQ

SEQ ID NO: 14269 - protein, 28 aa, Artificial Sequence
  Description of Artificial Sequence: Synthetic peptide
DEEEIRTVNPVATEQYGEVGTNLQRGNR

SEQ ID NO: 14270 - protein, 29 aa, Artificial Sequence
  Description of Artificial Sequence: Synthetic peptide
DEEEIRTTNPVATEQYGSVSTNPQRGNTF

SEQ ID NO: 14271 - protein, 29 aa, Artificial Sequence
  Description of Artificial Sequence: Synthetic peptide
DEEEIRTTNPVATEQYGSVSATNLERGNA

SEQ ID NO: 14272 - protein, 29 aa, Artificial Sequence
  Description of Artificial Sequence: Synthetic peptide
DEEEIRTVNPVATEQYGSVSTNLQTGNDR

SEQ ID NO: 14273 - protein, 30 aa, Artificial Sequence
  Description of Artificial Sequence: Synthetic polypeptide
DEEEIRTTNPVATEHYGSVSTNLQRDGNDR

SEQ ID NO: 14274 - protein, 28 aa, Artificial Sequence
  Description of Artificial Sequence: Synthetic peptide
DEEEIRTTNPVATEQYGSVSEQLQRGNP

SEQ ID NO: 14275 - protein, 30 aa, Artificial Sequence
  Description of Artificial Sequence: Synthetic polypeptide
DEEEIRTTNPVATEQYGSVSTCNLQMGDNR

SEQ ID NO: 14276 - protein, 28 aa, Artificial Sequence
  Description of Artificial Sequence: Synthetic peptide
DEEEIRTTNPVATEQYGSVDTDLQMGNR

SEQ ID NO: 14277 - protein, 28 aa, Artificial Sequence
  Description of Artificial Sequence: Synthetic peptide
DEEEIRATNPVATEQFGSVSENLQRGNR

SEQ ID NO: 14278 - protein, 28 aa, Artificial Sequence
  Description of Artificial Sequence: Synthetic peptide
DEHEIRTTNPVATEQYGDVSTNLQRGNK

SEQ ID NO: 14279 - protein, 28 aa, Artificial Sequence
  Description of Artificial Sequence: Synthetic peptide
DEEEIRTTNPVATEQYGSTSENLQRGNV

SEQ ID NO: 14280 - protein, 28 aa, Artificial Sequence
  Description of Artificial Sequence: Synthetic peptide
DEEEIRTTNPVATECYGSVSTNLQRGPV

SEQ ID NO: 14281 - protein, 30 aa, Artificial Sequence
  Description of Artificial Sequence: Synthetic polypeptide
DEEEIRTTNPVATEQYGSVSTANLQERGNV

SEQ ID NO: 14282 - protein, 28 aa, Artificial Sequence
  Description of Artificial Sequence: Synthetic peptide
DEEEITTTNPVATEQYGSVSTNLQYGNQ

SEQ ID NO: 14283 - protein, 28 aa, Artificial Sequence
  Description of Artificial Sequence: Synthetic peptide
DENEIRTTNPTATEQYGSVSVNLQRGNR

SEQ ID NO: 14284 - protein, 29 aa, Artificial Sequence
  Description of Artificial Sequence: Synthetic peptide
DEEEIRTTNPCATEQYGSVSTNLQRGNDI

SEQ ID NO: 14285 - protein, 28 aa, Artificial Sequence
  Description of Artificial Sequence: Synthetic peptide
DEEEIRTTNPVATEQYGSVSTNAQAGNA

SEQ ID NO: 14286 - protein, 28 aa, Artificial Sequence
  Description of Artificial Sequence: Synthetic peptide
DEQEIRTTNPVATEIYGSVSINLQRGNR

SEQ ID NO: 14287 - protein, 28 aa, Artificial Sequence
  Description of Artificial Sequence: Synthetic peptide
DEEEIRTTNIVATEQYGSVATCLQRGNR

SEQ ID NO: 14288 - protein, 28 aa, Artificial Sequence
  Description of Artificial Sequence: Synthetic peptide
DEEEIRTTNIVATEQYGSVSTVLQYGNR

SEQ ID NO: 14289 - protein, 28 aa, Artificial Sequence
  Description of Artificial Sequence: Synthetic peptide
DEEEIRTTNPVATEQYGSVSTELQDGNY

SEQ ID NO: 14290 - protein, 28 aa, Artificial Sequence
  Description of Artificial Sequence: Synthetic peptide
DEEEIRTTNPVATEQYGSVSTNEQIGNG

SEQ ID NO: 14291 - protein, 29 aa, Artificial Sequence
  Description of Artificial Sequence: Synthetic peptide
DEQEIRTTNPVATEQYGSVSTNLQQRGNH

SEQ ID NO: 14292 - protein, 29 aa, Artificial Sequence
  Description of Artificial Sequence: Synthetic peptide
DEEEIRTTNPVATEQYGSVSTELQNGNDR

SEQ ID NO: 14293 - protein, 28 aa, Artificial Sequence
  Description of Artificial Sequence: Synthetic peptide
DEEEIRTTNIVATELYGVVSTNLQRGNR

SEQ ID NO: 14294 - protein, 28 aa, Artificial Sequence
  Description of Artificial Sequence: Synthetic peptide
DEEEIRTTNPVATEQYGSVSTNLQQGEQ

SEQ ID NO: 14295 - protein, 29 aa, Artificial Sequence
  Description of Artificial Sequence: Synthetic peptide
DEEEIRTTNPVATECYGSVSTNLQRNGNQ

SEQ ID NO: 14296 - protein, 28 aa, Artificial Sequence
  Description of Artificial Sequence: Synthetic peptide
DEEEIRTTNPVAYEQYGSVSHNLQRGNP

SEQ ID NO: 14297 - protein, 29 aa, Artificial Sequence
  Description of Artificial Sequence: Synthetic peptide
DEEEIRTTNPVATEQYGSVSTNLQILGER

SEQ ID NO: 14298 - protein, 28 aa, Artificial Sequence
  Description of Artificial Sequence: Synthetic peptide
DEQEIATTNPVATETYGSVSTNLQRGNR

SEQ ID NO: 14299 - protein, 28 aa, Artificial Sequence
  Description of Artificial Sequence: Synthetic peptide
DEEEIRTTNPVASEIYGAVSTNLQRGNR

SEQ ID NO: 14300 - protein, 28 aa, Artificial Sequence
  Description of Artificial Sequence: Synthetic peptide
DEEEIRCTNIVANEQYGSVSTNLQRGNR

SEQ ID NO: 14301 - protein, 29 aa, Artificial Sequence
  Description of Artificial Sequence: Synthetic peptide
DEEEIRTTNPVATEQYWSVSTNPLQRGNP

SEQ ID NO: 14302 - protein, 29 aa, Artificial Sequence
  Description of Artificial Sequence: Synthetic peptide
DEEEIRTTNPVATEQYGSVSTNLVQRGEI

SEQ ID NO: 14303 - protein, 28 aa, Artificial Sequence
  Description of Artificial Sequence: Synthetic peptide
DEEEIRGTNPVATEQYGSASTILQRGNR

SEQ ID NO: 14304 - protein, 28 aa, Artificial Sequence
  Description of Artificial Sequence: Synthetic peptide
MEEEIRTTNPVATEQYGSVSTNLQIGNM

SEQ ID NO: 14305 - protein, 28 aa, Artificial Sequence
  Description of Artificial Sequence: Synthetic peptide
DEEEIRTTNPVATEQYGSVSTDLETGNR

SEQ ID NO: 14306 - protein, 28 aa, Artificial Sequence
  Description of Artificial Sequence: Synthetic peptide
DEEEIRTTNIVGTEQYGSVSTNLQRGGR

SEQ ID NO: 14307 - protein, 28 aa, Artificial Sequence
  Description of Artificial Sequence: Synthetic peptide
DEEEIRTTNPVATEQYGEVSTVLQRGGR

SEQ ID NO: 14308 - protein, 30 aa, Artificial Sequence
  Description of Artificial Sequence: Synthetic polypeptide
DEEEIRTTNPVATEQYGSVSTNLQVRGENN

SEQ ID NO: 14309 - protein, 28 aa, Artificial Sequence
  Description of Artificial Sequence: Synthetic peptide
MEEEIRTTNPVATEQYGSVSTNLQGGNQ

SEQ ID NO: 14310 - protein, 29 aa, Artificial Sequence
  Description of Artificial Sequence: Synthetic peptide
DEAEIRTTNPVATEVYGSVSTNLQLRGNR

SEQ ID NO: 14311 - protein, 29 aa, Artificial Sequence
  Description of Artificial Sequence: Synthetic peptide
DEEEIRTTNPVATEQYGSVSTNLQEIGNS

SEQ ID NO: 14312 - protein, 29 aa, Artificial Sequence
  Description of Artificial Sequence: Synthetic peptide
DEEEIRTTNPVATEQYGSVSTCNLQLGER

SEQ ID NO: 14313 - protein, 29 aa, Artificial Sequence
  Description of Artificial Sequence: Synthetic peptide
DEEEIRTTNPVATEQYGSVSTNPNQRGER

SEQ ID NO: 14314 - protein, 28 aa, Artificial Sequence
  Description of Artificial Sequence: Synthetic peptide
DEEEIVATNPVATEQYGVVSTNLQRGNR

SEQ ID NO: 14315 - protein, 28 aa, Artificial Sequence
  Description of Artificial Sequence: Synthetic peptide
DEEEIRTTNPVATEQYGDVSENLQRGNL

SEQ ID NO: 14316 - protein, 28 aa, Artificial Sequence
  Description of Artificial Sequence: Synthetic peptide
DEQEIRTTNPVATEQYGSVSTDLDRGNR

SEQ ID NO: 14317 - protein, 28 aa, Artificial Sequence
  Description of Artificial Sequence: Synthetic peptide
TEEEIRTTNPVATEQYGWVSTALQRGNR

SEQ ID NO: 14318 - protein, 28 aa, Artificial Sequence
  Description of Artificial Sequence: Synthetic peptide
DDEEIRTTNPVATECYGSVSTNLQQGNR

SEQ ID NO: 14319 - protein, 28 aa, Artificial Sequence
  Description of Artificial Sequence: Synthetic peptide
DEEEIATTNPVATEQYGCVSTNLQHGNR

SEQ ID NO: 14320 - protein, 28 aa, Artificial Sequence
  Description of Artificial Sequence: Synthetic peptide
DEEEIRTTNPVATEQYGSVSTNPQHGNE

SEQ ID NO: 14321 - protein, 30 aa, Artificial Sequence
  Description of Artificial Sequence: Synthetic polypeptide
DEEEIRTTNPVATEQYGAVSCTNLQQRGNR

SEQ ID NO: 14322 - protein, 28 aa, Artificial Sequence
  Description of Artificial Sequence: Synthetic peptide
DEQEIRTTNPVATEQYGSVSTNLQWGNT

SEQ ID NO: 14323 - protein, 28 aa, Artificial Sequence
  Description of Artificial Sequence: Synthetic peptide
DEEELRATNPVATEQYGSVSTDLQRGNR

SEQ ID NO: 14324 - protein, 28 aa, Artificial Sequence
  Description of Artificial Sequence: Synthetic peptide
DEEEITTTNPVCTEQYGSVSDNLQRGNR

SEQ ID NO: 14325 - protein, 28 aa, Artificial Sequence
  Description of Artificial Sequence: Synthetic peptide
DEEEIRTTNPVATEQYGFVSTNLMRGNQ

SEQ ID NO: 14326 - protein, 28 aa, Artificial Sequence
  Description of Artificial Sequence: Synthetic peptide
DENEIRTTNPVATECYGSVSTNLQRGNT

SEQ ID NO: 14327 - protein, 28 aa, Artificial Sequence
  Description of Artificial Sequence: Synthetic peptide
DEEEIATTNIVATEIYGSVSTNLQRGNR

SEQ ID NO: 14328 - protein, 28 aa, Artificial Sequence
  Description of Artificial Sequence: Synthetic peptide
DEEEICTTNPVATEQYGSVSTNWQRGNF

SEQ ID NO: 14329 - protein, 29 aa, Artificial Sequence
  Description of Artificial Sequence: Synthetic peptide
DEEEIRTTNPVATECYGSVSTNLQAGDNR

SEQ ID NO: 14330 - protein, 29 aa, Artificial Sequence
  Description of Artificial Sequence: Synthetic peptide
DEEEIRTTNPVATEQYGSVSENLQMQGNR

SEQ ID NO: 14331 - protein, 29 aa, Artificial Sequence
  Description of Artificial Sequence: Synthetic peptide
DEEEIATTNPFATEQYGSVDSTNLQRGNR

SEQ ID NO: 14332 - protein, 28 aa, Artificial Sequence
  Description of Artificial Sequence: Synthetic peptide
SEEEIRTTNPTATEQYGSVSTNEQRGNR

SEQ ID NO: 14333 - protein, 28 aa, Artificial Sequence
  Description of Artificial Sequence: Synthetic peptide
DEEEIRTTNPVATEQYGDVSTNLQRGQN

SEQ ID NO: 14334 - protein, 28 aa, Artificial Sequence
  Description of Artificial Sequence: Synthetic peptide
DEEEIRTTNPVATEMYGSVSTNLQRGTV

SEQ ID NO: 14335 - protein, 28 aa, Artificial Sequence
  Description of Artificial Sequence: Synthetic peptide
DEEEIRTTNPVATEQYGDVSTDLQNGNR

SEQ ID NO: 14336 - protein, 28 aa, Artificial Sequence
  Description of Artificial Sequence: Synthetic peptide
DEEEIRTTNPVATEQYGDVSTDLQYGNR

SEQ ID NO: 14337 - protein, 28 aa, Artificial Sequence
  Description of Artificial Sequence: Synthetic peptide
DEEEIRTTNIVATEQYGSVSNILQRGNR

SEQ ID NO: 14338 - protein, 28 aa, Artificial Sequence
  Description of Artificial Sequence: Synthetic peptide
YEEEIFTTNPVATEQYGSVSTNHQRGNR

SEQ ID NO: 14339 - protein, 28 aa, Artificial Sequence
  Description of Artificial Sequence: Synthetic peptide
DEEEIRTTNPDAFEQYGSVSTNLQRFNR

SEQ ID NO: 14340 - protein, 28 aa, Artificial Sequence
  Description of Artificial Sequence: Synthetic peptide
DEHEIRTTNIVATEQYGSVSNNLQRGNR

SEQ ID NO: 14341 - protein, 28 aa, Artificial Sequence
  Description of Artificial Sequence: Synthetic peptide
DEEEIRTTNPVATECYGSVSTNLQRGTL

SEQ ID NO: 14342 - protein, 28 aa, Artificial Sequence
  Description of Artificial Sequence: Synthetic peptide
DEEEIRTTNPVATECYGSVSTNLQIGNQ

SEQ ID NO: 14343 - protein, 28 aa, Artificial Sequence
  Description of Artificial Sequence: Synthetic peptide
DEEEIRTTNPVSTEVYGEVSTNLQRGNR

SEQ ID NO: 14344 - protein, 28 aa, Artificial Sequence
  Description of Artificial Sequence: Synthetic peptide
DEEEIGTTNPVATEQYGEVSDNLQRGNR

SEQ ID NO: 14345 - protein, 28 aa, Artificial Sequence
  Description of Artificial Sequence: Synthetic peptide
DEVEIATTNPVATEQYGSVSTNEQRGNR

SEQ ID NO: 14346 - protein, 28 aa, Artificial Sequence
  Description of Artificial Sequence: Synthetic peptide
DEEEIRATNPVATEQYGWVSTNLERGNR

SEQ ID NO: 14347 - protein, 28 aa, Artificial Sequence
  Description of Artificial Sequence: Synthetic peptide
DETEICTTNPVATEQYGSVSTNLQRGNI

SEQ ID NO: 14348 - protein, 28 aa, Artificial Sequence
  Description of Artificial Sequence: Synthetic peptide
DEEEITTTNPVATEQYGSVDTNLQRGNA

SEQ ID NO: 14349 - protein, 28 aa, Artificial Sequence
  Description of Artificial Sequence: Synthetic peptide
DEEEIRTTNPVASEQYGEVSTNLQAGNR

SEQ ID NO: 14350 - protein, 29 aa, Artificial Sequence
  Description of Artificial Sequence: Synthetic peptide
DEEEIRTTNPVATEQYGDVSENLQNRGNR

SEQ ID NO: 14351 - protein, 30 aa, Artificial Sequence
  Description of Artificial Sequence: Synthetic polypeptide
DEEEIRTTNPVATEQYGSVSTMNLCLRGNR

SEQ ID NO: 14352 - protein, 28 aa, Artificial Sequence
  Description of Artificial Sequence: Synthetic peptide
DEEEIRTTNPVATEQWGSVSTNDQRGNS

SEQ ID NO: 14353 - protein, 28 aa, Artificial Sequence
  Description of Artificial Sequence: Synthetic peptide
DEEEIRTTNPVATEQYGSVSEELQRPNR

SEQ ID NO: 14354 - protein, 28 aa, Artificial Sequence
  Description of Artificial Sequence: Synthetic peptide
DEEEIRATNPVATEQYGGVSTNLQRGTR

SEQ ID NO: 14355 - protein, 28 aa, Artificial Sequence
  Description of Artificial Sequence: Synthetic peptide
QEEEIRTTNPVATEQYGSVSTDLQSGNR

SEQ ID NO: 14356 - protein, 28 aa, Artificial Sequence
  Description of Artificial Sequence: Synthetic peptide
DEEEIATTNPVATEQYGEVSTNLQRSNR

SEQ ID NO: 14357 - protein, 29 aa, Artificial Sequence
  Description of Artificial Sequence: Synthetic peptide
DEEEIRTTNPVATEQYGSVSDNLQRGPNI

SEQ ID NO: 14358 - protein, 28 aa, Artificial Sequence
  Description of Artificial Sequence: Synthetic peptide
CEEEIRTTNPVATEQYGSVSTNLQRPTR

SEQ ID NO: 14359 - protein, 28 aa, Artificial Sequence
  Description of Artificial Sequence: Synthetic peptide
DEEEIRTTNPVATEGYGSVSENLQRANR

SEQ ID NO: 14360 - protein, 28 aa, Artificial Sequence
  Description of Artificial Sequence: Synthetic peptide
MEEEIRTTNPVATEQYGSVSTDLQHGNR

SEQ ID NO: 14361 - protein, 28 aa, Artificial Sequence
  Description of Artificial Sequence: Synthetic peptide
DEEEIRTTNPVATELYGSVSTNLQIGNQ

SEQ ID NO: 14362 - protein, 28 aa, Artificial Sequence
  Description of Artificial Sequence: Synthetic peptide
DEEEIRATNPVATEQYGSVSVNWQRGNR

SEQ ID NO: 14363 - protein, 28 aa, Artificial Sequence
  Description of Artificial Sequence: Synthetic peptide
DEEEIRTTNPTATECFGSVSTNLQRGNR

SEQ ID NO: 14364 - protein, 29 aa, Artificial Sequence
  Description of Artificial Sequence: Synthetic peptide
AEEEIRTTNPVATEQYGIVSTNLQRAGNR

SEQ ID NO: 14365 - protein, 28 aa, Artificial Sequence
  Description of Artificial Sequence: Synthetic peptide
DEEEIRTTNPVATEQYGSVDTELQAGNR

SEQ ID NO: 14366 - protein, 30 aa, Artificial Sequence
  Description of Artificial Sequence: Synthetic polypeptide
DEEEIRTTNPVATEQYGWSVSETNLQRGNY

SEQ ID NO: 14367 - protein, 28 aa, Artificial Sequence
  Description of Artificial Sequence: Synthetic peptide
DEEEIRTTNPVATEAYGSVSENLQRGTR

SEQ ID NO: 14368 - protein, 28 aa, Artificial Sequence
  Description of Artificial Sequence: Synthetic peptide
DEQEIVTTNPVATEQYGTVSTNLQRGNR

SEQ ID NO: 14369 - protein, 28 aa, Artificial Sequence
  Description of Artificial Sequence: Synthetic peptide
GEEEIRTTNPVATEQYGSVSTNLERGER

SEQ ID NO: 14370 - protein, 28 aa, Artificial Sequence
  Description of Artificial Sequence: Synthetic peptide
DEEEIRTTNPVATELYGSVSTNDQRGNY

SEQ ID NO: 14371 - protein, 28 aa, Artificial Sequence
  Description of Artificial Sequence: Synthetic peptide
DEEEIRTTNPTATEQYGSVSTNEQRGNA

SEQ ID NO: 14372 - protein, 28 aa, Artificial Sequence
  Description of Artificial Sequence: Synthetic peptide
NEEEIRTTNPVATEQYGSVSNNLQRGNQ

SEQ ID NO: 14373 - protein, 28 aa, Artificial Sequence
  Description of Artificial Sequence: Synthetic peptide
DEEEIRTTNPVATEQYGDASTNLQRGNQ

SEQ ID NO: 14374 - protein, 29 aa, Artificial Sequence
  Description of Artificial Sequence: Synthetic peptide
DEEEIRTTNPVATEQWGSVSTNLQNRGNM

SEQ ID NO: 14375 - protein, 28 aa, Artificial Sequence
  Description of Artificial Sequence: Synthetic peptide
DEEEIRTTNPVATEQYGDVSTNLCRGNV

SEQ ID NO: 14376 - protein, 28 aa, Artificial Sequence
  Description of Artificial Sequence: Synthetic peptide
DEEEIRTTNPVATEQYGSVSTDLQGGNA

SEQ ID NO: 14377 - protein, 28 aa, Artificial Sequence
  Description of Artificial Sequence: Synthetic peptide
DEEEIRATNPVATEQYGVVSTELQRGNR

SEQ ID NO: 14378 - protein, 28 aa, Artificial Sequence
  Description of Artificial Sequence: Synthetic peptide
DEEEIRTTNPVATEQYGVVSTNPQRGNA

SEQ ID NO: 14379 - protein, 28 aa, Artificial Sequence
  Description of Artificial Sequence: Synthetic peptide
DEEEIRTTNPVATEQYGEVSENLQYGNR

SEQ ID NO: 14380 - protein, 28 aa, Artificial Sequence
  Description of Artificial Sequence: Synthetic peptide
DEEEIRTTNPVAYEPYGSVSNNLQRGNR

SEQ ID NO: 14381 - protein, 28 aa, Artificial Sequence
  Description of Artificial Sequence: Synthetic peptide
SEEEIRTTNPVATEQYGSVSENLQTGNR

SEQ ID NO: 14382 - protein, 28 aa, Artificial Sequence
  Description of Artificial Sequence: Synthetic peptide
DEQEIRTTNIVATEQWGSVSTNLQRGNR

SEQ ID NO: 14383 - protein, 28 aa, Artificial Sequence
  Description of Artificial Sequence: Synthetic peptide
DEEEIVTTNPVATEQYGSVSTNPQRGNH

SEQ ID NO: 14384 - protein, 28 aa, Artificial Sequence
  Description of Artificial Sequence: Synthetic peptide
MEEEIRTTNPVATECYGSVSTNLQRGNM

SEQ ID NO: 14385 - protein, 29 aa, Artificial Sequence
  Description of Artificial Sequence: Synthetic peptide
DEEEIRTTNPVATEQYGSVSENLVQRGNT

SEQ ID NO: 14386 - protein, 29 aa, Artificial Sequence
  Description of Artificial Sequence: Synthetic peptide
DEEEIRTTNPVATEQYGSVSTDLQRGNDV

SEQ ID NO: 14387 - protein, 28 aa, Artificial Sequence
  Description of Artificial Sequence: Synthetic peptide
DEEEIRTTNPVATEQYGSVSTNLCTGNQ

SEQ ID NO: 14388 - protein, 28 aa, Artificial Sequence
  Description of Artificial Sequence: Synthetic peptide
DEVEIRQTNPVATEQYGSVSTNLQRGMR

SEQ ID NO: 14389 - protein, 28 aa, Artificial Sequence
  Description of Artificial Sequence: Synthetic peptide
DEEEIRTTNPVATEQYGSVSTNDIRGNG

SEQ ID NO: 14390 - protein, 28 aa, Artificial Sequence
  Description of Artificial Sequence: Synthetic peptide
DEEEIRTTNICATEQYGLVSTNLQRGNR

SEQ ID NO: 14391 - protein, 28 aa, Artificial Sequence
  Description of Artificial Sequence: Synthetic peptide
DEEEVRTTNPVATEIYGSVATNLQRGNR

SEQ ID NO: 14392 - protein, 29 aa, Artificial Sequence
  Description of Artificial Sequence: Synthetic peptide
DEEEIRATNPVASEQYGSVSATNLQRGNR

SEQ ID NO: 14393 - protein, 28 aa, Artificial Sequence
  Description of Artificial Sequence: Synthetic peptide
MEEEIRTTNPVATEQYGSVSTNPQRENR

SEQ ID NO: 14394 - protein, 30 aa, Artificial Sequence
  Description of Artificial Sequence: Synthetic polypeptide
DEEEIRTTNPVATEQYGSVSFTNLNRTGNR

SEQ ID NO: 14395 - protein, 28 aa, Artificial Sequence
  Description of Artificial Sequence: Synthetic peptide
DEEEIRTTNPVATEQYGSASENLQRGGR

SEQ ID NO: 14396 - protein, 28 aa, Artificial Sequence
  Description of Artificial Sequence: Synthetic peptide
AEEEIGTTNPVATEQYGDVSTNLQRGNR

SEQ ID NO: 14397 - protein, 30 aa, Artificial Sequence
  Description of Artificial Sequence: Synthetic polypeptide
DEEEIRTTNAVATEQYGSVSTNLLQRGNDR

SEQ ID NO: 14398 - protein, 28 aa, Artificial Sequence
  Description of Artificial Sequence: Synthetic peptide
HEEEIATTNPVATEQYGSVSTDLQRGNR

SEQ ID NO: 14399 - protein, 28 aa, Artificial Sequence
  Description of Artificial Sequence: Synthetic peptide
DEEEIRTTNPVATECYGSVSTNLQNGNF

SEQ ID NO: 14400 - protein, 29 aa, Artificial Sequence
  Description of Artificial Sequence: Synthetic peptide
DEEEIRTTNPVATECYGSVSTNLMNRGNR

SEQ ID NO: 14401 - protein, 28 aa, Artificial Sequence
  Description of Artificial Sequence: Synthetic peptide
DEEEIRTTNIVATELYGSVSTDLQRGNR

SEQ ID NO: 14402 - protein, 28 aa, Artificial Sequence
  Description of Artificial Sequence: Synthetic peptide
DDEEISTTNPVATEQYGIVSTNLQRGNR

SEQ ID NO: 14403 - protein, 28 aa, Artificial Sequence
  Description of Artificial Sequence: Synthetic peptide
DEEEIRTTNIVATEMYGEVSTNLQRGNR

SEQ ID NO: 14404 - protein, 28 aa, Artificial Sequence
  Description of Artificial Sequence: Synthetic peptide
DEEEIRTTNPCCTEQYGDVSTNLQRGNR

SEQ ID NO: 14405 - protein, 29 aa, Artificial Sequence
  Description of Artificial Sequence: Synthetic peptide
DEEEIRTTNPVATEQYGSVSTELDRGNER

SEQ ID NO: 14406 - protein, 28 aa, Artificial Sequence
  Description of Artificial Sequence: Synthetic peptide
DEEEIRTTNPVATEQYGSVSENEQRGNA

SEQ ID NO: 14407 - protein, 28 aa, Artificial Sequence
  Description of Artificial Sequence: Synthetic peptide
DEEEIRTTNPVATEQWGSVSTNLERGDR

SEQ ID NO: 14408 - protein, 28 aa, Artificial Sequence
  Description of Artificial Sequence: Synthetic peptide
DEEEIRTTNPAATEQYGEVSTNLQQGNR

SEQ ID NO: 14409 - protein, 28 aa, Artificial Sequence
  Description of Artificial Sequence: Synthetic peptide
DEEEIRTTNPVATEQYGVVSTDLQNGNR

SEQ ID NO: 14410 - protein, 28 aa, Artificial Sequence
  Description of Artificial Sequence: Synthetic peptide
DEEEIRTTNPVATEQYGGVSTNLERGNH

SEQ ID NO: 14411 - protein, 28 aa, Artificial Sequence
  Description of Artificial Sequence: Synthetic peptide
DEEEIRTTNPVCTEQYGSVSTNGQRGND

SEQ ID NO: 14412 - protein, 28 aa, Artificial Sequence
  Description of Artificial Sequence: Synthetic peptide
DEEEIRTTNPVATEQYGSVSTELQEGNW

SEQ ID NO: 14413 - protein, 28 aa, Artificial Sequence
  Description of Artificial Sequence: Synthetic peptide
DEEEIRTTNPVATEQYGVVSENLQRGNF

SEQ ID NO: 14414 - protein, 28 aa, Artificial Sequence
  Description of Artificial Sequence: Synthetic peptide
DEEEISTTNPVATENYGEVSTNLQRGNR

SEQ ID NO: 14415 - protein, 28 aa, Artificial Sequence
  Description of Artificial Sequence: Synthetic peptide
DEEEIRTTNPVASEQYGSVGTNLQRGNQ

SEQ ID NO: 14416 - protein, 28 aa, Artificial Sequence
  Description of Artificial Sequence: Synthetic peptide
DEEEIRTTNPVATEQYGVVSENLQRGNT

SEQ ID NO: 14417 - protein, 28 aa, Artificial Sequence
  Description of Artificial Sequence: Synthetic peptide
DEEEIRTTNPVATEQFGSVSTNLQNGNG

SEQ ID NO: 14418 - protein, 28 aa, Artificial Sequence
  Description of Artificial Sequence: Synthetic peptide
DESEINTTNPVATEQYGDVSTNLQRGNR

SEQ ID NO: 14419 - protein, 28 aa, Artificial Sequence
  Description of Artificial Sequence: Synthetic peptide
DEEEIRCTNIFATEQYGSVSTNLQRGNR

SEQ ID NO: 14420 - protein, 28 aa, Artificial Sequence
  Description of Artificial Sequence: Synthetic peptide
DEEEIRTTNPVATEQYGSVSENLQRGMG

SEQ ID NO: 14421 - protein, 30 aa, Artificial Sequence
  Description of Artificial Sequence: Synthetic polypeptide
DEEEIRTTNPVATEQYGVVSTNLQRKGENR

SEQ ID NO: 14422 - protein, 28 aa, Artificial Sequence
  Description of Artificial Sequence: Synthetic peptide
DEDEIRTTNPVATEQYGSVSTNLQNGNW

SEQ ID NO: 14423 - protein, 28 aa, Artificial Sequence
  Description of Artificial Sequence: Synthetic peptide
DEEEIRTVNPVATEQYGSVSTALQHGNR

SEQ ID NO: 14424 - protein, 28 aa, Artificial Sequence
  Description of Artificial Sequence: Synthetic peptide
DEEEIRTTNPVATEQYGSVSTNPQLGNE

SEQ ID NO: 14425 - protein, 28 aa, Artificial Sequence
  Description of Artificial Sequence: Synthetic peptide
DEEEIRTTNPVATEQYGSVSTDLQPGNV

SEQ ID NO: 14426 - protein, 28 aa, Artificial Sequence
  Description of Artificial Sequence: Synthetic peptide
DEEEIRTTNPVATEQYGSVSTNLQYGEQ

SEQ ID NO: 14427 - protein, 28 aa, Artificial Sequence
  Description of Artificial Sequence: Synthetic peptide
DEEEIRTVNPVATEQYGSVSDNLQHGNR

SEQ ID NO: 14428 - protein, 28 aa, Artificial Sequence
  Description of Artificial Sequence: Synthetic peptide
SEEEIATTNPVATEQFGSVSTNLQRGNR

SEQ ID NO: 14429 - protein, 28 aa, Artificial Sequence
  Description of Artificial Sequence: Synthetic peptide
DEMEICTTNPVATEQYGSVSENLQRGNR

SEQ ID NO: 14430 - protein, 28 aa, Artificial Sequence
  Description of Artificial Sequence: Synthetic peptide
DEQEIRTTNPVATEVYGSVSTNLQVGNR

SEQ ID NO: 14431 - protein, 28 aa, Artificial Sequence
  Description of Artificial Sequence: Synthetic peptide
DEEEIRTTNPVATEQYGSVSENLQFGVR

SEQ ID NO: 14432 - protein, 28 aa, Artificial Sequence
  Description of Artificial Sequence: Synthetic peptide
QEEEIATTNPVATEQYGSVSTNLQRGNL

SEQ ID NO: 14433 - protein, 28 aa, Artificial Sequence
  Description of Artificial Sequence: Synthetic peptide
DEEEIRTTNPVATECYGSVSTNLQQGNQ

SEQ ID NO: 14434 - protein, 31 aa, Artificial Sequence
  Description of Artificial Sequence: Synthetic polypeptide
DEEEIRTTNPVATEQYGSVCSDTNLQIRGNR

SEQ ID NO: 14435 - protein, 28 aa, Artificial Sequence
  Description of Artificial Sequence: Synthetic peptide
DEEEIRTTNPVATEQYGEVSENLQRGER

SEQ ID NO: 14436 - protein, 28 aa, Artificial Sequence
  Description of Artificial Sequence: Synthetic peptide
DEEEIRQTNPVATEQYGEVSTNLQEGNR

SEQ ID NO: 14437 - protein, 28 aa, Artificial Sequence
  Description of Artificial Sequence: Synthetic peptide
DEEEIRTTNPVATEVYGNVSENLQRGNR

SEQ ID NO: 14438 - protein, 28 aa, Artificial Sequence
  Description of Artificial Sequence: Synthetic peptide
DEEEIRTTNPVATEQYGSVSENLQRGDI

SEQ ID NO: 14439 - protein, 28 aa, Artificial Sequence
  Description of Artificial Sequence: Synthetic peptide
DEEEIRTTNPVATEQYGSVSTELQIGNY

SEQ ID NO: 14440 - protein, 29 aa, Artificial Sequence
  Description of Artificial Sequence: Synthetic peptide
DTEEIRTTNPVATEQYGSVHTNLQRDGNR

SEQ ID NO: 14441 - protein, 28 aa, Artificial Sequence
  Description of Artificial Sequence: Synthetic peptide
DEEEIRTTNPVATELYGSVSTNLQRGTQ

SEQ ID NO: 14442 - protein, 29 aa, Artificial Sequence
  Description of Artificial Sequence: Synthetic peptide
DEEEIRTTNPVATEQYGSVSENLMNRGNR

SEQ ID NO: 14443 - protein, 29 aa, Artificial Sequence
  Description of Artificial Sequence: Synthetic peptide
DEEEIRTTNPVATECYGSVSTELQIRGNR

SEQ ID NO: 14444 - protein, 29 aa, Artificial Sequence
  Description of Artificial Sequence: Synthetic peptide
DEEEIRTTNPVATEQYGSVSTGALQRGNA

SEQ ID NO: 14445 - protein, 29 aa, Artificial Sequence
  Description of Artificial Sequence: Synthetic peptide
DEEEIRTTNPVATEQYGSVSTNPQRGPNQ

SEQ ID NO: 14446 - protein, 28 aa, Artificial Sequence
  Description of Artificial Sequence: Synthetic peptide
DEEEIRTTNIVCTEQYGSVSTNLQRGMR

SEQ ID NO: 14447 - protein, 28 aa, Artificial Sequence
  Description of Artificial Sequence: Synthetic peptide
DEEEIRTTNPVATEQYGSVSTNDQHGNL

SEQ ID NO: 14448 - protein, 28 aa, Artificial Sequence
  Description of Artificial Sequence: Synthetic peptide
DEEEIRTTNPVATEQYGSVSTNPQIGNL

SEQ ID NO: 14449 - protein, 28 aa, Artificial Sequence
  Description of Artificial Sequence: Synthetic peptide
DEEEIRTTNPVATEQYGSVSTNEDRGMR

SEQ ID NO: 14450 - protein, 28 aa, Artificial Sequence
  Description of Artificial Sequence: Synthetic peptide
DEEEIRTTNPVATEQYGDVSINLQNGNR

SEQ ID NO: 14451 - protein, 28 aa, Artificial Sequence
  Description of Artificial Sequence: Synthetic peptide
GEEEIRTTNIVATEQYGSVSTGLQRGNR

SEQ ID NO: 14452 - protein, 28 aa, Artificial Sequence
  Description of Artificial Sequence: Synthetic peptide
DEEEIRTTNPVATEQYGSVSTDLQTGNA

SEQ ID NO: 14453 - protein, 28 aa, Artificial Sequence
  Description of Artificial Sequence: Synthetic peptide
HEEEISTTNPVATEQYGSVSTNLQRLNR

SEQ ID NO: 14454 - protein, 28 aa, Artificial Sequence
  Description of Artificial Sequence: Synthetic peptide
DEEEIRTTNPVATECYGSVSTDLERGNR

SEQ ID NO: 14455 - protein, 28 aa, Artificial Sequence
  Description of Artificial Sequence: Synthetic peptide
MEEEIRTTNPVATEQYGSVSTNLQSGNL

SEQ ID NO: 14456 - protein, 28 aa, Artificial Sequence
  Description of Artificial Sequence: Synthetic peptide
DEEEIRTTNPVATEQWGDVSTNLQQGNR

SEQ ID NO: 14457 - protein, 30 aa, Artificial Sequence
  Description of Artificial Sequence: Synthetic polypeptide
DEEEIRTTNPVATEQYGSVSTNLQLRGENV

SEQ ID NO: 14458 - protein, 28 aa, Artificial Sequence
  Description of Artificial Sequence: Synthetic peptide
DESEIRTTNPVATEQYGSVSTNLQFGMR

SEQ ID NO: 14459 - protein, 28 aa, Artificial Sequence
  Description of Artificial Sequence: Synthetic peptide
DEEHTRTTNPVATEQYGSVSTNLQRGNV

SEQ ID NO: 14460 - protein, 31 aa, Artificial Sequence
  Description of Artificial Sequence: Synthetic polypeptide
DEEEIRTTNPVATEQYGSVSTENLQDREGNR

SEQ ID NO: 14461 - protein, 29 aa, Artificial Sequence
  Description of Artificial Sequence: Synthetic peptide
DEEEIRTTNPVATECYGSVSTNLQHNGNR

SEQ ID NO: 14462 - protein, 30 aa, Artificial Sequence
  Description of Artificial Sequence: Synthetic polypeptide
DEEEIRTTNPVATEQYGSVSTNLQLRGNDQ

SEQ ID NO: 14463 - protein, 28 aa, Artificial Sequence
  Description of Artificial Sequence: Synthetic peptide
KEEEIRTTNPVATEQYGTVSTELQRGNR

SEQ ID NO: 14464 - protein, 28 aa, Artificial Sequence
  Description of Artificial Sequence: Synthetic peptide
MEEEIRTTNPVATEQYGSCSENLQRGNR

SEQ ID NO: 14465 - protein, 28 aa, Artificial Sequence
  Description of Artificial Sequence: Synthetic peptide
DEEEIRTTNPVATEPYGSVSANLERGNR

SEQ ID NO: 14466 - protein, 28 aa, Artificial Sequence
  Description of Artificial Sequence: Synthetic peptide
DEEEIVTTNPVATECYGSVSTNLQRGNE

SEQ ID NO: 14467 - protein, 30 aa, Artificial Sequence
  Description of Artificial Sequence: Synthetic polypeptide
DEEEIRTTNPVATEQYGSVSTMNEQDRGNR

SEQ ID NO: 14468 - protein, 28 aa, Artificial Sequence
  Description of Artificial Sequence: Synthetic peptide
DEEEIRTTNPVAVEQYGSVSENLQRGNQ

SEQ ID NO: 14469 - protein, 28 aa, Artificial Sequence
  Description of Artificial Sequence: Synthetic peptide
QEEEICTTNPVATEQYGSVSTNLQRGNF

SEQ ID NO: 14470 - protein, 28 aa, Artificial Sequence
  Description of Artificial Sequence: Synthetic peptide
DEEEIATTNPTATEQYGSVSTNEQRGNR

SEQ ID NO: 14471 - protein, 28 aa, Artificial Sequence
  Description of Artificial Sequence: Synthetic peptide
DEEEIRTTNPVATEQYGSVDENLQRGNV

SEQ ID NO: 14472 - protein, 29 aa, Artificial Sequence
  Description of Artificial Sequence: Synthetic peptide
QEEEIRTTNPVATEQYGSVSAENLQRGNR

SEQ ID NO: 14473 - protein, 28 aa, Artificial Sequence
  Description of Artificial Sequence: Synthetic peptide
DEEEIMCTNPVASEQYGSVSTNLQRGNR

SEQ ID NO: 14474 - protein, 28 aa, Artificial Sequence
  Description of Artificial Sequence: Synthetic peptide
DEEEIRTTNIVATEQYGCVDTNLQRGNR

SEQ ID NO: 14475 - protein, 28 aa, Artificial Sequence
  Description of Artificial Sequence: Synthetic peptide
DEEEIRTTNPVATEQYGSVSTNPQRGDN

SEQ ID NO: 14476 - protein, 28 aa, Artificial Sequence
  Description of Artificial Sequence: Synthetic peptide
DEEEIRTTNPCATELYGSVSENLQRGNR

SEQ ID NO: 14477 - protein, 28 aa, Artificial Sequence
  Description of Artificial Sequence: Synthetic peptide
DEEEIRTTNPVATEQYGEVPTNLQRGGR

SEQ ID NO: 14478 - protein, 28 aa, Artificial Sequence
  Description of Artificial Sequence: Synthetic peptide
DEEEIRTTNIVATEQYGSVRTNLERGNR

SEQ ID NO: 14479 - protein, 30 aa, Artificial Sequence
  Description of Artificial Sequence: Synthetic polypeptide
DEEEIRTTNPVATEQYGSVSTNLQENQGNR

SEQ ID NO: 14480 - protein, 28 aa, Artificial Sequence
  Description of Artificial Sequence: Synthetic peptide
DESEVRTTNPVATEQYGSVSDNLQRGNR

SEQ ID NO: 14481 - protein, 29 aa, Artificial Sequence
  Description of Artificial Sequence: Synthetic peptide
DEEEIRTTNPVATEQYGSVASTDLQRGER

SEQ ID NO: 14482 - protein, 28 aa, Artificial Sequence
  Description of Artificial Sequence: Synthetic peptide
DEQEIRTTNPVATEQYGEVSTNLQRGNF

SEQ ID NO: 14483 - protein, 29 aa, Artificial Sequence
  Description of Artificial Sequence: Synthetic peptide
DEEEIRTTNPVATEQYGSVDTNLQFNGNR

SEQ ID NO: 14484 - protein, 28 aa, Artificial Sequence
  Description of Artificial Sequence: Synthetic peptide
DEEEIRTTNIVATEQYGDVSMNLQRGNR

SEQ ID NO: 14485 - protein, 28 aa, Artificial Sequence
  Description of Artificial Sequence: Synthetic peptide
DEEEIRTTNPVATEQYGSVSTNDDIGNR

SEQ ID NO: 14486 - protein, 28 aa, Artificial Sequence
  Description of Artificial Sequence: Synthetic peptide
DEEEIRTTNPVATEQYGIVSTNLMRGDR

SEQ ID NO: 14487 - protein, 28 aa, Artificial Sequence
  Description of Artificial Sequence: Synthetic peptide
DEEEIRATNPVATEVYGSTSTNLQRGNR

SEQ ID NO: 14488 - protein, 28 aa, Artificial Sequence
  Description of Artificial Sequence: Synthetic peptide
DEEEIGTTNPVATEQYGEVSTNLQGGNR

SEQ ID NO: 14489 - protein, 28 aa, Artificial Sequence
  Description of Artificial Sequence: Synthetic peptide
DEEEIRTTNPCATEQWGSVSENLQRGNR

SEQ ID NO: 14490 - protein, 28 aa, Artificial Sequence
  Description of Artificial Sequence: Synthetic peptide
QEEEIRTTNPTATEQYGSVSTNEQRGNR

SEQ ID NO: 14491 - protein, 28 aa, Artificial Sequence
  Description of Artificial Sequence: Synthetic peptide
DEEEINTTNPVATEQYGEVSTILQRGNR

SEQ ID NO: 14492 - protein, 29 aa, Artificial Sequence
  Description of Artificial Sequence: Synthetic peptide
DEEEIRTTNPVATECYGSVSENLQREGNR

SEQ ID NO: 14493 - protein, 28 aa, Artificial Sequence
  Description of Artificial Sequence: Synthetic peptide
NDQEIRTTNPVATEQYGSVSTNLQRGNR

SEQ ID NO: 14494 - protein, 28 aa, Artificial Sequence
  Description of Artificial Sequence: Synthetic peptide
DEEEIRTTNPVATEQYGSVSENLQTGNT

SEQ ID NO: 14495 - protein, 28 aa, Artificial Sequence
  Description of Artificial Sequence: Synthetic peptide
DEEEIRTTNIVATEQYGGVSTGLQRGNR

SEQ ID NO: 14496 - protein, 29 aa, Artificial Sequence
  Description of Artificial Sequence: Synthetic peptide
DEEEIRTTNPVATEQYGSVSTNLPEHGNR

SEQ ID NO: 14497 - protein, 28 aa, Artificial Sequence
  Description of Artificial Sequence: Synthetic peptide
MEEEIRTTNPVATEQYGSVSTNLQVGNS

SEQ ID NO: 14498 - protein, 28 aa, Artificial Sequence
  Description of Artificial Sequence: Synthetic peptide
DEEEIRTTNPVATEQYGSVSTDLQNGNM

SEQ ID NO: 14499 - protein, 28 aa, Artificial Sequence
  Description of Artificial Sequence: Synthetic peptide
DEQEIATTNPVATEQYGSVSENLQRGNR

SEQ ID NO: 14500 - protein, 28 aa, Artificial Sequence
  Description of Artificial Sequence: Synthetic peptide
DEEEIRTTNPVATEQYGSVSTDLQRGEM

SEQ ID NO: 14501 - protein, 28 aa, Artificial Sequence
  Description of Artificial Sequence: Synthetic peptide
DEEEIRTTNPVATEQYGSVSTNEQQGNM

SEQ ID NO: 14502 - protein, 28 aa, Artificial Sequence
  Description of Artificial Sequence: Synthetic peptide
QEEEIRTTNPVATECYGVVSTNLQRGNR

SEQ ID NO: 14503 - protein, 28 aa, Artificial Sequence
  Description of Artificial Sequence: Synthetic peptide
DEEEIWTTNIVATEQYGSLSTNLQRGNR

SEQ ID NO: 14504 - protein, 28 aa, Artificial Sequence
  Description of Artificial Sequence: Synthetic peptide
DEEEIRTTNPVATEQYGDVSENLQRGNV

SEQ ID NO: 14505 - protein, 28 aa, Artificial Sequence
  Description of Artificial Sequence: Synthetic peptide
DEEEIRTTNPVATEQYGSVSTNEQQGNL

SEQ ID NO: 14506 - protein, 28 aa, Artificial Sequence
  Description of Artificial Sequence: Synthetic peptide
QEEEIRTTNPVATEGYGSVPTNLQRGNR

SEQ ID NO: 14507 - protein, 28 aa, Artificial Sequence
  Description of Artificial Sequence: Synthetic peptide
DEEEIRTTNPVSTEQYGSVSEVLQRGNR

SEQ ID NO: 14508 - protein, 28 aa, Artificial Sequence
  Description of Artificial Sequence: Synthetic peptide
DEEEIRTTNPVATEQYGSVSTELQSGNE

SEQ ID NO: 14509 - protein, 28 aa, Artificial Sequence
  Description of Artificial Sequence: Synthetic peptide
DEEEIRTTNPVATEQYGSVSEALQQGNR

SEQ ID NO: 14510 - protein, 28 aa, Artificial Sequence
  Description of Artificial Sequence: Synthetic peptide
DEEEISTTNPVATEQYGSVSTNLQNGNY

SEQ ID NO: 14511 - protein, 28 aa, Artificial Sequence
  Description of Artificial Sequence: Synthetic peptide
DEEEIRDTNIVATEQYGSVSTNLQRGNN

SEQ ID NO: 14512 - protein, 28 aa, Artificial Sequence
  Description of Artificial Sequence: Synthetic peptide
DEEEIRTTNPVATENYGEVSTNLQHGNR

SEQ ID NO: 14513 - protein, 29 aa, Artificial Sequence
  Description of Artificial Sequence: Synthetic peptide
DEEEIRTTNPVATEQYGSVSTNLQQGDNS

SEQ ID NO: 14514 - protein, 28 aa, Artificial Sequence
  Description of Artificial Sequence: Synthetic peptide
DEEEIRTTNPVATEQYGSVSTNLQYENV

SEQ ID NO: 14515 - protein, 28 aa, Artificial Sequence
  Description of Artificial Sequence: Synthetic peptide
DEEEIVCTNPVATEQYGVVSTNLQRGNR

SEQ ID NO: 14516 - protein, 28 aa, Artificial Sequence
  Description of Artificial Sequence: Synthetic peptide
DEEEIRTTNPVATEQYGSASTNEQRENR

SEQ ID NO: 14517 - protein, 28 aa, Artificial Sequence
  Description of Artificial Sequence: Synthetic peptide
DEEEIRTTNPVATEQYGSVSTNLQYGEN

SEQ ID NO: 14518 - protein, 28 aa, Artificial Sequence
  Description of Artificial Sequence: Synthetic peptide
DEEEIRTTNPVATEGYGSVSTNIQIGNR

SEQ ID NO: 14519 - protein, 28 aa, Artificial Sequence
  Description of Artificial Sequence: Synthetic peptide
SEEEIRTTNPVATEQYGSVSDNLQQGNR

SEQ ID NO: 14520 - protein, 30 aa, Artificial Sequence
  Description of Artificial Sequence: Synthetic polypeptide
DEEEIRTTNPVATEPYGSVSTNLQSRGNDR

SEQ ID NO: 14521 - protein, 28 aa, Artificial Sequence
  Description of Artificial Sequence: Synthetic peptide
DEEEIRCTNPVATEQYGSVSTNLQRENH

SEQ ID NO: 14522 - protein, 29 aa, Artificial Sequence
  Description of Artificial Sequence: Synthetic peptide
DEEEIRTTNPVATEQYGSVSTNLMIRGNQ

SEQ ID NO: 14523 - protein, 28 aa, Artificial Sequence
  Description of Artificial Sequence: Synthetic peptide
QEEEIRTTNPVATEQYGSVSTNLQRGEA

SEQ ID NO: 14524 - protein, 28 aa, Artificial Sequence
  Description of Artificial Sequence: Synthetic peptide
DEEEIRCTNPVATEMYGSVSTNLQRGNQ

SEQ ID NO: 14525 - protein, 29 aa, Artificial Sequence
  Description of Artificial Sequence: Synthetic peptide
DEEEIRTTNPVATECYGSVSTNLQRGNDI

SEQ ID NO: 14526 - protein, 28 aa, Artificial Sequence
  Description of Artificial Sequence: Synthetic peptide
DEEEIVTTNPVATEVYGVVSTNLQRGNR

SEQ ID NO: 14527 - protein, 28 aa, Artificial Sequence
  Description of Artificial Sequence: Synthetic peptide
MEEEIRTTNIVATEQYGSVSTNLQRGND

SEQ ID NO: 14528 - protein, 28 aa, Artificial Sequence
  Description of Artificial Sequence: Synthetic peptide
DEEEIRTTNPVATESYGKVSTELQRGNR

SEQ ID NO: 14529 - protein, 29 aa, Artificial Sequence
  Description of Artificial Sequence: Synthetic peptide
DEEEIHTTNPVATEGYGSVSTANLQRGNR

SEQ ID NO: 14530 - protein, 28 aa, Artificial Sequence
  Description of Artificial Sequence: Synthetic peptide
DEMEIRTTNPVATEQYGSVSTNLQRGDA

SEQ ID NO: 14531 - protein, 28 aa, Artificial Sequence
  Description of Artificial Sequence: Synthetic peptide
DEEEIATTNPVATECYGSVSTNLQTGNR

SEQ ID NO: 14532 - protein, 28 aa, Artificial Sequence
  Description of Artificial Sequence: Synthetic peptide
DEEEIRTTNPVATEIYGSVSSNLQRGTR

SEQ ID NO: 14533 - protein, 28 aa, Artificial Sequence
  Description of Artificial Sequence: Synthetic peptide
DDEEIRTTNIVSTEQYGSVSTNLQRGNR

SEQ ID NO: 14534 - protein, 28 aa, Artificial Sequence
  Description of Artificial Sequence: Synthetic peptide
DEEEIRTTNPVATEQYGGISDNLQRGNR

SEQ ID NO: 14535 - protein, 28 aa, Artificial Sequence
  Description of Artificial Sequence: Synthetic peptide
DEEEIVTTNPVATEQYGSISTNLQVGNR

SEQ ID NO: 14536 - protein, 28 aa, Artificial Sequence
  Description of Artificial Sequence: Synthetic peptide
DEEEIRTTNPVATEQYGSVSTHEQRGNT

SEQ ID NO: 14537 - protein, 28 aa, Artificial Sequence
  Description of Artificial Sequence: Synthetic peptide
DEEEIRTTNPVATECYGSVPTNLQHGNR

SEQ ID NO: 14538 - protein, 28 aa, Artificial Sequence
  Description of Artificial Sequence: Synthetic peptide
DEFEIVTTNPVATEQYGSVSTNLQRDNR

SEQ ID NO: 14539 - protein, 29 aa, Artificial Sequence
  Description of Artificial Sequence: Synthetic peptide
DEEEIRATNPVATEQYGSVSTNPQRGDNR

SEQ ID NO: 14540 - protein, 28 aa, Artificial Sequence
  Description of Artificial Sequence: Synthetic peptide
DEEEIRTTNPVATEQYGDASTNLQRGMR

SEQ ID NO: 14541 - protein, 28 aa, Artificial Sequence
  Description of Artificial Sequence: Synthetic peptide
DESEIRTTNPVATEQYGSVSTELERGNR

SEQ ID NO: 14542 - protein, 28 aa, Artificial Sequence
  Description of Artificial Sequence: Synthetic peptide
DEEEIRTTNPVATEQYGEVSENLQHGNR

SEQ ID NO: 14543 - protein, 28 aa, Artificial Sequence
  Description of Artificial Sequence: Synthetic peptide
DEEEIRTTNPVATEQYGDVSTVLQHGNR

SEQ ID NO: 14544 - protein, 29 aa, Artificial Sequence
  Description of Artificial Sequence: Synthetic peptide
DEEEIRTTNPVATEQYGDVSTTNLQRGND

SEQ ID NO: 14545 - protein, 28 aa, Artificial Sequence
  Description of Artificial Sequence: Synthetic peptide
DEEEVRTTNPVATEAYGVVSTNLQRGNR

SEQ ID NO: 14546 - protein, 28 aa, Artificial Sequence
  Description of Artificial Sequence: Synthetic peptide
DEEEIATTNPVATEQYGSVSTNLQRGEL

SEQ ID NO: 14547 - protein, 28 aa, Artificial Sequence
  Description of Artificial Sequence: Synthetic peptide
DEEEIRTTNIVATEQYGVVSTNLQRSNR

SEQ ID NO: 14548 - protein, 28 aa, Artificial Sequence
  Description of Artificial Sequence: Synthetic peptide
DEVEIRTTNPVATEQYGSVSENLQGGNR

SEQ ID NO: 14549 - protein, 28 aa, Artificial Sequence
  Description of Artificial Sequence: Synthetic peptide
DEDEIRTTNPVATEQYGSVSENLQRGQR

SEQ ID NO: 14550 - protein, 28 aa, Artificial Sequence
  Description of Artificial Sequence: Synthetic peptide
QEEEIRTTNPVATEQYGSVSENWQRGNR

SEQ ID NO: 14551 - protein, 28 aa, Artificial Sequence
  Description of Artificial Sequence: Synthetic peptide
DEEEIRTTNPVATEQYGSVSTNLSQGNY

SEQ ID NO: 14552 - protein, 28 aa, Artificial Sequence
  Description of Artificial Sequence: Synthetic peptide
DEEEIRTTNPVATEQYGSVSTCLQYGNF

SEQ ID NO: 14553 - protein, 30 aa, Artificial Sequence
  Description of Artificial Sequence: Synthetic polypeptide
DEEEIRTTNPVATEQYGSVSLTNLQYRGFR

SEQ ID NO: 14554 - protein, 28 aa, Artificial Sequence
  Description of Artificial Sequence: Synthetic peptide
DEEEIRTTNPVATEQYGSVDTCLQRGNC

SEQ ID NO: 14555 - protein, 28 aa, Artificial Sequence
  Description of Artificial Sequence: Synthetic peptide
QEEEIRTTNIVATEQYGSVSTNLQRGNW

SEQ ID NO: 14556 - protein, 28 aa, Artificial Sequence
  Description of Artificial Sequence: Synthetic peptide
DEEEIRTTNPVATEQYGSVSTNLTVGNF

SEQ ID NO: 14557 - protein, 29 aa, Artificial Sequence
  Description of Artificial Sequence: Synthetic peptide
DEEEIRCTNPVATEQYGSVSTNLQQGPNR

SEQ ID NO: 14558 - protein, 29 aa, Artificial Sequence
  Description of Artificial Sequence: Synthetic peptide
DEEEIATTNPVATEQYGSVSTNLQIRGNT

SEQ ID NO: 14559 - protein, 28 aa, Artificial Sequence
  Description of Artificial Sequence: Synthetic peptide
DEEEIRTTNPVATELWGSVSTNLQRGNL

SEQ ID NO: 14560 - protein, 28 aa, Artificial Sequence
  Description of Artificial Sequence: Synthetic peptide
DEEEIRTTNPVATEQYGSVSTDLQMGNM

SEQ ID NO: 14561 - protein, 28 aa, Artificial Sequence
  Description of Artificial Sequence: Synthetic peptide
DENEIRTTNPVATEQYGSVSTNLMHGNR

SEQ ID NO: 14562 - protein, 28 aa, Artificial Sequence
  Description of Artificial Sequence: Synthetic peptide
DEEEIRCTNIVATEQYGSVGTNLQRGNR

SEQ ID NO: 14563 - protein, 29 aa, Artificial Sequence
  Description of Artificial Sequence: Synthetic peptide
DEEEISTTNPVATEQYGLVSTNLQREGNR

SEQ ID NO: 14564 - protein, 29 aa, Artificial Sequence
  Description of Artificial Sequence: Synthetic peptide
DEEEIRTTNPVATECYGSVSTNLQNTGNR

SEQ ID NO: 14565 - protein, 28 aa, Artificial Sequence
  Description of Artificial Sequence: Synthetic peptide
DEEEIRTTNPTATEQYGSVSTNEQRGNI

SEQ ID NO: 14566 - protein, 28 aa, Artificial Sequence
  Description of Artificial Sequence: Synthetic peptide
DEEEIRTTNPVATEQFGDVSTNLQRGNI

SEQ ID NO: 14567 - protein, 30 aa, Artificial Sequence
  Description of Artificial Sequence: Synthetic polypeptide
DEEEIRTTNPVATEQYGSVQSTNLQQRGNT

SEQ ID NO: 14568 - protein, 28 aa, Artificial Sequence
  Description of Artificial Sequence: Synthetic peptide
DEFEIRTTNPVATEQWGSVSTNLQRGQR

SEQ ID NO: 14569 - protein, 28 aa, Artificial Sequence
  Description of Artificial Sequence: Synthetic peptide
DEEEIRTTNPVATEQWGIVSTNEQRGNR

SEQ ID NO: 14570 - protein, 28 aa, Artificial Sequence
  Description of Artificial Sequence: Synthetic peptide
DEEEIRTTNPVATEQYGSVSTNEQNGNI

SEQ ID NO: 14571 - protein, 29 aa, Artificial Sequence
  Description of Artificial Sequence: Synthetic peptide
DEEEIRTTNPCATEQYGCVSTNLQRGPNR

SEQ ID NO: 14572 - protein, 29 aa, Artificial Sequence
  Description of Artificial Sequence: Synthetic peptide
DEEEIRTTNPVATEQYGSVEETPLQRGNR

SEQ ID NO: 14573 - protein, 29 aa, Artificial Sequence
  Description of Artificial Sequence: Synthetic peptide
DEEEIRTTNPVATEQYGSVSTNLQQFGNS

SEQ ID NO: 14574 - protein, 29 aa, Artificial Sequence
  Description of Artificial Sequence: Synthetic peptide
DEEEIRTTNPVATEQYGSVSTNLQYGNDQ

SEQ ID NO: 14575 - protein, 28 aa, Artificial Sequence
  Description of Artificial Sequence: Synthetic peptide
DECEIRTTNPVATEQYGSVSSNLQRGNY

SEQ ID NO: 14576 - protein, 30 aa, Artificial Sequence
  Description of Artificial Sequence: Synthetic polypeptide
DEEEIRSTNPVATEQYGSVSETNLQERGNR

SEQ ID NO: 14577 - protein, 28 aa, Artificial Sequence
  Description of Artificial Sequence: Synthetic peptide
DEEEIRTTNIVATEQYGVVSNNLQRGNR

SEQ ID NO: 14578 - protein, 28 aa, Artificial Sequence
  Description of Artificial Sequence: Synthetic peptide
DEEEIRTTNPVATEQYGSVSENLQQGNW

SEQ ID NO: 14579 - protein, 30 aa, Artificial Sequence
  Description of Artificial Sequence: Synthetic polypeptide
DEEEIRTTNPVATEQYGASVLSTNWQRGNR

SEQ ID NO: 14580 - protein, 28 aa, Artificial Sequence
  Description of Artificial Sequence: Synthetic peptide
DEEEIRATNPTATEQYGSVSTNLQLGNR

SEQ ID NO: 14581 - protein, 28 aa, Artificial Sequence
  Description of Artificial Sequence: Synthetic peptide
DENEIVTTNPVATEQYGSVSTNLQRGNQ

SEQ ID NO: 14582 - protein, 28 aa, Artificial Sequence
  Description of Artificial Sequence: Synthetic peptide
DEEEIRTTNIVATEQYGSVIENLQRGNR

SEQ ID NO: 14583 - protein, 28 aa, Artificial Sequence
  Description of Artificial Sequence: Synthetic peptide
DEEEIATTNPVATEQYGSVSTNLQQGNG

SEQ ID NO: 14584 - protein, 29 aa, Artificial Sequence
  Description of Artificial Sequence: Synthetic peptide
DEEEIRTTNPVATEQWGSVSTNLQNRGNA

SEQ ID NO: 14585 - protein, 30 aa, Artificial Sequence
  Description of Artificial Sequence: Synthetic polypeptide
DEEEIRTTNPVATEQYGSVSTNLQRKGEDR

SEQ ID NO: 14586 - protein, 29 aa, Artificial Sequence
  Description of Artificial Sequence: Synthetic peptide
DEEEIRTTNPVATEQYGSVSDNLQRAGAR

SEQ ID NO: 14587 - protein, 28 aa, Artificial Sequence
  Description of Artificial Sequence: Synthetic peptide
DEEEICTTNPVATEQYGSVSTNLQLGNH

SEQ ID NO: 14588 - protein, 29 aa, Artificial Sequence
  Description of Artificial Sequence: Synthetic peptide
DEEEITTTNPVATEQYGSVSTNLQCHGNR

SEQ ID NO: 14589 - protein, 28 aa, Artificial Sequence
  Description of Artificial Sequence: Synthetic peptide
YEEEIRTTNPVATEQYGSVSSNLQHGNR

SEQ ID NO: 14590 - protein, 28 aa, Artificial Sequence
  Description of Artificial Sequence: Synthetic peptide
DEEEIRTTNPTATEQYGSVSENLQQGNR

SEQ ID NO: 14591 - protein, 29 aa, Artificial Sequence
  Description of Artificial Sequence: Synthetic peptide
DEEEIRTTNPVATEQYGSVSTNEQWRGNA

SEQ ID NO: 14592 - protein, 28 aa, Artificial Sequence
  Description of Artificial Sequence: Synthetic peptide
DEEEIYTTNPVATEQYGSVSDNLQNGNR

SEQ ID NO: 14593 - protein, 28 aa, Artificial Sequence
  Description of Artificial Sequence: Synthetic peptide
SEDEIRTTNPVATEQYGSVSTNLQRGNG

SEQ ID NO: 14594 - protein, 28 aa, Artificial Sequence
  Description of Artificial Sequence: Synthetic peptide
DDEEIRTTNPVATEQYGAVSTNLQVGNR

SEQ ID NO: 14595 - protein, 28 aa, Artificial Sequence
  Description of Artificial Sequence: Synthetic peptide
DEQEIRTTNPVATEVYGCVSTNLQRGNR

SEQ ID NO: 14596 - protein, 28 aa, Artificial Sequence
  Description of Artificial Sequence: Synthetic peptide
DEQEIATTNPVATEQYGSVSDNLQRGNR

SEQ ID NO: 14597 - protein, 28 aa, Artificial Sequence
  Description of Artificial Sequence: Synthetic peptide
DEEEIRTTNPVSTEQYGEVSTNLQRGGR

SEQ ID NO: 14598 - protein, 28 aa, Artificial Sequence
  Description of Artificial Sequence: Synthetic peptide
DEEELRTTNPVATEQYGSVSENLQRGGR

SEQ ID NO: 14599 - protein, 28 aa, Artificial Sequence
  Description of Artificial Sequence: Synthetic peptide
DEEEIRTVNPVATEHYGSVSENLQRGNR

SEQ ID NO: 14600 - protein, 28 aa, Artificial Sequence
  Description of Artificial Sequence: Synthetic peptide
SEEEIRTTNPVATEQYGSVSTNLQRGTN

SEQ ID NO: 14601 - protein, 29 aa, Artificial Sequence
  Description of Artificial Sequence: Synthetic peptide
DENEIRTTNPVATEQYGSVSTMNLQHGNR

SEQ ID NO: 14602 - protein, 28 aa, Artificial Sequence
  Description of Artificial Sequence: Synthetic peptide
DEEEIRTTNPVATEQYGSVSTNEQGGNI

SEQ ID NO: 14603 - protein, 28 aa, Artificial Sequence
  Description of Artificial Sequence: Synthetic peptide
MEEEIRTTNPVATEQYGSVSTNLQLGNY

SEQ ID NO: 14604 - protein, 28 aa, Artificial Sequence
  Description of Artificial Sequence: Synthetic peptide
DEEEIRTTNPVATEQYGSVPTNLQRGDN

SEQ ID NO: 14605 - protein, 28 aa, Artificial Sequence
  Description of Artificial Sequence: Synthetic peptide
DEEEIRTTNPEATEQYGSVSTNLQRENS

SEQ ID NO: 14606 - protein, 28 aa, Artificial Sequence
  Description of Artificial Sequence: Synthetic peptide
DEQEIVTTNPVATEQYGDVSTNLQRGNR

SEQ ID NO: 14607 - protein, 28 aa, Artificial Sequence
  Description of Artificial Sequence: Synthetic peptide
DEEEIRTTNPVATEQYGYVSENLQQGNR

SEQ ID NO: 14608 - protein, 28 aa, Artificial Sequence
  Description of Artificial Sequence: Synthetic peptide
DEEEIRTTNPVATEQYGSVSTNLEDGNA

SEQ ID NO: 14609 - protein, 28 aa, Artificial Sequence
  Description of Artificial Sequence: Synthetic peptide
DEEEIRATNPVATEQYGSVSTDLQRGNA

SEQ ID NO: 14610 - protein, 28 aa, Artificial Sequence
  Description of Artificial Sequence: Synthetic peptide
DEEEIGTTNPVATEQYGSVSDNLQRGGR

SEQ ID NO: 14611 - protein, 28 aa, Artificial Sequence
  Description of Artificial Sequence: Synthetic peptide
HEEEISTTNPVATEQYGSVSTNLQRGMR

SEQ ID NO: 14612 - protein, 29 aa, Artificial Sequence
  Description of Artificial Sequence: Synthetic peptide
DEEEIRTTNPVATEVYGEVSTNLQRAGNR

SEQ ID NO: 14613 - protein, 28 aa, Artificial Sequence
  Description of Artificial Sequence: Synthetic peptide
DEEEIRTTNPVATEIYGSVSTNWQIGNR

SEQ ID NO: 14614 - protein, 28 aa, Artificial Sequence
  Description of Artificial Sequence: Synthetic peptide
DEEEIRTTNPVATEQYGSVSTNDQGGNF

SEQ ID NO: 14615 - protein, 28 aa, Artificial Sequence
  Description of Artificial Sequence: Synthetic peptide
DENEIRTVNPVATEQYGSVSTNLQRGNY

SEQ ID NO: 14616 - protein, 28 aa, Artificial Sequence
  Description of Artificial Sequence: Synthetic peptide
DEEEIRCTNPVATEQYGIVSTNLQVGNR

SEQ ID NO: 14617 - protein, 29 aa, Artificial Sequence
  Description of Artificial Sequence: Synthetic peptide
DEEEIRTTNPVATEQYGSVSENLQMRGNM

SEQ ID NO: 14618 - protein, 28 aa, Artificial Sequence
  Description of Artificial Sequence: Synthetic peptide
DEEEIRATNPVATEQYGSVSDALQRGNR

SEQ ID NO: 14619 - protein, 28 aa, Artificial Sequence
  Description of Artificial Sequence: Synthetic peptide
SEEEIRTTNPVATEQYGSVSENPQRGNR

SEQ ID NO: 14620 - protein, 28 aa, Artificial Sequence
  Description of Artificial Sequence: Synthetic peptide
DEEEIRTTNPVATEQYGSVSTDLQAGNV

SEQ ID NO: 14621 - protein, 31 aa, Artificial Sequence
  Description of Artificial Sequence: Synthetic polypeptide
DEEEIRTTNPVATEQYGSVSTNLVQREGHNR

SEQ ID NO: 14622 - protein, 30 aa, Artificial Sequence
  Description of Artificial Sequence: Synthetic polypeptide
DEEEIRTTNPVATEQYGSVSTNLQDREGDR

SEQ ID NO: 14623 - protein, 30 aa, Artificial Sequence
  Description of Artificial Sequence: Synthetic polypeptide
DEEEIRTTNPTATEQYGSVSTNLQDRGDNR

SEQ ID NO: 14624 - protein, 28 aa, Artificial Sequence
  Description of Artificial Sequence: Synthetic peptide
DEVEIRTTNIVATEQYGSVSTNLQRGNA

SEQ ID NO: 14625 - protein, 30 aa, Artificial Sequence
  Description of Artificial Sequence: Synthetic polypeptide
DEEEIRTTNPVATEQYGSVLSTNLPQRNNR

SEQ ID NO: 14626 - protein, 28 aa, Artificial Sequence
  Description of Artificial Sequence: Synthetic peptide
DEQEIRTTNPVATEQYGEVSTNLQRGMR

SEQ ID NO: 14627 - protein, 30 aa, Artificial Sequence
  Description of Artificial Sequence: Synthetic polypeptide
DEEEIRTTNPVATEQYGSVSTQNLVQQGNR

SEQ ID NO: 14628 - protein, 28 aa, Artificial Sequence
  Description of Artificial Sequence: Synthetic peptide
DEQEIRTTNPVATEQWGSVSTNLQQGNR

SEQ ID NO: 14629 - protein, 29 aa, Artificial Sequence
  Description of Artificial Sequence: Synthetic peptide
QENEIRTTNPVATEQYGSVCSTNLQRGNR

SEQ ID NO: 14630 - protein, 28 aa, Artificial Sequence
  Description of Artificial Sequence: Synthetic peptide
SEEEIRTTNPVATEQYGEVSENLQRGNR

SEQ ID NO: 14631 - protein, 28 aa, Artificial Sequence
  Description of Artificial Sequence: Synthetic peptide
DEEEIRTTNPVATEQYGSVSTNLQTGEV

SEQ ID NO: 14632 - protein, 28 aa, Artificial Sequence
  Description of Artificial Sequence: Synthetic peptide
DEDEISTTNPVATEQYGSVSENLQRGNR

SEQ ID NO: 14633 - protein, 28 aa, Artificial Sequence
  Description of Artificial Sequence: Synthetic peptide
DEEEIRFTNIVATEQYGSVSTNLQAGNR

SEQ ID NO: 14634 - protein, 28 aa, Artificial Sequence
  Description of Artificial Sequence: Synthetic peptide
DEEEIRTTNPAATEQYGSVSDNLQNGNR

SEQ ID NO: 14635 - protein, 28 aa, Artificial Sequence
  Description of Artificial Sequence: Synthetic peptide
AEEEIGTTNPVATEQYGSVSTNLQRGGR

SEQ ID NO: 14636 - protein, 28 aa, Artificial Sequence
  Description of Artificial Sequence: Synthetic peptide
DEEEIRTTNPVATEVYGDVSTNLQRGNQ

SEQ ID NO: 14637 - protein, 28 aa, Artificial Sequence
  Description of Artificial Sequence: Synthetic peptide
DEEEIRTTNPVATEQFGEVSTNLQHGNR

SEQ ID NO: 14638 - protein, 28 aa, Artificial Sequence
  Description of Artificial Sequence: Synthetic peptide
DEEEIATTNPVATEQYGIVSTNLQRGNF

SEQ ID NO: 14639 - protein, 28 aa, Artificial Sequence
  Description of Artificial Sequence: Synthetic peptide
DEEEIRTTNPVATECYGSVSENLQRGNA

SEQ ID NO: 14640 - protein, 30 aa, Artificial Sequence
  Description of Artificial Sequence: Synthetic polypeptide
DEEEIRTTNPVATEQYGSVSTTNPLQRGNH

SEQ ID NO: 14641 - protein, 28 aa, Artificial Sequence
  Description of Artificial Sequence: Synthetic peptide
DEEEIRTTNPTATEQYGSVSTNEQLGNR

SEQ ID NO: 14642 - protein, 30 aa, Artificial Sequence
  Description of Artificial Sequence: Synthetic polypeptide
SEEEIRTTNPVATEQYGSVSTNLQREGDNR

SEQ ID NO: 14643 - protein, 28 aa, Artificial Sequence
  Description of Artificial Sequence: Synthetic peptide
DEEEIRTTNPVATEGYGSVSENLQRGER

SEQ ID NO: 14644 - protein, 28 aa, Artificial Sequence
  Description of Artificial Sequence: Synthetic peptide
DESEIRTTNPVATEQYGSMSTNLDRGNR

SEQ ID NO: 14645 - protein, 28 aa, Artificial Sequence
  Description of Artificial Sequence: Synthetic peptide
AEEEIRTTNPVATEQYGEISTNLQRGNR

SEQ ID NO: 14646 - protein, 31 aa, Artificial Sequence
  Description of Artificial Sequence: Synthetic polypeptide
DEEEIRTTNPVATEQYGSVSTGNLQDRGNPR

SEQ ID NO: 14647 - protein, 29 aa, Artificial Sequence
  Description of Artificial Sequence: Synthetic peptide
DEEEIRTTNPVATEQYGSVSENDQMRGNR

SEQ ID NO: 14648 - protein, 29 aa, Artificial Sequence
  Description of Artificial Sequence: Synthetic peptide
DEEEIRTTNPVATEQYGSVSTNDQRGEER

SEQ ID NO: 14649 - protein, 28 aa, Artificial Sequence
  Description of Artificial Sequence: Synthetic peptide
DEEEIRTTNPVATEQYGDVSENLQRGGR

SEQ ID NO: 14650 - protein, 28 aa, Artificial Sequence
  Description of Artificial Sequence: Synthetic peptide
DEEEIRATNIVATEQYGSVGTNLQRGNR

SEQ ID NO: 14651 - protein, 29 aa, Artificial Sequence
  Description of Artificial Sequence: Synthetic peptide
DEEEIRTTNPVATEQYGSVSTAETQRGNR

SEQ ID NO: 14652 - protein, 29 aa, Artificial Sequence
  Description of Artificial Sequence: Synthetic peptide
DEEEIRTTNPVATECYGSVSTANLQRGTR

SEQ ID NO: 14653 - protein, 28 aa, Artificial Sequence
  Description of Artificial Sequence: Synthetic peptide
DEEEIATTNPVATEQYGSVSDNLQRGTR

SEQ ID NO: 14654 - protein, 28 aa, Artificial Sequence
  Description of Artificial Sequence: Synthetic peptide
DEEEIRTTNIVATEQYGCVSTLLQRGNR

SEQ ID NO: 14655 - protein, 28 aa, Artificial Sequence
  Description of Artificial Sequence: Synthetic peptide
DEEEIRTTNPVATEQYGEVSTNLQRLNN

SEQ ID NO: 14656 - protein, 28 aa, Artificial Sequence
  Description of Artificial Sequence: Synthetic peptide
DEEEIRTTNPVATEQYGSVSENLQYGGR

SEQ ID NO: 14657 - protein, 29 aa, Artificial Sequence
  Description of Artificial Sequence: Synthetic peptide
DEEEIRTTNPVATEQYGSVSTEEVQRGNR

SEQ ID NO: 14658 - protein, 28 aa, Artificial Sequence
  Description of Artificial Sequence: Synthetic peptide
DQEEIRTTNPVATEQYGSVGNNLQRGNR

SEQ ID NO: 14659 - protein, 28 aa, Artificial Sequence
  Description of Artificial Sequence: Synthetic peptide
MEEEIRTTNPVATEQYGSVSTDLQRGNM

SEQ ID NO: 14660 - protein, 28 aa, Artificial Sequence
  Description of Artificial Sequence: Synthetic peptide
DEEEIRTTNPVATEQYGSVSTELQTGNL

SEQ ID NO: 14661 - protein, 28 aa, Artificial Sequence
  Description of Artificial Sequence: Synthetic peptide
DEEEIRTTNIVATEMYGSVSTNLQRGNK

SEQ ID NO: 14662 - protein, 28 aa, Artificial Sequence
  Description of Artificial Sequence: Synthetic peptide
DEEEIRTTNPTATEQYGSVSTNWQLGNR

SEQ ID NO: 14663 - protein, 28 aa, Artificial Sequence
  Description of Artificial Sequence: Synthetic peptide
DEEEIRTTNPVATEPYGTVATNLQRGNR

SEQ ID NO: 14664 - protein, 28 aa, Artificial Sequence
  Description of Artificial Sequence: Synthetic peptide
NEEEIRTTNPVASEQYGDVSTNLQRGNR

SEQ ID NO: 14665 - protein, 28 aa, Artificial Sequence
  Description of Artificial Sequence: Synthetic peptide
DEEEIATTNPVATEQYGSASTNLMRGNR

SEQ ID NO: 14666 - protein, 28 aa, Artificial Sequence
  Description of Artificial Sequence: Synthetic peptide
DEEEIRTTNPVATLQYGNMSTNLQRGNR

SEQ ID NO: 14667 - protein, 28 aa, Artificial Sequence
  Description of Artificial Sequence: Synthetic peptide
DEEEISTTNPVATEQYGSVSTNLMGGNR

SEQ ID NO: 14668 - protein, 28 aa, Artificial Sequence
  Description of Artificial Sequence: Synthetic peptide
DEQEIVTTNPVATEQYGSVSENLQRGNR

SEQ ID NO: 14669 - protein, 28 aa, Artificial Sequence
  Description of Artificial Sequence: Synthetic peptide
NEEEIRTTNPVATEQYGSVSTNLQAENR

SEQ ID NO: 14670 - protein, 28 aa, Artificial Sequence
  Description of Artificial Sequence: Synthetic peptide
DEEEIRTTNPVATEMYGSVSTNWQNGNR

SEQ ID NO: 14671 - protein, 28 aa, Artificial Sequence
  Description of Artificial Sequence: Synthetic peptide
DEEEIRTTNPVATEQYGSVSTDLQNGNN

SEQ ID NO: 14672 - protein, 28 aa, Artificial Sequence
  Description of Artificial Sequence: Synthetic peptide
DEEEIRTTNPVATEQYGSVSTNEQYGDR

SEQ ID NO: 14673 - protein, 28 aa, Artificial Sequence
  Description of Artificial Sequence: Synthetic peptide
DEEEIRTTNPTATEQYGSVSTNLQIGNA

SEQ ID NO: 14674 - protein, 29 aa, Artificial Sequence
  Description of Artificial Sequence: Synthetic peptide
DEEEIRTTNPVATEAYGSVCSTALQRGNR

SEQ ID NO: 14675 - protein, 28 aa, Artificial Sequence
  Description of Artificial Sequence: Synthetic peptide
DEEEIRTTNPVAYEQYGSIHTNLQRGNR

SEQ ID NO: 14676 - protein, 29 aa, Artificial Sequence
  Description of Artificial Sequence: Synthetic peptide
DEEEIRTTNPVATEQYGSVSTNLMNIGNR

SEQ ID NO: 14677 - protein, 28 aa, Artificial Sequence
  Description of Artificial Sequence: Synthetic peptide
DEEEIRTTNPVATEQYGGVSTNEQRGDR

SEQ ID NO: 14678 - protein, 28 aa, Artificial Sequence
  Description of Artificial Sequence: Synthetic peptide
DEEEIRTTNPVATEQYGSVSTDLQAGNF

SEQ ID NO: 14679 - protein, 28 aa, Artificial Sequence
  Description of Artificial Sequence: Synthetic peptide
DENEIRTTNIVSTEQYGSVSTNLQRGNR

SEQ ID NO: 14680 - protein, 28 aa, Artificial Sequence
  Description of Artificial Sequence: Synthetic peptide
DEEEIWTTNPVATEQYGEVSTNLQWGNR

SEQ ID NO: 14681 - protein, 28 aa, Artificial Sequence
  Description of Artificial Sequence: Synthetic peptide
DEEEIRCTNPVATEQWGSVSTNLQRGNF

SEQ ID NO: 14682 - protein, 28 aa, Artificial Sequence
  Description of Artificial Sequence: Synthetic peptide
DEEETRTTNIDATEQYGSVSTNLQRGNR

SEQ ID NO: 14683 - protein, 28 aa, Artificial Sequence
  Description of Artificial Sequence: Synthetic peptide
DEEEIRCTNIVATECYGSVSTNLQRGNR

SEQ ID NO: 14684 - protein, 29 aa, Artificial Sequence
  Description of Artificial Sequence: Synthetic peptide
DEEEIRTTNPVATEQYGTVSTNLQQRLNR

SEQ ID NO: 14685 - protein, 28 aa, Artificial Sequence
  Description of Artificial Sequence: Synthetic peptide
DEVEIRTTNPTATEQYGSVSTNLQRGNN

SEQ ID NO: 14686 - protein, 29 aa, Artificial Sequence
  Description of Artificial Sequence: Synthetic peptide
DEEEIRTTNPVCTEQYGSVSGTNLQRGGR

SEQ ID NO: 14687 - protein, 28 aa, Artificial Sequence
  Description of Artificial Sequence: Synthetic peptide
DEEEIRTTNPVATEQYGSVSENLQVGNN

SEQ ID NO: 14688 - protein, 28 aa, Artificial Sequence
  Description of Artificial Sequence: Synthetic peptide
DEEEIRTTNPVATEQYGDVSTNLQHGER

SEQ ID NO: 14689 - protein, 29 aa, Artificial Sequence
  Description of Artificial Sequence: Synthetic peptide
SEEEIRTTNPVATEQYGTVSTNLQDRGNR

SEQ ID NO: 14690 - protein, 28 aa, Artificial Sequence
  Description of Artificial Sequence: Synthetic peptide
DEEEIRTTNPVATEVYGSVSTNEQRGNQ

SEQ ID NO: 14691 - protein, 28 aa, Artificial Sequence
  Description of Artificial Sequence: Synthetic peptide
KEEEIRTTNPVATEQYGSVSTNLQLGNT

SEQ ID NO: 14692 - protein, 28 aa, Artificial Sequence
  Description of Artificial Sequence: Synthetic peptide
DEEEIRTTNPVATEVYGSVSTNPQDGNR

SEQ ID NO: 14693 - protein, 30 aa, Artificial Sequence
  Description of Artificial Sequence: Synthetic polypeptide
DEEEIRTTNPVATEQYGSVSTLNLQRGDNG

SEQ ID NO: 14694 - protein, 28 aa, Artificial Sequence
  Description of Artificial Sequence: Synthetic peptide
DEEEIRTTNPVATEQYGSVSTNPQHGNQ

SEQ ID NO: 14695 - protein, 28 aa, Artificial Sequence
  Description of Artificial Sequence: Synthetic peptide
DENEIRTTNPVATEQYGSVSTDLQRGNA

SEQ ID NO: 14696 - protein, 28 aa, Artificial Sequence
  Description of Artificial Sequence: Synthetic peptide
DEEEIRTTNPVATECYGVVSTNLQRGER

SEQ ID NO: 14697 - protein, 28 aa, Artificial Sequence
  Description of Artificial Sequence: Synthetic peptide
DEEEIRTTNIVATEQYTSVSTNIQRGNR

SEQ ID NO: 14698 - protein, 28 aa, Artificial Sequence
  Description of Artificial Sequence: Synthetic peptide
DEEEIATTNPVATEQYGSVSTLLQRGDR

SEQ ID NO: 14699 - protein, 28 aa, Artificial Sequence
  Description of Artificial Sequence: Synthetic peptide
DEENIRTTNPVATEQYGSVWTMLQRGNR

SEQ ID NO: 14700 - protein, 28 aa, Artificial Sequence
  Description of Artificial Sequence: Synthetic peptide
DEEEIRTTNPVATECYGSVSTDLQGGNR

SEQ ID NO: 14701 - protein, 28 aa, Artificial Sequence
  Description of Artificial Sequence: Synthetic peptide
GEEEIRTTNPVATEQYGVVSTNLQRGNA

SEQ ID NO: 14702 - protein, 28 aa, Artificial Sequence
  Description of Artificial Sequence: Synthetic peptide
DEEEIRTTNPVATEQYGTVSTELQHGNR

SEQ ID NO: 14703 - protein, 30 aa, Artificial Sequence
  Description of Artificial Sequence: Synthetic polypeptide
DEEEIRTTNPVATEQYGSVSTNLQDRNGER

SEQ ID NO: 14704 - protein, 29 aa, Artificial Sequence
  Description of Artificial Sequence: Synthetic peptide
DEEEIRTTNPVATEQYGSVSTDLQERGNS

SEQ ID NO: 14705 - protein, 28 aa, Artificial Sequence
  Description of Artificial Sequence: Synthetic peptide
DENEIRTTNPVATEQYGSYSTNLMRGNR

SEQ ID NO: 14706 - protein, 28 aa, Artificial Sequence
  Description of Artificial Sequence: Synthetic peptide
DEEEIRATNPVATEQYGVVSTNLQRGTR

SEQ ID NO: 14707 - protein, 28 aa, Artificial Sequence
  Description of Artificial Sequence: Synthetic peptide
DEEEIRTTNPVATEQYGSVSYNDQRFNR

SEQ ID NO: 14708 - protein, 28 aa, Artificial Sequence
  Description of Artificial Sequence: Synthetic peptide
SEEEIRTTNPVATEQYGDVSTNLQRGNM

SEQ ID NO: 14709 - protein, 28 aa, Artificial Sequence
  Description of Artificial Sequence: Synthetic peptide
DEEEIVTTNPVATECYGSVSTNLQRGNH

SEQ ID NO: 14710 - protein, 28 aa, Artificial Sequence
  Description of Artificial Sequence: Synthetic peptide
SEEEIRTTNPVATELYGSVSTNLQRGNF

SEQ ID NO: 14711 - protein, 29 aa, Artificial Sequence
  Description of Artificial Sequence: Synthetic peptide
DEEEIRTTNPVATEQYGSVSSTNLIEGNR

SEQ ID NO: 14712 - protein, 29 aa, Artificial Sequence
  Description of Artificial Sequence: Synthetic peptide
DEVEIRTTNPVATEQYGSVSENLQERGNR

SEQ ID NO: 14713 - protein, 28 aa, Artificial Sequence
  Description of Artificial Sequence: Synthetic peptide
DEEEIRTTNPVATECWGSVSTNLQTGNR

SEQ ID NO: 14714 - protein, 28 aa, Artificial Sequence
  Description of Artificial Sequence: Synthetic peptide
DEEEIRTTNIVATEQYGVVETNLQRGNR

SEQ ID NO: 14715 - protein, 28 aa, Artificial Sequence
  Description of Artificial Sequence: Synthetic peptide
DENEIRTTNPVATEQYGSVSTNLQVGND

SEQ ID NO: 14716 - protein, 30 aa, Artificial Sequence
  Description of Artificial Sequence: Synthetic polypeptide
DEEEIRTTNPVATEQYGSVSTDNGLERGNR

SEQ ID NO: 14717 - protein, 28 aa, Artificial Sequence
  Description of Artificial Sequence: Synthetic peptide
DEEEIRTVNIVATEQYGSVSTNLQVGNR

SEQ ID NO: 14718 - protein, 28 aa, Artificial Sequence
  Description of Artificial Sequence: Synthetic peptide
DEEEIRTTNPVATEQYGDYSTNEQRGNR

SEQ ID NO: 14719 - protein, 28 aa, Artificial Sequence
  Description of Artificial Sequence: Synthetic peptide
DENEIRTTNPVATECYGSVSTNLQRGNL

SEQ ID NO: 14720 - protein, 31 aa, Artificial Sequence
  Description of Artificial Sequence: Synthetic polypeptide
DEEEIRTTNPVATEQYGSVSTYNLQVRGENR

SEQ ID NO: 14721 - protein, 28 aa, Artificial Sequence
  Description of Artificial Sequence: Synthetic peptide
DEEEIRTVNPVATEQYGSVSTNLEGGNR

SEQ ID NO: 14722 - protein, 28 aa, Artificial Sequence
  Description of Artificial Sequence: Synthetic peptide
DEEEIRTTNPVATEQYGEASTNLQRGTR

SEQ ID NO: 14723 - protein, 28 aa, Artificial Sequence
  Description of Artificial Sequence: Synthetic peptide
DEEEISTTNPVATENYGSVSTNLQHGNR

SEQ ID NO: 14724 - protein, 28 aa, Artificial Sequence
  Description of Artificial Sequence: Synthetic peptide
VEEELRTTNPVATEQYGSVATNLQRGNR

SEQ ID NO: 14725 - protein, 28 aa, Artificial Sequence
  Description of Artificial Sequence: Synthetic peptide
DEEEIATTNPVCTEQYGDVSTNLQRGNR

SEQ ID NO: 14726 - protein, 28 aa, Artificial Sequence
  Description of Artificial Sequence: Synthetic peptide
DEEEIRTTNPVATEQYGSVDTNLQQGNW

SEQ ID NO: 14727 - protein, 30 aa, Artificial Sequence
  Description of Artificial Sequence: Synthetic polypeptide
DEEEIRTTNPVATEQYGSVDSTNLERGDNR

SEQ ID NO: 14728 - protein, 28 aa, Artificial Sequence
  Description of Artificial Sequence: Synthetic peptide
DEEEIRTTNPVATESYGTVSENLQRGNR

SEQ ID NO: 14729 - protein, 28 aa, Artificial Sequence
  Description of Artificial Sequence: Synthetic peptide
DEEEIRTTNPVATEQYGAVSDSLQRGNR

SEQ ID NO: 14730 - protein, 28 aa, Artificial Sequence
  Description of Artificial Sequence: Synthetic peptide
DEEEIRTTNPVATETYGSVSTNPQRGNN

SEQ ID NO: 14731 - protein, 28 aa, Artificial Sequence
  Description of Artificial Sequence: Synthetic peptide
SEEEIRATNIVATEQYGSVSTNLQRGNR

SEQ ID NO: 14732 - protein, 28 aa, Artificial Sequence
  Description of Artificial Sequence: Synthetic peptide
DEEEIWTTNPVATEQYGSVSNILQRGNR

SEQ ID NO: 14733 - protein, 30 aa, Artificial Sequence
  Description of Artificial Sequence: Synthetic polypeptide
DEQEIRTTNPVATEQYGSVSTNPLQRGNDR

SEQ ID NO: 14734 - protein, 28 aa, Artificial Sequence
  Description of Artificial Sequence: Synthetic peptide
DEEEIATTNPVATEQYGSVSTNLQRGEV

SEQ ID NO: 14735 - protein, 28 aa, Artificial Sequence
  Description of Artificial Sequence: Synthetic peptide
DEEEIRTTNPVATEQYGSWETNLQPGNR

SEQ ID NO: 14736 - protein, 28 aa, Artificial Sequence
  Description of Artificial Sequence: Synthetic peptide
DEEEIRTTNPVATEQYGSASENLQRGNM

SEQ ID NO: 14737 - protein, 28 aa, Artificial Sequence
  Description of Artificial Sequence: Synthetic peptide
DEEEIRTTNPVATEQYGQVSTNLIYGNR

SEQ ID NO: 14738 - protein, 28 aa, Artificial Sequence
  Description of Artificial Sequence: Synthetic peptide
DEEEIRTTNPYATEQYGSVSTNLQRLGR

SEQ ID NO: 14739 - protein, 28 aa, Artificial Sequence
  Description of Artificial Sequence: Synthetic peptide
DEEEIATTNPVATEVYGVVSTNLQRGNR

SEQ ID NO: 14740 - protein, 29 aa, Artificial Sequence
  Description of Artificial Sequence: Synthetic peptide
DEEEIRTTNPVATEQYGSVHQTNLQRGNP

SEQ ID NO: 14741 - protein, 29 aa, Artificial Sequence
  Description of Artificial Sequence: Synthetic peptide
DEEEIRCTNPVATEQYGSVSTNLQREGLR

SEQ ID NO: 14742 - protein, 29 aa, Artificial Sequence
  Description of Artificial Sequence: Synthetic peptide
DEIEIRTTNPVATEQYGEVSTNLQSRGNR

SEQ ID NO: 14743 - protein, 28 aa, Artificial Sequence
  Description of Artificial Sequence: Synthetic peptide
DEEEIRTTNPVATEQYGDVSTNDQQGNR

SEQ ID NO: 14744 - protein, 28 aa, Artificial Sequence
  Description of Artificial Sequence: Synthetic peptide
DEAEIRTTNPVATEAYGSVSENLQRGNR

SEQ ID NO: 14745 - protein, 30 aa, Artificial Sequence
  Description of Artificial Sequence: Synthetic polypeptide
DEEEIRTTNPVATEQYGMSVHTNLQIRGNR

SEQ ID NO: 14746 - protein, 28 aa, Artificial Sequence
  Description of Artificial Sequence: Synthetic peptide
DEEEIRTTNPVATEQYGEASENLQRGNR

SEQ ID NO: 14747 - protein, 28 aa, Artificial Sequence
  Description of Artificial Sequence: Synthetic peptide
DEEEIRTTNPVATEQYGSASTVLQHGNR

SEQ ID NO: 14748 - protein, 28 aa, Artificial Sequence
  Description of Artificial Sequence: Synthetic peptide
DEEEIATTNPVSTEQYGSVCTNLQRGNR

SEQ ID NO: 14749 - protein, 28 aa, Artificial Sequence
  Description of Artificial Sequence: Synthetic peptide
DEEEIKTTNPVATEQYGSVSENLQHGNR

SEQ ID NO: 14750 - protein, 29 aa, Artificial Sequence
  Description of Artificial Sequence: Synthetic peptide
DEEEIRTTNPVATEQYGDSVSTALQRGER

SEQ ID NO: 14751 - protein, 28 aa, Artificial Sequence
  Description of Artificial Sequence: Synthetic peptide
DEEEIYTTNIVATEQGGSVSTNLQRGNR

SEQ ID NO: 14752 - protein, 28 aa, Artificial Sequence
  Description of Artificial Sequence: Synthetic peptide
DEEEIRTTNPVATEMYGSVSENLQRGMR

SEQ ID NO: 14753 - protein, 28 aa, Artificial Sequence
  Description of Artificial Sequence: Synthetic peptide
DEEEIRTTNPVATEQYGTMSTNLQIGNR

SEQ ID NO: 14754 - protein, 28 aa, Artificial Sequence
  Description of Artificial Sequence: Synthetic peptide
DEEEIRTTNPVATEQYGSVSTNLQRETA

SEQ ID NO: 14755 - protein, 28 aa, Artificial Sequence
  Description of Artificial Sequence: Synthetic peptide
DEEEIRTTNPVSTEQYGSVSTVLQRGNM

SEQ ID NO: 14756 - protein, 29 aa, Artificial Sequence
  Description of Artificial Sequence: Synthetic peptide
DEEEIRTTNPVATEQYGDVSENLQLRGNR

SEQ ID NO: 14757 - protein, 28 aa, Artificial Sequence
  Description of Artificial Sequence: Synthetic peptide
DESEIRTTNPVSTEQYGSVSCNLQRGNR

SEQ ID NO: 14758 - protein, 28 aa, Artificial Sequence
  Description of Artificial Sequence: Synthetic peptide
DEEEISTTNPVATEQYGSVSTNLQRGTL

SEQ ID NO: 14759 - protein, 28 aa, Artificial Sequence
  Description of Artificial Sequence: Synthetic peptide
DEEEIRTTNPVATEQYGSVSTDLQTGNV

SEQ ID NO: 14760 - protein, 28 aa, Artificial Sequence
  Description of Artificial Sequence: Synthetic peptide
DEQEIRTTNICATEQYGSVSTNLQRGNR

SEQ ID NO: 14761 - protein, 28 aa, Artificial Sequence
  Description of Artificial Sequence: Synthetic peptide
DENEIRTTNPVATEVYGSVSTNLQRGNQ

SEQ ID NO: 14762 - protein, 28 aa, Artificial Sequence
  Description of Artificial Sequence: Synthetic peptide
DEEEIRTTNPVSTEQYGDVSENLQRGNR

SEQ ID NO: 14763 - protein, 28 aa, Artificial Sequence
  Description of Artificial Sequence: Synthetic peptide
DEEEIRTTNPVATEQYGSVSTNEMVGNR

SEQ ID NO: 14764 - protein, 28 aa, Artificial Sequence
  Description of Artificial Sequence: Synthetic peptide
AEEEIGTTNPVATEQYGSVSTVLQRGNR

SEQ ID NO: 14765 - protein, 28 aa, Artificial Sequence
  Description of Artificial Sequence: Synthetic peptide
DECEIRTTNPVATEQYGSVGENLQRGNR

SEQ ID NO: 14766 - protein, 28 aa, Artificial Sequence
  Description of Artificial Sequence: Synthetic peptide
DEEEIRTTNPVATEQYGDVSENLQQGNR

SEQ ID NO: 14767 - protein, 28 aa, Artificial Sequence
  Description of Artificial Sequence: Synthetic peptide
DDEEIRTTNPVATEQYGTVSTNLQRGNQ

SEQ ID NO: 14768 - protein, 28 aa, Artificial Sequence
  Description of Artificial Sequence: Synthetic peptide
DEEEIRTTNPVATEVYGSVGTNLQHGNR

SEQ ID NO: 14769 - protein, 28 aa, Artificial Sequence
  Description of Artificial Sequence: Synthetic peptide
DEEEIRTTNPVATEQYGSVSTELQAGNV

SEQ ID NO: 14770 - protein, 28 aa, Artificial Sequence
  Description of Artificial Sequence: Synthetic peptide
DEVEIRTTNPVATEQYGSVSENLQRGTR

SEQ ID NO: 14771 - protein, 28 aa, Artificial Sequence
  Description of Artificial Sequence: Synthetic peptide
DEEEIRTTNPVAWEQYGSVSENPQRGNR

SEQ ID NO: 14772 - protein, 29 aa, Artificial Sequence
  Description of Artificial Sequence: Synthetic peptide
DEEEIRTVNPVATEQYGSVSTNLQREGNN

SEQ ID NO: 14773 - protein, 28 aa, Artificial Sequence
  Description of Artificial Sequence: Synthetic peptide
DEEEIATTNPTATEQYGSVSTNLYRGNR

SEQ ID NO: 14774 - protein, 28 aa, Artificial Sequence
  Description of Artificial Sequence: Synthetic peptide
DEEEIRPTNPVATEPYGSVSENLQRGNR

SEQ ID NO: 14775 - protein, 28 aa, Artificial Sequence
  Description of Artificial Sequence: Synthetic peptide
DDEEIRTTNPVSTETYGSVSTNLQRGNR

SEQ ID NO: 14776 - protein, 28 aa, Artificial Sequence
  Description of Artificial Sequence: Synthetic peptide
DEEEIATTNPVATEQYGSVCENLQRGNR

SEQ ID NO: 14777 - protein, 28 aa, Artificial Sequence
  Description of Artificial Sequence: Synthetic peptide
DEEEIRTTNPVATEQYGSVSMNWERGNR

SEQ ID NO: 14778 - protein, 28 aa, Artificial Sequence
  Description of Artificial Sequence: Synthetic peptide
DEQEIRTTNIDATEQYGSVSTNLQRGNR

SEQ ID NO: 14779 - protein, 28 aa, Artificial Sequence
  Description of Artificial Sequence: Synthetic peptide
DEEEIRTTNPVATEQYGSVSTELEVGNR

SEQ ID NO: 14780 - protein, 29 aa, Artificial Sequence
  Description of Artificial Sequence: Synthetic peptide
DEEEIRTTNPVATEQYGSVSTDLQEAGNR

SEQ ID NO: 14781 - protein, 28 aa, Artificial Sequence
  Description of Artificial Sequence: Synthetic peptide
DEDEISTTNPVATEQYGSCSTNLQRGNR

SEQ ID NO: 14782 - protein, 28 aa, Artificial Sequence
  Description of Artificial Sequence: Synthetic peptide
MEEEIRTTNPVATEQYGSVSTDLQLGNR

SEQ ID NO: 14783 - protein, 28 aa, Artificial Sequence
  Description of Artificial Sequence: Synthetic peptide
NEEEIRTTNPVATEQYGSVSTNLDIGNR

SEQ ID NO: 14784 - protein, 28 aa, Artificial Sequence
  Description of Artificial Sequence: Synthetic peptide
DEEEIRTTNPVATEQYGSVSENEQIGNR

SEQ ID NO: 14785 - protein, 28 aa, Artificial Sequence
  Description of Artificial Sequence: Synthetic peptide
DEEEITTTNIVATEQYGSVDTNLQRGNR

SEQ ID NO: 14786 - protein, 29 aa, Artificial Sequence
  Description of Artificial Sequence: Synthetic peptide
DEEEIRCTNPVATEQYGIVSTNLQIRGNR

SEQ ID NO: 14787 - protein, 28 aa, Artificial Sequence
  Description of Artificial Sequence: Synthetic peptide
KEEEIRTTNIVATEQYGSVSENLQRGNR

SEQ ID NO: 14788 - protein, 28 aa, Artificial Sequence
  Description of Artificial Sequence: Synthetic peptide
DESEIRTTNPVATEQYGSVSTNLQAGDR

SEQ ID NO: 14789 - protein, 29 aa, Artificial Sequence
  Description of Artificial Sequence: Synthetic peptide
DEEEVRTTNPVATEQYGSVSTNLQERGNF

SEQ ID NO: 14790 - protein, 28 aa, Artificial Sequence
  Description of Artificial Sequence: Synthetic peptide
DEEEIRTTNPVSTEPYGSVSTNLQRGNT

SEQ ID NO: 14791 - protein, 28 aa, Artificial Sequence
  Description of Artificial Sequence: Synthetic peptide
DEEEIRTTNPVATECYGSVSTNQQRGNN

SEQ ID NO: 14792 - protein, 28 aa, Artificial Sequence
  Description of Artificial Sequence: Synthetic peptide
DEEEIRTTNPVATEQYGSVSTDLERGNI

SEQ ID NO: 14793 - protein, 28 aa, Artificial Sequence
  Description of Artificial Sequence: Synthetic peptide
DEEEIRTTNPVATEGYGSVSEVLQRGNR

SEQ ID NO: 14794 - protein, 28 aa, Artificial Sequence
  Description of Artificial Sequence: Synthetic peptide
QEEEIRTTNIVATEQYGSVSTNLQIGNR

SEQ ID NO: 14795 - protein, 28 aa, Artificial Sequence
  Description of Artificial Sequence: Synthetic peptide
DEEEIVTTNPVATEQYGSVSENLQRGNQ

SEQ ID NO: 14796 - protein, 28 aa, Artificial Sequence
  Description of Artificial Sequence: Synthetic peptide
DEEEIRTTNPVATEQYGEASTNLQRGMR

SEQ ID NO: 14797 - protein, 28 aa, Artificial Sequence
  Description of Artificial Sequence: Synthetic peptide
KEEEIRTTNIVATEQYGSVSTNLQRGNQ

SEQ ID NO: 14798 - protein, 28 aa, Artificial Sequence
  Description of Artificial Sequence: Synthetic peptide
DEEEIRTTNPVATEMYGEVSTNLQRGNA

SEQ ID NO: 14799 - protein, 29 aa, Artificial Sequence
  Description of Artificial Sequence: Synthetic peptide
DEEEIRTTNPVATECYGSVSTNLQRGNDT

SEQ ID NO: 14800 - protein, 28 aa, Artificial Sequence
  Description of Artificial Sequence: Synthetic peptide
DEEEIRTTNPVATEQYGSASTNLQRENQ

SEQ ID NO: 14801 - protein, 28 aa, Artificial Sequence
  Description of Artificial Sequence: Synthetic peptide
DEEEIRTTNPVATECYGSVSTNEQRGNQ

SEQ ID NO: 14802 - protein, 29 aa, Artificial Sequence
  Description of Artificial Sequence: Synthetic peptide
DEEEIATTNPVATEQYGSVSTDLQRGNWR

SEQ ID NO: 14803 - protein, 30 aa, Artificial Sequence
  Description of Artificial Sequence: Synthetic polypeptide
DEEEIRTTNPVATEQYGSVSTNLVQENGNR

SEQ ID NO: 14804 - protein, 28 aa, Artificial Sequence
  Description of Artificial Sequence: Synthetic peptide
MEEEIRTTNPVATEQYGSVSTNLQTGNL

SEQ ID NO: 14805 - protein, 28 aa, Artificial Sequence
  Description of Artificial Sequence: Synthetic peptide
DEEEIRTTNPVATEQWGSVSDNLQRGPR

SEQ ID NO: 14806 - protein, 28 aa, Artificial Sequence
  Description of Artificial Sequence: Synthetic peptide
DEEEIRTTNPVATEQGGVVSVNLQRGNR

SEQ ID NO: 14807 - protein, 28 aa, Artificial Sequence
  Description of Artificial Sequence: Synthetic peptide
DEEEIRCTNPVATEQWGSVSTNLQRGNS

SEQ ID NO: 14808 - protein, 28 aa, Artificial Sequence
  Description of Artificial Sequence: Synthetic peptide
DEQEIATTNPVATEQYGWVSTNLQRGNR

SEQ ID NO: 14809 - protein, 28 aa, Artificial Sequence
  Description of Artificial Sequence: Synthetic peptide
DEEEIRTTNPVATEQYGSHSENLQTGNR

SEQ ID NO: 14810 - protein, 28 aa, Artificial Sequence
  Description of Artificial Sequence: Synthetic peptide
DEEEIRTTNPVATEQYGSVSMNIQPGNR

SEQ ID NO: 14811 - protein, 28 aa, Artificial Sequence
  Description of Artificial Sequence: Synthetic peptide
DEEEIRTTNPVATEQYGSVDTGPQRGNR

SEQ ID NO: 14812 - protein, 28 aa, Artificial Sequence
  Description of Artificial Sequence: Synthetic peptide
DEDEIRTTNPVATEIYGSVSTNLQYGNR

SEQ ID NO: 14813 - protein, 28 aa, Artificial Sequence
  Description of Artificial Sequence: Synthetic peptide
DEEEIRTTNPTATEQYGSVATNLQVGNR

SEQ ID NO: 14814 - protein, 28 aa, Artificial Sequence
  Description of Artificial Sequence: Synthetic peptide
DEEEIRCTNPVATEMYGSVSTNLQIGNR

SEQ ID NO: 14815 - protein, 28 aa, Artificial Sequence
  Description of Artificial Sequence: Synthetic peptide
DEEEIRCTNPVATEQYGSVSTNLMRGNF

SEQ ID NO: 14816 - protein, 28 aa, Artificial Sequence
  Description of Artificial Sequence: Synthetic peptide
DEEEIRTTNPVATEQYGSVSTPEQLGNR

SEQ ID NO: 14817 - protein, 30 aa, Artificial Sequence
  Description of Artificial Sequence: Synthetic polypeptide
DEEEIRTTNPVATEQYGSVSTNLQEVNGNR

SEQ ID NO: 14818 - protein, 29 aa, Artificial Sequence
  Description of Artificial Sequence: Synthetic peptide
DEEEIRTTNPVATEQYGSASTNLQCRGDR

SEQ ID NO: 14819 - protein, 28 aa, Artificial Sequence
  Description of Artificial Sequence: Synthetic peptide
DEEEIRTTNPVASEQYGDVSTNLQVGNR

SEQ ID NO: 14820 - protein, 28 aa, Artificial Sequence
  Description of Artificial Sequence: Synthetic peptide
DEEEIRTTNPVSTEQYGTVSTNLQSGNR

SEQ ID NO: 14821 - protein, 30 aa, Artificial Sequence
  Description of Artificial Sequence: Synthetic polypeptide
DEEEIRTTNPVATAQYGSVSTPNPLQRGNR

SEQ ID NO: 14822 - protein, 28 aa, Artificial Sequence
  Description of Artificial Sequence: Synthetic peptide
DEEEIRCTNPVATEQYGSVSNALQRGNR

SEQ ID NO: 14823 - protein, 28 aa, Artificial Sequence
  Description of Artificial Sequence: Synthetic peptide
DETEIRTTNPVATEQYGEVSTNLQRGGR

SEQ ID NO: 14824 - protein, 28 aa, Artificial Sequence
  Description of Artificial Sequence: Synthetic peptide
SEEEIRTTNPVATEQYGSVSENLQRGNQ

SEQ ID NO: 14825 - protein, 30 aa, Artificial Sequence
  Description of Artificial Sequence: Synthetic polypeptide
DEEEIRTTNPVATEQYGSVSETENLERGNR

SEQ ID NO: 14826 - protein, 28 aa, Artificial Sequence
  Description of Artificial Sequence: Synthetic peptide
DEEEIRTTNIVATEQYGSVSTNIMRGNR

SEQ ID NO: 14827 - protein, 30 aa, Artificial Sequence
  Description of Artificial Sequence: Synthetic polypeptide
DEEEIRTTNPVATEQYGSVSETNLQEPGNR

SEQ ID NO: 14828 - protein, 28 aa, Artificial Sequence
  Description of Artificial Sequence: Synthetic peptide
DEEEIRTTNPVATEQYGSVSENLQRFVR

SEQ ID NO: 14829 - protein, 28 aa, Artificial Sequence
  Description of Artificial Sequence: Synthetic peptide
DEEEIATTNPVATEQYGDVSTNLQHGNR

SEQ ID NO: 14830 - protein, 28 aa, Artificial Sequence
  Description of Artificial Sequence: Synthetic peptide
QEEEIRTTNPVATEQYGSVSTNLQHGNL

SEQ ID NO: 14831 - protein, 29 aa, Artificial Sequence
  Description of Artificial Sequence: Synthetic peptide
DEDEIRTTNPVATEQYGSVSTLNLQRGNY

SEQ ID NO: 14832 - protein, 28 aa, Artificial Sequence
  Description of Artificial Sequence: Synthetic peptide
DEEEIRTTNPVATEQWGSVSENLQVGNR

SEQ ID NO: 14833 - protein, 28 aa, Artificial Sequence
  Description of Artificial Sequence: Synthetic peptide
DETEIRTTNPVATEQYGSVSDNLQLGNR

SEQ ID NO: 14834 - protein, 30 aa, Artificial Sequence
  Description of Artificial Sequence: Synthetic polypeptide
DEEEIRTTNPVATEQYGSVSTNLQENGNTR

SEQ ID NO: 14835 - protein, 28 aa, Artificial Sequence
  Description of Artificial Sequence: Synthetic peptide
DEEEIATTNPVATEVYGSVSTDLQRGNR

SEQ ID NO: 14836 - protein, 28 aa, Artificial Sequence
  Description of Artificial Sequence: Synthetic peptide
DEEEIRTTNIVATECYGSVSTNLQRGQR

SEQ ID NO: 14837 - protein, 29 aa, Artificial Sequence
  Description of Artificial Sequence: Synthetic peptide
DEEEIRTTNPVATEQYGSVSTNEQRGDNV

SEQ ID NO: 14838 - protein, 28 aa, Artificial Sequence
  Description of Artificial Sequence: Synthetic peptide
DEEEIRTTNPVATEQYGSVSDNLQIGNW

SEQ ID NO: 14839 - protein, 31 aa, Artificial Sequence
  Description of Artificial Sequence: Synthetic polypeptide
DEEEIRTTNPVATEQYGSVSTMNLQDRGNTR

SEQ ID NO: 14840 - protein, 28 aa, Artificial Sequence
  Description of Artificial Sequence: Synthetic peptide
DEEEIRTTNPVATEQYGSVSTELERGND

SEQ ID NO: 14841 - protein, 28 aa, Artificial Sequence
  Description of Artificial Sequence: Synthetic peptide
DEEEIRTTNPVSTEQWGSVSTNLQRGNL

SEQ ID NO: 14842 - protein, 29 aa, Artificial Sequence
  Description of Artificial Sequence: Synthetic peptide
DEEEIRTTNPVATEQYGSVSDNLQRAGMR

SEQ ID NO: 14843 - protein, 30 aa, Artificial Sequence
  Description of Artificial Sequence: Synthetic polypeptide
DEEEIRTTNPVATEQYGSVSTNLQCYGNDR

SEQ ID NO: 14844 - protein, 28 aa, Artificial Sequence
  Description of Artificial Sequence: Synthetic peptide
DEEEIRTTNIVATEIYGSVSTNLQRGNY

SEQ ID NO: 14845 - protein, 28 aa, Artificial Sequence
  Description of Artificial Sequence: Synthetic peptide
DEEEIRTTNPTATEQYGSVSTNLQNGNE

SEQ ID NO: 14846 - protein, 28 aa, Artificial Sequence
  Description of Artificial Sequence: Synthetic peptide
DEEEIRTTNPVATEQYGSVSEQLQRGNG

SEQ ID NO: 14847 - protein, 28 aa, Artificial Sequence
  Description of Artificial Sequence: Synthetic peptide
DEEEIRATNPVATEQYGSVSDNLQYGNR

SEQ ID NO: 14848 - protein, 28 aa, Artificial Sequence
  Description of Artificial Sequence: Synthetic peptide
DEQEIRTTNPVATEQYGSVSTDDQRGNR

SEQ ID NO: 14849 - protein, 28 aa, Artificial Sequence
  Description of Artificial Sequence: Synthetic peptide
SEEEIRTTNPVATECYGSVSTNLQRGNY

SEQ ID NO: 14850 - protein, 29 aa, Artificial Sequence
  Description of Artificial Sequence: Synthetic peptide
DEEEIRTTNPVATEQYGSVSTNLQQGNDH

SEQ ID NO: 14851 - protein, 28 aa, Artificial Sequence
  Description of Artificial Sequence: Synthetic peptide
GEEELRTTNPVSTEQYGSVSTNLQRGNR

SEQ ID NO: 14852 - protein, 28 aa, Artificial Sequence
  Description of Artificial Sequence: Synthetic peptide
DENEIRTTNPTATEQYGSVSENLQRGNR

SEQ ID NO: 14853 - protein, 29 aa, Artificial Sequence
  Description of Artificial Sequence: Synthetic peptide
DEEEIRTTNPVATEQYGSVAETNLQNGNR

SEQ ID NO: 14854 - protein, 28 aa, Artificial Sequence
  Description of Artificial Sequence: Synthetic peptide
DEEEIRTTNIVATECYGVVSTNLQRGNR

SEQ ID NO: 14855 - protein, 28 aa, Artificial Sequence
  Description of Artificial Sequence: Synthetic peptide
DDEEIRTTNPVATEQYGTVSTDLQRGNR

SEQ ID NO: 14856 - protein, 28 aa, Artificial Sequence
  Description of Artificial Sequence: Synthetic peptide
DEDEIRTTNPVATEQYGEASTNLQRGNR

SEQ ID NO: 14857 - protein, 28 aa, Artificial Sequence
  Description of Artificial Sequence: Synthetic peptide
DEDEIRTTNPVATEQYGSASTNLQRGNQ

SEQ ID NO: 14858 - protein, 28 aa, Artificial Sequence
  Description of Artificial Sequence: Synthetic peptide
DEEEIRTTNPVATECYGSVSTNLQTGNS

SEQ ID NO: 14859 - protein, 28 aa, Artificial Sequence
  Description of Artificial Sequence: Synthetic peptide
DEVEIYTTNPVATEQYGSVSENLQRGNR

SEQ ID NO: 14860 - protein, 29 aa, Artificial Sequence
  Description of Artificial Sequence: Synthetic peptide
DEEEIRTTNPVATEQYGSVSEMNLQRGNQ

SEQ ID NO: 14861 - protein, 29 aa, Artificial Sequence
  Description of Artificial Sequence: Synthetic peptide
DEEEIRTTNPVATECYGSVSVTNLQRGNF

SEQ ID NO: 14862 - protein, 28 aa, Artificial Sequence
  Description of Artificial Sequence: Synthetic peptide
DEEEIRTTNPVATEQYGSVSTDLQNGNL

SEQ ID NO: 14863 - protein, 29 aa, Artificial Sequence
  Description of Artificial Sequence: Synthetic peptide
MEEEIRTTNPVATEQYGSVSTNLQERGNM

SEQ ID NO: 14864 - protein, 28 aa, Artificial Sequence
  Description of Artificial Sequence: Synthetic peptide
DEEEIRTTNPVATEEYGDVSENLQRGNR

SEQ ID NO: 14865 - protein, 29 aa, Artificial Sequence
  Description of Artificial Sequence: Synthetic peptide
SEEEIRTTNPVATEQYGSVSTNDQRKGNR

SEQ ID NO: 14866 - protein, 30 aa, Artificial Sequence
  Description of Artificial Sequence: Synthetic polypeptide
DEEEIRTTNPVATEQYGSVSTNLQDYKGNR

SEQ ID NO: 14867 - protein, 28 aa, Artificial Sequence
  Description of Artificial Sequence: Synthetic peptide
DEQEIRTTNPVATEQYGSVSTNLQNGNM

SEQ ID NO: 14868 - protein, 28 aa, Artificial Sequence
  Description of Artificial Sequence: Synthetic peptide
DEEEIRTTNPVATEGYGSVGTNLQTGNR

SEQ ID NO: 14869 - protein, 28 aa, Artificial Sequence
  Description of Artificial Sequence: Synthetic peptide
DEEEIRTTNPVSTEQYGSVSVNLQIGNR

SEQ ID NO: 14870 - protein, 28 aa, Artificial Sequence
  Description of Artificial Sequence: Synthetic peptide
DEEEIRTTNIVATECYGGVSTNLQRGNR

SEQ ID NO: 14871 - protein, 28 aa, Artificial Sequence
  Description of Artificial Sequence: Synthetic peptide
DEEEIRATNPVATEQYGSVSTNLQLGNY

SEQ ID NO: 14872 - protein, 28 aa, Artificial Sequence
  Description of Artificial Sequence: Synthetic peptide
DEEETRTTNPVATEQYGSVSTNLSRGNL

SEQ ID NO: 14873 - protein, 28 aa, Artificial Sequence
  Description of Artificial Sequence: Synthetic peptide
DEEEIATTNPVATEQYGSVSTNLEYGNR

SEQ ID NO: 14874 - protein, 29 aa, Artificial Sequence
  Description of Artificial Sequence: Synthetic peptide
DEEEIRTTNPVATECYGSVSTNLQDHGNR

SEQ ID NO: 14875 - protein, 28 aa, Artificial Sequence
  Description of Artificial Sequence: Synthetic peptide
DEEEIRTTNPVATEQYGEVSENLQRGGR

SEQ ID NO: 14876 - protein, 28 aa, Artificial Sequence
  Description of Artificial Sequence: Synthetic peptide
DEEEIRTTNPVATEQYGSVSTNPEAGNR

SEQ ID NO: 14877 - protein, 29 aa, Artificial Sequence
  Description of Artificial Sequence: Synthetic peptide
DEEEIRTTNPVATEQYGSVSTNLQILGNQ

SEQ ID NO: 14878 - protein, 28 aa, Artificial Sequence
  Description of Artificial Sequence: Synthetic peptide
DEGEIRCTNIVATEQYGSVSTNLQRGNR

SEQ ID NO: 14879 - protein, 28 aa, Artificial Sequence
  Description of Artificial Sequence: Synthetic peptide
DEEEIRTTNPVATEQYGSVSTNDQQGER

SEQ ID NO: 14880 - protein, 28 aa, Artificial Sequence
  Description of Artificial Sequence: Synthetic peptide
MEEEIRTTNPVATEQYGSMSTNLQRGER

SEQ ID NO: 14881 - protein, 30 aa, Artificial Sequence
  Description of Artificial Sequence: Synthetic polypeptide
DEEEIRTTNPVATEQYGSVSTNGLQDRGNN

SEQ ID NO: 14882 - protein, 28 aa, Artificial Sequence
  Description of Artificial Sequence: Synthetic peptide
DEEEIRTTNPVATEQYGSVSTNLEQGNS

SEQ ID NO: 14883 - protein, 29 aa, Artificial Sequence
  Description of Artificial Sequence: Synthetic peptide
DEEEIRTVNPVATEQYGSVSTNLQYRGNL

SEQ ID NO: 14884 - protein, 30 aa, Artificial Sequence
  Description of Artificial Sequence: Synthetic polypeptide
DEEEIRTTNPYATEQYGSVSTTNLQRDGNR

SEQ ID NO: 14885 - protein, 28 aa, Artificial Sequence
  Description of Artificial Sequence: Synthetic peptide
DEKEIRTTNPVATEQYGSVSWNLQQGNR

SEQ ID NO: 14886 - protein, 28 aa, Artificial Sequence
  Description of Artificial Sequence: Synthetic peptide
DEGEIRTTNPTATEQYGSVSTNLQRGNF

SEQ ID NO: 14887 - protein, 28 aa, Artificial Sequence
  Description of Artificial Sequence: Synthetic peptide
DEEEIRTTNPVATEQYGSVSTNEQQGNN

SEQ ID NO: 14888 - protein, 28 aa, Artificial Sequence
  Description of Artificial Sequence: Synthetic peptide
DEEEIRTTNPVATEQYGIVSTNLQRTNQ

SEQ ID NO: 14889 - protein, 28 aa, Artificial Sequence
  Description of Artificial Sequence: Synthetic peptide
DEEEIRTTNPVATELYGSVSTNLQGGNS

SEQ ID NO: 14890 - protein, 28 aa, Artificial Sequence
  Description of Artificial Sequence: Synthetic peptide
DEEEIRTTNPVATEQYGIVSTALQQGNR

SEQ ID NO: 14891 - protein, 28 aa, Artificial Sequence
  Description of Artificial Sequence: Synthetic peptide
DEIEIRTTNIVATEQYGSVSTNEQRGNR

SEQ ID NO: 14892 - protein, 28 aa, Artificial Sequence
  Description of Artificial Sequence: Synthetic peptide
DEEEIRTTNPVATEQYGSVSTGDQRGNF

SEQ ID NO: 14893 - protein, 28 aa, Artificial Sequence
  Description of Artificial Sequence: Synthetic peptide
AEEEIRTTNPVATEQYGSVSENLQHGNR

SEQ ID NO: 14894 - protein, 30 aa, Artificial Sequence
  Description of Artificial Sequence: Synthetic polypeptide
DENEIRTTNPVATEQYGSVSTENLQRNGNR

SEQ ID NO: 14895 - protein, 29 aa, Artificial Sequence
  Description of Artificial Sequence: Synthetic peptide
DEEEIRTTNPVATEQYGSVSTANPQNGNR

SEQ ID NO: 14896 - protein, 28 aa, Artificial Sequence
  Description of Artificial Sequence: Synthetic peptide
NEEEIRTTNPVATEQYGEVSTNLQTGNR

SEQ ID NO: 14897 - protein, 28 aa, Artificial Sequence
  Description of Artificial Sequence: Synthetic peptide
DEEEIRTTNPVATEVYGSVSTNLQHGNN

SEQ ID NO: 14898 - protein, 28 aa, Artificial Sequence
  Description of Artificial Sequence: Synthetic peptide
DEEEIRTTNPVATEQYGSVSTDLQLGNL

SEQ ID NO: 14899 - protein, 28 aa, Artificial Sequence
  Description of Artificial Sequence: Synthetic peptide
DEEEICTTNPVATEQYGWVGTNLQRGNR

SEQ ID NO: 14900 - protein, 28 aa, Artificial Sequence
  Description of Artificial Sequence: Synthetic peptide
DEEEIRTTNPVATEQYGSVATNLQNGNM

SEQ ID NO: 14901 - protein, 29 aa, Artificial Sequence
  Description of Artificial Sequence: Synthetic peptide
DEEEIRTTNPVATECYGSVSTNLQIQGNR

SEQ ID NO: 14902 - protein, 28 aa, Artificial Sequence
  Description of Artificial Sequence: Synthetic peptide
DEEEIRTTNPVATEQYGEASTVLQRGNR

SEQ ID NO: 14903 - protein, 28 aa, Artificial Sequence
  Description of Artificial Sequence: Synthetic peptide
DEEEIRTTNIVATEIYGSVSTNLQRGNC

SEQ ID NO: 14904 - protein, 28 aa, Artificial Sequence
  Description of Artificial Sequence: Synthetic peptide
DEEEICTTNPVATEQYGSASDNLQRGNR

SEQ ID NO: 14905 - protein, 28 aa, Artificial Sequence
  Description of Artificial Sequence: Synthetic peptide
DEEEIRTTNPVATELYGSVSTNLERGNS

SEQ ID NO: 14906 - protein, 28 aa, Artificial Sequence
  Description of Artificial Sequence: Synthetic peptide
DEEEIRTTNPVATECYGSVSTNMQGGNR

SEQ ID NO: 14907 - protein, 28 aa, Artificial Sequence
  Description of Artificial Sequence: Synthetic peptide
DEEEIRTTNPVATEQYGSVSTNLMIGNL

SEQ ID NO: 14908 - protein, 28 aa, Artificial Sequence
  Description of Artificial Sequence: Synthetic peptide
NEEEIRTTNPVATEQYGSVATNLQRGNI

SEQ ID NO: 14909 - protein, 28 aa, Artificial Sequence
  Description of Artificial Sequence: Synthetic peptide
DEEEIRTTNPVASEQYGGVATNLQRGNR

SEQ ID NO: 14910 - protein, 28 aa, Artificial Sequence
  Description of Artificial Sequence: Synthetic peptide
MEQEIRTTNPVATEQYGSVSFNLQRGNR

SEQ ID NO: 14911 - protein, 29 aa, Artificial Sequence
  Description of Artificial Sequence: Synthetic peptide
DEEEIRTTNPVCTEQYGSVSTNLQQRGNM

SEQ ID NO: 14912 - protein, 29 aa, Artificial Sequence
  Description of Artificial Sequence: Synthetic peptide
DEEEIRTTNPVATEQYGSVSENLQTVGNR

SEQ ID NO: 14913 - protein, 28 aa, Artificial Sequence
  Description of Artificial Sequence: Synthetic peptide
DEEEIAQTNPVATEQYGSVSTDLQRGNR

SEQ ID NO: 14914 - protein, 28 aa, Artificial Sequence
  Description of Artificial Sequence: Synthetic peptide
DEEEIRTTNPVATECYGSVSTNLQNGNM

SEQ ID NO: 14915 - protein, 28 aa, Artificial Sequence
  Description of Artificial Sequence: Synthetic peptide
DEEEIRTVNPVSTEQYGSVSTNLQRLNQ

SEQ ID NO: 14916 - protein, 29 aa, Artificial Sequence
  Description of Artificial Sequence: Synthetic peptide
DEEEIATTNPVATEQYGSVYSTNLQRGDT

SEQ ID NO: 14917 - protein, 30 aa, Artificial Sequence
  Description of Artificial Sequence: Synthetic polypeptide
DEEEIRTTNPVATEQYGSVSTNLQAEGENM

SEQ ID NO: 14918 - protein, 28 aa, Artificial Sequence
  Description of Artificial Sequence: Synthetic peptide
DEQEIRTTNPVASEQYGSVATNLERGNR

SEQ ID NO: 14919 - protein, 30 aa, Artificial Sequence
  Description of Artificial Sequence: Synthetic polypeptide
DEEEIVTTNPVATEQYGSVSTNLQIDGNDR

SEQ ID NO: 14920 - protein, 29 aa, Artificial Sequence
  Description of Artificial Sequence: Synthetic peptide
DEEEIATTNPVAWEQYGSVSTNGLQRGNF

SEQ ID NO: 14921 - protein, 29 aa, Artificial Sequence
  Description of Artificial Sequence: Synthetic peptide
SEEEIRTTNPVATEQYGSVSENLQRGVDR

SEQ ID NO: 14922 - protein, 28 aa, Artificial Sequence
  Description of Artificial Sequence: Synthetic peptide
DEEEIRTTNPVATECWGSVSENLQRGNM

SEQ ID NO: 14923 - protein, 28 aa, Artificial Sequence
  Description of Artificial Sequence: Synthetic peptide
DECEIRTTNPVATEQYGTVDTNLQGGNR

SEQ ID NO: 14924 - protein, 28 aa, Artificial Sequence
  Description of Artificial Sequence: Synthetic peptide
DENEIRTTNPTATEHYGSVSTNLQRGTR

SEQ ID NO: 14925 - protein, 28 aa, Artificial Sequence
  Description of Artificial Sequence: Synthetic peptide
DEEEIRSTNPVASEQYGTVSTNLQVGNR

SEQ ID NO: 14926 - protein, 28 aa, Artificial Sequence
  Description of Artificial Sequence: Synthetic peptide
DEEEIRTTNPVATECYGDVSTNLQAGNC

SEQ ID NO: 14927 - protein, 28 aa, Artificial Sequence
  Description of Artificial Sequence: Synthetic peptide
DEQEIRTTNIVATEQYGSVSTNDQGGNR

SEQ ID NO: 14928 - protein, 28 aa, Artificial Sequence
  Description of Artificial Sequence: Synthetic peptide
DENEIRTTNPVSTEQWGSVSENLQRGNR

SEQ ID NO: 14929 - protein, 30 aa, Artificial Sequence
  Description of Artificial Sequence: Synthetic polypeptide
DEEEIRTTNPVATEQYGSTSITNLQIGENR

SEQ ID NO: 14930 - protein, 29 aa, Artificial Sequence
  Description of Artificial Sequence: Synthetic peptide
DEEEIRTTNPVATEQYGSVSTNPQRGPTQ

SEQ ID NO: 14931 - protein, 28 aa, Artificial Sequence
  Description of Artificial Sequence: Synthetic peptide
MEEEIRTTNIVATEQYGSVEENLQRGNR

SEQ ID NO: 14932 - protein, 28 aa, Artificial Sequence
  Description of Artificial Sequence: Synthetic peptide
DDEEIGTTNPAATEQYGSVSENLQRGNR

SEQ ID NO: 14933 - protein, 28 aa, Artificial Sequence
  Description of Artificial Sequence: Synthetic peptide
DEEEIRATNPVATEVYGVVATNLQRGNR

SEQ ID NO: 14934 - protein, 28 aa, Artificial Sequence
  Description of Artificial Sequence: Synthetic peptide
MEEEIRTTNPVATEQYGVVSTNLQRGEA

SEQ ID NO: 14935 - protein, 30 aa, Artificial Sequence
  Description of Artificial Sequence: Synthetic polypeptide
DEEEIRTTNPVATEQYGSVSTNEQELGNTR

SEQ ID NO: 14936 - protein, 28 aa, Artificial Sequence
  Description of Artificial Sequence: Synthetic peptide
DEEEIRTTNPVATECWGSVSTQEQRGNR

SEQ ID NO: 14937 - protein, 30 aa, Artificial Sequence
  Description of Artificial Sequence: Synthetic polypeptide
DEEEIRTTNPVATEQYGSVSCTDLQMGNDR

SEQ ID NO: 14938 - protein, 30 aa, Artificial Sequence
  Description of Artificial Sequence: Synthetic polypeptide
DEEEIRTTNPVATEQYGSVSTEPLQERGDR

SEQ ID NO: 14939 - protein, 28 aa, Artificial Sequence
  Description of Artificial Sequence: Synthetic peptide
DEEEIAATNIVATEQYGDVSTNLQRGNR

SEQ ID NO: 14940 - protein, 31 aa, Artificial Sequence
  Description of Artificial Sequence: Synthetic polypeptide
DEEEIRTTNPVATEQYGSVSTELVQRKGVNR

SEQ ID NO: 14941 - protein, 29 aa, Artificial Sequence
  Description of Artificial Sequence: Synthetic peptide
DEEEIRTTNPLATEQFGSVSTGNLQQGNR

SEQ ID NO: 14942 - protein, 29 aa, Artificial Sequence
  Description of Artificial Sequence: Synthetic peptide
DEEEIRTTNPVATEQYGSVSTDLQDQGER

SEQ ID NO: 14943 - protein, 28 aa, Artificial Sequence
  Description of Artificial Sequence: Synthetic peptide
DEGEIATTNPVATECYGSVSTNLQRGNQ

SEQ ID NO: 14944 - protein, 29 aa, Artificial Sequence
  Description of Artificial Sequence: Synthetic peptide
DEEEISTTNPCATEQYGSVSTNLQLQGNR

SEQ ID NO: 14945 - protein, 28 aa, Artificial Sequence
  Description of Artificial Sequence: Synthetic peptide
DESEIRTTNPVATEQYGSVSTNLQLGDM

SEQ ID NO: 14946 - protein, 28 aa, Artificial Sequence
  Description of Artificial Sequence: Synthetic peptide
AEEEIRTTNIVASEQYGSVSTNLQRGNF

SEQ ID NO: 14947 - protein, 28 aa, Artificial Sequence
  Description of Artificial Sequence: Synthetic peptide
DEEEIAQTNPVATEVYGEVSTNLQRGNR

SEQ ID NO: 14948 - protein, 28 aa, Artificial Sequence
  Description of Artificial Sequence: Synthetic peptide
DEEEIRTTNIVATEQYGSVSTLDQRGER

SEQ ID NO: 14949 - protein, 29 aa, Artificial Sequence
  Description of Artificial Sequence: Synthetic peptide
DEEEIRTTNPVASENYGAVSTNLQREGNR

SEQ ID NO: 14950 - protein, 29 aa, Artificial Sequence
  Description of Artificial Sequence: Synthetic peptide
DEQEIRTTNPVATEMYGSVSAENLQRGNR

SEQ ID NO: 14951 - protein, 29 aa, Artificial Sequence
  Description of Artificial Sequence: Synthetic peptide
DEEEIRTTNPVATESYGDVSLNLQTRGNR

SEQ ID NO: 14952 - protein, 28 aa, Artificial Sequence
  Description of Artificial Sequence: Synthetic peptide
DEEEIRTTNIVATECYGSVSDDLQRGNR

SEQ ID NO: 14953 - protein, 28 aa, Artificial Sequence
  Description of Artificial Sequence: Synthetic peptide
DEMEIRTTNPVATEMYGEVGTNLQRGNR

SEQ ID NO: 14954 - protein, 28 aa, Artificial Sequence
  Description of Artificial Sequence: Synthetic peptide
DEVEIRTTNPVATEVYGSVSTNLQIGNS

SEQ ID NO: 14955 - protein, 30 aa, Artificial Sequence
  Description of Artificial Sequence: Synthetic polypeptide
DEEEIRTTNPVATEQYGSVSTLNLQRGTSQ

SEQ ID NO: 14956 - protein, 28 aa, Artificial Sequence
  Description of Artificial Sequence: Synthetic peptide
AEEEIRTTNPVGTEQYGSVSENPQRGNR

SEQ ID NO: 14957 - protein, 28 aa, Artificial Sequence
  Description of Artificial Sequence: Synthetic peptide
QEGEITTTNPVATEQYGSVSCNLQRGNR

SEQ ID NO: 14958 - protein, 28 aa, Artificial Sequence
  Description of Artificial Sequence: Synthetic peptide
DEEEIRTTNPAATEQFGSVSTNWQFGNR

SEQ ID NO: 14959 - protein, 28 aa, Artificial Sequence
  Description of Artificial Sequence: Synthetic peptide
DEEEIATTNPVATEQYGSVSANLQRENQ

SEQ ID NO: 14960 - protein, 28 aa, Artificial Sequence
  Description of Artificial Sequence: Synthetic peptide
DEQEIATTNPVATEQYGSVDTNLQHGNR

SEQ ID NO: 14961 - protein, 28 aa, Artificial Sequence
  Description of Artificial Sequence: Synthetic peptide
DEEEIATTNPVATEIYGSVSTNLQHGNQ

SEQ ID NO: 14962 - protein, 30 aa, Artificial Sequence
  Description of Artificial Sequence: Synthetic polypeptide
DEEEIRTTNPVATEQYGSVDTMDLQRGNDR

SEQ ID NO: 14963 - protein, 29 aa, Artificial Sequence
  Description of Artificial Sequence: Synthetic peptide
DENEIRTTNPVATEVYGSVSTNWQRGDNR

SEQ ID NO: 14964 - protein, 28 aa, Artificial Sequence
  Description of Artificial Sequence: Synthetic peptide
DEEEIRTTNPVAWEQYGSVSCNWQIGNR

SEQ ID NO: 14965 - protein, 28 aa, Artificial Sequence
  Description of Artificial Sequence: Synthetic peptide
QEEEIRTTNPVATEQYGWVSTNLQNGER

SEQ ID NO: 14966 - protein, 28 aa, Artificial Sequence
  Description of Artificial Sequence: Synthetic peptide
DENEIATTNPVATEHYGTVSTNLQRGNR

SEQ ID NO: 14967 - protein, 29 aa, Artificial Sequence
  Description of Artificial Sequence: Synthetic peptide
CEEEIRTVNPVATEQYGSVATNLQFRGNR

SEQ ID NO: 14968 - protein, 28 aa, Artificial Sequence
  Description of Artificial Sequence: Synthetic peptide
DEEEIRTTNPVATEQWGSVSENLMRGNA

SEQ ID NO: 14969 - protein, 28 aa, Artificial Sequence
  Description of Artificial Sequence: Synthetic peptide
DEEEIRTTNPVATEQYGSVSTELQYGEV

SEQ ID NO: 14970 - protein, 28 aa, Artificial Sequence
  Description of Artificial Sequence: Synthetic peptide
DEEEIRTTNPVATEQYGSVSTELQGGEW

SEQ ID NO: 14971 - protein, 28 aa, Artificial Sequence
  Description of Artificial Sequence: Synthetic peptide
DEEEIRTTNPVATDQYGEVSENIQRGNR

SEQ ID NO: 14972 - protein, 28 aa, Artificial Sequence
  Description of Artificial Sequence: Synthetic peptide
DEEEIRTTNPVATEQYGDASTNLQRFNQ

SEQ ID NO: 14973 - protein, 28 aa, Artificial Sequence
  Description of Artificial Sequence: Synthetic peptide
DEEEISTTNPVATEQYGSMSTELQRGER

SEQ ID NO: 14974 - protein, 28 aa, Artificial Sequence
  Description of Artificial Sequence: Synthetic peptide
DEEEIRTTNPCAYEQYGSVATNLERGNR

SEQ ID NO: 14975 - protein, 29 aa, Artificial Sequence
  Description of Artificial Sequence: Synthetic peptide
DEEEIATTNPVATEQYGSVSTNLQDNGNQ

SEQ ID NO: 14976 - protein, 29 aa, Artificial Sequence
  Description of Artificial Sequence: Synthetic peptide
DEQEIRTTNPVATEQYGSVSTNLQNLGNA

SEQ ID NO: 14977 - protein, 28 aa, Artificial Sequence
  Description of Artificial Sequence: Synthetic peptide
REESIRTTNPVATEQYGSVSTLLMRGNR

SEQ ID NO: 14978 - protein, 28 aa, Artificial Sequence
  Description of Artificial Sequence: Synthetic peptide
DENEIAATNPVATEQYGSVSTNLQIGNR

SEQ ID NO: 14979 - protein, 28 aa, Artificial Sequence
  Description of Artificial Sequence: Synthetic peptide
DEEEIRCTNIVATEQYGSVSENLQQGNR

SEQ ID NO: 14980 - protein, 28 aa, Artificial Sequence
  Description of Artificial Sequence: Synthetic peptide
DEEEIKATNPVATEQWGSVSTNLQRGNF

SEQ ID NO: 14981 - protein, 28 aa, Artificial Sequence
  Description of Artificial Sequence: Synthetic peptide
DEEELRTTNPVAYEQYGSVDTNLLRGNR

SEQ ID NO: 14982 - protein, 28 aa, Artificial Sequence
  Description of Artificial Sequence: Synthetic peptide
AEEEIWTTNPIATEQYGSVGTNLQRGNR

SEQ ID NO: 14983 - protein, 29 aa, Artificial Sequence
  Description of Artificial Sequence: Synthetic peptide
DEEEIRCTNPVATEQYGSVSTNWQRGIDR

SEQ ID NO: 14984 - protein, 28 aa, Artificial Sequence
  Description of Artificial Sequence: Synthetic peptide
DEEEISTTNPVATEQWGSVSENLQRGNM

SEQ ID NO: 14985 - protein, 28 aa, Artificial Sequence
  Description of Artificial Sequence: Synthetic peptide
DENEIRTTNPVATEQYGSVSENEQQGNR

SEQ ID NO: 14986 - protein, 28 aa, Artificial Sequence
  Description of Artificial Sequence: Synthetic peptide
DEEEIRTTNPVATEQYGSVSTQLQDGDA

SEQ ID NO: 14987 - protein, 28 aa, Artificial Sequence
  Description of Artificial Sequence: Synthetic peptide
NEEEIRCTNPVATEPYGSVSTNLQQGNR

SEQ ID NO: 14988 - protein, 28 aa, Artificial Sequence
  Description of Artificial Sequence: Synthetic peptide
AEEEIRTTNPCATEQYGNVSTNLQRLNR

SEQ ID NO: 14989 - protein, 29 aa, Artificial Sequence
  Description of Artificial Sequence: Synthetic peptide
DEEEIATTNPVATEQYGEVSTNLQHAGNR

SEQ ID NO: 14990 - protein, 28 aa, Artificial Sequence
  Description of Artificial Sequence: Synthetic peptide
DEQEIATTNPVATEQYGSVSTNLQNGNM

SEQ ID NO: 14991 - protein, 29 aa, Artificial Sequence
  Description of Artificial Sequence: Synthetic peptide
MEEEIRTTNPVATEQYGSVSTNLQNGNDS

SEQ ID NO: 14992 - protein, 28 aa, Artificial Sequence
  Description of Artificial Sequence: Synthetic peptide
DENEIRTTNIVATEQYGSVSTNLQIGNA

SEQ ID NO: 14993 - protein, 28 aa, Artificial Sequence
  Description of Artificial Sequence: Synthetic peptide
DEQEIRQTNPVATEQYGSVSENQQRGNR

SEQ ID NO: 14994 - protein, 28 aa, Artificial Sequence
  Description of Artificial Sequence: Synthetic peptide
DEEEIRTTNPVATEQYGSVDTDLQTGNM

SEQ ID NO: 14995 - protein, 28 aa, Artificial Sequence
  Description of Artificial Sequence: Synthetic peptide
DEEEIRTTNPVSTECYGTVGTNLQRGNR

SEQ ID NO: 14996 - protein, 29 aa, Artificial Sequence
  Description of Artificial Sequence: Synthetic peptide
DEEEVRCTNPVATEQYGCVSTNLQRNGNR

SEQ ID NO: 14997 - protein, 28 aa, Artificial Sequence
  Description of Artificial Sequence: Synthetic peptide
DEEEIRTTNPVATEQYGSVSTDLEIGNN

SEQ ID NO: 14998 - protein, 28 aa, Artificial Sequence
  Description of Artificial Sequence: Synthetic peptide
DEEEIRTTNITATEQYGSVSTDDQRGNR

SEQ ID NO: 14999 - protein, 28 aa, Artificial Sequence
  Description of Artificial Sequence: Synthetic peptide
DEEEIRTTNIVATEQYGEVSTDLQIGNR

SEQ ID NO: 15000 - protein, 28 aa, Artificial Sequence
  Description of Artificial Sequence: Synthetic peptide
QENEIRTTNPVATECYGSVSTNLQRGER

SEQ ID NO: 15001 - protein, 28 aa, Artificial Sequence
  Description of Artificial Sequence: Synthetic peptide
DEMEIRTTNIVATEQYGSVVTNLQNGNR

SEQ ID NO: 15002 - protein, 28 aa, Artificial Sequence
  Description of Artificial Sequence: Synthetic peptide
DDEEIRCTNPVATEPYGSVSTNLQVGNR

SEQ ID NO: 15003 - protein, 28 aa, Artificial Sequence
  Description of Artificial Sequence: Synthetic peptide
DEYEICTTNPVATEPYGSVSENLQRGNR

SEQ ID NO: 15004 - protein, 28 aa, Artificial Sequence
  Description of Artificial Sequence: Synthetic peptide
DEEEIRTTNPVATEWWGSYSTNLQRGNW

SEQ ID NO: 15005 - protein, 28 aa, Artificial Sequence
  Description of Artificial Sequence: Synthetic peptide
DEEEIATTNPVSTEQYGSVSENLQHGNR

SEQ ID NO: 15006 - protein, 28 aa, Artificial Sequence
  Description of Artificial Sequence: Synthetic peptide
DEEEIRTTNPVATEQYGSVSTELQNGEY

SEQ ID NO: 15007 - protein, 28 aa, Artificial Sequence
  Description of Artificial Sequence: Synthetic peptide
DEEEIRTTNPFATEQYGSVSTNPDRTNR

SEQ ID NO: 15008 - protein, 28 aa, Artificial Sequence
  Description of Artificial Sequence: Synthetic peptide
DEEEIWTTNPVATEIYGEVSTNLQRGNQ

SEQ ID NO: 15009 - protein, 28 aa, Artificial Sequence
  Description of Artificial Sequence: Synthetic peptide
DEEEIRTTNPVATEQYGSVSTELEPGND

SEQ ID NO: 15010 - protein, 28 aa, Artificial Sequence
  Description of Artificial Sequence: Synthetic peptide
DEEEIRTTNIVATEVYGSVSDNLQRGER

SEQ ID NO: 15011 - protein, 29 aa, Artificial Sequence
  Description of Artificial Sequence: Synthetic peptide
DEEEICCTNPVATEQYGSVSTANLQRGNY

SEQ ID NO: 15012 - protein, 30 aa, Artificial Sequence
  Description of Artificial Sequence: Synthetic polypeptide
DEEEIRTTNPVATEQYGVVSTNLQEVGENR

SEQ ID NO: 15013 - protein, 28 aa, Artificial Sequence
  Description of Artificial Sequence: Synthetic peptide
DEEEIRTTNIVATEQYGSVSTNLMFGER

SEQ ID NO: 15014 - protein, 28 aa, Artificial Sequence
  Description of Artificial Sequence: Synthetic peptide
DEEEVRTTNPVATEIYGSVATNLERGNR

SEQ ID NO: 15015 - protein, 28 aa, Artificial Sequence
  Description of Artificial Sequence: Synthetic peptide
GEEEIATTNIVATEQYGSVSTNLQRGNQ

SEQ ID NO: 15016 - protein, 28 aa, Artificial Sequence
  Description of Artificial Sequence: Synthetic peptide
DESEIYTTNPVATEQYGYVSTNWQRGNR

SEQ ID NO: 15017 - protein, 28 aa, Artificial Sequence
  Description of Artificial Sequence: Synthetic peptide
HEHEIRTTNPVATEQYGSTSTNLQRGER

SEQ ID NO: 15018 - protein, 28 aa, Artificial Sequence
  Description of Artificial Sequence: Synthetic peptide
DEEELRTTNPVATECYGWVSSNLQRGNR

SEQ ID NO: 15019 - protein, 30 aa, Artificial Sequence
  Description of Artificial Sequence: Synthetic polypeptide
DEEEIRTTNPVATEQYGSVSTNLQRNGEDL

SEQ ID NO: 15020 - protein, 29 aa, Artificial Sequence
  Description of Artificial Sequence: Synthetic peptide
MEEEIATTNPVATEQYGSVSDNLQRGNDR

SEQ ID NO: 15021 - protein, 30 aa, Artificial Sequence
  Description of Artificial Sequence: Synthetic polypeptide
DEEEIRTTNPVATEQYGSVSCTMDLQAGNR

SEQ ID NO: 15022 - protein, 28 aa, Artificial Sequence
  Description of Artificial Sequence: Synthetic peptide
DEEEIRTTNPVATEQYGSVSTELQHGEE

SEQ ID NO: 15023 - protein, 28 aa, Artificial Sequence
  Description of Artificial Sequence: Synthetic peptide
DEEEIRTTNIVATEQFGSVSENLQRGNA

SEQ ID NO: 15024 - protein, 28 aa, Artificial Sequence
  Description of Artificial Sequence: Synthetic peptide
DEEEIRTTNIVATEQFGSVSTNEQVGNR

SEQ ID NO: 15025 - protein, 28 aa, Artificial Sequence
  Description of Artificial Sequence: Synthetic peptide
DEAEIRTTNPVATEQYGSASENLQRENR

SEQ ID NO: 15026 - protein, 28 aa, Artificial Sequence
  Description of Artificial Sequence: Synthetic peptide
DEEEIRTTNPEATEQYGSVSTPLERGDR

SEQ ID NO: 15027 - protein, 30 aa, Artificial Sequence
  Description of Artificial Sequence: Synthetic polypeptide
DEEEIRTTNPVATEQYGSVSTNLQDIGNDA

SEQ ID NO: 15028 - protein, 28 aa, Artificial Sequence
  Description of Artificial Sequence: Synthetic peptide
DEDEIRTTNPVATEQYGSASTNCQHGNR

SEQ ID NO: 15029 - protein, 28 aa, Artificial Sequence
  Description of Artificial Sequence: Synthetic peptide
DEEEIRTTNPVATECYGSVSTELEDGNR

SEQ ID NO: 15030 - protein, 28 aa, Artificial Sequence
  Description of Artificial Sequence: Synthetic peptide
DELEIYTTNIVATEQYGSVSENLQRGNR

SEQ ID NO: 15031 - protein, 29 aa, Artificial Sequence
  Description of Artificial Sequence: Synthetic peptide
DEEEIRTTNPVATEQYGSASTNLENGNDR

SEQ ID NO: 15032 - protein, 29 aa, Artificial Sequence
  Description of Artificial Sequence: Synthetic peptide
DEEEIRTTNPVATEQYGSVSTELQITGNL

SEQ ID NO: 15033 - protein, 28 aa, Artificial Sequence
  Description of Artificial Sequence: Synthetic peptide
DEEEIMTTNPVSTEQYGSVPTNLQNGNR

SEQ ID NO: 15034 - protein, 30 aa, Artificial Sequence
  Description of Artificial Sequence: Synthetic polypeptide
DEEEIRTTNPVATEQYGSVSTNLQNIEGNS

SEQ ID NO: 15035 - protein, 30 aa, Artificial Sequence
  Description of Artificial Sequence: Synthetic polypeptide
DEEEIRTTNPVATECYGDVCSTNLQIRGNR

SEQ ID NO: 15036 - protein, 29 aa, Artificial Sequence
  Description of Artificial Sequence: Synthetic peptide
DEEEIRTTNPVATEQYGSVDCEDLQRGNR

SEQ ID NO: 15037 - protein, 28 aa, Artificial Sequence
  Description of Artificial Sequence: Synthetic peptide
DEEEIRTTNPVATEQYGSVETDLQRGEF

SEQ ID NO: 15038 - protein, 29 aa, Artificial Sequence
  Description of Artificial Sequence: Synthetic peptide
DEEMIRTTNPVATEQYGSVSTNDTQRGER

SEQ ID NO: 15039 - protein, 32 aa, Artificial Sequence
  Description of Artificial Sequence: Synthetic polypeptide
DEEEIRTTNPVATEQYGSVSTPNPLQVRGNDR

SEQ ID NO: 15040 - protein, 30 aa, Artificial Sequence
  Description of Artificial Sequence: Synthetic polypeptide
DEEEIRTTNPVATEQYGSVSCTMNLQQGNV

SEQ ID NO: 15041 - protein, 29 aa, Artificial Sequence
  Description of Artificial Sequence: Synthetic peptide
DEEEIRTTNPVATEQYGSVSTNLEWDGNQ

SEQ ID NO: 15042 - protein, 28 aa, Artificial Sequence
  Description of Artificial Sequence: Synthetic peptide
DEEEIRTTNIVATEQYGAVSTNDQRGNF

SEQ ID NO: 15043 - protein, 29 aa, Artificial Sequence
  Description of Artificial Sequence: Synthetic peptide
DEEEIRTTNPVSTEQYGSVSATVLQHGNR

SEQ ID NO: 15044 - protein, 28 aa, Artificial Sequence
  Description of Artificial Sequence: Synthetic peptide
DEEEIRTTNIVATEQYGSVSDNLQRQNN

SEQ ID NO: 15045 - protein, 29 aa, Artificial Sequence
  Description of Artificial Sequence: Synthetic peptide
DENEIRTTNPVATEQWGSVSENLQRAGNR

SEQ ID NO: 15046 - protein, 28 aa, Artificial Sequence
  Description of Artificial Sequence: Synthetic peptide
DEEEIRTTNPVATEIYGSVSTNLMLGTR

SEQ ID NO: 15047 - protein, 28 aa, Artificial Sequence
  Description of Artificial Sequence: Synthetic peptide
DEEEIRTTNPVASEQYGSVSTNLEQGNI

SEQ ID NO: 15048 - protein, 28 aa, Artificial Sequence
  Description of Artificial Sequence: Synthetic peptide
DEEEIRTTNIVATEVYGSVSTNLQRGEF

SEQ ID NO: 15049 - protein, 29 aa, Artificial Sequence
  Description of Artificial Sequence: Synthetic peptide
DEEEIRTTNPVATEMYGSVSENLQQGNTR

SEQ ID NO: 15050 - protein, 28 aa, Artificial Sequence
  Description of Artificial Sequence: Synthetic peptide
DEEEIWTTNPVATEQYGSVADDLQRGNR

SEQ ID NO: 15051 - protein, 29 aa, Artificial Sequence
  Description of Artificial Sequence: Synthetic peptide
DEEEIRTTNPEATEQYGSVSTDDVQRGNR

SEQ ID NO: 15052 - protein, 30 aa, Artificial Sequence
  Description of Artificial Sequence: Synthetic polypeptide
DEEEIRTTNPVATEQYGSVSTDLEREGENR

SEQ ID NO: 15053 - protein, 30 aa, Artificial Sequence
  Description of Artificial Sequence: Synthetic polypeptide
DEEEIRTTNPVATEQYGSVSTDLQVTGINR

SEQ ID NO: 15054 - protein, 28 aa, Artificial Sequence
  Description of Artificial Sequence: Synthetic peptide
DEEEIRTTNIVASEQYGSVSENLQHGNR

SEQ ID NO: 15055 - protein, 28 aa, Artificial Sequence
  Description of Artificial Sequence: Synthetic peptide
DEEEIVCTNIVATEQYGSVSTNDQRGNR

SEQ ID NO: 15056 - protein, 28 aa, Artificial Sequence
  Description of Artificial Sequence: Synthetic peptide
DEEEIRTTNIVATEQYGSASTNLQIGNN

SEQ ID NO: 15057 - protein, 31 aa, Artificial Sequence
  Description of Artificial Sequence: Synthetic polypeptide
DEEEIRSTNPVATEQYGSVSTGNLQLRGENR

SEQ ID NO: 15058 - protein, 30 aa, Artificial Sequence
  Description of Artificial Sequence: Synthetic polypeptide
DEEEIRTTNPVATEQYGSVDTMNLQQRGNI

SEQ ID NO: 15059 - protein, 28 aa, Artificial Sequence
  Description of Artificial Sequence: Synthetic peptide
DEEEIRTTNPDAYEQYGSVSQNLQMGNR

SEQ ID NO: 15060 - protein, 28 aa, Artificial Sequence
  Description of Artificial Sequence: Synthetic peptide
DEEEIRTTNPVATEQYGSVETDLEVGNR

SEQ ID NO: 15061 - protein, 28 aa, Artificial Sequence
  Description of Artificial Sequence: Synthetic peptide
DEDEIRTTNPVATEVYGWVGTNLQRGNR

SEQ ID NO: 15062 - protein, 28 aa, Artificial Sequence
  Description of Artificial Sequence: Synthetic peptide
SEEEIRTTNPVATEQYGNVSDNLQRGNK

SEQ ID NO: 15063 - protein, 28 aa, Artificial Sequence
  Description of Artificial Sequence: Synthetic peptide
DEEEIATTNPVAYEQYGSVSTNLQRGMA

SEQ ID NO: 15064 - protein, 28 aa, Artificial Sequence
  Description of Artificial Sequence: Synthetic peptide
DEEEIATTNPVATEQYGCVSTNLQRGPQ

SEQ ID NO: 15065 - protein, 28 aa, Artificial Sequence
  Description of Artificial Sequence: Synthetic peptide
DEEEIRTTNPDATEQYGSVSTNDQNGNT

SEQ ID NO: 15066 - protein, 28 aa, Artificial Sequence
  Description of Artificial Sequence: Synthetic peptide
DEEEIRTTNPVATEQYGNVDTNLQYGNA

SEQ ID NO: 15067 - protein, 29 aa, Artificial Sequence
  Description of Artificial Sequence: Synthetic peptide
DEEEISTTNPVATEQYGSVDTNLQNGDNR

SEQ ID NO: 15068 - protein, 28 aa, Artificial Sequence
  Description of Artificial Sequence: Synthetic peptide
DEEEIRTTNPVATEQWGSYSTNEMRGNR

SEQ ID NO: 15069 - protein, 30 aa, Artificial Sequence
  Description of Artificial Sequence: Synthetic polypeptide
DEEEIRTTNPVATEQYGSVSTNLVQINGNN

SEQ ID NO: 15070 - protein, 28 aa, Artificial Sequence
  Description of Artificial Sequence: Synthetic peptide
DENEITTTNPVATEQYGEVSENLQRGNR

SEQ ID NO: 15071 - protein, 28 aa, Artificial Sequence
  Description of Artificial Sequence: Synthetic peptide
DEVEIRTTNPVATECYGGVSTNEQRGNR

SEQ ID NO: 15072 - protein, 28 aa, Artificial Sequence
  Description of Artificial Sequence: Synthetic peptide
DDSEIVATNPVATEQYGSVSTNLQRGNR

SEQ ID NO: 15073 - protein, 30 aa, Artificial Sequence
  Description of Artificial Sequence: Synthetic polypeptide
DEEEIRTTNPTATEQFGSVSTNLQDRGNTR

SEQ ID NO: 15074 - protein, 29 aa, Artificial Sequence
  Description of Artificial Sequence: Synthetic peptide
DEEEIRTTNPVATEQYGSVSTNLMNQGNM

SEQ ID NO: 15075 - protein, 28 aa, Artificial Sequence
  Description of Artificial Sequence: Synthetic peptide
DEEEICTTNPVATEQYGEASENLQRGNR

SEQ ID NO: 15076 - protein, 28 aa, Artificial Sequence
  Description of Artificial Sequence: Synthetic peptide
DEEEIRTTNPVATEQYGSVSMNLQIGEL

SEQ ID NO: 15077 - protein, 28 aa, Artificial Sequence
  Description of Artificial Sequence: Synthetic peptide
DEQEIRTTNPVATEQYGSVDTNLQREND

SEQ ID NO: 15078 - protein, 28 aa, Artificial Sequence
  Description of Artificial Sequence: Synthetic peptide
DEEEIATTNPTATEQYGSVSTNEQIGNR

SEQ ID NO: 15079 - protein, 29 aa, Artificial Sequence
  Description of Artificial Sequence: Synthetic peptide
DEEEIRSTNPVATEQYGSVSTPLQVRGDR

SEQ ID NO: 15080 - protein, 30 aa, Artificial Sequence
  Description of Artificial Sequence: Synthetic polypeptide
DEEEIRTTNPVATEQYGSVSTANLQLFGNI

SEQ ID NO: 15081 - protein, 30 aa, Artificial Sequence
  Description of Artificial Sequence: Synthetic polypeptide
DEEEIRTTNPVATEQYGSVSTMNEQRGNDG

SEQ ID NO: 15082 - protein, 28 aa, Artificial Sequence
  Description of Artificial Sequence: Synthetic peptide
DEMEIRTTNPVASEQYGSVGTNLQRGNL

SEQ ID NO: 15083 - protein, 28 aa, Artificial Sequence
  Description of Artificial Sequence: Synthetic peptide
DEEEIRTTNPVATEQYGEVSEVLQRGER

SEQ ID NO: 15084 - protein, 31 aa, Artificial Sequence
  Description of Artificial Sequence: Synthetic polypeptide
DEEEIRTTNPVATEQYGSVSCTNLQCHGNDR

SEQ ID NO: 15085 - protein, 28 aa, Artificial Sequence
  Description of Artificial Sequence: Synthetic peptide
DEEEIRTTNPVATEQYGSVDTELQNGNT

SEQ ID NO: 15086 - protein, 30 aa, Artificial Sequence
  Description of Artificial Sequence: Synthetic polypeptide
DEEEIRTTNPVATEMYGSVSENLQDRGNTR

SEQ ID NO: 15087 - protein, 30 aa, Artificial Sequence
  Description of Artificial Sequence: Synthetic polypeptide
DEEEIRTTNPVATEQYGSVSTNLEDREGER

SEQ ID NO: 15088 - protein, 29 aa, Artificial Sequence
  Description of Artificial Sequence: Synthetic peptide
DEEEIRTTNPVSTEQYGEVSTNLQRAGGR

SEQ ID NO: 15089 - protein, 28 aa, Artificial Sequence
  Description of Artificial Sequence: Synthetic peptide
DEEEIRTTNPVATEQYGSVETNLQDGDS

SEQ ID NO: 15090 - protein, 28 aa, Artificial Sequence
  Description of Artificial Sequence: Synthetic peptide
DEEEIRTTNPVATEQYGDVSTDLQHGNQ

SEQ ID NO: 15091 - protein, 30 aa, Artificial Sequence
  Description of Artificial Sequence: Synthetic polypeptide
DEEEIRTTNPVATEQYGSVSTNLQDAEGNS

SEQ ID NO: 15092 - protein, 29 aa, Artificial Sequence
  Description of Artificial Sequence: Synthetic peptide
DEGEIRTTNPVATEQYGSVSTNLQIQGER

SEQ ID NO: 15093 - protein, 28 aa, Artificial Sequence
  Description of Artificial Sequence: Synthetic peptide
DEEEIRTTNPFATEQYGSVSENLQRGED

SEQ ID NO: 15094 - protein, 30 aa, Artificial Sequence
  Description of Artificial Sequence: Synthetic polypeptide
DEEEIRTTNPEATEQYGSVSATNLQANGNR

SEQ ID NO: 15095 - protein, 28 aa, Artificial Sequence
  Description of Artificial Sequence: Synthetic peptide
MEEEIRTTNPFATEQYGSVSTNLQTGNL

SEQ ID NO: 15096 - protein, 28 aa, Artificial Sequence
  Description of Artificial Sequence: Synthetic peptide
DDEEIRTTNCVATEQYGSVATNLQRMNR

SEQ ID NO: 15097 - protein, 28 aa, Artificial Sequence
  Description of Artificial Sequence: Synthetic peptide
DEEEIRTTNIVATEQYGSVGTNLQRGEW

SEQ ID NO: 15098 - protein, 28 aa, Artificial Sequence
  Description of Artificial Sequence: Synthetic peptide
DEEEIRTTNPVATECYGSVSTNLQVGEE

SEQ ID NO: 15099 - protein, 28 aa, Artificial Sequence
  Description of Artificial Sequence: Synthetic peptide
DEQEIATTNPVATENYGTVSTNLQRGNR

SEQ ID NO: 15100 - protein, 28 aa, Artificial Sequence
  Description of Artificial Sequence: Synthetic peptide
DENEIRTTNPVATEQYGSVPENPQRGNR

SEQ ID NO: 15101 - protein, 31 aa, Artificial Sequence
  Description of Artificial Sequence: Synthetic polypeptide
DEEEIRTTNPEATEQYGSVSETENLQERGNR

SEQ ID NO: 15102 - protein, 28 aa, Artificial Sequence
  Description of Artificial Sequence: Synthetic peptide
DENEIRTTNPVATECYGSVSTDLQHGNR

SEQ ID NO: 15103 - protein, 28 aa, Artificial Sequence
  Description of Artificial Sequence: Synthetic peptide
DEEEIRTTNPVATLQYGSVSTSLDEGNR

SEQ ID NO: 15104 - protein, 29 aa, Artificial Sequence
  Description of Artificial Sequence: Synthetic peptide
DEEEIRTTNPVATEQYGSVSTDLQAGNDY

SEQ ID NO: 15105 - protein, 28 aa, Artificial Sequence
  Description of Artificial Sequence: Synthetic peptide
DEEEIRTTNPVAYEQYGSVSMNLQRPNF

SEQ ID NO: 15106 - protein, 28 aa, Artificial Sequence
  Description of Artificial Sequence: Synthetic peptide
DEGEIATTNPVATEQYGSVPTVLQRGNR

SEQ ID NO: 15107 - protein, 30 aa, Artificial Sequence
  Description of Artificial Sequence: Synthetic polypeptide
DEEEIRTTNPVATEQYGSVSTNLQISGENL

SEQ ID NO: 15108 - protein, 29 aa, Artificial Sequence
  Description of Artificial Sequence: Synthetic peptide
DEEEIATTNPVATEQYGSVSTDLEDRGNR

SEQ ID NO: 15109 - protein, 30 aa, Artificial Sequence
  Description of Artificial Sequence: Synthetic polypeptide
DEEEIRTTNPVATEQYGSVSDENLQERGER

SEQ ID NO: 15110 - protein, 32 aa, Artificial Sequence
  Description of Artificial Sequence: Synthetic polypeptide
DEEEIRTTNPVATEQYGSVSTNGLQVRGVNDR

SEQ ID NO: 15111 - protein, 28 aa, Artificial Sequence
  Description of Artificial Sequence: Synthetic peptide
DEEEIRTTNPVATEQYGSVSTELQIGED

SEQ ID NO: 15112 - protein, 28 aa, Artificial Sequence
  Description of Artificial Sequence: Synthetic peptide
DEEEIRTTNPVATEQYGSVETNLEYGER

SEQ ID NO: 15113 - protein, 28 aa, Artificial Sequence
  Description of Artificial Sequence: Synthetic peptide
DECEIRSTNCVATEQWGSVSTNLQRGNR

SEQ ID NO: 15114 - protein, 28 aa, Artificial Sequence
  Description of Artificial Sequence: Synthetic peptide
DEEEIRTTNPVATECYGSVSTDLQNGNW

SEQ ID NO: 15115 - protein, 28 aa, Artificial Sequence
  Description of Artificial Sequence: Synthetic peptide
DPEEIRTTNPVAWEQYGSVDTGLQRGNR

SEQ ID NO: 15116 - protein, 28 aa, Artificial Sequence
  Description of Artificial Sequence: Synthetic peptide
DEEEIRTTNPVATEQYGSVAENLQHGNC

SEQ ID NO: 15117 - protein, 28 aa, Artificial Sequence
  Description of Artificial Sequence: Synthetic peptide
DEEEIRTTNPFATEQYGSVSENLDRGNS

SEQ ID NO: 15118 - protein, 30 aa, Artificial Sequence
  Description of Artificial Sequence: Synthetic polypeptide
DEEEIRTTNPVATEQYGSVSSTTGLQRGNN

SEQ ID NO: 15119 - protein, 29 aa, Artificial Sequence
  Description of Artificial Sequence: Synthetic peptide
YEEEIRTTNPVATEQYGSVKSENLQRGND

SEQ ID NO: 15120 - protein, 28 aa, Artificial Sequence
  Description of Artificial Sequence: Synthetic peptide
DEVEIRTTNIVATEQYGSVSTDLQRGNH

SEQ ID NO: 15121 - protein, 28 aa, Artificial Sequence
  Description of Artificial Sequence: Synthetic peptide
DEVEIAATNPVATEQYGSVSTNLQRGNF

SEQ ID NO: 15122 - protein, 28 aa, Artificial Sequence
  Description of Artificial Sequence: Synthetic peptide
DEEEIRTTNPVATEQYGSVSTDLQDGEY

SEQ ID NO: 15123 - protein, 31 aa, Artificial Sequence
  Description of Artificial Sequence: Synthetic polypeptide
DEEEIRTTNPVATEQYGSVDSETNLQEDGNR

SEQ ID NO: 15124 - protein, 28 aa, Artificial Sequence
  Description of Artificial Sequence: Synthetic peptide
DEEEIRTTNPFATEQYGSVSTGLLRGNE

SEQ ID NO: 15125 - protein, 28 aa, Artificial Sequence
  Description of Artificial Sequence: Synthetic peptide
DEEEIRTTNPVATEQYGSVSTDLEDGND

SEQ ID NO: 15126 - protein, 28 aa, Artificial Sequence
  Description of Artificial Sequence: Synthetic peptide
DEHEIRTTNPVATEQYGDVSTILQRGNH

SEQ ID NO: 15127 - protein, 29 aa, Artificial Sequence
  Description of Artificial Sequence: Synthetic peptide
DEEEIRCTNPVATEQYGSVSTNLQDHGNI

SEQ ID NO: 15128 - protein, 28 aa, Artificial Sequence
  Description of Artificial Sequence: Synthetic peptide
DEEEIRTTNPVATEQYGSVSTNEQLGEY

SEQ ID NO: 15129 - protein, 28 aa, Artificial Sequence
  Description of Artificial Sequence: Synthetic peptide
DEEEIATTNPEATEQYGSVSTNQQRPNR

SEQ ID NO: 15130 - protein, 28 aa, Artificial Sequence
  Description of Artificial Sequence: Synthetic peptide
DEEEIRTTNIVATEIYGSVSTNIQRGNQ

SEQ ID NO: 15131 - protein, 29 aa, Artificial Sequence
  Description of Artificial Sequence: Synthetic peptide
DENEIRTTNPVATEQWGSVSTNLQNRGNF

SEQ ID NO: 15132 - protein, 29 aa, Artificial Sequence
  Description of Artificial Sequence: Synthetic peptide
DEEEIRTTNPVATEQYGVVSENLQNRNNR

SEQ ID NO: 15133 - protein, 30 aa, Artificial Sequence
  Description of Artificial Sequence: Synthetic polypeptide
DEQEIRTTNPVATEQYGSVDSTPLQRGNDR

SEQ ID NO: 15134 - protein, 28 aa, Artificial Sequence
  Description of Artificial Sequence: Synthetic peptide
DEEEIRTTNIVATEQYGSVGENLQVGNR

SEQ ID NO: 15135 - protein, 29 aa, Artificial Sequence
  Description of Artificial Sequence: Synthetic peptide
DEEEIRTTNPVATEQYGSVSTDLQDYGNW

SEQ ID NO: 15136 - protein, 28 aa, Artificial Sequence
  Description of Artificial Sequence: Synthetic peptide
DEEEIRTTNPVATEQYGSVETNDQWGNY

SEQ ID NO: 15137 - protein, 28 aa, Artificial Sequence
  Description of Artificial Sequence: Synthetic peptide
DEQEIASTNPVATEVYGSVSTNLQRGNR

SEQ ID NO: 15138 - protein, 30 aa, Artificial Sequence
  Description of Artificial Sequence: Synthetic polypeptide
DEEEIRTTNPVATEQYGSVSCTNEQCRGNQ

SEQ ID NO: 15139 - protein, 28 aa, Artificial Sequence
  Description of Artificial Sequence: Synthetic peptide
DEEEIRTTNPVATEQYGDVSENLQYGNI

SEQ ID NO: 15140 - protein, 29 aa, Artificial Sequence
  Description of Artificial Sequence: Synthetic peptide
DEEEIRTTNPVATEQYGSVSEALQQYGNR

SEQ ID NO: 15141 - protein, 32 aa, Artificial Sequence
  Description of Artificial Sequence: Synthetic polypeptide
DEEEIRTTNPVATEQYGSVSETNLQDREGNER

SEQ ID NO: 15142 - protein, 28 aa, Artificial Sequence
  Description of Artificial Sequence: Synthetic peptide
DEVEIRTTNPVATEQYGSVSTNLQGGDN

SEQ ID NO: 15143 - protein, 30 aa, Artificial Sequence
  Description of Artificial Sequence: Synthetic polypeptide
DEQEIRTTNPVATEQYGSVSTNLEDREGNR

SEQ ID NO: 15144 - protein, 28 aa, Artificial Sequence
  Description of Artificial Sequence: Synthetic peptide
DEEEIRTTNPVATEQYGDVSENQQVGNR

SEQ ID NO: 15145 - protein, 28 aa, Artificial Sequence
  Description of Artificial Sequence: Synthetic peptide
DEEEIRTTNPVATEQYGSVETDEQDGNR

SEQ ID NO: 15146 - protein, 28 aa, Artificial Sequence
  Description of Artificial Sequence: Synthetic peptide
DEEEIRQTNPVATEQYGVVSTAQQRGNR

SEQ ID NO: 15147 - protein, 28 aa, Artificial Sequence
  Description of Artificial Sequence: Synthetic peptide
DEEEIRTTNPVATEQYGSVDTDLQVGNS

SEQ ID NO: 15148 - protein, 30 aa, Artificial Sequence
  Description of Artificial Sequence: Synthetic polypeptide
DEEEIRTTNPVATEQYGSWSDHNLQERGNR

SEQ ID NO: 15149 - protein, 29 aa, Artificial Sequence
  Description of Artificial Sequence: Synthetic peptide
DEEEIRTTNPVATEQYGSVSTNLQQNGDM

SEQ ID NO: 15150 - protein, 32 aa, Artificial Sequence
  Description of Artificial Sequence: Synthetic polypeptide
DEEEIRTTNPVATEQYGSVISTCNGLQRGDNR

SEQ ID NO: 15151 - protein, 29 aa, Artificial Sequence
  Description of Artificial Sequence: Synthetic peptide
DENEIRTTNPVATEQYGHSYSTNEQRGNR

SEQ ID NO: 15152 - protein, 29 aa, Artificial Sequence
  Description of Artificial Sequence: Synthetic peptide
DEEEIRTTNPVATECYGSVSTNLQNEGNL

SEQ ID NO: 15153 - protein, 29 aa, Artificial Sequence
  Description of Artificial Sequence: Synthetic peptide
DEQEIRTTNPVATEQYGDVSCTNLQAGNR

SEQ ID NO: 15154 - protein, 28 aa, Artificial Sequence
  Description of Artificial Sequence: Synthetic peptide
DEEEIATTNPVATEMYGEVSTNLQRGGR

SEQ ID NO: 15155 - protein, 28 aa, Artificial Sequence
  Description of Artificial Sequence: Synthetic peptide
DEQEIRTTNIVATEQYGSISTNLQFGNR

SEQ ID NO: 15156 - protein, 28 aa, Artificial Sequence
  Description of Artificial Sequence: Synthetic peptide
QEEEIRTTNPVATEQYGSVSANLQQGNH

SEQ ID NO: 15157 - protein, 30 aa, Artificial Sequence
  Description of Artificial Sequence: Synthetic polypeptide
DEEEIRTTNPLATECYGSVSTNLQLRGDNR

SEQ ID NO: 15158 - protein, 28 aa, Artificial Sequence
  Description of Artificial Sequence: Synthetic peptide
MEDEIRTTNPVATEQYGSVSTNLQHGNM

SEQ ID NO: 15159 - protein, 30 aa, Artificial Sequence
  Description of Artificial Sequence: Synthetic polypeptide
DEEEIRTTNPEATEQYGSVSTNLQRGDNDW

SEQ ID NO: 15160 - protein, 28 aa, Artificial Sequence
  Description of Artificial Sequence: Synthetic peptide
DEEEIRTTNPVATEQYGSVSTELQIGEE

SEQ ID NO: 15161 - protein, 30 aa, Artificial Sequence
  Description of Artificial Sequence: Synthetic polypeptide
DEEEIRTTNPEATEQYGSVSETENDQRGNR

SEQ ID NO: 15162 - protein, 28 aa, Artificial Sequence
  Description of Artificial Sequence: Synthetic peptide
DEEEIRTTNPVATEQYGLVSENLQAGNK

SEQ ID NO: 15163 - protein, 28 aa, Artificial Sequence
  Description of Artificial Sequence: Synthetic peptide
DEEEIRTTNPVATEQYGDVSEDLQHGNR

SEQ ID NO: 15164 - protein, 28 aa, Artificial Sequence
  Description of Artificial Sequence: Synthetic peptide
DEEEIRTTNPVAYEIYGCVATNLQRGNR

SEQ ID NO: 15165 - protein, 28 aa, Artificial Sequence
  Description of Artificial Sequence: Synthetic peptide
DEEAIRTTNPFATEQYGSVSTNLQWLNR

SEQ ID NO: 15166 - protein, 29 aa, Artificial Sequence
  Description of Artificial Sequence: Synthetic peptide
DEEEIRTTNPVATECYGSVSTNLQVAGNN

SEQ ID NO: 15167 - protein, 28 aa, Artificial Sequence
  Description of Artificial Sequence: Synthetic peptide
AEDEICTTNPVATEQYGSVSENLQRGNR

SEQ ID NO: 15168 - protein, 30 aa, Artificial Sequence
  Description of Artificial Sequence: Synthetic polypeptide
DEEEIRTTNPVATEQYGSVEDTNLQGKGNR

SEQ ID NO: 15169 - protein, 29 aa, Artificial Sequence
  Description of Artificial Sequence: Synthetic peptide
DEQEIRTTNPVATEVYGAVSATNLQRGNR

SEQ ID NO: 15170 - protein, 28 aa, Artificial Sequence
  Description of Artificial Sequence: Synthetic peptide
DGEEIRTTNPVATEQYGSVSTNLDDGLR

SEQ ID NO: 15171 - protein, 29 aa, Artificial Sequence
  Description of Artificial Sequence: Synthetic peptide
MEEEIRTTNPVATEQYGSVSTNLQNEGNM

SEQ ID NO: 15172 - protein, 29 aa, Artificial Sequence
  Description of Artificial Sequence: Synthetic peptide
DEEEIRTTNPVATEQYGSVSTNWQRKGTG

SEQ ID NO: 15173 - protein, 28 aa, Artificial Sequence
  Description of Artificial Sequence: Synthetic peptide
DEEEIRTTNPFATEQYGSVSTDQQRGER

SEQ ID NO: 15174 - protein, 28 aa, Artificial Sequence
  Description of Artificial Sequence: Synthetic peptide
DEEEIRTTNPCATEQYGSAATNLQRGNF

SEQ ID NO: 15175 - protein, 28 aa, Artificial Sequence
  Description of Artificial Sequence: Synthetic peptide
DQEEIRTTNPVATEQWGTVSTNLQEGNR

SEQ ID NO: 15176 - protein, 28 aa, Artificial Sequence
  Description of Artificial Sequence: Synthetic peptide
CEEEIGTTNPVATEQYGDVSTNLQRMNR

SEQ ID NO: 15177 - protein, 29 aa, Artificial Sequence
  Description of Artificial Sequence: Synthetic peptide
DEEEIRTTNPVATEQYGNVSVTNPQHGNR

SEQ ID NO: 15178 - protein, 29 aa, Artificial Sequence
  Description of Artificial Sequence: Synthetic peptide
DEEEIRTTNPVATENYGSVDSTPLQRGNI

SEQ ID NO: 15179 - protein, 28 aa, Artificial Sequence
  Description of Artificial Sequence: Synthetic peptide
SESEIRTTNPVATEQYGEVSNNLQRGNR

SEQ ID NO: 15180 - protein, 30 aa, Artificial Sequence
  Description of Artificial Sequence: Synthetic polypeptide
DEEEIATTNPVATEQYGSVSCENLQCRGNR

SEQ ID NO: 15181 - protein, 28 aa, Artificial Sequence
  Description of Artificial Sequence: Synthetic peptide
DEQEITTTNPVATEQYGDVSTNLQRGNS

SEQ ID NO: 15182 - protein, 30 aa, Artificial Sequence
  Description of Artificial Sequence: Synthetic polypeptide
DEEEIRTTNPVATQQYGGVSTNLQRTGDNR

SEQ ID NO: 15183 - protein, 28 aa, Artificial Sequence
  Description of Artificial Sequence: Synthetic peptide
DESEIRTTNPVATEQYGSVGTNDQRGNP

SEQ ID NO: 15184 - protein, 29 aa, Artificial Sequence
  Description of Artificial Sequence: Synthetic peptide
DEEEIRTTNPIATEQYGSTSTNLQREGER

SEQ ID NO: 15185 - protein, 28 aa, Artificial Sequence
  Description of Artificial Sequence: Synthetic peptide
DEEEISTTNPVATTQYGSVSTNPMRGNR

SEQ ID NO: 15186 - protein, 28 aa, Artificial Sequence
  Description of Artificial Sequence: Synthetic peptide
DEEEIRTTNIVATEQYGSVSTNLLRFNT

SEQ ID NO: 15187 - protein, 28 aa, Artificial Sequence
  Description of Artificial Sequence: Synthetic peptide
SEEEIRTTNPVSTEQYGSVSTNEQVGNR

SEQ ID NO: 15188 - protein, 28 aa, Artificial Sequence
  Description of Artificial Sequence: Synthetic peptide
DEEEIRTTNIVATEQYGTVSTELERGNR

SEQ ID NO: 15189 - protein, 29 aa, Artificial Sequence
  Description of Artificial Sequence: Synthetic peptide
DENEIRTTNPVATECYGSVSTNLQDRGNN

SEQ ID NO: 15190 - protein, 28 aa, Artificial Sequence
  Description of Artificial Sequence: Synthetic peptide
DEEEISTTNPVATELYGSVSTNLQRGLQ

SEQ ID NO: 15191 - protein, 29 aa, Artificial Sequence
  Description of Artificial Sequence: Synthetic peptide
DENEIRQTNPVATEQYGSVSATDLQRGNR

SEQ ID NO: 15192 - protein, 30 aa, Artificial Sequence
  Description of Artificial Sequence: Synthetic polypeptide
DEEEIRTTNPVATEQYGSVSTINPLQLGER

SEQ ID NO: 15193 - protein, 30 aa, Artificial Sequence
  Description of Artificial Sequence: Synthetic polypeptide
DEEEIRTTNPTATEQYGSVSATNLQRGDNF

SEQ ID NO: 15194 - protein, 30 aa, Artificial Sequence
  Description of Artificial Sequence: Synthetic polypeptide
DEEEIRTTNPVATECYGSVSTNLQSEGNDR

SEQ ID NO: 15195 - protein, 28 aa, Artificial Sequence
  Description of Artificial Sequence: Synthetic peptide
DEEEIRTTNPVASENYGSVCTNLERGNR

SEQ ID NO: 15196 - protein, 28 aa, Artificial Sequence
  Description of Artificial Sequence: Synthetic peptide
VEQEIRTTNPVASEQYGSVSTNLQRGNQ

SEQ ID NO: 15197 - protein, 28 aa, Artificial Sequence
  Description of Artificial Sequence: Synthetic peptide
AEEEIRSTNIVATEQYGSVSTNLQQGNR

SEQ ID NO: 15198 - protein, 28 aa, Artificial Sequence
  Description of Artificial Sequence: Synthetic peptide
DENEIRQTNIVATEQYGSVSTELQRGNR

SEQ ID NO: 15199 - protein, 30 aa, Artificial Sequence
  Description of Artificial Sequence: Synthetic polypeptide
DEEEIRTTNPVATEQYGSVSDTNLQFGENI

SEQ ID NO: 15200 - protein, 29 aa, Artificial Sequence
  Description of Artificial Sequence: Synthetic peptide
DEEEIRCTNPVATEQYGSVSTADQRGDNR

SEQ ID NO: 15201 - protein, 28 aa, Artificial Sequence
  Description of Artificial Sequence: Synthetic peptide
DEEEIRTTNPVATEQYGSASENLIRGND

SEQ ID NO: 15202 - protein, 29 aa, Artificial Sequence
  Description of Artificial Sequence: Synthetic peptide
DEEEIRTTNPVATEQYGFVSDNLQRSGVR

SEQ ID NO: 15203 - protein, 28 aa, Artificial Sequence
  Description of Artificial Sequence: Synthetic peptide
DEEEIRTTNPVATEQYGSVSTPDQPGER

SEQ ID NO: 15204 - protein, 28 aa, Artificial Sequence
  Description of Artificial Sequence: Synthetic peptide
DEEEIRTTNPISTEQYGSTSTNLQRGND

SEQ ID NO: 15205 - protein, 28 aa, Artificial Sequence
  Description of Artificial Sequence: Synthetic peptide
DEQEIRTTNIVATEQYGSVSTNLQLGNI

SEQ ID NO: 15206 - protein, 28 aa, Artificial Sequence
  Description of Artificial Sequence: Synthetic peptide
DEEEIRTTNPTATEQYGSVSTNPQVGNF

SEQ ID NO: 15207 - protein, 30 aa, Artificial Sequence
  Description of Artificial Sequence: Synthetic polypeptide
DEEEIRTTNPVATEQYGSVSTIALQRKGNT

SEQ ID NO: 15208 - protein, 28 aa, Artificial Sequence
  Description of Artificial Sequence: Synthetic peptide
DENEIRTTNPVATEQYGSVSTNLMIGNF

SEQ ID NO: 15209 - protein, 28 aa, Artificial Sequence
  Description of Artificial Sequence: Synthetic peptide
DEEEIRTTNPCATEQYGSVSTNLETGND

SEQ ID NO: 15210 - protein, 28 aa, Artificial Sequence
  Description of Artificial Sequence: Synthetic peptide
DEEEIRTTNIVATEQYGTASTNDQRGNR

SEQ ID NO: 15211 - protein, 29 aa, Artificial Sequence
  Description of Artificial Sequence: Synthetic peptide
DEEEIATTNPCSTEQYGSVSATNLQRGNR

SEQ ID NO: 15212 - protein, 28 aa, Artificial Sequence
  Description of Artificial Sequence: Synthetic peptide
DEEEIRTTNPVATCFYGSVSTNLQRGVP

SEQ ID NO: 15213 - protein, 28 aa, Artificial Sequence
  Description of Artificial Sequence: Synthetic peptide
DEHEIWTTNPVATEHYGEVSTNLQRGNR

SEQ ID NO: 15214 - protein, 28 aa, Artificial Sequence
  Description of Artificial Sequence: Synthetic peptide
DEEEISTTNPVATECYGDVSTNLQRGNS

SEQ ID NO: 15215 - protein, 28 aa, Artificial Sequence
  Description of Artificial Sequence: Synthetic peptide
DTEEIRTTNPVATEQYGSVSDNDQRGNP

SEQ ID NO: 15216 - protein, 28 aa, Artificial Sequence
  Description of Artificial Sequence: Synthetic peptide
VEEEIRTTNPVATEQYGSVSDNLQQQNR

SEQ ID NO: 15217 - protein, 30 aa, Artificial Sequence
  Description of Artificial Sequence: Synthetic polypeptide
DEEEIRTTNPVATEQYGSVSTNLEDEGNDR

SEQ ID NO: 15218 - protein, 28 aa, Artificial Sequence
  Description of Artificial Sequence: Synthetic peptide
DEQEIRTTNPVATEQYGSVETDDQRGNR

SEQ ID NO: 15219 - protein, 28 aa, Artificial Sequence
  Description of Artificial Sequence: Synthetic peptide
DEEEIRTTNPVATEQYGSVSTDLEIGNE

SEQ ID NO: 15220 - protein, 28 aa, Artificial Sequence
  Description of Artificial Sequence: Synthetic peptide
DEEEIRTTNIVATEQYGSVSENLAVGNR

SEQ ID NO: 15221 - protein, 28 aa, Artificial Sequence
  Description of Artificial Sequence: Synthetic peptide
DEEEIRTTNPVATEQYGSVDTNLQPENE

SEQ ID NO: 15222 - protein, 28 aa, Artificial Sequence
  Description of Artificial Sequence: Synthetic peptide
VEEEIRPTNPVATEQYGSVSTNLDRPNR

SEQ ID NO: 15223 - protein, 28 aa, Artificial Sequence
  Description of Artificial Sequence: Synthetic peptide
DEEMIRTTNPVATEQYGDVSENLQEGNR

SEQ ID NO: 15224 - protein, 29 aa, Artificial Sequence
  Description of Artificial Sequence: Synthetic peptide
DECEIRTTNPVATETYGSVSTNDQDRGNR

SEQ ID NO: 15225 - protein, 28 aa, Artificial Sequence
  Description of Artificial Sequence: Synthetic peptide
DEEEIRTTNPYATEQYGSVSTNEMQGNR

SEQ ID NO: 15226 - protein, 29 aa, Artificial Sequence
  Description of Artificial Sequence: Synthetic peptide
DEQEIRTTNPVATEQYGCVSNNLQRNGNR

SEQ ID NO: 15227 - protein, 28 aa, Artificial Sequence
  Description of Artificial Sequence: Synthetic peptide
HEEEIRTTNPVATEVYGDVSTNLQRGNA

SEQ ID NO: 15228 - protein, 28 aa, Artificial Sequence
  Description of Artificial Sequence: Synthetic peptide
DEEEICTTNIVATEQYGSVATDLQRGNR

SEQ ID NO: 15229 - protein, 31 aa, Artificial Sequence
  Description of Artificial Sequence: Synthetic polypeptide
DEEEIRTTNPVATEQYGSVISTNEQRGDNTR

SEQ ID NO: 15230 - protein, 28 aa, Artificial Sequence
  Description of Artificial Sequence: Synthetic peptide
DEEEIRTTNPVATECYGSVSENLQRGDH

SEQ ID NO: 15231 - protein, 28 aa, Artificial Sequence
  Description of Artificial Sequence: Synthetic peptide
DEEEIRTTNPVATEQYGSVSTDEQRGEW

SEQ ID NO: 15232 - protein, 28 aa, Artificial Sequence
  Description of Artificial Sequence: Synthetic peptide
DENEVRTTNPVASEQYGSVSTNLQRGNT

SEQ ID NO: 15233 - protein, 30 aa, Artificial Sequence
  Description of Artificial Sequence: Synthetic polypeptide
DEEEIRTTNPVATEQYGSVSTMNLQNGDDR

SEQ ID NO: 15234 - protein, 28 aa, Artificial Sequence
  Description of Artificial Sequence: Synthetic peptide
DEEEIRQTNPVATELYGSVSTNLQRGDD

SEQ ID NO: 15235 - protein, 28 aa, Artificial Sequence
  Description of Artificial Sequence: Synthetic peptide
DEEEIRTTNPVATELYGSVSTNPQQGNF

SEQ ID NO: 15236 - protein, 28 aa, Artificial Sequence
  Description of Artificial Sequence: Synthetic peptide
DEQEIRATNPVATEHYGWVSTNLQRGNR

SEQ ID NO: 15237 - protein, 28 aa, Artificial Sequence
  Description of Artificial Sequence: Synthetic peptide
DENEITTTNPVATEQYGSVSENLQRGNQ

SEQ ID NO: 15238 - protein, 29 aa, Artificial Sequence
  Description of Artificial Sequence: Synthetic peptide
DEEEIRTTNPVATEQYGVMSTNLQDIGNR

SEQ ID NO: 15239 - protein, 28 aa, Artificial Sequence
  Description of Artificial Sequence: Synthetic peptide
DEQEIRTTNPVATEQYGSVSTDLEHGNR

SEQ ID NO: 15240 - protein, 28 aa, Artificial Sequence
  Description of Artificial Sequence: Synthetic peptide
DEEEIRTTNPVATEQYGEVSDNLQRGTH

SEQ ID NO: 15241 - protein, 29 aa, Artificial Sequence
  Description of Artificial Sequence: Synthetic peptide
DEEEIRTTNPVATEQYGSASECCLQRGNR

SEQ ID NO: 15242 - protein, 30 aa, Artificial Sequence
  Description of Artificial Sequence: Synthetic polypeptide
DEEEIRTTNPEATEQYGSVSITNLVQDGNR

SEQ ID NO: 15243 - protein, 29 aa, Artificial Sequence
  Description of Artificial Sequence: Synthetic peptide
DEEEIRTTNPVATEQYGSVSTNLQVGEDQ

SEQ ID NO: 15244 - protein, 29 aa, Artificial Sequence
  Description of Artificial Sequence: Synthetic peptide
DEEEIRTTNPTATEQYGSVSTNLQNGDNS

SEQ ID NO: 15245 - protein, 28 aa, Artificial Sequence
  Description of Artificial Sequence: Synthetic peptide
DEEEIRTTNPVATEQYGSVSTDDQRGEF

SEQ ID NO: 15246 - protein, 28 aa, Artificial Sequence
  Description of Artificial Sequence: Synthetic peptide
DEEEIRTVNPVATEQYGVVSMNLQRGNL

SEQ ID NO: 15247 - protein, 28 aa, Artificial Sequence
  Description of Artificial Sequence: Synthetic peptide
MEEEIRTTNPVATEQYGSVSTDLQNGNA

SEQ ID NO: 15248 - protein, 31 aa, Artificial Sequence
  Description of Artificial Sequence: Synthetic polypeptide
DEEEIRTTNPVATEQYGSVSETNDQERGDNR

SEQ ID NO: 15249 - protein, 28 aa, Artificial Sequence
  Description of Artificial Sequence: Synthetic peptide
DEEEIRTTNPDATEQYGSVSTNEQQGNS

SEQ ID NO: 15250 - protein, 28 aa, Artificial Sequence
  Description of Artificial Sequence: Synthetic peptide
SEEEIRTTNPVATEQYGSVSTVLQREDR

SEQ ID NO: 15251 - protein, 28 aa, Artificial Sequence
  Description of Artificial Sequence: Synthetic peptide
DEHEIRTTNIVATEQYGSVSTELQRGER

SEQ ID NO: 15252 - protein, 30 aa, Artificial Sequence
  Description of Artificial Sequence: Synthetic polypeptide
DEEEIRTTNPVATECYGSVSTNLQREGNDM

SEQ ID NO: 15253 - protein, 29 aa, Artificial Sequence
  Description of Artificial Sequence: Synthetic peptide
DEEEIRTTNPVATEQYGSVDNNLQRGMER

SEQ ID NO: 15254 - protein, 28 aa, Artificial Sequence
  Description of Artificial Sequence: Synthetic peptide
SEEEIRTTNPVATEQYGTVSVNLQTGNR

SEQ ID NO: 15255 - protein, 28 aa, Artificial Sequence
  Description of Artificial Sequence: Synthetic peptide
DEEEIRTTNIVATEMYGSVSDNLQRGNN

SEQ ID NO: 15256 - protein, 28 aa, Artificial Sequence
  Description of Artificial Sequence: Synthetic peptide
DEEEIRTTNPVATEQYGSVSTPLEIGER

SEQ ID NO: 15257 - protein, 28 aa, Artificial Sequence
  Description of Artificial Sequence: Synthetic peptide
DEEEIRTTNPVATECYGSVSTNLQYGEN

SEQ ID NO: 15258 - protein, 28 aa, Artificial Sequence
  Description of Artificial Sequence: Synthetic peptide
DEEEIVTTNPVATEQYGCVSENLQRGNF

SEQ ID NO: 15259 - protein, 28 aa, Artificial Sequence
  Description of Artificial Sequence: Synthetic peptide
DEEEIRATNPVATEQFGSVSTNPQRGNA

SEQ ID NO: 15260 - protein, 30 aa, Artificial Sequence
  Description of Artificial Sequence: Synthetic polypeptide
DEEEIRTTNPVATETFGSVSTNLPQERGNR

SEQ ID NO: 15261 - protein, 30 aa, Artificial Sequence
  Description of Artificial Sequence: Synthetic polypeptide
DEEEIRTTNPVATEQYGVVSTELQERGNDR

SEQ ID NO: 15262 - protein, 30 aa, Artificial Sequence
  Description of Artificial Sequence: Synthetic polypeptide
DEEEIRTTNPVATEQYGVVSTNLQDREGDR

SEQ ID NO: 15263 - protein, 28 aa, Artificial Sequence
  Description of Artificial Sequence: Synthetic peptide
DEEEIRTTNPVATECYGSVSTELERGNE

SEQ ID NO: 15264 - protein, 29 aa, Artificial Sequence
  Description of Artificial Sequence: Synthetic peptide
DEEEIRTTNPVATEQYGESVETEDQRGNR

SEQ ID NO: 15265 - protein, 28 aa, Artificial Sequence
  Description of Artificial Sequence: Synthetic peptide
DEEEIRTTNPVATEQYGSVSTDLEDGNA

SEQ ID NO: 15266 - protein, 28 aa, Artificial Sequence
  Description of Artificial Sequence: Synthetic peptide
DEEEIRTVNPVATEQYGSASTNIQRGNI

SEQ ID NO: 15267 - protein, 28 aa, Artificial Sequence
  Description of Artificial Sequence: Synthetic peptide
DEEEIRTTNPVATEQYGSVSENLGRGMW

SEQ ID NO: 15268 - protein, 28 aa, Artificial Sequence
  Description of Artificial Sequence: Synthetic peptide
DEEEIRTTNIVATECYGSASTNLQHGNR

SEQ ID NO: 15269 - protein, 28 aa, Artificial Sequence
  Description of Artificial Sequence: Synthetic peptide
DEEEIRTTNIVATEQYGSVETNDQQGNR

SEQ ID NO: 15270 - protein, 30 aa, Artificial Sequence
  Description of Artificial Sequence: Synthetic polypeptide
DEEEIRTTNPVATEQYGSVSTDLQDVGNDR

SEQ ID NO: 15271 - protein, 28 aa, Artificial Sequence
  Description of Artificial Sequence: Synthetic peptide
DEEEIRTTNPVATECYGSASTNLQRENL

SEQ ID NO: 15272 - protein, 28 aa, Artificial Sequence
  Description of Artificial Sequence: Synthetic peptide
DEEEIRTTNPVATEQYGSVSTNLQAEEI

SEQ ID NO: 15273 - protein, 31 aa, Artificial Sequence
  Description of Artificial Sequence: Synthetic polypeptide
DEEEIRTTNPVATEQYGSVESTNLDREGDNR

SEQ ID NO: 15274 - protein, 28 aa, Artificial Sequence
  Description of Artificial Sequence: Synthetic peptide
DEQEIRTTNPVATEGYGSISENLQRGNR

SEQ ID NO: 15275 - protein, 28 aa, Artificial Sequence
  Description of Artificial Sequence: Synthetic peptide
DEQEIRTTNPVATEQWGSVSTNLQRGTA

SEQ ID NO: 15276 - protein, 28 aa, Artificial Sequence
  Description of Artificial Sequence: Synthetic peptide
DEEEIRTTNPVATEQYGSVSTDDERGNF

SEQ ID NO: 15277 - protein, 29 aa, Artificial Sequence
  Description of Artificial Sequence: Synthetic peptide
DESEIRTTNPVCTEQYGSVSTNEDQRGNR

SEQ ID NO: 15278 - protein, 29 aa, Artificial Sequence
  Description of Artificial Sequence: Synthetic peptide
QEEEIRTTNPVATEQYGSVSTDGPQRGNR

SEQ ID NO: 15279 - protein, 28 aa, Artificial Sequence
  Description of Artificial Sequence: Synthetic peptide
DEEEIRTTNPVATECYGTVATNLQRGNN

SEQ ID NO: 15280 - protein, 28 aa, Artificial Sequence
  Description of Artificial Sequence: Synthetic peptide
DEEEIRTTNPVATEQYGSVDTDEQRGNV

SEQ ID NO: 15281 - protein, 28 aa, Artificial Sequence
  Description of Artificial Sequence: Synthetic peptide
DEEEIRPTNPVATENYGSVSNNLQSGNR

SEQ ID NO: 15282 - protein, 28 aa, Artificial Sequence
  Description of Artificial Sequence: Synthetic peptide
DEEEIRTTNPVATEQYGSVDTPLDRGER

SEQ ID NO: 15283 - protein, 30 aa, Artificial Sequence
  Description of Artificial Sequence: Synthetic polypeptide
DEEEIRTTNPVATEQYGSVEDTNLQRGDER

SEQ ID NO: 15284 - protein, 28 aa, Artificial Sequence
  Description of Artificial Sequence: Synthetic peptide
DEEEIRTTNPVATEQYGSVSTPDDRGER

SEQ ID NO: 15285 - protein, 31 aa, Artificial Sequence
  Description of Artificial Sequence: Synthetic polypeptide
DEEEIRTTNPVATEQYGSVTSDTNLQREGNP

SEQ ID NO: 15286 - protein, 28 aa, Artificial Sequence
  Description of Artificial Sequence: Synthetic peptide
DENEIATTNPVATECYGSVSTNLQRGDR

SEQ ID NO: 15287 - protein, 28 aa, Artificial Sequence
  Description of Artificial Sequence: Synthetic peptide
DEQEIATTNPVATEQYGSVATNLQRGNL

SEQ ID NO: 15288 - protein, 28 aa, Artificial Sequence
  Description of Artificial Sequence: Synthetic peptide
DEEQIRTTNPVATEQYGSVSTGLQPGNP

SEQ ID NO: 15289 - protein, 29 aa, Artificial Sequence
  Description of Artificial Sequence: Synthetic peptide
DEEEIRTTNPVATMQYGSVSTNLEVNGNR

SEQ ID NO: 15290 - protein, 28 aa, Artificial Sequence
  Description of Artificial Sequence: Synthetic peptide
DEGEIRCTNPVASEQYGIVSTNLQRGNR

SEQ ID NO: 15291 - protein, 30 aa, Artificial Sequence
  Description of Artificial Sequence: Synthetic polypeptide
DEEEIRTTNPVATEQYGSVSTNLQEVGNDL

SEQ ID NO: 15292 - protein, 28 aa, Artificial Sequence
  Description of Artificial Sequence: Synthetic peptide
DEEEIRCTNPVATEWYGSVSTNLQGGNY

SEQ ID NO: 15293 - protein, 31 aa, Artificial Sequence
  Description of Artificial Sequence: Synthetic polypeptide
DEEEIRTTNPVATEQYGSVSETNLERGDNDR

SEQ ID NO: 15294 - protein, 29 aa, Artificial Sequence
  Description of Artificial Sequence: Synthetic peptide
DEEEIRTTNPDATEQYGSVSTGLVIRGNR

SEQ ID NO: 15295 - protein, 28 aa, Artificial Sequence
  Description of Artificial Sequence: Synthetic peptide
DEEEISTTNPVATEQYGIVDTGLQRGNR

SEQ ID NO: 15296 - protein, 28 aa, Artificial Sequence
  Description of Artificial Sequence: Synthetic peptide
DEEEIRTTNPVATEQYGSVSTELEDGND

SEQ ID NO: 15297 - protein, 28 aa, Artificial Sequence
  Description of Artificial Sequence: Synthetic peptide
DEEEIRTTNIVATEQYGSVSMNLERGNT

SEQ ID NO: 15298 - protein, 29 aa, Artificial Sequence
  Description of Artificial Sequence: Synthetic peptide
DEEEIRTTNPVATEQYGSVGTCLQRGNDQ

SEQ ID NO: 15299 - protein, 28 aa, Artificial Sequence
  Description of Artificial Sequence: Synthetic peptide
DEEEIRCTNPVAVEQYGEVSTNLQHGNR

SEQ ID NO: 15300 - protein, 28 aa, Artificial Sequence
  Description of Artificial Sequence: Synthetic peptide
NEEEIRTTNPVASEMYGSVSTNLQRGTR

SEQ ID NO: 15301 - protein, 31 aa, Artificial Sequence
  Description of Artificial Sequence: Synthetic polypeptide
DEEEIRTTNPVATEQWGHSHVSTNLQRAGNR

SEQ ID NO: 15302 - protein, 28 aa, Artificial Sequence
  Description of Artificial Sequence: Synthetic peptide
SEEEIRTVNPVATEQYGSVSTNLQTGNL

SEQ ID NO: 15303 - protein, 28 aa, Artificial Sequence
  Description of Artificial Sequence: Synthetic peptide
DEEEIRTTNPVATAQYGSVPTWVQRGNR

SEQ ID NO: 15304 - protein, 30 aa, Artificial Sequence
  Description of Artificial Sequence: Synthetic polypeptide
DEEEIRTTNPVATEQYGSVSTANLYDRGNS

SEQ ID NO: 15305 - protein, 28 aa, Artificial Sequence
  Description of Artificial Sequence: Synthetic peptide
DEEEIRTTNPVATEQYGSVDTELQLGNM

SEQ ID NO: 15306 - protein, 28 aa, Artificial Sequence
  Description of Artificial Sequence: Synthetic peptide
DEEEIRTTNPEATEQYGSVSTEEQAGNR

SEQ ID NO: 15307 - protein, 28 aa, Artificial Sequence
  Description of Artificial Sequence: Synthetic peptide
SEEEIRTTNPVATEMFGSVSTNLQRGDR

SEQ ID NO: 15308 - protein, 29 aa, Artificial Sequence
  Description of Artificial Sequence: Synthetic peptide
DEEEIRCTNPVATELYGSVSTNGLQRGPR

SEQ ID NO: 15309 - protein, 29 aa, Artificial Sequence
  Description of Artificial Sequence: Synthetic peptide
DEEEIRTTNPVATEQYGSMSTNLQDLGNF

SEQ ID NO: 15310 - protein, 30 aa, Artificial Sequence
  Description of Artificial Sequence: Synthetic polypeptide
DEEEIRTTNPVATENYGSVSTVNLQDRGNF

SEQ ID NO: 15311 - protein, 28 aa, Artificial Sequence
  Description of Artificial Sequence: Synthetic peptide
DEEEIRTTNPVSTEQYGSVSENLMRGNQ

SEQ ID NO: 15312 - protein, 29 aa, Artificial Sequence
  Description of Artificial Sequence: Synthetic peptide
KEEEIRTTNPVATEQYGSVSTDLQDRGNY

SEQ ID NO: 15313 - protein, 29 aa, Artificial Sequence
  Description of Artificial Sequence: Synthetic peptide
DENEIRQTNPVATEQYGSVSTPLQVRGNR

SEQ ID NO: 15314 - protein, 30 aa, Artificial Sequence
  Description of Artificial Sequence: Synthetic polypeptide
DEEEITTTNPVATEQYGSVSDTNLQRGEDR

SEQ ID NO: 15315 - protein, 28 aa, Artificial Sequence
  Description of Artificial Sequence: Synthetic peptide
DEVEIATTNPVATEQYGSVSENLQRGTR

SEQ ID NO: 15316 - protein, 28 aa, Artificial Sequence
  Description of Artificial Sequence: Synthetic peptide
DEEEIRTTNPFATEQYGSVSTNDQYGNK

SEQ ID NO: 15317 - protein, 28 aa, Artificial Sequence
  Description of Artificial Sequence: Synthetic peptide
SEEEIRTTNPVATECYGSVSTNLMQGNR

SEQ ID NO: 15318 - protein, 30 aa, Artificial Sequence
  Description of Artificial Sequence: Synthetic polypeptide
DEEEIRTTNPVATEQYGSVSTNEQREGNTQ

SEQ ID NO: 15319 - protein, 29 aa, Artificial Sequence
  Description of Artificial Sequence: Synthetic peptide
DEEEIRTTNPVATEQYGDSVSTALQRGEP

SEQ ID NO: 15320 - protein, 28 aa, Artificial Sequence
  Description of Artificial Sequence: Synthetic peptide
DEEEIRQTNIVATEQYGSVSTNLQHGNI

SEQ ID NO: 15321 - protein, 28 aa, Artificial Sequence
  Description of Artificial Sequence: Synthetic peptide
DEQEVATTNPVATEQYGWVSTNLQRGNR

SEQ ID NO: 15322 - protein, 28 aa, Artificial Sequence
  Description of Artificial Sequence: Synthetic peptide
DEEEIRTTNPVATEQYGSVETDLDRGNV

SEQ ID NO: 15323 - protein, 28 aa, Artificial Sequence
  Description of Artificial Sequence: Synthetic peptide
DEEEIATTNPVATEQYGSVSTNEQNGNE

SEQ ID NO: 15324 - protein, 28 aa, Artificial Sequence
  Description of Artificial Sequence: Synthetic peptide
DEEEIRTTNPEATEQYGSVSTNEQRGEP

SEQ ID NO: 15325 - protein, 28 aa, Artificial Sequence
  Description of Artificial Sequence: Synthetic peptide
DECEIRCTNPVSTEQYGSVDTNLQRGNR

SEQ ID NO: 15326 - protein, 28 aa, Artificial Sequence
  Description of Artificial Sequence: Synthetic peptide
DEEEIRSTNPVATEQYGFVSTNPQMGNR

SEQ ID NO: 15327 - protein, 30 aa, Artificial Sequence
  Description of Artificial Sequence: Synthetic polypeptide
DEEEIRQTNPVATEQYGSVSETGLQRGENR

SEQ ID NO: 15328 - protein, 30 aa, Artificial Sequence
  Description of Artificial Sequence: Synthetic polypeptide
DEEEIRTTNPVATEQYGSVHQTNLQIRGNP

SEQ ID NO: 15329 - protein, 30 aa, Artificial Sequence
  Description of Artificial Sequence: Synthetic polypeptide
DEEEIRTTNPVATEQYGDVGSTNLQERGNQ

SEQ ID NO: 15330 - protein, 28 aa, Artificial Sequence
  Description of Artificial Sequence: Synthetic peptide
DEEEITTTNPVCTEQYGSVSENLQHGNR

SEQ ID NO: 15331 - protein, 29 aa, Artificial Sequence
  Description of Artificial Sequence: Synthetic peptide
DEEEIRTTNPVATEQYGSVSCENLCRGNN

SEQ ID NO: 15332 - protein, 28 aa, Artificial Sequence
  Description of Artificial Sequence: Synthetic peptide
DEEEIRTTNPVASEQYGTVGMNLQRGNR

SEQ ID NO: 15333 - protein, 29 aa, Artificial Sequence
  Description of Artificial Sequence: Synthetic peptide
DEEEIRTTNPVATEQYGSVSTNLQHAGQQ

SEQ ID NO: 15334 - protein, 28 aa, Artificial Sequence
  Description of Artificial Sequence: Synthetic peptide
REEEIRTTNPVATEQYGEVSTNLQHGNA

SEQ ID NO: 15335 - protein, 28 aa, Artificial Sequence
  Description of Artificial Sequence: Synthetic peptide
DEEEIRTTNPVATEQYGDVSENLQQGNC

SEQ ID NO: 15336 - protein, 28 aa, Artificial Sequence
  Description of Artificial Sequence: Synthetic peptide
DEEEIRTTNIVATEQYGSVTENLQQGNR

SEQ ID NO: 15337 - protein, 31 aa, Artificial Sequence
  Description of Artificial Sequence: Synthetic polypeptide
DEEEIRTTNPVATEQYGSVESTDNDQRGNER

SEQ ID NO: 15338 - protein, 30 aa, Artificial Sequence
  Description of Artificial Sequence: Synthetic polypeptide
DEEEIRTTNPVATEQYGSVSTENDQREGER

SEQ ID NO: 15339 - protein, 28 aa, Artificial Sequence
  Description of Artificial Sequence: Synthetic peptide
DENEIRTTNPVATEQWGSVSTNLQRGTF

SEQ ID NO: 15340 - protein, 28 aa, Artificial Sequence
  Description of Artificial Sequence: Synthetic peptide
DEEEIRTTNPVATEQYGVVSTNLDDGNF

SEQ ID NO: 15341 - protein, 30 aa, Artificial Sequence
  Description of Artificial Sequence: Synthetic polypeptide
DEECIRTTNPVATEYYGSVSTTNWLQRGNR

SEQ ID NO: 15342 - protein, 28 aa, Artificial Sequence
  Description of Artificial Sequence: Synthetic peptide
DEEEIRTTNIVATEQYGSVSTILQHGNA

SEQ ID NO: 15343 - protein, 28 aa, Artificial Sequence
  Description of Artificial Sequence: Synthetic peptide
DEEEISTTNPVATEQYGSVSNNLQFGPR

SEQ ID NO: 15344 - protein, 28 aa, Artificial Sequence
  Description of Artificial Sequence: Synthetic peptide
DEEEIRTTNPVATEQYGSYSTNEQVGTR

SEQ ID NO: 15345 - protein, 28 aa, Artificial Sequence
  Description of Artificial Sequence: Synthetic peptide
DEEEIRTTNPVATEQYGSVDTDLQYGNI

SEQ ID NO: 15346 - protein, 28 aa, Artificial Sequence
  Description of Artificial Sequence: Synthetic peptide
KEEEIRTTNPVATECYGSVSTNLQTGNY

SEQ ID NO: 15347 - protein, 30 aa, Artificial Sequence
  Description of Artificial Sequence: Synthetic polypeptide
DESEIRTTNPVATEQYGSVFSTNLQRFGNF

SEQ ID NO: 15348 - protein, 28 aa, Artificial Sequence
  Description of Artificial Sequence: Synthetic peptide
DEEEIRTTNIVATEQYGVVSTNLQRGEG

SEQ ID NO: 15349 - protein, 29 aa, Artificial Sequence
  Description of Artificial Sequence: Synthetic peptide
DEEEIRTTNPDATEQYGSVSTNDQERGNF

SEQ ID NO: 15350 - protein, 30 aa, Artificial Sequence
  Description of Artificial Sequence: Synthetic polypeptide
DEEEIRTTNPVATELYGSVSATNLEREGNR

SEQ ID NO: 15351 - protein, 28 aa, Artificial Sequence
  Description of Artificial Sequence: Synthetic peptide
DEEEIRTTNIVATEQYGSVSTNLLQGNI

SEQ ID NO: 15352 - protein, 30 aa, Artificial Sequence
  Description of Artificial Sequence: Synthetic polypeptide
DEEEIRTTNPVCTEQYGSVSTNLQCRGNDH

SEQ ID NO: 15353 - protein, 31 aa, Artificial Sequence
  Description of Artificial Sequence: Synthetic polypeptide
DEEEIRTTNPVATEQYGSVCSTMPLAQRGNR

SEQ ID NO: 15354 - protein, 28 aa, Artificial Sequence
  Description of Artificial Sequence: Synthetic peptide
DEEEIRTTNPVASEQYGSVSTPLQAGNS

SEQ ID NO: 15355 - protein, 31 aa, Artificial Sequence
  Description of Artificial Sequence: Synthetic polypeptide
DEEEIRTTNPVATEQYGSVSLTNPLVERGNR

SEQ ID NO: 15356 - protein, 28 aa, Artificial Sequence
  Description of Artificial Sequence: Synthetic peptide
DEEEIRTTNPVATEIYGSVDMNLQQGNR

SEQ ID NO: 15357 - protein, 28 aa, Artificial Sequence
  Description of Artificial Sequence: Synthetic peptide
DEEEIRTTNPVATEQYGSVSTNDEFGER

SEQ ID NO: 15358 - protein, 28 aa, Artificial Sequence
  Description of Artificial Sequence: Synthetic peptide
DEEEIRTTNPVATEQYGSVSDLLQHGMR

SEQ ID NO: 15359 - protein, 31 aa, Artificial Sequence
  Description of Artificial Sequence: Synthetic polypeptide
DEEEIRTTNPVATEQYGSVSTLNPLQDRGER

SEQ ID NO: 15360 - protein, 28 aa, Artificial Sequence
  Description of Artificial Sequence: Synthetic peptide
DEEEIRTTNPVATEQYGDVSEDLQSGNR

SEQ ID NO: 15361 - protein, 29 aa, Artificial Sequence
  Description of Artificial Sequence: Synthetic peptide
DEEEIRTTNPVSTEQYGSVSQENLQSGNR

SEQ ID NO: 15362 - protein, 28 aa, Artificial Sequence
  Description of Artificial Sequence: Synthetic peptide
DEEEIATTNPVATETYGSVSENEQRGNR

SEQ ID NO: 15363 - protein, 28 aa, Artificial Sequence
  Description of Artificial Sequence: Synthetic peptide
DEEELRTTNPVATEQYGSESTNLQRENI

SEQ ID NO: 15364 - protein, 30 aa, Artificial Sequence
  Description of Artificial Sequence: Synthetic polypeptide
DETEIRTTNPVATEQYGTVLSTNLQRSGNR

SEQ ID NO: 15365 - protein, 29 aa, Artificial Sequence
  Description of Artificial Sequence: Synthetic peptide
DEQEIRTTNPVATEQYGSVSTNLMIRGNL

SEQ ID NO: 15366 - protein, 28 aa, Artificial Sequence
  Description of Artificial Sequence: Synthetic peptide
DEEEIRTTNPVATEQYGSVDTNLLVGNH

SEQ ID NO: 15367 - protein, 28 aa, Artificial Sequence
  Description of Artificial Sequence: Synthetic peptide
SEEEIRTTNPVATEQYGAVSENLQRGND

SEQ ID NO: 15368 - protein, 28 aa, Artificial Sequence
  Description of Artificial Sequence: Synthetic peptide
QDEEISTTNPVATEQYGSVSTNLQRGGR

SEQ ID NO: 15369 - protein, 28 aa, Artificial Sequence
  Description of Artificial Sequence: Synthetic peptide
DEEEIRTTNPVATEQYGSVETNLQDGED

SEQ ID NO: 15370 - protein, 30 aa, Artificial Sequence
  Description of Artificial Sequence: Synthetic polypeptide
DEEEIRTTNPVATEQYGSVSCTELCRGNDR

SEQ ID NO: 15371 - protein, 28 aa, Artificial Sequence
  Description of Artificial Sequence: Synthetic peptide
MEEEIRATNPVATEQYGSVSTNLQQGNM

SEQ ID NO: 15372 - protein, 28 aa, Artificial Sequence
  Description of Artificial Sequence: Synthetic peptide
DEEEIRTTNPVATECYGFVSENPQRGNR

SEQ ID NO: 15373 - protein, 28 aa, Artificial Sequence
  Description of Artificial Sequence: Synthetic peptide
DESEIRTTNPCATEQYGTASTNLQRGNR

SEQ ID NO: 15374 - protein, 28 aa, Artificial Sequence
  Description of Artificial Sequence: Synthetic peptide
DEEEIRTTNPVATEQWGSVSTNLMQGNQ

SEQ ID NO: 15375 - protein, 28 aa, Artificial Sequence
  Description of Artificial Sequence: Synthetic peptide
DEEEIRTTNPVATEQYGSVSTNLEVGEN

SEQ ID NO: 15376 - protein, 28 aa, Artificial Sequence
  Description of Artificial Sequence: Synthetic peptide
MENEIRTTNPVATEQYGSVSTDLQRGNM

SEQ ID NO: 15377 - protein, 30 aa, Artificial Sequence
  Description of Artificial Sequence: Synthetic polypeptide
DEEEIRTTNPVATEQYGSVSMTNLKRDQNR

SEQ ID NO: 15378 - protein, 28 aa, Artificial Sequence
  Description of Artificial Sequence: Synthetic peptide
SEEGIRTTNPVATEQWGSVSTNLQTGNR

SEQ ID NO: 15379 - protein, 28 aa, Artificial Sequence
  Description of Artificial Sequence: Synthetic peptide
QEEEIATTNPVATEQYGSASTNLQRGMR

SEQ ID NO: 15380 - protein, 28 aa, Artificial Sequence
  Description of Artificial Sequence: Synthetic peptide
DEEEIRTTNPVATEVYGAVSTNLQVGNT

SEQ ID NO: 15381 - protein, 28 aa, Artificial Sequence
  Description of Artificial Sequence: Synthetic peptide
DEEEIRTTNPVATEGYGSVSENLQHGGR

SEQ ID NO: 15382 - protein, 30 aa, Artificial Sequence
  Description of Artificial Sequence: Synthetic polypeptide
MEEEIRTTNPVATEQYGSVSTNLQREGNDS

SEQ ID NO: 15383 - protein, 28 aa, Artificial Sequence
  Description of Artificial Sequence: Synthetic peptide
DGEEIRTTNPVATEQYGEVSTNLQHGDR

SEQ ID NO: 15384 - protein, 28 aa, Artificial Sequence
  Description of Artificial Sequence: Synthetic peptide
NEEEVATTNPVATEQYGSVSTNLQRGNQ

SEQ ID NO: 15385 - protein, 30 aa, Artificial Sequence
  Description of Artificial Sequence: Synthetic polypeptide
DEEEIRTTNPVATEQYGSVETNPLQPGDNR

SEQ ID NO: 15386 - protein, 28 aa, Artificial Sequence
  Description of Artificial Sequence: Synthetic peptide
DEQEVRTTNPVATEQYGSVANNLQRGNR

SEQ ID NO: 15387 - protein, 28 aa, Artificial Sequence
  Description of Artificial Sequence: Synthetic peptide
DEEEIRTTNPVASENYGNVSTNLQRGNQ

SEQ ID NO: 15388 - protein, 28 aa, Artificial Sequence
  Description of Artificial Sequence: Synthetic peptide
DEEEIRTTNIVATEQYGSVSTDLMRGNF

SEQ ID NO: 15389 - protein, 30 aa, Artificial Sequence
  Description of Artificial Sequence: Synthetic polypeptide
DENEIRTTNPVATEQYGSVSTNLEDREGNR

SEQ ID NO: 15390 - protein, 28 aa, Artificial Sequence
  Description of Artificial Sequence: Synthetic peptide
DENEIGTTNPVATEQYGDVSTNLQHGNR

SEQ ID NO: 15391 - protein, 30 aa, Artificial Sequence
  Description of Artificial Sequence: Synthetic polypeptide
DEVEIRTTNPTATEQYGSVSTNLQREGNDR

SEQ ID NO: 15392 - protein, 28 aa, Artificial Sequence
  Description of Artificial Sequence: Synthetic peptide
DEEEIRTTNPVATEQYGSVDTNDERGND

SEQ ID NO: 15393 - protein, 29 aa, Artificial Sequence
  Description of Artificial Sequence: Synthetic peptide
DEECIRTTNPVATEQYGSVHSTPLQPGNR

SEQ ID NO: 15394 - protein, 28 aa, Artificial Sequence
  Description of Artificial Sequence: Synthetic peptide
DEEEIRTTNPVATEQYGSVDDPEQRGNR

SEQ ID NO: 15395 - protein, 28 aa, Artificial Sequence
  Description of Artificial Sequence: Synthetic peptide
DEEEIRTTNPVATECWGSVSENLQRGNS

SEQ ID NO: 15396 - protein, 28 aa, Artificial Sequence
  Description of Artificial Sequence: Synthetic peptide
DEFEINTTNPVATEQYGDVSDNLQRGNR

SEQ ID NO: 15397 - protein, 28 aa, Artificial Sequence
  Description of Artificial Sequence: Synthetic peptide
DEEEIRAVNPVATEQYGSVSTNVQRENR

SEQ ID NO: 15398 - protein, 29 aa, Artificial Sequence
  Description of Artificial Sequence: Synthetic peptide
DENEIRTTNPVATEQYGSASATNLQRGGR

SEQ ID NO: 15399 - protein, 29 aa, Artificial Sequence
  Description of Artificial Sequence: Synthetic peptide
DEVEIATTNPTATEQYGSVSTNLQRGDNR

SEQ ID NO: 15400 - protein, 28 aa, Artificial Sequence
  Description of Artificial Sequence: Synthetic peptide
DEEEIVTTNPVATEQYGEVSTNLQRPMR

SEQ ID NO: 15401 - protein, 28 aa, Artificial Sequence
  Description of Artificial Sequence: Synthetic peptide
DDSEIRTTNPVAVEQYGSVSTNLQRGER

SEQ ID NO: 15402 - protein, 28 aa, Artificial Sequence
  Description of Artificial Sequence: Synthetic peptide
DEQEIVTTNPVATEQYGEVSENLQRGNR

SEQ ID NO: 15403 - protein, 28 aa, Artificial Sequence
  Description of Artificial Sequence: Synthetic peptide
DEEEIRAVNPVAYEQYGCVSTNLQRGNR

SEQ ID NO: 15404 - protein, 28 aa, Artificial Sequence
  Description of Artificial Sequence: Synthetic peptide
DEQEIATTNPVATEQYGSVSTNLQQGNY

SEQ ID NO: 15405 - protein, 28 aa, Artificial Sequence
  Description of Artificial Sequence: Synthetic peptide
DEEIIRTTNPTATEQYGSVSTNLQNGNN

SEQ ID NO: 15406 - protein, 30 aa, Artificial Sequence
  Description of Artificial Sequence: Synthetic polypeptide
DEEEIRTTNPVATEQYGSVSCTNLQCAGNN

SEQ ID NO: 15407 - protein, 28 aa, Artificial Sequence
  Description of Artificial Sequence: Synthetic peptide
QEEEICTTNPVATEQYGEVSENLQRGNR

SEQ ID NO: 15408 - protein, 28 aa, Artificial Sequence
  Description of Artificial Sequence: Synthetic peptide
DEQEIRTTNPVATECYGSVSTNLERGER

SEQ ID NO: 15409 - protein, 29 aa, Artificial Sequence
  Description of Artificial Sequence: Synthetic peptide
DEEEIRTTNPVATEQYGSVSTDLQDQGNI

SEQ ID NO: 15410 - protein, 28 aa, Artificial Sequence
  Description of Artificial Sequence: Synthetic peptide
AEEEIWTTNPVCSEQYGSVSTNLQRGNR

SEQ ID NO: 15411 - protein, 28 aa, Artificial Sequence
  Description of Artificial Sequence: Synthetic peptide
DEEEIRTTNPVATEQYGSVDTELQAGNM

SEQ ID NO: 15412 - protein, 28 aa, Artificial Sequence
  Description of Artificial Sequence: Synthetic peptide
DEEEIRTTNPVATEQYGSVETDLQREER

SEQ ID NO: 15413 - protein, 28 aa, Artificial Sequence
  Description of Artificial Sequence: Synthetic peptide
DEEEIRTTNPVATECYGSVSNNIQRGER

SEQ ID NO: 15414 - protein, 29 aa, Artificial Sequence
  Description of Artificial Sequence: Synthetic peptide
DEEEIRTTNPTATEQFGSVSTNLQQAGNR

SEQ ID NO: 15415 - protein, 31 aa, Artificial Sequence
  Description of Artificial Sequence: Synthetic polypeptide
DEEPIRTTNPVATEQYGSVGSTNLQVRGDNR

SEQ ID NO: 15416 - protein, 30 aa, Artificial Sequence
  Description of Artificial Sequence: Synthetic polypeptide
DEEEIRTTNPVATEQYGSVESGNLTRNGNR

SEQ ID NO: 15417 - protein, 28 aa, Artificial Sequence
  Description of Artificial Sequence: Synthetic peptide
DEEEIRTTNPVATEWYGSVDTNLMIGNR

SEQ ID NO: 15418 - protein, 30 aa, Artificial Sequence
  Description of Artificial Sequence: Synthetic polypeptide
DEEEIRTTNPVATEQYGSVSENLQRGDTTR

SEQ ID NO: 15419 - protein, 28 aa, Artificial Sequence
  Description of Artificial Sequence: Synthetic peptide
DEEEIRTTNPVATEQYGSVSTDEERENR

SEQ ID NO: 15420 - protein, 28 aa, Artificial Sequence
  Description of Artificial Sequence: Synthetic peptide
DEREIRTTNPVATEQYGEASTNLQRGNL

SEQ ID NO: 15421 - protein, 30 aa, Artificial Sequence
  Description of Artificial Sequence: Synthetic polypeptide
DEEEIATTNPVATEQYGSVSATDLQERGNR

SEQ ID NO: 15422 - protein, 28 aa, Artificial Sequence
  Description of Artificial Sequence: Synthetic peptide
DEEEIRTTNPVATEQYGSVSTPLDNENR

SEQ ID NO: 15423 - protein, 28 aa, Artificial Sequence
  Description of Artificial Sequence: Synthetic peptide
DEEEIRTTNPVATEQYGAVSENLQLGER

SEQ ID NO: 15424 - protein, 29 aa, Artificial Sequence
  Description of Artificial Sequence: Synthetic peptide
DEEEIRTTNPVATEQWGSVSTNEQIQGNR

SEQ ID NO: 15425 - protein, 30 aa, Artificial Sequence
  Description of Artificial Sequence: Synthetic polypeptide
DEEEIRTTNPVATEQYGNVSTNNLQLDGNR

SEQ ID NO: 15426 - protein, 32 aa, Artificial Sequence
  Description of Artificial Sequence: Synthetic polypeptide
DEEEIRTTNPVATEQYGSVDSTNLQDREGNDR

SEQ ID NO: 15427 - protein, 29 aa, Artificial Sequence
  Description of Artificial Sequence: Synthetic peptide
DEEEIRTTNPVATEQYGSVEETNLDRGER

SEQ ID NO: 15428 - protein, 28 aa, Artificial Sequence
  Description of Artificial Sequence: Synthetic peptide
DEEEIRTTNPDATEQYGSVSTPLQNGER

SEQ ID NO: 15429 - protein, 31 aa, Artificial Sequence
  Description of Artificial Sequence: Synthetic polypeptide
DEEEIRTTNPVATEQYGSVDSTNLQERYGNM

SEQ ID NO: 15430 - protein, 28 aa, Artificial Sequence
  Description of Artificial Sequence: Synthetic peptide
DEEEIRTTNIVATEQYGSVSTNALRGNS

SEQ ID NO: 15431 - protein, 28 aa, Artificial Sequence
  Description of Artificial Sequence: Synthetic peptide
DENEIRTTNPVATEQYGSVSTDLQAGNV

SEQ ID NO: 15432 - protein, 29 aa, Artificial Sequence
  Description of Artificial Sequence: Synthetic peptide
DEECIRTTNPVATEGYGSVSTNPDQRGNR

SEQ ID NO: 15433 - protein, 28 aa, Artificial Sequence
  Description of Artificial Sequence: Synthetic peptide
DEQEIRTTNPVATEQYGSVETDLQRGNF

SEQ ID NO: 15434 - protein, 28 aa, Artificial Sequence
  Description of Artificial Sequence: Synthetic peptide
DEEEIRTTNPVATEQYGSVFTNFDRGNH

SEQ ID NO: 15435 - protein, 30 aa, Artificial Sequence
  Description of Artificial Sequence: Synthetic polypeptide
DEEEIRTTNPVATEQYGSVSTNLQDVGNDA

SEQ ID NO: 15436 - protein, 31 aa, Artificial Sequence
  Description of Artificial Sequence: Synthetic polypeptide
DEEEIRTTNPVATEQYGSVDSTENLQLGENR

SEQ ID NO: 15437 - protein, 28 aa, Artificial Sequence
  Description of Artificial Sequence: Synthetic peptide
DEEEIRTTNPVATEQYGSVDTDLQYGNE

SEQ ID NO: 15438 - protein, 29 aa, Artificial Sequence
  Description of Artificial Sequence: Synthetic peptide
DEQEIRTTNPVATECYGSVSTELQRGNDR

SEQ ID NO: 15439 - protein, 31 aa, Artificial Sequence
  Description of Artificial Sequence: Synthetic polypeptide
DEEEIRTTNPVATEQYGVSVSTTDPLQRGNR

SEQ ID NO: 15440 - protein, 28 aa, Artificial Sequence
  Description of Artificial Sequence: Synthetic peptide
DEEEIRTTNPVATEQYGSVSTELQEGDA

SEQ ID NO: 15441 - protein, 28 aa, Artificial Sequence
  Description of Artificial Sequence: Synthetic peptide
DEEEIRTTNPDATEQYGSVSTNDQQGNY

SEQ ID NO: 15442 - protein, 28 aa, Artificial Sequence
  Description of Artificial Sequence: Synthetic peptide
DEEEIRTTNPTATETFGSVSTNLQLGNR

SEQ ID NO: 15443 - protein, 30 aa, Artificial Sequence
  Description of Artificial Sequence: Synthetic polypeptide
DEEEIRTTNPVATEAYGSVSADNLQNRGNR

SEQ ID NO: 15444 - protein, 28 aa, Artificial Sequence
  Description of Artificial Sequence: Synthetic peptide
DLEEIRTTNPVATEQYGDVSTNLQQENR

SEQ ID NO: 15445 - protein, 28 aa, Artificial Sequence
  Description of Artificial Sequence: Synthetic peptide
DEEEIRTTNPIATEGYGSVATNLQRGER

SEQ ID NO: 15446 - protein, 28 aa, Artificial Sequence
  Description of Artificial Sequence: Synthetic peptide
DEEEIRTTNIVATEQYGSVSTNLQITNS

SEQ ID NO: 15447 - protein, 28 aa, Artificial Sequence
  Description of Artificial Sequence: Synthetic peptide
DEEEIRTTNPVATEQYGSVSDNLEREER

SEQ ID NO: 15448 - protein, 28 aa, Artificial Sequence
  Description of Artificial Sequence: Synthetic peptide
DEEEIYTTNIVATEQYGSVSTNLQCGNL

SEQ ID NO: 15449 - protein, 28 aa, Artificial Sequence
  Description of Artificial Sequence: Synthetic peptide
DEEEIRTTNPVATEVYGSVSTNLQRMQQ

SEQ ID NO: 15450 - protein, 28 aa, Artificial Sequence
  Description of Artificial Sequence: Synthetic peptide
DEEEIRTTNIDATEQYGSVSMNLQRGNA

SEQ ID NO: 15451 - protein, 28 aa, Artificial Sequence
  Description of Artificial Sequence: Synthetic peptide
DEECIRTTNPVAAEQYGSVSTNLQRENP

SEQ ID NO: 15452 - protein, 31 aa, Artificial Sequence
  Description of Artificial Sequence: Synthetic polypeptide
DEEEIRTTNPDATEQYGSVASTNNLQREGNR

SEQ ID NO: 15453 - protein, 31 aa, Artificial Sequence
  Description of Artificial Sequence: Synthetic polypeptide
DEEEIRTTNPVATEQYGSVSTENLQERNGNE

SEQ ID NO: 15454 - protein, 29 aa, Artificial Sequence
  Description of Artificial Sequence: Synthetic peptide
DEEEIRTTNPVATEQYGSVSTNGQTGNDL

SEQ ID NO: 15455 - protein, 28 aa, Artificial Sequence
  Description of Artificial Sequence: Synthetic peptide
DEEVIRTTNPVATEQYGDVCANLQRGNR

SEQ ID NO: 15456 - protein, 28 aa, Artificial Sequence
  Description of Artificial Sequence: Synthetic peptide
DEQEICTTNPVATEQYGDVSTNLQYGNR

SEQ ID NO: 15457 - protein, 28 aa, Artificial Sequence
  Description of Artificial Sequence: Synthetic peptide
DEEEIRTTNPVATECYGSVSTELQQGNE

SEQ ID NO: 15458 - protein, 30 aa, Artificial Sequence
  Description of Artificial Sequence: Synthetic polypeptide
DEEEIRSTNPVATEQWGISVSTNLQRGENR

SEQ ID NO: 15459 - protein, 28 aa, Artificial Sequence
  Description of Artificial Sequence: Synthetic peptide
SEVEIACTNPVATEQYGSVSTNLQRGNR

SEQ ID NO: 15460 - protein, 29 aa, Artificial Sequence
  Description of Artificial Sequence: Synthetic peptide
DEQEIRTTNPVATEQYGSVSCTNLQTGNC

SEQ ID NO: 15461 - protein, 28 aa, Artificial Sequence
  Description of Artificial Sequence: Synthetic peptide
DEFEIRTTNPVATEMYGSVSDNMQRGNR

SEQ ID NO: 15462 - protein, 29 aa, Artificial Sequence
  Description of Artificial Sequence: Synthetic peptide
DEEEIRTTNPVATEQYGSVSTDLQNEGNS

SEQ ID NO: 15463 - protein, 28 aa, Artificial Sequence
  Description of Artificial Sequence: Synthetic peptide
DEEEIRTTNPEATEQYGSVSTNLQGGEI

SEQ ID NO: 15464 - protein, 28 aa, Artificial Sequence
  Description of Artificial Sequence: Synthetic peptide
DEEEIRTTNPVATEQYGSVSTPLLVGNV

SEQ ID NO: 15465 - protein, 28 aa, Artificial Sequence
  Description of Artificial Sequence: Synthetic peptide
DEEEIRTTNPVATEQYGSWSTNEQVGNH

SEQ ID NO: 15466 - protein, 30 aa, Artificial Sequence
  Description of Artificial Sequence: Synthetic polypeptide
DEEEIRTTNPVATEQYGSVLSDNLMRFGNR

SEQ ID NO: 15467 - protein, 30 aa, Artificial Sequence
  Description of Artificial Sequence: Synthetic polypeptide
DETEIRTTNPVATEQYGSVDSTNLQGDGNR

SEQ ID NO: 15468 - protein, 30 aa, Artificial Sequence
  Description of Artificial Sequence: Synthetic polypeptide
DEEEIRTTNPVATEQYGSVSTMNDQNGNDR

SEQ ID NO: 15469 - protein, 28 aa, Artificial Sequence
  Description of Artificial Sequence: Synthetic peptide
DEEEIRTTNPVATECYGSVSMNLQYGNM

SEQ ID NO: 15470 - protein, 28 aa, Artificial Sequence
  Description of Artificial Sequence: Synthetic peptide
QEEEIATTNPVATEQYGEVSENLQRGNR

SEQ ID NO: 15471 - protein, 30 aa, Artificial Sequence
  Description of Artificial Sequence: Synthetic polypeptide
DEEEIRTTNPVATEQYGSVSTPPLQERGND

SEQ ID NO: 15472 - protein, 29 aa, Artificial Sequence
  Description of Artificial Sequence: Synthetic peptide
DEEEIRTTNPVATEQYGSVSTNEPQQGNF

SEQ ID NO: 15473 - protein, 28 aa, Artificial Sequence
  Description of Artificial Sequence: Synthetic peptide
QEEEIVTTNPVATEQYGEVSDNLQRGNR

SEQ ID NO: 15474 - protein, 30 aa, Artificial Sequence
  Description of Artificial Sequence: Synthetic polypeptide
DEEEIRTTNPVATEQYGSVSCTCPQQRGNR

SEQ ID NO: 15475 - protein, 30 aa, Artificial Sequence
  Description of Artificial Sequence: Synthetic polypeptide
DEEEIRTTNPVATEQYGSVSTNLQDIGNDS

SEQ ID NO: 15476 - protein, 28 aa, Artificial Sequence
  Description of Artificial Sequence: Synthetic peptide
DEDEIRATNPVATEIYGSVSMNLQRGNR

SEQ ID NO: 15477 - protein, 28 aa, Artificial Sequence
  Description of Artificial Sequence: Synthetic peptide
MEEEIYTTNPVATEQYGSVSTNLQNGNF

SEQ ID NO: 15478 - protein, 28 aa, Artificial Sequence
  Description of Artificial Sequence: Synthetic peptide
DEEEIATTNPFATEQYGSVPTNLQRGNQ

SEQ ID NO: 15479 - protein, 28 aa, Artificial Sequence
  Description of Artificial Sequence: Synthetic peptide
SEEEIRATNPVATELYGSVSTNEQRGNR

SEQ ID NO: 15480 - protein, 28 aa, Artificial Sequence
  Description of Artificial Sequence: Synthetic peptide
DEEEIRTTNIVATEQYGSVSTNLEIGNV

SEQ ID NO: 15481 - protein, 30 aa, Artificial Sequence
  Description of Artificial Sequence: Synthetic polypeptide
DEDEIRTTNPVATEQYGWVTSTNLQRGLNR

SEQ ID NO: 15482 - protein, 30 aa, Artificial Sequence
  Description of Artificial Sequence: Synthetic polypeptide
QEEEIRTTNPVATEQYGSVSTNLQELGENR

SEQ ID NO: 15483 - protein, 28 aa, Artificial Sequence
  Description of Artificial Sequence: Synthetic peptide
DEEEIRTTNPVATENYGSVSENLQAGPR

SEQ ID NO: 15484 - protein, 28 aa, Artificial Sequence
  Description of Artificial Sequence: Synthetic peptide
DEEEIRTVNIVATEQYGSVSTNLQRGEN

SEQ ID NO: 15485 - protein, 28 aa, Artificial Sequence
  Description of Artificial Sequence: Synthetic peptide
DEEQIRTTNPVAFEQYGSVSTNLHPGNR

SEQ ID NO: 15486 - protein, 28 aa, Artificial Sequence
  Description of Artificial Sequence: Synthetic peptide
DEEEIRTTNPVSTEGYGSVSTVCQRGNR

SEQ ID NO: 15487 - protein, 29 aa, Artificial Sequence
  Description of Artificial Sequence: Synthetic peptide
DEEEIRTTNPVATEQYGSVSTNLQQGEDN

SEQ ID NO: 15488 - protein, 29 aa, Artificial Sequence
  Description of Artificial Sequence: Synthetic peptide
DEEEIRTTNPVATEQYGSVSTNEQNGDNF

SEQ ID NO: 15489 - protein, 30 aa, Artificial Sequence
  Description of Artificial Sequence: Synthetic polypeptide
DEEEIRTTNPVATEQYGSVETNGLEREGNR

SEQ ID NO: 15490 - protein, 28 aa, Artificial Sequence
  Description of Artificial Sequence: Synthetic peptide
DEEEIRSTNPVSTECYGSVSTNLQRGNL

SEQ ID NO: 15491 - protein, 29 aa, Artificial Sequence
  Description of Artificial Sequence: Synthetic peptide
DEEEIRTTNPVATEQYGLVSANLQERMNR

SEQ ID NO: 15492 - protein, 28 aa, Artificial Sequence
  Description of Artificial Sequence: Synthetic peptide
DEEEIRTTNPVATEFYGSVSSNLQNGNF

SEQ ID NO: 15493 - protein, 29 aa, Artificial Sequence
  Description of Artificial Sequence: Synthetic peptide
FEEEIRTTNPVATEQYGSFSYTNPQRGNR

SEQ ID NO: 15494 - protein, 28 aa, Artificial Sequence
  Description of Artificial Sequence: Synthetic peptide
AEVEISTTNPVATEQYGSVSTNLQRGNF

SEQ ID NO: 15495 - protein, 29 aa, Artificial Sequence
  Description of Artificial Sequence: Synthetic peptide
DEEEIRTTNPVATELYGSVSTNLQNIGNQ

SEQ ID NO: 15496 - protein, 30 aa, Artificial Sequence
  Description of Artificial Sequence: Synthetic polypeptide
DEEEIRTTNPTATEQYGSVSTNPQDRGDNR

SEQ ID NO: 15497 - protein, 28 aa, Artificial Sequence
  Description of Artificial Sequence: Synthetic peptide
DEEEIRTTNPVATEQYGSYSENLMQGNR

SEQ ID NO: 15498 - protein, 28 aa, Artificial Sequence
  Description of Artificial Sequence: Synthetic peptide
VEEEIRTTNPVASEQYGSVSTNLQRGTQ

SEQ ID NO: 15499 - protein, 29 aa, Artificial Sequence
  Description of Artificial Sequence: Synthetic peptide
DEEEIRTTNPVATEQYGSVSQNLQFDGDR

SEQ ID NO: 15500 - protein, 31 aa, Artificial Sequence
  Description of Artificial Sequence: Synthetic polypeptide
DEEEIRTTNPVATEQYGSVSETNLQDRGENS

SEQ ID NO: 15501 - protein, 28 aa, Artificial Sequence
  Description of Artificial Sequence: Synthetic peptide
DENEICTTNPTATEQYGSVSDNLQRGNR

SEQ ID NO: 15502 - protein, 28 aa, Artificial Sequence
  Description of Artificial Sequence: Synthetic peptide
DEEEIATTNPVSTEQYGSASTNLQHGNR

SEQ ID NO: 15503 - protein, 28 aa, Artificial Sequence
  Description of Artificial Sequence: Synthetic peptide
NEEEIRTTNPIATEIYGSVATNLQRGNR

SEQ ID NO: 15504 - protein, 28 aa, Artificial Sequence
  Description of Artificial Sequence: Synthetic peptide
DEEEIATVNPVATEQYGEVSENLQRGNR

SEQ ID NO: 15505 - protein, 28 aa, Artificial Sequence
  Description of Artificial Sequence: Synthetic peptide
DEEEIRTTNPVATEQYGVVSTELEPGNR

SEQ ID NO: 15506 - protein, 28 aa, Artificial Sequence
  Description of Artificial Sequence: Synthetic peptide
QEEEIRTVNPVATEGYGSVSTNLMRGNR

SEQ ID NO: 15507 - protein, 28 aa, Artificial Sequence
  Description of Artificial Sequence: Synthetic peptide
DEEEIRTTNPDATEQYGSVSTNLATGNF

SEQ ID NO: 15508 - protein, 28 aa, Artificial Sequence
  Description of Artificial Sequence: Synthetic peptide
GEDEIRTTNPVATEQYGDVSTNLQRENR

SEQ ID NO: 15509 - protein, 28 aa, Artificial Sequence
  Description of Artificial Sequence: Synthetic peptide
DEEEIRTTNPVATEQYGSVSTELQVGEV

SEQ ID NO: 15510 - protein, 31 aa, Artificial Sequence
  Description of Artificial Sequence: Synthetic polypeptide
DEEEIRTTNPVATEQYGSVNSPNLQRGVNHR

SEQ ID NO: 15511 - protein, 28 aa, Artificial Sequence
  Description of Artificial Sequence: Synthetic peptide
DEEEIRTTNPVATEQYGSVETEDERGNR

SEQ ID NO: 15512 - protein, 28 aa, Artificial Sequence
  Description of Artificial Sequence: Synthetic peptide
DEEEIRATNPVATEQYGSVSTDLQHGNT

SEQ ID NO: 15513 - protein, 28 aa, Artificial Sequence
  Description of Artificial Sequence: Synthetic peptide
DEEEIATTNPVASEQYGVVSTNLQRGTR

SEQ ID NO: 15514 - protein, 28 aa, Artificial Sequence
  Description of Artificial Sequence: Synthetic peptide
VEEEIRTTNPVATEMYGNVSTNLQRGNQ

SEQ ID NO: 15515 - protein, 28 aa, Artificial Sequence
  Description of Artificial Sequence: Synthetic peptide
DEEEIRTTNPVATEWWGSVSENLQLGNR

SEQ ID NO: 15516 - protein, 28 aa, Artificial Sequence
  Description of Artificial Sequence: Synthetic peptide
DEEEIATTNPVATEQYGTVSTNLQYGNA

SEQ ID NO: 15517 - protein, 28 aa, Artificial Sequence
  Description of Artificial Sequence: Synthetic peptide
DEEEIRTTNPVATEQYGSVSTDLQNGEH

SEQ ID NO: 15518 - protein, 28 aa, Artificial Sequence
  Description of Artificial Sequence: Synthetic peptide
DDEEIRATNPVATEIYGSVSTNLERGNR

SEQ ID NO: 15519 - protein, 28 aa, Artificial Sequence
  Description of Artificial Sequence: Synthetic peptide
DEEEIRTTNPVATEQYGSVSTDLERGEE

SEQ ID NO: 15520 - protein, 28 aa, Artificial Sequence
  Description of Artificial Sequence: Synthetic peptide
DEEEIRTTNIVATEQYGSVSTELQQGNY

SEQ ID NO: 15521 - protein, 31 aa, Artificial Sequence
  Description of Artificial Sequence: Synthetic polypeptide
DEEEIRTTNPVATEQYGSVISTNPLWQDGNR

SEQ ID NO: 15522 - protein, 30 aa, Artificial Sequence
  Description of Artificial Sequence: Synthetic polypeptide
DEEEIRGTNPVATEQYGSVSTMNLQREFNR

SEQ ID NO: 15523 - protein, 29 aa, Artificial Sequence
  Description of Artificial Sequence: Synthetic peptide
QEEEIATTNPVATEQYGSVSTNLQHAGNR

SEQ ID NO: 15524 - protein, 30 aa, Artificial Sequence
  Description of Artificial Sequence: Synthetic polypeptide
DEEEIRTTNPVATEQYGSVSTNLQDNGDNF

SEQ ID NO: 15525 - protein, 28 aa, Artificial Sequence
  Description of Artificial Sequence: Synthetic peptide
DEEEIRTTNPVATEIYGSVSTNLQQGIV

SEQ ID NO: 15526 - protein, 29 aa, Artificial Sequence
  Description of Artificial Sequence: Synthetic peptide
DEEEIRTTNPVATEQYGSVSTDLQENGND

SEQ ID NO: 15527 - protein, 28 aa, Artificial Sequence
  Description of Artificial Sequence: Synthetic peptide
DEEEIRTTNPVATENYGAVSNNLQRGNQ

SEQ ID NO: 15528 - protein, 28 aa, Artificial Sequence
  Description of Artificial Sequence: Synthetic peptide
DEEEIRTTNPDATEQYGSVSTNDQPGNP

SEQ ID NO: 15529 - protein, 28 aa, Artificial Sequence
  Description of Artificial Sequence: Synthetic peptide
QEEEIVTTNPVATEQYGSVCTNLQRGND

SEQ ID NO: 15530 - protein, 28 aa, Artificial Sequence
  Description of Artificial Sequence: Synthetic peptide
DEEEIRTTNPVAYEMYGVVATNLQRGNR

SEQ ID NO: 15531 - protein, 28 aa, Artificial Sequence
  Description of Artificial Sequence: Synthetic peptide
DEEEIRTTNPVATECYGSVSTNLMIGNA

SEQ ID NO: 15532 - protein, 28 aa, Artificial Sequence
  Description of Artificial Sequence: Synthetic peptide
DEEEIRTTNIVATEQYGSVSENLQRGGI

SEQ ID NO: 15533 - protein, 28 aa, Artificial Sequence
  Description of Artificial Sequence: Synthetic peptide
DEFEIITTNIVATEQYGSVSTNLQYGNR

SEQ ID NO: 15534 - protein, 28 aa, Artificial Sequence
  Description of Artificial Sequence: Synthetic peptide
SEEEIRTTNPTATEQYGSVSTNEQLGNR

SEQ ID NO: 15535 - protein, 28 aa, Artificial Sequence
  Description of Artificial Sequence: Synthetic peptide
DEEEIRTTNPVATEQYGSVSTDLETGER

SEQ ID NO: 15536 - protein, 30 aa, Artificial Sequence
  Description of Artificial Sequence: Synthetic polypeptide
DEEEIRTTNPVATEQFGSVISTNLQDNGNR

SEQ ID NO: 15537 - protein, 28 aa, Artificial Sequence
  Description of Artificial Sequence: Synthetic peptide
DEEEIRCTNIVATEQYGSVSTNLQREER

SEQ ID NO: 15538 - protein, 28 aa, Artificial Sequence
  Description of Artificial Sequence: Synthetic peptide
DEEEIRTTNPVSTENYGSVSENLQKGNR

SEQ ID NO: 15539 - protein, 28 aa, Artificial Sequence
  Description of Artificial Sequence: Synthetic peptide
DEECIRTTNPFATEQYGSVSTNLFRGER

SEQ ID NO: 15540 - protein, 28 aa, Artificial Sequence
  Description of Artificial Sequence: Synthetic peptide
DEEEIRTTNPVATEVYGSVSENLQHGMR

SEQ ID NO: 15541 - protein, 28 aa, Artificial Sequence
  Description of Artificial Sequence: Synthetic peptide
DEEEIRTTNPQATEQYGCVSTGLERGNR

SEQ ID NO: 15542 - protein, 30 aa, Artificial Sequence
  Description of Artificial Sequence: Synthetic polypeptide
DEEEIRTTNPVATEQYGSVSTNLVQENGNE

SEQ ID NO: 15543 - protein, 30 aa, Artificial Sequence
  Description of Artificial Sequence: Synthetic polypeptide
DEEEIRTTNPVAYEQYGGSVSTRNLQAGNR

SEQ ID NO: 15544 - protein, 30 aa, Artificial Sequence
  Description of Artificial Sequence: Synthetic polypeptide
DEEEIRTTNPVATEQYGSVSCTDLQCNGNR

SEQ ID NO: 15545 - protein, 29 aa, Artificial Sequence
  Description of Artificial Sequence: Synthetic peptide
DEEEIRTTNPVATEQYGSASENLQHSGNR

SEQ ID NO: 15546 - protein, 29 aa, Artificial Sequence
  Description of Artificial Sequence: Synthetic peptide
DEEEIRTTNPVATECYGSVSTNLQTGEDR

SEQ ID NO: 15547 - protein, 28 aa, Artificial Sequence
  Description of Artificial Sequence: Synthetic peptide
DEEEIRTTNPVATEQYGSVSTDLEDGNS

SEQ ID NO: 15548 - protein, 30 aa, Artificial Sequence
  Description of Artificial Sequence: Synthetic polypeptide
DEEEIRTTNPVATEQYGSRVSTPNLDRGND

SEQ ID NO: 15549 - protein, 28 aa, Artificial Sequence
  Description of Artificial Sequence: Synthetic peptide
DEEEICTTNIVATEQYGSVSTNDQRGNY

SEQ ID NO: 15550 - protein, 31 aa, Artificial Sequence
  Description of Artificial Sequence: Synthetic polypeptide
DEEEIRTTNPVATEQYGSVSITNLQDREGDR

SEQ ID NO: 15551 - protein, 30 aa, Artificial Sequence
  Description of Artificial Sequence: Synthetic polypeptide
DEEEIRTTNPVATEQYGSVDTNLMMRGENR

SEQ ID NO: 15552 - protein, 28 aa, Artificial Sequence
  Description of Artificial Sequence: Synthetic peptide
DEEEIRTTNPVATEQFGTVSENLQRGNF

SEQ ID NO: 15553 - protein, 30 aa, Artificial Sequence
  Description of Artificial Sequence: Synthetic polypeptide
DEEEIRTTNPVATEQYGSYVSTDLQRGENS

SEQ ID NO: 15554 - protein, 28 aa, Artificial Sequence
  Description of Artificial Sequence: Synthetic peptide
AELEIRTVNPVATEQYGSVSTNLQSGNR

SEQ ID NO: 15555 - protein, 28 aa, Artificial Sequence
  Description of Artificial Sequence: Synthetic peptide
DEEEIRTTNPFATEQYGSVSTGLDPGNR

SEQ ID NO: 15556 - protein, 28 aa, Artificial Sequence
  Description of Artificial Sequence: Synthetic peptide
DEEEIRTTNPVATEIYGSVSTDLQSGNQ

SEQ ID NO: 15557 - protein, 28 aa, Artificial Sequence
  Description of Artificial Sequence: Synthetic peptide
KEEEIRTTNPVATEQYGSVSTNLQAGDV

SEQ ID NO: 15558 - protein, 28 aa, Artificial Sequence
  Description of Artificial Sequence: Synthetic peptide
DEQEIVTTNPVSTEQYGSVSTNLQRGNQ

SEQ ID NO: 15559 - protein, 31 aa, Artificial Sequence
  Description of Artificial Sequence: Synthetic polypeptide
DEEEIRTVNPVATEQYGSVSTMNLQRFGENR

SEQ ID NO: 15560 - protein, 28 aa, Artificial Sequence
  Description of Artificial Sequence: Synthetic peptide
SEEEIRTTNPHATEQYGSVSTNLDNGNR

SEQ ID NO: 15561 - protein, 28 aa, Artificial Sequence
  Description of Artificial Sequence: Synthetic peptide
DEEEISTTNPVATEQYGSVSELLQNGNR

SEQ ID NO: 15562 - protein, 29 aa, Artificial Sequence
  Description of Artificial Sequence: Synthetic peptide
DEEEIRTTNPVATEQYGSVDTNLLPNGNR

SEQ ID NO: 15563 - protein, 28 aa, Artificial Sequence
  Description of Artificial Sequence: Synthetic peptide
DEEEIATTNPVATEQYGSVSTNWQPGND

SEQ ID NO: 15564 - protein, 28 aa, Artificial Sequence
  Description of Artificial Sequence: Synthetic peptide
DEREIRTTNPVATEQYGSVSTNLQRTFH

SEQ ID NO: 15565 - protein, 28 aa, Artificial Sequence
  Description of Artificial Sequence: Synthetic peptide
DEEEIRTTNPVATEQYGSVSTDLEDGNF

SEQ ID NO: 15566 - protein, 29 aa, Artificial Sequence
  Description of Artificial Sequence: Synthetic peptide
SEEEIRTTNPVATEQYGWVTATNLQRGNR

SEQ ID NO: 15567 - protein, 28 aa, Artificial Sequence
  Description of Artificial Sequence: Synthetic peptide
DEEEIRTTNPVATEQYGSVSTEDQEGNS

SEQ ID NO: 15568 - protein, 28 aa, Artificial Sequence
  Description of Artificial Sequence: Synthetic peptide
DEEEIRTTNIVATEQYGSVSTNIERGNT

SEQ ID NO: 15569 - protein, 29 aa, Artificial Sequence
  Description of Artificial Sequence: Synthetic peptide
DEEEIRTTNPDATEQYGSVSTNLQYHGDR

SEQ ID NO: 15570 - protein, 28 aa, Artificial Sequence
  Description of Artificial Sequence: Synthetic peptide
DEEEIRQTNIVATEWYGSVSTNLQRGER

SEQ ID NO: 15571 - protein, 28 aa, Artificial Sequence
  Description of Artificial Sequence: Synthetic peptide
DENEIRTTNPVATEQYGSVSEDLQRGNS

SEQ ID NO: 15572 - protein, 29 aa, Artificial Sequence
  Description of Artificial Sequence: Synthetic peptide
DEEEIRTTNPVATEQYGVVSDTELQDGNR

SEQ ID NO: 15573 - protein, 29 aa, Artificial Sequence
  Description of Artificial Sequence: Synthetic peptide
DEEEIRTTNPVATEQYGSVDSTNLEHGNL

SEQ ID NO: 15574 - protein, 28 aa, Artificial Sequence
  Description of Artificial Sequence: Synthetic peptide
DEEEIRTTNPVATEQYGSVSTELQGGDI

SEQ ID NO: 15575 - protein, 28 aa, Artificial Sequence
  Description of Artificial Sequence: Synthetic peptide
DNEEIRTTNPFATHQYGSVSTNLQRGER

SEQ ID NO: 15576 - protein, 30 aa, Artificial Sequence
  Description of Artificial Sequence: Synthetic polypeptide
DEEEIRTTNPVATEQYGSYVSTNLQNGNLG

SEQ ID NO: 15577 - protein, 30 aa, Artificial Sequence
  Description of Artificial Sequence: Synthetic polypeptide
DCEEIRATNPVATEQYGSVSTENLQRGNNR

SEQ ID NO: 15578 - protein, 30 aa, Artificial Sequence
  Description of Artificial Sequence: Synthetic polypeptide
DEEEIRTTNPVATEQYGSVSTINLQDKGER

SEQ ID NO: 15579 - protein, 30 aa, Artificial Sequence
  Description of Artificial Sequence: Synthetic polypeptide
DEEEIRTTNPVATEQYGSVSETENLQPGNH

SEQ ID NO: 15580 - protein, 29 aa, Artificial Sequence
  Description of Artificial Sequence: Synthetic peptide
DEEEIRTTNPVATEQYGSVECTNPDRGNR

SEQ ID NO: 15581 - protein, 28 aa, Artificial Sequence
  Description of Artificial Sequence: Synthetic peptide
DEEEIRTTNPVATEQYGSVSTELQDGEY

SEQ ID NO: 15582 - protein, 28 aa, Artificial Sequence
  Description of Artificial Sequence: Synthetic peptide
SEEEIRTTNPVATEQFGSVSTNLQRGTH

SEQ ID NO: 15583 - protein, 30 aa, Artificial Sequence
  Description of Artificial Sequence: Synthetic polypeptide
DEEEIKTTNPVATEQYGSVSTNLQIWNGNR

SEQ ID NO: 15584 - protein, 29 aa, Artificial Sequence
  Description of Artificial Sequence: Synthetic peptide
DEEEIRTTNPVATECYGSVISTNGQRGNH

SEQ ID NO: 15585 - protein, 30 aa, Artificial Sequence
  Description of Artificial Sequence: Synthetic polypeptide
DEEEIRTTNPVATEIYGCVSATNLQREGNR

SEQ ID NO: 15586 - protein, 30 aa, Artificial Sequence
  Description of Artificial Sequence: Synthetic polypeptide
DEEEIRTTNPVATEQYGSVSTDEPLQWGNR

SEQ ID NO: 15587 - protein, 29 aa, Artificial Sequence
  Description of Artificial Sequence: Synthetic peptide
DEEEIRTTNPVATEQYGSVSTGLDVRLNR

SEQ ID NO: 15588 - protein, 28 aa, Artificial Sequence
  Description of Artificial Sequence: Synthetic peptide
DEEEIRTTNPTATECFGSVSTNLQHGNR

SEQ ID NO: 15589 - protein, 30 aa, Artificial Sequence
  Description of Artificial Sequence: Synthetic polypeptide
DEEEIRTTNPVATEQYGSVSCTDLCRGNDR

SEQ ID NO: 15590 - protein, 29 aa, Artificial Sequence
  Description of Artificial Sequence: Synthetic peptide
SEEEIRTTNPVATEQYGSVSTNPQSGNDR

SEQ ID NO: 15591 - protein, 28 aa, Artificial Sequence
  Description of Artificial Sequence: Synthetic peptide
SEEEIRTTNPVATECYGSVSTNLQNGNW

SEQ ID NO: 15592 - protein, 28 aa, Artificial Sequence
  Description of Artificial Sequence: Synthetic peptide
YEEEIRTTNPVATEQYGSVSTDLQWGNA

SEQ ID NO: 15593 - protein, 30 aa, Artificial Sequence
  Description of Artificial Sequence: Synthetic polypeptide
DEEEIRTTNPVATEQYGSVSTNLQENGNDM

SEQ ID NO: 15594 - protein, 29 aa, Artificial Sequence
  Description of Artificial Sequence: Synthetic peptide
DEDEIRTTNPVATEIYGSVSSNLQREGNR

SEQ ID NO: 15595 - protein, 28 aa, Artificial Sequence
  Description of Artificial Sequence: Synthetic peptide
DETEIATTNPVATEQYGVVATNLQRGNR

SEQ ID NO: 15596 - protein, 28 aa, Artificial Sequence
  Description of Artificial Sequence: Synthetic peptide
DEEEIRTTNPVATEQYGSVSTDLQREDP

SEQ ID NO: 15597 - protein, 28 aa, Artificial Sequence
  Description of Artificial Sequence: Synthetic peptide
DEEEIRTTNIVATEQYGSVGTNLQVGNS

SEQ ID NO: 15598 - protein, 28 aa, Artificial Sequence
  Description of Artificial Sequence: Synthetic peptide
DEQEIRTTNPVATEQYGSVSTNQQPGNE

SEQ ID NO: 15599 - protein, 28 aa, Artificial Sequence
  Description of Artificial Sequence: Synthetic peptide
DENEIRTTNPVATEQYGSVSENLMRGNF

SEQ ID NO: 15600 - protein, 28 aa, Artificial Sequence
  Description of Artificial Sequence: Synthetic peptide
DEEEIRTTNPVATEAYGEVSTNAQRGQR

SEQ ID NO: 15601 - protein, 28 aa, Artificial Sequence
  Description of Artificial Sequence: Synthetic peptide
KEEEIRTTNPVATECYGSVSTNLQTGNV

SEQ ID NO: 15602 - protein, 28 aa, Artificial Sequence
  Description of Artificial Sequence: Synthetic peptide
DEEEIRTTNPVATEQYGSVSEDLQNGNV

SEQ ID NO: 15603 - protein, 28 aa, Artificial Sequence
  Description of Artificial Sequence: Synthetic peptide
DEEEIRTTNPVATEQWGSVSTNLEVGNL

SEQ ID NO: 15604 - protein, 31 aa, Artificial Sequence
  Description of Artificial Sequence: Synthetic polypeptide
DEEEIRTTNPVATEQYGSVSETNLEREGENR

SEQ ID NO: 15605 - protein, 29 aa, Artificial Sequence
  Description of Artificial Sequence: Synthetic peptide
DEEEIRTTNPVATELYGSVSTNLQQEDNR

SEQ ID NO: 15606 - protein, 28 aa, Artificial Sequence
  Description of Artificial Sequence: Synthetic peptide
DEEEIRTTNPVATEQYGSVSTDLERENN

SEQ ID NO: 15607 - protein, 28 aa, Artificial Sequence
  Description of Artificial Sequence: Synthetic peptide
DEEEIRTTNPVATECYGTVSTDLQHGNR

SEQ ID NO: 15608 - protein, 30 aa, Artificial Sequence
  Description of Artificial Sequence: Synthetic polypeptide
DEEEIRTTNPVATEQYGIVVTMNNLQRGNR

SEQ ID NO: 15609 - protein, 28 aa, Artificial Sequence
  Description of Artificial Sequence: Synthetic peptide
DEEEIRTTNPVATECYGSVSTNLQQGED

SEQ ID NO: 15610 - protein, 30 aa, Artificial Sequence
  Description of Artificial Sequence: Synthetic polypeptide
DEEEIRTTNPVATEQYGSVDITLNLERGNR

SEQ ID NO: 15611 - protein, 29 aa, Artificial Sequence
  Description of Artificial Sequence: Synthetic peptide
DEEEIRTTNPVATEQYGSVSENEMNRGNR

SEQ ID NO: 15612 - protein, 29 aa, Artificial Sequence
  Description of Artificial Sequence: Synthetic peptide
DEEEIRTTNPVATMQWGSVSTNEQWRGNR

SEQ ID NO: 15613 - protein, 29 aa, Artificial Sequence
  Description of Artificial Sequence: Synthetic peptide
DEEEISTTNPVATEQYGSVASTNLQQENR

SEQ ID NO: 15614 - protein, 29 aa, Artificial Sequence
  Description of Artificial Sequence: Synthetic peptide
DEEEIATTNPVATEQYGSVTTNLQQHGNR

SEQ ID NO: 15615 - protein, 31 aa, Artificial Sequence
  Description of Artificial Sequence: Synthetic polypeptide
DEEEIRTTNPVATEQYGDVSTNLVQREGNPR

SEQ ID NO: 15616 - protein, 28 aa, Artificial Sequence
  Description of Artificial Sequence: Synthetic peptide
SEEEIRTTNPVATEQYGGVSENLQRGTR

SEQ ID NO: 15617 - protein, 30 aa, Artificial Sequence
  Description of Artificial Sequence: Synthetic polypeptide
DEEEIRTTNPVATEQYGSVTTGNLQRGDNI

SEQ ID NO: 15618 - protein, 29 aa, Artificial Sequence
  Description of Artificial Sequence: Synthetic peptide
DEEEIRTTNPEATEQYGSVSTNPLQSGNH

SEQ ID NO: 15619 - protein, 28 aa, Artificial Sequence
  Description of Artificial Sequence: Synthetic peptide
DENEIRTTNPVATEQYGSVSTNLMVGDR

SEQ ID NO: 15620 - protein, 29 aa, Artificial Sequence
  Description of Artificial Sequence: Synthetic peptide
DEEEIRTTNPTATEQYGSVSTNEQRGTDR

SEQ ID NO: 15621 - protein, 28 aa, Artificial Sequence
  Description of Artificial Sequence: Synthetic peptide
DEEEIRTTNPVATEQYGSVSTNLINGYE

SEQ ID NO: 15622 - protein, 30 aa, Artificial Sequence
  Description of Artificial Sequence: Synthetic polypeptide
DEEEIRTTNPVATEQYGSVSTNLQENGNDI

SEQ ID NO: 15623 - protein, 28 aa, Artificial Sequence
  Description of Artificial Sequence: Synthetic peptide
DEEEIRTTNIVATEQYGSVSENLQLGDR

SEQ ID NO: 15624 - protein, 28 aa, Artificial Sequence
  Description of Artificial Sequence: Synthetic peptide
MEEEIRTVNPVATEQYGSVSTNLQNGNV

SEQ ID NO: 15625 - protein, 28 aa, Artificial Sequence
  Description of Artificial Sequence: Synthetic peptide
DEEEIRTTNIVATEQYGEVSTNDQYGNR

SEQ ID NO: 15626 - protein, 28 aa, Artificial Sequence
  Description of Artificial Sequence: Synthetic peptide
DEEEIRTTNPIATEIYGAVSTNLERGNR

SEQ ID NO: 15627 - protein, 29 aa, Artificial Sequence
  Description of Artificial Sequence: Synthetic peptide
DEQEIRTTNPEATEQYGSVSTNLQRDGNH

SEQ ID NO: 15628 - protein, 29 aa, Artificial Sequence
  Description of Artificial Sequence: Synthetic peptide
MEEEIRTTNPVATEQYGSVSTNLQDNGNS

SEQ ID NO: 15629 - protein, 28 aa, Artificial Sequence
  Description of Artificial Sequence: Synthetic peptide
DEEEIRTTNPVATEQYGDVSENLQHGNS

SEQ ID NO: 15630 - protein, 28 aa, Artificial Sequence
  Description of Artificial Sequence: Synthetic peptide
DENEIVATNPVATEQYGWVSTNLQRGNR

SEQ ID NO: 15631 - protein, 31 aa, Artificial Sequence
  Description of Artificial Sequence: Synthetic polypeptide
DEEEIRTTNPVATEQYGSVSTNLQDVEGNDR

SEQ ID NO: 15632 - protein, 28 aa, Artificial Sequence
  Description of Artificial Sequence: Synthetic peptide
SEEEIRTTNPAATEQYGSVSTNLQRGTE

SEQ ID NO: 15633 - protein, 30 aa, Artificial Sequence
  Description of Artificial Sequence: Synthetic polypeptide
DEEEIRTTNPVATEQYGSVSTNLQEQGNDT

SEQ ID NO: 15634 - protein, 28 aa, Artificial Sequence
  Description of Artificial Sequence: Synthetic peptide
DEEEIRTTNPVATEQYGSVFTDLQRENQ

SEQ ID NO: 15635 - protein, 30 aa, Artificial Sequence
  Description of Artificial Sequence: Synthetic polypeptide
DEEEIRTTNPVATEQYGSVSTNLQEAGNDA

SEQ ID NO: 15636 - protein, 28 aa, Artificial Sequence
  Description of Artificial Sequence: Synthetic peptide
VEEEIRTTNPVATETYGSVGNNLQRGNR

SEQ ID NO: 15637 - protein, 28 aa, Artificial Sequence
  Description of Artificial Sequence: Synthetic peptide
DEEEIRTTNPVATEQYGSVSTNLEQGEM

SEQ ID NO: 15638 - protein, 28 aa, Artificial Sequence
  Description of Artificial Sequence: Synthetic peptide
DEEEIRTTNPDATECYGSVFTNLQRGND

SEQ ID NO: 15639 - protein, 28 aa, Artificial Sequence
  Description of Artificial Sequence: Synthetic peptide
DEEEIRTTNIVATEQYGEVGTNLQRGNA

SEQ ID NO: 15640 - protein, 30 aa, Artificial Sequence
  Description of Artificial Sequence: Synthetic polypeptide
DEEEIRTTNPVATEQYGSVDATALQRNGNR

SEQ ID NO: 15641 - protein, 28 aa, Artificial Sequence
  Description of Artificial Sequence: Synthetic peptide
DEEEIRTTNPVATEQYGSVSTNEMLGNA

SEQ ID NO: 15642 - protein, 28 aa, Artificial Sequence
  Description of Artificial Sequence: Synthetic peptide
DEEEIRTTNPVATEQYGSVSEDLQHGNA

SEQ ID NO: 15643 - protein, 28 aa, Artificial Sequence
  Description of Artificial Sequence: Synthetic peptide
DEVEIRTTNPVATEQYGSVDTNLQAGNQ

SEQ ID NO: 15644 - protein, 28 aa, Artificial Sequence
  Description of Artificial Sequence: Synthetic peptide
DEETIATTNPVATEQYGSVSTPLQVGNR

SEQ ID NO: 15645 - protein, 28 aa, Artificial Sequence
  Description of Artificial Sequence: Synthetic peptide
DEEEIRTTNPVATEQYGSVDTCLDEGNR

SEQ ID NO: 15646 - protein, 31 aa, Artificial Sequence
  Description of Artificial Sequence: Synthetic polypeptide
DEEEIRTTNPVATEQYGSVSTNLEEREGENR

SEQ ID NO: 15647 - protein, 28 aa, Artificial Sequence
  Description of Artificial Sequence: Synthetic peptide
DAEEIRTTNPVATEQYGSVDANLQRGNG

SEQ ID NO: 15648 - protein, 31 aa, Artificial Sequence
  Description of Artificial Sequence: Synthetic polypeptide
DEEEIRTTNPVATEQYGSVSTNLQESEGNDR

SEQ ID NO: 15649 - protein, 28 aa, Artificial Sequence
  Description of Artificial Sequence: Synthetic peptide
KEEEIATTNPVATEQYGSASTNLQHGNR

SEQ ID NO: 15650 - protein, 28 aa, Artificial Sequence
  Description of Artificial Sequence: Synthetic peptide
DENEIRTTNIVATEQWGSVSENLQRGNR

SEQ ID NO: 15651 - protein, 28 aa, Artificial Sequence
  Description of Artificial Sequence: Synthetic peptide
DEEEIRTTNPVATEQYGSVSTNLEIGEA

SEQ ID NO: 15652 - protein, 30 aa, Artificial Sequence
  Description of Artificial Sequence: Synthetic polypeptide
DEQEIRTTNPVATEQYGSVSTNDQRGDNDR

SEQ ID NO: 15653 - protein, 28 aa, Artificial Sequence
  Description of Artificial Sequence: Synthetic peptide
DEQEIRTTNPVATEQYGSVETNLQRGEM

SEQ ID NO: 15654 - protein, 30 aa, Artificial Sequence
  Description of Artificial Sequence: Synthetic polypeptide
DEEEIRTTNPVATEQYGSVSTNLVQVDGNV

SEQ ID NO: 15655 - protein, 29 aa, Artificial Sequence
  Description of Artificial Sequence: Synthetic peptide
DEVEIRTTNPVATEQYGSCSENLQERGNR

SEQ ID NO: 15656 - protein, 29 aa, Artificial Sequence
  Description of Artificial Sequence: Synthetic peptide
DEEEIRTTNPVATEQYGSVSTNEQNGNTL

SEQ ID NO: 15657 - protein, 30 aa, Artificial Sequence
  Description of Artificial Sequence: Synthetic polypeptide
DENEIRTTNPVATEQYGSVSTNLQLDGENR

SEQ ID NO: 15658 - protein, 29 aa, Artificial Sequence
  Description of Artificial Sequence: Synthetic peptide
DEEEIGTTNPVATEQYGSVSENLQRAGNI

SEQ ID NO: 15659 - protein, 29 aa, Artificial Sequence
  Description of Artificial Sequence: Synthetic peptide
NEEEIRCTNPVCTEQYGSVSTNLQQRGNR

SEQ ID NO: 15660 - protein, 28 aa, Artificial Sequence
  Description of Artificial Sequence: Synthetic peptide
DEEEIRCTNPVATEIYGCVSTNLERGNR

SEQ ID NO: 15661 - protein, 30 aa, Artificial Sequence
  Description of Artificial Sequence: Synthetic polypeptide
DEEEIRTTNPVCTEQYGSVSCTNLQRAGNQ

SEQ ID NO: 15662 - protein, 28 aa, Artificial Sequence
  Description of Artificial Sequence: Synthetic peptide
SEEEIRTTNPIATEQYGCVSTNGQRGNR

SEQ ID NO: 15663 - protein, 30 aa, Artificial Sequence
  Description of Artificial Sequence: Synthetic polypeptide
DEEEIRTTNPVATEQYGSVSTNLQEHGNDA

SEQ ID NO: 15664 - protein, 30 aa, Artificial Sequence
  Description of Artificial Sequence: Synthetic polypeptide
KEEEIRTTNPVATEQYGSVSTNLQDLGNDR

SEQ ID NO: 15665 - protein, 28 aa, Artificial Sequence
  Description of Artificial Sequence: Synthetic peptide
DEEEIRTTNPVATECYGSVSTDLQQGNE

SEQ ID NO: 15666 - protein, 28 aa, Artificial Sequence
  Description of Artificial Sequence: Synthetic peptide
KEEEIRTTNPVATEQYGSVSTDLQSGNS

SEQ ID NO: 15667 - protein, 28 aa, Artificial Sequence
  Description of Artificial Sequence: Synthetic peptide
DEEEIRTTNPVATEQYGSVSTELQIEDR

SEQ ID NO: 15668 - protein, 30 aa, Artificial Sequence
  Description of Artificial Sequence: Synthetic polypeptide
DEEEINTTNPVATEQYGSVSSTNLQRPGNI

SEQ ID NO: 15669 - protein, 28 aa, Artificial Sequence
  Description of Artificial Sequence: Synthetic peptide
DEEEIRTTNPVATEQYGSVDTNDQNGDR

SEQ ID NO: 15670 - protein, 28 aa, Artificial Sequence
  Description of Artificial Sequence: Synthetic peptide
DEEEIRTTNPFATEQYGSVHTGLQDGNR

SEQ ID NO: 15671 - protein, 31 aa, Artificial Sequence
  Description of Artificial Sequence: Synthetic polypeptide
DEEEIRTTNPVATEQYGESVQSTNLQERGNE

SEQ ID NO: 15672 - protein, 28 aa, Artificial Sequence
  Description of Artificial Sequence: Synthetic peptide
DEEEIRTTNPVATEIYGSVSTNEQHGTR

SEQ ID NO: 15673 - protein, 28 aa, Artificial Sequence
  Description of Artificial Sequence: Synthetic peptide
DEEEIRTTNIVATEQYGSVSTDLQRGTM

SEQ ID NO: 15674 - protein, 28 aa, Artificial Sequence
  Description of Artificial Sequence: Synthetic peptide
NEEEIRTTNPCGTEQYGSVSTQLQRGNR

SEQ ID NO: 15675 - protein, 31 aa, Artificial Sequence
  Description of Artificial Sequence: Synthetic polypeptide
DEEEIRTTNPVATEQYGQSVYSTMLNQRGNR

SEQ ID NO: 15676 - protein, 29 aa, Artificial Sequence
  Description of Artificial Sequence: Synthetic peptide
DEEEIRTTNPVATEQYGSVSTNLERGDDA

SEQ ID NO: 15677 - protein, 29 aa, Artificial Sequence
  Description of Artificial Sequence: Synthetic peptide
DEEEIRTTNPVATEQYGSVSTNLQEQGDV

SEQ ID NO: 15678 - protein, 29 aa, Artificial Sequence
  Description of Artificial Sequence: Synthetic peptide
DEQEIRTTNPVATEQWGSVSTNLQIGDNR

SEQ ID NO: 15679 - protein, 28 aa, Artificial Sequence
  Description of Artificial Sequence: Synthetic peptide
DEIEIATTNPVATEGYGEVSTNLQRGNR

SEQ ID NO: 15680 - protein, 28 aa, Artificial Sequence
  Description of Artificial Sequence: Synthetic peptide
DEEEIRTTNIVATEQYGSVSTDDQRGNF

SEQ ID NO: 15681 - protein, 28 aa, Artificial Sequence
  Description of Artificial Sequence: Synthetic peptide
DEMEIRTTNPVATEQCGSVSTNLQTGND

SEQ ID NO: 15682 - protein, 28 aa, Artificial Sequence
  Description of Artificial Sequence: Synthetic peptide
DDEEIRTTNPVSTECYGSVSTNLQTGNR

SEQ ID NO: 15683 - protein, 30 aa, Artificial Sequence
  Description of Artificial Sequence: Synthetic polypeptide
DEEEIRTTNPVATEQWGSVSTNLMLRGNDR

SEQ ID NO: 15684 - protein, 28 aa, Artificial Sequence
  Description of Artificial Sequence: Synthetic peptide
DEEEIRTTNPAATEQYGSVSTNEQLGNQ

SEQ ID NO: 15685 - protein, 28 aa, Artificial Sequence
  Description of Artificial Sequence: Synthetic peptide
DEEEIRTTNPEATEQYGSVSTELQRGEA

SEQ ID NO: 15686 - protein, 29 aa, Artificial Sequence
  Description of Artificial Sequence: Synthetic peptide
DEEEIRTTNPVATQQYGSVSTPPLQRGER

SEQ ID NO: 15687 - protein, 28 aa, Artificial Sequence
  Description of Artificial Sequence: Synthetic peptide
DEEEIRTTNPVATEQYGSVSTDLQDGET

SEQ ID NO: 15688 - protein, 28 aa, Artificial Sequence
  Description of Artificial Sequence: Synthetic peptide
DEEEIATVNPVCTEQYGSASTNLQRGNR

SEQ ID NO: 15689 - protein, 30 aa, Artificial Sequence
  Description of Artificial Sequence: Synthetic polypeptide
DEEEIRTTNPVATEMYGSVISTDLPQRGNR

SEQ ID NO: 15690 - protein, 28 aa, Artificial Sequence
  Description of Artificial Sequence: Synthetic peptide
DEEEICTTNPVSTENYGSVSCNLQRGNR

SEQ ID NO: 15691 - protein, 30 aa, Artificial Sequence
  Description of Artificial Sequence: Synthetic polypeptide
DEEEIRTTNPVATEQYGSVCSTNWLQQGER

SEQ ID NO: 15692 - protein, 28 aa, Artificial Sequence
  Description of Artificial Sequence: Synthetic peptide
DEEEIATTNPVATEQYGDVSTNLQHGER

SEQ ID NO: 15693 - protein, 28 aa, Artificial Sequence
  Description of Artificial Sequence: Synthetic peptide
DEQEIRTTNPVATEQYGSVSTNLMIGNF

SEQ ID NO: 15694 - protein, 28 aa, Artificial Sequence
  Description of Artificial Sequence: Synthetic peptide
DEEEIRTTNPVSTECYGSVSTELQRGNV

SEQ ID NO: 15695 - protein, 30 aa, Artificial Sequence
  Description of Artificial Sequence: Synthetic polypeptide
DENEIRTTNPVATEQYGSVCSDTNLERGNR

SEQ ID NO: 15696 - protein, 30 aa, Artificial Sequence
  Description of Artificial Sequence: Synthetic polypeptide
DEEEIRTTNPEATEQYGSVSTNGLQIEGNR

SEQ ID NO: 15697 - protein, 29 aa, Artificial Sequence
  Description of Artificial Sequence: Synthetic peptide
DEEEIRTTNPVATEVYGSVSATVLQRGGR

SEQ ID NO: 15698 - protein, 32 aa, Artificial Sequence
  Description of Artificial Sequence: Synthetic polypeptide
DEEEIRTTNPVATEQYGSVSITPNPLVQRGNR

SEQ ID NO: 15699 - protein, 30 aa, Artificial Sequence
  Description of Artificial Sequence: Synthetic polypeptide
DEEEIRTTNPVATEQYGSVSENLQRGDTDR

SEQ ID NO: 15700 - protein, 28 aa, Artificial Sequence
  Description of Artificial Sequence: Synthetic peptide
SEEEIRTTNPTATEQYGSVSTNLQLGTR

SEQ ID NO: 15701 - protein, 28 aa, Artificial Sequence
  Description of Artificial Sequence: Synthetic peptide
DEEEIRTTNPEATEHYGSVSTNPQNGNR

SEQ ID NO: 15702 - protein, 28 aa, Artificial Sequence
  Description of Artificial Sequence: Synthetic peptide
GEEEIRTTNPVATECYGWVSTNLQRGNL

SEQ ID NO: 15703 - protein, 28 aa, Artificial Sequence
  Description of Artificial Sequence: Synthetic peptide
QEEEIATTNPVATEQYGEVSTNLQRGGR

SEQ ID NO: 15704 - protein, 29 aa, Artificial Sequence
  Description of Artificial Sequence: Synthetic peptide
DEQEIRTTNPVATEQYGSVSTNLQTGNDM

SEQ ID NO: 15705 - protein, 28 aa, Artificial Sequence
  Description of Artificial Sequence: Synthetic peptide
NEEEIRTTNIVATEQYGSVSTNLQQGTR

SEQ ID NO: 15706 - protein, 29 aa, Artificial Sequence
  Description of Artificial Sequence: Synthetic peptide
DEQEIRTTNPVATEQYGDVSEMNLQRGNR

SEQ ID NO: 15707 - protein, 28 aa, Artificial Sequence
  Description of Artificial Sequence: Synthetic peptide
DEEEIRTTNIVATEQYGSVSENLQRENI

SEQ ID NO: 15708 - protein, 28 aa, Artificial Sequence
  Description of Artificial Sequence: Synthetic peptide
DEEEIRTTNPVATEGYGSASENLQRANR

SEQ ID NO: 15709 - protein, 28 aa, Artificial Sequence
  Description of Artificial Sequence: Synthetic peptide
DEEEIRTTNPVATEQWGSVSENEQRGNL

SEQ ID NO: 15710 - protein, 28 aa, Artificial Sequence
  Description of Artificial Sequence: Synthetic peptide
DEVEIRTTNPVATEQYGQVSEILQRGNR

SEQ ID NO: 15711 - protein, 28 aa, Artificial Sequence
  Description of Artificial Sequence: Synthetic peptide
DEEEIRTTNPVATQQYGSVSTELQEGQR

SEQ ID NO: 15712 - protein, 29 aa, Artificial Sequence
  Description of Artificial Sequence: Synthetic peptide
DDEEIRTTNPVATEQYGSMSTNLQRGDNF

SEQ ID NO: 15713 - protein, 28 aa, Artificial Sequence
  Description of Artificial Sequence: Synthetic peptide
DEEEIATTNIVATEQYGGVSTNLQRGNQ

SEQ ID NO: 15714 - protein, 28 aa, Artificial Sequence
  Description of Artificial Sequence: Synthetic peptide
DEEEIRPTNPVATEQYGSVSHNDQRGND

SEQ ID NO: 15715 - protein, 28 aa, Artificial Sequence
  Description of Artificial Sequence: Synthetic peptide
SEEELRTTNPVSTEQYGSVSTNLQRGNL

SEQ ID NO: 15716 - protein, 28 aa, Artificial Sequence
  Description of Artificial Sequence: Synthetic peptide
DEEEIRTTNIVATEQYGSVSTNLERGES

SEQ ID NO: 15717 - protein, 28 aa, Artificial Sequence
  Description of Artificial Sequence: Synthetic peptide
DEEEIRTTNPVATEQYGSVDTELQTGNE

SEQ ID NO: 15718 - protein, 28 aa, Artificial Sequence
  Description of Artificial Sequence: Synthetic peptide
DEEEIRCTNIVATEQYGSVSENLQRGER

SEQ ID NO: 15719 - protein, 30 aa, Artificial Sequence
  Description of Artificial Sequence: Synthetic polypeptide
SEEEIRTTNPVATEMYGSVISTNLQERGNR

SEQ ID NO: 15720 - protein, 28 aa, Artificial Sequence
  Description of Artificial Sequence: Synthetic peptide
DEEEIRTTNIVATEQYGVVSENLQRGDR

SEQ ID NO: 15721 - protein, 28 aa, Artificial Sequence
  Description of Artificial Sequence: Synthetic peptide
DEEEIRTTNPVATEQYGSVSTNLEDGEM

SEQ ID NO: 15722 - protein, 28 aa, Artificial Sequence
  Description of Artificial Sequence: Synthetic peptide
DEEEIRTTNIVATEQYGDVSTNDQGGNR

SEQ ID NO: 15723 - protein, 28 aa, Artificial Sequence
  Description of Artificial Sequence: Synthetic peptide
DEEEIRTTNIVATEQYGSVSTDLENGNR

SEQ ID NO: 15724 - protein, 28 aa, Artificial Sequence
  Description of Artificial Sequence: Synthetic peptide
DEEEIATTNPSATEQWGDVSTNLQRGNR

SEQ ID NO: 15725 - protein, 28 aa, Artificial Sequence
  Description of Artificial Sequence: Synthetic peptide
DEEEIRTTNPVASEQYGGVSTNLQRGDF

SEQ ID NO: 15726 - protein, 29 aa, Artificial Sequence
  Description of Artificial Sequence: Synthetic peptide
DENEIRTTNPVATEQYGSASTNLQRAGQR

SEQ ID NO: 15727 - protein, 30 aa, Artificial Sequence
  Description of Artificial Sequence: Synthetic polypeptide
DEEEIRTTNPVATEQYGSVSTNGQVQRGER

SEQ ID NO: 15728 - protein, 29 aa, Artificial Sequence
  Description of Artificial Sequence: Synthetic peptide
DEEEIATTNPCATEQYGCVSATNLQRGNR

SEQ ID NO: 15729 - protein, 30 aa, Artificial Sequence
  Description of Artificial Sequence: Synthetic polypeptide
DEEEIRTTNPVATEQYGSVSDTNDQPGNDR

SEQ ID NO: 15730 - protein, 28 aa, Artificial Sequence
  Description of Artificial Sequence: Synthetic peptide
NEEEICTTNPVATEQYGDVSTLLQRGNR

SEQ ID NO: 15731 - protein, 29 aa, Artificial Sequence
  Description of Artificial Sequence: Synthetic peptide
DEEEIRTTNPVATEQYGSTSENLMVRGNR

SEQ ID NO: 15732 - protein, 28 aa, Artificial Sequence
  Description of Artificial Sequence: Synthetic peptide
DECEIRTTNPVATLQYGCVSTNLERGNR

SEQ ID NO: 15733 - protein, 28 aa, Artificial Sequence
  Description of Artificial Sequence: Synthetic peptide
DEEEIRTTNPVATECYGVVSTNLQQGNV

SEQ ID NO: 15734 - protein, 28 aa, Artificial Sequence
  Description of Artificial Sequence: Synthetic peptide
DEEEIRTTNPVATEQYGDASTNLQRGQQ

SEQ ID NO: 15735 - protein, 29 aa, Artificial Sequence
  Description of Artificial Sequence: Synthetic peptide
DEEEIATTNPVATEQYGSVSTDLQEQGNR

SEQ ID NO: 15736 - protein, 28 aa, Artificial Sequence
  Description of Artificial Sequence: Synthetic peptide
QEEEIRTTNPVATEQYGVVSTNSQRENR

SEQ ID NO: 15737 - protein, 30 aa, Artificial Sequence
  Description of Artificial Sequence: Synthetic polypeptide
DEEEIRTTNPVATEQYGSVSTNLQELGNDQ

SEQ ID NO: 15738 - protein, 30 aa, Artificial Sequence
  Description of Artificial Sequence: Synthetic polypeptide
MEEEIRTTNPVATEQYGSVSTNLQDREGND

SEQ ID NO: 15739 - protein, 28 aa, Artificial Sequence
  Description of Artificial Sequence: Synthetic peptide
DEDEIATTNPVATEQYGSASTNLQRENR

SEQ ID NO: 15740 - protein, 31 aa, Artificial Sequence
  Description of Artificial Sequence: Synthetic polypeptide
DEEEIRTTNPVATEQYGSVASTNLQESGNLR

SEQ ID NO: 15741 - protein, 29 aa, Artificial Sequence
  Description of Artificial Sequence: Synthetic peptide
DESEIRTTNPCATEQYGSVSTNEQYRGNR

SEQ ID NO: 15742 - protein, 28 aa, Artificial Sequence
  Description of Artificial Sequence: Synthetic peptide
DEGEIRTTNIVATEQYGTVSTNEQRGNR

SEQ ID NO: 15743 - protein, 30 aa, Artificial Sequence
  Description of Artificial Sequence: Synthetic polypeptide
DENEIRTTNPVATEQYGSVSTNLQQADGNR

SEQ ID NO: 15744 - protein, 28 aa, Artificial Sequence
  Description of Artificial Sequence: Synthetic peptide
DEEEIRTTNPTATEQFGSVSTNLQRGTN

SEQ ID NO: 15745 - protein, 28 aa, Artificial Sequence
  Description of Artificial Sequence: Synthetic peptide
DEEEIRCTNIVATEQYGSVSTNLQIGDR

SEQ ID NO: 15746 - protein, 28 aa, Artificial Sequence
  Description of Artificial Sequence: Synthetic peptide
DENEVRTTNPVATEQYGSVSTCLQVGNR

SEQ ID NO: 15747 - protein, 28 aa, Artificial Sequence
  Description of Artificial Sequence: Synthetic peptide
DSEEIRTTNPVATEQYGSVSTNLQNQTR

SEQ ID NO: 15748 - protein, 30 aa, Artificial Sequence
  Description of Artificial Sequence: Synthetic polypeptide
DEEEIRTTNPVATEQYGSVSTNLQENGNDA

SEQ ID NO: 15749 - protein, 28 aa, Artificial Sequence
  Description of Artificial Sequence: Synthetic peptide
DEEEIRTTNIVATEQYGSVSTNEQLGNY

SEQ ID NO: 15750 - protein, 28 aa, Artificial Sequence
  Description of Artificial Sequence: Synthetic peptide
DEQEIRTTNPVATEQYGSVVTNLQEGNP

SEQ ID NO: 15751 - protein, 31 aa, Artificial Sequence
  Description of Artificial Sequence: Synthetic polypeptide
DEEEIRTTNPVATEQYGSVSETNLPLREGNR

SEQ ID NO: 15752 - protein, 28 aa, Artificial Sequence
  Description of Artificial Sequence: Synthetic peptide
DEEEIRTTNPVATEQYGSVSENEQQGNW

SEQ ID NO: 15753 - protein, 28 aa, Artificial Sequence
  Description of Artificial Sequence: Synthetic peptide
DEDEIRSVNPCATEQYGSVSTNLQRGNR

SEQ ID NO: 15754 - protein, 31 aa, Artificial Sequence
  Description of Artificial Sequence: Synthetic polypeptide
DEEEIRTTNPVATEQYGSVSTTNLVQVGENR

SEQ ID NO: 15755 - protein, 28 aa, Artificial Sequence
  Description of Artificial Sequence: Synthetic peptide
DEEEIRTTNIVATEQYGSVSTNLDTENR

SEQ ID NO: 15756 - protein, 31 aa, Artificial Sequence
  Description of Artificial Sequence: Synthetic polypeptide
DEEEIRTTNPVATEQYGSVESTNLQRGEEDR

SEQ ID NO: 15757 - protein, 28 aa, Artificial Sequence
  Description of Artificial Sequence: Synthetic peptide
SEDEIRTTNPVATEQYGSVSTNDQSGNR

SEQ ID NO: 15758 - protein, 28 aa, Artificial Sequence
  Description of Artificial Sequence: Synthetic peptide
DEHEIRTTNPVATEVYGSVSTNLQHGNT

SEQ ID NO: 15759 - protein, 28 aa, Artificial Sequence
  Description of Artificial Sequence: Synthetic peptide
DEEEISTTNPVATEQYGSVSENLQGGNY

SEQ ID NO: 15760 - protein, 28 aa, Artificial Sequence
  Description of Artificial Sequence: Synthetic peptide
DEQEIRTTNPVATEQWGSVSTNLQQGNW

SEQ ID NO: 15761 - protein, 28 aa, Artificial Sequence
  Description of Artificial Sequence: Synthetic peptide
DEEEIRTTNPVATEQYGSVSTNLDNGEN

SEQ ID NO: 15762 - protein, 28 aa, Artificial Sequence
  Description of Artificial Sequence: Synthetic peptide
DEEEIRTTNPVATEQYGSVSTLLAEGGR

SEQ ID NO: 15763 - protein, 29 aa, Artificial Sequence
  Description of Artificial Sequence: Synthetic peptide
DEEEIRTTNPVATEQYGSVSTNEQNGNTG

SEQ ID NO: 15764 - protein, 29 aa, Artificial Sequence
  Description of Artificial Sequence: Synthetic peptide
AEEEIQTTNPVATEQYGSVSADNLQRGNR

SEQ ID NO: 15765 - protein, 29 aa, Artificial Sequence
  Description of Artificial Sequence: Synthetic peptide
DEEEIRTTNPEATEQYGSVSTNPQRGAER

SEQ ID NO: 15766 - protein, 30 aa, Artificial Sequence
  Description of Artificial Sequence: Synthetic polypeptide
DEEEIRTTNPVATEQYGSVSDTNLELPGNR

SEQ ID NO: 15767 - protein, 28 aa, Artificial Sequence
  Description of Artificial Sequence: Synthetic peptide
FEGEIRTTNPVATEQYGDCSTNLQRGNR

SEQ ID NO: 15768 - protein, 28 aa, Artificial Sequence
  Description of Artificial Sequence: Synthetic peptide
DEEEIRTTNPVATEQYGDVSENLQQGNM

SEQ ID NO: 15769 - protein, 28 aa, Artificial Sequence
  Description of Artificial Sequence: Synthetic peptide
DEEEIRTTNPVSTELWGSVSTNEQRGNR

SEQ ID NO: 15770 - protein, 28 aa, Artificial Sequence
  Description of Artificial Sequence: Synthetic peptide
DEEEIRTTNPVATEQYGSVDTNLELGDR

SEQ ID NO: 15771 - protein, 28 aa, Artificial Sequence
  Description of Artificial Sequence: Synthetic peptide
DEEEISTTNPVATEQYGNVSTNLQRGTQ

SEQ ID NO: 15772 - protein, 30 aa, Artificial Sequence
  Description of Artificial Sequence: Synthetic polypeptide
DEEEIRTTNPVATEQYGSVDSTMNLQRGPY

SEQ ID NO: 15773 - protein, 28 aa, Artificial Sequence
  Description of Artificial Sequence: Synthetic peptide
DEEEIRTTNIVATEQYGSVSCNLQIGER

SEQ ID NO: 15774 - protein, 28 aa, Artificial Sequence
  Description of Artificial Sequence: Synthetic peptide
DEEEIVTTNPVATEQYGVVGTNLQRPNR

SEQ ID NO: 15775 - protein, 28 aa, Artificial Sequence
  Description of Artificial Sequence: Synthetic peptide
DEEEIRTTNPVATEQYGSVSDNLQSEDR

SEQ ID NO: 15776 - protein, 28 aa, Artificial Sequence
  Description of Artificial Sequence: Synthetic peptide
DENEIRTTNPVATEQYGSVSENEQRGNF

SEQ ID NO: 15777 - protein, 30 aa, Artificial Sequence
  Description of Artificial Sequence: Synthetic polypeptide
DDEEIRTTNPVATEQYGSVDVTNNLQRGNR

SEQ ID NO: 15778 - protein, 28 aa, Artificial Sequence
  Description of Artificial Sequence: Synthetic peptide
DESEIRTTNPVATEQYGFVSENLQRGNL

SEQ ID NO: 15779 - protein, 28 aa, Artificial Sequence
  Description of Artificial Sequence: Synthetic peptide
AEEEIRTTNPVATEQYGEVSTVLQYGNR

SEQ ID NO: 15780 - protein, 28 aa, Artificial Sequence
  Description of Artificial Sequence: Synthetic peptide
DEEEIRTTNPVATEQYGFVSTNLMRGTQ

SEQ ID NO: 15781 - protein, 28 aa, Artificial Sequence
  Description of Artificial Sequence: Synthetic peptide
DEEEIRTTNIVATEQYGSVSTDLQGLNR

SEQ ID NO: 15782 - protein, 28 aa, Artificial Sequence
  Description of Artificial Sequence: Synthetic peptide
DEEEIRTTNIVATEGYGSVSTNLQVGNL

SEQ ID NO: 15783 - protein, 28 aa, Artificial Sequence
  Description of Artificial Sequence: Synthetic peptide
DEEEIRTTNPVATEVYGSVAMNLQRGNM

SEQ ID NO: 15784 - protein, 28 aa, Artificial Sequence
  Description of Artificial Sequence: Synthetic peptide
DEEEIRTTNPVATEQYGSVSTNDQDGEW

SEQ ID NO: 15785 - protein, 30 aa, Artificial Sequence
  Description of Artificial Sequence: Synthetic polypeptide
DEEEIRTTNPVATEQYGSVSTNLQDDKGER

SEQ ID NO: 15786 - protein, 28 aa, Artificial Sequence
  Description of Artificial Sequence: Synthetic peptide
DEEEIRTTNIVATEQYGSVSTDLGTGNR

SEQ ID NO: 15787 - protein, 29 aa, Artificial Sequence
  Description of Artificial Sequence: Synthetic peptide
DEEEIATVNPVATEQYGSVSTPLQRGENR

SEQ ID NO: 15788 - protein, 30 aa, Artificial Sequence
  Description of Artificial Sequence: Synthetic polypeptide
DLEEIRTTNPVATEQYGSVSTQNLNQVGNR

SEQ ID NO: 15789 - protein, 28 aa, Artificial Sequence
  Description of Artificial Sequence: Synthetic peptide
DEQEIRTTNPVATEQYGSWSTNLQRGDA

SEQ ID NO: 15790 - protein, 28 aa, Artificial Sequence
  Description of Artificial Sequence: Synthetic peptide
DEEEIRTTNPDATEQYGSVSTNLQGGDI

SEQ ID NO: 15791 - protein, 31 aa, Artificial Sequence
  Description of Artificial Sequence: Synthetic polypeptide
MEEEIRTTNPVATEQYGSVSTNLQDREGNDR

SEQ ID NO: 15792 - protein, 28 aa, Artificial Sequence
  Description of Artificial Sequence: Synthetic peptide
DEEEIRTTNPVATECYGSVSTDLQNGNY

SEQ ID NO: 15793 - protein, 28 aa, Artificial Sequence
  Description of Artificial Sequence: Synthetic peptide
DEEEIRTVNPVATEQYGVMSTNLQRGDR

SEQ ID NO: 15794 - protein, 30 aa, Artificial Sequence
  Description of Artificial Sequence: Synthetic polypeptide
DEEEIRTTNPVATEQYGSVSDTDLQDGENR

SEQ ID NO: 15795 - protein, 28 aa, Artificial Sequence
  Description of Artificial Sequence: Synthetic peptide
DENEIRQTNPVATEQYGSVSTNLERGER

SEQ ID NO: 15796 - protein, 29 aa, Artificial Sequence
  Description of Artificial Sequence: Synthetic peptide
DEEEIRTTNPVATEQYGSVSTNLQENGEF

SEQ ID NO: 15797 - protein, 31 aa, Artificial Sequence
  Description of Artificial Sequence: Synthetic polypeptide
DEEEIRTTNPVATEQYGSTSETNLQERGNDR

SEQ ID NO: 15798 - protein, 28 aa, Artificial Sequence
  Description of Artificial Sequence: Synthetic peptide
DEEEIRTTNIVATEQYGSYSTNDQQGNR

SEQ ID NO: 15799 - protein, 31 aa, Artificial Sequence
  Description of Artificial Sequence: Synthetic polypeptide
DEEEIRTTNPVATEQYGSVSTANEQERGNTR

SEQ ID NO: 15800 - protein, 29 aa, Artificial Sequence
  Description of Artificial Sequence: Synthetic peptide
DEEEIAATNPVATEQYGSVNTNLQRGDNR

SEQ ID NO: 15801 - protein, 28 aa, Artificial Sequence
  Description of Artificial Sequence: Synthetic peptide
DEEEIRTTNPVATEQWGSVSTNLMQGNW

SEQ ID NO: 15802 - protein, 32 aa, Artificial Sequence
  Description of Artificial Sequence: Synthetic polypeptide
DEEEIRTTNPVATEQYGSVSTPNPLQQREGNR

SEQ ID NO: 15803 - protein, 28 aa, Artificial Sequence
  Description of Artificial Sequence: Synthetic peptide
DEVEIRTTNIVATEQWGDVSTNLQRGNR

SEQ ID NO: 15804 - protein, 29 aa, Artificial Sequence
  Description of Artificial Sequence: Synthetic peptide
SEEEITTTNPVATEQYGSVSTNLEQRGNF

SEQ ID NO: 15805 - protein, 29 aa, Artificial Sequence
  Description of Artificial Sequence: Synthetic peptide
DEEEIRTTNPVATEQYGSVSENLQDRGDH

SEQ ID NO: 15806 - protein, 28 aa, Artificial Sequence
  Description of Artificial Sequence: Synthetic peptide
DEEEIRTTNPVATEQYGSVSTDLENGND

SEQ ID NO: 15807 - protein, 28 aa, Artificial Sequence
  Description of Artificial Sequence: Synthetic peptide
DEQEIRTTNPVATEQYGSVETNLQRGDD

SEQ ID NO: 15808 - protein, 28 aa, Artificial Sequence
  Description of Artificial Sequence: Synthetic peptide
DEEEIRATNIVATEQYGSVATNEQRGNR

SEQ ID NO: 15809 - protein, 28 aa, Artificial Sequence
  Description of Artificial Sequence: Synthetic peptide
DEEEIRTTNPVATECYGSVSTNLQGGDN

SEQ ID NO: 15810 - protein, 28 aa, Artificial Sequence
  Description of Artificial Sequence: Synthetic peptide
DEEEIRATNPVATEQYGVVGTNLQRGGR

SEQ ID NO: 15811 - protein, 30 aa, Artificial Sequence
  Description of Artificial Sequence: Synthetic polypeptide
DEEEIRTTNPVATEQYGSVSTMNLQDIGNV

SEQ ID NO: 15812 - protein, 30 aa, Artificial Sequence
  Description of Artificial Sequence: Synthetic polypeptide
DEEEIRTTNPVATEQYGSVSTNDQNKGDNR

SEQ ID NO: 15813 - protein, 29 aa, Artificial Sequence
  Description of Artificial Sequence: Synthetic peptide
DEEEIATTNPVATEQYGSVISTLEQRGNR

SEQ ID NO: 15814 - protein, 28 aa, Artificial Sequence
  Description of Artificial Sequence: Synthetic peptide
DEEEIRTTNPVATEQYGSVSTELDRGGQ

SEQ ID NO: 15815 - protein, 29 aa, Artificial Sequence
  Description of Artificial Sequence: Synthetic peptide
DEEEIRTTNPVATEQYGSVSCENLQMGNL

SEQ ID NO: 15816 - protein, 28 aa, Artificial Sequence
  Description of Artificial Sequence: Synthetic peptide
DEEEIRTTNPVATEQYGSVDTDLQMGNT

SEQ ID NO: 15817 - protein, 29 aa, Artificial Sequence
  Description of Artificial Sequence: Synthetic peptide
DEEEIRCTNPVATEQYGSVSTNDQIVGNR

SEQ ID NO: 15818 - protein, 28 aa, Artificial Sequence
  Description of Artificial Sequence: Synthetic peptide
DEEEIRTTNIVATEQYGSVSTNDQRGTM

SEQ ID NO: 15819 - protein, 28 aa, Artificial Sequence
  Description of Artificial Sequence: Synthetic peptide
DEEEIRTTNPVAFEQYGSVSTGLQAGLR

SEQ ID NO: 15820 - protein, 28 aa, Artificial Sequence
  Description of Artificial Sequence: Synthetic peptide
SEEEIATTNPVATFQYGSVSTNEQRGNR

SEQ ID NO: 15821 - protein, 28 aa, Artificial Sequence
  Description of Artificial Sequence: Synthetic peptide
DEEEIRTTNPVATEQYGSVSTELQNGEW

SEQ ID NO: 15822 - protein, 30 aa, Artificial Sequence
  Description of Artificial Sequence: Synthetic polypeptide
DEQEIRTTNPVATEQYGSVSTNHLQSDGNR

SEQ ID NO: 15823 - protein, 31 aa, Artificial Sequence
  Description of Artificial Sequence: Synthetic polypeptide
DEEEIRTTNPVATEQYGSVESTPLQIRGENR

SEQ ID NO: 15824 - protein, 29 aa, Artificial Sequence
  Description of Artificial Sequence: Synthetic peptide
DEEEIRTTNPVATEQYGSASTALQRDLNR

SEQ ID NO: 15825 - protein, 29 aa, Artificial Sequence
  Description of Artificial Sequence: Synthetic peptide
DEDEIRTTNPVATEQYGSVSTNWQIEGNR

SEQ ID NO: 15826 - protein, 28 aa, Artificial Sequence
  Description of Artificial Sequence: Synthetic peptide
SEEEIRTTNPVATEQYGSVSENLQQGTR

SEQ ID NO: 15827 - protein, 31 aa, Artificial Sequence
  Description of Artificial Sequence: Synthetic polypeptide
DEEEIRTTNPVATEQYGSVSTANLQREGDNF

SEQ ID NO: 15828 - protein, 28 aa, Artificial Sequence
  Description of Artificial Sequence: Synthetic peptide
DEEEIRATNPTATEQFGSVSTNEQRGNR

SEQ ID NO: 15829 - protein, 32 aa, Artificial Sequence
  Description of Artificial Sequence: Synthetic polypeptide
DEEEIRTTNPVATEQYGCSVSTMNLIQRDGNR

SEQ ID NO: 15830 - protein, 28 aa, Artificial Sequence
  Description of Artificial Sequence: Synthetic peptide
DEEEIRTTNPVATEQYGSVSTDLQFGEF

SEQ ID NO: 15831 - protein, 29 aa, Artificial Sequence
  Description of Artificial Sequence: Synthetic peptide
DEEEIRTTNPVATEQYGSVEFHNDQRGNR

SEQ ID NO: 15832 - protein, 28 aa, Artificial Sequence
  Description of Artificial Sequence: Synthetic peptide
DEWEIRTTNPVATEQYGSVSTNDQTGDR

SEQ ID NO: 15833 - protein, 28 aa, Artificial Sequence
  Description of Artificial Sequence: Synthetic peptide
KEEEIRTTNPVATECYGSVSTNLQTGNW

SEQ ID NO: 15834 - protein, 28 aa, Artificial Sequence
  Description of Artificial Sequence: Synthetic peptide
DEEEIRTTNPVATEQFGSVSTNLQQGTS

SEQ ID NO: 15835 - protein, 28 aa, Artificial Sequence
  Description of Artificial Sequence: Synthetic peptide
DEEEIRTTNPVATEQYGVASTDLQSGNR

SEQ ID NO: 15836 - protein, 30 aa, Artificial Sequence
  Description of Artificial Sequence: Synthetic polypeptide
DENEIRTTNPVATEQYGSVSITDGLQRGNR

SEQ ID NO: 15837 - protein, 28 aa, Artificial Sequence
  Description of Artificial Sequence: Synthetic peptide
DEEEIRATNPVASEQYGSVSTELQMGNR

SEQ ID NO: 15838 - protein, 28 aa, Artificial Sequence
  Description of Artificial Sequence: Synthetic peptide
DEEEITTTNPVATEQYGSVDTNLQHGNA

SEQ ID NO: 15839 - protein, 29 aa, Artificial Sequence
  Description of Artificial Sequence: Synthetic peptide
DEEEIRTTNPVATECYGSASTNLQRQENR

SEQ ID NO: 15840 - protein, 28 aa, Artificial Sequence
  Description of Artificial Sequence: Synthetic peptide
DEEEIRTTNPDAYEQYGSVSTGDQRGNR

SEQ ID NO: 15841 - protein, 28 aa, Artificial Sequence
  Description of Artificial Sequence: Synthetic peptide
DEEEIRQTNPVATEQYGSVSTNQERGND

SEQ ID NO: 15842 - protein, 28 aa, Artificial Sequence
  Description of Artificial Sequence: Synthetic peptide
DEEEIRTTNPVATEQYGQVSTPDQRGNQ

SEQ ID NO: 15843 - protein, 28 aa, Artificial Sequence
  Description of Artificial Sequence: Synthetic peptide
DEQEIRTTNPVATEQWGSVSTNLMRGNW

SEQ ID NO: 15844 - protein, 28 aa, Artificial Sequence
  Description of Artificial Sequence: Synthetic peptide
DEEEIRTTNPVATQQYGSVSHNLDRGNP

SEQ ID NO: 15845 - protein, 28 aa, Artificial Sequence
  Description of Artificial Sequence: Synthetic peptide
DEEEIRTTNPVATEQYGSVSTPPNEGNR

SEQ ID NO: 15846 - protein, 29 aa, Artificial Sequence
  Description of Artificial Sequence: Synthetic peptide
DEEEIRTTNPVATEQYGSVDTNDQQRGNH

SEQ ID NO: 15847 - protein, 31 aa, Artificial Sequence
  Description of Artificial Sequence: Synthetic polypeptide
DEEEIRTTNPVATEQYGSVSTGNLVQERGND

SEQ ID NO: 15848 - protein, 30 aa, Artificial Sequence
  Description of Artificial Sequence: Synthetic polypeptide
DEEEIRTTNPVATEQYGSVSTNLQEREGEI

SEQ ID NO: 15849 - protein, 28 aa, Artificial Sequence
  Description of Artificial Sequence: Synthetic peptide
DEEEINTTNPVSTEQYGSVSTVLQHGNR

SEQ ID NO: 15850 - protein, 28 aa, Artificial Sequence
  Description of Artificial Sequence: Synthetic peptide
DEEEIRTTNPVATEQYGSVSDNLQVGTA

SEQ ID NO: 15851 - protein, 28 aa, Artificial Sequence
  Description of Artificial Sequence: Synthetic peptide
DNEEIRTTNPIATEQYGSVSTNAQPGNR

SEQ ID NO: 15852 - protein, 28 aa, Artificial Sequence
  Description of Artificial Sequence: Synthetic peptide
DEEEIRTTNPEATEQYGSVSTNLQGGDL

SEQ ID NO: 15853 - protein, 28 aa, Artificial Sequence
  Description of Artificial Sequence: Synthetic peptide
DEEEIRTTNPVATEQYGSVSTNDMTGDR

SEQ ID NO: 15854 - protein, 29 aa, Artificial Sequence
  Description of Artificial Sequence: Synthetic peptide
DESEIRTVNPVATEVYGSVSTNLQVRGNR

SEQ ID NO: 15855 - protein, 28 aa, Artificial Sequence
  Description of Artificial Sequence: Synthetic peptide
DEEEIRTTNPVATEQYGSVDDNLQMGNN

SEQ ID NO: 15856 - protein, 28 aa, Artificial Sequence
  Description of Artificial Sequence: Synthetic peptide
DEEEIRTTNPVATECYGSVSTNLQTGEM

SEQ ID NO: 15857 - protein, 28 aa, Artificial Sequence
  Description of Artificial Sequence: Synthetic peptide
DEEEIRTTNPVATECYGIVSTVLQRGNL

SEQ ID NO: 15858 - protein, 28 aa, Artificial Sequence
  Description of Artificial Sequence: Synthetic peptide
DEEQIRTTNPVAFEQYGSVDTNLQRGTR

SEQ ID NO: 15859 - protein, 28 aa, Artificial Sequence
  Description of Artificial Sequence: Synthetic peptide
DENEIRTTNIVATEQYGIVSTNLQNGNR

SEQ ID NO: 15860 - protein, 28 aa, Artificial Sequence
  Description of Artificial Sequence: Synthetic peptide
DEEEIRTTNIVATENYGSVSTNLQAGNF

SEQ ID NO: 15861 - protein, 29 aa, Artificial Sequence
  Description of Artificial Sequence: Synthetic peptide
DEEEIRTTNPVATEQWGSVSTNEMNRGNR

SEQ ID NO: 15862 - protein, 28 aa, Artificial Sequence
  Description of Artificial Sequence: Synthetic peptide
DEQEIRTTNPVATEQYGSVSSNLQRGMG

SEQ ID NO: 15863 - protein, 28 aa, Artificial Sequence
  Description of Artificial Sequence: Synthetic peptide
DEEEIRTTNPVATEQYGSVETNPQRDER

SEQ ID NO: 15864 - protein, 31 aa, Artificial Sequence
  Description of Artificial Sequence: Synthetic polypeptide
DEEEIRTTNPVATEQYGSVEDTNLQDRGNDR

SEQ ID NO: 15865 - protein, 28 aa, Artificial Sequence
  Description of Artificial Sequence: Synthetic peptide
DEQEIRSTNPVATEQYGWVSTNLQRLNR

SEQ ID NO: 15866 - protein, 29 aa, Artificial Sequence
  Description of Artificial Sequence: Synthetic peptide
DDEEIRTTNPVATEQYGWVSTNLQRGDDR

SEQ ID NO: 15867 - protein, 28 aa, Artificial Sequence
  Description of Artificial Sequence: Synthetic peptide
SEEEIRTTNPVATEQYGSVSTNEQRGTG

SEQ ID NO: 15868 - protein, 28 aa, Artificial Sequence
  Description of Artificial Sequence: Synthetic peptide
DEEEIATTNPVATEVYGEASTNLQRGNR

SEQ ID NO: 15869 - protein, 30 aa, Artificial Sequence
  Description of Artificial Sequence: Synthetic polypeptide
DEEEIRTTNPVATEQYGSVSTENLDRKGNP

SEQ ID NO: 15870 - protein, 28 aa, Artificial Sequence
  Description of Artificial Sequence: Synthetic peptide
DEEEIRTTNPTATEQYGSVSTNPQIGNA

SEQ ID NO: 15871 - protein, 28 aa, Artificial Sequence
  Description of Artificial Sequence: Synthetic peptide
DEEEIRATNIVATEQYGSVSTNLQRGTM

SEQ ID NO: 15872 - protein, 28 aa, Artificial Sequence
  Description of Artificial Sequence: Synthetic peptide
SEEEIRTTNPTAHEQYGEVSTNLQRGNR

SEQ ID NO: 15873 - protein, 28 aa, Artificial Sequence
  Description of Artificial Sequence: Synthetic peptide
DEEEIRTTNPTATEQYGSVSTNPQIGNF

SEQ ID NO: 15874 - protein, 28 aa, Artificial Sequence
  Description of Artificial Sequence: Synthetic peptide
DEEEIRTTNPVATEQYGSVDTDLQMGND

SEQ ID NO: 15875 - protein, 28 aa, Artificial Sequence
  Description of Artificial Sequence: Synthetic peptide
GEEEIRTTNPVATEQYGTVSTNLEAGNR

SEQ ID NO: 15876 - protein, 30 aa, Artificial Sequence
  Description of Artificial Sequence: Synthetic polypeptide
DEEEIRTTNPVATEQYGSVSVNLQRGNPFI

SEQ ID NO: 15877 - protein, 30 aa, Artificial Sequence
  Description of Artificial Sequence: Synthetic polypeptide
DEEEIRATNPVATEQYGVVSTENLQRGNDR

SEQ ID NO: 15878 - protein, 28 aa, Artificial Sequence
  Description of Artificial Sequence: Synthetic peptide
DEEEIRTTNPVATEQYGSVSTDLQVGEW

SEQ ID NO: 15879 - protein, 29 aa, Artificial Sequence
  Description of Artificial Sequence: Synthetic peptide
HEEEIRTTNPVATEQYGSVSDNLQRSGNA

SEQ ID NO: 15880 - protein, 28 aa, Artificial Sequence
  Description of Artificial Sequence: Synthetic peptide
DEEEIRTTNPVATEQYGSVETNLQHEER

SEQ ID NO: 15881 - protein, 29 aa, Artificial Sequence
  Description of Artificial Sequence: Synthetic peptide
DEEEIRTTNPDATEQYGSVSTVDEQRGNR

SEQ ID NO: 15882 - protein, 28 aa, Artificial Sequence
  Description of Artificial Sequence: Synthetic peptide
DEQEIRTTNPVATEQYGSVSTNEMQGNR

SEQ ID NO: 15883 - protein, 29 aa, Artificial Sequence
  Description of Artificial Sequence: Synthetic peptide
DEEEIRTTNPVATEQYGSVSENEQMQGNR

SEQ ID NO: 15884 - protein, 28 aa, Artificial Sequence
  Description of Artificial Sequence: Synthetic peptide
DEEEIRTTNPVATEQYGEVANTLQRGNR

SEQ ID NO: 15885 - protein, 29 aa, Artificial Sequence
  Description of Artificial Sequence: Synthetic peptide
DENEIRTTNPVATEQYGSVSTNLQNIGNW

SEQ ID NO: 15886 - protein, 29 aa, Artificial Sequence
  Description of Artificial Sequence: Synthetic peptide
DEEEIRTTNPVATEQWGSVSTNLQMQGNW

SEQ ID NO: 15887 - protein, 28 aa, Artificial Sequence
  Description of Artificial Sequence: Synthetic peptide
DCEEIRTTNPVATEKWGSVSTNLQRGDR

SEQ ID NO: 15888 - protein, 28 aa, Artificial Sequence
  Description of Artificial Sequence: Synthetic peptide
DEEEIRCTNPVATEQYGCVAMNLQRGNR

SEQ ID NO: 15889 - protein, 28 aa, Artificial Sequence
  Description of Artificial Sequence: Synthetic peptide
DEEEIRTTNPVATEQYGDVSENLQRGEA

SEQ ID NO: 15890 - protein, 29 aa, Artificial Sequence
  Description of Artificial Sequence: Synthetic peptide
DEQEIRTTNPVATEQYGSVETNDQERGNR

SEQ ID NO: 15891 - protein, 28 aa, Artificial Sequence
  Description of Artificial Sequence: Synthetic peptide
DESEIQTTNPVATEGYGEVSTNLQRGNR

SEQ ID NO: 15892 - protein, 30 aa, Artificial Sequence
  Description of Artificial Sequence: Synthetic polypeptide
DEEEIRTTNPVATEQYGSVSTNLQTEGNDL

SEQ ID NO: 15893 - protein, 28 aa, Artificial Sequence
  Description of Artificial Sequence: Synthetic peptide
AEEEIRQTNPVATEQYGSVSTNLEVGNR

SEQ ID NO: 15894 - protein, 29 aa, Artificial Sequence
  Description of Artificial Sequence: Synthetic peptide
SEQEIRTTNPVATEQYGSVSTNLQEAGNR

SEQ ID NO: 15895 - protein, 29 aa, Artificial Sequence
  Description of Artificial Sequence: Synthetic peptide
DEEEIRCTNPVATEQYGSVAENLQRSGNR

SEQ ID NO: 15896 - protein, 29 aa, Artificial Sequence
  Description of Artificial Sequence: Synthetic peptide
DEEEIRTVNPVSTEQYGSVSTNLQRAGGR

SEQ ID NO: 15897 - protein, 28 aa, Artificial Sequence
  Description of Artificial Sequence: Synthetic peptide
DEEEIRTTNPVATEIYGEVPTNLQRGNK

SEQ ID NO: 15898 - protein, 28 aa, Artificial Sequence
  Description of Artificial Sequence: Synthetic peptide
DEEEIRTTNPVATEQYGSVDTNDQAGND

SEQ ID NO: 15899 - protein, 31 aa, Artificial Sequence
  Description of Artificial Sequence: Synthetic polypeptide
DEEEIRTTNPVATEQYGESVSENLVQRGNER

SEQ ID NO: 15900 - protein, 28 aa, Artificial Sequence
  Description of Artificial Sequence: Synthetic peptide
DEEEIRTTNIVATEQFGEVATNLQRGNR

SEQ ID NO: 15901 - protein, 28 aa, Artificial Sequence
  Description of Artificial Sequence: Synthetic peptide
DEEEIRTTNPVATEQYGSASEVLQRENR

SEQ ID NO: 15902 - protein, 28 aa, Artificial Sequence
  Description of Artificial Sequence: Synthetic peptide
DEEEIRTTNIVATEQYGSVSTNLQYGDW

SEQ ID NO: 15903 - protein, 28 aa, Artificial Sequence
  Description of Artificial Sequence: Synthetic peptide
DEQAIRTTNPVATEQYGSVSTMLIRGNR

SEQ ID NO: 15904 - protein, 29 aa, Artificial Sequence
  Description of Artificial Sequence: Synthetic peptide
DEEEIRTTNPDATEQYGSVSDTNLDRGNP

SEQ ID NO: 15905 - protein, 31 aa, Artificial Sequence
  Description of Artificial Sequence: Synthetic polypeptide
DEEEIRTTNPVATEQYGSVSATNLQEDGNDR

SEQ ID NO: 15906 - protein, 28 aa, Artificial Sequence
  Description of Artificial Sequence: Synthetic peptide
DEEELRTTNPVATEGYGSVSDNLQRGNT

SEQ ID NO: 15907 - protein, 28 aa, Artificial Sequence
  Description of Artificial Sequence: Synthetic peptide
NEEEIRTTNPVATEQYGSVSTAWQRGNF

SEQ ID NO: 15908 - protein, 28 aa, Artificial Sequence
  Description of Artificial Sequence: Synthetic peptide
DEEEIRTTNIVATEQFGSVSTNEQRGDR

SEQ ID NO: 15909 - protein, 28 aa, Artificial Sequence
  Description of Artificial Sequence: Synthetic peptide
DEEEIRTTNPVATEQFGGVSDNLQRGTR

SEQ ID NO: 15910 - protein, 30 aa, Artificial Sequence
  Description of Artificial Sequence: Synthetic polypeptide
DEEEIRTTNPVATECYGSVSTNLEERGNDR

SEQ ID NO: 15911 - protein, 28 aa, Artificial Sequence
  Description of Artificial Sequence: Synthetic peptide
DEEEIRTTNIVATEQYGSVSENLQRENE

SEQ ID NO: 15912 - protein, 31 aa, Artificial Sequence
  Description of Artificial Sequence: Synthetic polypeptide
DEEEIRTTNPVATEQYGSVSTNLVQIGDNDR

SEQ ID NO: 15913 - protein, 29 aa, Artificial Sequence
  Description of Artificial Sequence: Synthetic peptide
DEEEIRTTNPVATEPYGSVSSNLEREGNR

SEQ ID NO: 15914 - protein, 28 aa, Artificial Sequence
  Description of Artificial Sequence: Synthetic peptide
DEEEIRATNPVATECYGSVSTAYQRGNR

SEQ ID NO: 15915 - protein, 28 aa, Artificial Sequence
  Description of Artificial Sequence: Synthetic peptide
DEEEIRTTNPVATEWYGSVSTNEQRGDL

SEQ ID NO: 15916 - protein, 28 aa, Artificial Sequence
  Description of Artificial Sequence: Synthetic peptide
DEVEIRTTNPTATEQYGSVSTNLQQGDR

SEQ ID NO: 15917 - protein, 28 aa, Artificial Sequence
  Description of Artificial Sequence: Synthetic peptide
DEEEIRTTNPTATEQYGSVCTDLQRGNI

SEQ ID NO: 15918 - protein, 28 aa, Artificial Sequence
  Description of Artificial Sequence: Synthetic peptide
DEEEIRTTNPFATEQYGSVATNLERGER

SEQ ID NO: 15919 - protein, 28 aa, Artificial Sequence
  Description of Artificial Sequence: Synthetic peptide
DEEEIRTTNPVATEQYGEAATNLQRGGR

SEQ ID NO: 15920 - protein, 28 aa, Artificial Sequence
  Description of Artificial Sequence: Synthetic peptide
DEEEIRTTNPVATQQYGSVSTNPQREER

SEQ ID NO: 15921 - protein, 29 aa, Artificial Sequence
  Description of Artificial Sequence: Synthetic peptide
DEEEIRTVNPVATEQYGSVSTNLQEIGNT

SEQ ID NO: 15922 - protein, 28 aa, Artificial Sequence
  Description of Artificial Sequence: Synthetic peptide
DEEEIRTTNPVATEQYGFVSTNLFDGNP

SEQ ID NO: 15923 - protein, 29 aa, Artificial Sequence
  Description of Artificial Sequence: Synthetic peptide
DEAEIRTTNPVATEQYGSVSDMNLQRGNV

SEQ ID NO: 15924 - protein, 30 aa, Artificial Sequence
  Description of Artificial Sequence: Synthetic polypeptide
DEEEIRTTNPVATEQYGSVDCTNLQMGNDR

SEQ ID NO: 15925 - protein, 28 aa, Artificial Sequence
  Description of Artificial Sequence: Synthetic peptide
DENEIRTTNPVATEQWGSVSENLQRGNF

SEQ ID NO: 15926 - protein, 32 aa, Artificial Sequence
  Description of Artificial Sequence: Synthetic polypeptide
DEEEIRTTNPVATEQYGSVSTANLQREGDNTR

SEQ ID NO: 15927 - protein, 28 aa, Artificial Sequence
  Description of Artificial Sequence: Synthetic peptide
DEEEIRTTNIVATEQYGSVSTNDERGDR

SEQ ID NO: 15928 - protein, 28 aa, Artificial Sequence
  Description of Artificial Sequence: Synthetic peptide
QEEEIHTTNPVATEPYGSVSENLQRGNR

SEQ ID NO: 15929 - protein, 28 aa, Artificial Sequence
  Description of Artificial Sequence: Synthetic peptide
SEGEIRTTNPVATEQYGFVSENLQRGNR

SEQ ID NO: 15930 - protein, 28 aa, Artificial Sequence
  Description of Artificial Sequence: Synthetic peptide
DEQEIVTTNPVATEQYGEVSDNLQRGNR

SEQ ID NO: 15931 - protein, 29 aa, Artificial Sequence
  Description of Artificial Sequence: Synthetic peptide
DEEEIRTTNPVATEQYGSVCSENQIRGNR

SEQ ID NO: 15932 - protein, 29 aa, Artificial Sequence
  Description of Artificial Sequence: Synthetic peptide
DEEEIRTTNPVATEQYGSVSTENLEQGDR

SEQ ID NO: 15933 - protein, 28 aa, Artificial Sequence
  Description of Artificial Sequence: Synthetic peptide
DHEEIRTTNPVATEQYGSVSTGLDPGNR

SEQ ID NO: 15934 - protein, 29 aa, Artificial Sequence
  Description of Artificial Sequence: Synthetic peptide
DGEEIRTTNPVATEQYGVVSTNLQPRGER

SEQ ID NO: 15935 - protein, 29 aa, Artificial Sequence
  Description of Artificial Sequence: Synthetic peptide
DEEEIRTTNPVATECYGSVSDTNLQSGNA

SEQ ID NO: 15936 - protein, 28 aa, Artificial Sequence
  Description of Artificial Sequence: Synthetic peptide
MEEEIRTTNPVATECYGSVSTNLQNGNM

SEQ ID NO: 15937 - protein, 32 aa, Artificial Sequence
  Description of Artificial Sequence: Synthetic polypeptide
DEEEIRTTNPVATEQYGSVSCTMNLQCRGNDR

SEQ ID NO: 15938 - protein, 30 aa, Artificial Sequence
  Description of Artificial Sequence: Synthetic polypeptide
DEEEIRTTNPVATEQYGSVSETNLERGENP

SEQ ID NO: 15939 - protein, 30 aa, Artificial Sequence
  Description of Artificial Sequence: Synthetic polypeptide
DEEEIRATNPVATEMYGSVSTMNLQRGDNR

SEQ ID NO: 15940 - protein, 28 aa, Artificial Sequence
  Description of Artificial Sequence: Synthetic peptide
DEEEIRTTNPVATEQYGYVSENMQGGNR

SEQ ID NO: 15941 - protein, 28 aa, Artificial Sequence
  Description of Artificial Sequence: Synthetic peptide
DEEEIRTTNPVATEQYGSVSTCLQAGEV

SEQ ID NO: 15942 - protein, 30 aa, Artificial Sequence
  Description of Artificial Sequence: Synthetic polypeptide
DEEEIRTTNPVATEQYGSVSTNLQDSGNDT

SEQ ID NO: 15943 - protein, 29 aa, Artificial Sequence
  Description of Artificial Sequence: Synthetic peptide
DEEEIRTTNPVATEQYGSVSENLQDNGNE

SEQ ID NO: 15944 - protein, 29 aa, Artificial Sequence
  Description of Artificial Sequence: Synthetic peptide
DENEIRTTNPVATEQYGEVSAENLQRGNR

SEQ ID NO: 15945 - protein, 28 aa, Artificial Sequence
  Description of Artificial Sequence: Synthetic peptide
KEEEIRTTNPVATEQYGSVSTELQQGNT

SEQ ID NO: 15946 - protein, 28 aa, Artificial Sequence
  Description of Artificial Sequence: Synthetic peptide
DEEEIRTTNPTATEQYGSVSENEQQGNR

SEQ ID NO: 15947 - protein, 28 aa, Artificial Sequence
  Description of Artificial Sequence: Synthetic peptide
DEEEIRTTNPDATEQYGSVSTNDERGER

SEQ ID NO: 15948 - protein, 30 aa, Artificial Sequence
  Description of Artificial Sequence: Synthetic polypeptide
DEEEIRTTNPVATEQYGSVSTNLQDQEGNF

SEQ ID NO: 15949 - protein, 28 aa, Artificial Sequence
  Description of Artificial Sequence: Synthetic peptide
DEDEIRTTNPVATEQYGDVSTNLQFGNF

SEQ ID NO: 15950 - protein, 28 aa, Artificial Sequence
  Description of Artificial Sequence: Synthetic peptide
DEEEIATTNPVATEVYGSVSTNIQRGGR

SEQ ID NO: 15951 - protein, 28 aa, Artificial Sequence
  Description of Artificial Sequence: Synthetic peptide
DEEEIRTTNPVATEQWGIVSENLQRGNS

SEQ ID NO: 15952 - protein, 29 aa, Artificial Sequence
  Description of Artificial Sequence: Synthetic peptide
DENEIATTNPVATECYGSVSTNLQRGNDR

SEQ ID NO: 15953 - protein, 28 aa, Artificial Sequence
  Description of Artificial Sequence: Synthetic peptide
DEEEIRTTNIVATEQYGSVSTDLQHGNY

SEQ ID NO: 15954 - protein, 28 aa, Artificial Sequence
  Description of Artificial Sequence: Synthetic peptide
DEQEIVTTNPVATENYGWVSTNLQRGNR

SEQ ID NO: 15955 - protein, 30 aa, Artificial Sequence
  Description of Artificial Sequence: Synthetic polypeptide
DEEEIRTTNPVATEQYGSVSTELQVRGNPV

SEQ ID NO: 15956 - protein, 28 aa, Artificial Sequence
  Description of Artificial Sequence: Synthetic peptide
DEEEIRTTNPDATEQYGSVSTELQYGNF

SEQ ID NO: 15957 - protein, 28 aa, Artificial Sequence
  Description of Artificial Sequence: Synthetic peptide
DEEEIRTTNPVATEQYGSVSTPLQVGEG

SEQ ID NO: 15958 - protein, 29 aa, Artificial Sequence
  Description of Artificial Sequence: Synthetic peptide
DEEEIATTNPVATEVYGEVSATNLQRGNR

SEQ ID NO: 15959 - protein, 28 aa, Artificial Sequence
  Description of Artificial Sequence: Synthetic peptide
DEQEIAATNPVATEQYGTVSTNLQRGNR

SEQ ID NO: 15960 - protein, 31 aa, Artificial Sequence
  Description of Artificial Sequence: Synthetic polypeptide
DEEEIRTTNPVATEQYGSVSETNLEERGNDR

SEQ ID NO: 15961 - protein, 28 aa, Artificial Sequence
  Description of Artificial Sequence: Synthetic peptide
GDEEIRTTNPVATEQYGSVSTGLQNGNR

SEQ ID NO: 15962 - protein, 28 aa, Artificial Sequence
  Description of Artificial Sequence: Synthetic peptide
DEEEIRTTNPVATECYGSVSTDLQQGNS

SEQ ID NO: 15963 - protein, 28 aa, Artificial Sequence
  Description of Artificial Sequence: Synthetic peptide
DEEEIRTTNPFATEQYGSVSMNLQQGND

SEQ ID NO: 15964 - protein, 28 aa, Artificial Sequence
  Description of Artificial Sequence: Synthetic peptide
SEEEIRTTNPVSTEQYGSVSENLERGNR

SEQ ID NO: 15965 - protein, 28 aa, Artificial Sequence
  Description of Artificial Sequence: Synthetic peptide
DEEEIRTTNPVAYEQYGSMFTNLQVGNR

SEQ ID NO: 15966 - protein, 28 aa, Artificial Sequence
  Description of Artificial Sequence: Synthetic peptide
DEEEIRTTNPEATEQYGSVSTNLQSGDV

SEQ ID NO: 15967 - protein, 28 aa, Artificial Sequence
  Description of Artificial Sequence: Synthetic peptide
DEEEIRTTNPVATEQYGSVETNLQIGDS

SEQ ID NO: 15968 - protein, 29 aa, Artificial Sequence
  Description of Artificial Sequence: Synthetic peptide
DEEEIRTTNPVATEQYGSVEDTNDERGNR

SEQ ID NO: 15969 - protein, 28 aa, Artificial Sequence
  Description of Artificial Sequence: Synthetic peptide
DEEEIRTTNPVCTEQYGSVSTELQYGNM

SEQ ID NO: 15970 - protein, 28 aa, Artificial Sequence
  Description of Artificial Sequence: Synthetic peptide
TEEEIVTTNPVATEQYGDVSTNLQRGNL

SEQ ID NO: 15971 - protein, 29 aa, Artificial Sequence
  Description of Artificial Sequence: Synthetic peptide
DEEEIRTTNPVATEIYGSVGTNLEIRGNR

SEQ ID NO: 15972 - protein, 29 aa, Artificial Sequence
  Description of Artificial Sequence: Synthetic peptide
SEEEIRTTNPVATEMYGEVSTNLQRAGNR

SEQ ID NO: 15973 - protein, 30 aa, Artificial Sequence
  Description of Artificial Sequence: Synthetic polypeptide
DEEEIRTTNPVATECYGSVSTNLQREGEDR

SEQ ID NO: 15974 - protein, 29 aa, Artificial Sequence
  Description of Artificial Sequence: Synthetic peptide
DEEEIRTTNPVATEQYGSVSTNLQEIGEL

SEQ ID NO: 15975 - protein, 28 aa, Artificial Sequence
  Description of Artificial Sequence: Synthetic peptide
DENEIRTTNPVATECYGSVSTNLQRGEL

SEQ ID NO: 15976 - protein, 28 aa, Artificial Sequence
  Description of Artificial Sequence: Synthetic peptide
DEEEIRTTNPEATEQYGSVSTNEQVGDR

SEQ ID NO: 15977 - protein, 30 aa, Artificial Sequence
  Description of Artificial Sequence: Synthetic polypeptide
DEEEIRTTNPAATECYGSVSTNLQLRGPNR

SEQ ID NO: 15978 - protein, 29 aa, Artificial Sequence
  Description of Artificial Sequence: Synthetic peptide
DENEIRTTNPVATECYGSVSTDLQRNGNR

SEQ ID NO: 15979 - protein, 28 aa, Artificial Sequence
  Description of Artificial Sequence: Synthetic peptide
DEEEIRTTNPVSTEQYGSVSTNLQVGEQ

SEQ ID NO: 15980 - protein, 28 aa, Artificial Sequence
  Description of Artificial Sequence: Synthetic peptide
SEEEIRTTNPVATEQYGSVSENEQRGNG

SEQ ID NO: 15981 - protein, 29 aa, Artificial Sequence
  Description of Artificial Sequence: Synthetic peptide
DEEEIRTTNPVATEQYGSVSTELEREGER

SEQ ID NO: 15982 - protein, 28 aa, Artificial Sequence
  Description of Artificial Sequence: Synthetic peptide
YEEEIRTTNPVATEQYGTVATNEQRGNR

SEQ ID NO: 15983 - protein, 28 aa, Artificial Sequence
  Description of Artificial Sequence: Synthetic peptide
DEEEIRTTNPAATEQYGSVSTNLQLGDT

SEQ ID NO: 15984 - protein, 31 aa, Artificial Sequence
  Description of Artificial Sequence: Synthetic polypeptide
DEEEIRTTNPVATEQYGSVSTNLPEDREGNR

SEQ ID NO: 15985 - protein, 28 aa, Artificial Sequence
  Description of Artificial Sequence: Synthetic peptide
DENEIRCTNPVATETYGWVSTNLQRGNR

SEQ ID NO: 15986 - protein, 28 aa, Artificial Sequence
  Description of Artificial Sequence: Synthetic peptide
DEEEIRTTNPVATEQWGAVSTNLQRGPH

SEQ ID NO: 15987 - protein, 30 aa, Artificial Sequence
  Description of Artificial Sequence: Synthetic polypeptide
DEEEIRTTNPVATEQYGSVSTNLQELGNDI

SEQ ID NO: 15988 - protein, 28 aa, Artificial Sequence
  Description of Artificial Sequence: Synthetic peptide
DEQEIRTTNPVATEQYGSVSENLMRGNF

SEQ ID NO: 15989 - protein, 28 aa, Artificial Sequence
  Description of Artificial Sequence: Synthetic peptide
DEEEIRTTNPVATEQYGSVSTELQSGDG

SEQ ID NO: 15990 - protein, 29 aa, Artificial Sequence
  Description of Artificial Sequence: Synthetic peptide
DEEEIRTTNPVATEQYGDVSENLQGDGNR

SEQ ID NO: 15991 - protein, 28 aa, Artificial Sequence
  Description of Artificial Sequence: Synthetic peptide
DEESIRATNPVATHQYGSVSTNLDRGNR

SEQ ID NO: 15992 - protein, 28 aa, Artificial Sequence
  Description of Artificial Sequence: Synthetic peptide
DEEEIRQTNPVATEQYGVVSENLQYGNR

SEQ ID NO: 15993 - protein, 30 aa, Artificial Sequence
  Description of Artificial Sequence: Synthetic polypeptide
DEEEIRTTNPVATEQYGSVSTNLVQENGNV

SEQ ID NO: 15994 - protein, 28 aa, Artificial Sequence
  Description of Artificial Sequence: Synthetic peptide
DENEIVTTNPVATEQYGDASTNLQRGNR

SEQ ID NO: 15995 - protein, 30 aa, Artificial Sequence
  Description of Artificial Sequence: Synthetic polypeptide
DEEEIRTTNPVATEQYGSVESTENLQVGNY

SEQ ID NO: 15996 - protein, 29 aa, Artificial Sequence
  Description of Artificial Sequence: Synthetic peptide
DEEEIRATNPVATEQYGSVSTDLQQGNDR

SEQ ID NO: 15997 - protein, 29 aa, Artificial Sequence
  Description of Artificial Sequence: Synthetic peptide
DEEEIVTTNPVATEQYGSVSTNLQVNGNI

SEQ ID NO: 15998 - protein, 29 aa, Artificial Sequence
  Description of Artificial Sequence: Synthetic peptide
KEEEIRTTNPVATEQYGSVSTNLQETGNY

SEQ ID NO: 15999 - protein, 28 aa, Artificial Sequence
  Description of Artificial Sequence: Synthetic peptide
DEEEIRTTNPVATEQYGSVETNEQNGNS

SEQ ID NO: 16000 - protein, 28 aa, Artificial Sequence
  Description of Artificial Sequence: Synthetic peptide
DEEEIRTTNPVATEQYGSVSTEDQEGNV

SEQ ID NO: 16001 - protein, 28 aa, Artificial Sequence
  Description of Artificial Sequence: Synthetic peptide
DEEEIRTTNPVATEQWGNVSENLMRGNR

SEQ ID NO: 16002 - protein, 28 aa, Artificial Sequence
  Description of Artificial Sequence: Synthetic peptide
DEMEIRTTNPVASEQYGSVSTNLQTENR

SEQ ID NO: 16003 - protein, 29 aa, Artificial Sequence
  Description of Artificial Sequence: Synthetic peptide
DEEEIRTTNPVATEQYGTVSENLQTHGNR

SEQ ID NO: 16004 - protein, 29 aa, Artificial Sequence
  Description of Artificial Sequence: Synthetic peptide
DEEEIRTTNPVATEQYGSVSTNDQVGNEE

SEQ ID NO: 16005 - protein, 28 aa, Artificial Sequence
  Description of Artificial Sequence: Synthetic peptide
DEECIRTTNPVAFEQYGSVETNLQRGNG

SEQ ID NO: 16006 - protein, 29 aa, Artificial Sequence
  Description of Artificial Sequence: Synthetic peptide
DEEEIRTTNPVATEQYGWVSTNLQAGNDN

SEQ ID NO: 16007 - protein, 29 aa, Artificial Sequence
  Description of Artificial Sequence: Synthetic peptide
DEEEIRTTNPVATECYGSVSTNWQRGINF

SEQ ID NO: 16008 - protein, 28 aa, Artificial Sequence
  Description of Artificial Sequence: Synthetic peptide
KEEEIRTTNIVATEQYGSVSENLQIGNR

SEQ ID NO: 16009 - protein, 28 aa, Artificial Sequence
  Description of Artificial Sequence: Synthetic peptide
DEEEIRTTNPVATEQYGSVSTGLEVGNF

SEQ ID NO: 16010 - protein, 28 aa, Artificial Sequence
  Description of Artificial Sequence: Synthetic peptide
DDEEIRPTNPVATEQYGSVSTPVQRGNR

SEQ ID NO: 16011 - protein, 28 aa, Artificial Sequence
  Description of Artificial Sequence: Synthetic peptide
DEQEIRTTNPVATEQYGSVSTNDQHGNA

SEQ ID NO: 16012 - protein, 30 aa, Artificial Sequence
  Description of Artificial Sequence: Synthetic polypeptide
DEEEIRTTNPVATEQYGSVSTMNGLERGDR

SEQ ID NO: 16013 - protein, 28 aa, Artificial Sequence
  Description of Artificial Sequence: Synthetic peptide
DEEEIRTTNPDATEQYGSVSTDLLRGNA

SEQ ID NO: 16014 - protein, 30 aa, Artificial Sequence
  Description of Artificial Sequence: Synthetic polypeptide
DEEEIATTNPVATEQYGSVSTNLQERKGER

SEQ ID NO: 16015 - protein, 28 aa, Artificial Sequence
  Description of Artificial Sequence: Synthetic peptide
DEEEIRTTNPVATECWGSVSTNEQRGNS

SEQ ID NO: 16016 - protein, 30 aa, Artificial Sequence
  Description of Artificial Sequence: Synthetic polypeptide
DEQEIRTTNPVATEQYGCVSATNLQRNGNR

SEQ ID NO: 16017 - protein, 28 aa, Artificial Sequence
  Description of Artificial Sequence: Synthetic peptide
DEEEIRTTNPVATEQYGSVETDLERGER

SEQ ID NO: 16018 - protein, 28 aa, Artificial Sequence
  Description of Artificial Sequence: Synthetic peptide
DEEEIRTTNPVATECYGSVSTNLQHGED

SEQ ID NO: 16019 - protein, 28 aa, Artificial Sequence
  Description of Artificial Sequence: Synthetic peptide
DEEEIRTTNPVATEQYGVVSTDLQNGNI

SEQ ID NO: 16020 - protein, 28 aa, Artificial Sequence
  Description of Artificial Sequence: Synthetic peptide
DEEEIRTTNPVSTEQYGSVSENLQHGGR

SEQ ID NO: 16021 - protein, 30 aa, Artificial Sequence
  Description of Artificial Sequence: Synthetic polypeptide
DEEEIRTTNPVATEQYGSVSTIENLIRGER

SEQ ID NO: 16022 - protein, 28 aa, Artificial Sequence
  Description of Artificial Sequence: Synthetic peptide
DDEEVACTNPVATEQYGSVSTNLQRGNR

SEQ ID NO: 16023 - protein, 28 aa, Artificial Sequence
  Description of Artificial Sequence: Synthetic peptide
QEQEIRTTNPVATECYGSVSTNLQRGNH

SEQ ID NO: 16024 - protein, 28 aa, Artificial Sequence
  Description of Artificial Sequence: Synthetic peptide
DEEEIRSTNPVATEQYGNVSTALQGGNR

SEQ ID NO: 16025 - protein, 28 aa, Artificial Sequence
  Description of Artificial Sequence: Synthetic peptide
SEEEIRTTNPVATEIYGSVATNLQRGNF

SEQ ID NO: 16026 - protein, 29 aa, Artificial Sequence
  Description of Artificial Sequence: Synthetic peptide
DEQEIRTTNPVATEIYGCVSATNLQRGNR

SEQ ID NO: 16027 - protein, 28 aa, Artificial Sequence
  Description of Artificial Sequence: Synthetic peptide
DEEEIRTTNIVATEQYGSVSTELQRGED

SEQ ID NO: 16028 - protein, 30 aa, Artificial Sequence
  Description of Artificial Sequence: Synthetic polypeptide
DEEEIRTTNPVATEQYGSSWSTNLQPGDNR

SEQ ID NO: 16029 - protein, 29 aa, Artificial Sequence
  Description of Artificial Sequence: Synthetic peptide
DEVEIRTTNPVATEQYGSVSTPNDNRGNR

SEQ ID NO: 16030 - protein, 28 aa, Artificial Sequence
  Description of Artificial Sequence: Synthetic peptide
DEEEIRTTNPVATEMYGGVSENLQRGNF

SEQ ID NO: 16031 - protein, 30 aa, Artificial Sequence
  Description of Artificial Sequence: Synthetic polypeptide
DEEEIRTTNPDATEQYGSVSTNDQIRNGNR

SEQ ID NO: 16032 - protein, 28 aa, Artificial Sequence
  Description of Artificial Sequence: Synthetic peptide
DEDEIRTTNPVATEMWGSVSENLQRGNR

SEQ ID NO: 16033 - protein, 28 aa, Artificial Sequence
  Description of Artificial Sequence: Synthetic peptide
DDEEIRTTNPVATEQYGSVVTQLQRGGR

SEQ ID NO: 16034 - protein, 28 aa, Artificial Sequence
  Description of Artificial Sequence: Synthetic peptide
DEEEIRCTNPVATEQYGVVSTDWQRGNR

SEQ ID NO: 16035 - protein, 28 aa, Artificial Sequence
  Description of Artificial Sequence: Synthetic peptide
DEEEIRTTNPVATEQYGSVSTNGGLGFR

SEQ ID NO: 16036 - protein, 28 aa, Artificial Sequence
  Description of Artificial Sequence: Synthetic peptide
DDEEIRSTNPVATEQYGSVSNNLQVGNR

SEQ ID NO: 16037 - protein, 28 aa, Artificial Sequence
  Description of Artificial Sequence: Synthetic peptide
DEEEVRTTNPVATEQYGCVSANLQIGNR

SEQ ID NO: 16038 - protein, 28 aa, Artificial Sequence
  Description of Artificial Sequence: Synthetic peptide
DEQEIATTNPVATEVYGWVSTNLQRGNR

SEQ ID NO: 16039 - protein, 29 aa, Artificial Sequence
  Description of Artificial Sequence: Synthetic peptide
DEEEIRTTNPVATEQYGSVSTGDLENGNR

SEQ ID NO: 16040 - protein, 30 aa, Artificial Sequence
  Description of Artificial Sequence: Synthetic polypeptide
DEEEIRTTNPVATEQYGTVSENLQSRSGNR

SEQ ID NO: 16041 - protein, 28 aa, Artificial Sequence
  Description of Artificial Sequence: Synthetic peptide
DEQEIRTTNPVATEQWGSVSENEQRGNR

SEQ ID NO: 16042 - protein, 28 aa, Artificial Sequence
  Description of Artificial Sequence: Synthetic peptide
QEEEIRTTNIVATEQYGEVSTNLQRGNQ

SEQ ID NO: 16043 - protein, 30 aa, Artificial Sequence
  Description of Artificial Sequence: Synthetic polypeptide
DEEEIRTTNPVATEQYGSVSTIELQIDGNR

SEQ ID NO: 16044 - protein, 31 aa, Artificial Sequence
  Description of Artificial Sequence: Synthetic polypeptide
DEEEIRTTNPVATEQYGSVSITDLQDRGNDR

SEQ ID NO: 16045 - protein, 28 aa, Artificial Sequence
  Description of Artificial Sequence: Synthetic peptide
KEEEIRTTNPVATECYGSVSTNLQTGNH

SEQ ID NO: 16046 - protein, 28 aa, Artificial Sequence
  Description of Artificial Sequence: Synthetic peptide
DLEEIRTTNPVATEQYGDVSTNLQQGDR

SEQ ID NO: 16047 - protein, 29 aa, Artificial Sequence
  Description of Artificial Sequence: Synthetic peptide
DEEEIRTTNPVATEQYGVVSATLLQRGGR

SEQ ID NO: 16048 - protein, 28 aa, Artificial Sequence
  Description of Artificial Sequence: Synthetic peptide
DEHEIRTTNPVATEQYGWVSTNEQRGND

SEQ ID NO: 16049 - protein, 31 aa, Artificial Sequence
  Description of Artificial Sequence: Synthetic polypeptide
DEEEIRTTNPVATEQYGYSVTSTNLQEPGNR

SEQ ID NO: 16050 - protein, 28 aa, Artificial Sequence
  Description of Artificial Sequence: Synthetic peptide
DEEEIRTTNPVATEQYGSVDTNLEVGNQ

SEQ ID NO: 16051 - protein, 28 aa, Artificial Sequence
  Description of Artificial Sequence: Synthetic peptide
DEEEIRTVNPVATEQYGSVSDNVQRGNA

SEQ ID NO: 16052 - protein, 28 aa, Artificial Sequence
  Description of Artificial Sequence: Synthetic peptide
DEEEIRTTNPVATEQYGSVSTDLQIGEM

SEQ ID NO: 16053 - protein, 28 aa, Artificial Sequence
  Description of Artificial Sequence: Synthetic peptide
DEEEIRTTNPVATEQYGSVSTELEVGNP

SEQ ID NO: 16054 - protein, 28 aa, Artificial Sequence
  Description of Artificial Sequence: Synthetic peptide
SEEEIRTVNPVATENYGSCSTNLQRGNR

SEQ ID NO: 16055 - protein, 28 aa, Artificial Sequence
  Description of Artificial Sequence: Synthetic peptide
SEEEIAATNPVATEQYGSVSTNLQRGNF

SEQ ID NO: 16056 - protein, 28 aa, Artificial Sequence
  Description of Artificial Sequence: Synthetic peptide
EESEIRTTNPVATEQYGSVSENLQRLNR

SEQ ID NO: 16057 - protein, 28 aa, Artificial Sequence
  Description of Artificial Sequence: Synthetic peptide
DEEEIRTVNPVATEQYGSVSNPEQRGNR

SEQ ID NO: 16058 - protein, 28 aa, Artificial Sequence
  Description of Artificial Sequence: Synthetic peptide
DEEEIRTTNIVATEQYGSVSTDDGRGNR

SEQ ID NO: 16059 - protein, 28 aa, Artificial Sequence
  Description of Artificial Sequence: Synthetic peptide
DEEEIRTTNPDATEQYGSVSTNLDDGND

SEQ ID NO: 16060 - protein, 28 aa, Artificial Sequence
  Description of Artificial Sequence: Synthetic peptide
DEEEIRTTNPDATEQYGNVSTNEQRGNT

SEQ ID NO: 16061 - protein, 28 aa, Artificial Sequence
  Description of Artificial Sequence: Synthetic peptide
DEEEIRATNPVSTEQYGEVSTNVQRGNR

SEQ ID NO: 16062 - protein, 28 aa, Artificial Sequence
  Description of Artificial Sequence: Synthetic peptide
DEEEIRTTNIVATEQYGEVSTELQQGNR

SEQ ID NO: 16063 - protein, 28 aa, Artificial Sequence
  Description of Artificial Sequence: Synthetic peptide
DENEIRCTNPVATEQYGSVDENLQRGNR

SEQ ID NO: 16064 - protein, 28 aa, Artificial Sequence
  Description of Artificial Sequence: Synthetic peptide
DEEEIRTTNPVATEQYGSAATNLQHGNM

SEQ ID NO: 16065 - protein, 30 aa, Artificial Sequence
  Description of Artificial Sequence: Synthetic polypeptide
DEEEIRTTNPVATEQFGSVISTNLQRGDNF

SEQ ID NO: 16066 - protein, 28 aa, Artificial Sequence
  Description of Artificial Sequence: Synthetic peptide
REEEIRTTNPIATEQWGNVSTNLQRGNR

SEQ ID NO: 16067 - protein, 28 aa, Artificial Sequence
  Description of Artificial Sequence: Synthetic peptide
DEEEIRTTNPVATEQYGSVSCTVQHGNR

SEQ ID NO: 16068 - protein, 28 aa, Artificial Sequence
  Description of Artificial Sequence: Synthetic peptide
DEEEIRTTNPFATEQYGSVSTNLFRGEP

SEQ ID NO: 16069 - protein, 30 aa, Artificial Sequence
  Description of Artificial Sequence: Synthetic polypeptide
DEEEIRTTNPVATEQYGSVSTDLQDGENDR

SEQ ID NO: 16070 - protein, 28 aa, Artificial Sequence
  Description of Artificial Sequence: Synthetic peptide
SEEEIRTTNPVATEQYGSVSTDVQRGTR

SEQ ID NO: 16071 - protein, 29 aa, Artificial Sequence
  Description of Artificial Sequence: Synthetic peptide
DEEEIRTTNPVATEQYGSWSDTPLQNGNR

SEQ ID NO: 16072 - protein, 28 aa, Artificial Sequence
  Description of Artificial Sequence: Synthetic peptide
DENEIRTTNPVATEQYGIVSENLQRGDR

SEQ ID NO: 16073 - protein, 30 aa, Artificial Sequence
  Description of Artificial Sequence: Synthetic polypeptide
DEEEIRTTNPVATECYGSVSTNLQDQNGNR

SEQ ID NO: 16074 - protein, 28 aa, Artificial Sequence
  Description of Artificial Sequence: Synthetic peptide
DEEEIRTTNPVAYEMYGSVSNNLERGNR

SEQ ID NO: 16075 - protein, 28 aa, Artificial Sequence
  Description of Artificial Sequence: Synthetic peptide
DEEEIRTTNIDATEQYGSVSTNLQRENL

SEQ ID NO: 16076 - protein, 28 aa, Artificial Sequence
  Description of Artificial Sequence: Synthetic peptide
SENEIRTTNPVATEQYGSVSTNLQQENR

SEQ ID NO: 16077 - protein, 28 aa, Artificial Sequence
  Description of Artificial Sequence: Synthetic peptide
DEEEIRATNPVATEQYGSVSEDLQHGNR

SEQ ID NO: 16078 - protein, 28 aa, Artificial Sequence
  Description of Artificial Sequence: Synthetic peptide
DEHEIRTTNPVATEQYGDVSENLQRGNV

SEQ ID NO: 16079 - protein, 29 aa, Artificial Sequence
  Description of Artificial Sequence: Synthetic peptide
DEEEIRTTNPVATEQYGAVSMNLQQRGNL

SEQ ID NO: 16080 - protein, 30 aa, Artificial Sequence
  Description of Artificial Sequence: Synthetic polypeptide
DEEEIRTTNPCATEQYGSVSTENLQRNGER

SEQ ID NO: 16081 - protein, 28 aa, Artificial Sequence
  Description of Artificial Sequence: Synthetic peptide
MEEEISTTNPVATEQYGSVSENLQRGDR

SEQ ID NO: 16082 - protein, 30 aa, Artificial Sequence
  Description of Artificial Sequence: Synthetic polypeptide
DEEEIRTTNPVATEQYGSVSTNLEREGNDF

SEQ ID NO: 16083 - protein, 28 aa, Artificial Sequence
  Description of Artificial Sequence: Synthetic peptide
SEEEIRTTNPVATECYGSVSTNWQLGNR

SEQ ID NO: 16084 - protein, 30 aa, Artificial Sequence
  Description of Artificial Sequence: Synthetic polypeptide
DEEEIRTTNPVATEQYGSVDCTDLQRGNDR

SEQ ID NO: 16085 - protein, 28 aa, Artificial Sequence
  Description of Artificial Sequence: Synthetic peptide
DEEEIRTTNPVATEQYGSWSTNDQMGNW

SEQ ID NO: 16086 - protein, 28 aa, Artificial Sequence
  Description of Artificial Sequence: Synthetic peptide
DEEEIRTTNPVATEQYGSVDTNLQIGDA

SEQ ID NO: 16087 - protein, 28 aa, Artificial Sequence
  Description of Artificial Sequence: Synthetic peptide
DEEEIRTVNPVATEMYGSVSTDLQRGDR

SEQ ID NO: 16088 - protein, 29 aa, Artificial Sequence
  Description of Artificial Sequence: Synthetic peptide
VEEEIRTTNPVATEQYGSVSTNLQRQNIE

SEQ ID NO: 16089 - protein, 28 aa, Artificial Sequence
  Description of Artificial Sequence: Synthetic peptide
DEVEIRTTNPLATEQYGSVSTNKQGGNR

SEQ ID NO: 16090 - protein, 28 aa, Artificial Sequence
  Description of Artificial Sequence: Synthetic peptide
DENEIATTNPVATEIYGVVSTNLQRGNR

SEQ ID NO: 16091 - protein, 29 aa, Artificial Sequence
  Description of Artificial Sequence: Synthetic peptide
DEQEIRCTNPVATETYGSVSATNLQRGNR

SEQ ID NO: 16092 - protein, 28 aa, Artificial Sequence
  Description of Artificial Sequence: Synthetic peptide
DEVEIRTTNPTATEQYGSVSTNEQLGNR

SEQ ID NO: 16093 - protein, 29 aa, Artificial Sequence
  Description of Artificial Sequence: Synthetic peptide
DENEIRTTNPVATEQYGDVSENLQMRGNR

SEQ ID NO: 16094 - protein, 30 aa, Artificial Sequence
  Description of Artificial Sequence: Synthetic polypeptide
DEEEIRTTNPSATEQYGSVSTNLTRNGMNR

SEQ ID NO: 16095 - protein, 31 aa, Artificial Sequence
  Description of Artificial Sequence: Synthetic polypeptide
DEEEIRTTNPVATEQYGSVSETNLQREGNED

SEQ ID NO: 16096 - protein, 28 aa, Artificial Sequence
  Description of Artificial Sequence: Synthetic peptide
DENEIRTTNPVATEQYGSVSTNLMQGNF

SEQ ID NO: 16097 - protein, 31 aa, Artificial Sequence
  Description of Artificial Sequence: Synthetic polypeptide
DEEEIRTTNPVATEQYGSVSCTDLQCRGNDR

SEQ ID NO: 16098 - protein, 28 aa, Artificial Sequence
  Description of Artificial Sequence: Synthetic peptide
DEVEIRTTNPVATEQYGHVSTNLQVGNE

SEQ ID NO: 16099 - protein, 28 aa, Artificial Sequence
  Description of Artificial Sequence: Synthetic peptide
DEEEIATTNPVCTEQYGSVSTDLQRGDR

SEQ ID NO: 16100 - protein, 30 aa, Artificial Sequence
  Description of Artificial Sequence: Synthetic polypeptide
DEEEIRTTNPVATEQYGSYTSSPNLQRGNR

SEQ ID NO: 16101 - protein, 29 aa, Artificial Sequence
  Description of Artificial Sequence: Synthetic peptide
DEEEIRTTNPVATAQYGSVSSSNDQRGNR

SEQ ID NO: 16102 - protein, 28 aa, Artificial Sequence
  Description of Artificial Sequence: Synthetic peptide
DDEEIRTTNPCATEQYGSVSSNLERGNR

SEQ ID NO: 16103 - protein, 28 aa, Artificial Sequence
  Description of Artificial Sequence: Synthetic peptide
AEEEISTVNPVATELYGSVSTNLQRGNR

SEQ ID NO: 16104 - protein, 28 aa, Artificial Sequence
  Description of Artificial Sequence: Synthetic peptide
SEEEIRTTNIVATEQYGVVSTNLQRMNR

SEQ ID NO: 16105 - protein, 29 aa, Artificial Sequence
  Description of Artificial Sequence: Synthetic peptide
DTEEIRTTNPVATEQYGGSVSTNLQWGNQ

SEQ ID NO: 16106 - protein, 28 aa, Artificial Sequence
  Description of Artificial Sequence: Synthetic peptide
DEQEIRTVNPVATEQYGEVSTNLQRGGR

SEQ ID NO: 16107 - protein, 28 aa, Artificial Sequence
  Description of Artificial Sequence: Synthetic peptide
KEEEIRTTNPVATEQYGSVSTGLEEGNR

SEQ ID NO: 16108 - protein, 28 aa, Artificial Sequence
  Description of Artificial Sequence: Synthetic peptide
GEQEIRTTNIVATEQYGSVSTNLQTGNR

SEQ ID NO: 16109 - protein, 28 aa, Artificial Sequence
  Description of Artificial Sequence: Synthetic peptide
DEDEIATTNPVATEQYGSVSDLLQRGNR

SEQ ID NO: 16110 - protein, 28 aa, Artificial Sequence
  Description of Artificial Sequence: Synthetic peptide
QEDEIVTTNPVATEQYGSVSDNLQRGNR

SEQ ID NO: 16111 - protein, 28 aa, Artificial Sequence
  Description of Artificial Sequence: Synthetic peptide
DEEEIRTTNPEATEQYGSVSTNDQNGER

SEQ ID NO: 16112 - protein, 28 aa, Artificial Sequence
  Description of Artificial Sequence: Synthetic peptide
DEEEIRTTNPDATEQYGSVSTNEEMGNR

SEQ ID NO: 16113 - protein, 29 aa, Artificial Sequence
  Description of Artificial Sequence: Synthetic peptide
DEEEIRTTNPVATEQYGSVSTELCCRGNI

SEQ ID NO: 16114 - protein, 28 aa, Artificial Sequence
  Description of Artificial Sequence: Synthetic peptide
DEEEIRTTNPVATELWGSVSTNEMRGNR

SEQ ID NO: 16115 - protein, 28 aa, Artificial Sequence
  Description of Artificial Sequence: Synthetic peptide
DEEEIATTNIVATEQYGSVSENLQRGGR

SEQ ID NO: 16116 - protein, 28 aa, Artificial Sequence
  Description of Artificial Sequence: Synthetic peptide
DEEEIRTTNPEATEQYGSVSTNEQRGDQ

SEQ ID NO: 16117 - protein, 28 aa, Artificial Sequence
  Description of Artificial Sequence: Synthetic peptide
NEEEIRTTNIVATEQYGVASTNLQRGNR

SEQ ID NO: 16118 - protein, 28 aa, Artificial Sequence
  Description of Artificial Sequence: Synthetic peptide
DEEEIRTTNPCATEPYGSVDTNLQRGNG

SEQ ID NO: 16119 - protein, 28 aa, Artificial Sequence
  Description of Artificial Sequence: Synthetic peptide
DEAEIRTVNPVATEQYGSVATNLQRGIR

SEQ ID NO: 16120 - protein, 31 aa, Artificial Sequence
  Description of Artificial Sequence: Synthetic polypeptide
DEECIRTTNPVATEQYGMSVSITNLQRGNPR

SEQ ID NO: 16121 - protein, 30 aa, Artificial Sequence
  Description of Artificial Sequence: Synthetic polypeptide
DEEEIRTTNPVATEQYGSYVSETNLWRENR

SEQ ID NO: 16122 - protein, 28 aa, Artificial Sequence
  Description of Artificial Sequence: Synthetic peptide
DEEEIRTTNIVATEVYGSVSDNLQRGNT

SEQ ID NO: 16123 - protein, 28 aa, Artificial Sequence
  Description of Artificial Sequence: Synthetic peptide
DEEEIRTTNIVATEQYGSVSTNQQVGNY

SEQ ID NO: 16124 - protein, 28 aa, Artificial Sequence
  Description of Artificial Sequence: Synthetic peptide
DEEEIRTTNIVSTEQYGSVSTGLQRGDR

SEQ ID NO: 16125 - protein, 28 aa, Artificial Sequence
  Description of Artificial Sequence: Synthetic peptide
QENEIRTTNPVATEQYGSVSTCLERGNR

SEQ ID NO: 16126 - protein, 28 aa, Artificial Sequence
  Description of Artificial Sequence: Synthetic peptide
DEEEIRTTNPVATEQFGVVSTNEQVGNR

SEQ ID NO: 16127 - protein, 28 aa, Artificial Sequence
  Description of Artificial Sequence: Synthetic peptide
DEEEIRTTNIVASEVYGSVSTNLQNGNR

SEQ ID NO: 16128 - protein, 28 aa, Artificial Sequence
  Description of Artificial Sequence: Synthetic peptide
DEQEIRTTNPVATEIWGSVSTNLERGNR

SEQ ID NO: 16129 - protein, 29 aa, Artificial Sequence
  Description of Artificial Sequence: Synthetic peptide
DEEEIRTTNPVATELYGSVSTNLMNRGNW

SEQ ID NO: 16130 - protein, 28 aa, Artificial Sequence
  Description of Artificial Sequence: Synthetic peptide
DEEEVRTTNPVSTENYGSVSTNLQHGNR

SEQ ID NO: 16131 - protein, 28 aa, Artificial Sequence
  Description of Artificial Sequence: Synthetic peptide
DEEEIRTTNPAATEQFGSVSDNLQRGNA

SEQ ID NO: 16132 - protein, 28 aa, Artificial Sequence
  Description of Artificial Sequence: Synthetic peptide
DEEEIRTTNPIATEQYGLVSTNLQRGDH

SEQ ID NO: 16133 - protein, 28 aa, Artificial Sequence
  Description of Artificial Sequence: Synthetic peptide
DEEEIRTTNPVATEQYGSVSVALQLGPR

SEQ ID NO: 16134 - protein, 29 aa, Artificial Sequence
  Description of Artificial Sequence: Synthetic peptide
DEEEIRTVNPVATEQYGSVSTINGQRGDR

SEQ ID NO: 16135 - protein, 30 aa, Artificial Sequence
  Description of Artificial Sequence: Synthetic polypeptide
DEEEIRTTNPVATEQYGHVSWTNLNRGMNR

SEQ ID NO: 16136 - protein, 28 aa, Artificial Sequence
  Description of Artificial Sequence: Synthetic peptide
DCEEIRTTNPVATEQYGSVDTGLERGNR

SEQ ID NO: 16137 - protein, 28 aa, Artificial Sequence
  Description of Artificial Sequence: Synthetic peptide
DEEEIKTVNPVATEQYGSISENLQRGNR

SEQ ID NO: 16138 - protein, 28 aa, Artificial Sequence
  Description of Artificial Sequence: Synthetic peptide
DDQEIRTTNPVATEQYGSVSTNLQRPNA

SEQ ID NO: 16139 - protein, 28 aa, Artificial Sequence
  Description of Artificial Sequence: Synthetic peptide
SEVEIVTTNPVATEQYGSVSTNEQRGNR

SEQ ID NO: 16140 - protein, 29 aa, Artificial Sequence
  Description of Artificial Sequence: Synthetic peptide
DEEEIRTTNPVATEQYGSVSMNPIQRLNR

SEQ ID NO: 16141 - protein, 28 aa, Artificial Sequence
  Description of Artificial Sequence: Synthetic peptide
DEEEIRTTNPVATEQYGVVSYNLQAGNQ

SEQ ID NO: 16142 - protein, 28 aa, Artificial Sequence
  Description of Artificial Sequence: Synthetic peptide
DEEEIRATNPVATECYGSVSTNLQRGEL

SEQ ID NO: 16143 - protein, 28 aa, Artificial Sequence
  Description of Artificial Sequence: Synthetic peptide
DEEEIRTTNPVATEQYGSVDTNDQIGDR

SEQ ID NO: 16144 - protein, 28 aa, Artificial Sequence
  Description of Artificial Sequence: Synthetic peptide
DEEEIRTTNPEATEQYGSVSTNLQQGEN

SEQ ID NO: 16145 - protein, 28 aa, Artificial Sequence
  Description of Artificial Sequence: Synthetic peptide
DENEIRTTNPVATEQYGSVSTGLQVGNQ

SEQ ID NO: 16146 - protein, 28 aa, Artificial Sequence
  Description of Artificial Sequence: Synthetic peptide
DDNEIRTTNPVATEQYGCVSTNLQRPNR

SEQ ID NO: 16147 - protein, 29 aa, Artificial Sequence
  Description of Artificial Sequence: Synthetic peptide
DEEEIRATNPVATEWYGSVSENLQRAGNR

SEQ ID NO: 16148 - protein, 28 aa, Artificial Sequence
  Description of Artificial Sequence: Synthetic peptide
DEQEIATTNPVATECYGSVSTNLQSGNR

SEQ ID NO: 16149 - protein, 30 aa, Artificial Sequence
  Description of Artificial Sequence: Synthetic polypeptide
DEEEIRTTNPVATEQYGSVSTNLQCHGNDD

SEQ ID NO: 16150 - protein, 28 aa, Artificial Sequence
  Description of Artificial Sequence: Synthetic peptide
DEEEIRPTNPVAHEQYGSVSTNLARGND

SEQ ID NO: 16151 - protein, 28 aa, Artificial Sequence
  Description of Artificial Sequence: Synthetic peptide
DEEEIRTTNPVATEQYGSVSTNLENGEQ

SEQ ID NO: 16152 - protein, 28 aa, Artificial Sequence
  Description of Artificial Sequence: Synthetic peptide
DEEEIRTTNPVATEQYGSVFTNDWRGNA

SEQ ID NO: 16153 - protein, 28 aa, Artificial Sequence
  Description of Artificial Sequence: Synthetic peptide
QEEEISTTNPVATEQYGWASTNLQRGNR

SEQ ID NO: 16154 - protein, 28 aa, Artificial Sequence
  Description of Artificial Sequence: Synthetic peptide
DEEEISTTNIVATEQYGSVSENLQRGNL

SEQ ID NO: 16155 - protein, 28 aa, Artificial Sequence
  Description of Artificial Sequence: Synthetic peptide
DEDEITTTNPVATEQYGNVSTNLQRGNM

SEQ ID NO: 16156 - protein, 32 aa, Artificial Sequence
  Description of Artificial Sequence: Synthetic polypeptide
DEEEIRTTNPVATEQYGSVSTNGLQREGENDR

SEQ ID NO: 16157 - protein, 29 aa, Artificial Sequence
  Description of Artificial Sequence: Synthetic peptide
DEEEIRTTNPEATEQYGSVSTDLQRGDNY

SEQ ID NO: 16158 - protein, 28 aa, Artificial Sequence
  Description of Artificial Sequence: Synthetic peptide
DEEEIATTNPVSTEQYGEVSTVLQRGNR

SEQ ID NO: 16159 - protein, 28 aa, Artificial Sequence
  Description of Artificial Sequence: Synthetic peptide
AEEEIGTTNPVATEQYGDVSTNLQMGNR

SEQ ID NO: 16160 - protein, 28 aa, Artificial Sequence
  Description of Artificial Sequence: Synthetic peptide
DEQEIRTTNPVATEQWGSVSTNLMRGTR

SEQ ID NO: 16161 - protein, 30 aa, Artificial Sequence
  Description of Artificial Sequence: Synthetic polypeptide
SEEEIRTTNPVATEQYGSVSTMNLQREGDR

SEQ ID NO: 16162 - protein, 28 aa, Artificial Sequence
  Description of Artificial Sequence: Synthetic peptide
SEEEIRTTNPVATEQYGCVAENLQRGNR

SEQ ID NO: 16163 - protein, 30 aa, Artificial Sequence
  Description of Artificial Sequence: Synthetic polypeptide
DEEEIRTTNPDATEQYGSVSTNQQTRGENR

SEQ ID NO: 16164 - protein, 29 aa, Artificial Sequence
  Description of Artificial Sequence: Synthetic peptide
DEEEICTTNPVATEQYGSASTNLQRAGMR

SEQ ID NO: 16165 - protein, 28 aa, Artificial Sequence
  Description of Artificial Sequence: Synthetic peptide
DENEIVTTNPVATEQYGDVSTNLQHGNR

SEQ ID NO: 16166 - protein, 28 aa, Artificial Sequence
  Description of Artificial Sequence: Synthetic peptide
DEEEIRTTNPVAYEQYGSWSTNLDPGNR

SEQ ID NO: 16167 - protein, 28 aa, Artificial Sequence
  Description of Artificial Sequence: Synthetic peptide
DEDEIRTTNPVATEQYGAVSENLQRGVR

SEQ ID NO: 16168 - protein, 30 aa, Artificial Sequence
  Description of Artificial Sequence: Synthetic polypeptide
DEESIRTTNPVATEQYGSVHSTNPLDRGNR

SEQ ID NO: 16169 - protein, 28 aa, Artificial Sequence
  Description of Artificial Sequence: Synthetic peptide
DEVEIATTNPVATEMYGSVSENLQRGNR

SEQ ID NO: 16170 - protein, 28 aa, Artificial Sequence
  Description of Artificial Sequence: Synthetic peptide
QEEEIRTTNPVATEQYGDVSTNLQRGEE

SEQ ID NO: 16171 - protein, 28 aa, Artificial Sequence
  Description of Artificial Sequence: Synthetic peptide
DEEEIRTTNIVATEVYGSVSTNLQVGDR

SEQ ID NO: 16172 - protein, 29 aa, Artificial Sequence
  Description of Artificial Sequence: Synthetic peptide
DEEEIRTTNPVATEQYGSVSENLQHAGNM

SEQ ID NO: 16173 - protein, 28 aa, Artificial Sequence
  Description of Artificial Sequence: Synthetic peptide
DEEEIRTTNPVATEIWGSVSENLQRGNF

SEQ ID NO: 16174 - protein, 28 aa, Artificial Sequence
  Description of Artificial Sequence: Synthetic peptide
DEEEIRTTNPVATEQYGVVSEELQRGNL

SEQ ID NO: 16175 - protein, 28 aa, Artificial Sequence
  Description of Artificial Sequence: Synthetic peptide
DEEEIATVNPVATEQYGVVSTNLQIGNR

SEQ ID NO: 16176 - protein, 28 aa, Artificial Sequence
  Description of Artificial Sequence: Synthetic peptide
DEEEIRTTNPVATEQYGSVSTEEDRGNN

SEQ ID NO: 16177 - protein, 28 aa, Artificial Sequence
  Description of Artificial Sequence: Synthetic peptide
NEQEIRTTNPVATEQYGSVSDNLQRGNV

SEQ ID NO: 16178 - protein, 28 aa, Artificial Sequence
  Description of Artificial Sequence: Synthetic peptide
DEEEIRQTNPVATEQYGSVSTNQQHGNI

SEQ ID NO: 16179 - protein, 28 aa, Artificial Sequence
  Description of Artificial Sequence: Synthetic peptide
DEEELRTTNPVATEQYGGVGTNLQRGNA

SEQ ID NO: 16180 - protein, 28 aa, Artificial Sequence
  Description of Artificial Sequence: Synthetic peptide
DEEEIRCTNPVACEQYGSVSTLIQRGNR

SEQ ID NO: 16181 - protein, 28 aa, Artificial Sequence
  Description of Artificial Sequence: Synthetic peptide
NEEEIVTTNPVATEQYGSVGMNLQRGNR

SEQ ID NO: 16182 - protein, 28 aa, Artificial Sequence
  Description of Artificial Sequence: Synthetic peptide
DEEEIRTTNPVATECYGSVSTNLQVGEL

SEQ ID NO: 16183 - protein, 28 aa, Artificial Sequence
  Description of Artificial Sequence: Synthetic peptide
DEEEIRSTNPVATEQYGSVSDVLQFGNR

SEQ ID NO: 16184 - protein, 30 aa, Artificial Sequence
  Description of Artificial Sequence: Synthetic polypeptide
DEEEIRTTNPVATEQYGSVSTNLQDIGNDI

SEQ ID NO: 16185 - protein, 31 aa, Artificial Sequence
  Description of Artificial Sequence: Synthetic polypeptide
DEEEIVTTNPVATEQYGSVSTNLQIRNGDNR

SEQ ID NO: 16186 - protein, 28 aa, Artificial Sequence
  Description of Artificial Sequence: Synthetic peptide
DEEEIRTTNIVATEQYGSVSTEIQRGDR

SEQ ID NO: 16187 - protein, 28 aa, Artificial Sequence
  Description of Artificial Sequence: Synthetic peptide
DEEEIRTTNPVATEIYGSCSENLQRGTR

SEQ ID NO: 16188 - protein, 28 aa, Artificial Sequence
  Description of Artificial Sequence: Synthetic peptide
DEQEIRTTNPVATEQYGVVSTNLQIGNA

SEQ ID NO: 16189 - protein, 28 aa, Artificial Sequence
  Description of Artificial Sequence: Synthetic peptide
DEEELRTTNPVATEQYGSVSSNLQRLNI

SEQ ID NO: 16190 - protein, 28 aa, Artificial Sequence
  Description of Artificial Sequence: Synthetic peptide
MENEIRTTNPVATEQYGSVSENLQRGDR

SEQ ID NO: 16191 - protein, 28 aa, Artificial Sequence
  Description of Artificial Sequence: Synthetic peptide
DEEEITTTNPVATEQYGVVSTNLQAGNT

SEQ ID NO: 16192 - protein, 28 aa, Artificial Sequence
  Description of Artificial Sequence: Synthetic peptide
DEEEIRTTNPVASEAYGSVGMNLQRGNR

SEQ ID NO: 16193 - protein, 30 aa, Artificial Sequence
  Description of Artificial Sequence: Synthetic polypeptide
DEEEIRTTNPVATEQYGSVSTNLQEVGNDN

SEQ ID NO: 16194 - protein, 28 aa, Artificial Sequence
  Description of Artificial Sequence: Synthetic peptide
NEEEIRATNPVATETYGSVSTNLQRGNQ

SEQ ID NO: 16195 - protein, 28 aa, Artificial Sequence
  Description of Artificial Sequence: Synthetic peptide
SEEEIAATNPTATEQYGSVSTNLQRGNR

SEQ ID NO: 16196 - protein, 30 aa, Artificial Sequence
  Description of Artificial Sequence: Synthetic polypeptide
DEEEIRTTNPVAYEQYGSVTSTPGLQRGNR

SEQ ID NO: 16197 - protein, 28 aa, Artificial Sequence
  Description of Artificial Sequence: Synthetic peptide
DEQEITCTNPVATEQYGVVSTNLQRGNR

SEQ ID NO: 16198 - protein, 30 aa, Artificial Sequence
  Description of Artificial Sequence: Synthetic polypeptide
DEEEIRTTNPVATECYGSVSTNLQDTGENR

SEQ ID NO: 16199 - protein, 28 aa, Artificial Sequence
  Description of Artificial Sequence: Synthetic peptide
DESEIRTTNPVATEQFGSVSNNLQHGNR

SEQ ID NO: 16200 - protein, 29 aa, Artificial Sequence
  Description of Artificial Sequence: Synthetic peptide
DEEEIRTTNPVAYEQYGVVSTGLQRGDNR

SEQ ID NO: 16201 - protein, 28 aa, Artificial Sequence
  Description of Artificial Sequence: Synthetic peptide
SEEEIATTNPVATEQYGVVSTNLQLGNR

SEQ ID NO: 16202 - protein, 28 aa, Artificial Sequence
  Description of Artificial Sequence: Synthetic peptide
DEEEIAQTNPVSTEQYGEVSTNLQRGNR

SEQ ID NO: 16203 - protein, 29 aa, Artificial Sequence
  Description of Artificial Sequence: Synthetic peptide
QEEEIRTTNPVATEQYGSVSTNEQRGDTR

SEQ ID NO: 16204 - protein, 28 aa, Artificial Sequence
  Description of Artificial Sequence: Synthetic peptide
DEEEIRTTNPVATECYGSVSENEQLGNR

SEQ ID NO: 16205 - protein, 30 aa, Artificial Sequence
  Description of Artificial Sequence: Synthetic polypeptide
DEEEIRTTNPVATEQYGSVSTNLQEIEGER

SEQ ID NO: 16206 - protein, 28 aa, Artificial Sequence
  Description of Artificial Sequence: Synthetic peptide
DEHEIRTTNPVATEQYGSVSERLQDGNR

SEQ ID NO: 16207 - protein, 29 aa, Artificial Sequence
  Description of Artificial Sequence: Synthetic peptide
DEEEIRTTNPAASEQYGSVSTNLQDRGNN

SEQ ID NO: 16208 - protein, 28 aa, Artificial Sequence
  Description of Artificial Sequence: Synthetic peptide
DEEEIRTTNIVATEQYGSVSENLQYGNT

SEQ ID NO: 16209 - protein, 28 aa, Artificial Sequence
  Description of Artificial Sequence: Synthetic peptide
VEEEINTTNPVATEQYGSVSTNLQRQNA

SEQ ID NO: 16210 - protein, 28 aa, Artificial Sequence
  Description of Artificial Sequence: Synthetic peptide
DEEEIRTTNPVATEQYGSVETELDRGNP

SEQ ID NO: 16211 - protein, 28 aa, Artificial Sequence
  Description of Artificial Sequence: Synthetic peptide
DEEEIRTTNIVATEQYGDVSTNLQHGNM

SEQ ID NO: 16212 - protein, 29 aa, Artificial Sequence
  Description of Artificial Sequence: Synthetic peptide
SEEEIRTTNPVATEQYGSVSTNWQQEGNR

SEQ ID NO: 16213 - protein, 28 aa, Artificial Sequence
  Description of Artificial Sequence: Synthetic peptide
DEEEIRTVNPVATEMYGSVSENLQRGER

SEQ ID NO: 16214 - protein, 30 aa, Artificial Sequence
  Description of Artificial Sequence: Synthetic polypeptide
DEEEIRTTNPVATEQYGCVSTNPLFVRGNR

SEQ ID NO: 16215 - protein, 28 aa, Artificial Sequence
  Description of Artificial Sequence: Synthetic peptide
DEEAIRTTNIVATEQYGQVSTNLQRNNR

SEQ ID NO: 16216 - protein, 28 aa, Artificial Sequence
  Description of Artificial Sequence: Synthetic peptide
DEEEIRTTNIVATEQYGSVSTFLQTGNT

SEQ ID NO: 16217 - protein, 29 aa, Artificial Sequence
  Description of Artificial Sequence: Synthetic peptide
DEEEIRTTNPVATEQYGSVSTNLQEAGEL

SEQ ID NO: 16218 - protein, 28 aa, Artificial Sequence
  Description of Artificial Sequence: Synthetic peptide
GEEEIRTTNIVATELYGSVSTNLQQGNR

SEQ ID NO: 16219 - protein, 28 aa, Artificial Sequence
  Description of Artificial Sequence: Synthetic peptide
DEEEIRTTNPVATEQYGSWSTNLQREEP

SEQ ID NO: 16220 - protein, 28 aa, Artificial Sequence
  Description of Artificial Sequence: Synthetic peptide
DEQEIATVNPVATEQYGVVSTNLQRGNR

SEQ ID NO: 16221 - protein, 28 aa, Artificial Sequence
  Description of Artificial Sequence: Synthetic peptide
QEEEIRTTNPVSTEQYGDVSENLQRGNR

SEQ ID NO: 16222 - protein, 28 aa, Artificial Sequence
  Description of Artificial Sequence: Synthetic peptide
DEEEIRATNPVATETYGVVATNLQRGNR

SEQ ID NO: 16223 - protein, 28 aa, Artificial Sequence
  Description of Artificial Sequence: Synthetic peptide
DEEEITTTNPVATEQYGSVSTDLQVGER

SEQ ID NO: 16224 - protein, 28 aa, Artificial Sequence
  Description of Artificial Sequence: Synthetic peptide
DEEEIATTNPVATEQYGSVSDCLQRGMR

SEQ ID NO: 16225 - protein, 28 aa, Artificial Sequence
  Description of Artificial Sequence: Synthetic peptide
DEEEIRTTNPVATEQYGDASANLQHGNR

SEQ ID NO: 16226 - protein, 28 aa, Artificial Sequence
  Description of Artificial Sequence: Synthetic peptide
DEEEIVTTNPVATEQYGSVSDILQRGNY

SEQ ID NO: 16227 - protein, 28 aa, Artificial Sequence
  Description of Artificial Sequence: Synthetic peptide
DEEEIRTTNIVATEQYGTVSTNLERGNV

SEQ ID NO: 16228 - protein, 30 aa, Artificial Sequence
  Description of Artificial Sequence: Synthetic polypeptide
DEEEIRTTNPVATEQYGSVETNLQREGNEP

SEQ ID NO: 16229 - protein, 31 aa, Artificial Sequence
  Description of Artificial Sequence: Synthetic polypeptide
DEEEIRTTNPVATEQYGSVISTNPQLRGDNR

SEQ ID NO: 16230 - protein, 28 aa, Artificial Sequence
  Description of Artificial Sequence: Synthetic peptide
DEVEIATTNPTATEQYGGVSTNLQRGNR

SEQ ID NO: 16231 - protein, 30 aa, Artificial Sequence
  Description of Artificial Sequence: Synthetic polypeptide
DENEIRTTNPVATEVYGSVSATNLQREGNR

SEQ ID NO: 16232 - protein, 28 aa, Artificial Sequence
  Description of Artificial Sequence: Synthetic peptide
DEEEIWATNPVATEQYGEVSTNLQRGMR

SEQ ID NO: 16233 - protein, 29 aa, Artificial Sequence
  Description of Artificial Sequence: Synthetic peptide
QEEEIATTNPVATEQYGSVSTNLQSRGQR

SEQ ID NO: 16234 - protein, 28 aa, Artificial Sequence
  Description of Artificial Sequence: Synthetic peptide
KEEEIRTTNPVATETYGSVSTNDQQGNR

SEQ ID NO: 16235 - protein, 31 aa, Artificial Sequence
  Description of Artificial Sequence: Synthetic polypeptide
DEEEIRTTNPVATEQYGSVSTNLQEREGEDR

SEQ ID NO: 16236 - protein, 28 aa, Artificial Sequence
  Description of Artificial Sequence: Synthetic peptide
SEEEIATTNPVATEQFGSVSTNLQVGNR

SEQ ID NO: 16237 - protein, 28 aa, Artificial Sequence
  Description of Artificial Sequence: Synthetic peptide
DEEEITATNPVATEQYGVVSTNLQRGTR

SEQ ID NO: 16238 - protein, 28 aa, Artificial Sequence
  Description of Artificial Sequence: Synthetic peptide
DEEEIRTTNPVAVEQYGEVTTNLQWGNR

SEQ ID NO: 16239 - protein, 30 aa, Artificial Sequence
  Description of Artificial Sequence: Synthetic polypeptide
DEEEIRTTNPVATEQYGSVSATDLEDRGNR

SEQ ID NO: 16240 - protein, 28 aa, Artificial Sequence
  Description of Artificial Sequence: Synthetic peptide
DEEEICTTNPVATEQYGEMSNNLQRGNR

SEQ ID NO: 16241 - protein, 28 aa, Artificial Sequence
  Description of Artificial Sequence: Synthetic peptide
DEEEIRTTNPDATQQYGSVSTNLDRGER

SEQ ID NO: 16242 - protein, 29 aa, Artificial Sequence
  Description of Artificial Sequence: Synthetic peptide
DEEEIRTTNPVATEQYGSVSTELQENGDR

SEQ ID NO: 16243 - protein, 30 aa, Artificial Sequence
  Description of Artificial Sequence: Synthetic polypeptide
DEEEIRTTNPVATEQYGSVISTNPQERGTR

SEQ ID NO: 16244 - protein, 28 aa, Artificial Sequence
  Description of Artificial Sequence: Synthetic peptide
DEEEIRCTNIVATEQYGSVSTDLQRGER

SEQ ID NO: 16245 - protein, 28 aa, Artificial Sequence
  Description of Artificial Sequence: Synthetic peptide
DEEEIRTTNPDATEQYGSVSTNLDDGNF

SEQ ID NO: 16246 - protein, 28 aa, Artificial Sequence
  Description of Artificial Sequence: Synthetic peptide
NEHEIRTTNPVATEQYGSVSTNDQHGNR

SEQ ID NO: 16247 - protein, 28 aa, Artificial Sequence
  Description of Artificial Sequence: Synthetic peptide
DEEEIRTTNIVSTEQYGGVSTNLQDGNR

SEQ ID NO: 16248 - protein, 28 aa, Artificial Sequence
  Description of Artificial Sequence: Synthetic peptide
DEEEIRTTNPVATERYGSVSSNSQHGNR

SEQ ID NO: 16249 - protein, 28 aa, Artificial Sequence
  Description of Artificial Sequence: Synthetic peptide
DEEEVRATNPVATEWYGSVSTNLERGNR

SEQ ID NO: 16250 - protein, 28 aa, Artificial Sequence
  Description of Artificial Sequence: Synthetic peptide
DEEEIATTNPVATEQFGSVSTDLQRGLR

SEQ ID NO: 16251 - protein, 28 aa, Artificial Sequence
  Description of Artificial Sequence: Synthetic peptide
DEQEIRCTNPVATEQYGSVSTNLQIGNL

SEQ ID NO: 16252 - protein, 28 aa, Artificial Sequence
  Description of Artificial Sequence: Synthetic peptide
DEEEIRTTNIVATEQYGTVSTNLMRGNQ

SEQ ID NO: 16253 - protein, 28 aa, Artificial Sequence
  Description of Artificial Sequence: Synthetic peptide
HEEEIRTTNPVATEQYGSVDTNLQEGNE

SEQ ID NO: 16254 - protein, 28 aa, Artificial Sequence
  Description of Artificial Sequence: Synthetic peptide
DEEEVRTTNPVATEQYGSVANNLERGNR

SEQ ID NO: 16255 - protein, 31 aa, Artificial Sequence
  Description of Artificial Sequence: Synthetic polypeptide
DEEEIRTTNPVATEQYGSTVSCTHNLQRGNH

SEQ ID NO: 16256 - protein, 28 aa, Artificial Sequence
  Description of Artificial Sequence: Synthetic peptide
DEEEIRTTNPVATEQYGSVSTELQGGDL

SEQ ID NO: 16257 - protein, 29 aa, Artificial Sequence
  Description of Artificial Sequence: Synthetic peptide
DEEEIRTTNPVATEQYGSVSTNPEDEGNR

SEQ ID NO: 16258 - protein, 30 aa, Artificial Sequence
  Description of Artificial Sequence: Synthetic polypeptide
DEEEIRCTNPVATEQYGSVISTNLPQRENR

SEQ ID NO: 16259 - protein, 30 aa, Artificial Sequence
  Description of Artificial Sequence: Synthetic polypeptide
DEEEIRTTNPVATEQYGSVWSTNLQAGNPA

SEQ ID NO: 16260 - protein, 28 aa, Artificial Sequence
  Description of Artificial Sequence: Synthetic peptide
DAEEIRTTNPVAVEQYGSVSTNLDRGNM

SEQ ID NO: 16261 - protein, 29 aa, Artificial Sequence
  Description of Artificial Sequence: Synthetic peptide
DENEIRTTNPVATEQYGSVDTMNLQRGDR

SEQ ID NO: 16262 - protein, 28 aa, Artificial Sequence
  Description of Artificial Sequence: Synthetic peptide
DEEEIRTTNPVATESYGCVSMNIQRGNR

SEQ ID NO: 16263 - protein, 29 aa, Artificial Sequence
  Description of Artificial Sequence: Synthetic peptide
DEEEIRPTNPVATEQYGSVDSTNGQEGNR

SEQ ID NO: 16264 - protein, 28 aa, Artificial Sequence
  Description of Artificial Sequence: Synthetic peptide
DEEEIRTTNPVATEQYGSVSTDLELGNE

SEQ ID NO: 16265 - protein, 28 aa, Artificial Sequence
  Description of Artificial Sequence: Synthetic peptide
DEEEIRTTNPAATEQFGSVSTNWQRGNL

SEQ ID NO: 16266 - protein, 28 aa, Artificial Sequence
  Description of Artificial Sequence: Synthetic peptide
DEHEIRTTNPVATEQYGSVSTNEQHGDR

SEQ ID NO: 16267 - protein, 31 aa, Artificial Sequence
  Description of Artificial Sequence: Synthetic polypeptide
DEEEIRTTNPVATEQYGSVSTDLQRDGENDR

SEQ ID NO: 16268 - protein, 28 aa, Artificial Sequence
  Description of Artificial Sequence: Synthetic peptide
DEEEIRTTNPVATEQYGDVSEELQGGNR

SEQ ID NO: 16269 - protein, 30 aa, Artificial Sequence
  Description of Artificial Sequence: Synthetic polypeptide
DEEEIRTTNPVATEQYGSVSTNLQDTGNDW

SEQ ID NO: 16270 - protein, 28 aa, Artificial Sequence
  Description of Artificial Sequence: Synthetic peptide
DEEEIRTTNPEATEQYGSVSTELQRENQ

SEQ ID NO: 16271 - protein, 28 aa, Artificial Sequence
  Description of Artificial Sequence: Synthetic peptide
DEEEIRTTNPEATEQYGSVSTPDQPGNR

SEQ ID NO: 16272 - protein, 31 aa, Artificial Sequence
  Description of Artificial Sequence: Synthetic polypeptide
DEEEIRTTNPVATEQYGSVSCTMELQRGNDR

SEQ ID NO: 16273 - protein, 28 aa, Artificial Sequence
  Description of Artificial Sequence: Synthetic peptide
DEQEIATTNPVATECYGSVSTNLQHGNR

SEQ ID NO: 16274 - protein, 30 aa, Artificial Sequence
  Description of Artificial Sequence: Synthetic polypeptide
DEEEIRTTNPVATEQYGSVSTNLVQVDGNT

SEQ ID NO: 16275 - protein, 29 aa, Artificial Sequence
  Description of Artificial Sequence: Synthetic peptide
DEEEIRSTNPVATEQYGSVSDYNLQRENR

SEQ ID NO: 16276 - protein, 28 aa, Artificial Sequence
  Description of Artificial Sequence: Synthetic peptide
QEEEIRTTNPVSTEQYGSVSTLLQHGNR

SEQ ID NO: 16277 - protein, 28 aa, Artificial Sequence
  Description of Artificial Sequence: Synthetic peptide
DEEEIGTTNPVATELYGIVSTNEQRGNR

SEQ ID NO: 16278 - protein, 28 aa, Artificial Sequence
  Description of Artificial Sequence: Synthetic peptide
SEMEIRTTNPVATEQYGEVSTNLQRGGR

SEQ ID NO: 16279 - protein, 29 aa, Artificial Sequence
  Description of Artificial Sequence: Synthetic peptide
DEHELRTTNPVATEQYGSVSENLQRTGNR

SEQ ID NO: 16280 - protein, 30 aa, Artificial Sequence
  Description of Artificial Sequence: Synthetic polypeptide
DEEEIRTTNPVATEQYGESVSTNEQRGDER

SEQ ID NO: 16281 - protein, 28 aa, Artificial Sequence
  Description of Artificial Sequence: Synthetic peptide
SEEEIRTTNPVATEQFGSVSTNWQRGNQ

SEQ ID NO: 16282 - protein, 29 aa, Artificial Sequence
  Description of Artificial Sequence: Synthetic peptide
DEEEIRTTNPVATEQFGSVSTNPQIGVNR

SEQ ID NO: 16283 - protein, 28 aa, Artificial Sequence
  Description of Artificial Sequence: Synthetic peptide
AEEEISTTNPVATEQYGGVSDNLQRGNR

SEQ ID NO: 16284 - protein, 29 aa, Artificial Sequence
  Description of Artificial Sequence: Synthetic peptide
DEEEIRPTNPVATEIYGAVSATNLQRGNR

SEQ ID NO: 16285 - protein, 31 aa, Artificial Sequence
  Description of Artificial Sequence: Synthetic polypeptide
DEEEIRTTNPVATEQYGMSVSTNALQQGNFR

SEQ ID NO: 16286 - protein, 28 aa, Artificial Sequence
  Description of Artificial Sequence: Synthetic peptide
DEEEIRTTNPVATECYGSVSTDLQRGEE

SEQ ID NO: 16287 - protein, 28 aa, Artificial Sequence
  Description of Artificial Sequence: Synthetic peptide
DESEITATNPVATEQYGTVSTNLQRGNR

SEQ ID NO: 16288 - protein, 28 aa, Artificial Sequence
  Description of Artificial Sequence: Synthetic peptide
DEEEIRTTNPVATEQYGSVSTNPQVGPP

SEQ ID NO: 16289 - protein, 28 aa, Artificial Sequence
  Description of Artificial Sequence: Synthetic peptide
DEQEIVTTNPVATEQYGDVSENLQRGNR

SEQ ID NO: 16290 - protein, 29 aa, Artificial Sequence
  Description of Artificial Sequence: Synthetic peptide
DEEEIRTTNPVATEQYGGVSTPNLQDGNL

SEQ ID NO: 16291 - protein, 28 aa, Artificial Sequence
  Description of Artificial Sequence: Synthetic peptide
SEEEIRTTNPTATEQYGSVSTNLQQGNF

SEQ ID NO: 16292 - protein, 28 aa, Artificial Sequence
  Description of Artificial Sequence: Synthetic peptide
DEEEIRTTNPVATEQYGSVKDNLQREER

SEQ ID NO: 16293 - protein, 30 aa, Artificial Sequence
  Description of Artificial Sequence: Synthetic polypeptide
DEEEIRTTNPVATEQYGSVSTDNLDDPGNR

SEQ ID NO: 16294 - protein, 29 aa, Artificial Sequence
  Description of Artificial Sequence: Synthetic peptide
DEEEIATTNPVATEQYGSCSTNLQRSGNA

SEQ ID NO: 16295 - protein, 28 aa, Artificial Sequence
  Description of Artificial Sequence: Synthetic peptide
DEEEIRTTNPVATEQFGSVSENEQRGDR

SEQ ID NO: 16296 - protein, 28 aa, Artificial Sequence
  Description of Artificial Sequence: Synthetic peptide
DEEEVRTTNPVATECYGSTSTNLQRGDR

SEQ ID NO: 16297 - protein, 29 aa, Artificial Sequence
  Description of Artificial Sequence: Synthetic peptide
DEEEIRTTNPVATEQYGWVSTNLDDQGNR

SEQ ID NO: 16298 - protein, 28 aa, Artificial Sequence
  Description of Artificial Sequence: Synthetic peptide
DEEEIRTTNPVATEQWGSSSENLQTGNR

SEQ ID NO: 16299 - protein, 28 aa, Artificial Sequence
  Description of Artificial Sequence: Synthetic peptide
DEEEIRTTNPVATEQYGSVDTDLQYGNL

SEQ ID NO: 16300 - protein, 28 aa, Artificial Sequence
  Description of Artificial Sequence: Synthetic peptide
DEEEIRTTNPVATEQYGSVSTDLQLGEI

SEQ ID NO: 16301 - protein, 29 aa, Artificial Sequence
  Description of Artificial Sequence: Synthetic peptide
DEEEIRTVNPVATECYGSVSTENLQRGMR

SEQ ID NO: 16302 - protein, 28 aa, Artificial Sequence
  Description of Artificial Sequence: Synthetic peptide
DEEEIRTTNPVATEQYGSASENIQRGNA

SEQ ID NO: 16303 - protein, 28 aa, Artificial Sequence
  Description of Artificial Sequence: Synthetic peptide
DEGEICTTNPVATEQYGIVSTNVQRGNR

SEQ ID NO: 16304 - protein, 28 aa, Artificial Sequence
  Description of Artificial Sequence: Synthetic peptide
DENEISTTNPVATEQYGSVSTNLQVGNQ

SEQ ID NO: 16305 - protein, 31 aa, Artificial Sequence
  Description of Artificial Sequence: Synthetic polypeptide
DEEEIRTTNPVATEQYGSVSTANLQRGDNTG

SEQ ID NO: 16306 - protein, 28 aa, Artificial Sequence
  Description of Artificial Sequence: Synthetic peptide
AEQEIVTTNPVATEIYGSVSTNLQRGNR

SEQ ID NO: 16307 - protein, 29 aa, Artificial Sequence
  Description of Artificial Sequence: Synthetic peptide
DEQEIRTTNPVATEQYGSVSTDLVERGNR

SEQ ID NO: 16308 - protein, 28 aa, Artificial Sequence
  Description of Artificial Sequence: Synthetic peptide
DEEEIRTTNPVATEQYGSVETDLQRENQ

SEQ ID NO: 16309 - protein, 28 aa, Artificial Sequence
  Description of Artificial Sequence: Synthetic peptide
DENEIRCTNPVATEQYGSVSTNLMTGNR

SEQ ID NO: 16310 - protein, 29 aa, Artificial Sequence
  Description of Artificial Sequence: Synthetic peptide
DEEEIRTTNPVATEQYGSVSTNLQHEEDR

SEQ ID NO: 16311 - protein, 28 aa, Artificial Sequence
  Description of Artificial Sequence: Synthetic peptide
NEEEVRTTNPVATEIYGCVSTNLQRGNR

SEQ ID NO: 16312 - protein, 29 aa, Artificial Sequence
  Description of Artificial Sequence: Synthetic peptide
DEEEIRTTNPVATEQYGSVETNLDRGLMR

SEQ ID NO: 16313 - protein, 28 aa, Artificial Sequence
  Description of Artificial Sequence: Synthetic peptide
SEEEIRTTNPVATEQYGEVSYNHQRGNR

SEQ ID NO: 16314 - protein, 28 aa, Artificial Sequence
  Description of Artificial Sequence: Synthetic peptide
DCEEIRTTNPVATEQYGSVSTNLIDGNP

SEQ ID NO: 16315 - protein, 28 aa, Artificial Sequence
  Description of Artificial Sequence: Synthetic peptide
DEEEIATTNPVATECYGSVSTNLQHGER

SEQ ID NO: 16316 - protein, 28 aa, Artificial Sequence
  Description of Artificial Sequence: Synthetic peptide
KENEIATTNPVATEQYGSVSENLQRGNR

SEQ ID NO: 16317 - protein, 30 aa, Artificial Sequence
  Description of Artificial Sequence: Synthetic polypeptide
DEEEIRTTNPVATEQYGSVSTANLQNEGNG

SEQ ID NO: 16318 - protein, 28 aa, Artificial Sequence
  Description of Artificial Sequence: Synthetic peptide
DEEEIRTTNIVCTEQYGSVSTNLQSGNG

SEQ ID NO: 16319 - protein, 28 aa, Artificial Sequence
  Description of Artificial Sequence: Synthetic peptide
DEEEIRTTNIVATECYGSVSENLQRGNN

SEQ ID NO: 16320 - protein, 29 aa, Artificial Sequence
  Description of Artificial Sequence: Synthetic peptide
DEEEIRTTNPVATEQYGSVSCENLQMGNC

SEQ ID NO: 16321 - protein, 28 aa, Artificial Sequence
  Description of Artificial Sequence: Synthetic peptide
DEQEIRTTNPVATEQYGSVSTNLMRGTA

SEQ ID NO: 16322 - protein, 28 aa, Artificial Sequence
  Description of Artificial Sequence: Synthetic peptide
SEEEIRTTNIVATEQYGSVSTDDQRGNR

SEQ ID NO: 16323 - protein, 28 aa, Artificial Sequence
  Description of Artificial Sequence: Synthetic peptide
DDEEIRSTNPVATEQYGSVGTNLQRGNQ

SEQ ID NO: 16324 - protein, 30 aa, Artificial Sequence
  Description of Artificial Sequence: Synthetic polypeptide
DEEEIRTTNPVATEQYGSVSTNLQIRENNI

SEQ ID NO: 16325 - protein, 32 aa, Artificial Sequence
  Description of Artificial Sequence: Synthetic polypeptide
DEEEIRTTNPVATEQYGSVSETQNLQIRGNDR

SEQ ID NO: 16326 - protein, 28 aa, Artificial Sequence
  Description of Artificial Sequence: Synthetic peptide
DEAEIRTTNPVATEQYGQVSDNIQRGNR

SEQ ID NO: 16327 - protein, 28 aa, Artificial Sequence
  Description of Artificial Sequence: Synthetic peptide
DEEEIRCTNPVATEQYGAVSTNLQVGNA

SEQ ID NO: 16328 - protein, 28 aa, Artificial Sequence
  Description of Artificial Sequence: Synthetic peptide
DEEEIRTTNIVATEQYGTVSTGLQYGNR

SEQ ID NO: 16329 - protein, 31 aa, Artificial Sequence
  Description of Artificial Sequence: Synthetic polypeptide
DEEEIRTTNPVATEQYGSVSVTNLQDRGDNG

SEQ ID NO: 16330 - protein, 31 aa, Artificial Sequence
  Description of Artificial Sequence: Synthetic polypeptide
SEEEIRTTNPVATEQYGSVISTMNLQRSGNR

SEQ ID NO: 16331 - protein, 28 aa, Artificial Sequence
  Description of Artificial Sequence: Synthetic peptide
DEEEIRTTNPDATEQYGSVSTPDQDGNR

SEQ ID NO: 16332 - protein, 29 aa, Artificial Sequence
  Description of Artificial Sequence: Synthetic peptide
SEEEIRTTNPVATEQYGSVSTNLQPGVND

SEQ ID NO: 16333 - protein, 30 aa, Artificial Sequence
  Description of Artificial Sequence: Synthetic polypeptide
DEEEIRTTNPVATEQYGSVSTNLQLDEGNE

SEQ ID NO: 16334 - protein, 28 aa, Artificial Sequence
  Description of Artificial Sequence: Synthetic peptide
DEEEIRTTNPVATEQYGSVSTNDQFGEE

SEQ ID NO: 16335 - protein, 28 aa, Artificial Sequence
  Description of Artificial Sequence: Synthetic peptide
DEEEIRTTNPVATEQYGVVDTELERGNR

SEQ ID NO: 16336 - protein, 30 aa, Artificial Sequence
  Description of Artificial Sequence: Synthetic polypeptide
DEEEIRTTNPVATECYGSVSTNLQEAEGNR

SEQ ID NO: 16337 - protein, 28 aa, Artificial Sequence
  Description of Artificial Sequence: Synthetic peptide
DEEEIRTTNPAATEQYGSVSANLQRGTQ

SEQ ID NO: 16338 - protein, 28 aa, Artificial Sequence
  Description of Artificial Sequence: Synthetic peptide
DEECIRTTNPMATEQYGSVSTDLQRGNG

SEQ ID NO: 16339 - protein, 28 aa, Artificial Sequence
  Description of Artificial Sequence: Synthetic peptide
DEEEIRCTNPVATEQYGSVDNNGQRGNR

SEQ ID NO: 16340 - protein, 28 aa, Artificial Sequence
  Description of Artificial Sequence: Synthetic peptide
DEEEIRTTNPVATEQYGSVSTNLEIGEL

SEQ ID NO: 16341 - protein, 28 aa, Artificial Sequence
  Description of Artificial Sequence: Synthetic peptide
HEEEVRTTNPVATEQYGSVSTNLERGDR

SEQ ID NO: 16342 - protein, 28 aa, Artificial Sequence
  Description of Artificial Sequence: Synthetic peptide
DEEEIRQTNIVATEIYGSVSTNLQVGNR

SEQ ID NO: 16343 - protein, 28 aa, Artificial Sequence
  Description of Artificial Sequence: Synthetic peptide
DEEEIRTTNPTASEQYGSVSTNLERGNF

SEQ ID NO: 16344 - protein, 28 aa, Artificial Sequence
  Description of Artificial Sequence: Synthetic peptide
DEEEIRTTNPDATEQYGSVSTGPQRGDR

SEQ ID NO: 16345 - protein, 30 aa, Artificial Sequence
  Description of Artificial Sequence: Synthetic polypeptide
DEEEIRQTNPVATEQYGSVSTNLELRGENR

SEQ ID NO: 16346 - protein, 28 aa, Artificial Sequence
  Description of Artificial Sequence: Synthetic peptide
SEEEIRTTNPVATEMYGSVSTLLQRGNF

SEQ ID NO: 16347 - protein, 28 aa, Artificial Sequence
  Description of Artificial Sequence: Synthetic peptide
DEEEIRTTNPDATEQYGSVSTNLEWGNQ

SEQ ID NO: 16348 - protein, 29 aa, Artificial Sequence
  Description of Artificial Sequence: Synthetic peptide
DEEEIRCTNPVATEQYGSAATNLQERGNR

SEQ ID NO: 16349 - protein, 28 aa, Artificial Sequence
  Description of Artificial Sequence: Synthetic peptide
DENEIATTNPVATECYGSVSTDLQRGNR

SEQ ID NO: 16350 - protein, 29 aa, Artificial Sequence
  Description of Artificial Sequence: Synthetic peptide
DEEEIRTTNPVATECYGSVSTNLQEFGER

SEQ ID NO: 16351 - protein, 28 aa, Artificial Sequence
  Description of Artificial Sequence: Synthetic peptide
QEEEIRTTNPVATEQYGSVSTDLQVGER

SEQ ID NO: 16352 - protein, 28 aa, Artificial Sequence
  Description of Artificial Sequence: Synthetic peptide
DENEIVTTNPVATEVYGVVSTNLQRGNR

SEQ ID NO: 16353 - protein, 28 aa, Artificial Sequence
  Description of Artificial Sequence: Synthetic peptide
DELEIRTTNPVATEQYGVVGTNLQRGNQ

SEQ ID NO: 16354 - protein, 28 aa, Artificial Sequence
  Description of Artificial Sequence: Synthetic peptide
DEEEIATTNPVATEIYGVVSTNLQRGER

SEQ ID NO: 16355 - protein, 28 aa, Artificial Sequence
  Description of Artificial Sequence: Synthetic peptide
DEEEIRTTNIVATEQYGSVSTNDMRGNY

SEQ ID NO: 16356 - protein, 29 aa, Artificial Sequence
  Description of Artificial Sequence: Synthetic peptide
DEQEIATTNPVATEQYGSVSTNLQREGNL

SEQ ID NO: 16357 - protein, 29 aa, Artificial Sequence
  Description of Artificial Sequence: Synthetic peptide
DEDEIRTTNPVATEQYGSVSATNLQDGNI

SEQ ID NO: 16358 - protein, 28 aa, Artificial Sequence
  Description of Artificial Sequence: Synthetic peptide
NEEEIRCTNCVATEAYGSVSTNLQRGNR

SEQ ID NO: 16359 - protein, 30 aa, Artificial Sequence
  Description of Artificial Sequence: Synthetic polypeptide
DEEEIRTTNPVATEQYGSVSTNLQEAGNDS

SEQ ID NO: 16360 - protein, 29 aa, Artificial Sequence
  Description of Artificial Sequence: Synthetic peptide
DENEIRTTNPVATEQYGSVSTTNLEDGNR

SEQ ID NO: 16361 - protein, 28 aa, Artificial Sequence
  Description of Artificial Sequence: Synthetic peptide
DEEEIRTTNPVATECYGSVSTNLQDGES

SEQ ID NO: 16362 - protein, 28 aa, Artificial Sequence
  Description of Artificial Sequence: Synthetic peptide
DEEEIRTTNPVATEQYGSVSTPLEREER

SEQ ID NO: 16363 - protein, 28 aa, Artificial Sequence
  Description of Artificial Sequence: Synthetic peptide
DEEEIRTTNPVATEQYGSVSTNLEVGEA

SEQ ID NO: 16364 - protein, 31 aa, Artificial Sequence
  Description of Artificial Sequence: Synthetic polypeptide
DEEEIRTTNPVATECYGSYVSTPNLQRGDNR

SEQ ID NO: 16365 - protein, 28 aa, Artificial Sequence
  Description of Artificial Sequence: Synthetic peptide
DEEEIRTTNPVATEQYGSVSTEDERGNY

SEQ ID NO: 16366 - protein, 28 aa, Artificial Sequence
  Description of Artificial Sequence: Synthetic peptide
KEEEIRTTNPVATEQYGWMSTNLQRGDR

SEQ ID NO: 16367 - protein, 28 aa, Artificial Sequence
  Description of Artificial Sequence: Synthetic peptide
DEEEIRTTNPVATEQYGSVSTDDDRENR

SEQ ID NO: 16368 - protein, 28 aa, Artificial Sequence
  Description of Artificial Sequence: Synthetic peptide
DEEEIRTTNPVATECYGSVSTDLQNGNH

SEQ ID NO: 16369 - protein, 29 aa, Artificial Sequence
  Description of Artificial Sequence: Synthetic peptide
DEEEIRTTNPVATECYGSVCSECLQRGNR

SEQ ID NO: 16370 - protein, 28 aa, Artificial Sequence
  Description of Artificial Sequence: Synthetic peptide
DEEEIRTTNPVATEQYGSVDTDDQYGNR

SEQ ID NO: 16371 - protein, 28 aa, Artificial Sequence
  Description of Artificial Sequence: Synthetic peptide
DEEEIRATNPVATEMYGSVSTVLQRGGR

SEQ ID NO: 16372 - protein, 28 aa, Artificial Sequence
  Description of Artificial Sequence: Synthetic peptide
SEEEIRTTNPVATECFGSVSTNLQVGNR

SEQ ID NO: 16373 - protein, 30 aa, Artificial Sequence
  Description of Artificial Sequence: Synthetic polypeptide
DEEEIRTTNPVATEQYGSNSTNLGQAGNTR

SEQ ID NO: 16374 - protein, 28 aa, Artificial Sequence
  Description of Artificial Sequence: Synthetic peptide
CEEEISTTNPVATEQYGDVSANLQRGNR

SEQ ID NO: 16375 - protein, 30 aa, Artificial Sequence
  Description of Artificial Sequence: Synthetic polypeptide
DEEEIRTTNPDATEQYGSVSTNLPQMGVNR

SEQ ID NO: 16376 - protein, 31 aa, Artificial Sequence
  Description of Artificial Sequence: Synthetic polypeptide
DEEEIRTTNPVATEQYGGSSVSWTNLQDGNR

SEQ ID NO: 16377 - protein, 30 aa, Artificial Sequence
  Description of Artificial Sequence: Synthetic polypeptide
DPEEIRTTNPVATEQYGSVSHNLQREGDNR

SEQ ID NO: 16378 - protein, 29 aa, Artificial Sequence
  Description of Artificial Sequence: Synthetic peptide
DEEEIRSTNPVATEQYGTVSTNLQRAGMR

SEQ ID NO: 16379 - protein, 31 aa, Artificial Sequence
  Description of Artificial Sequence: Synthetic polypeptide
DTEEIRTTNPVATEQYGVSVSTSNLAQRGNR

SEQ ID NO: 16380 - protein, 28 aa, Artificial Sequence
  Description of Artificial Sequence: Synthetic peptide
DEEEIRTTNIVATEQYGSVSEDLQRGER

SEQ ID NO: 16381 - protein, 28 aa, Artificial Sequence
  Description of Artificial Sequence: Synthetic peptide
DEEEIRTTNPVASELYGSVSTGLQRPNR

SEQ ID NO: 16382 - protein, 28 aa, Artificial Sequence
  Description of Artificial Sequence: Synthetic peptide
DEEEIRTTNPVATEQYGSVEHGLQPGNR

SEQ ID NO: 16383 - protein, 29 aa, Artificial Sequence
  Description of Artificial Sequence: Synthetic peptide
DEEEIRTTNPVATEQYGSVSTPLEERGNM

SEQ ID NO: 16384 - protein, 28 aa, Artificial Sequence
  Description of Artificial Sequence: Synthetic peptide
DEEEIRTTNPTATEMYGSVSENEQRGNR

SEQ ID NO: 16385 - protein, 28 aa, Artificial Sequence
  Description of Artificial Sequence: Synthetic peptide
DEEEIRTTNPVAYEQYGCVSTNLERPNR

SEQ ID NO: 16386 - protein, 28 aa, Artificial Sequence
  Description of Artificial Sequence: Synthetic peptide
DEEEIRTTNPTATEQYGSVSTNEQIGNV

SEQ ID NO: 16387 - protein, 30 aa, Artificial Sequence
  Description of Artificial Sequence: Synthetic polypeptide
DEEEIRTTNPVATEQYGSVDTMDLQDRGNR

SEQ ID NO: 16388 - protein, 28 aa, Artificial Sequence
  Description of Artificial Sequence: Synthetic peptide
DEEEIRTTNPVATEQYGSVSTELQYGEF

SEQ ID NO: 16389 - protein, 28 aa, Artificial Sequence
  Description of Artificial Sequence: Synthetic peptide
DEQEIATTNPVATEHYGVVSTNLQRGNR

SEQ ID NO: 16390 - protein, 29 aa, Artificial Sequence
  Description of Artificial Sequence: Synthetic peptide
DEEEIRTTNPVATECYGSVSATNLEHGNR

SEQ ID NO: 16391 - protein, 28 aa, Artificial Sequence
  Description of Artificial Sequence: Synthetic peptide
DEEEIRTTNPVATEQYGSVSTGPQHGNV

SEQ ID NO: 16392 - protein, 29 aa, Artificial Sequence
  Description of Artificial Sequence: Synthetic peptide
QENEIRTTNPVATEQYGSVSTNLQRGFER

SEQ ID NO: 16393 - protein, 28 aa, Artificial Sequence
  Description of Artificial Sequence: Synthetic peptide
DEEEIRTTNPVATEQWGSVSTNLMTGNQ

SEQ ID NO: 16394 - protein, 29 aa, Artificial Sequence
  Description of Artificial Sequence: Synthetic peptide
DEEEIRTTNPVATEVYGSVSTVLQHAGNR

SEQ ID NO: 16395 - protein, 28 aa, Artificial Sequence
  Description of Artificial Sequence: Synthetic peptide
DEEEIRTTNIVATEQYGDVSTNLQRGEQ

SEQ ID NO: 16396 - protein, 28 aa, Artificial Sequence
  Description of Artificial Sequence: Synthetic peptide
DESEIVTTNPVATEQYGSVDDNLQRGNR

SEQ ID NO: 16397 - protein, 29 aa, Artificial Sequence
  Description of Artificial Sequence: Synthetic peptide
DEEEIRTTNPVATEQYGSVSITNLQQGDA

SEQ ID NO: 16398 - protein, 30 aa, Artificial Sequence
  Description of Artificial Sequence: Synthetic polypeptide
DEEEIRTTNPVCTEQYGSVSTTGLQRGNER

SEQ ID NO: 16399 - protein, 31 aa, Artificial Sequence
  Description of Artificial Sequence: Synthetic polypeptide
DEEEIRTTNPVATEQYGSVTSTELQRKGLNR

SEQ ID NO: 16400 - protein, 30 aa, Artificial Sequence
  Description of Artificial Sequence: Synthetic polypeptide
DEEEIRTTNPVATEQYGSVETNLVQRGEDR

SEQ ID NO: 16401 - protein, 28 aa, Artificial Sequence
  Description of Artificial Sequence: Synthetic peptide
DESEVRTTNPVATENYGSVSTNLQRGNI

SEQ ID NO: 16402 - protein, 30 aa, Artificial Sequence
  Description of Artificial Sequence: Synthetic polypeptide
DEEEIRTTNPVATEQYGSVTSTELQRGNDE

SEQ ID NO: 16403 - protein, 31 aa, Artificial Sequence
  Description of Artificial Sequence: Synthetic polypeptide
DEEEIRTTNPVATEQYGSVESTNLTQREGND

SEQ ID NO: 16404 - protein, 31 aa, Artificial Sequence
  Description of Artificial Sequence: Synthetic polypeptide
DEEEIRTTNPVATEQYGSVSTMNLQLRGDNG

SEQ ID NO: 16405 - protein, 31 aa, Artificial Sequence
  Description of Artificial Sequence: Synthetic polypeptide
DEEEIRTTNPVATEQYGSVSTNLQDDNGNDR

SEQ ID NO: 16406 - protein, 28 aa, Artificial Sequence
  Description of Artificial Sequence: Synthetic peptide
DEEEIRTTNPVATEQYGMVSTNLDPGER

SEQ ID NO: 16407 - protein, 28 aa, Artificial Sequence
  Description of Artificial Sequence: Synthetic peptide
DEEEIRTTNPVATEQWGSVSTNLQLGEE

SEQ ID NO: 16408 - protein, 30 aa, Artificial Sequence
  Description of Artificial Sequence: Synthetic polypeptide
DEEELRTTNPVATEQYGIVSTNLDQDRGNR

SEQ ID NO: 16409 - protein, 28 aa, Artificial Sequence
  Description of Artificial Sequence: Synthetic peptide
DEEEIRCTNPVATEVYGVASTNLQRGNR

SEQ ID NO: 16410 - protein, 28 aa, Artificial Sequence
  Description of Artificial Sequence: Synthetic peptide
DEEEIRTTNPVATECYGSVSTDLQLGNT

SEQ ID NO: 16411 - protein, 28 aa, Artificial Sequence
  Description of Artificial Sequence: Synthetic peptide
DENEIVTTNPVATEMYGVVSTNLQRGNR

SEQ ID NO: 16412 - protein, 29 aa, Artificial Sequence
  Description of Artificial Sequence: Synthetic peptide
DDDEIRTTNPVATEQYGSVSTNFQREGNR

SEQ ID NO: 16413 - protein, 31 aa, Artificial Sequence
  Description of Artificial Sequence: Synthetic polypeptide
DEEEIRTTNPVATEQYGSVSETNLPQERENR

SEQ ID NO: 16414 - protein, 30 aa, Artificial Sequence
  Description of Artificial Sequence: Synthetic polypeptide
DEMEIRTTNPVATEQYGSVSTWNWQRGANR

SEQ ID NO: 16415 - protein, 29 aa, Artificial Sequence
  Description of Artificial Sequence: Synthetic peptide
NEEEIRTTNPTATMQYGSVSTNLQDRGNR

SEQ ID NO: 16416 - protein, 28 aa, Artificial Sequence
  Description of Artificial Sequence: Synthetic peptide
DEEEIRTTNPVATEQYGSVETPDQLGNR

SEQ ID NO: 16417 - protein, 28 aa, Artificial Sequence
  Description of Artificial Sequence: Synthetic peptide
DEEEIRATNIVATEQYGSVSTNLQRGMI

SEQ ID NO: 16418 - protein, 28 aa, Artificial Sequence
  Description of Artificial Sequence: Synthetic peptide
DDEEIRTTNPVATEQYGSVATNLQSGDR

SEQ ID NO: 16419 - protein, 28 aa, Artificial Sequence
  Description of Artificial Sequence: Synthetic peptide
DEEEIRTTNPVATEQYGSVETNLDTGNA

SEQ ID NO: 16420 - protein, 28 aa, Artificial Sequence
  Description of Artificial Sequence: Synthetic peptide
KEEEIRTTNIVATEQYGSVSTDLQMGNR

SEQ ID NO: 16421 - protein, 28 aa, Artificial Sequence
  Description of Artificial Sequence: Synthetic peptide
DENEIRQTNPVATEQYGSVSTNLQNGNA

SEQ ID NO: 16422 - protein, 28 aa, Artificial Sequence
  Description of Artificial Sequence: Synthetic peptide
DENEIRTTNPVATECYGSVSTNLQHGNL

SEQ ID NO: 16423 - protein, 28 aa, Artificial Sequence
  Description of Artificial Sequence: Synthetic peptide
DEEEIRCTNPVATECYGVVSTNLQRGNF

SEQ ID NO: 16424 - protein, 28 aa, Artificial Sequence
  Description of Artificial Sequence: Synthetic peptide
DEDEIATTNPVATEQYGSVSTVLQRGGR

SEQ ID NO: 16425 - protein, 29 aa, Artificial Sequence
  Description of Artificial Sequence: Synthetic peptide
DEEEIRTTNPVATEQYGSVDTMNEQRGND

SEQ ID NO: 16426 - protein, 28 aa, Artificial Sequence
  Description of Artificial Sequence: Synthetic peptide
SEEEIRTTNPYATEQWGSVSTNEQRGNR

SEQ ID NO: 16427 - protein, 31 aa, Artificial Sequence
  Description of Artificial Sequence: Synthetic polypeptide
DEEEIRTTNPVATEQYGSVCSTNPLQRNGDR

SEQ ID NO: 16428 - protein, 28 aa, Artificial Sequence
  Description of Artificial Sequence: Synthetic peptide
DEEEIRTTNPVATEQYGWVSENLQRFNS

SEQ ID NO: 16429 - protein, 28 aa, Artificial Sequence
  Description of Artificial Sequence: Synthetic peptide
DEQEIATTNPVATEQYGSVSENLMRGNR

SEQ ID NO: 16430 - protein, 30 aa, Artificial Sequence
  Description of Artificial Sequence: Synthetic polypeptide
DEEEIRTTNPVATEQYGSYVSLTNGQRGQR

SEQ ID NO: 16431 - protein, 29 aa, Artificial Sequence
  Description of Artificial Sequence: Synthetic peptide
DEEEIRTTNPVASEVYGCVSTNLQRNGNR

SEQ ID NO: 16432 - protein, 28 aa, Artificial Sequence
  Description of Artificial Sequence: Synthetic peptide
DEQEIATTNPVATECYGSVSTNLERGNR

SEQ ID NO: 16433 - protein, 28 aa, Artificial Sequence
  Description of Artificial Sequence: Synthetic peptide
DEEEIRTVNPCATEQYGSVSTNLQAMNR

SEQ ID NO: 16434 - protein, 29 aa, Artificial Sequence
  Description of Artificial Sequence: Synthetic peptide
DEEEIRTTNPVATECYGSVSTNLQIGNDD

SEQ ID NO: 16435 - protein, 28 aa, Artificial Sequence
  Description of Artificial Sequence: Synthetic peptide
DEEEIAATNPVATEMYGWVSTNLQRGNR

SEQ ID NO: 16436 - protein, 28 aa, Artificial Sequence
  Description of Artificial Sequence: Synthetic peptide
DEEEIRTTNPVATECYGSVDTNLQQGNW

SEQ ID NO: 16437 - protein, 28 aa, Artificial Sequence
  Description of Artificial Sequence: Synthetic peptide
QEEEIRQTNPVATEQFGSVSTNLQRENR

SEQ ID NO: 16438 - protein, 28 aa, Artificial Sequence
  Description of Artificial Sequence: Synthetic peptide
DEDEIRQTNPVATEQYGSAATNLQRGNR

SEQ ID NO: 16439 - protein, 28 aa, Artificial Sequence
  Description of Artificial Sequence: Synthetic peptide
DEEEIVTTNPVATEMYGSVSTNLQQGNP

SEQ ID NO: 16440 - protein, 29 aa, Artificial Sequence
  Description of Artificial Sequence: Synthetic peptide
DEEEIRATNPVATELYGSVSTNLPQRGNF

SEQ ID NO: 16441 - protein, 30 aa, Artificial Sequence
  Description of Artificial Sequence: Synthetic polypeptide
DEAEIRTTNPVATEQYGSVKSTDNLQSGNR

SEQ ID NO: 16442 - protein, 28 aa, Artificial Sequence
  Description of Artificial Sequence: Synthetic peptide
DEEEIRTTNIVATEQYGSVGTNLERGNS

SEQ ID NO: 16443 - protein, 28 aa, Artificial Sequence
  Description of Artificial Sequence: Synthetic peptide
DEEEIRTTNPEATEHYGSVSTNLQLGNF

SEQ ID NO: 16444 - protein, 28 aa, Artificial Sequence
  Description of Artificial Sequence: Synthetic peptide
DDEEIRTTNPIATECYGSVSTNLQVGNR

SEQ ID NO: 16445 - protein, 28 aa, Artificial Sequence
  Description of Artificial Sequence: Synthetic peptide
DEEEIRTTNIVASEQWGSVSTNLQRGER

SEQ ID NO: 16446 - protein, 29 aa, Artificial Sequence
  Description of Artificial Sequence: Synthetic peptide
MEEEIRTTNPVATEQYGSVSTNLQENGNM

SEQ ID NO: 16447 - protein, 28 aa, Artificial Sequence
  Description of Artificial Sequence: Synthetic peptide
VEEEIRTTNPDATEQYGSVSTNLQRPNP

SEQ ID NO: 16448 - protein, 28 aa, Artificial Sequence
  Description of Artificial Sequence: Synthetic peptide
DEEEIRTTNPVATEQYGSVSTDLQVGEM

SEQ ID NO: 16449 - protein, 28 aa, Artificial Sequence
  Description of Artificial Sequence: Synthetic peptide
DEEEIRTTNPVCCEQYGSVSENLQRENR

SEQ ID NO: 16450 - protein, 28 aa, Artificial Sequence
  Description of Artificial Sequence: Synthetic peptide
DEEEIRQTNPVATEQYGAVGDNLQRGNR

SEQ ID NO: 16451 - protein, 28 aa, Artificial Sequence
  Description of Artificial Sequence: Synthetic peptide
DEEEIRTTNPVATEQYGSVDTELQVGNS

SEQ ID NO: 16452 - protein, 28 aa, Artificial Sequence
  Description of Artificial Sequence: Synthetic peptide
DEEEIATTNPVATEQYGSVSTDLEHGNR

SEQ ID NO: 16453 - protein, 30 aa, Artificial Sequence
  Description of Artificial Sequence: Synthetic polypeptide
DEEEIRTTNPVATETYGSVDSTNLQEVGNR

SEQ ID NO: 16454 - protein, 28 aa, Artificial Sequence
  Description of Artificial Sequence: Synthetic peptide
DEEEIRTTNPVATEQYGEVMTNLQYGNS

SEQ ID NO: 16455 - protein, 31 aa, Artificial Sequence
  Description of Artificial Sequence: Synthetic polypeptide
DEEEIRTTNPVATEQYGSVSTNLQVFKGVNR

SEQ ID NO: 16456 - protein, 30 aa, Artificial Sequence
  Description of Artificial Sequence: Synthetic polypeptide
DEEEIRTTNPVATEQYGSWSITNLEREGNR

SEQ ID NO: 16457 - protein, 28 aa, Artificial Sequence
  Description of Artificial Sequence: Synthetic peptide
DEEEIRTTNPVATEQYGSVETPDERGNR

SEQ ID NO: 16458 - protein, 30 aa, Artificial Sequence
  Description of Artificial Sequence: Synthetic polypeptide
DEEEIRTTNPVATEQYGSVSITNPQGGNPR

SEQ ID NO: 16459 - protein, 29 aa, Artificial Sequence
  Description of Artificial Sequence: Synthetic peptide
DEEELRTTNPVATEQYGSVSEMNLQLGNR

SEQ ID NO: 16460 - protein, 28 aa, Artificial Sequence
  Description of Artificial Sequence: Synthetic peptide
DEDEIRTTNPVATEQYGSVSMNLQHGNE

SEQ ID NO: 16461 - protein, 28 aa, Artificial Sequence
  Description of Artificial Sequence: Synthetic peptide
SEEEIRATNIVATEQYGSVSTNDQRGNR

SEQ ID NO: 16462 - protein, 29 aa, Artificial Sequence
  Description of Artificial Sequence: Synthetic peptide
NENEIRTTNPVATEQYGSVSATNLQRGER

SEQ ID NO: 16463 - protein, 29 aa, Artificial Sequence
  Description of Artificial Sequence: Synthetic peptide
DEEEIRTTNPVATEQYGGVSTNDQRGENS

SEQ ID NO: 16464 - protein, 29 aa, Artificial Sequence
  Description of Artificial Sequence: Synthetic peptide
DEEEIATTNPVATEQYGSVSTNLQLHGNF

SEQ ID NO: 16465 - protein, 28 aa, Artificial Sequence
  Description of Artificial Sequence: Synthetic peptide
DENEIRTTNPVATEQYGDVSTNLQRFAR

SEQ ID NO: 16466 - protein, 30 aa, Artificial Sequence
  Description of Artificial Sequence: Synthetic polypeptide
DEEEIRTTNPVATEQYGSVSTNLQDVGNDQ

SEQ ID NO: 16467 - protein, 28 aa, Artificial Sequence
  Description of Artificial Sequence: Synthetic peptide
DEEEIRQTNPVATEQYGSVSTCLQRGEQ

SEQ ID NO: 16468 - protein, 28 aa, Artificial Sequence
  Description of Artificial Sequence: Synthetic peptide
DEEEIRTTNPVATEQYGSVSTDLQDGED

SEQ ID NO: 16469 - protein, 28 aa, Artificial Sequence
  Description of Artificial Sequence: Synthetic peptide
DEEEIRTTNPVATEVYGFVSENLQRGNL

SEQ ID NO: 16470 - protein, 31 aa, Artificial Sequence
  Description of Artificial Sequence: Synthetic polypeptide
DEEEIRTTNPVATEQYGSVTAETNLQIRGNR

SEQ ID NO: 16471 - protein, 30 aa, Artificial Sequence
  Description of Artificial Sequence: Synthetic polypeptide
DEEEIRTTNPVATEQYGSVSTNLQDNGNDF

SEQ ID NO: 16472 - protein, 28 aa, Artificial Sequence
  Description of Artificial Sequence: Synthetic peptide
DEEEIRTTNPVATEQYGSVDTDLQGGND

SEQ ID NO: 16473 - protein, 28 aa, Artificial Sequence
  Description of Artificial Sequence: Synthetic peptide
DEEEINTTNPVGTEQYGSCSENLQRGNR

SEQ ID NO: 16474 - protein, 28 aa, Artificial Sequence
  Description of Artificial Sequence: Synthetic peptide
DEEEIRTTNIVATEQYGSVSENLQQGNY

SEQ ID NO: 16475 - protein, 28 aa, Artificial Sequence
  Description of Artificial Sequence: Synthetic peptide
DEEEIMTTNPVGTEQYGSVSTNLQLGNQ

SEQ ID NO: 16476 - protein, 29 aa, Artificial Sequence
  Description of Artificial Sequence: Synthetic peptide
DEEEIRTTNPIATEQYGSVSTNLQPEPNR

SEQ ID NO: 16477 - protein, 28 aa, Artificial Sequence
  Description of Artificial Sequence: Synthetic peptide
DEEEIRTTNPVATECYGSVSTDLQSGNS

SEQ ID NO: 16478 - protein, 28 aa, Artificial Sequence
  Description of Artificial Sequence: Synthetic peptide
DEEEIRTTNPVAIEQYGSVSEDLQIGNR

SEQ ID NO: 16479 - protein, 28 aa, Artificial Sequence
  Description of Artificial Sequence: Synthetic peptide
DEEEIRTTNIVATEQYGSVSTNLMRGES

SEQ ID NO: 16480 - protein, 28 aa, Artificial Sequence
  Description of Artificial Sequence: Synthetic peptide
DESEIRTTNPVATCQYGSVSENLQRGNM

SEQ ID NO: 16481 - protein, 30 aa, Artificial Sequence
  Description of Artificial Sequence: Synthetic polypeptide
DEEEIRTTNPVATEHYGVSAVSTLLQRGNR

SEQ ID NO: 16482 - protein, 30 aa, Artificial Sequence
  Description of Artificial Sequence: Synthetic polypeptide
QEEEIRTTNPVATEQYGSVCSENLQRAGNR

SEQ ID NO: 16483 - protein, 28 aa, Artificial Sequence
  Description of Artificial Sequence: Synthetic peptide
NEEEIRTTNPVATELYGSVSENLQRLNR

SEQ ID NO: 16484 - protein, 28 aa, Artificial Sequence
  Description of Artificial Sequence: Synthetic peptide
DENEIRTTNPVATEQWGSVSTNEMRGNR

SEQ ID NO: 16485 - protein, 29 aa, Artificial Sequence
  Description of Artificial Sequence: Synthetic peptide
DEDEIRTTNPVATEQYGDVSTNLQRGNDY

SEQ ID NO: 16486 - protein, 28 aa, Artificial Sequence
  Description of Artificial Sequence: Synthetic peptide
DEEEIKTTNPVATEQYGSVDTNLERGNQ

SEQ ID NO: 16487 - protein, 30 aa, Artificial Sequence
  Description of Artificial Sequence: Synthetic polypeptide
DEEEIRTTNPVGTEQYGSVDSTNLQERGNS

SEQ ID NO: 16488 - protein, 28 aa, Artificial Sequence
  Description of Artificial Sequence: Synthetic peptide
DEQEIRTTNPVATEQYGSVSEELQRENR

SEQ ID NO: 16489 - protein, 28 aa, Artificial Sequence
  Description of Artificial Sequence: Synthetic peptide
DEEEIRTTNPVATEQYGSVETNDQHGER

SEQ ID NO: 16490 - protein, 28 aa, Artificial Sequence
  Description of Artificial Sequence: Synthetic peptide
DEEEIRTTNPVATEQYGCVSTDWQFGNR

SEQ ID NO: 16491 - protein, 28 aa, Artificial Sequence
  Description of Artificial Sequence: Synthetic peptide
DEAEIRATNPVATEQYGSCSTNLQRGMR

SEQ ID NO: 16492 - protein, 30 aa, Artificial Sequence
  Description of Artificial Sequence: Synthetic polypeptide
DEEEIRTTNPVATEQWGHVSVTNLNQRGNR

SEQ ID NO: 16493 - protein, 28 aa, Artificial Sequence
  Description of Artificial Sequence: Synthetic peptide
DEEEIRCTNPVATELYGSVSTNWQFGNR

SEQ ID NO: 16494 - protein, 28 aa, Artificial Sequence
  Description of Artificial Sequence: Synthetic peptide
DEEEIRTTNPTATEMYGSVSTNEQRGTR

SEQ ID NO: 16495 - protein, 29 aa, Artificial Sequence
  Description of Artificial Sequence: Synthetic peptide
DEHEIRTTNPCATEQYGSVSTNLQQRGNA

SEQ ID NO: 16496 - protein, 28 aa, Artificial Sequence
  Description of Artificial Sequence: Synthetic peptide
DEEEIRTTNPVATEQYGSVSTVLQGGTA

SEQ ID NO: 16497 - protein, 29 aa, Artificial Sequence
  Description of Artificial Sequence: Synthetic peptide
DEEEIRTTNPVATEQYGSVSCENLQHGNL

SEQ ID NO: 16498 - protein, 28 aa, Artificial Sequence
  Description of Artificial Sequence: Synthetic peptide
DEEEIRTTNPVATECYGSVSDNWQVGNR

SEQ ID NO: 16499 - protein, 28 aa, Artificial Sequence
  Description of Artificial Sequence: Synthetic peptide
DEEEIRTTNPVATEQYGIVSYNLMRGNQ

SEQ ID NO: 16500 - protein, 28 aa, Artificial Sequence
  Description of Artificial Sequence: Synthetic peptide
DEEEIRTTNIVSTEQYGSVSENLQNGNR

SEQ ID NO: 16501 - protein, 28 aa, Artificial Sequence
  Description of Artificial Sequence: Synthetic peptide
GEEEIRTTNPVATEQYGSVSTNAERGKR

SEQ ID NO: 16502 - protein, 28 aa, Artificial Sequence
  Description of Artificial Sequence: Synthetic peptide
DEEEIRTTNPVATECYGSVSTNLQYGEW

SEQ ID NO: 16503 - protein, 28 aa, Artificial Sequence
  Description of Artificial Sequence: Synthetic peptide
DENEIATTNPVATEQYGEVSENLQRGNR

SEQ ID NO: 16504 - protein, 28 aa, Artificial Sequence
  Description of Artificial Sequence: Synthetic peptide
DEEEICTTNPVASEQYGSVSTNLERGND

SEQ ID NO: 16505 - protein, 28 aa, Artificial Sequence
  Description of Artificial Sequence: Synthetic peptide
DENEIRTTNPVATEQWGSVSTNLMIGNR

SEQ ID NO: 16506 - protein, 29 aa, Artificial Sequence
  Description of Artificial Sequence: Synthetic peptide
DEEEIRTTNPVATEQYGSVSTNLDYGENE

SEQ ID NO: 16507 - protein, 29 aa, Artificial Sequence
  Description of Artificial Sequence: Synthetic peptide
DEEEIRTTNPVATEQWGSVSTNLMMQGNR

SEQ ID NO: 16508 - protein, 28 aa, Artificial Sequence
  Description of Artificial Sequence: Synthetic peptide
DEEEIRTTNPVATEQYGSVSTNPQTGEM

SEQ ID NO: 16509 - protein, 28 aa, Artificial Sequence
  Description of Artificial Sequence: Synthetic peptide
DEVEIRTTNPVATECYGSVNTNEQRGNR

SEQ ID NO: 16510 - protein, 28 aa, Artificial Sequence
  Description of Artificial Sequence: Synthetic peptide
DEEEISTTNPTATEQYGSVSTNLQFGNG

SEQ ID NO: 16511 - protein, 28 aa, Artificial Sequence
  Description of Artificial Sequence: Synthetic peptide
DEEEIRTTNIVATEQYGSVSTNLEQGNI

SEQ ID NO: 16512 - protein, 29 aa, Artificial Sequence
  Description of Artificial Sequence: Synthetic peptide
DEEEIRTTNPTATEQYGSVSAANLQRGPR

SEQ ID NO: 16513 - protein, 28 aa, Artificial Sequence
  Description of Artificial Sequence: Synthetic peptide
GENEIRTTNPVATEQYGSVSTNEQRGNM

SEQ ID NO: 16514 - protein, 28 aa, Artificial Sequence
  Description of Artificial Sequence: Synthetic peptide
DEEEIRTTNPVATEQYGSVDTDLQLGNE

SEQ ID NO: 16515 - protein, 28 aa, Artificial Sequence
  Description of Artificial Sequence: Synthetic peptide
DEGEIATTNPVATELYGSVSTNLQRGNH

SEQ ID NO: 16516 - protein, 28 aa, Artificial Sequence
  Description of Artificial Sequence: Synthetic peptide
DDEEIRTTNPVATEQYGSVSTDLDRGNH

SEQ ID NO: 16517 - protein, 30 aa, Artificial Sequence
  Description of Artificial Sequence: Synthetic polypeptide
DEEEIRTTNPVATEQYGSVSTNPLQADGER

SEQ ID NO: 16518 - protein, 28 aa, Artificial Sequence
  Description of Artificial Sequence: Synthetic peptide
DEEEIRTTNPVATEQYGSVSTPDQVGNN

SEQ ID NO: 16519 - protein, 32 aa, Artificial Sequence
  Description of Artificial Sequence: Synthetic polypeptide
DEEEIRTTNPVATEQYGSVDSDTNLQDRDGNR

SEQ ID NO: 16520 - protein, 28 aa, Artificial Sequence
  Description of Artificial Sequence: Synthetic peptide
DEEEIRTTNPVATEQYGSVDTDLQVGNN

SEQ ID NO: 16521 - protein, 28 aa, Artificial Sequence
  Description of Artificial Sequence: Synthetic peptide
DEEEIRTTNPVATEQYGSVSTPLEEGNV

SEQ ID NO: 16522 - protein, 28 aa, Artificial Sequence
  Description of Artificial Sequence: Synthetic peptide
DEEEIRTTNIVATEQYGSVSDNLQRGEI

SEQ ID NO: 16523 - protein, 28 aa, Artificial Sequence
  Description of Artificial Sequence: Synthetic peptide
DEEEIATTNPVATEQYGSVSTNEQNGNQ

SEQ ID NO: 16524 - protein, 28 aa, Artificial Sequence
  Description of Artificial Sequence: Synthetic peptide
DEEEIRTTNPDATEQYGSVSTADQRGNS

SEQ ID NO: 16525 - protein, 30 aa, Artificial Sequence
  Description of Artificial Sequence: Synthetic polypeptide
DEEEIRTTNPVATEQYGESVSTGNLQFGDR

SEQ ID NO: 16526 - protein, 30 aa, Artificial Sequence
  Description of Artificial Sequence: Synthetic polypeptide
DEEEIRTTNPTATEQYGSVSAENLQREGNR

SEQ ID NO: 16527 - protein, 28 aa, Artificial Sequence
  Description of Artificial Sequence: Synthetic peptide
DEVEIRTTNPVATEQYGGVSTNLQQGNF

SEQ ID NO: 16528 - protein, 30 aa, Artificial Sequence
  Description of Artificial Sequence: Synthetic polypeptide
DEEEIRTTNPVATEQYGSVSTNLQEVGNDS

SEQ ID NO: 16529 - protein, 28 aa, Artificial Sequence
  Description of Artificial Sequence: Synthetic peptide
DEEEIRQTNPVATENYGVVSTNLQRGGR

SEQ ID NO: 16530 - protein, 28 aa, Artificial Sequence
  Description of Artificial Sequence: Synthetic peptide
DEEEIATTNPVATEQYGSSSTDLQRGNA

SEQ ID NO: 16531 - protein, 28 aa, Artificial Sequence
  Description of Artificial Sequence: Synthetic peptide
DEEEIRTTNPVATEQYGSVDTELQYGNE

SEQ ID NO: 16532 - protein, 28 aa, Artificial Sequence
  Description of Artificial Sequence: Synthetic peptide
DEEEIRTTNPCCTEQYGSVSTNLQNGNQ

SEQ ID NO: 16533 - protein, 28 aa, Artificial Sequence
  Description of Artificial Sequence: Synthetic peptide
DECEIRTTNPVATEQYGGVSENLQRGPR

SEQ ID NO: 16534 - protein, 29 aa, Artificial Sequence
  Description of Artificial Sequence: Synthetic peptide
DEVEIRTTNPVATEFYGSVISTNLQQGNR

SEQ ID NO: 16535 - protein, 29 aa, Artificial Sequence
  Description of Artificial Sequence: Synthetic peptide
NEEEIRTTNPCATEQYGSVDCTNLQRGNR

SEQ ID NO: 16536 - protein, 30 aa, Artificial Sequence
  Description of Artificial Sequence: Synthetic polypeptide
DEEEIRQTNPVATEQYGSVSVTNLQRGNDT

SEQ ID NO: 16537 - protein, 28 aa, Artificial Sequence
  Description of Artificial Sequence: Synthetic peptide
DEEEIATTNIVATEQYGDVSTNLDRGNR

SEQ ID NO: 16538 - protein, 28 aa, Artificial Sequence
  Description of Artificial Sequence: Synthetic peptide
DDEEIRTTNPVATEQYGSCSDNLQRGMR

SEQ ID NO: 16539 - protein, 28 aa, Artificial Sequence
  Description of Artificial Sequence: Synthetic peptide
DEEEIRTTNPAATEIYGSVSTNPQRGNF

SEQ ID NO: 16540 - protein, 28 aa, Artificial Sequence
  Description of Artificial Sequence: Synthetic peptide
DEEEIRCTNPVASEQYGSVSNNLERGNR

SEQ ID NO: 16541 - protein, 28 aa, Artificial Sequence
  Description of Artificial Sequence: Synthetic peptide
DEEEIRTTNIVATEQYGSVSDNLQRGGG

SEQ ID NO: 16542 - protein, 28 aa, Artificial Sequence
  Description of Artificial Sequence: Synthetic peptide
DEEEIRTTNIVATEQYGSVSTELDRGNT

SEQ ID NO: 16543 - protein, 28 aa, Artificial Sequence
  Description of Artificial Sequence: Synthetic peptide
DEEEIATTNPVATEMYGSVSENLQRGGR

SEQ ID NO: 16544 - protein, 28 aa, Artificial Sequence
  Description of Artificial Sequence: Synthetic peptide
AEEEIRTTNIVATEQYGSVSTNLMIGNR

SEQ ID NO: 16545 - protein, 28 aa, Artificial Sequence
  Description of Artificial Sequence: Synthetic peptide
DEGEIRTTNIVATEQYGSVSTNLDHGNR

SEQ ID NO: 16546 - protein, 30 aa, Artificial Sequence
  Description of Artificial Sequence: Synthetic polypeptide
DEEEIRTTNPVATEQYGSVSTIDLQRKGNS

SEQ ID NO: 16547 - protein, 28 aa, Artificial Sequence
  Description of Artificial Sequence: Synthetic peptide
DEDEIRTTNPVATEQYGSVSECLQRGND

SEQ ID NO: 16548 - protein, 28 aa, Artificial Sequence
  Description of Artificial Sequence: Synthetic peptide
DEEEIRTVNPVATEQYGEVSDNLQGGNR

SEQ ID NO: 16549 - protein, 31 aa, Artificial Sequence
  Description of Artificial Sequence: Synthetic polypeptide
DEEEIRTTNPVATEPYGSFVVSTMNLQRGNR

SEQ ID NO: 16550 - protein, 28 aa, Artificial Sequence
  Description of Artificial Sequence: Synthetic peptide
DEEEIRTTNPDATEQYGSVSTNLTSGER

SEQ ID NO: 16551 - protein, 28 aa, Artificial Sequence
  Description of Artificial Sequence: Synthetic peptide
KEEEIRTTNPVATEQYGSMSTNLQTGNL

SEQ ID NO: 16552 - protein, 28 aa, Artificial Sequence
  Description of Artificial Sequence: Synthetic peptide
DEEEIRTTNIVATEQYGSVSTDDQRGNA

SEQ ID NO: 16553 - protein, 28 aa, Artificial Sequence
  Description of Artificial Sequence: Synthetic peptide
DENEIATTNPVATEQYGSVSTDLERGNR

SEQ ID NO: 16554 - protein, 29 aa, Artificial Sequence
  Description of Artificial Sequence: Synthetic peptide
DEEEIRTTNPVATEQYGSASTDLQHFGNR

SEQ ID NO: 16555 - protein, 28 aa, Artificial Sequence
  Description of Artificial Sequence: Synthetic peptide
DEEEIRTTNPVAWEQYGIVSDNLNRGNR

SEQ ID NO: 16556 - protein, 30 aa, Artificial Sequence
  Description of Artificial Sequence: Synthetic polypeptide
DEEEIRTTNPVATEQYGSVDSETNLEDGNR

SEQ ID NO: 16557 - protein, 29 aa, Artificial Sequence
  Description of Artificial Sequence: Synthetic peptide
DENEIRTTNPVATEMYGIVSTNLQRQGNR

SEQ ID NO: 16558 - protein, 28 aa, Artificial Sequence
  Description of Artificial Sequence: Synthetic peptide
DEEEIRATNIVSTEQYGVVSTNLQRGNR

SEQ ID NO: 16559 - protein, 32 aa, Artificial Sequence
  Description of Artificial Sequence: Synthetic polypeptide
DEEEIRTTNPVATEQYGSSVSTNLVQIRGNPR

SEQ ID NO: 16560 - protein, 28 aa, Artificial Sequence
  Description of Artificial Sequence: Synthetic peptide
DEEEIRTTNPVATEQFGSVSENLQRFDR

SEQ ID NO: 16561 - protein, 30 aa, Artificial Sequence
  Description of Artificial Sequence: Synthetic polypeptide
DEEEIRTTNPTATEQYGSVSTNEQLREGNR

SEQ ID NO: 16562 - protein, 28 aa, Artificial Sequence
  Description of Artificial Sequence: Synthetic peptide
QEEEIRTTNPVATEMYGSVSESLQRGNR

SEQ ID NO: 16563 - protein, 29 aa, Artificial Sequence
  Description of Artificial Sequence: Synthetic peptide
DEEEIRTTNPVATEQYGSVDTNEQFVGNR

SEQ ID NO: 16564 - protein, 28 aa, Artificial Sequence
  Description of Artificial Sequence: Synthetic peptide
DEEEIRCTNPVATEGYGEVSDNLQRGNR

SEQ ID NO: 16565 - protein, 28 aa, Artificial Sequence
  Description of Artificial Sequence: Synthetic peptide
DEEEIRTTNPVATEWYGSYSTNLQRGDM

SEQ ID NO: 16566 - protein, 29 aa, Artificial Sequence
  Description of Artificial Sequence: Synthetic peptide
DEEEIRTTNPVATEVYGSCSTQNLQRLNR

SEQ ID NO: 16567 - protein, 28 aa, Artificial Sequence
  Description of Artificial Sequence: Synthetic peptide
DEEEIRTTNPVAVEQYGSVSTNLHRGHV

SEQ ID NO: 16568 - protein, 29 aa, Artificial Sequence
  Description of Artificial Sequence: Synthetic peptide
DEEEISTTNPVATEQYGSVCSTNLQIGNF

SEQ ID NO: 16569 - protein, 32 aa, Artificial Sequence
  Description of Artificial Sequence: Synthetic polypeptide
DEEEIRTTNPVATEQYGSVSITENLQDRDGNR

SEQ ID NO: 16570 - protein, 30 aa, Artificial Sequence
  Description of Artificial Sequence: Synthetic polypeptide
DEEEIRTTNPVATEQYGSIVSTNLEEVGNR

SEQ ID NO: 16571 - protein, 28 aa, Artificial Sequence
  Description of Artificial Sequence: Synthetic peptide
DEEEIATTNPVATEQYGDASTNLQRGDR

SEQ ID NO: 16572 - protein, 29 aa, Artificial Sequence
  Description of Artificial Sequence: Synthetic peptide
DEHEIRTTNPVATEQYGSVSVMNIQRGNR

SEQ ID NO: 16573 - protein, 28 aa, Artificial Sequence
  Description of Artificial Sequence: Synthetic peptide
DDEEIRTTNPVSTEQYGSVCTNLQGGNR

SEQ ID NO: 16574 - protein, 28 aa, Artificial Sequence
  Description of Artificial Sequence: Synthetic peptide
YEEEIRTTNPVATDQYGSVSTNLQIGNV

SEQ ID NO: 16575 - protein, 28 aa, Artificial Sequence
  Description of Artificial Sequence: Synthetic peptide
DEEEIRCTNPVATEQYGSADTNLQTGNR

SEQ ID NO: 16576 - protein, 28 aa, Artificial Sequence
  Description of Artificial Sequence: Synthetic peptide
DEEEIRTTNPVATEQYGSVSTDLNRGEV

SEQ ID NO: 16577 - protein, 28 aa, Artificial Sequence
  Description of Artificial Sequence: Synthetic peptide
DEEEIRTTNPDATEQYGSVSTNLLRGDP

SEQ ID NO: 16578 - protein, 28 aa, Artificial Sequence
  Description of Artificial Sequence: Synthetic peptide
DEEEIRTVNPVATEQYGWVSTNIQHGNR

SEQ ID NO: 16579 - protein, 29 aa, Artificial Sequence
  Description of Artificial Sequence: Synthetic peptide
DCEEIRSTNPVATEQYGAVSTNLQRNGNR

SEQ ID NO: 16580 - protein, 28 aa, Artificial Sequence
  Description of Artificial Sequence: Synthetic peptide
DEEEIRTTNPVCSEHYGVVSTNLQRGNR

SEQ ID NO: 16581 - protein, 28 aa, Artificial Sequence
  Description of Artificial Sequence: Synthetic peptide
DEEEIRTTNPDATEQYGSVSTATQRGNP

SEQ ID NO: 16582 - protein, 30 aa, Artificial Sequence
  Description of Artificial Sequence: Synthetic polypeptide
DEEEIRTTNPVATEQYGSVSETDLQNGDNR

SEQ ID NO: 16583 - protein, 28 aa, Artificial Sequence
  Description of Artificial Sequence: Synthetic peptide
DEEEIRTTNIVATEQYGSASTNLMIGNR

SEQ ID NO: 16584 - protein, 30 aa, Artificial Sequence
  Description of Artificial Sequence: Synthetic polypeptide
DEEEIRTTNPIATEQYGAVSTENLQRGNYR

SEQ ID NO: 16585 - protein, 29 aa, Artificial Sequence
  Description of Artificial Sequence: Synthetic peptide
DEEEIRTTNPVATEQYGSVSTNLIARSNI

SEQ ID NO: 16586 - protein, 28 aa, Artificial Sequence
  Description of Artificial Sequence: Synthetic peptide
DEEEIRTTNPVATEQYGSVDMNEQRGER

SEQ ID NO: 16587 - protein, 28 aa, Artificial Sequence
  Description of Artificial Sequence: Synthetic peptide
DEDEIRTTNPVATEQYGSVPTVLQRENR

SEQ ID NO: 16588 - protein, 28 aa, Artificial Sequence
  Description of Artificial Sequence: Synthetic peptide
DEDEISTTNPVATEQYGSVSENLQRGNF

SEQ ID NO: 16589 - protein, 29 aa, Artificial Sequence
  Description of Artificial Sequence: Synthetic peptide
DEEEIRSTNPVATEQYGTVGATNLQRGNR

SEQ ID NO: 16590 - protein, 31 aa, Artificial Sequence
  Description of Artificial Sequence: Synthetic polypeptide
DEEEIRTTNPVATEVYGSVSTNGLQRGPNDR

SEQ ID NO: 16591 - protein, 28 aa, Artificial Sequence
  Description of Artificial Sequence: Synthetic peptide
DEEEIRTVNPVCTEQYGCVSTNLQRGNQ

SEQ ID NO: 16592 - protein, 28 aa, Artificial Sequence
  Description of Artificial Sequence: Synthetic peptide
QEEEIATTNPCATEQYGSLSTNLQRGNR

SEQ ID NO: 16593 - protein, 28 aa, Artificial Sequence
  Description of Artificial Sequence: Synthetic peptide
NEEEIRTTNPVATEQYGSVSTNLQADNA

SEQ ID NO: 16594 - protein, 28 aa, Artificial Sequence
  Description of Artificial Sequence: Synthetic peptide
KEEEIRTTNPVATEQYGSVSTDLQQGNT

SEQ ID NO: 16595 - protein, 28 aa, Artificial Sequence
  Description of Artificial Sequence: Synthetic peptide
DEEEIRTTNPVATEIYGSVSTNWQVGTR

SEQ ID NO: 16596 - protein, 28 aa, Artificial Sequence
  Description of Artificial Sequence: Synthetic peptide
DTEEIRTTNPVAFEQYGSVSTNEQEGNR

SEQ ID NO: 16597 - protein, 30 aa, Artificial Sequence
  Description of Artificial Sequence: Synthetic polypeptide
DEHEIRTTNPVATEQYGSVSTMNLQRNGTR

SEQ ID NO: 16598 - protein, 31 aa, Artificial Sequence
  Description of Artificial Sequence: Synthetic polypeptide
DEEEIRTTNPVATEQYGSVSLTQNLQRGNLI

SEQ ID NO: 16599 - protein, 29 aa, Artificial Sequence
  Description of Artificial Sequence: Synthetic peptide
DENEIRTTNPVATEQWGSVSENLQMRGNR

SEQ ID NO: 16600 - protein, 29 aa, Artificial Sequence
  Description of Artificial Sequence: Synthetic peptide
DEMEIRTTNPVATEQYGSVSTNLVERGDR

SEQ ID NO: 16601 - protein, 28 aa, Artificial Sequence
  Description of Artificial Sequence: Synthetic peptide
DEEAIRTTNPVATEQYGSWLTNLQRGND

SEQ ID NO: 16602 - protein, 30 aa, Artificial Sequence
  Description of Artificial Sequence: Synthetic polypeptide
DEVEIRTTNPVATEMYGSVSTMNLQDRGNR

SEQ ID NO: 16603 - protein, 29 aa, Artificial Sequence
  Description of Artificial Sequence: Synthetic peptide
DEEEIRTTNPVAWEQYGSVETPGLQRGNR

SEQ ID NO: 16604 - protein, 28 aa, Artificial Sequence
  Description of Artificial Sequence: Synthetic peptide
DEEEIRTTNPCASEVYGCVSTNLQRGNR

SEQ ID NO: 16605 - protein, 28 aa, Artificial Sequence
  Description of Artificial Sequence: Synthetic peptide
DEEEIRTTNIVCTETYGSVSTNLQRGER

SEQ ID NO: 16606 - protein, 31 aa, Artificial Sequence
  Description of Artificial Sequence: Synthetic polypeptide
DEEEIRTTNPVATEQYGSVSTYNLQMWGNDR

SEQ ID NO: 16607 - protein, 28 aa, Artificial Sequence
  Description of Artificial Sequence: Synthetic peptide
REEEIRTTNPTATEQYGSVSDNLQRGNQ

SEQ ID NO: 16608 - protein, 30 aa, Artificial Sequence
  Description of Artificial Sequence: Synthetic polypeptide
DEQEIRTTNPVATEVYGSVSATNLQRNGNR

SEQ ID NO: 16609 - protein, 28 aa, Artificial Sequence
  Description of Artificial Sequence: Synthetic peptide
QEEEIRTTNIVCTEQYGDVSTNLQRGNR

SEQ ID NO: 16610 - protein, 29 aa, Artificial Sequence
  Description of Artificial Sequence: Synthetic peptide
DDEEIRTTNPVATEVYGSVATNLQRGENR

SEQ ID NO: 16611 - protein, 30 aa, Artificial Sequence
  Description of Artificial Sequence: Synthetic polypeptide
DEEEIRSTNPVATEQYGSVSTNLEERGNDR

SEQ ID NO: 16612 - protein, 28 aa, Artificial Sequence
  Description of Artificial Sequence: Synthetic peptide
DEEEIRTVNPVATECYGSVSTNLQTGNQ

SEQ ID NO: 16613 - protein, 28 aa, Artificial Sequence
  Description of Artificial Sequence: Synthetic peptide
DEEEIRATNPVATEQWGIVSTNLQLGNR

SEQ ID NO: 16614 - protein, 29 aa, Artificial Sequence
  Description of Artificial Sequence: Synthetic peptide
DEECIRTTNPVATEQYGSVHTNLQRKENR

SEQ ID NO: 16615 - protein, 29 aa, Artificial Sequence
  Description of Artificial Sequence: Synthetic peptide
DEECIRTTNPFATEQYGSVSTNLWRDGNR

SEQ ID NO: 16616 - protein, 28 aa, Artificial Sequence
  Description of Artificial Sequence: Synthetic peptide
DEHEIATTNPVATEQYGSASTNLQHGNR

SEQ ID NO: 16617 - protein, 28 aa, Artificial Sequence
  Description of Artificial Sequence: Synthetic peptide
GEEEIRTTNPVATEVYGSVSMNLQRGNY

SEQ ID NO: 16618 - protein, 28 aa, Artificial Sequence
  Description of Artificial Sequence: Synthetic peptide
DEEEIATVNIVATEQYGSVGTNLQRGNR

SEQ ID NO: 16619 - protein, 30 aa, Artificial Sequence
  Description of Artificial Sequence: Synthetic polypeptide
DEEEIRTTNPVATEQYGSVDSTNLQDGDND

SEQ ID NO: 16620 - protein, 30 aa, Artificial Sequence
  Description of Artificial Sequence: Synthetic polypeptide
DEEEIRTTNPVATEQYGSVTENLQRGPNSR

SEQ ID NO: 16621 - protein, 28 aa, Artificial Sequence
  Description of Artificial Sequence: Synthetic peptide
DDEEISTTNPVATECYGSVSTNLQRGNI

SEQ ID NO: 16622 - protein, 29 aa, Artificial Sequence
  Description of Artificial Sequence: Synthetic peptide
NEEEIRATNPVATEQYGSVSTNLQTRGGR

SEQ ID NO: 16623 - protein, 28 aa, Artificial Sequence
  Description of Artificial Sequence: Synthetic peptide
DEEEIATTNPVATEQYGSVSTDLERGND

SEQ ID NO: 16624 - protein, 31 aa, Artificial Sequence
  Description of Artificial Sequence: Synthetic polypeptide
DEEEIRTTNPVATEQYGSVETMNLVQRGDNR

SEQ ID NO: 16625 - protein, 28 aa, Artificial Sequence
  Description of Artificial Sequence: Synthetic peptide
DEEEIATTNPVATEQYGSVSTNLQHGPQ

SEQ ID NO: 16626 - protein, 28 aa, Artificial Sequence
  Description of Artificial Sequence: Synthetic peptide
DEEEIRTTNPVATEQYGSVDTELQTGND

SEQ ID NO: 16627 - protein, 28 aa, Artificial Sequence
  Description of Artificial Sequence: Synthetic peptide
DEEEIRTTNPVATEQYGSVSTAPQDGNL

SEQ ID NO: 16628 - protein, 28 aa, Artificial Sequence
  Description of Artificial Sequence: Synthetic peptide
REEEIRTTNPVATEQYGSVSCILQRGER

SEQ ID NO: 16629 - protein, 28 aa, Artificial Sequence
  Description of Artificial Sequence: Synthetic peptide
DEEEIRTTNIVATHQYGSVSTNLQQGNF

SEQ ID NO: 16630 - protein, 31 aa, Artificial Sequence
  Description of Artificial Sequence: Synthetic polypeptide
DEEEIRTTNPVATEQYGSVSTNLQDREGNDM

SEQ ID NO: 16631 - protein, 31 aa, Artificial Sequence
  Description of Artificial Sequence: Synthetic polypeptide
DEEEIRTTNPVATEQYGSVSTTNLVQRGEND

SEQ ID NO: 16632 - protein, 31 aa, Artificial Sequence
  Description of Artificial Sequence: Synthetic polypeptide
DEEEIRTTNPVATEVYGSVSVTNLQERGENR

SEQ ID NO: 16633 - protein, 30 aa, Artificial Sequence
  Description of Artificial Sequence: Synthetic polypeptide
DEEEIRTTNPVATEQYGSVSTNLQEAGNDT

SEQ ID NO: 16634 - protein, 29 aa, Artificial Sequence
  Description of Artificial Sequence: Synthetic peptide
DEEEIRTTNPVATEQYGSVSTNLQELGEH

SEQ ID NO: 16635 - protein, 29 aa, Artificial Sequence
  Description of Artificial Sequence: Synthetic peptide
DEEEIRTTNPVATEQYGSVDTNLEMRGNQ

SEQ ID NO: 16636 - protein, 28 aa, Artificial Sequence
  Description of Artificial Sequence: Synthetic peptide
DEQEIRTTNPVATEQYGTVSTNLQNGNN

SEQ ID NO: 16637 - protein, 29 aa, Artificial Sequence
  Description of Artificial Sequence: Synthetic peptide
DEEEIATTNPVATEQYGSVSITNLQDGNH

SEQ ID NO: 16638 - protein, 28 aa, Artificial Sequence
  Description of Artificial Sequence: Synthetic peptide
SEEEIRQTNIVATEQYGSVSTNEQRGNR

SEQ ID NO: 16639 - protein, 28 aa, Artificial Sequence
  Description of Artificial Sequence: Synthetic peptide
DEEEIRTTNPVATEQYGSVDTELQNGNQ

SEQ ID NO: 16640 - protein, 28 aa, Artificial Sequence
  Description of Artificial Sequence: Synthetic peptide
DEEEIRQTNPVATEQYGSCATVLQRGNR

SEQ ID NO: 16641 - protein, 28 aa, Artificial Sequence
  Description of Artificial Sequence: Synthetic peptide
DEDEIRTTNIVATEQYGSVSMNLERGNR

SEQ ID NO: 16642 - protein, 30 aa, Artificial Sequence
  Description of Artificial Sequence: Synthetic polypeptide
DEEEIMTTNPVATEQYGSVSTANLQMRGNS

SEQ ID NO: 16643 - protein, 31 aa, Artificial Sequence
  Description of Artificial Sequence: Synthetic polypeptide
DEEEIRTTNPVATEQYGSVISTANLQREGNF

SEQ ID NO: 16644 - protein, 31 aa, Artificial Sequence
  Description of Artificial Sequence: Synthetic polypeptide
DEEEIRTTNPVATEQYGSVCSCTNLQVPGNR

SEQ ID NO: 16645 - protein, 28 aa, Artificial Sequence
  Description of Artificial Sequence: Synthetic peptide
DEEEIRTTNPDATEQYGSVSTNEERDNR

SEQ ID NO: 16646 - protein, 28 aa, Artificial Sequence
  Description of Artificial Sequence: Synthetic peptide
DEEEINATNIVATEQYGSVSTNLQRGTR

SEQ ID NO: 16647 - protein, 28 aa, Artificial Sequence
  Description of Artificial Sequence: Synthetic peptide
DEQEIRTTNIVATEQYGSVSTNLQRDNW

SEQ ID NO: 16648 - protein, 30 aa, Artificial Sequence
  Description of Artificial Sequence: Synthetic polypeptide
DEEEIRTTNPVATEQYGSVSTNLQETEGNF

SEQ ID NO: 16649 - protein, 29 aa, Artificial Sequence
  Description of Artificial Sequence: Synthetic peptide
DEEEIRTTNPVATEQYGSVSETELQLGDR

SEQ ID NO: 16650 - protein, 28 aa, Artificial Sequence
  Description of Artificial Sequence: Synthetic peptide
DEEEIRTTNIVATEIYGSVSTNIQVGNR

SEQ ID NO: 16651 - protein, 31 aa, Artificial Sequence
  Description of Artificial Sequence: Synthetic polypeptide
DEEEIRTTNPVATEQYGSVSCTNLQRDGNDC

SEQ ID NO: 16652 - protein, 28 aa, Artificial Sequence
  Description of Artificial Sequence: Synthetic peptide
DEEEISTTNPTATEQYGSVSENDQRGNR

SEQ ID NO: 16653 - protein, 28 aa, Artificial Sequence
  Description of Artificial Sequence: Synthetic peptide
DEEEIRQTNPVSTEQYGEVSTNLQRGLR

SEQ ID NO: 16654 - protein, 31 aa, Artificial Sequence
  Description of Artificial Sequence: Synthetic polypeptide
DEEEIRTTNPVATEQYGSVSTNLQEREGENQ

SEQ ID NO: 16655 - protein, 30 aa, Artificial Sequence
  Description of Artificial Sequence: Synthetic polypeptide
DEEEIRTTNPVATEQYGSVETNLQLQGDNR

SEQ ID NO: 16656 - protein, 30 aa, Artificial Sequence
  Description of Artificial Sequence: Synthetic polypeptide
DEEEIRTTNPVATEQYGSVSTNLELVGNDR

SEQ ID NO: 16657 - protein, 30 aa, Artificial Sequence
  Description of Artificial Sequence: Synthetic polypeptide
AEEEIRTTNPVATEQYGSVESTDLQERGNR

SEQ ID NO: 16658 - protein, 28 aa, Artificial Sequence
  Description of Artificial Sequence: Synthetic peptide
DEQEIVTTNPVATEIYGVVSTNLQRGNR

SEQ ID NO: 16659 - protein, 29 aa, Artificial Sequence
  Description of Artificial Sequence: Synthetic peptide
DEEEIRTTNPVATEQYGSVSEMNLQQGNM

SEQ ID NO: 16660 - protein, 28 aa, Artificial Sequence
  Description of Artificial Sequence: Synthetic peptide
GEEEIRTTNPVATEQYGTMSTNLQRGNN

SEQ ID NO: 16661 - protein, 28 aa, Artificial Sequence
  Description of Artificial Sequence: Synthetic peptide
DEEEIAQTNPVATEQYGSVSENLQRGNA

SEQ ID NO: 16662 - protein, 30 aa, Artificial Sequence
  Description of Artificial Sequence: Synthetic polypeptide
DEEEIRTTNPVATEQYGSVSTMNLQHGNDQ

SEQ ID NO: 16663 - protein, 28 aa, Artificial Sequence
  Description of Artificial Sequence: Synthetic peptide
QEEEITTTNPVASEQYGSVSTNLQRGNI

SEQ ID NO: 16664 - protein, 30 aa, Artificial Sequence
  Description of Artificial Sequence: Synthetic polypeptide
DEMEIRTTNPVATEQYGSVSDNLQMRGTNR

SEQ ID NO: 16665 - protein, 31 aa, Artificial Sequence
  Description of Artificial Sequence: Synthetic polypeptide
DEEEIRTTNPVATEQYGESVDSTNLQRENDR

SEQ ID NO: 16666 - protein, 29 aa, Artificial Sequence
  Description of Artificial Sequence: Synthetic peptide
DEEEIRTTNPCATEQYGSVSCTNLQHGNQ

SEQ ID NO: 16667 - protein, 30 aa, Artificial Sequence
  Description of Artificial Sequence: Synthetic polypeptide
DEEEICTTNPVATEQYGSVISTNLQLNGNR

SEQ ID NO: 16668 - protein, 28 aa, Artificial Sequence
  Description of Artificial Sequence: Synthetic peptide
DEEEIRTTNPDATEQYGSVSNNLQTGNF

SEQ ID NO: 16669 - protein, 29 aa, Artificial Sequence
  Description of Artificial Sequence: Synthetic peptide
DEQEIRATNPVATEQYGVVSATNLQRGNR

SEQ ID NO: 16670 - protein, 28 aa, Artificial Sequence
  Description of Artificial Sequence: Synthetic peptide
QEEEIRTTNIVATEQYGSVSDNLQTGNR

SEQ ID NO: 16671 - protein, 29 aa, Artificial Sequence
  Description of Artificial Sequence: Synthetic peptide
DEEEIRSTNPVATELYGWVSTNLQRGNDR

SEQ ID NO: 16672 - protein, 29 aa, Artificial Sequence
  Description of Artificial Sequence: Synthetic peptide
DEEEIRTTNPVATEQYGSVSTDLQEQGER

SEQ ID NO: 16673 - protein, 28 aa, Artificial Sequence
  Description of Artificial Sequence: Synthetic peptide
DEEEISQTNPVATEQYGSVSTDLQRGNQ

SEQ ID NO: 16674 - protein, 28 aa, Artificial Sequence
  Description of Artificial Sequence: Synthetic peptide
MEEEIRTTNIVATEQYGSVSTNDQRGNG

SEQ ID NO: 16675 - protein, 29 aa, Artificial Sequence
  Description of Artificial Sequence: Synthetic peptide
DEEEIRTTNPVATEQYGSVETDDQRGDNR

SEQ ID NO: 16676 - protein, 28 aa, Artificial Sequence
  Description of Artificial Sequence: Synthetic peptide
DEEEIRTTNPVATEQYGSVDTDLQNGNA

SEQ ID NO: 16677 - protein, 28 aa, Artificial Sequence
  Description of Artificial Sequence: Synthetic peptide
DEEEIRTVNPVATEQYGTASTNLIRGNR

SEQ ID NO: 16678 - protein, 28 aa, Artificial Sequence
  Description of Artificial Sequence: Synthetic peptide
DESEITTTNPVATEQYGWVSTNQQRGNR

SEQ ID NO: 16679 - protein, 29 aa, Artificial Sequence
  Description of Artificial Sequence: Synthetic peptide
DEEEIRTTNPVATEQWGSVSTNEQIRGNA

SEQ ID NO: 16680 - protein, 28 aa, Artificial Sequence
  Description of Artificial Sequence: Synthetic peptide
DEEEIATTNIFATELYGSVSTNLQRGNR

SEQ ID NO: 16681 - protein, 28 aa, Artificial Sequence
  Description of Artificial Sequence: Synthetic peptide
DEEEIRTTNPVATEQYGSVSTDDQLGER

SEQ ID NO: 16682 - protein, 30 aa, Artificial Sequence
  Description of Artificial Sequence: Synthetic polypeptide
DEEEIRTTNPVCTEQYGSVSTMNLQVSGNR

SEQ ID NO: 16683 - protein, 28 aa, Artificial Sequence
  Description of Artificial Sequence: Synthetic peptide
SEEEIRTTNPVATEVYGIVSTNLQGGNR

SEQ ID NO: 16684 - protein, 30 aa, Artificial Sequence
  Description of Artificial Sequence: Synthetic polypeptide
DEEEIRTTNPVATEQYGSVSTNLQDIGNDF

SEQ ID NO: 16685 - protein, 28 aa, Artificial Sequence
  Description of Artificial Sequence: Synthetic peptide
DEEEIRTTNPVATEIYGSVSTNLEMGNM

SEQ ID NO: 16686 - protein, 29 aa, Artificial Sequence
  Description of Artificial Sequence: Synthetic peptide
AEEEIRTTNPVATEQYGSVSTNLQQHENR

SEQ ID NO: 16687 - protein, 31 aa, Artificial Sequence
  Description of Artificial Sequence: Synthetic polypeptide
DEEEIRTTNPVATEQYGSVSSTLNLQRVENR

SEQ ID NO: 16688 - protein, 29 aa, Artificial Sequence
  Description of Artificial Sequence: Synthetic peptide
EEESIRTTNPVATEQYGSVYSTNLIRGNR

SEQ ID NO: 16689 - protein, 28 aa, Artificial Sequence
  Description of Artificial Sequence: Synthetic peptide
NDEEIRATNPVATEQYGSVSTNLQRGTR

SEQ ID NO: 16690 - protein, 28 aa, Artificial Sequence
  Description of Artificial Sequence: Synthetic peptide
DEEEIRTTNPDATEQYGSVSTNLEVGNS

SEQ ID NO: 16691 - protein, 28 aa, Artificial Sequence
  Description of Artificial Sequence: Synthetic peptide
DEEEIRTTNPDATEQYGSVSTPDQRGNL

SEQ ID NO: 16692 - protein, 28 aa, Artificial Sequence
  Description of Artificial Sequence: Synthetic peptide
DEEEIRTTNPVATEQYGSNSTNKQDGNP

SEQ ID NO: 16693 - protein, 29 aa, Artificial Sequence
  Description of Artificial Sequence: Synthetic peptide
DEEPIRTTNPVATEQYGDSVSTNLQRGSL

SEQ ID NO: 16694 - protein, 29 aa, Artificial Sequence
  Description of Artificial Sequence: Synthetic peptide
DEQEIRTTNPVATEQYGSVETNLQRNGER

SEQ ID NO: 16695 - protein, 28 aa, Artificial Sequence
  Description of Artificial Sequence: Synthetic peptide
DEEEIRTTNPVATECYGSVSENDQRGDR

SEQ ID NO: 16696 - protein, 28 aa, Artificial Sequence
  Description of Artificial Sequence: Synthetic peptide
DENEIRTTNPVATEQYGSVSDVLQRGMR

SEQ ID NO: 16697 - protein, 28 aa, Artificial Sequence
  Description of Artificial Sequence: Synthetic peptide
DEEEIRTTNPVATEQYGSVSEDLQQGND

SEQ ID NO: 16698 - protein, 29 aa, Artificial Sequence
  Description of Artificial Sequence: Synthetic peptide
DEEEIRTTNPVAHEQYGSVSNNLQDRGND

SEQ ID NO: 16699 - protein, 28 aa, Artificial Sequence
  Description of Artificial Sequence: Synthetic peptide
DEEEIWTTNPVATEGYGSVSTILQQGNR

SEQ ID NO: 16700 - protein, 30 aa, Artificial Sequence
  Description of Artificial Sequence: Synthetic polypeptide
DEEEIRTTNPVATECYGSVSTNLQITKGNR

SEQ ID NO: 16701 - protein, 31 aa, Artificial Sequence
  Description of Artificial Sequence: Synthetic polypeptide
DEQEIRTTNPVATEQYGESVSTENGLQRGNR

SEQ ID NO: 16702 - protein, 28 aa, Artificial Sequence
  Description of Artificial Sequence: Synthetic peptide
DEEEIRTTNPEATEQYGSVSTEEQRGER

SEQ ID NO: 16703 - protein, 28 aa, Artificial Sequence
  Description of Artificial Sequence: Synthetic peptide
DEEEIRTTNPEATEQYGSVSTNDQRGEA

SEQ ID NO: 16704 - protein, 28 aa, Artificial Sequence
  Description of Artificial Sequence: Synthetic peptide
KEEEIRTTNIVATEQYGSVSTELQNGNR

SEQ ID NO: 16705 - protein, 28 aa, Artificial Sequence
  Description of Artificial Sequence: Synthetic peptide
DEEEIRTTNPVATQCYGSVSTPLQDGNR

SEQ ID NO: 16706 - protein, 28 aa, Artificial Sequence
  Description of Artificial Sequence: Synthetic peptide
DEEEIRTVNIVATEQYGSVSTDLQRGNL

SEQ ID NO: 16707 - protein, 28 aa, Artificial Sequence
  Description of Artificial Sequence: Synthetic peptide
DEEEIRTTNPVATEQYGSVSTELEQGND

SEQ ID NO: 16708 - protein, 28 aa, Artificial Sequence
  Description of Artificial Sequence: Synthetic peptide
DEEEIRTTNPVATEWWGIVSTNLQRGNF

SEQ ID NO: 16709 - protein, 28 aa, Artificial Sequence
  Description of Artificial Sequence: Synthetic peptide
DEEEIRTTNPVANEQYGSVSTNLDRHNL

SEQ ID NO: 16710 - protein, 29 aa, Artificial Sequence
  Description of Artificial Sequence: Synthetic peptide
DEEEIRTTNPVATEQWGSVSENLQMRGNA

SEQ ID NO: 16711 - protein, 29 aa, Artificial Sequence
  Description of Artificial Sequence: Synthetic peptide
DEEEIRTTNPVATEQYGSVSCENLQYGNC

SEQ ID NO: 16712 - protein, 28 aa, Artificial Sequence
  Description of Artificial Sequence: Synthetic peptide
DEEEIRTTNIVATEQYGFVSENLERGNR

SEQ ID NO: 16713 - protein, 31 aa, Artificial Sequence
  Description of Artificial Sequence: Synthetic polypeptide
DEEEIRTTNPVATEQYGSVISTNPPQRGINR

SEQ ID NO: 16714 - protein, 28 aa, Artificial Sequence
  Description of Artificial Sequence: Synthetic peptide
DEEEIRTTNPVATECYGSVSTNLQVGED

SEQ ID NO: 16715 - protein, 28 aa, Artificial Sequence
  Description of Artificial Sequence: Synthetic peptide
NEEEIRTTNPVATEIYGVVSTNLQRLNR

SEQ ID NO: 16716 - protein, 28 aa, Artificial Sequence
  Description of Artificial Sequence: Synthetic peptide
DEEEIRTTNPVATEQYGSVSTGLEIGNM

SEQ ID NO: 16717 - protein, 31 aa, Artificial Sequence
  Description of Artificial Sequence: Synthetic polypeptide
DEEEIRTTNPVATEQYGSVSTINGQDRGPNR

SEQ ID NO: 16718 - protein, 30 aa, Artificial Sequence
  Description of Artificial Sequence: Synthetic polypeptide
DEEEIRTTNPVATEQYGSVETDNLIQRGNI

SEQ ID NO: 16719 - protein, 28 aa, Artificial Sequence
  Description of Artificial Sequence: Synthetic peptide
DEEEIRTTNPVATQQYGSVSHGDQRGNR

SEQ ID NO: 16720 - protein, 28 aa, Artificial Sequence
  Description of Artificial Sequence: Synthetic peptide
IEEEIKTTNPVATEQWGSVSSNLQRGNR

SEQ ID NO: 16721 - protein, 29 aa, Artificial Sequence
  Description of Artificial Sequence: Synthetic peptide
DEEEIRTTNPVATEQYGSVETNLQDHGNH

SEQ ID NO: 16722 - protein, 28 aa, Artificial Sequence
  Description of Artificial Sequence: Synthetic peptide
DEEEIRTTNPVATEQYGSVSTELQNGEQ

SEQ ID NO: 16723 - protein, 29 aa, Artificial Sequence
  Description of Artificial Sequence: Synthetic peptide
DEEEISTTNPVATEQYGSVSTELQEFGNR

SEQ ID NO: 16724 - protein, 29 aa, Artificial Sequence
  Description of Artificial Sequence: Synthetic peptide
DEEEIRTTNPVATEQYGSWSTNLNEGNER

SEQ ID NO: 16725 - protein, 28 aa, Artificial Sequence
  Description of Artificial Sequence: Synthetic peptide
DENEISTTNPVATEQYGSVSEQLQRGNR

SEQ ID NO: 16726 - protein, 28 aa, Artificial Sequence
  Description of Artificial Sequence: Synthetic peptide
DETEIRTTNIVATEQYGSVSENLQRGNI

SEQ ID NO: 16727 - protein, 29 aa, Artificial Sequence
  Description of Artificial Sequence: Synthetic peptide
DEEEIRTTNPVATEQYGSVSDNLEERGNT

SEQ ID NO: 16728 - protein, 28 aa, Artificial Sequence
  Description of Artificial Sequence: Synthetic peptide
DEEEIRCTNPVASEQYGSVSMNLERGNR

SEQ ID NO: 16729 - protein, 28 aa, Artificial Sequence
  Description of Artificial Sequence: Synthetic peptide
DEEEIRTTNPEATEQYGSVSTNEQMGNT

SEQ ID NO: 16730 - protein, 30 aa, Artificial Sequence
  Description of Artificial Sequence: Synthetic polypeptide
DEEEIRTTNPVATEQYGSVSTNLQEHGNDI

SEQ ID NO: 16731 - protein, 28 aa, Artificial Sequence
  Description of Artificial Sequence: Synthetic peptide
DEEEIATTNPVATEQYGAVSENLQRGNA

SEQ ID NO: 16732 - protein, 28 aa, Artificial Sequence
  Description of Artificial Sequence: Synthetic peptide
DENEIVTTNPVATEIYGVVSTNLQRGNR

SEQ ID NO: 16733 - protein, 28 aa, Artificial Sequence
  Description of Artificial Sequence: Synthetic peptide
DEEEIRTTNPVATEQYGSVDTNPQTGNW

SEQ ID NO: 16734 - protein, 32 aa, Artificial Sequence
  Description of Artificial Sequence: Synthetic polypeptide
DEEEIRTTNPVATEQYGSVISTNGLPQRGINR

SEQ ID NO: 16735 - protein, 28 aa, Artificial Sequence
  Description of Artificial Sequence: Synthetic peptide
DEEEIAATNPVATEQYGSVSTNEQIGNR

SEQ ID NO: 16736 - protein, 28 aa, Artificial Sequence
  Description of Artificial Sequence: Synthetic peptide
GEEEIRTTNPVATEQYGTVSCNLQHGNR

SEQ ID NO: 16737 - protein, 30 aa, Artificial Sequence
  Description of Artificial Sequence: Synthetic polypeptide
SEEEIRTTNPVATEQFGSVISTNLQRGDNR

SEQ ID NO: 16738 - protein, 28 aa, Artificial Sequence
  Description of Artificial Sequence: Synthetic peptide
DEEEIATTNPVATEMYGGVSTNLQQGNR

SEQ ID NO: 16739 - protein, 30 aa, Artificial Sequence
  Description of Artificial Sequence: Synthetic polypeptide
DEEEIRTTNPVATEQYGNVSSITNLQRGNL

SEQ ID NO: 16740 - protein, 28 aa, Artificial Sequence
  Description of Artificial Sequence: Synthetic peptide
QEEEIRTTNPVATEQYGEASTVLQRGNR

SEQ ID NO: 16741 - protein, 28 aa, Artificial Sequence
  Description of Artificial Sequence: Synthetic peptide
HEEEIRTTNPVATEQYGIASTNIQRGNR

SEQ ID NO: 16742 - protein, 28 aa, Artificial Sequence
  Description of Artificial Sequence: Synthetic peptide
GEEEIRTTNIVATEQYGSVSTNLQRGDD

SEQ ID NO: 16743 - protein, 31 aa, Artificial Sequence
  Description of Artificial Sequence: Synthetic polypeptide
DEEEIRTTNPVATEQYGESVSTDLQRGENDR

SEQ ID NO: 16744 - protein, 28 aa, Artificial Sequence
  Description of Artificial Sequence: Synthetic peptide
DEEEIRTTNPVATEQYGDASTELQHGNR

SEQ ID NO: 16745 - protein, 28 aa, Artificial Sequence
  Description of Artificial Sequence: Synthetic peptide
DEEEIRTTNIVATELYGGVSTNLQIGNR

SEQ ID NO: 16746 - protein, 28 aa, Artificial Sequence
  Description of Artificial Sequence: Synthetic peptide
DEQEIRTTNPVATEQYGSVSDNLQVGNA

SEQ ID NO: 16747 - protein, 30 aa, Artificial Sequence
  Description of Artificial Sequence: Synthetic polypeptide
DAEEIRTTNPVATEQYGSVSITTNLDRGNR

SEQ ID NO: 16748 - protein, 29 aa, Artificial Sequence
  Description of Artificial Sequence: Synthetic peptide
DECEIYTTNPVATEQYGSVSATVLQRGNR

SEQ ID NO: 16749 - protein, 29 aa, Artificial Sequence
  Description of Artificial Sequence: Synthetic peptide
DEEEIRTTNPVATEQYGSVSTNPQAQGNP

SEQ ID NO: 16750 - protein, 30 aa, Artificial Sequence
  Description of Artificial Sequence: Synthetic polypeptide
DEEEIRTTNPVATEQYGSVSTDLQDRGNDW

SEQ ID NO: 16751 - protein, 29 aa, Artificial Sequence
  Description of Artificial Sequence: Synthetic peptide
DEEEIATTNPVATEQYGSVSTDLQDRGER

SEQ ID NO: 16752 - protein, 30 aa, Artificial Sequence
  Description of Artificial Sequence: Synthetic polypeptide
DEEEIRTTNPVATEQYGSWSTNLERGENYR

SEQ ID NO: 16753 - protein, 28 aa, Artificial Sequence
  Description of Artificial Sequence: Synthetic peptide
DEEEICTTNPVATEQYGIASENLQRGNR

SEQ ID NO: 16754 - protein, 29 aa, Artificial Sequence
  Description of Artificial Sequence: Synthetic peptide
DEEEIRTTNPVATEQYGSVSTELQERGDW

SEQ ID NO: 16755 - protein, 28 aa, Artificial Sequence
  Description of Artificial Sequence: Synthetic peptide
DEEEIRTTNIVATETYGAVSENLQRGNR

SEQ ID NO: 16756 - protein, 30 aa, Artificial Sequence
  Description of Artificial Sequence: Synthetic polypeptide
MEEEIRTTNPVATEQYGSVSTNLQERGNDW

SEQ ID NO: 16757 - protein, 28 aa, Artificial Sequence
  Description of Artificial Sequence: Synthetic peptide
DEEEIRTTNPVATEWYGSVSTNEERGNF

SEQ ID NO: 16758 - protein, 28 aa, Artificial Sequence
  Description of Artificial Sequence: Synthetic peptide
DEEEIRCTNPVATEVFGSVSDNLQRGNR

SEQ ID NO: 16759 - protein, 28 aa, Artificial Sequence
  Description of Artificial Sequence: Synthetic peptide
DEEEIRTTNPVATECYGSVSTDLQRGEN

SEQ ID NO: 16760 - protein, 29 aa, Artificial Sequence
  Description of Artificial Sequence: Synthetic peptide
DEEEIRTTNPVATEIYGSVSENLQLVGNR

SEQ ID NO: 16761 - protein, 28 aa, Artificial Sequence
  Description of Artificial Sequence: Synthetic peptide
DDEEIVTTNPVATEQYGAVSTNLQRGER

SEQ ID NO: 16762 - protein, 28 aa, Artificial Sequence
  Description of Artificial Sequence: Synthetic peptide
NEEEIRTTNPVATEQYGSVANNLQRGTR

SEQ ID NO: 16763 - protein, 28 aa, Artificial Sequence
  Description of Artificial Sequence: Synthetic peptide
DEEQIRTTNPVATEQYGSVSTNDDRGNP

SEQ ID NO: 16764 - protein, 28 aa, Artificial Sequence
  Description of Artificial Sequence: Synthetic peptide
DEEEIATTNPVATEQYGSVDTNLERGDR

SEQ ID NO: 16765 - protein, 28 aa, Artificial Sequence
  Description of Artificial Sequence: Synthetic peptide
SEEEIWTTNPVATEQYGDASTNLQRGNR

SEQ ID NO: 16766 - protein, 30 aa, Artificial Sequence
  Description of Artificial Sequence: Synthetic polypeptide
DEGEIRTTNPVATEQYGSVSTGNLQRGNQF

SEQ ID NO: 16767 - protein, 29 aa, Artificial Sequence
  Description of Artificial Sequence: Synthetic peptide
DEEEIRPTNPVAYEQYGSVSTNDVQRGNR

SEQ ID NO: 16768 - protein, 28 aa, Artificial Sequence
  Description of Artificial Sequence: Synthetic peptide
DEEEIRTTNIVATEMYGDVSTNLQMGNR

SEQ ID NO: 16769 - protein, 28 aa, Artificial Sequence
  Description of Artificial Sequence: Synthetic peptide
DEEEIRQTNIVATEQFGSVSENLQRGNR

SEQ ID NO: 16770 - protein, 28 aa, Artificial Sequence
  Description of Artificial Sequence: Synthetic peptide
DEEEIGTTNPVATEQYGVVSDNLQMGNR

SEQ ID NO: 16771 - protein, 28 aa, Artificial Sequence
  Description of Artificial Sequence: Synthetic peptide
DENEIRTTNPVATEQYGSVSTDLQHGNT

SEQ ID NO: 16772 - protein, 28 aa, Artificial Sequence
  Description of Artificial Sequence: Synthetic peptide
DEEEIRTTNIVSTEIYGSVSTNLQRGDR

SEQ ID NO: 16773 - protein, 28 aa, Artificial Sequence
  Description of Artificial Sequence: Synthetic peptide
DDEEIRTTNPVSTEQFGSVSTNLQRGNS

SEQ ID NO: 16774 - protein, 28 aa, Artificial Sequence
  Description of Artificial Sequence: Synthetic peptide
VEEEIRSTNPVATDQYGSVSTNLQRGNC

SEQ ID NO: 16775 - protein, 28 aa, Artificial Sequence
  Description of Artificial Sequence: Synthetic peptide
DEEEVRTTNIVATECYGSVSDNLQRGNR

SEQ ID NO: 16776 - protein, 28 aa, Artificial Sequence
  Description of Artificial Sequence: Synthetic peptide
DEEEIRTTNPVATECYGSVSTDLQSGNL

SEQ ID NO: 16777 - protein, 28 aa, Artificial Sequence
  Description of Artificial Sequence: Synthetic peptide
DENEIRTTNIVATEQYGSVSTNLIQGNR

SEQ ID NO: 16778 - protein, 28 aa, Artificial Sequence
  Description of Artificial Sequence: Synthetic peptide
TEEEIRSTNPVATEQYGWVSTNLQRGGR

SEQ ID NO: 16779 - protein, 28 aa, Artificial Sequence
  Description of Artificial Sequence: Synthetic peptide
DEEEICTTNPVATEQYGWASENLQRGNR

SEQ ID NO: 16780 - protein, 31 aa, Artificial Sequence
  Description of Artificial Sequence: Synthetic polypeptide
DEEEIRTTNPVATEQYGSVSTMNPQREGDNR

SEQ ID NO: 16781 - protein, 28 aa, Artificial Sequence
  Description of Artificial Sequence: Synthetic peptide
MEEEIRTTNPVATECYGAVSTNLQHGNR

SEQ ID NO: 16782 - protein, 29 aa, Artificial Sequence
  Description of Artificial Sequence: Synthetic peptide
DEEEIRTTNPVATEQYGSVSFDNEQPGNR

SEQ ID NO: 16783 - protein, 31 aa, Artificial Sequence
  Description of Artificial Sequence: Synthetic polypeptide
DEEEIRTTNPVATEQYGSVSTYNLQPQGNDR

SEQ ID NO: 16784 - protein, 28 aa, Artificial Sequence
  Description of Artificial Sequence: Synthetic peptide
DEEEINTTNPVATNQYGSSSTNLQAGNR

SEQ ID NO: 16785 - protein, 28 aa, Artificial Sequence
  Description of Artificial Sequence: Synthetic peptide
VEEELRTTNPVATEQYGSVATNLQRGNQ

SEQ ID NO: 16786 - protein, 28 aa, Artificial Sequence
  Description of Artificial Sequence: Synthetic peptide
DEEEIRTTNPVGTEQYGSCSENLQRGNH

SEQ ID NO: 16787 - protein, 28 aa, Artificial Sequence
  Description of Artificial Sequence: Synthetic peptide
DEEEIRATNPVATEIFGAVSTNLQRGNR

SEQ ID NO: 16788 - protein, 29 aa, Artificial Sequence
  Description of Artificial Sequence: Synthetic peptide
DEQEIRTTNPVATEQYGVVDTNLQLRGNR

SEQ ID NO: 16789 - protein, 28 aa, Artificial Sequence
  Description of Artificial Sequence: Synthetic peptide
DEEEIRTTNPVATEQYGSVSTDLEEGNG

SEQ ID NO: 16790 - protein, 28 aa, Artificial Sequence
  Description of Artificial Sequence: Synthetic peptide
GEEEIRTTNPVATEQYGVVSTNWQRGNA

SEQ ID NO: 16791 - protein, 28 aa, Artificial Sequence
  Description of Artificial Sequence: Synthetic peptide
DEEEIATTNIVATEQFGIVSTNLQRGNR

SEQ ID NO: 16792 - protein, 30 aa, Artificial Sequence
  Description of Artificial Sequence: Synthetic polypeptide
DEEEIRTTNPVATEQYGSASTNLQRAGFNL

SEQ ID NO: 16793 - protein, 28 aa, Artificial Sequence
  Description of Artificial Sequence: Synthetic peptide
AEEEIRTTNIVATEQYGSVSDNLQRGNY

SEQ ID NO: 16794 - protein, 28 aa, Artificial Sequence
  Description of Artificial Sequence: Synthetic peptide
DEQEIATTNPVATEQYGWVSENLQRGNR

SEQ ID NO: 16795 - protein, 30 aa, Artificial Sequence
  Description of Artificial Sequence: Synthetic polypeptide
DEEEIRTTNPVATEQYGSVSTNLQELGNDM

SEQ ID NO: 16796 - protein, 28 aa, Artificial Sequence
  Description of Artificial Sequence: Synthetic peptide
DEEEIVTTNPVATESYGSVSENLQNGNR

SEQ ID NO: 16797 - protein, 28 aa, Artificial Sequence
  Description of Artificial Sequence: Synthetic peptide
DEEEIRTTNPVATEQYGDVNTNLHRGMR

SEQ ID NO: 16798 - protein, 30 aa, Artificial Sequence
  Description of Artificial Sequence: Synthetic polypeptide
DEEEVRTTNPVATEQYGSVSQTDNLQVGNR

SEQ ID NO: 16799 - protein, 30 aa, Artificial Sequence
  Description of Artificial Sequence: Synthetic polypeptide
DEEEIRTTNPVATEVYGSVSMNLQRNGENR

SEQ ID NO: 16800 - protein, 30 aa, Artificial Sequence
  Description of Artificial Sequence: Synthetic polypeptide
DEEEIRTTNPVATEQYGSVSCTMNLQVGNV

SEQ ID NO: 16801 - protein, 28 aa, Artificial Sequence
  Description of Artificial Sequence: Synthetic peptide
DEEEIRTVNPVATEQYGEVSTVLQHGNR

SEQ ID NO: 16802 - protein, 30 aa, Artificial Sequence
  Description of Artificial Sequence: Synthetic polypeptide
DEEEIRTTNPAATEQYGSVSTNGLQDRGNG

SEQ ID NO: 16803 - protein, 30 aa, Artificial Sequence
  Description of Artificial Sequence: Synthetic polypeptide
DEEEIRTTNPVATEQYGSVISTNEQDRGNH

SEQ ID NO: 16804 - protein, 28 aa, Artificial Sequence
  Description of Artificial Sequence: Synthetic peptide
DEEEIAATNPVATEQYGSVSTNLERGNQ

SEQ ID NO: 16805 - protein, 28 aa, Artificial Sequence
  Description of Artificial Sequence: Synthetic peptide
DECEISTTNPVATEQYGSCSENLQRGNR

SEQ ID NO: 16806 - protein, 28 aa, Artificial Sequence
  Description of Artificial Sequence: Synthetic peptide
DEEEIYTTNPVATEQYGSVSTNEQNGNV

SEQ ID NO: 16807 - protein, 28 aa, Artificial Sequence
  Description of Artificial Sequence: Synthetic peptide
DEEEITCTNPVATEQYGVVSTNLQRGMR

SEQ ID NO: 16808 - protein, 28 aa, Artificial Sequence
  Description of Artificial Sequence: Synthetic peptide
GEEEIRTTNPVATEQYGSVSMPLERGNR

SEQ ID NO: 16809 - protein, 28 aa, Artificial Sequence
  Description of Artificial Sequence: Synthetic peptide
DEQEIATTNPVATEQYGSVSTNLQRGEL

SEQ ID NO: 16810 - protein, 31 aa, Artificial Sequence
  Description of Artificial Sequence: Synthetic polypeptide
DEEEIRTTNPVATEQYGSVSTENLQEREGNT

SEQ ID NO: 16811 - protein, 28 aa, Artificial Sequence
  Description of Artificial Sequence: Synthetic peptide
DEEEIRTTNPVATEQYGSVSANLQLGDQ

SEQ ID NO: 16812 - protein, 28 aa, Artificial Sequence
  Description of Artificial Sequence: Synthetic peptide
DEQEIRTTNPVATEQWGSVSENLQRGNQ

SEQ ID NO: 16813 - protein, 28 aa, Artificial Sequence
  Description of Artificial Sequence: Synthetic peptide
DEEEIRTTNPVSTEGYGSVPTNLQRGER

SEQ ID NO: 16814 - protein, 28 aa, Artificial Sequence
  Description of Artificial Sequence: Synthetic peptide
DEEEIVTTNPVATEQYGTVSENLQRGNL

SEQ ID NO: 16815 - protein, 28 aa, Artificial Sequence
  Description of Artificial Sequence: Synthetic peptide
DDEEIRTTNPVAYEQYGSVANNLQRGNR

SEQ ID NO: 16816 - protein, 28 aa, Artificial Sequence
  Description of Artificial Sequence: Synthetic peptide
DEEEIRTTNIVATEIYGVVSTDLQRGNR

SEQ ID NO: 16817 - protein, 28 aa, Artificial Sequence
  Description of Artificial Sequence: Synthetic peptide
DEEEIVTTNPVATEQYGEVSENLQRGGR

SEQ ID NO: 16818 - protein, 28 aa, Artificial Sequence
  Description of Artificial Sequence: Synthetic peptide
DEEEIRTTNPVATEQYGSVSTDLELGNN

SEQ ID NO: 16819 - protein, 30 aa, Artificial Sequence
  Description of Artificial Sequence: Synthetic polypeptide
DEEEIRTTNPVATEQYGSVSTNLQERGEDA

SEQ ID NO: 16820 - protein, 28 aa, Artificial Sequence
  Description of Artificial Sequence: Synthetic peptide
DEEEIRTTNPEATEQYGSVSTDLERGER

SEQ ID NO: 16821 - protein, 28 aa, Artificial Sequence
  Description of Artificial Sequence: Synthetic peptide
DEECIRTTNPVATEQYGSWSTNDDRGNR

SEQ ID NO: 16822 - protein, 31 aa, Artificial Sequence
  Description of Artificial Sequence: Synthetic polypeptide
DEEEIRTTNPVATEQYGVSSSCTNLQCRGNR

SEQ ID NO: 16823 - protein, 29 aa, Artificial Sequence
  Description of Artificial Sequence: Synthetic peptide
DEEEIRTTNPVAHEQYGSISTNLQRKGNF

SEQ ID NO: 16824 - protein, 30 aa, Artificial Sequence
  Description of Artificial Sequence: Synthetic polypeptide
DEEEIRTTNPVATEQFGSVSTAGLQNRGNR

SEQ ID NO: 16825 - protein, 28 aa, Artificial Sequence
  Description of Artificial Sequence: Synthetic peptide
DEEEIRTTNPDATEQYGSVSTNEDVGNR

SEQ ID NO: 16826 - protein, 28 aa, Artificial Sequence
  Description of Artificial Sequence: Synthetic peptide
CEHEIRTTNPVATELYGEVSTNLQRGNR

SEQ ID NO: 16827 - protein, 32 aa, Artificial Sequence
  Description of Artificial Sequence: Synthetic polypeptide
DEEEIRTTNPVATEQYGSVSETDNLQRGDNDR

SEQ ID NO: 16828 - protein, 28 aa, Artificial Sequence
  Description of Artificial Sequence: Synthetic peptide
DEHEIRATNPVATEPYGSVSTNLQHGNR

SEQ ID NO: 16829 - protein, 28 aa, Artificial Sequence
  Description of Artificial Sequence: Synthetic peptide
DEEEIRTTNPVATEQYGSVSTDLEVGNE

SEQ ID NO: 16830 - protein, 30 aa, Artificial Sequence
  Description of Artificial Sequence: Synthetic polypeptide
DEEEIRTTNPVATEQYGSVSETALQYAGNR

SEQ ID NO: 16831 - protein, 30 aa, Artificial Sequence
  Description of Artificial Sequence: Synthetic polypeptide
DEEEIRTTNPVATEQYGCVSTNGQLRGENR

SEQ ID NO: 16832 - protein, 28 aa, Artificial Sequence
  Description of Artificial Sequence: Synthetic peptide
DEEEIATTNPVATEQYGSVSTELQHGND

SEQ ID NO: 16833 - protein, 28 aa, Artificial Sequence
  Description of Artificial Sequence: Synthetic peptide
DENEIVTTNPVATEQYGVVSTNLQRGER

SEQ ID NO: 16834 - protein, 28 aa, Artificial Sequence
  Description of Artificial Sequence: Synthetic peptide
DEREIRTTNPVATEQYGSVSTGAQRGNV

SEQ ID NO: 16835 - protein, 28 aa, Artificial Sequence
  Description of Artificial Sequence: Synthetic peptide
DEEEIRTTNPVATEQYGSVDTDLQYGNV

SEQ ID NO: 16836 - protein, 29 aa, Artificial Sequence
  Description of Artificial Sequence: Synthetic peptide
DEEEIRTTNPVATEQYGDVSTNLQAGNDQ

SEQ ID NO: 16837 - protein, 28 aa, Artificial Sequence
  Description of Artificial Sequence: Synthetic peptide
DEQEIRTTNPVATEIYGSVSTNLERPNR

SEQ ID NO: 16838 - protein, 28 aa, Artificial Sequence
  Description of Artificial Sequence: Synthetic peptide
DENEIVTTNPVATEQYGSVSTSLQRGNF

SEQ ID NO: 16839 - protein, 28 aa, Artificial Sequence
  Description of Artificial Sequence: Synthetic peptide
DEEEIRTTNPVATEQYGSVDTNLEVGNG

SEQ ID NO: 16840 - protein, 28 aa, Artificial Sequence
  Description of Artificial Sequence: Synthetic peptide
GEEEIRCTNIVATEQYGSVSTNLQRGNA

SEQ ID NO: 16841 - protein, 29 aa, Artificial Sequence
  Description of Artificial Sequence: Synthetic peptide
DEEEIRTTNPVATEQYGSVSTDLQNGNDF

SEQ ID NO: 16842 - protein, 28 aa, Artificial Sequence
  Description of Artificial Sequence: Synthetic peptide
DEEEIRTTNPVATECWGSVSTNLQQGNY

SEQ ID NO: 16843 - protein, 28 aa, Artificial Sequence
  Description of Artificial Sequence: Synthetic peptide
SEEEIRTTNPTATEQYGSVSENLQRGNL

SEQ ID NO: 16844 - protein, 29 aa, Artificial Sequence
  Description of Artificial Sequence: Synthetic peptide
DEEEIRTTNPVATEQYGTVSDNLQRGGMR

SEQ ID NO: 16845 - protein, 28 aa, Artificial Sequence
  Description of Artificial Sequence: Synthetic peptide
DEGEIRATNPVATEQYGSASTNLQRGMR

SEQ ID NO: 16846 - protein, 30 aa, Artificial Sequence
  Description of Artificial Sequence: Synthetic polypeptide
DEEEIRTTNPVSTEQYGSVSTNGLQRGVNF

SEQ ID NO: 16847 - protein, 32 aa, Artificial Sequence
  Description of Artificial Sequence: Synthetic polypeptide
DEEEIRTTNPVATEQYGSVSETDNLQRGENDR

SEQ ID NO: 16848 - protein, 29 aa, Artificial Sequence
  Description of Artificial Sequence: Synthetic peptide
DEEEISTTNPVATEQYGSVSATNLQHGNE

SEQ ID NO: 16849 - protein, 28 aa, Artificial Sequence
  Description of Artificial Sequence: Synthetic peptide
DEEEIRTTNPDATEQYGSVSTNLDIGNI

SEQ ID NO: 16850 - protein, 30 aa, Artificial Sequence
  Description of Artificial Sequence: Synthetic polypeptide
DEEEIRATNPVATEQYGSVSCTNEQCRGNR

SEQ ID NO: 16851 - protein, 28 aa, Artificial Sequence
  Description of Artificial Sequence: Synthetic peptide
DEQEIATTNIVATEQYGDVSTNLQRGNR

SEQ ID NO: 16852 - protein, 28 aa, Artificial Sequence
  Description of Artificial Sequence: Synthetic peptide
DEFEIRTTNPTATEQYGSVSTNLQQGDR

SEQ ID NO: 16853 - protein, 28 aa, Artificial Sequence
  Description of Artificial Sequence: Synthetic peptide
DENEIRTTNPVATEQYGDVSTNPQHGNR

SEQ ID NO: 16854 - protein, 28 aa, Artificial Sequence
  Description of Artificial Sequence: Synthetic peptide
DEQEIVTTNPVATEVYGWVSTNLQRGNR

SEQ ID NO: 16855 - protein, 30 aa, Artificial Sequence
  Description of Artificial Sequence: Synthetic polypeptide
DEEEIRTTNPVATEQYGSVSTNLQEAGNDI

SEQ ID NO: 16856 - protein, 28 aa, Artificial Sequence
  Description of Artificial Sequence: Synthetic peptide
DEEEIRATNIVATEMYGSVETNLQRGNR

SEQ ID NO: 16857 - protein, 28 aa, Artificial Sequence
  Description of Artificial Sequence: Synthetic peptide
DEEEIRTVNPVATEQYGEVSENLQRGGR

SEQ ID NO: 16858 - protein, 28 aa, Artificial Sequence
  Description of Artificial Sequence: Synthetic peptide
DEDEIVTTNPCATEQYGSVSTNLQRGNN

SEQ ID NO: 16859 - protein, 28 aa, Artificial Sequence
  Description of Artificial Sequence: Synthetic peptide
DEQEIATTNPVATEQYGSVSTDLQHGNR

SEQ ID NO: 16860 - protein, 28 aa, Artificial Sequence
  Description of Artificial Sequence: Synthetic peptide
DESEIRSVNPVATEQYGSVGTNLQRGNR

SEQ ID NO: 16861 - protein, 28 aa, Artificial Sequence
  Description of Artificial Sequence: Synthetic peptide
DEEMIRTTNPVATAQYGSVSTGLQRGND

SEQ ID NO: 16862 - protein, 29 aa, Artificial Sequence
  Description of Artificial Sequence: Synthetic peptide
DEEEIRTTNPVATECYGSVSTNLQLEGER

SEQ ID NO: 16863 - protein, 28 aa, Artificial Sequence
  Description of Artificial Sequence: Synthetic peptide
DEEEIRTTNPVATEQYGDVSENLQHGER

SEQ ID NO: 16864 - protein, 28 aa, Artificial Sequence
  Description of Artificial Sequence: Synthetic peptide
DEEEIRTTNIVATEQYGSWSTNLDRGER

SEQ ID NO: 16865 - protein, 30 aa, Artificial Sequence
  Description of Artificial Sequence: Synthetic polypeptide
DEEEIRTTNPTATEQYGSVSTMNLQIEGNR

SEQ ID NO: 16866 - protein, 30 aa, Artificial Sequence
  Description of Artificial Sequence: Synthetic polypeptide
DEEEIRTTNPVATEQYGSVDTMNLQRGNDV

SEQ ID NO: 16867 - protein, 28 aa, Artificial Sequence
  Description of Artificial Sequence: Synthetic peptide
DEEEIRTTNPVATEQYGSVSEELQRDER

SEQ ID NO: 16868 - protein, 30 aa, Artificial Sequence
  Description of Artificial Sequence: Synthetic polypeptide
DEEEIRTTNPVATEQYGSVSETNLERGENY

SEQ ID NO: 16869 - protein, 29 aa, Artificial Sequence
  Description of Artificial Sequence: Synthetic peptide
DEEEIRTTNPDATECYGMVSTNLQRGDNR

SEQ ID NO: 16870 - protein, 32 aa, Artificial Sequence
  Description of Artificial Sequence: Synthetic polypeptide
DEEEIRTTNPVATEQYGSVSETNLQERGDNDR

SEQ ID NO: 16871 - protein, 31 aa, Artificial Sequence
  Description of Artificial Sequence: Synthetic polypeptide
DEEEIRTTNPVATEQYGSVESTPNLIRGMNR

SEQ ID NO: 16872 - protein, 30 aa, Artificial Sequence
  Description of Artificial Sequence: Synthetic polypeptide
DENEIRTTNPVATEQYGDVSCTNLQREGNR

SEQ ID NO: 16873 - protein, 29 aa, Artificial Sequence
  Description of Artificial Sequence: Synthetic peptide
DEEEIRTTNPVATEQYGSVQSENLQVGNV

SEQ ID NO: 16874 - protein, 28 aa, Artificial Sequence
  Description of Artificial Sequence: Synthetic peptide
DEVEIYTTNPVATEQYGSVSENSQRGNR

SEQ ID NO: 16875 - protein, 29 aa, Artificial Sequence
  Description of Artificial Sequence: Synthetic peptide
DEEEIATTNPVATEQYGSVSTELQDLGNR

SEQ ID NO: 16876 - protein, 28 aa, Artificial Sequence
  Description of Artificial Sequence: Synthetic peptide
DEEEIRTTNPVATEQYGSAADNLQHGNR

SEQ ID NO: 16877 - protein, 28 aa, Artificial Sequence
  Description of Artificial Sequence: Synthetic peptide
AEQEIATTNPVATEVYGSVSTNLQRGNR

SEQ ID NO: 16878 - protein, 28 aa, Artificial Sequence
  Description of Artificial Sequence: Synthetic peptide
VEEELRTTNPVATEVYGSVSTNLQPGNR

SEQ ID NO: 16879 - protein, 29 aa, Artificial Sequence
  Description of Artificial Sequence: Synthetic peptide
DEEEIRTTNPEATEQYGSVSTELQRGEPR

SEQ ID NO: 16880 - protein, 30 aa, Artificial Sequence
  Description of Artificial Sequence: Synthetic polypeptide
DEEEIRTTNPVATEQYGDVSCTMELQRGNR

SEQ ID NO: 16881 - protein, 28 aa, Artificial Sequence
  Description of Artificial Sequence: Synthetic peptide
DEEEIVATNPVATEVYGVVSTNLQRGNR

SEQ ID NO: 16882 - protein, 28 aa, Artificial Sequence
  Description of Artificial Sequence: Synthetic peptide
DEEEIRTTNPEATEQYGSVSDNLERGNA

SEQ ID NO: 16883 - protein, 28 aa, Artificial Sequence
  Description of Artificial Sequence: Synthetic peptide
DETEIRTTNPVCTEQYGSVSTNQQVGNR

SEQ ID NO: 16884 - protein, 28 aa, Artificial Sequence
  Description of Artificial Sequence: Synthetic peptide
DEEEIRTTNPVATEMYGSVSTNLQRPLS

SEQ ID NO: 16885 - protein, 30 aa, Artificial Sequence
  Description of Artificial Sequence: Synthetic polypeptide
DEEEIRTTNPVATEQYGSVSTDLQEHGNDR

SEQ ID NO: 16886 - protein, 30 aa, Artificial Sequence
  Description of Artificial Sequence: Synthetic polypeptide
MEEEIRTTNPVATEQYGSVSTNLQENGNDR

SEQ ID NO: 16887 - protein, 28 aa, Artificial Sequence
  Description of Artificial Sequence: Synthetic peptide
DEEEIRTTNPVATEQYGSVSEDLQYGNI

SEQ ID NO: 16888 - protein, 29 aa, Artificial Sequence
  Description of Artificial Sequence: Synthetic peptide
DEEEIRTTNPVATECYGSYVSTPLQRGER

SEQ ID NO: 16889 - protein, 28 aa, Artificial Sequence
  Description of Artificial Sequence: Synthetic peptide
DEGEIRTTNPVATEQYGSVDTPLIRGNR

SEQ ID NO: 16890 - protein, 29 aa, Artificial Sequence
  Description of Artificial Sequence: Synthetic peptide
DEGEIRTTNPVATEQFGGVSTNLQRGNTR

SEQ ID NO: 16891 - protein, 28 aa, Artificial Sequence
  Description of Artificial Sequence: Synthetic peptide
DEQEIATTNPVATEQYGDVSENLQRGNR

SEQ ID NO: 16892 - protein, 28 aa, Artificial Sequence
  Description of Artificial Sequence: Synthetic peptide
DEEEIATTNPVATEQYGDVSTELQRGER

SEQ ID NO: 16893 - protein, 28 aa, Artificial Sequence
  Description of Artificial Sequence: Synthetic peptide
DEQEIRTTNPVATEQYGSVSDNLERGND

SEQ ID NO: 16894 - protein, 30 aa, Artificial Sequence
  Description of Artificial Sequence: Synthetic polypeptide
DEEEIRTTNPVATEQYGWIVSTNEQRIGNR

SEQ ID NO: 16895 - protein, 29 aa, Artificial Sequence
  Description of Artificial Sequence: Synthetic peptide
DEEELRTTNPVATECYGSTSTNLQRGENR

SEQ ID NO: 16896 - protein, 31 aa, Artificial Sequence
  Description of Artificial Sequence: Synthetic polypeptide
DEEEIRTTNPVATEQYGSVESTDNPDQRGNR

SEQ ID NO: 16897 - protein, 28 aa, Artificial Sequence
  Description of Artificial Sequence: Synthetic peptide
DEEEIRTTNPVATEQYGSVDTDLQVGNE

SEQ ID NO: 16898 - protein, 28 aa, Artificial Sequence
  Description of Artificial Sequence: Synthetic peptide
SEEEIMTTNPVATEQYGSVSTNLQFGNP

SEQ ID NO: 16899 - protein, 28 aa, Artificial Sequence
  Description of Artificial Sequence: Synthetic peptide
DEEEIRATNPVATEQFGEVSTNLQRENR

SEQ ID NO: 16900 - protein, 28 aa, Artificial Sequence
  Description of Artificial Sequence: Synthetic peptide
DEEEIRATNPVATEIYGSVSTNLQHGNC

SEQ ID NO: 16901 - protein, 30 aa, Artificial Sequence
  Description of Artificial Sequence: Synthetic polypeptide
DEEEIRTTNPVATEQYGSVSENLQDQGNDR

SEQ ID NO: 16902 - protein, 28 aa, Artificial Sequence
  Description of Artificial Sequence: Synthetic peptide
DEEEIATTNPVATEQYGSASTCLQRGER

SEQ ID NO: 16903 - protein, 28 aa, Artificial Sequence
  Description of Artificial Sequence: Synthetic peptide
DEQEIATTNPVATEQYGSVSTNLQYGNF

SEQ ID NO: 16904 - protein, 30 aa, Artificial Sequence
  Description of Artificial Sequence: Synthetic polypeptide
DEEEIRTTNPVATECYGSVSTNLQDRGEDR

SEQ ID NO: 16905 - protein, 29 aa, Artificial Sequence
  Description of Artificial Sequence: Synthetic peptide
KEEEIRTTNPVATEQYGSVSTNLQERGEY

SEQ ID NO: 16906 - protein, 28 aa, Artificial Sequence
  Description of Artificial Sequence: Synthetic peptide
CEEEIRPTNPVATEIYGSVSTNLQPGNR

SEQ ID NO: 16907 - protein, 28 aa, Artificial Sequence
  Description of Artificial Sequence: Synthetic peptide
DEMEIRTTNPVATEVYGVVSTNLQRGNA

SEQ ID NO: 16908 - protein, 28 aa, Artificial Sequence
  Description of Artificial Sequence: Synthetic peptide
QEQEIRTTNPVATEQYGIVSDNLQRGNR

SEQ ID NO: 16909 - protein, 30 aa, Artificial Sequence
  Description of Artificial Sequence: Synthetic polypeptide
DEEEIRTTNPVATEQYGSVSCTENLERGNE

SEQ ID NO: 16910 - protein, 28 aa, Artificial Sequence
  Description of Artificial Sequence: Synthetic peptide
DEEEIRTTNPTATEQYGSVSTNEQVGNN

SEQ ID NO: 16911 - protein, 28 aa, Artificial Sequence
  Description of Artificial Sequence: Synthetic peptide
DEEEIRTTNPVATEQYGSVSTNEMIGNW

SEQ ID NO: 16912 - protein, 28 aa, Artificial Sequence
  Description of Artificial Sequence: Synthetic peptide
DEEEIATTNIVATEMYGSASTNLQRGNR

SEQ ID NO: 16913 - protein, 28 aa, Artificial Sequence
  Description of Artificial Sequence: Synthetic peptide
DEEEIRTTNPVATEQYGSVSTGLEVGNE

SEQ ID NO: 16914 - protein, 28 aa, Artificial Sequence
  Description of Artificial Sequence: Synthetic peptide
DEQEIATTNPVATEMYGWVSTNLQRGNR

SEQ ID NO: 16915 - protein, 28 aa, Artificial Sequence
  Description of Artificial Sequence: Synthetic peptide
DEEEIRTTNPVATEQYGEASENLQRGMR

SEQ ID NO: 16916 - protein, 28 aa, Artificial Sequence
  Description of Artificial Sequence: Synthetic peptide
DEEEIRTTNPEATEQYGSVSTDLQVGER

SEQ ID NO: 16917 - protein, 31 aa, Artificial Sequence
  Description of Artificial Sequence: Synthetic polypeptide
SEEEIRTTNPVATEQYGSVISTMNLQRGNTR

SEQ ID NO: 16918 - protein, 29 aa, Artificial Sequence
  Description of Artificial Sequence: Synthetic peptide
DEEEIRTTNPVATEQYGSVSENLQAGNDV

SEQ ID NO: 16919 - protein, 28 aa, Artificial Sequence
  Description of Artificial Sequence: Synthetic peptide
DEEEIRTTNPVATECYGSVSTNLQLGTF

SEQ ID NO: 16920 - protein, 28 aa, Artificial Sequence
  Description of Artificial Sequence: Synthetic peptide
DEEEIRTTNPVATEQYGSVETDDQRGNF

SEQ ID NO: 16921 - protein, 28 aa, Artificial Sequence
  Description of Artificial Sequence: Synthetic peptide
DEYEIRTTNIVATEQYGSVSTNLQIGNF

SEQ ID NO: 16922 - protein, 29 aa, Artificial Sequence
  Description of Artificial Sequence: Synthetic peptide
DEEEIRTTNPVATEQYGDVSTNDQRDGER

SEQ ID NO: 16923 - protein, 28 aa, Artificial Sequence
  Description of Artificial Sequence: Synthetic peptide
DEEEIRAVNPVATEQYGSVSTNLQRLNQ

SEQ ID NO: 16924 - protein, 30 aa, Artificial Sequence
  Description of Artificial Sequence: Synthetic polypeptide
DEEEIRTTNPVATEQYGGVSTNEPQRGDNR

SEQ ID NO: 16925 - protein, 28 aa, Artificial Sequence
  Description of Artificial Sequence: Synthetic peptide
SEEEIRATNPVATECYGSVSTDLQRGNR

SEQ ID NO: 16926 - protein, 29 aa, Artificial Sequence
  Description of Artificial Sequence: Synthetic peptide
DEEEIRTTNPVATEQYGDVSTNLQREFNA

SEQ ID NO: 16927 - protein, 28 aa, Artificial Sequence
  Description of Artificial Sequence: Synthetic peptide
SEEEIRTTNPTATEQYGSVSTNEQRGNQ

SEQ ID NO: 16928 - protein, 28 aa, Artificial Sequence
  Description of Artificial Sequence: Synthetic peptide
DEEEIRTTNPFATEQYGSVSTPDDRGNR

SEQ ID NO: 16929 - protein, 28 aa, Artificial Sequence
  Description of Artificial Sequence: Synthetic peptide
DEEEIRSTNPVSTEHYGSVATNLQRGNR

SEQ ID NO: 16930 - protein, 28 aa, Artificial Sequence
  Description of Artificial Sequence: Synthetic peptide
DEEELRTTNPVATEQYGSVSTNVTRGNA

SEQ ID NO: 16931 - protein, 29 aa, Artificial Sequence
  Description of Artificial Sequence: Synthetic peptide
SEEEIRTTNPVATEQYGSVSTGNLQGGNF

SEQ ID NO: 16932 - protein, 28 aa, Artificial Sequence
  Description of Artificial Sequence: Synthetic peptide
DEEEIRTTNPVATEQYGIVSTGEQRWNR

SEQ ID NO: 16933 - protein, 28 aa, Artificial Sequence
  Description of Artificial Sequence: Synthetic peptide
DEQEIRATNPVATEQYGGVSTNLQQGNR

SEQ ID NO: 16934 - protein, 28 aa, Artificial Sequence
  Description of Artificial Sequence: Synthetic peptide
HETEICTTNPVATEQYGSVSTNLQRGNI

SEQ ID NO: 16935 - protein, 28 aa, Artificial Sequence
  Description of Artificial Sequence: Synthetic peptide
DEEEIRTTNPTATEQYGSVSSGLQRPNR

SEQ ID NO: 16936 - protein, 28 aa, Artificial Sequence
  Description of Artificial Sequence: Synthetic peptide
DEQEIVTTNPVATEQYGDVSDNLQRGNR

SEQ ID NO: 16937 - protein, 28 aa, Artificial Sequence
  Description of Artificial Sequence: Synthetic peptide
DENEIRTTNIVATEQYGSVSTDEQRGNR

SEQ ID NO: 16938 - protein, 30 aa, Artificial Sequence
  Description of Artificial Sequence: Synthetic polypeptide
DEEEIRTTNPVATEQYGSVSTNLEREGNEE

SEQ ID NO: 16939 - protein, 29 aa, Artificial Sequence
  Description of Artificial Sequence: Synthetic peptide
DEEEISTTNPVATEQYGSVQDTNLIRGNR

SEQ ID NO: 16940 - protein, 28 aa, Artificial Sequence
  Description of Artificial Sequence: Synthetic peptide
QEEEIATTNPVATEQYGGVSTVLQRGNR

SEQ ID NO: 16941 - protein, 28 aa, Artificial Sequence
  Description of Artificial Sequence: Synthetic peptide
SEEEIYTTNPVATEQYGEVSENLQRGNR

SEQ ID NO: 16942 - protein, 28 aa, Artificial Sequence
  Description of Artificial Sequence: Synthetic peptide
KEEEIRTTNPVATEQYGSVSDNLQIGNN

SEQ ID NO: 16943 - protein, 28 aa, Artificial Sequence
  Description of Artificial Sequence: Synthetic peptide
DEEEIRTVNPVATEQYGSVSTEPLRGNR

SEQ ID NO: 16944 - protein, 29 aa, Artificial Sequence
  Description of Artificial Sequence: Synthetic peptide
DEEEIRTTNPDATEQYGSVSTPLDERGNR

SEQ ID NO: 16945 - protein, 28 aa, Artificial Sequence
  Description of Artificial Sequence: Synthetic peptide
GEEEIRTTNIVATECYGSVSTNLQRGNQ

SEQ ID NO: 16946 - protein, 28 aa, Artificial Sequence
  Description of Artificial Sequence: Synthetic peptide
SEEEIRTTNPTATELYGSVSTNLQQGNR

SEQ ID NO: 16947 - protein, 28 aa, Artificial Sequence
  Description of Artificial Sequence: Synthetic peptide
DEEEIRTTNPDATEQYGSVSTNLQGGEF

SEQ ID NO: 16948 - protein, 30 aa, Artificial Sequence
  Description of Artificial Sequence: Synthetic polypeptide
DEEEIRTTNPVATEQYGSVESDTELQTGNR

SEQ ID NO: 16949 - protein, 28 aa, Artificial Sequence
  Description of Artificial Sequence: Synthetic peptide
DEEEIRTVNPVATEMYGTVSTNLQHGNR

SEQ ID NO: 16950 - protein, 30 aa, Artificial Sequence
  Description of Artificial Sequence: Synthetic polypeptide
DEEEIRTTNPVATEQYGSVSTELQVKGNDR

SEQ ID NO: 16951 - protein, 30 aa, Artificial Sequence
  Description of Artificial Sequence: Synthetic polypeptide
DEEEIRTTNPVATEQYGSVSTNLEERGEDR

SEQ ID NO: 16952 - protein, 28 aa, Artificial Sequence
  Description of Artificial Sequence: Synthetic peptide
QEEEIRTTNITATEQYGSVSDNLQRGNR

SEQ ID NO: 16953 - protein, 29 aa, Artificial Sequence
  Description of Artificial Sequence: Synthetic peptide
DEEEVRTTNPCATEQYGSVSTNGLERGNR

SEQ ID NO: 16954 - protein, 28 aa, Artificial Sequence
  Description of Artificial Sequence: Synthetic peptide
DEEEIRTTNPVATEQWGSVTENLQRGNM

SEQ ID NO: 16955 - protein, 29 aa, Artificial Sequence
  Description of Artificial Sequence: Synthetic peptide
DEEEIRTTNPVATEQYGSVDTNLEYGINR

SEQ ID NO: 16956 - protein, 30 aa, Artificial Sequence
  Description of Artificial Sequence: Synthetic polypeptide
DEEEIRTTNPVATEQYGSVSTMDLQRGNDD

SEQ ID NO: 16957 - protein, 29 aa, Artificial Sequence
  Description of Artificial Sequence: Synthetic peptide
DEEEIRTTNPVSTEQYGSTSTNLQRGNEF

SEQ ID NO: 16958 - protein, 30 aa, Artificial Sequence
  Description of Artificial Sequence: Synthetic polypeptide
DEEEIRTTNPVATEQYGSVSETNLERGNEE

SEQ ID NO: 16959 - protein, 28 aa, Artificial Sequence
  Description of Artificial Sequence: Synthetic peptide
DEEEIRSTNIVATEQYGGVSTNEQRGNR

SEQ ID NO: 16960 - protein, 31 aa, Artificial Sequence
  Description of Artificial Sequence: Synthetic polypeptide
DEEEIRTTNPVATEQYGSVSTNLQDVNGNDR

SEQ ID NO: 16961 - protein, 28 aa, Artificial Sequence
  Description of Artificial Sequence: Synthetic peptide
DEEEIRTTNIVATEQYGSVSTNIQVGMR

SEQ ID NO: 16962 - protein, 29 aa, Artificial Sequence
  Description of Artificial Sequence: Synthetic peptide
DEEEIRTTNPIATEQYGSVDSTNLQFGNI

SEQ ID NO: 16963 - protein, 30 aa, Artificial Sequence
  Description of Artificial Sequence: Synthetic polypeptide
DEEEIRTTNPVAHEQYGSVSTNLILRGNER

SEQ ID NO: 16964 - protein, 28 aa, Artificial Sequence
  Description of Artificial Sequence: Synthetic peptide
DEEEIRSTNIVATEQYGSVSTALQRGER

SEQ ID NO: 16965 - protein, 28 aa, Artificial Sequence
  Description of Artificial Sequence: Synthetic peptide
DEEEVRQTNIVATEQYGSVSTNLQRGER

SEQ ID NO: 16966 - protein, 28 aa, Artificial Sequence
  Description of Artificial Sequence: Synthetic peptide
DEEEIRCTNIVATEQYGSVSTNLMRGNS

SEQ ID NO: 16967 - protein, 28 aa, Artificial Sequence
  Description of Artificial Sequence: Synthetic peptide
DEEEIRTTNPVATELWGSVSTNLMQGNR

SEQ ID NO: 16968 - protein, 28 aa, Artificial Sequence
  Description of Artificial Sequence: Synthetic peptide
NEEEIRTTNPCATEQYGSVSTELQTGNR

SEQ ID NO: 16969 - protein, 31 aa, Artificial Sequence
  Description of Artificial Sequence: Synthetic polypeptide
DEEEIRTTNPVATEQYGSVSQTTLQRMGENR

SEQ ID NO: 16970 - protein, 29 aa, Artificial Sequence
  Description of Artificial Sequence: Synthetic peptide
DEEEIRTTNPDATEQYGSVSITNLDRGNW

SEQ ID NO: 16971 - protein, 28 aa, Artificial Sequence
  Description of Artificial Sequence: Synthetic peptide
DEEEIRTTNPVCTEQYGSVFEDLQRGNR

SEQ ID NO: 16972 - protein, 28 aa, Artificial Sequence
  Description of Artificial Sequence: Synthetic peptide
DEEEISTTNPVATEFYGSVGDNLQRGNR

SEQ ID NO: 16973 - protein, 28 aa, Artificial Sequence
  Description of Artificial Sequence: Synthetic peptide
DEDEIRCTNPVATEMYGAVSTNLQRGNR

SEQ ID NO: 16974 - protein, 28 aa, Artificial Sequence
  Description of Artificial Sequence: Synthetic peptide
DENEIRTTNPVATECYGSVSTNLQDGNM

SEQ ID NO: 16975 - protein, 28 aa, Artificial Sequence
  Description of Artificial Sequence: Synthetic peptide
DEEEIRTTNIVATEIYGSTSTNLQRGNL

SEQ ID NO: 16976 - protein, 28 aa, Artificial Sequence
  Description of Artificial Sequence: Synthetic peptide
DEEEISTTNPVATEQYGWVSMNLQRGNM

SEQ ID NO: 16977 - protein, 28 aa, Artificial Sequence
  Description of Artificial Sequence: Synthetic peptide
DEQEISTTNPVATEQYGSVSSNLQRGNA

SEQ ID NO: 16978 - protein, 28 aa, Artificial Sequence
  Description of Artificial Sequence: Synthetic peptide
DEEEIRTTNPVATECYGIVSTNLQTGNQ

SEQ ID NO: 16979 - protein, 31 aa, Artificial Sequence
  Description of Artificial Sequence: Synthetic polypeptide
DEEEIRTTNPVATEQYGSVSLTNLQERGDYR

SEQ ID NO: 16980 - protein, 29 aa, Artificial Sequence
  Description of Artificial Sequence: Synthetic peptide
DEEEIRTTNPCCTEQYGSVSCTNLQRGNA

SEQ ID NO: 16981 - protein, 31 aa, Artificial Sequence
  Description of Artificial Sequence: Synthetic polypeptide
DEEEIRTTNPVATEQYGSVSTNLQDREGNDA

SEQ ID NO: 16982 - protein, 28 aa, Artificial Sequence
  Description of Artificial Sequence: Synthetic peptide
QEEEIRTTNIVATECYGSVSENLQRGNR

SEQ ID NO: 16983 - protein, 31 aa, Artificial Sequence
  Description of Artificial Sequence: Synthetic polypeptide
DEEEIRTTNPEATEQYGSVSTNPLQRDGNDR

SEQ ID NO: 16984 - protein, 29 aa, Artificial Sequence
  Description of Artificial Sequence: Synthetic peptide
KEEEIRTTNPVATEQYGSVCTNLQIIGNR

SEQ ID NO: 16985 - protein, 28 aa, Artificial Sequence
  Description of Artificial Sequence: Synthetic peptide
DENEIRTTNPVATEQYGSVDDNLQHGNR

SEQ ID NO: 16986 - protein, 30 aa, Artificial Sequence
  Description of Artificial Sequence: Synthetic polypeptide
DEEEIRTTNPVATEQYGSVSTNLQEQGEDR

SEQ ID NO: 16987 - protein, 30 aa, Artificial Sequence
  Description of Artificial Sequence: Synthetic polypeptide
DEEEIRTTNPVATEQYGSVSTNLQEQGNDN

SEQ ID NO: 16988 - protein, 30 aa, Artificial Sequence
  Description of Artificial Sequence: Synthetic polypeptide
DEEEIRTTNPVATEQFGSVSTNLPARGNLR

SEQ ID NO: 16989 - protein, 28 aa, Artificial Sequence
  Description of Artificial Sequence: Synthetic peptide
DEEEIRTTNPVATEQYGSVSTELQEGEE

SEQ ID NO: 16990 - protein, 29 aa, Artificial Sequence
  Description of Artificial Sequence: Synthetic peptide
DEEEIRTTNPVATEQYGSVSTDLQVGNDS

SEQ ID NO: 16991 - protein, 28 aa, Artificial Sequence
  Description of Artificial Sequence: Synthetic peptide
NEEEIATTNPVSTEQYGSVGTNLQRGNR

SEQ ID NO: 16992 - protein, 30 aa, Artificial Sequence
  Description of Artificial Sequence: Synthetic polypeptide
DEEEIRTTNPVATEQYGSVESTNLDRGMNH

SEQ ID NO: 16993 - protein, 30 aa, Artificial Sequence
  Description of Artificial Sequence: Synthetic polypeptide
DEEEIRTTNPVATEQYGSVDTNPDVQRGNR

SEQ ID NO: 16994 - protein, 30 aa, Artificial Sequence
  Description of Artificial Sequence: Synthetic polypeptide
DEEEIRTTNPVATEQYGTSVSTPLQIRGNP

SEQ ID NO: 16995 - protein, 28 aa, Artificial Sequence
  Description of Artificial Sequence: Synthetic peptide
DEEEIRTTNPVATEQYGSWSHNDQRGND

SEQ ID NO: 16996 - protein, 29 aa, Artificial Sequence
  Description of Artificial Sequence: Synthetic peptide
DEEEIRTTNPVGTEVYGSVSATNIQRGNR

SEQ ID NO: 16997 - protein, 28 aa, Artificial Sequence
  Description of Artificial Sequence: Synthetic peptide
DENEIRCTNPVATEQWGSVSTNLQRGNA

SEQ ID NO: 16998 - protein, 28 aa, Artificial Sequence
  Description of Artificial Sequence: Synthetic peptide
DEEEIRTTNPVATEQYGSVSTELQDGEQ

SEQ ID NO: 16999 - protein, 28 aa, Artificial Sequence
  Description of Artificial Sequence: Synthetic peptide
DEEEIRSTNIVATEQYGDVSTELQRGNR

SEQ ID NO: 17000 - protein, 28 aa, Artificial Sequence
  Description of Artificial Sequence: Synthetic peptide
DEEEIRTTNPVATEQYGSVSTNLEVGEF

SEQ ID NO: 17001 - protein, 30 aa, Artificial Sequence
  Description of Artificial Sequence: Synthetic polypeptide
DEEEIRTTNPVATEQYGESVSTNGDQRENR

SEQ ID NO: 17002 - protein, 29 aa, Artificial Sequence
  Description of Artificial Sequence: Synthetic peptide
DEQEIRTTNPVATEQYGSVDSTNDQRGNF

SEQ ID NO: 17003 - protein, 28 aa, Artificial Sequence
  Description of Artificial Sequence: Synthetic peptide
DEECIRTTNPVATCQYGDVSTNLQRGDR

SEQ ID NO: 17004 - protein, 30 aa, Artificial Sequence
  Description of Artificial Sequence: Synthetic polypeptide
DEEEIRTTNPVATELYGSVSTGNLPQLGNR

SEQ ID NO: 17005 - protein, 28 aa, Artificial Sequence
  Description of Artificial Sequence: Synthetic peptide
DEEEIRTTNPVATEQYGSVSDEEQQGNR

SEQ ID NO: 17006 - protein, 28 aa, Artificial Sequence
  Description of Artificial Sequence: Synthetic peptide
DEEEIKGTNPVATEQYGQVSSNLQRGNR

SEQ ID NO: 17007 - protein, 30 aa, Artificial Sequence
  Description of Artificial Sequence: Synthetic polypeptide
DEEEIRTTNPVATEQYGSVSTNEQERGNTF

SEQ ID NO: 17008 - protein, 28 aa, Artificial Sequence
  Description of Artificial Sequence: Synthetic peptide
SEEEIRTTNPVATECYGGVSTNEQRGNR

SEQ ID NO: 17009 - protein, 28 aa, Artificial Sequence
  Description of Artificial Sequence: Synthetic peptide
DEEEIYTTNPVATEQYGSVSTNPQRENA

SEQ ID NO: 17010 - protein, 29 aa, Artificial Sequence
  Description of Artificial Sequence: Synthetic peptide
DEEEIRTTNPVATEQYGFVSTNLLIDGNR

SEQ ID NO: 17011 - protein, 28 aa, Artificial Sequence
  Description of Artificial Sequence: Synthetic peptide
DEEEIRTTNPVATEQYGSVSTNDEREER

SEQ ID NO: 17012 - protein, 28 aa, Artificial Sequence
  Description of Artificial Sequence: Synthetic peptide
DEEEIRTTNIVATEVFGSVSTNEQRGNR

SEQ ID NO: 17013 - protein, 28 aa, Artificial Sequence
  Description of Artificial Sequence: Synthetic peptide
DEEEIRTTNPVATEQYGVVSTELQWGNE

SEQ ID NO: 17014 - protein, 28 aa, Artificial Sequence
  Description of Artificial Sequence: Synthetic peptide
DEEEIRTTNPVATEQYGSVSTELQAGEQ

SEQ ID NO: 17015 - protein, 30 aa, Artificial Sequence
  Description of Artificial Sequence: Synthetic polypeptide
DEEEIRTTNPVATEQYGSVSTNLQDSGNDQ

SEQ ID NO: 17016 - protein, 28 aa, Artificial Sequence
  Description of Artificial Sequence: Synthetic peptide
DEEEIRTTNPCATEVYGWVSTNLQRGNN

SEQ ID NO: 17017 - protein, 28 aa, Artificial Sequence
  Description of Artificial Sequence: Synthetic peptide
DEHPIRTTNPVATEQYGSVSTTLQRGVR

SEQ ID NO: 17018 - protein, 28 aa, Artificial Sequence
  Description of Artificial Sequence: Synthetic peptide
DEEEIRTTNPVATEQYGSVSTADFLGNR

SEQ ID NO: 17019 - protein, 28 aa, Artificial Sequence
  Description of Artificial Sequence: Synthetic peptide
DEEEIRTTNIVATEQYGSVSTDLQLLNR

SEQ ID NO: 17020 - protein, 28 aa, Artificial Sequence
  Description of Artificial Sequence: Synthetic peptide
DEEEIRTTNPCATEIYGAVCTNLQRGNR

SEQ ID NO: 17021 - protein, 31 aa, Artificial Sequence
  Description of Artificial Sequence: Synthetic polypeptide
DEEEIRTTNPVATEQYGSVDSTNLQIIGNPR

SEQ ID NO: 17022 - protein, 28 aa, Artificial Sequence
  Description of Artificial Sequence: Synthetic peptide
DEEEIRTTNPVATEQYGSVDTDLQQGNS

SEQ ID NO: 17023 - protein, 29 aa, Artificial Sequence
  Description of Artificial Sequence: Synthetic peptide
DEEEIRTTNPVATEQYGSVSTNLQTGEDV

SEQ ID NO: 17024 - protein, 31 aa, Artificial Sequence
  Description of Artificial Sequence: Synthetic polypeptide
DELEIRTTNPVATEQYGSVSCTDNLQDRGNR

SEQ ID NO: 17025 - protein, 28 aa, Artificial Sequence
  Description of Artificial Sequence: Synthetic peptide
SEEEIRPTNPVSTEQYGSVSTNLQRLNR

SEQ ID NO: 17026 - protein, 28 aa, Artificial Sequence
  Description of Artificial Sequence: Synthetic peptide
DEEEIRTTNIVAREQYGQVSTNEQRGNR

SEQ ID NO: 17027 - protein, 28 aa, Artificial Sequence
  Description of Artificial Sequence: Synthetic peptide
DESEIRTTNPVMTEYYGSVSTNLQRGNA

SEQ ID NO: 17028 - protein, 30 aa, Artificial Sequence
  Description of Artificial Sequence: Synthetic polypeptide
DEEEIRTTNPVATEQYGSVSATNLQLDGNL

SEQ ID NO: 17029 - protein, 30 aa, Artificial Sequence
  Description of Artificial Sequence: Synthetic polypeptide
DEEEIRTTNPVATEQYGSVSTNLQYIGLNQ

SEQ ID NO: 17030 - protein, 28 aa, Artificial Sequence
  Description of Artificial Sequence: Synthetic peptide
KEEEISTTNPVATEQYGSVSTNLDMGNR

SEQ ID NO: 17031 - protein, 28 aa, Artificial Sequence
  Description of Artificial Sequence: Synthetic peptide
DEEEIRTTNPVATEQYGCVSTALQVGNL

SEQ ID NO: 17032 - protein, 29 aa, Artificial Sequence
  Description of Artificial Sequence: Synthetic peptide
DEEEIRTTNPVAHEQYGSISTMNLQRGNH

SEQ ID NO: 17033 - protein, 31 aa, Artificial Sequence
  Description of Artificial Sequence: Synthetic polypeptide
DEEEIRTTNPVATEQYGSVSTANLQLREGTR

SEQ ID NO: 17034 - protein, 28 aa, Artificial Sequence
  Description of Artificial Sequence: Synthetic peptide
DEEEIRTTNPDATEQYGSVSTNLDPGNG

SEQ ID NO: 17035 - protein, 29 aa, Artificial Sequence
  Description of Artificial Sequence: Synthetic peptide
DEEEIRTTNPTATEQYGSVSTNLQQGDNF

SEQ ID NO: 17036 - protein, 28 aa, Artificial Sequence
  Description of Artificial Sequence: Synthetic peptide
DEEEIRTTNPVATEQYGSVSTELMQGDR

SEQ ID NO: 17037 - protein, 29 aa, Artificial Sequence
  Description of Artificial Sequence: Synthetic peptide
DEEEIRTTNPTATEQYGSVSTNLQNGDNF

SEQ ID NO: 17038 - protein, 28 aa, Artificial Sequence
  Description of Artificial Sequence: Synthetic peptide
DEEEIRSTNPVATEQYGSVSENLQRGLA

SEQ ID NO: 17039 - protein, 28 aa, Artificial Sequence
  Description of Artificial Sequence: Synthetic peptide
SEEEIRQTNIVATEQYGSVSTNDQRGNR

SEQ ID NO: 17040 - protein, 28 aa, Artificial Sequence
  Description of Artificial Sequence: Synthetic peptide
DEEEISTTNPVATEWWGSVDTNLQRGNR

SEQ ID NO: 17041 - protein, 31 aa, Artificial Sequence
  Description of Artificial Sequence: Synthetic polypeptide
DEEEIRTTNPVATEQYGSVESTNLEERDGNR

SEQ ID NO: 17042 - protein, 30 aa, Artificial Sequence
  Description of Artificial Sequence: Synthetic polypeptide
DEEEIRTTNPVATEQYGSVSTDLQERGENF

SEQ ID NO: 17043 - protein, 28 aa, Artificial Sequence
  Description of Artificial Sequence: Synthetic peptide
DEEEIRPTNPVATEQYGSVSTDLNRGDR

SEQ ID NO: 17044 - protein, 28 aa, Artificial Sequence
  Description of Artificial Sequence: Synthetic peptide
DEEEIRATNPVATEQYGGVSENLQRGDR

SEQ ID NO: 17045 - protein, 30 aa, Artificial Sequence
  Description of Artificial Sequence: Synthetic polypeptide
DEEEIRTTNPVATEQYGSVSTNNLQNDGNV

SEQ ID NO: 17046 - protein, 28 aa, Artificial Sequence
  Description of Artificial Sequence: Synthetic peptide
DEEEIRTTNPVATEQYGLVSENLQRFNS

SEQ ID NO: 17047 - protein, 28 aa, Artificial Sequence
  Description of Artificial Sequence: Synthetic peptide
NEEEIRTTNPVATESYGSVSTNLQHGNQ

SEQ ID NO: 17048 - protein, 28 aa, Artificial Sequence
  Description of Artificial Sequence: Synthetic peptide
DEQEIRTTNPVATEQYGSVETPLQYGNR

SEQ ID NO: 17049 - protein, 28 aa, Artificial Sequence
  Description of Artificial Sequence: Synthetic peptide
DEEEIRTTNIVATEQYGNVATDLQRGNR

SEQ ID NO: 17050 - protein, 28 aa, Artificial Sequence
  Description of Artificial Sequence: Synthetic peptide
DEFEIRCTNPVATEQYGSASTNIQRGNR

SEQ ID NO: 17051 - protein, 28 aa, Artificial Sequence
  Description of Artificial Sequence: Synthetic peptide
DEEEIRCTNIVATSQYGSVSTNLQRGNT

SEQ ID NO: 17052 - protein, 30 aa, Artificial Sequence
  Description of Artificial Sequence: Synthetic polypeptide
DEEEIRTTNPVATEQYGSVLSTNLDERGNS

SEQ ID NO: 17053 - protein, 28 aa, Artificial Sequence
  Description of Artificial Sequence: Synthetic peptide
DEEEIRTTNPVATEQYGSVETNDQRGEA

SEQ ID NO: 17054 - protein, 28 aa, Artificial Sequence
  Description of Artificial Sequence: Synthetic peptide
DESECATTNPVATEQYGIVSTNLQRGNR

SEQ ID NO: 17055 - protein, 28 aa, Artificial Sequence
  Description of Artificial Sequence: Synthetic peptide
DEQEIRTTNPVATEQYGDVSTDLQHGNR

SEQ ID NO: 17056 - protein, 28 aa, Artificial Sequence
  Description of Artificial Sequence: Synthetic peptide
MENEIRTTNPVATEQYGSVSTNLQLGNH

SEQ ID NO: 17057 - protein, 28 aa, Artificial Sequence
  Description of Artificial Sequence: Synthetic peptide
DEEEIRTTNPVATECYGSVSTNLQIGEV

SEQ ID NO: 17058 - protein, 28 aa, Artificial Sequence
  Description of Artificial Sequence: Synthetic peptide
DEEEIRTVNIVATEQYGDVSTNLDRGNR

SEQ ID NO: 17059 - protein, 30 aa, Artificial Sequence
  Description of Artificial Sequence: Synthetic polypeptide
DEEEIRTTNPVATEQYGSVSTHNLQQNENR

SEQ ID NO: 17060 - protein, 28 aa, Artificial Sequence
  Description of Artificial Sequence: Synthetic peptide
AESELRTTNPVATEQYGSVSTNLQRGPR

SEQ ID NO: 17061 - protein, 28 aa, Artificial Sequence
  Description of Artificial Sequence: Synthetic peptide
DEEEIRCTNPVATELWGSVSTNLERGNR

SEQ ID NO: 17062 - protein, 28 aa, Artificial Sequence
  Description of Artificial Sequence: Synthetic peptide
DETEIRATNPVATEMYGWVSTNLQRGNR

SEQ ID NO: 17063 - protein, 29 aa, Artificial Sequence
  Description of Artificial Sequence: Synthetic peptide
DEQEIRCTNPVATEQYGSVSTNLERNGNR

SEQ ID NO: 17064 - protein, 28 aa, Artificial Sequence
  Description of Artificial Sequence: Synthetic peptide
DEEEIRTTNPFATEQYGDVSTDLQRGER

SEQ ID NO: 17065 - protein, 29 aa, Artificial Sequence
  Description of Artificial Sequence: Synthetic peptide
DEEEIRTTNPVATEQYGSVSTECLECGNR

SEQ ID NO: 17066 - protein, 29 aa, Artificial Sequence
  Description of Artificial Sequence: Synthetic peptide
YEEEIRTTNPVATEQYGSVSTAWQRGNDR

SEQ ID NO: 17067 - protein, 30 aa, Artificial Sequence
  Description of Artificial Sequence: Synthetic polypeptide
DEEEIATTNPVATEQYGSVSTNLQEREGNA

SEQ ID NO: 17068 - protein, 30 aa, Artificial Sequence
  Description of Artificial Sequence: Synthetic polypeptide
DEEEIRTTNPVATEQYGSVSTMNLQQGNDA

SEQ ID NO: 17069 - protein, 30 aa, Artificial Sequence
  Description of Artificial Sequence: Synthetic polypeptide
DEEEIRTTNPVATEQYGSMVWTPNDQRGNR

SEQ ID NO: 17070 - protein, 30 aa, Artificial Sequence
  Description of Artificial Sequence: Synthetic polypeptide
DEEEIATTNPVATEQYGSVSTMNEQDRGNR

SEQ ID NO: 17071 - protein, 29 aa, Artificial Sequence
  Description of Artificial Sequence: Synthetic peptide
DEEEIRTTNPVACEQYGSVGTNLQTRGTR

SEQ ID NO: 17072 - protein, 28 aa, Artificial Sequence
  Description of Artificial Sequence: Synthetic peptide
DEEEIRTTNPVATEQWGSVSTNLMRGTM

SEQ ID NO: 17073 - protein, 28 aa, Artificial Sequence
  Description of Artificial Sequence: Synthetic peptide
DEEEIRATNIVATEQYGSVSTNLLRGER

SEQ ID NO: 17074 - protein, 29 aa, Artificial Sequence
  Description of Artificial Sequence: Synthetic peptide
DEEEIRTTNPVATEQYGGVSTNLQQGPLR

SEQ ID NO: 17075 - protein, 31 aa, Artificial Sequence
  Description of Artificial Sequence: Synthetic polypeptide
DEEEIRTTNPVATEQYGSVDETQNLVQRGNR

SEQ ID NO: 17076 - protein, 31 aa, Artificial Sequence
  Description of Artificial Sequence: Synthetic polypeptide
DEEEIRTTNPVATEQYGSVSTNLQDRKGNDN

SEQ ID NO: 17077 - protein, 28 aa, Artificial Sequence
  Description of Artificial Sequence: Synthetic peptide
DEEEIRTTNPVATECYGSVDTNLQGGTR

SEQ ID NO: 17078 - protein, 30 aa, Artificial Sequence
  Description of Artificial Sequence: Synthetic polypeptide
DEEEIRTTNPVATEQYGSVSTNLVQENGNT

SEQ ID NO: 17079 - protein, 29 aa, Artificial Sequence
  Description of Artificial Sequence: Synthetic peptide
DEEEIATTNPYATEQYGSVSENLNQRGNR

SEQ ID NO: 17080 - protein, 28 aa, Artificial Sequence
  Description of Artificial Sequence: Synthetic peptide
DEEEIRCTNPVATEQWGSVSENLQRGNA

SEQ ID NO: 17081 - protein, 29 aa, Artificial Sequence
  Description of Artificial Sequence: Synthetic peptide
SEEEIRSTNPVATEQYGTVSTNLQRGNDR

SEQ ID NO: 17082 - protein, 29 aa, Artificial Sequence
  Description of Artificial Sequence: Synthetic peptide
DEEEIRTTNCVATECYGSVSTNLQRGNDL

SEQ ID NO: 17083 - protein, 28 aa, Artificial Sequence
  Description of Artificial Sequence: Synthetic peptide
DEEEIRTTNIVATSQYGDHSTNLQRGNR

SEQ ID NO: 17084 - protein, 29 aa, Artificial Sequence
  Description of Artificial Sequence: Synthetic peptide
DEEEIRATNPVAWEQYGSVSTNLQLNGNR

SEQ ID NO: 17085 - protein, 30 aa, Artificial Sequence
  Description of Artificial Sequence: Synthetic polypeptide
DEEEIRTTNPVATEQFGSVSTANLQEQGNR

SEQ ID NO: 17086 - protein, 29 aa, Artificial Sequence
  Description of Artificial Sequence: Synthetic peptide
DEEEIRTTNPVATECYGSVSTNLQRGEDL

SEQ ID NO: 17087 - protein, 29 aa, Artificial Sequence
  Description of Artificial Sequence: Synthetic peptide
DEEEIRTTNPVATEQYGSVSTMDLQAGNA

SEQ ID NO: 17088 - protein, 30 aa, Artificial Sequence
  Description of Artificial Sequence: Synthetic polypeptide
DEEEIRTTNPVATEQYGSVDTGNPGQRGNR

SEQ ID NO: 17089 - protein, 28 aa, Artificial Sequence
  Description of Artificial Sequence: Synthetic peptide
DEEEIRTTNPVATEQYGSVDTNEQLGER

SEQ ID NO: 17090 - protein, 30 aa, Artificial Sequence
  Description of Artificial Sequence: Synthetic polypeptide
DEEEIRTTNPFATEQYGSVSTNLDRKGENR

SEQ ID NO: 17091 - protein, 28 aa, Artificial Sequence
  Description of Artificial Sequence: Synthetic peptide
DEEEIRTTNPVATEQYGSVSTELEDGNP

SEQ ID NO: 17092 - protein, 28 aa, Artificial Sequence
  Description of Artificial Sequence: Synthetic peptide
QEEEIRTTNPVATEQYGCVSTNLQRGIF

SEQ ID NO: 17093 - protein, 28 aa, Artificial Sequence
  Description of Artificial Sequence: Synthetic peptide
DEEEIRTTNPVASEQYGSVSTNIQRGMK

SEQ ID NO: 17094 - protein, 28 aa, Artificial Sequence
  Description of Artificial Sequence: Synthetic peptide
DEECIRTTNPVATEQYGDVHTNLLRGNR

SEQ ID NO: 17095 - protein, 28 aa, Artificial Sequence
  Description of Artificial Sequence: Synthetic peptide
SEEEIRCTNPVATECYGIVSTNLQRGNR

SEQ ID NO: 17096 - protein, 28 aa, Artificial Sequence
  Description of Artificial Sequence: Synthetic peptide
DENEIVTTNPVATEVYGWVSTNLQRGNR

SEQ ID NO: 17097 - protein, 28 aa, Artificial Sequence
  Description of Artificial Sequence: Synthetic peptide
SEEEIRTTNIVSTEQYGSVSTDLQRGNR

SEQ ID NO: 17098 - protein, 28 aa, Artificial Sequence
  Description of Artificial Sequence: Synthetic peptide
DEEEISTTNPVATEQYGSVSENLQMGNF

SEQ ID NO: 17099 - protein, 28 aa, Artificial Sequence
  Description of Artificial Sequence: Synthetic peptide
DEQEIRTTNIVATEQYGNVSTNLQRGNI

SEQ ID NO: 17100 - protein, 29 aa, Artificial Sequence
  Description of Artificial Sequence: Synthetic peptide
DEEEIRTTNPVACEQYGSVSTNLQVGINP

SEQ ID NO: 17101 - protein, 29 aa, Artificial Sequence
  Description of Artificial Sequence: Synthetic peptide
DEEEIRTTNPVATECYGVVSTNLQDRGDR

SEQ ID NO: 17102 - protein, 29 aa, Artificial Sequence
  Description of Artificial Sequence: Synthetic peptide
DEEEIRTTNPVCTEQYGSVSTNLQHAGNA

SEQ ID NO: 17103 - protein, 30 aa, Artificial Sequence
  Description of Artificial Sequence: Synthetic polypeptide
DEEEIRTTNPVATEQYGSVSPTDLQFRGNL

SEQ ID NO: 17104 - protein, 28 aa, Artificial Sequence
  Description of Artificial Sequence: Synthetic peptide
DEEEIRTTNPVSTEGYGSCSDNLQRGNR

SEQ ID NO: 17105 - protein, 28 aa, Artificial Sequence
  Description of Artificial Sequence: Synthetic peptide
DDEEIRTTNPVATEVYGAVATNLQRGNR

SEQ ID NO: 17106 - protein, 28 aa, Artificial Sequence
  Description of Artificial Sequence: Synthetic peptide
DEEEIATTNPVATEIYGSVSTNLQVGND

SEQ ID NO: 17107 - protein, 28 aa, Artificial Sequence
  Description of Artificial Sequence: Synthetic peptide
DEQEIRTTNPVATEQYGSVDTDLDRGNR

SEQ ID NO: 17108 - protein, 32 aa, Artificial Sequence
  Description of Artificial Sequence: Synthetic polypeptide
DEEEIRTTNPVATEQYGSVDSTNLVQERGNDR

SEQ ID NO: 17109 - protein, 30 aa, Artificial Sequence
  Description of Artificial Sequence: Synthetic polypeptide
DEEEIATTNPVATEQYGSVSTNLDQRGNQG

SEQ ID NO: 17110 - protein, 28 aa, Artificial Sequence
  Description of Artificial Sequence: Synthetic peptide
DEEEIRTTNPDATEQYGSVSTPLQQGNP

SEQ ID NO: 17111 - protein, 28 aa, Artificial Sequence
  Description of Artificial Sequence: Synthetic peptide
DENEIATTNPVSTEQYGDVSTNLQRGNR

SEQ ID NO: 17112 - protein, 28 aa, Artificial Sequence
  Description of Artificial Sequence: Synthetic peptide
DEEEIRTTNPVATEWWGSVSTNEQIGNR

SEQ ID NO: 17113 - protein, 28 aa, Artificial Sequence
  Description of Artificial Sequence: Synthetic peptide
DEEEIRTTNPVATEQYGSVSTNEQDGES

SEQ ID NO: 17114 - protein, 28 aa, Artificial Sequence
  Description of Artificial Sequence: Synthetic peptide
DEEEIRTTNPVATEQYGSVSTGVQRPTR

SEQ ID NO: 17115 - protein, 28 aa, Artificial Sequence
  Description of Artificial Sequence: Synthetic peptide
DEEEIRTTNPVATEQYGSVSTDPQGGNL

SEQ ID NO: 17116 - protein, 28 aa, Artificial Sequence
  Description of Artificial Sequence: Synthetic peptide
DEEEITTTNIVATEQYGGVSTNLQQGNR

SEQ ID NO: 17117 - protein, 28 aa, Artificial Sequence
  Description of Artificial Sequence: Synthetic peptide
DEEEIRTTNPIATEIYGCVSTNLERGNR

SEQ ID NO: 17118 - protein, 28 aa, Artificial Sequence
  Description of Artificial Sequence: Synthetic peptide
DEEEIRCTNPVATEQYGSTSNNLERGNR

SEQ ID NO: 17119 - protein, 28 aa, Artificial Sequence
  Description of Artificial Sequence: Synthetic peptide
DEEEIRTTNPDATEQYGSVSTNGQPGNE

SEQ ID NO: 17120 - protein, 28 aa, Artificial Sequence
  Description of Artificial Sequence: Synthetic peptide
NEEEIRCTNPVATEVYGSVSTELQRGNR

SEQ ID NO: 17121 - protein, 29 aa, Artificial Sequence
  Description of Artificial Sequence: Synthetic peptide
DENEIRTTNPVATEQYGSVSTNEQMQGNR

SEQ ID NO: 17122 - protein, 28 aa, Artificial Sequence
  Description of Artificial Sequence: Synthetic peptide
DEEEIATTNPVATEQYGSVSTDLQVGER

SEQ ID NO: 17123 - protein, 30 aa, Artificial Sequence
  Description of Artificial Sequence: Synthetic polypeptide
DEEEIRTTNPVATEQYGSVSTNLQEAGNDQ

SEQ ID NO: 17124 - protein, 30 aa, Artificial Sequence
  Description of Artificial Sequence: Synthetic polypeptide
DEEEIRTTNPVATEQYGSVSCENLQCMGNR

SEQ ID NO: 17125 - protein, 28 aa, Artificial Sequence
  Description of Artificial Sequence: Synthetic peptide
AEEEIRTTNPVATEQYGDASTNLQRGNN

SEQ ID NO: 17126 - protein, 29 aa, Artificial Sequence
  Description of Artificial Sequence: Synthetic peptide
DEEEIRTTNPVATEQYGSVSCENLQAGNQ

SEQ ID NO: 17127 - protein, 28 aa, Artificial Sequence
  Description of Artificial Sequence: Synthetic peptide
DEEEIRTTNPFATEQYGVVSTNDQPGNR

SEQ ID NO: 17128 - protein, 28 aa, Artificial Sequence
  Description of Artificial Sequence: Synthetic peptide
DEGEIRATNPVATEQYGSVSTNIQRGNF

SEQ ID NO: 17129 - protein, 28 aa, Artificial Sequence
  Description of Artificial Sequence: Synthetic peptide
DEEEIRTTNPDATEQYGSVSTNDDEGNR

SEQ ID NO: 17130 - protein, 28 aa, Artificial Sequence
  Description of Artificial Sequence: Synthetic peptide
DEEEIATTNPVATEQYGSMSENLQHGNR

SEQ ID NO: 17131 - protein, 28 aa, Artificial Sequence
  Description of Artificial Sequence: Synthetic peptide
DEEEIRTTNPVATEQYGSVSEVLQHGGR

SEQ ID NO: 17132 - protein, 28 aa, Artificial Sequence
  Description of Artificial Sequence: Synthetic peptide
DEEELRATNIVATEQYGSVSTNLQRGGR

SEQ ID NO: 17133 - protein, 30 aa, Artificial Sequence
  Description of Artificial Sequence: Synthetic polypeptide
DEEEIRTTNPVATEQYGSVSTANEQRGNTV

SEQ ID NO: 17134 - protein, 28 aa, Artificial Sequence
  Description of Artificial Sequence: Synthetic peptide
AEEEIRTTNPDATEQYGSVSTNLQLGDR

SEQ ID NO: 17135 - protein, 30 aa, Artificial Sequence
  Description of Artificial Sequence: Synthetic polypeptide
DEEEIRTTNPVATEQYGSVSTMDLQRGNDQ

SEQ ID NO: 17136 - protein, 28 aa, Artificial Sequence
  Description of Artificial Sequence: Synthetic peptide
DEQEIGTTNIVATEQYGSVSTDLQRGNR

SEQ ID NO: 17137 - protein, 28 aa, Artificial Sequence
  Description of Artificial Sequence: Synthetic peptide
DEEEIRTTNPVATEQYGSVETNLERENF

SEQ ID NO: 17138 - protein, 28 aa, Artificial Sequence
  Description of Artificial Sequence: Synthetic peptide
DEEEIRTTNPVATEQWGSVSENLMRGTR

SEQ ID NO: 17139 - protein, 30 aa, Artificial Sequence
  Description of Artificial Sequence: Synthetic polypeptide
DEEEIRTTNPVATEQYGSVSTMNLQVGNTV

SEQ ID NO: 17140 - protein, 30 aa, Artificial Sequence
  Description of Artificial Sequence: Synthetic polypeptide
DEGEIRTTNPVATEQYGSVSTLNLQREGNY

SEQ ID NO: 17141 - protein, 30 aa, Artificial Sequence
  Description of Artificial Sequence: Synthetic polypeptide
MEEEIRTTNPVATEQYGSVSTNLQNGENDR

SEQ ID NO: 17142 - protein, 29 aa, Artificial Sequence
  Description of Artificial Sequence: Synthetic peptide
DEEEIRTTNPDATEQYGSVWTNDQRGNDR

SEQ ID NO: 17143 - protein, 29 aa, Artificial Sequence
  Description of Artificial Sequence: Synthetic peptide
QEEEIRTTNPVSTEQYGSVSTENLQRGMR

SEQ ID NO: 17144 - protein, 28 aa, Artificial Sequence
  Description of Artificial Sequence: Synthetic peptide
DEEEIRTTNPAATEQYGSVSTNWQVGNG

SEQ ID NO: 17145 - protein, 28 aa, Artificial Sequence
  Description of Artificial Sequence: Synthetic peptide
DEEEIRTTNPVATEQYGSVSDNLEHGND

SEQ ID NO: 17146 - protein, 28 aa, Artificial Sequence
  Description of Artificial Sequence: Synthetic peptide
DEEEIRTTNPEATEQYGSVSTPLQSGNA

SEQ ID NO: 17147 - protein, 28 aa, Artificial Sequence
  Description of Artificial Sequence: Synthetic peptide
DEEEIRCTNPVASEMYGSVATNLQRGNR

SEQ ID NO: 17148 - protein, 29 aa, Artificial Sequence
  Description of Artificial Sequence: Synthetic peptide
DECEIRTTNPVATEQYGSVTTNQQDRGNR

SEQ ID NO: 17149 - protein, 28 aa, Artificial Sequence
  Description of Artificial Sequence: Synthetic peptide
DEEEIRTTNPVATELYGSVSTNLMVGNF

SEQ ID NO: 17150 - protein, 30 aa, Artificial Sequence
  Description of Artificial Sequence: Synthetic polypeptide
DEEEIRTTNPVATEQYGSVSTNLQEQGNDL

SEQ ID NO: 17151 - protein, 28 aa, Artificial Sequence
  Description of Artificial Sequence: Synthetic peptide
DEEEIRTTNPVATEQYGSVSTELQNGEE

SEQ ID NO: 17152 - protein, 30 aa, Artificial Sequence
  Description of Artificial Sequence: Synthetic polypeptide
KEEEIRTTNPVATEQYGSVSTNLQDRGEDR

SEQ ID NO: 17153 - protein, 28 aa, Artificial Sequence
  Description of Artificial Sequence: Synthetic peptide
DEEEIRTTNNVATEQFGNVSTNLQYGNR

SEQ ID NO: 17154 - protein, 28 aa, Artificial Sequence
  Description of Artificial Sequence: Synthetic peptide
QEEEISTTNPVATEQYGWVSTVLQRGNR

SEQ ID NO: 17155 - protein, 31 aa, Artificial Sequence
  Description of Artificial Sequence: Synthetic polypeptide
DEEEIRTTNPVATEQYGSVSDTNLERDGDNR

SEQ ID NO: 17156 - protein, 29 aa, Artificial Sequence
  Description of Artificial Sequence: Synthetic peptide
DEEEIRTTNPVATEMYGSVSTNDQLGDNR

SEQ ID NO: 17157 - protein, 30 aa, Artificial Sequence
  Description of Artificial Sequence: Synthetic polypeptide
DEEEIRTTNPVATEQYGSVSTNLQENGNDL

SEQ ID NO: 17158 - protein, 29 aa, Artificial Sequence
  Description of Artificial Sequence: Synthetic peptide
DAEEIRTTNPVATEQYGSVSENDQRNGNR

SEQ ID NO: 17159 - protein, 31 aa, Artificial Sequence
  Description of Artificial Sequence: Synthetic polypeptide
DEEEIRTTNPVATEQYGSVDSDTNLELRGNR

SEQ ID NO: 17160 - protein, 28 aa, Artificial Sequence
  Description of Artificial Sequence: Synthetic peptide
DEEEIKTTNPVSTEQYGGVSDNLQRGNR

SEQ ID NO: 17161 - protein, 31 aa, Artificial Sequence
  Description of Artificial Sequence: Synthetic polypeptide
DEEEIRTTNPVATEQYGSVSETNLQVENGNR

SEQ ID NO: 17162 - protein, 28 aa, Artificial Sequence
  Description of Artificial Sequence: Synthetic peptide
DEEEIRTTNPVSTEMYGCVGTNLQRGNR

SEQ ID NO: 17163 - protein, 31 aa, Artificial Sequence
  Description of Artificial Sequence: Synthetic polypeptide
DEEEIRTTNPVATEQYGSVASTENNEQRGNR

SEQ ID NO: 17164 - protein, 28 aa, Artificial Sequence
  Description of Artificial Sequence: Synthetic peptide
DEEEIRTTNPVATEQYGNASTNLQHPNR

SEQ ID NO: 17165 - protein, 28 aa, Artificial Sequence
  Description of Artificial Sequence: Synthetic peptide
GEEEIRTTNPVATEQYGSVSTNPQVGNM

SEQ ID NO: 17166 - protein, 28 aa, Artificial Sequence
  Description of Artificial Sequence: Synthetic peptide
DEEEIRTTNPVATEQYGSVSENLQHGEQ

SEQ ID NO: 17167 - protein, 28 aa, Artificial Sequence
  Description of Artificial Sequence: Synthetic peptide
DENEIATTNPVATECYGSVSTNLQHGNR

SEQ ID NO: 17168 - protein, 28 aa, Artificial Sequence
  Description of Artificial Sequence: Synthetic peptide
DEEEIRTTNPVATEIYGSVSTNDQTGTR

SEQ ID NO: 17169 - protein, 28 aa, Artificial Sequence
  Description of Artificial Sequence: Synthetic peptide
DEEEISTTNPVATEMYGDVSTNLQRGNS

SEQ ID NO: 17170 - protein, 28 aa, Artificial Sequence
  Description of Artificial Sequence: Synthetic peptide
DEQEIATTNPVATEQYGSVSENLQHGNR

SEQ ID NO: 17171 - protein, 30 aa, Artificial Sequence
  Description of Artificial Sequence: Synthetic polypeptide
DEEEIRTTNPVATEQFGSVSTNLQDREGDR

SEQ ID NO: 17172 - protein, 30 aa, Artificial Sequence
  Description of Artificial Sequence: Synthetic polypeptide
DEQEIRTTNPVATEQYGSVAATNLQRNGNR

SEQ ID NO: 17173 - protein, 28 aa, Artificial Sequence
  Description of Artificial Sequence: Synthetic peptide
DEEEIRTTNIVATEQYGSVITNMQRGNF

SEQ ID NO: 17174 - protein, 30 aa, Artificial Sequence
  Description of Artificial Sequence: Synthetic polypeptide
DEEEIRTTNPVATEQYGSVSTNLQRNGEDD

SEQ ID NO: 17175 - protein, 28 aa, Artificial Sequence
  Description of Artificial Sequence: Synthetic peptide
DEEEIATTNPVATECYGSVSTDLERGNR

SEQ ID NO: 17176 - protein, 28 aa, Artificial Sequence
  Description of Artificial Sequence: Synthetic peptide
DEEEIRTTNPVASENYGSVSTNLQRGTQ

SEQ ID NO: 17177 - protein, 29 aa, Artificial Sequence
  Description of Artificial Sequence: Synthetic peptide
DEEEIRTTNPVATEQYGSVDTNLQSGEND

SEQ ID NO: 17178 - protein, 30 aa, Artificial Sequence
  Description of Artificial Sequence: Synthetic polypeptide
DEEEIRTTNPVATEQYGSVSTNLQDAGNDI

SEQ ID NO: 17179 - protein, 28 aa, Artificial Sequence
  Description of Artificial Sequence: Synthetic peptide
DEEEIRCVNIVATEQYGSVSENLQRGNR

SEQ ID NO: 17180 - protein, 28 aa, Artificial Sequence
  Description of Artificial Sequence: Synthetic peptide
DEEEIATVNPVATEQFGSTSTNLQRGNR

SEQ ID NO: 17181 - protein, 28 aa, Artificial Sequence
  Description of Artificial Sequence: Synthetic peptide
DEEEIRATNPVSTEQYGEASTNLQRGNR

SEQ ID NO: 17182 - protein, 28 aa, Artificial Sequence
  Description of Artificial Sequence: Synthetic peptide
DEEEIRTTNPVATEQYGSVSEIPQNGNR

SEQ ID NO: 17183 - protein, 28 aa, Artificial Sequence
  Description of Artificial Sequence: Synthetic peptide
DMEEIRTTNPVATEQYGEVATNLQRYNR

SEQ ID NO: 17184 - protein, 29 aa, Artificial Sequence
  Description of Artificial Sequence: Synthetic peptide
DEEEIRTTNPDATEQYGSVSTNLQDEGER

SEQ ID NO: 17185 - protein, 30 aa, Artificial Sequence
  Description of Artificial Sequence: Synthetic polypeptide
DEEEIRTTNPVATECYGSVSTNLQETGNDR

SEQ ID NO: 17186 - protein, 31 aa, Artificial Sequence
  Description of Artificial Sequence: Synthetic polypeptide
DEEEIRTTNPVATEQYGSVDSTNLQDRGNDI

SEQ ID NO: 17187 - protein, 31 aa, Artificial Sequence
  Description of Artificial Sequence: Synthetic polypeptide
DEEEIRTTNPVATEQYGSVSTDNPLTQRGAR

SEQ ID NO: 17188 - protein, 31 aa, Artificial Sequence
  Description of Artificial Sequence: Synthetic polypeptide
DEEEIRTTNPVATEQYGSVDSTNLQREGEDR

SEQ ID NO: 17189 - protein, 28 aa, Artificial Sequence
  Description of Artificial Sequence: Synthetic peptide
DEMEIRTVNPVATEQYGDVSTNLQAGNR

SEQ ID NO: 17190 - protein, 28 aa, Artificial Sequence
  Description of Artificial Sequence: Synthetic peptide
DEEEIRTTNPTATEQYGSVSTNPQNGNG

SEQ ID NO: 17191 - protein, 29 aa, Artificial Sequence
  Description of Artificial Sequence: Synthetic peptide
DEEEIRTTNPTATEQYGSVSTNEQRGDNQ

SEQ ID NO: 17192 - protein, 28 aa, Artificial Sequence
  Description of Artificial Sequence: Synthetic peptide
QEEEIRATNPVATEQYGSASTNLQRGMR

SEQ ID NO: 17193 - protein, 28 aa, Artificial Sequence
  Description of Artificial Sequence: Synthetic peptide
KEEEIATTNPVATEQYGSVSENLQRENR

SEQ ID NO: 17194 - protein, 28 aa, Artificial Sequence
  Description of Artificial Sequence: Synthetic peptide
DEEEIRTTNPVATEQYGSVSTELQIGEW

SEQ ID NO: 17195 - protein, 30 aa, Artificial Sequence
  Description of Artificial Sequence: Synthetic polypeptide
DEETIRTTNPVATEQYGSVSTQNLMRGPNR

SEQ ID NO: 17196 - protein, 29 aa, Artificial Sequence
  Description of Artificial Sequence: Synthetic peptide
DEEEIRTTNPVATEQWGSVSTNLMNRGNW

SEQ ID NO: 17197 - protein, 29 aa, Artificial Sequence
  Description of Artificial Sequence: Synthetic peptide
DEEEIRTTNPVATECYGSVSTNLERGEER

SEQ ID NO: 17198 - protein, 30 aa, Artificial Sequence
  Description of Artificial Sequence: Synthetic polypeptide
DEEEIRTTNPVATEQYGSVSTMNLQAGNDQ

SEQ ID NO: 17199 - protein, 28 aa, Artificial Sequence
  Description of Artificial Sequence: Synthetic peptide
DEEEIRTTNPEATEQYGSVSTDLQRENH

SEQ ID NO: 17200 - protein, 28 aa, Artificial Sequence
  Description of Artificial Sequence: Synthetic peptide
MEEEIRTVNPVATEVYGSVSTNLERGNR

SEQ ID NO: 17201 - protein, 28 aa, Artificial Sequence
  Description of Artificial Sequence: Synthetic peptide
DENEIRTTNPVATEQWGSVSTNLMRGNQ

SEQ ID NO: 17202 - protein, 28 aa, Artificial Sequence
  Description of Artificial Sequence: Synthetic peptide
DNEEIRTTNPVATEQYGSVSHNLQEWNR

SEQ ID NO: 17203 - protein, 31 aa, Artificial Sequence
  Description of Artificial Sequence: Synthetic polypeptide
DEEEIRTTNPVATEQYGSVSATNLQLRNGND

SEQ ID NO: 17204 - protein, 29 aa, Artificial Sequence
  Description of Artificial Sequence: Synthetic peptide
DEEEIATTNPVATECYGSVSTNLQHNGNR

SEQ ID NO: 17205 - protein, 28 aa, Artificial Sequence
  Description of Artificial Sequence: Synthetic peptide
DEEEIRTTNITATEQYGVASTNLQRGNR

SEQ ID NO: 17206 - protein, 29 aa, Artificial Sequence
  Description of Artificial Sequence: Synthetic peptide
DEEEIRTTNPVATEQYGSVSTNLQIGEDF

SEQ ID NO: 17207 - protein, 28 aa, Artificial Sequence
  Description of Artificial Sequence: Synthetic peptide
DEEEIRTTNPVATECYGSVSTDLQSGNE

SEQ ID NO: 17208 - protein, 28 aa, Artificial Sequence
  Description of Artificial Sequence: Synthetic peptide
DEHEIRTTNPVATEVYGSVSTNLEVGNR

SEQ ID NO: 17209 - protein, 28 aa, Artificial Sequence
  Description of Artificial Sequence: Synthetic peptide
DEEEIRTTNPVATEQYGSVSTEEQRGEL

SEQ ID NO: 17210 - protein, 28 aa, Artificial Sequence
  Description of Artificial Sequence: Synthetic peptide
DEEEIRTTNICATEQYGTVSTNLQRQNR

SEQ ID NO: 17211 - protein, 30 aa, Artificial Sequence
  Description of Artificial Sequence: Synthetic polypeptide
DEEEIATTNPVATEQYGSVSTANEQDRGNR

SEQ ID NO: 17212 - protein, 30 aa, Artificial Sequence
  Description of Artificial Sequence: Synthetic polypeptide
DEEEIATTNPVATEQYGGVISTNLQREGNR

SEQ ID NO: 17213 - protein, 28 aa, Artificial Sequence
  Description of Artificial Sequence: Synthetic peptide
DEEEIRTTNPFATEQYGSVSTNDIRGER

SEQ ID NO: 17214 - protein, 30 aa, Artificial Sequence
  Description of Artificial Sequence: Synthetic polypeptide
DEEEIRTTNPVATEQYGSVDSTPLQEGNDR

SEQ ID NO: 17215 - protein, 28 aa, Artificial Sequence
  Description of Artificial Sequence: Synthetic peptide
DEEEIRTTNPVATEVYGSVVENLQGGNR

SEQ ID NO: 17216 - protein, 28 aa, Artificial Sequence
  Description of Artificial Sequence: Synthetic peptide
DEEEIRTTNIFATEQYGSVSNNLQRGNF

SEQ ID NO: 17217 - protein, 29 aa, Artificial Sequence
  Description of Artificial Sequence: Synthetic peptide
DEEEIRTTNPVATEQYGSVDTALVQRGNG

SEQ ID NO: 17218 - protein, 28 aa, Artificial Sequence
  Description of Artificial Sequence: Synthetic peptide
DENEIRTTNPVATEQWGSVSTNEQRGNM

SEQ ID NO: 17219 - protein, 28 aa, Artificial Sequence
  Description of Artificial Sequence: Synthetic peptide
DEEEIRTTNPVATEQYGSVSTEDQRGED

SEQ ID NO: 17220 - protein, 30 aa, Artificial Sequence
  Description of Artificial Sequence: Synthetic polypeptide
DEEEIRTTNPVATEQYGSVSTDLQEDGNDR

SEQ ID NO: 17221 - protein, 28 aa, Artificial Sequence
  Description of Artificial Sequence: Synthetic peptide
DEEEIRTTNPVATEQYGSVETELERGER

SEQ ID NO: 17222 - protein, 28 aa, Artificial Sequence
  Description of Artificial Sequence: Synthetic peptide
DEEEIRTTNPDATEQYGSVSEELQMGNR

SEQ ID NO: 17223 - protein, 28 aa, Artificial Sequence
  Description of Artificial Sequence: Synthetic peptide
DEMEIRTTNPVATEQYGSVSTALQAGNS

SEQ ID NO: 17224 - protein, 28 aa, Artificial Sequence
  Description of Artificial Sequence: Synthetic peptide
DEEEIRTTNPVATEMYGSVWTNLQPGNF

SEQ ID NO: 17225 - protein, 29 aa, Artificial Sequence
  Description of Artificial Sequence: Synthetic peptide
MEEEIRTTNPVATEQYGTVSTNLQEVGNR

SEQ ID NO: 17226 - protein, 29 aa, Artificial Sequence
  Description of Artificial Sequence: Synthetic peptide
DEEEIRTTNPVATEQYGSVSTNDTQFGNM

SEQ ID NO: 17227 - protein, 28 aa, Artificial Sequence
  Description of Artificial Sequence: Synthetic peptide
QEEEIRTTNPVATEQYGSVPTNLQRENN

SEQ ID NO: 17228 - protein, 28 aa, Artificial Sequence
  Description of Artificial Sequence: Synthetic peptide
DEEEIRPTNPVATEAYGSVSENLQRGTR

SEQ ID NO: 17229 - protein, 28 aa, Artificial Sequence
  Description of Artificial Sequence: Synthetic peptide
DEEEIRTTNPEATEQFGSVSTNLQLGNI

SEQ ID NO: 17230 - protein, 28 aa, Artificial Sequence
  Description of Artificial Sequence: Synthetic peptide
DEAEIRCTNPVATEQYGSASTNLQRLNR

SEQ ID NO: 17231 - protein, 28 aa, Artificial Sequence
  Description of Artificial Sequence: Synthetic peptide
YEEEIRTTNPVATEQYGSVNTNLQTGER

SEQ ID NO: 17232 - protein, 28 aa, Artificial Sequence
  Description of Artificial Sequence: Synthetic peptide
SEEEIYTTNPIATECYGSVSTNLQRGNR

SEQ ID NO: 17233 - protein, 28 aa, Artificial Sequence
  Description of Artificial Sequence: Synthetic peptide
DEEEIRTTNPVSTEQYGGVSNNLQRGTR

SEQ ID NO: 17234 - protein, 28 aa, Artificial Sequence
  Description of Artificial Sequence: Synthetic peptide
DEDEIRTTNPVATEQYGSVSENLMRGNS

SEQ ID NO: 17235 - protein, 28 aa, Artificial Sequence
  Description of Artificial Sequence: Synthetic peptide
DEEEIRTTNPVATEQYGSASTNLQNEER

SEQ ID NO: 17236 - protein, 29 aa, Artificial Sequence
  Description of Artificial Sequence: Synthetic peptide
DEEEIRTTNPVCTEPYGSVSTNLQVAGNR

SEQ ID NO: 17237 - protein, 29 aa, Artificial Sequence
  Description of Artificial Sequence: Synthetic peptide
MENEIRTTNPVATEQYGSVSTNLQERGNT

SEQ ID NO: 17238 - protein, 30 aa, Artificial Sequence
  Description of Artificial Sequence: Synthetic polypeptide
DEEEIRTTNPCATEQYGSVSTNLCCRGNDR

SEQ ID NO: 17239 - protein, 28 aa, Artificial Sequence
  Description of Artificial Sequence: Synthetic peptide
DEEEIRTTNIVAYEQYGSWSTNLQRGER

SEQ ID NO: 17240 - protein, 31 aa, Artificial Sequence
  Description of Artificial Sequence: Synthetic polypeptide
DEEEIRTTNPVATEQYGSVDSDTNLERGENR

SEQ ID NO: 17241 - protein, 28 aa, Artificial Sequence
  Description of Artificial Sequence: Synthetic peptide
DEEEIATTNPVATEQYGSVSTNLQVGEV

SEQ ID NO: 17242 - protein, 28 aa, Artificial Sequence
  Description of Artificial Sequence: Synthetic peptide
DEEEIRTVNPVATEQYGSVSTELQVPNR

SEQ ID NO: 17243 - protein, 28 aa, Artificial Sequence
  Description of Artificial Sequence: Synthetic peptide
DDEEIATTNPVATELYGSVSDNLQRGNR

SEQ ID NO: 17244 - protein, 28 aa, Artificial Sequence
  Description of Artificial Sequence: Synthetic peptide
DEEEIRTVNIVATEQYGSVSTELQRGNF

SEQ ID NO: 17245 - protein, 30 aa, Artificial Sequence
  Description of Artificial Sequence: Synthetic polypeptide
DEEEIRTTNPVATEQYGSVSTNLQGGGNDD

SEQ ID NO: 17246 - protein, 28 aa, Artificial Sequence
  Description of Artificial Sequence: Synthetic peptide
DENEIATTNPVATEVYGSVSTNLQRGTR

SEQ ID NO: 17247 - protein, 28 aa, Artificial Sequence
  Description of Artificial Sequence: Synthetic peptide
DEGEIATTNIVATEQYGSVSTNLQRGTR

SEQ ID NO: 17248 - protein, 28 aa, Artificial Sequence
  Description of Artificial Sequence: Synthetic peptide
DEEEIRTTNPVATEQYGSVDTNLQDEER

SEQ ID NO: 17249 - protein, 29 aa, Artificial Sequence
  Description of Artificial Sequence: Synthetic peptide
DEEEICTTNPCATEQYGSVSTNNLQRGNQ

SEQ ID NO: 17250 - protein, 29 aa, Artificial Sequence
  Description of Artificial Sequence: Synthetic peptide
DEEEIRTTNPVATEQYGSVSTNLQELGES

SEQ ID NO: 17251 - protein, 30 aa, Artificial Sequence
  Description of Artificial Sequence: Synthetic polypeptide
DEEEIRTTNPVATEQYGSVSTNLVIFEGNR

SEQ ID NO: 17252 - protein, 31 aa, Artificial Sequence
  Description of Artificial Sequence: Synthetic polypeptide
DEEEIRTTNPVATEQYGSVSTNLPQRDGEDR

SEQ ID NO: 17253 - protein, 29 aa, Artificial Sequence
  Description of Artificial Sequence: Synthetic peptide
DEEEIRTTNPVATEQYGIVSDNLQRAGMR

SEQ ID NO: 17254 - protein, 28 aa, Artificial Sequence
  Description of Artificial Sequence: Synthetic peptide
DEEEIRTTNNVATEQYGEVSTELQRGND

SEQ ID NO: 17255 - protein, 30 aa, Artificial Sequence
  Description of Artificial Sequence: Synthetic polypeptide
SEEEIRTTNPVATEQYGSVSTNEQERGDNR

SEQ ID NO: 17256 - protein, 28 aa, Artificial Sequence
  Description of Artificial Sequence: Synthetic peptide
QEEEIRTTNIVATEQYGSVSTNLERGNN

SEQ ID NO: 17257 - protein, 30 aa, Artificial Sequence
  Description of Artificial Sequence: Synthetic polypeptide
DEEEIRTTNPVAWEQYGSVSNTNLGRGNTR

SEQ ID NO: 17258 - protein, 30 aa, Artificial Sequence
  Description of Artificial Sequence: Synthetic polypeptide
DEEEIRTTNPVATEQYGSVSTNLQEQGNDQ

SEQ ID NO: 17259 - protein, 28 aa, Artificial Sequence
  Description of Artificial Sequence: Synthetic peptide
DEEEIRTTNPVATETYGSVSDNLQHGNF

SEQ ID NO: 17260 - protein, 28 aa, Artificial Sequence
  Description of Artificial Sequence: Synthetic peptide
DEEEIATTNIVATEVYGSVATNLQRGNR

SEQ ID NO: 17261 - protein, 28 aa, Artificial Sequence
  Description of Artificial Sequence: Synthetic peptide
DEEEIRTTNPCATEQYGSVSSNLQYGNI

SEQ ID NO: 17262 - protein, 28 aa, Artificial Sequence
  Description of Artificial Sequence: Synthetic peptide
DEEEIRTTNPVATEQYGSVSTDDQQGER

SEQ ID NO: 17263 - protein, 28 aa, Artificial Sequence
  Description of Artificial Sequence: Synthetic peptide
DEQEIRTTNIVATEMYGSVSTNLQRGNV

SEQ ID NO: 17264 - protein, 29 aa, Artificial Sequence
  Description of Artificial Sequence: Synthetic peptide
DEEEIRTTNPVATEQYGMSVSTDLQDGER

SEQ ID NO: 17265 - protein, 29 aa, Artificial Sequence
  Description of Artificial Sequence: Synthetic peptide
DEEEIRTTNPVATEQYGSVETELQIGENR

SEQ ID NO: 17266 - protein, 29 aa, Artificial Sequence
  Description of Artificial Sequence: Synthetic peptide
DEEEIRTTNPVATEFFGSVSTNLQLRGDR

SEQ ID NO: 17267 - protein, 30 aa, Artificial Sequence
  Description of Artificial Sequence: Synthetic polypeptide
DEEEIATTNPFATEQYGSVSTNLVQRGNDR

SEQ ID NO: 17268 - protein, 28 aa, Artificial Sequence
  Description of Artificial Sequence: Synthetic peptide
DEEEIRTTNPVATEIYGSVSTNLQLGEF

SEQ ID NO: 17269 - protein, 28 aa, Artificial Sequence
  Description of Artificial Sequence: Synthetic peptide
DEEEIRTTNPVATECYGSVSTELERGNT

SEQ ID NO: 17270 - protein, 30 aa, Artificial Sequence
  Description of Artificial Sequence: Synthetic polypeptide
DSEEIRTTNPVATEQYGSVSPTNLQRNVNR

SEQ ID NO: 17271 - protein, 30 aa, Artificial Sequence
  Description of Artificial Sequence: Synthetic polypeptide
DEEEIRTTNPVATEQYGSVSTNLQPGDNEE

SEQ ID NO: 17272 - protein, 30 aa, Artificial Sequence
  Description of Artificial Sequence: Synthetic polypeptide
DEEEIRTTNPVATEQYGSVETNLQDRGDNL

SEQ ID NO: 17273 - protein, 30 aa, Artificial Sequence
  Description of Artificial Sequence: Synthetic polypeptide
DEEEIRGTNPVATEQYGSVSATNLQRGELR

SEQ ID NO: 17274 - protein, 28 aa, Artificial Sequence
  Description of Artificial Sequence: Synthetic peptide
DEEEIRTTNPFGTEHWGSVSTNLQRGNR

SEQ ID NO: 17275 - protein, 28 aa, Artificial Sequence
  Description of Artificial Sequence: Synthetic peptide
DENEIVTTNPVATEIYGWVSTNLQRGNR

SEQ ID NO: 17276 - protein, 29 aa, Artificial Sequence
  Description of Artificial Sequence: Synthetic peptide
DEEEITTTNPVATEQYGSVSTELERGNAR

SEQ ID NO: 17277 - protein, 29 aa, Artificial Sequence
  Description of Artificial Sequence: Synthetic peptide
DEEEIRTTNPVATEQYGSVSTDLQTGNDS

SEQ ID NO: 17278 - protein, 29 aa, Artificial Sequence
  Description of Artificial Sequence: Synthetic peptide
DEEEIRTTNPVAHEQYGSVSTNLQDRPTR

SEQ ID NO: 17279 - protein, 28 aa, Artificial Sequence
  Description of Artificial Sequence: Synthetic peptide
DEEEIRTTNPTATEQYGSVSTNPQVGNN

SEQ ID NO: 17280 - protein, 28 aa, Artificial Sequence
  Description of Artificial Sequence: Synthetic peptide
DETEISTTNIVATEQYGSVATNLQRGNR

SEQ ID NO: 17281 - protein, 28 aa, Artificial Sequence
  Description of Artificial Sequence: Synthetic peptide
DEQEIRTTNPVATEQWGSVSENLQRGNM

SEQ ID NO: 17282 - protein, 30 aa, Artificial Sequence
  Description of Artificial Sequence: Synthetic polypeptide
DEEEIRTTNPVATYQYGTTVSDTNLQRGNR

SEQ ID NO: 17283 - protein, 28 aa, Artificial Sequence
  Description of Artificial Sequence: Synthetic peptide
DDEEIRTTNPVATEQYGEVSENLQRGVR

SEQ ID NO: 17284 - protein, 28 aa, Artificial Sequence
  Description of Artificial Sequence: Synthetic peptide
DEEEIATTNPVATEQYGSASTNLQRGQQ

SEQ ID NO: 17285 - protein, 29 aa, Artificial Sequence
  Description of Artificial Sequence: Synthetic peptide
DEEEIRTTNPVATEQYGSVSTNPQHGPTR

SEQ ID NO: 17286 - protein, 28 aa, Artificial Sequence
  Description of Artificial Sequence: Synthetic peptide
DEWEIRTTNIVATEQYGSVGTNLQIGNR

SEQ ID NO: 17287 - protein, 29 aa, Artificial Sequence
  Description of Artificial Sequence: Synthetic peptide
DEEEIRTTNPVATEQYGSVSTPLQRGDDE

SEQ ID NO: 17288 - protein, 28 aa, Artificial Sequence
  Description of Artificial Sequence: Synthetic peptide
DEEEIRATNPVSTEQFGSVSTNLQRGTR

SEQ ID NO: 17289 - protein, 29 aa, Artificial Sequence
  Description of Artificial Sequence: Synthetic peptide
DEEEIVTTNPVATEQFGSVSTANLQFGNR

SEQ ID NO: 17290 - protein, 29 aa, Artificial Sequence
  Description of Artificial Sequence: Synthetic peptide
DEEEIRTTNPTATEQYGSVSTNPQLIGNR

SEQ ID NO: 17291 - protein, 29 aa, Artificial Sequence
  Description of Artificial Sequence: Synthetic peptide
DEEEIRTTNPVATECWGSVSTNLQNRGNL

SEQ ID NO: 17292 - protein, 28 aa, Artificial Sequence
  Description of Artificial Sequence: Synthetic peptide
DEEEIRTTNPVATEQYGSVSTDLERGEG

SEQ ID NO: 17293 - protein, 28 aa, Artificial Sequence
  Description of Artificial Sequence: Synthetic peptide
DEEEIRTTNPDATEQYGSVSTNLQRDEE

SEQ ID NO: 17294 - protein, 28 aa, Artificial Sequence
  Description of Artificial Sequence: Synthetic peptide
EEEEIRTTNIVATEQYGSVSENLQRGTR

SEQ ID NO: 17295 - protein, 30 aa, Artificial Sequence
  Description of Artificial Sequence: Synthetic polypeptide
DEEEIRTTNPVATEQYGSVSATNLEREGND

SEQ ID NO: 17296 - protein, 28 aa, Artificial Sequence
  Description of Artificial Sequence: Synthetic peptide
DEEEIATTNPVATEQYGDVSDNLQRGLR

SEQ ID NO: 17297 - protein, 28 aa, Artificial Sequence
  Description of Artificial Sequence: Synthetic peptide
TEEYIRTTNPVATEQYGSVSTNLQPGQR

SEQ ID NO: 17298 - protein, 28 aa, Artificial Sequence
  Description of Artificial Sequence: Synthetic peptide
DEEEIRTTNPAATEMYGSVSTNPQIGNR

SEQ ID NO: 17299 - protein, 28 aa, Artificial Sequence
  Description of Artificial Sequence: Synthetic peptide
DENEIRSTNPVATEQYGSYSENLQRGNR

SEQ ID NO: 17300 - protein, 28 aa, Artificial Sequence
  Description of Artificial Sequence: Synthetic peptide
DEEEIRTTNPVCTEQYGSVSTDLQNGNT

SEQ ID NO: 17301 - protein, 28 aa, Artificial Sequence
  Description of Artificial Sequence: Synthetic peptide
DEEEIRTTNPFATEQYGSVSTNLEREND

SEQ ID NO: 17302 - protein, 29 aa, Artificial Sequence
  Description of Artificial Sequence: Synthetic peptide
DEEEIRTTNPVATEQYGSVSTDLQEQGND

SEQ ID NO: 17303 - protein, 29 aa, Artificial Sequence
  Description of Artificial Sequence: Synthetic peptide
DEEEIATTNPVATEQYGSVSCTDLCRGNR

SEQ ID NO: 17304 - protein, 28 aa, Artificial Sequence
  Description of Artificial Sequence: Synthetic peptide
DEEEIRTTNPFATEQYGSVSTNDQLGNE

SEQ ID NO: 17305 - protein, 28 aa, Artificial Sequence
  Description of Artificial Sequence: Synthetic peptide
AENEIRTTNPVATEQYGSVSTPLQRGER

SEQ ID NO: 17306 - protein, 30 aa, Artificial Sequence
  Description of Artificial Sequence: Synthetic polypeptide
DEEEIRTTNPVATEQYGSVDSATNLEVGNR

SEQ ID NO: 17307 - protein, 28 aa, Artificial Sequence
  Description of Artificial Sequence: Synthetic peptide
DEEEIRTTNPTATEQYGSVSTNEQNGNV

SEQ ID NO: 17308 - protein, 29 aa, Artificial Sequence
  Description of Artificial Sequence: Synthetic peptide
DTEEIRTTNPVATEQYGSWSTNLTQRGNP

SEQ ID NO: 17309 - protein, 28 aa, Artificial Sequence
  Description of Artificial Sequence: Synthetic peptide
DEEEIRTTNPVATEQYGSVSTELEDGNN

SEQ ID NO: 17310 - protein, 28 aa, Artificial Sequence
  Description of Artificial Sequence: Synthetic peptide
DEEEIRTTNPEATENYGSVSTNLQGGNM

SEQ ID NO: 17311 - protein, 29 aa, Artificial Sequence
  Description of Artificial Sequence: Synthetic peptide
DEEEIRTTNPVATEQYGSVSTDLQEQGNV

SEQ ID NO: 17312 - protein, 28 aa, Artificial Sequence
  Description of Artificial Sequence: Synthetic peptide
SEEEIRATNPVATEQYGSVSDNLQRGNQ

SEQ ID NO: 17313 - protein, 28 aa, Artificial Sequence
  Description of Artificial Sequence: Synthetic peptide
DEEEIRTTNPVATELYGSCSTNLQHGNQ

SEQ ID NO: 17314 - protein, 28 aa, Artificial Sequence
  Description of Artificial Sequence: Synthetic peptide
DEEEIRTTNPVATELYGSVSTNPQQGNI

SEQ ID NO: 17315 - protein, 30 aa, Artificial Sequence
  Description of Artificial Sequence: Synthetic polypeptide
DEEEIRTTNPVATEQYGSVDCTMNLQRGNH

SEQ ID NO: 17316 - protein, 28 aa, Artificial Sequence
  Description of Artificial Sequence: Synthetic peptide
DEEEIRTTNPVATEQYGSCSENLQAGER

SEQ ID NO: 17317 - protein, 28 aa, Artificial Sequence
  Description of Artificial Sequence: Synthetic peptide
DEEEITTTNPVATEVYGTVSTNLQRGNS

SEQ ID NO: 17318 - protein, 29 aa, Artificial Sequence
  Description of Artificial Sequence: Synthetic peptide
DEEEIRTTNPVATEQYGSVSCENLQMGNA

SEQ ID NO: 17319 - protein, 28 aa, Artificial Sequence
  Description of Artificial Sequence: Synthetic peptide
DEEEIRTTNPDATEQYGVVATNLQRGND

SEQ ID NO: 17320 - protein, 28 aa, Artificial Sequence
  Description of Artificial Sequence: Synthetic peptide
DEEEIATTNPVATECYGSVSTDLQRGER

SEQ ID NO: 17321 - protein, 28 aa, Artificial Sequence
  Description of Artificial Sequence: Synthetic peptide
DEEEIRTTNPVATEQYGDVSENLQHENR

SEQ ID NO: 17322 - protein, 28 aa, Artificial Sequence
  Description of Artificial Sequence: Synthetic peptide
DEEEIGTTNPVATEQYGSVSTGLQIGNA

SEQ ID NO: 17323 - protein, 30 aa, Artificial Sequence
  Description of Artificial Sequence: Synthetic polypeptide
DEEEIRTTNPVATEQYGSVSTNLQERGDDW

SEQ ID NO: 17324 - protein, 28 aa, Artificial Sequence
  Description of Artificial Sequence: Synthetic peptide
DEEEIRTTNPCATEQYGVVSSNIQRGNR

SEQ ID NO: 17325 - protein, 28 aa, Artificial Sequence
  Description of Artificial Sequence: Synthetic peptide
DEEEIRTTNSVNTEQYGSVSTFLQRGNS

SEQ ID NO: 17326 - protein, 28 aa, Artificial Sequence
  Description of Artificial Sequence: Synthetic peptide
DEEEISTTNPTATEQYGSVSVNLQRGNN

SEQ ID NO: 17327 - protein, 28 aa, Artificial Sequence
  Description of Artificial Sequence: Synthetic peptide
DEGEVRTTNPVATEQFGSVSTNLQRLNR

SEQ ID NO: 17328 - protein, 29 aa, Artificial Sequence
  Description of Artificial Sequence: Synthetic peptide
DEEEIRTTNPVATEQYGWVGTNLQSRGER

SEQ ID NO: 17329 - protein, 30 aa, Artificial Sequence
  Description of Artificial Sequence: Synthetic polypeptide
DEEEIRTTNPTATEQYGSVSTMNLQQGDNR

SEQ ID NO: 17330 - protein, 29 aa, Artificial Sequence
  Description of Artificial Sequence: Synthetic peptide
DEEEIVTTNPVATEQYGSVSTNDVQDGNR

SEQ ID NO: 17331 - protein, 29 aa, Artificial Sequence
  Description of Artificial Sequence: Synthetic peptide
DEEEIRTTNPVATEQYGSVSTDLERGNDE

SEQ ID NO: 17332 - protein, 29 aa, Artificial Sequence
  Description of Artificial Sequence: Synthetic peptide
DEEEIRTTNPVATEQYGSVSTNLQDQGES

SEQ ID NO: 17333 - protein, 28 aa, Artificial Sequence
  Description of Artificial Sequence: Synthetic peptide
DEEEIRTTNIVATEQYGIVATNLERGNR

SEQ ID NO: 17334 - protein, 28 aa, Artificial Sequence
  Description of Artificial Sequence: Synthetic peptide
DEEEIATTNPVATEQYGIVSTNLQIGNF

SEQ ID NO: 17335 - protein, 28 aa, Artificial Sequence
  Description of Artificial Sequence: Synthetic peptide
DEQEIVTTNPVATEHYGWVSTNLQRGNR

SEQ ID NO: 17336 - protein, 29 aa, Artificial Sequence
  Description of Artificial Sequence: Synthetic peptide
DEEEIRTTNPVATEQYGSVSTNEQQGNTN

SEQ ID NO: 17337 - protein, 28 aa, Artificial Sequence
  Description of Artificial Sequence: Synthetic peptide
DENEIRTTNPVATEQYGSVSENLMRENR

SEQ ID NO: 17338 - protein, 29 aa, Artificial Sequence
  Description of Artificial Sequence: Synthetic peptide
DEEEIRTTNPVATEQYGSVSTMDLQMGNM

SEQ ID NO: 17339 - protein, 28 aa, Artificial Sequence
  Description of Artificial Sequence: Synthetic peptide
DEEEIRTTNIVATEQYGQVATNLQRSNR

SEQ ID NO: 17340 - protein, 28 aa, Artificial Sequence
  Description of Artificial Sequence: Synthetic peptide
AEEEIATTNIVATEVYGSVSTNLQRGNR

SEQ ID NO: 17341 - protein, 28 aa, Artificial Sequence
  Description of Artificial Sequence: Synthetic peptide
DEEEIRTTNPVATEQFGSVSTGWQFGNR

SEQ ID NO: 17342 - protein, 29 aa, Artificial Sequence
  Description of Artificial Sequence: Synthetic peptide
DDEEIRTTNPVATEQYGSVSCTNLQTGNL

SEQ ID NO: 17343 - protein, 28 aa, Artificial Sequence
  Description of Artificial Sequence: Synthetic peptide
DEMEICTTNPVATELYGSASTNLQRGNR

SEQ ID NO: 17344 - protein, 29 aa, Artificial Sequence
  Description of Artificial Sequence: Synthetic peptide
DEEEIVCTNPVATEQYGSVSTNNLQRGND

SEQ ID NO: 17345 - protein, 28 aa, Artificial Sequence
  Description of Artificial Sequence: Synthetic peptide
DEAEIRATNPCATEQYGSVSTNLQRGNL

SEQ ID NO: 17346 - protein, 28 aa, Artificial Sequence
  Description of Artificial Sequence: Synthetic peptide
DEEEIRTTNPVATEQYGEVSENLQHGNV

SEQ ID NO: 17347 - protein, 29 aa, Artificial Sequence
  Description of Artificial Sequence: Synthetic peptide
DEEEIRTTNPVAYEQYGSVSENLQRGDNS

SEQ ID NO: 17348 - protein, 29 aa, Artificial Sequence
  Description of Artificial Sequence: Synthetic peptide
DEEEIRTTNPVATEQYGSVESTNDQGGNQ

SEQ ID NO: 17349 - protein, 28 aa, Artificial Sequence
  Description of Artificial Sequence: Synthetic peptide
DEETIRTTNPVATEQYGSVFTNLFRGNN

SEQ ID NO: 17350 - protein, 30 aa, Artificial Sequence
  Description of Artificial Sequence: Synthetic polypeptide
DEEEIRTTNPVATEQYGSVSTNLQDSGNDF

SEQ ID NO: 17351 - protein, 30 aa, Artificial Sequence
  Description of Artificial Sequence: Synthetic polypeptide
DEEEIRTTNPVATEQYGSVSTNEQDVGNDR

SEQ ID NO: 17352 - protein, 31 aa, Artificial Sequence
  Description of Artificial Sequence: Synthetic polypeptide
DEEEIRTTNPVATEQYGFVSTPNLQRNGDNR

SEQ ID NO: 17353 - protein, 29 aa, Artificial Sequence
  Description of Artificial Sequence: Synthetic peptide
DEEEIRTTNPVATEVYGSVSTNLEREGNM

SEQ ID NO: 17354 - protein, 30 aa, Artificial Sequence
  Description of Artificial Sequence: Synthetic polypeptide
DEEEIRTTNPVATEQYGSVSTNNDQTRGND

SEQ ID NO: 17355 - protein, 28 aa, Artificial Sequence
  Description of Artificial Sequence: Synthetic peptide
DEEEIRTVNPVSTEPYGSVSTNLQRGNS

SEQ ID NO: 17356 - protein, 29 aa, Artificial Sequence
  Description of Artificial Sequence: Synthetic peptide
DEEEIRTTNPVATEQYGSWSITDDQRGNR

SEQ ID NO: 17357 - protein, 28 aa, Artificial Sequence
  Description of Artificial Sequence: Synthetic peptide
GEEEIRTTNPVATEQYGSVSTNEERGNW

SEQ ID NO: 17358 - protein, 29 aa, Artificial Sequence
  Description of Artificial Sequence: Synthetic peptide
DEMEIRTTNPVATEQYGSVDTNLQGGNLR

SEQ ID NO: 17359 - protein, 28 aa, Artificial Sequence
  Description of Artificial Sequence: Synthetic peptide
DEEQIRTTNPVATECYGSVSHNLDRGNR

SEQ ID NO: 17360 - protein, 28 aa, Artificial Sequence
  Description of Artificial Sequence: Synthetic peptide
DEEEIRTTNIVATEQYGWVSTNIQQGNR

SEQ ID NO: 17361 - protein, 31 aa, Artificial Sequence
  Description of Artificial Sequence: Synthetic polypeptide
DEEEIRTTNPVATEQYGSVSITNLESRGNDR

SEQ ID NO: 17362 - protein, 30 aa, Artificial Sequence
  Description of Artificial Sequence: Synthetic polypeptide
DEEEIRTTNPVATEQYGSMSTNLQNHGDNR

SEQ ID NO: 17363 - protein, 29 aa, Artificial Sequence
  Description of Artificial Sequence: Synthetic peptide
DEEEIRTTNPVATEIYGVVSTNLQDRGNW

SEQ ID NO: 17364 - protein, 28 aa, Artificial Sequence
  Description of Artificial Sequence: Synthetic peptide
DEVEIRTTNPVATEQYGEVSTNLQREDR

SEQ ID NO: 17365 - protein, 28 aa, Artificial Sequence
  Description of Artificial Sequence: Synthetic peptide
DEEEIRTTNPEATEQYGSVSTALQQGNG

SEQ ID NO: 17366 - protein, 28 aa, Artificial Sequence
  Description of Artificial Sequence: Synthetic peptide
DEVEIRTTNPVATEQYGSVSENLQQGNF

SEQ ID NO: 17367 - protein, 28 aa, Artificial Sequence
  Description of Artificial Sequence: Synthetic peptide
DENEIRATNPVATEHYGWVSTNLQRGNR

SEQ ID NO: 17368 - protein, 30 aa, Artificial Sequence
  Description of Artificial Sequence: Synthetic polypeptide
DEEEIRTTNPVATEQYGSVSTENLELGENR

SEQ ID NO: 17369 - protein, 28 aa, Artificial Sequence
  Description of Artificial Sequence: Synthetic peptide
DEAEIRTTNPVAYENYGSVSTNLQRGNF

SEQ ID NO: 17370 - protein, 28 aa, Artificial Sequence
  Description of Artificial Sequence: Synthetic peptide
SEEEIRTTNPVATEQYGSVNENLQQGNR

SEQ ID NO: 17371 - protein, 28 aa, Artificial Sequence
  Description of Artificial Sequence: Synthetic peptide
DEEEIATTNPVATECYGSVSTNLQHGNL

SEQ ID NO: 17372 - protein, 28 aa, Artificial Sequence
  Description of Artificial Sequence: Synthetic peptide
VEEEIATTNIVATEQYGSVSENLQRGNR

SEQ ID NO: 17373 - protein, 28 aa, Artificial Sequence
  Description of Artificial Sequence: Synthetic peptide
DEEEIRTTNPVATEQYGSVETPLQMGNH

SEQ ID NO: 17374 - protein, 28 aa, Artificial Sequence
  Description of Artificial Sequence: Synthetic peptide
DEEEIRTTNIVATEVYGSVSTNIERGNR

SEQ ID NO: 17375 - protein, 28 aa, Artificial Sequence
  Description of Artificial Sequence: Synthetic peptide
DEEEIAATNPVASEIYGSVSTNLQRGNR

SEQ ID NO: 17376 - protein, 28 aa, Artificial Sequence
  Description of Artificial Sequence: Synthetic peptide
DEEEIRTTNPVATEVYGSVSENQQNGNR

SEQ ID NO: 17377 - protein, 28 aa, Artificial Sequence
  Description of Artificial Sequence: Synthetic peptide
DEEEIRSTNPVATEQYGVVSENLQLGNR

SEQ ID NO: 17378 - protein, 30 aa, Artificial Sequence
  Description of Artificial Sequence: Synthetic polypeptide
DEEEIRTTNPVATEQYGSVSTNPQEQGNTR

SEQ ID NO: 17379 - protein, 30 aa, Artificial Sequence
  Description of Artificial Sequence: Synthetic polypeptide
DEEEIRTTNPVATEQYGSVSTNLERDGNEE

SEQ ID NO: 17380 - protein, 29 aa, Artificial Sequence
  Description of Artificial Sequence: Synthetic peptide
DEEEIRTTNPVATEQYGSYVSTNDDRENR

SEQ ID NO: 17381 - protein, 28 aa, Artificial Sequence
  Description of Artificial Sequence: Synthetic peptide
QEQEIRTTNPVATEQYGEVSDNLQRGNR

SEQ ID NO: 17382 - protein, 28 aa, Artificial Sequence
  Description of Artificial Sequence: Synthetic peptide
DEEEIWTTNINATEQYGSVSTNLQCGNR

SEQ ID NO: 17383 - protein, 28 aa, Artificial Sequence
  Description of Artificial Sequence: Synthetic peptide
DEEEIRTTNPVATECYGSVSTDLQAGNI

SEQ ID NO: 17384 - protein, 28 aa, Artificial Sequence
  Description of Artificial Sequence: Synthetic peptide
DEQEIAATNPVATEMYGSVSTNLQRGNR

SEQ ID NO: 17385 - protein, 28 aa, Artificial Sequence
  Description of Artificial Sequence: Synthetic peptide
DEEEIRTTNPCATEVYGSVATNLQRGNQ

SEQ ID NO: 17386 - protein, 28 aa, Artificial Sequence
  Description of Artificial Sequence: Synthetic peptide
AEEEIRTTNPVATEQYGDVSENLQHGNR

SEQ ID NO: 17387 - protein, 28 aa, Artificial Sequence
  Description of Artificial Sequence: Synthetic peptide
VEEEIRTTNPVATEQYGSVSTDLQVGNH

SEQ ID NO: 17388 - protein, 32 aa, Artificial Sequence
  Description of Artificial Sequence: Synthetic polypeptide
DEEEIRTTNPVATEQYGSVSTMNLQQRFGNDR

SEQ ID NO: 17389 - protein, 28 aa, Artificial Sequence
  Description of Artificial Sequence: Synthetic peptide
DEQEIRTTNITATEQYGSVSTNLQRGER

SEQ ID NO: 17390 - protein, 29 aa, Artificial Sequence
  Description of Artificial Sequence: Synthetic peptide
DEEEIRTTNPVATEQYGVVSTNLEIYGNR

SEQ ID NO: 17391 - protein, 28 aa, Artificial Sequence
  Description of Artificial Sequence: Synthetic peptide
DEEEIRTTNPVATQCYGSVSHNDQRGNR

SEQ ID NO: 17392 - protein, 30 aa, Artificial Sequence
  Description of Artificial Sequence: Synthetic polypeptide
DEEEIRTTNPVATEQYGMSVHQTNLQRGNP

SEQ ID NO: 17393 - protein, 28 aa, Artificial Sequence
  Description of Artificial Sequence: Synthetic peptide
DEEEIRTTNPVATEQFGCVSVNLQRGTR

SEQ ID NO: 17394 - protein, 28 aa, Artificial Sequence
  Description of Artificial Sequence: Synthetic peptide
DENEIATTNPVATEQYGSVSTNLQIGNN

SEQ ID NO: 17395 - protein, 28 aa, Artificial Sequence
  Description of Artificial Sequence: Synthetic peptide
DETEIRTTNPVATEQYGVVSNNLQRGNS

SEQ ID NO: 17396 - protein, 28 aa, Artificial Sequence
  Description of Artificial Sequence: Synthetic peptide
DEEEIRTTNPVATEQYGSVSTNLETMVR

SEQ ID NO: 17397 - protein, 28 aa, Artificial Sequence
  Description of Artificial Sequence: Synthetic peptide
DEEGIRTTNPVATEQFGSTSTNLQRGNG

SEQ ID NO: 17398 - protein, 28 aa, Artificial Sequence
  Description of Artificial Sequence: Synthetic peptide
DEEEIAQTNPVSTEQYGSVSTNLQRGGR

SEQ ID NO: 17399 - protein, 28 aa, Artificial Sequence
  Description of Artificial Sequence: Synthetic peptide
DEEEIATTNPVATQQYGSVSTNLDRGNM

SEQ ID NO: 17400 - protein, 28 aa, Artificial Sequence
  Description of Artificial Sequence: Synthetic peptide
DEEEIRSTNPVATEQYGSVDTNLQLGNE

SEQ ID NO: 17401 - protein, 28 aa, Artificial Sequence
  Description of Artificial Sequence: Synthetic peptide
DENEIRTTNIVATEQYGEVDTNLQRGNR

SEQ ID NO: 17402 - protein, 32 aa, Artificial Sequence
  Description of Artificial Sequence: Synthetic polypeptide
DEEEIRTTNPVATEQYGESVSETNLPQRGNDR

SEQ ID NO: 17403 - protein, 29 aa, Artificial Sequence
  Description of Artificial Sequence: Synthetic peptide
DEEEIRTTNPVATEQYGSVSTNLEDRGEI

SEQ ID NO: 17404 - protein, 28 aa, Artificial Sequence
  Description of Artificial Sequence: Synthetic peptide
DEQEIATTNPVATEQYGEVSENLQRGNR

SEQ ID NO: 17405 - protein, 28 aa, Artificial Sequence
  Description of Artificial Sequence: Synthetic peptide
DEEEICTTNPVATEQYGWASDNLQRGNR

SEQ ID NO: 17406 - protein, 31 aa, Artificial Sequence
  Description of Artificial Sequence: Synthetic polypeptide
DEEEIRTTNPVATEQYGDVSTPNPLQRDGNR

SEQ ID NO: 17407 - protein, 30 aa, Artificial Sequence
  Description of Artificial Sequence: Synthetic polypeptide
DEEEIRTTNPVATEQYGSVSTELQDRGNDI

SEQ ID NO: 17408 - protein, 28 aa, Artificial Sequence
  Description of Artificial Sequence: Synthetic peptide
DENEIRTTNPVATEQYGVVSENGQRGNR

SEQ ID NO: 17409 - protein, 28 aa, Artificial Sequence
  Description of Artificial Sequence: Synthetic peptide
DEEEIRTTNPTATEQFGGVSTNEQRGNR

SEQ ID NO: 17410 - protein, 28 aa, Artificial Sequence
  Description of Artificial Sequence: Synthetic peptide
DEEEIRTTNPVATEWYGNVSSNLQRGNI

SEQ ID NO: 17411 - protein, 29 aa, Artificial Sequence
  Description of Artificial Sequence: Synthetic peptide
DEEEIRTTNPVATEQYGMSVSTPLQVGND

SEQ ID NO: 17412 - protein, 30 aa, Artificial Sequence
  Description of Artificial Sequence: Synthetic polypeptide
DEEEIRTTNPVATEQYGSVSTMNEQNGDNR

SEQ ID NO: 17413 - protein, 28 aa, Artificial Sequence
  Description of Artificial Sequence: Synthetic peptide
DEEEIRTTNPVATECYGSVSTDLQAGNE

SEQ ID NO: 17414 - protein, 28 aa, Artificial Sequence
  Description of Artificial Sequence: Synthetic peptide
DEEEIRTTNPVATEQFGGVSENLQQGNR

SEQ ID NO: 17415 - protein, 28 aa, Artificial Sequence
  Description of Artificial Sequence: Synthetic peptide
DEEEIRTTNPVATEQYGSVSENEQHGNQ

SEQ ID NO: 17416 - protein, 30 aa, Artificial Sequence
  Description of Artificial Sequence: Synthetic polypeptide
DEEEIRTTNPVATEQYGSVNFITVLQRGNR

SEQ ID NO: 17417 - protein, 28 aa, Artificial Sequence
  Description of Artificial Sequence: Synthetic peptide
DENEIRTTNIVATEMYGSVSTNLQLGNR

SEQ ID NO: 17418 - protein, 28 aa, Artificial Sequence
  Description of Artificial Sequence: Synthetic peptide
DEEEIRTTNPAATEQYGDVSTNLQVGNG

SEQ ID NO: 17419 - protein, 28 aa, Artificial Sequence
  Description of Artificial Sequence: Synthetic peptide
DEEEIRTTNPVATEQYGSVETNLEQGDR

SEQ ID NO: 17420 - protein, 30 aa, Artificial Sequence
  Description of Artificial Sequence: Synthetic polypeptide
DEEEIRTTNPVATEQYGSVSTINLYFNGNR

SEQ ID NO: 17421 - protein, 28 aa, Artificial Sequence
  Description of Artificial Sequence: Synthetic peptide
DEEEIRTTNPVATEQYGEASTVLQRGGR

SEQ ID NO: 17422 - protein, 28 aa, Artificial Sequence
  Description of Artificial Sequence: Synthetic peptide
DEAPIRTTNPVATEQYGSVSTELQRGND

SEQ ID NO: 17423 - protein, 28 aa, Artificial Sequence
  Description of Artificial Sequence: Synthetic peptide
DEEEIRTTNPVATEQYGSVETDDQRGER

SEQ ID NO: 17424 - protein, 28 aa, Artificial Sequence
  Description of Artificial Sequence: Synthetic peptide
DENEIVTTNPVATEHYGWVSTNLQRGNR

SEQ ID NO: 17425 - protein, 30 aa, Artificial Sequence
  Description of Artificial Sequence: Synthetic polypeptide
DEEEIRTTNPVATEQYGSVSTNEQDRGNDF

SEQ ID NO: 17426 - protein, 28 aa, Artificial Sequence
  Description of Artificial Sequence: Synthetic peptide
DEEEIRTTNPVATECYGSVVTILQNGNR

SEQ ID NO: 17427 - protein, 28 aa, Artificial Sequence
  Description of Artificial Sequence: Synthetic peptide
DEEEIYTTNPVATEQYGSVSTNEQFGIR

SEQ ID NO: 17428 - protein, 30 aa, Artificial Sequence
  Description of Artificial Sequence: Synthetic polypeptide
DEEEIRTTNPVATEQYGSVSVGLQLRGDNR

SEQ ID NO: 17429 - protein, 30 aa, Artificial Sequence
  Description of Artificial Sequence: Synthetic polypeptide
DEEEIRTTNPVATEQYGSVSTNLQDNGNDW

SEQ ID NO: 17430 - protein, 28 aa, Artificial Sequence
  Description of Artificial Sequence: Synthetic peptide
DEEEIVATNPVATEQYGSVSTNLEPGNR

SEQ ID NO: 17431 - protein, 28 aa, Artificial Sequence
  Description of Artificial Sequence: Synthetic peptide
DEQEIVCTNPVATEQYGWVSTNLQRGNR

SEQ ID NO: 17432 - protein, 28 aa, Artificial Sequence
  Description of Artificial Sequence: Synthetic peptide
DEEEIRTTNPVATEQYGSVSTNEMTGNQ

SEQ ID NO: 17433 - protein, 28 aa, Artificial Sequence
  Description of Artificial Sequence: Synthetic peptide
DEMEIRTTNPVATEQYGSCSTPLQRGNG

SEQ ID NO: 17434 - protein, 28 aa, Artificial Sequence
  Description of Artificial Sequence: Synthetic peptide
DEEEIRTTNPVATEQYGSVSTEPQNGNM

SEQ ID NO: 17435 - protein, 28 aa, Artificial Sequence
  Description of Artificial Sequence: Synthetic peptide
DEEEIRTTNIVSTEQYGEVGTNLQRGNR

SEQ ID NO: 17436 - protein, 28 aa, Artificial Sequence
  Description of Artificial Sequence: Synthetic peptide
DEHEIRTTNPVATEQFGSVSENLQRGNM

SEQ ID NO: 17437 - protein, 30 aa, Artificial Sequence
  Description of Artificial Sequence: Synthetic polypeptide
DEEEIRTTNPVATEQYGSVSTNLQEVGNDT

SEQ ID NO: 17438 - protein, 28 aa, Artificial Sequence
  Description of Artificial Sequence: Synthetic peptide
DESEIATTNPVATENYGSVSTNQQRGNR

SEQ ID NO: 17439 - protein, 31 aa, Artificial Sequence
  Description of Artificial Sequence: Synthetic polypeptide
DEEEIRTTNPVATEQYGSVSTPNPLQRGDER

SEQ ID NO: 17440 - protein, 28 aa, Artificial Sequence
  Description of Artificial Sequence: Synthetic peptide
MENEIRTTNPVATECYGSVSTNLQRGNH

SEQ ID NO: 17441 - protein, 28 aa, Artificial Sequence
  Description of Artificial Sequence: Synthetic peptide
DENEIRTTNPCATEQYGDVSTNLQRGNY

SEQ ID NO: 17442 - protein, 31 aa, Artificial Sequence
  Description of Artificial Sequence: Synthetic polypeptide
DEEEIRTTNPVATEQYGSWSDTNLVQREGNR

SEQ ID NO: 17443 - protein, 28 aa, Artificial Sequence
  Description of Artificial Sequence: Synthetic peptide
DEEEIRTTNPVATECYGSVSTNLQHGEL

SEQ ID NO: 17444 - protein, 30 aa, Artificial Sequence
  Description of Artificial Sequence: Synthetic polypeptide
DEEEIRTTNPEATEQYGSVSTINLQRKGNA

SEQ ID NO: 17445 - protein, 28 aa, Artificial Sequence
  Description of Artificial Sequence: Synthetic peptide
DEECIRCTNPVATEQYGSVSTNLQAGNF

SEQ ID NO: 17446 - protein, 28 aa, Artificial Sequence
  Description of Artificial Sequence: Synthetic peptide
DEEEIRTTNPDATEQYGSVSEPLQPGNR

SEQ ID NO: 17447 - protein, 28 aa, Artificial Sequence
  Description of Artificial Sequence: Synthetic peptide
SEEEIRTTNIVATEQYGSVETDLQRGNR

SEQ ID NO: 17448 - protein, 29 aa, Artificial Sequence
  Description of Artificial Sequence: Synthetic peptide
DEEEIRTTNPVATEQYGSVSDTNLDPGNP

SEQ ID NO: 17449 - protein, 30 aa, Artificial Sequence
  Description of Artificial Sequence: Synthetic polypeptide
DEEEIRTTNPVATEQYGSVSTELQVVEGNR

SEQ ID NO: 17450 - protein, 29 aa, Artificial Sequence
  Description of Artificial Sequence: Synthetic peptide
DEEEIRTTNPVATEQYGSVSTNPQEIGNN

SEQ ID NO: 17451 - protein, 29 aa, Artificial Sequence
  Description of Artificial Sequence: Synthetic peptide
DEEEIRSTNPVATEQYGSVSTNLCRAGNC

SEQ ID NO: 17452 - protein, 29 aa, Artificial Sequence
  Description of Artificial Sequence: Synthetic peptide
DEEEIRTTNPVATEQWGSVDTNEQWRGNR

SEQ ID NO: 17453 - protein, 31 aa, Artificial Sequence
  Description of Artificial Sequence: Synthetic polypeptide
DEEEIRTTNPVATEQYGSVSETNLERNGDNR

SEQ ID NO: 17454 - protein, 30 aa, Artificial Sequence
  Description of Artificial Sequence: Synthetic polypeptide
DEEEIRTTNPVAIEQYGSVSTNLNDRKGNR

SEQ ID NO: 17455 - protein, 28 aa, Artificial Sequence
  Description of Artificial Sequence: Synthetic peptide
DDEEIRTTNPVATEIYGCVATNLQRGNR

SEQ ID NO: 17456 - protein, 28 aa, Artificial Sequence
  Description of Artificial Sequence: Synthetic peptide
DEEEIRTTNPVATEQYGWASENLQRGNT

SEQ ID NO: 17457 - protein, 29 aa, Artificial Sequence
  Description of Artificial Sequence: Synthetic peptide
DEEEIRTTNPVCTEQYGSASTNLQRGFNA

SEQ ID NO: 17458 - protein, 29 aa, Artificial Sequence
  Description of Artificial Sequence: Synthetic peptide
DEEEIRTTNPVATEIYGSVTSTDDQRGNR

SEQ ID NO: 17459 - protein, 28 aa, Artificial Sequence
  Description of Artificial Sequence: Synthetic peptide
DEEEIRSTNPVATEQYGEVSNTLQRGNR

SEQ ID NO: 17460 - protein, 29 aa, Artificial Sequence
  Description of Artificial Sequence: Synthetic peptide
SEEEIRTTNPVATEQYGFVSENLQRGNNR

SEQ ID NO: 17461 - protein, 29 aa, Artificial Sequence
  Description of Artificial Sequence: Synthetic peptide
DEEEIRTTNPVATEQYGVVSENLQRGTTR

SEQ ID NO: 17462 - protein, 28 aa, Artificial Sequence
  Description of Artificial Sequence: Synthetic peptide
DEEEIRTTNPVATEQYGWVSDNLQRGDY

SEQ ID NO: 17463 - protein, 28 aa, Artificial Sequence
  Description of Artificial Sequence: Synthetic peptide
DEQEIRTTNPVATEQYGVASTNLQSGNR

SEQ ID NO: 17464 - protein, 28 aa, Artificial Sequence
  Description of Artificial Sequence: Synthetic peptide
DEEEIRTTNPVASECYGSVATNLQWGNR

SEQ ID NO: 17465 - protein, 28 aa, Artificial Sequence
  Description of Artificial Sequence: Synthetic peptide
DEEEIRTTNPVATELYGWVSDNLQAGNR

SEQ ID NO: 17466 - protein, 28 aa, Artificial Sequence
  Description of Artificial Sequence: Synthetic peptide
DEEEIRTTNIVATEQYGSVLTTLQRGNG

SEQ ID NO: 17467 - protein, 30 aa, Artificial Sequence
  Description of Artificial Sequence: Synthetic polypeptide
DEEEIRTTNPVATEQYGSVSTINLQQEGND

SEQ ID NO: 17468 - protein, 30 aa, Artificial Sequence
  Description of Artificial Sequence: Synthetic polypeptide
DEEEIRTTNPVATELYGSVSENLPQRGNDR

SEQ ID NO: 17469 - protein, 28 aa, Artificial Sequence
  Description of Artificial Sequence: Synthetic peptide
DEEEIRTTNPVATEQYGSVDTNLNHGNW

SEQ ID NO: 17470 - protein, 29 aa, Artificial Sequence
  Description of Artificial Sequence: Synthetic peptide
SEEEIRATNPVATEQYGGVSTNLQRGNTR

SEQ ID NO: 17471 - protein, 28 aa, Artificial Sequence
  Description of Artificial Sequence: Synthetic peptide
DEQEIRTTNIVATEGYGSVSTNEQRGNR

SEQ ID NO: 17472 - protein, 28 aa, Artificial Sequence
  Description of Artificial Sequence: Synthetic peptide
DEEEIRCTNPDATEQYGSVSTNDQPGNR

SEQ ID NO: 17473 - protein, 31 aa, Artificial Sequence
  Description of Artificial Sequence: Synthetic polypeptide
DEEEIRTTNPVCTEQYGSVSCTNLQQREGNR

SEQ ID NO: 17474 - protein, 28 aa, Artificial Sequence
  Description of Artificial Sequence: Synthetic peptide
DEEEIRTTNPVATEQYGSVDTNGQSGER

SEQ ID NO: 17475 - protein, 28 aa, Artificial Sequence
  Description of Artificial Sequence: Synthetic peptide
DEEEIRTTNICATEIYGAVSTNLQRGNR

SEQ ID NO: 17476 - protein, 28 aa, Artificial Sequence
  Description of Artificial Sequence: Synthetic peptide
YEEEVRTTNPMATEQYGSVSTNLQAGNR

SEQ ID NO: 17477 - protein, 30 aa, Artificial Sequence
  Description of Artificial Sequence: Synthetic polypeptide
DEEEIATTNPVATECYGSVSTNLQRNGNDR

SEQ ID NO: 17478 - protein, 31 aa, Artificial Sequence
  Description of Artificial Sequence: Synthetic polypeptide
DEEEIRTTNPTATEQYGSVSTNLQERGDNTR

SEQ ID NO: 17479 - protein, 28 aa, Artificial Sequence
  Description of Artificial Sequence: Synthetic peptide
DEQEIATTNPVATEQYGDVSDNLQRGNR

SEQ ID NO: 17480 - protein, 28 aa, Artificial Sequence
  Description of Artificial Sequence: Synthetic peptide
DEEEIRTTNPVATEQYGSVSTPLDLGNE

SEQ ID NO: 17481 - protein, 28 aa, Artificial Sequence
  Description of Artificial Sequence: Synthetic peptide
MEEEIRTTNPVATEMYGSVSTNLQNGNA

SEQ ID NO: 17482 - protein, 31 aa, Artificial Sequence
  Description of Artificial Sequence: Synthetic polypeptide
DEEEIRTTNPVATEQYGSVDSTNGDQRGDNR

SEQ ID NO: 17483 - protein, 28 aa, Artificial Sequence
  Description of Artificial Sequence: Synthetic peptide
QEIEIRTTNPVATEQYGVVSTNLQRGNA

SEQ ID NO: 17484 - protein, 29 aa, Artificial Sequence
  Description of Artificial Sequence: Synthetic peptide
DEEEIATTNPVATEQYGSVSTNLQAEGNM

SEQ ID NO: 17485 - protein, 30 aa, Artificial Sequence
  Description of Artificial Sequence: Synthetic polypeptide
DEEEIRTTNPEATEQYGSVSTPNLERGNPR

SEQ ID NO: 17486 - protein, 28 aa, Artificial Sequence
  Description of Artificial Sequence: Synthetic peptide
DEEEIATTNPVATEQYGSVSENLEVGNR

SEQ ID NO: 17487 - protein, 28 aa, Artificial Sequence
  Description of Artificial Sequence: Synthetic peptide
DEEEIRTTNPFATEQYGSVSTGLDDGNR

SEQ ID NO: 17488 - protein, 30 aa, Artificial Sequence
  Description of Artificial Sequence: Synthetic polypeptide
DEEEIRTTNPVATEQYGSVSCTMCGQRGNR

SEQ ID NO: 17489 - protein, 28 aa, Artificial Sequence
  Description of Artificial Sequence: Synthetic peptide
DEEEIRTTNPVATEQYGSVSTNLHNMNH

SEQ ID NO: 17490 - protein, 28 aa, Artificial Sequence
  Description of Artificial Sequence: Synthetic peptide
DEEEICATNPVATEIYGSVSENLQRGNR

SEQ ID NO: 17491 - protein, 28 aa, Artificial Sequence
  Description of Artificial Sequence: Synthetic peptide
DEEEIRTTNIVATEQFGDVSTNLQRGTR

SEQ ID NO: 17492 - protein, 28 aa, Artificial Sequence
  Description of Artificial Sequence: Synthetic peptide
DEEEIRTTNPVATEQYGSVSTNDDREDR

SEQ ID NO: 17493 - protein, 28 aa, Artificial Sequence
  Description of Artificial Sequence: Synthetic peptide
DEEEIRTTNPVATEQYGVVSIGQQRGNR

SEQ ID NO: 17494 - protein, 30 aa, Artificial Sequence
  Description of Artificial Sequence: Synthetic polypeptide
KEEEIRTTNPVATEQYGSASTNLQERSGNR

SEQ ID NO: 17495 - protein, 29 aa, Artificial Sequence
  Description of Artificial Sequence: Synthetic peptide
DESEIRTTNPVATEQYGSVSTANPQRGNL

SEQ ID NO: 17496 - protein, 28 aa, Artificial Sequence
  Description of Artificial Sequence: Synthetic peptide
DEAEIVTVNPVATENYGSVSTNLQRGNR

SEQ ID NO: 17497 - protein, 28 aa, Artificial Sequence
  Description of Artificial Sequence: Synthetic peptide
DEEEIRTTNIVATEQYGDVSMNLQIGNR

SEQ ID NO: 17498 - protein, 28 aa, Artificial Sequence
  Description of Artificial Sequence: Synthetic peptide
DEEEIRTTNPVATEQYGSVETNLEDGNW

SEQ ID NO: 17499 - protein, 28 aa, Artificial Sequence
  Description of Artificial Sequence: Synthetic peptide
AEEEIRTTNPVATEQYGSVSELLQRGGR

SEQ ID NO: 17500 - protein, 28 aa, Artificial Sequence
  Description of Artificial Sequence: Synthetic peptide
SEVEIATTNPVATEQYGSVSTNEQRGNR

SEQ ID NO: 17501 - protein, 30 aa, Artificial Sequence
  Description of Artificial Sequence: Synthetic polypeptide
DEEEIRTTNPVATEQYGSVSTNLQELGNDN

SEQ ID NO: 17502 - protein, 29 aa, Artificial Sequence
  Description of Artificial Sequence: Synthetic peptide
DEEEIRTVNPVATEQYGSVSTDLQVEGNR

SEQ ID NO: 17503 - protein, 30 aa, Artificial Sequence
  Description of Artificial Sequence: Synthetic polypeptide
DEEEIRTTNPVATEQYGSVSTMNLQQEGNI

SEQ ID NO: 17504 - protein, 31 aa, Artificial Sequence
  Description of Artificial Sequence: Synthetic polypeptide
DEEEIRTTNPVATEQYGSVSTPNPLQIRGER

SEQ ID NO: 17505 - protein, 28 aa, Artificial Sequence
  Description of Artificial Sequence: Synthetic peptide
DEEEITTTNPVATEQYGSASTNLQVGNN

SEQ ID NO: 17506 - protein, 28 aa, Artificial Sequence
  Description of Artificial Sequence: Synthetic peptide
DEEEIATTNPVATECYGDVSENLQRGNR

SEQ ID NO: 17507 - protein, 28 aa, Artificial Sequence
  Description of Artificial Sequence: Synthetic peptide
DEECIRTTNPVATEQYGSVSTNDQDGNP

SEQ ID NO: 17508 - protein, 28 aa, Artificial Sequence
  Description of Artificial Sequence: Synthetic peptide
DEEEIRTTNPVATQQYGSVHENDQRGNR

SEQ ID NO: 17509 - protein, 30 aa, Artificial Sequence
  Description of Artificial Sequence: Synthetic polypeptide
DEEEIRTTNPTATEQYGSVSEANLQRGDNR

SEQ ID NO: 17510 - protein, 28 aa, Artificial Sequence
  Description of Artificial Sequence: Synthetic peptide
MENEIRTTNPVATEQYGSVSTDLQNGNR

SEQ ID NO: 17511 - protein, 28 aa, Artificial Sequence
  Description of Artificial Sequence: Synthetic peptide
DEEEIRTTNPDATEQYGSVSTNQERGNP

SEQ ID NO: 17512 - protein, 28 aa, Artificial Sequence
  Description of Artificial Sequence: Synthetic peptide
DEEEIRTTNPEATEQYGSVSTNLDYGNV

SEQ ID NO: 17513 - protein, 32 aa, Artificial Sequence
  Description of Artificial Sequence: Synthetic polypeptide
DEEEIRTTNPVATEQYGSVDSTNLQEREGNDR

SEQ ID NO: 17514 - protein, 28 aa, Artificial Sequence
  Description of Artificial Sequence: Synthetic peptide
DEEEIRTTNPVATEQYGSVSTDLEVGNM

SEQ ID NO: 17515 - protein, 28 aa, Artificial Sequence
  Description of Artificial Sequence: Synthetic peptide
DENEIVTTNPVATEQYGSVSTNLQNGNN

SEQ ID NO: 17516 - protein, 28 aa, Artificial Sequence
  Description of Artificial Sequence: Synthetic peptide
DEEEIRTTNPCASELYGSVATNLQRGNR

SEQ ID NO: 17517 - protein, 29 aa, Artificial Sequence
  Description of Artificial Sequence: Synthetic peptide
SEEEIRTTNPTATEQYGSVSTNLQQEGNR

SEQ ID NO: 17518 - protein, 28 aa, Artificial Sequence
  Description of Artificial Sequence: Synthetic peptide
DEEEIRCTNPVATEWWGSVSDNLQRGNR

SEQ ID NO: 17519 - protein, 29 aa, Artificial Sequence
  Description of Artificial Sequence: Synthetic peptide
DEEEIRTTNPVATEQYGSVSDNLQENGER

SEQ ID NO: 17520 - protein, 28 aa, Artificial Sequence
  Description of Artificial Sequence: Synthetic peptide
DEEEIRTTNPVATEQYGSVSDNLQHGEM

SEQ ID NO: 17521 - protein, 28 aa, Artificial Sequence
  Description of Artificial Sequence: Synthetic peptide
DEEEIRTTNIVATEQYGSVSENLMRGTR

SEQ ID NO: 17522 - protein, 29 aa, Artificial Sequence
  Description of Artificial Sequence: Synthetic peptide
DEEEIRTTNPVATEQYGSMSTELQRGEDR

SEQ ID NO: 17523 - protein, 28 aa, Artificial Sequence
  Description of Artificial Sequence: Synthetic peptide
DEEEIVATNPVATEQYGVVSTNLQAGNR

SEQ ID NO: 17524 - protein, 28 aa, Artificial Sequence
  Description of Artificial Sequence: Synthetic peptide
QEEEIRTTNIVATEQYGSVSTNLEVGNR

SEQ ID NO: 17525 - protein, 29 aa, Artificial Sequence
  Description of Artificial Sequence: Synthetic peptide
DEEEIRTTNPVSTEQYGEVSTVLQRAGNR

SEQ ID NO: 17526 - protein, 29 aa, Artificial Sequence
  Description of Artificial Sequence: Synthetic peptide
DEEEIRTTNPVATEQYGFVSDNVQRAGNR

SEQ ID NO: 17527 - protein, 31 aa, Artificial Sequence
  Description of Artificial Sequence: Synthetic polypeptide
DENEIRTTNPVATEQYGSVSTENLQRNGVNR

SEQ ID NO: 17528 - protein, 31 aa, Artificial Sequence
  Description of Artificial Sequence: Synthetic polypeptide
DEEEIRTTNPVATEQYGSVSCTMNLCRGNDR

SEQ ID NO: 17529 - protein, 28 aa, Artificial Sequence
  Description of Artificial Sequence: Synthetic peptide
SEVEIRTTNPVATEQYGEVSTNLQRGNF

SEQ ID NO: 17530 - protein, 28 aa, Artificial Sequence
  Description of Artificial Sequence: Synthetic peptide
DENEIATTNPVATEQYGSVSTNLQHGNL

SEQ ID NO: 17531 - protein, 28 aa, Artificial Sequence
  Description of Artificial Sequence: Synthetic peptide
SEEEIRTTNIVATEQYGSVSENLQRGNC

SEQ ID NO: 17532 - protein, 28 aa, Artificial Sequence
  Description of Artificial Sequence: Synthetic peptide
DEEEIRTTNPVATEQYGIVSENLMRGDR

SEQ ID NO: 17533 - protein, 30 aa, Artificial Sequence
  Description of Artificial Sequence: Synthetic polypeptide
DEEEIRTTNPVATEQYGSVSCENLQCQGNR

SEQ ID NO: 17534 - protein, 28 aa, Artificial Sequence
  Description of Artificial Sequence: Synthetic peptide
DEQEIRTTNPVATEIYGSVSMNLERGNR

SEQ ID NO: 17535 - protein, 28 aa, Artificial Sequence
  Description of Artificial Sequence: Synthetic peptide
DEEEIRTTNIVATENFGSVSTNLQRGNF

SEQ ID NO: 17536 - protein, 28 aa, Artificial Sequence
  Description of Artificial Sequence: Synthetic peptide
DEDEIATTNPVATETYGTVSTNLQRGNR

SEQ ID NO: 17537 - protein, 30 aa, Artificial Sequence
  Description of Artificial Sequence: Synthetic polypeptide
DEEEIRTTNPVATEQYGYTISTNELQRGNR

SEQ ID NO: 17538 - protein, 28 aa, Artificial Sequence
  Description of Artificial Sequence: Synthetic peptide
DEEEIRTTNPVATEQYGLVSTILQTGNA

SEQ ID NO: 17539 - protein, 28 aa, Artificial Sequence
  Description of Artificial Sequence: Synthetic peptide
AEEEICTTNPVATEQYGWVSDNLQRGNR

SEQ ID NO: 17540 - protein, 30 aa, Artificial Sequence
  Description of Artificial Sequence: Synthetic polypeptide
DEEEIRTTNPVATEQYGSVSTNLVQIIGNE

SEQ ID NO: 17541 - protein, 30 aa, Artificial Sequence
  Description of Artificial Sequence: Synthetic polypeptide
KEEEIRTTNPVATEQYGSVSTNLQDRGNDM

SEQ ID NO: 17542 - protein, 28 aa, Artificial Sequence
  Description of Artificial Sequence: Synthetic peptide
DEEEIRTTNPVATEQYGSVPENLQHGNK

SEQ ID NO: 17543 - protein, 28 aa, Artificial Sequence
  Description of Artificial Sequence: Synthetic peptide
DEEEIRTTNPVATEQYGSVSTDLEHGER

SEQ ID NO: 17544 - protein, 28 aa, Artificial Sequence
  Description of Artificial Sequence: Synthetic peptide
DEEEIRTTNPEATEQYGSVSTEDQRGDR

SEQ ID NO: 17545 - protein, 28 aa, Artificial Sequence
  Description of Artificial Sequence: Synthetic peptide
DEEEIRTTNPVATEQYGSVDTEEQRGNM

SEQ ID NO: 17546 - protein, 28 aa, Artificial Sequence
  Description of Artificial Sequence: Synthetic peptide
DEEEIRATNPTATEQYGSVSTNLQREDR

SEQ ID NO: 17547 - protein, 28 aa, Artificial Sequence
  Description of Artificial Sequence: Synthetic peptide
GEEEIRATNPVATEQYGTVSTNLQRGNV

SEQ ID NO: 17548 - protein, 30 aa, Artificial Sequence
  Description of Artificial Sequence: Synthetic polypeptide
DEEEIRTTNPVATEQYGSVSETNPLEDGNR

SEQ ID NO: 17549 - protein, 28 aa, Artificial Sequence
  Description of Artificial Sequence: Synthetic peptide
DEEEIRTTNPVATEQYGSVDTNLDLENR

SEQ ID NO: 17550 - protein, 29 aa, Artificial Sequence
  Description of Artificial Sequence: Synthetic peptide
DENEIRTTNPVATEVYGSVSENLQRAGNR

SEQ ID NO: 17551 - protein, 28 aa, Artificial Sequence
  Description of Artificial Sequence: Synthetic peptide
DEEEIRTTNIVATEIYGSVSTNLQFGNF

SEQ ID NO: 17552 - protein, 28 aa, Artificial Sequence
  Description of Artificial Sequence: Synthetic peptide
DEQEIRTTNIVATECYGSVSENLQRGNR

SEQ ID NO: 17553 - protein, 28 aa, Artificial Sequence
  Description of Artificial Sequence: Synthetic peptide
QEEEIRTTNIVATENYGSVSTNLQQGNR

SEQ ID NO: 17554 - protein, 28 aa, Artificial Sequence
  Description of Artificial Sequence: Synthetic peptide
DEEEIRCTNPCATEPYGSVSTNLQSGNR

SEQ ID NO: 17555 - protein, 31 aa, Artificial Sequence
  Description of Artificial Sequence: Synthetic polypeptide
DEEEIRTTNPVATEQYGESVSTPNLPQRGDR

SEQ ID NO: 17556 - protein, 32 aa, Artificial Sequence
  Description of Artificial Sequence: Synthetic polypeptide
DEEEIRTTNPVATEQYGSVSTLNLTQRGDNPR

SEQ ID NO: 17557 - protein, 28 aa, Artificial Sequence
  Description of Artificial Sequence: Synthetic peptide
DEEEIRTTNPVATEQYGDVSENLQHGNQ

SEQ ID NO: 17558 - protein, 28 aa, Artificial Sequence
  Description of Artificial Sequence: Synthetic peptide
DEEEIRSTNPVATEQYGSVSDNLQGFNR

SEQ ID NO: 17559 - protein, 31 aa, Artificial Sequence
  Description of Artificial Sequence: Synthetic polypeptide
DEEEIRQTNPVATEQYGSVSTNGLVQDRGNR

SEQ ID NO: 17560 - protein, 28 aa, Artificial Sequence
  Description of Artificial Sequence: Synthetic peptide
DEEEIRTTNPVATEQYGSVETNLEWGER

SEQ ID NO: 17561 - protein, 29 aa, Artificial Sequence
  Description of Artificial Sequence: Synthetic peptide
DEEEIRTTNPVATEQYGSVGSSNGQRGAR

SEQ ID NO: 17562 - protein, 28 aa, Artificial Sequence
  Description of Artificial Sequence: Synthetic peptide
DEQEIRTTNIVATECYGSVSTNLQVGNR

SEQ ID NO: 17563 - protein, 28 aa, Artificial Sequence
  Description of Artificial Sequence: Synthetic peptide
DESEIRTTNPVSTEQYGQVSTNLQRGGR

SEQ ID NO: 17564 - protein, 28 aa, Artificial Sequence
  Description of Artificial Sequence: Synthetic peptide
DEEEIRTTNPCATEQYGNVSDNLQRGNT

SEQ ID NO: 17565 - protein, 28 aa, Artificial Sequence
  Description of Artificial Sequence: Synthetic peptide
DEQEIRTTNIVATEQYGSVSTNELRGNR

SEQ ID NO: 17566 - protein, 28 aa, Artificial Sequence
  Description of Artificial Sequence: Synthetic peptide
AEEEIRTTNPVATEQYGSVSENLMRGNQ

SEQ ID NO: 17567 - protein, 29 aa, Artificial Sequence
  Description of Artificial Sequence: Synthetic peptide
DEEEIRTTNPVATEQYGSVSTELQVFGNM

SEQ ID NO: 17568 - protein, 28 aa, Artificial Sequence
  Description of Artificial Sequence: Synthetic peptide
DEEEIRTTNPVATEQYGEVSEILQYGNR

SEQ ID NO: 17569 - protein, 29 aa, Artificial Sequence
  Description of Artificial Sequence: Synthetic peptide
DEEEIATTNPVATEQYGSVSTDLQDRGNT

SEQ ID NO: 17570 - protein, 30 aa, Artificial Sequence
  Description of Artificial Sequence: Synthetic polypeptide
DEEEIRTTNPVATEQYGSVSTNLQERGEDF

SEQ ID NO: 17571 - protein, 29 aa, Artificial Sequence
  Description of Artificial Sequence: Synthetic peptide
SETEIRTTNPVATEQFGSVSTNLQREGNR

SEQ ID NO: 17572 - protein, 28 aa, Artificial Sequence
  Description of Artificial Sequence: Synthetic peptide
DDEEIRTTNCVATEQYGSVATNLQRGNF

SEQ ID NO: 17573 - protein, 29 aa, Artificial Sequence
  Description of Artificial Sequence: Synthetic peptide
DEEEIRTTNPVATEQYGAVDTNLQQQGNR

SEQ ID NO: 17574 - protein, 30 aa, Artificial Sequence
  Description of Artificial Sequence: Synthetic polypeptide
DEEEIRTTNPVATEQYGSVSTDLQDREGER

SEQ ID NO: 17575 - protein, 29 aa, Artificial Sequence
  Description of Artificial Sequence: Synthetic peptide
DEEEIRTTNPVATEVYGTVSTNLERNGNR

SEQ ID NO: 17576 - protein, 28 aa, Artificial Sequence
  Description of Artificial Sequence: Synthetic peptide
DEREIRTTNPVATWAYGSVSTNLQEGNR

SEQ ID NO: 17577 - protein, 29 aa, Artificial Sequence
  Description of Artificial Sequence: Synthetic peptide
DEVEIRTTNPVATEQFGSVSTNEQRGNTR

SEQ ID NO: 17578 - protein, 28 aa, Artificial Sequence
  Description of Artificial Sequence: Synthetic peptide
DEEEIRTTNPDATEQYGSVSTNLDPGNP

SEQ ID NO: 17579 - protein, 30 aa, Artificial Sequence
  Description of Artificial Sequence: Synthetic polypeptide
DEEEIRTTNPVATEVYGSVSTNLVQANGNR

SEQ ID NO: 17580 - protein, 28 aa, Artificial Sequence
  Description of Artificial Sequence: Synthetic peptide
DEEEIRTTNPVATEIYGSVSTNLYRENP

SEQ ID NO: 17581 - protein, 30 aa, Artificial Sequence
  Description of Artificial Sequence: Synthetic polypeptide
DEEEIRTTNPVATEQYGSVSCTDLQRGNDD

SEQ ID NO: 17582 - protein, 30 aa, Artificial Sequence
  Description of Artificial Sequence: Synthetic polypeptide
DEEEIRATNPEATEQYGSVSTNLLQRDGNR

SEQ ID NO: 17583 - protein, 28 aa, Artificial Sequence
  Description of Artificial Sequence: Synthetic peptide
DEEEIRTTNPVATEQYGSWSTNLQIEDR

SEQ ID NO: 17584 - protein, 28 aa, Artificial Sequence
  Description of Artificial Sequence: Synthetic peptide
DEEEIRTTNPFATEQYGSVSTDLQVGNA

SEQ ID NO: 17585 - protein, 29 aa, Artificial Sequence
  Description of Artificial Sequence: Synthetic peptide
DEEEIRTTNPVATEQYGSVSENLQHAGMR

SEQ ID NO: 17586 - protein, 28 aa, Artificial Sequence
  Description of Artificial Sequence: Synthetic peptide
AEEEIRTTNIEATEQYGSVSTELQRGNR

SEQ ID NO: 17587 - protein, 28 aa, Artificial Sequence
  Description of Artificial Sequence: Synthetic peptide
DEEEIRATNPVATCQYGSVSYNLQRGNG

SEQ ID NO: 17588 - protein, 28 aa, Artificial Sequence
  Description of Artificial Sequence: Synthetic peptide
DENEISTTNIVATEQYGCVSTNLQRGNR

SEQ ID NO: 17589 - protein, 28 aa, Artificial Sequence
  Description of Artificial Sequence: Synthetic peptide
DEEEIVATNPVATEVYGWVSTNLQRGNR

SEQ ID NO: 17590 - protein, 29 aa, Artificial Sequence
  Description of Artificial Sequence: Synthetic peptide
DEEEIRTTNPVATEQYGSVSTELEVGNDR

SEQ ID NO: 17591 - protein, 28 aa, Artificial Sequence
  Description of Artificial Sequence: Synthetic peptide
DEEEIRTTNIVATEQYGSVVTDLQRSNR

SEQ ID NO: 17592 - protein, 28 aa, Artificial Sequence
  Description of Artificial Sequence: Synthetic peptide
DEEEIAQTNPVATEQYGSVSTDQQRGNR

SEQ ID NO: 17593 - protein, 29 aa, Artificial Sequence
  Description of Artificial Sequence: Synthetic peptide
EEAEIRTTNPVACEQYGSVSATNLQRGNR

SEQ ID NO: 17594 - protein, 28 aa, Artificial Sequence
  Description of Artificial Sequence: Synthetic peptide
DEEEIRTTNPVATEQYGDVSTNLMRMNQ

SEQ ID NO: 17595 - protein, 28 aa, Artificial Sequence
  Description of Artificial Sequence: Synthetic peptide
DEEEIRTTNPVATEQYGTVSELLQRENR

SEQ ID NO: 17596 - protein, 28 aa, Artificial Sequence
  Description of Artificial Sequence: Synthetic peptide
DEEEIRTTNPVATEQYGSVSNNDQRVNT

SEQ ID NO: 17597 - protein, 30 aa, Artificial Sequence
  Description of Artificial Sequence: Synthetic polypeptide
DEEEIRTTNPVATEQYGSVSTNLQEIGNTF

SEQ ID NO: 17598 - protein, 30 aa, Artificial Sequence
  Description of Artificial Sequence: Synthetic polypeptide
DEEEIATTNPVATEQYGSVSTNLQTKGNDR

SEQ ID NO: 17599 - protein, 28 aa, Artificial Sequence
  Description of Artificial Sequence: Synthetic peptide
QEEEIRTTNPVGTEQYGSVSTNLQIGLR

SEQ ID NO: 17600 - protein, 28 aa, Artificial Sequence
  Description of Artificial Sequence: Synthetic peptide
DEEEIRTTNPVATELYGSVSENLQGGNA

SEQ ID NO: 17601 - protein, 30 aa, Artificial Sequence
  Description of Artificial Sequence: Synthetic polypeptide
SEEEIRTTNPFATEQYGSVSTNLQRGENDR

SEQ ID NO: 17602 - protein, 28 aa, Artificial Sequence
  Description of Artificial Sequence: Synthetic peptide
DEEEIRTTNPVATEQYGGVSEALQNGNR

SEQ ID NO: 17603 - protein, 28 aa, Artificial Sequence
  Description of Artificial Sequence: Synthetic peptide
DELEIRTTNPVATEIYGSVSTNLEPGNR

SEQ ID NO: 17604 - protein, 30 aa, Artificial Sequence
  Description of Artificial Sequence: Synthetic polypeptide
DEEEIRTTNPEATEQYGSVSTEPLQIRGNR

SEQ ID NO: 17605 - protein, 28 aa, Artificial Sequence
  Description of Artificial Sequence: Synthetic peptide
DEEEIRTTNIVATEQYGWVSENLERGNR

SEQ ID NO: 17606 - protein, 29 aa, Artificial Sequence
  Description of Artificial Sequence: Synthetic peptide
SEEEIRTTNPVATEQYGSVNENLPQRGNR

SEQ ID NO: 17607 - protein, 28 aa, Artificial Sequence
  Description of Artificial Sequence: Synthetic peptide
DEEEIRTTNPVATEMYGSVSTVLQAENR

SEQ ID NO: 17608 - protein, 30 aa, Artificial Sequence
  Description of Artificial Sequence: Synthetic polypeptide
DEEEIRTTNPVATECYGSVSTDLQREGNDR

SEQ ID NO: 17609 - protein, 30 aa, Artificial Sequence
  Description of Artificial Sequence: Synthetic polypeptide
DEEEIRTTNPVATEQYGSVETNLQIRGNPG

SEQ ID NO: 17610 - protein, 28 aa, Artificial Sequence
  Description of Artificial Sequence: Synthetic peptide
DAEEIRTTNPVASEQFGSVSTNLQRGNA

SEQ ID NO: 17611 - protein, 28 aa, Artificial Sequence
  Description of Artificial Sequence: Synthetic peptide
DEHEIRTTNIVATEQYGSVSMNLERGNR

SEQ ID NO: 17612 - protein, 28 aa, Artificial Sequence
  Description of Artificial Sequence: Synthetic peptide
DEQEIRTTNIVATEQYGSVAENLQRGNR

SEQ ID NO: 17613 - protein, 28 aa, Artificial Sequence
  Description of Artificial Sequence: Synthetic peptide
QEEEIRTTNPVATEQYGYVSTNLQVGNF

SEQ ID NO: 17614 - protein, 28 aa, Artificial Sequence
  Description of Artificial Sequence: Synthetic peptide
AENEIRTTNPVATEQYGSVSTDLERGNR

SEQ ID NO: 17615 - protein, 28 aa, Artificial Sequence
  Description of Artificial Sequence: Synthetic peptide
DEEEIRTTNPEATEQYGSVSTELQRGEM

SEQ ID NO: 17616 - protein, 28 aa, Artificial Sequence
  Description of Artificial Sequence: Synthetic peptide
DEEEIRTTNPVATEQYGSVSTELEDGNG

SEQ ID NO: 17617 - protein, 30 aa, Artificial Sequence
  Description of Artificial Sequence: Synthetic polypeptide
DEEEIRTTNPVATEQYGSQVSEVNLQAGNR

SEQ ID NO: 17618 - protein, 28 aa, Artificial Sequence
  Description of Artificial Sequence: Synthetic peptide
DENEIATTNPVATEQYGDVSTNLQRMNR

SEQ ID NO: 17619 - protein, 31 aa, Artificial Sequence
  Description of Artificial Sequence: Synthetic polypeptide
DEEEIRTTNPVATEQYGSVSTNLQIIKGNDR

SEQ ID NO: 17620 - protein, 28 aa, Artificial Sequence
  Description of Artificial Sequence: Synthetic peptide
DEEEIRTTNIVATEQYGSVETALQRGNL

SEQ ID NO: 17621 - protein, 28 aa, Artificial Sequence
  Description of Artificial Sequence: Synthetic peptide
DEEEIATTNPVATEGYGSVSENLMRGNR

SEQ ID NO: 17622 - protein, 28 aa, Artificial Sequence
  Description of Artificial Sequence: Synthetic peptide
DEEEIRTTNPVATEIYGSCSENLQAGNR

SEQ ID NO: 17623 - protein, 28 aa, Artificial Sequence
  Description of Artificial Sequence: Synthetic peptide
DEHEIVTTNPVATECYGSVSTELQRGNR

SEQ ID NO: 17624 - protein, 28 aa, Artificial Sequence
  Description of Artificial Sequence: Synthetic peptide
DEEELRTTNPVATEIYGSVANNLQRGNR

SEQ ID NO: 17625 - protein, 28 aa, Artificial Sequence
  Description of Artificial Sequence: Synthetic peptide
DEEEIRTTNPVATEQYGSVSTDLERGEL

SEQ ID NO: 17626 - protein, 28 aa, Artificial Sequence
  Description of Artificial Sequence: Synthetic peptide
SEEEIRCTNPVATEQYGSVSTNGQHGNR

SEQ ID NO: 17627 - protein, 28 aa, Artificial Sequence
  Description of Artificial Sequence: Synthetic peptide
DEEEIRTTNPVATEQYGSGSANLQYGNN

SEQ ID NO: 17628 - protein, 28 aa, Artificial Sequence
  Description of Artificial Sequence: Synthetic peptide
DSNEIRTTNPCATEQYGSVSENLQRGNR

SEQ ID NO: 17629 - protein, 28 aa, Artificial Sequence
  Description of Artificial Sequence: Synthetic peptide
DEEEIRTTNPVATEQFGSVSENLQRGMK

SEQ ID NO: 17630 - protein, 29 aa, Artificial Sequence
  Description of Artificial Sequence: Synthetic peptide
DEQEIRTTNPVATEIYGSVSASNLQRGNR

SEQ ID NO: 17631 - protein, 28 aa, Artificial Sequence
  Description of Artificial Sequence: Synthetic peptide
DEEEIATTNPTATEQYGSVNTNEQRGNR

SEQ ID NO: 17632 - protein, 28 aa, Artificial Sequence
  Description of Artificial Sequence: Synthetic peptide
DEEEIRTTNPVATEQYGSVSENLMRENA

SEQ ID NO: 17633 - protein, 28 aa, Artificial Sequence
  Description of Artificial Sequence: Synthetic peptide
DEEEIRQTNIVATEQYGDVSTNLQRGER

SEQ ID NO: 17634 - protein, 28 aa, Artificial Sequence
  Description of Artificial Sequence: Synthetic peptide
DEEEIRTTNIVATEQYGVVSTNIERGNR

SEQ ID NO: 17635 - protein, 30 aa, Artificial Sequence
  Description of Artificial Sequence: Synthetic polypeptide
DEEEIRTTNPVATEQYGSVSTNWQHEGNDR

SEQ ID NO: 17636 - protein, 28 aa, Artificial Sequence
  Description of Artificial Sequence: Synthetic peptide
DEEEIRTTNPVATEQYGSASEVLQRGGR

SEQ ID NO: 17637 - protein, 28 aa, Artificial Sequence
  Description of Artificial Sequence: Synthetic peptide
MENEIRTTNPVATEMYGSVSTNLQYGNR

SEQ ID NO: 17638 - protein, 28 aa, Artificial Sequence
  Description of Artificial Sequence: Synthetic peptide
DEQEIRTTNPVATEQYGSVDANLQRGNS

SEQ ID NO: 17639 - protein, 28 aa, Artificial Sequence
  Description of Artificial Sequence: Synthetic peptide
DEEEIRTTNPVATEQYGSVETNLEIGNF

SEQ ID NO: 17640 - protein, 28 aa, Artificial Sequence
  Description of Artificial Sequence: Synthetic peptide
DEEEIRTTNPVATEQYGGVSNQLQRGTR

SEQ ID NO: 17641 - protein, 28 aa, Artificial Sequence
  Description of Artificial Sequence: Synthetic peptide
DEEEIRTTNPDATECYGSVSTNLQVGND

SEQ ID NO: 17642 - protein, 29 aa, Artificial Sequence
  Description of Artificial Sequence: Synthetic peptide
DEEEIRTTNPVATEQYGSVSTLNGQEGNF

SEQ ID NO: 17643 - protein, 29 aa, Artificial Sequence
  Description of Artificial Sequence: Synthetic peptide
DEEEIRTTNPEATEQYGSVSTNLEPGENR

SEQ ID NO: 17644 - protein, 28 aa, Artificial Sequence
  Description of Artificial Sequence: Synthetic peptide
DEEEIRTTNPVATEQYGDVSEDLQRGER

SEQ ID NO: 17645 - protein, 28 aa, Artificial Sequence
  Description of Artificial Sequence: Synthetic peptide
DEGEIGTTNPVATEQYGEVSDNLQRGNR

SEQ ID NO: 17646 - protein, 30 aa, Artificial Sequence
  Description of Artificial Sequence: Synthetic polypeptide
DEEEIRTTNPVATEQYGSVSTNLEQSNGER

SEQ ID NO: 17647 - protein, 30 aa, Artificial Sequence
  Description of Artificial Sequence: Synthetic polypeptide
DEEEIRTTNPVATEQYGSVDSITNDLRGNR

SEQ ID NO: 17648 - protein, 28 aa, Artificial Sequence
  Description of Artificial Sequence: Synthetic peptide
DEEEIRTTNPCATEQYGSVSTNEERGNH

SEQ ID NO: 17649 - protein, 28 aa, Artificial Sequence
  Description of Artificial Sequence: Synthetic peptide
DEEEIGTTNPVATEQYGSVSTNDQMGND

SEQ ID NO: 17650 - protein, 29 aa, Artificial Sequence
  Description of Artificial Sequence: Synthetic peptide
DEEEIATTNPVATELYGSVSTDLQRGNDR

SEQ ID NO: 17651 - protein, 28 aa, Artificial Sequence
  Description of Artificial Sequence: Synthetic peptide
QEEEIATTNPVATECYGSVSTNLQGGNR

SEQ ID NO: 17652 - protein, 29 aa, Artificial Sequence
  Description of Artificial Sequence: Synthetic peptide
QEEEIRSTNPVATEQYGSVSTNLQSRGTR

SEQ ID NO: 17653 - protein, 28 aa, Artificial Sequence
  Description of Artificial Sequence: Synthetic peptide
DSEEIRTTNPVATEQYGKVSTNLNPGNR

SEQ ID NO: 17654 - protein, 28 aa, Artificial Sequence
  Description of Artificial Sequence: Synthetic peptide
DENEIRTTNIVATEQYGSVSEILQRGNR

SEQ ID NO: 17655 - protein, 28 aa, Artificial Sequence
  Description of Artificial Sequence: Synthetic peptide
DETEIRTTNIVATEQYGSVSTDLQRGNT

SEQ ID NO: 17656 - protein, 28 aa, Artificial Sequence
  Description of Artificial Sequence: Synthetic peptide
DEEEIRTTNPVATESYGSVSNYLQRGNL

SEQ ID NO: 17657 - protein, 28 aa, Artificial Sequence
  Description of Artificial Sequence: Synthetic peptide
DEEEIAATNPVATEMYGGVSTNLQRGNR

SEQ ID NO: 17658 - protein, 30 aa, Artificial Sequence
  Description of Artificial Sequence: Synthetic polypeptide
DEEEIRTTNPVATEQYGSVSTGLQNGENDR

SEQ ID NO: 17659 - protein, 30 aa, Artificial Sequence
  Description of Artificial Sequence: Synthetic polypeptide
DEEEIRTTNPVATELYGSVSENPLQRGNDR

SEQ ID NO: 17660 - protein, 30 aa, Artificial Sequence
  Description of Artificial Sequence: Synthetic polypeptide
DEEEIRTTNPEATEQYGSVSTNLQANGNDR

SEQ ID NO: 17661 - protein, 28 aa, Artificial Sequence
  Description of Artificial Sequence: Synthetic peptide
DEEEIRCTNPVSTEWYGSVSTNLQRGNL

SEQ ID NO: 17662 - protein, 28 aa, Artificial Sequence
  Description of Artificial Sequence: Synthetic peptide
AEEEIATTNPVATEQYGDVSTNSQRGNR

SEQ ID NO: 17663 - protein, 31 aa, Artificial Sequence
  Description of Artificial Sequence: Synthetic polypeptide
DEEEIRTTNPVATEQYGSVSTNLQEAEGNDR

SEQ ID NO: 17664 - protein, 31 aa, Artificial Sequence
  Description of Artificial Sequence: Synthetic polypeptide
DEEEIRTTNPVATEQYGSVSTNLQEQDGNDR

SEQ ID NO: 17665 - protein, 28 aa, Artificial Sequence
  Description of Artificial Sequence: Synthetic peptide
AENEIRTTNPVATEQYGEVSENLQRGNR

SEQ ID NO: 17666 - protein, 28 aa, Artificial Sequence
  Description of Artificial Sequence: Synthetic peptide
DEEEIRTTNPVSTEWYGSVSTNLQGGNQ

SEQ ID NO: 17667 - protein, 30 aa, Artificial Sequence
  Description of Artificial Sequence: Synthetic polypeptide
DEEEIRTTNPVATEQYGSVSTNLQEAGNDY

SEQ ID NO: 17668 - protein, 28 aa, Artificial Sequence
  Description of Artificial Sequence: Synthetic peptide
DEEEIRTTNPVATEQYGSVSTELQEGDH

SEQ ID NO: 17669 - protein, 28 aa, Artificial Sequence
  Description of Artificial Sequence: Synthetic peptide
DEEEIRTTNPVATEQYGSWSTNDDRGNP

SEQ ID NO: 17670 - protein, 30 aa, Artificial Sequence
  Description of Artificial Sequence: Synthetic polypeptide
DEEEIRTTNPVATEQYGSVSTNLQETGNDF

SEQ ID NO: 17671 - protein, 29 aa, Artificial Sequence
  Description of Artificial Sequence: Synthetic peptide
DEEEIRTTNPVATEQYGSVSTDLQERGEM

SEQ ID NO: 17672 - protein, 28 aa, Artificial Sequence
  Description of Artificial Sequence: Synthetic peptide
GDEEIRTTNPVATEQYGAVSTNLQRGTR

SEQ ID NO: 17673 - protein, 28 aa, Artificial Sequence
  Description of Artificial Sequence: Synthetic peptide
SEEEIRTTNIVATEQYNSVSTNLQNGNR

SEQ ID NO: 17674 - protein, 28 aa, Artificial Sequence
  Description of Artificial Sequence: Synthetic peptide
DEQEIATTNPVATETYGWVSTNLQRGNR

SEQ ID NO: 17675 - protein, 29 aa, Artificial Sequence
  Description of Artificial Sequence: Synthetic peptide
DEEEIRTVNPVATEQYGEVSTNLQRAGGR

SEQ ID NO: 17676 - protein, 28 aa, Artificial Sequence
  Description of Artificial Sequence: Synthetic peptide
DEEEIRTTNPVATEQYGSVEDGLQRGER

SEQ ID NO: 17677 - protein, 28 aa, Artificial Sequence
  Description of Artificial Sequence: Synthetic peptide
DEEEIRTTNPEATEQYGSVSTPLEDGNR

SEQ ID NO: 17678 - protein, 28 aa, Artificial Sequence
  Description of Artificial Sequence: Synthetic peptide
DEEEIRTTNPVATEQYGSVSTGLEIGNE

SEQ ID NO: 17679 - protein, 28 aa, Artificial Sequence
  Description of Artificial Sequence: Synthetic peptide
DEAEIATTNPVATEMYGSVSTNLQRGNY

SEQ ID NO: 17680 - protein, 28 aa, Artificial Sequence
  Description of Artificial Sequence: Synthetic peptide
DEEEIRATNPVGTEQYGSASTNLQAGNR

SEQ ID NO: 17681 - protein, 29 aa, Artificial Sequence
  Description of Artificial Sequence: Synthetic peptide
DEQEIRTTNPVATEQYGSTSENLQRGNSR

SEQ ID NO: 17682 - protein, 28 aa, Artificial Sequence
  Description of Artificial Sequence: Synthetic peptide
DEVEIAATNPVATEQYGSVSENLQRGNR

SEQ ID NO: 17683 - protein, 28 aa, Artificial Sequence
  Description of Artificial Sequence: Synthetic peptide
DEEEIRTTNPVATEQYGSVSTEEEIGNR

SEQ ID NO: 17684 - protein, 29 aa, Artificial Sequence
  Description of Artificial Sequence: Synthetic peptide
DEEEIRTTNPVATEQYGSVSTNEMMIGNR

SEQ ID NO: 17685 - protein, 29 aa, Artificial Sequence
  Description of Artificial Sequence: Synthetic peptide
DEEEIRTTNPVATECYGSVSTNLQERGEI

SEQ ID NO: 17686 - protein, 28 aa, Artificial Sequence
  Description of Artificial Sequence: Synthetic peptide
DEEEIRTTNPVATEQYGSVSTGPEDGNR

SEQ ID NO: 17687 - protein, 28 aa, Artificial Sequence
  Description of Artificial Sequence: Synthetic peptide
DEEEIRTVNPVATEMYGSVATNLQMGNR

SEQ ID NO: 17688 - protein, 28 aa, Artificial Sequence
  Description of Artificial Sequence: Synthetic peptide
DEQEIATTNPVATEVYGNVSTNLQRGNR

SEQ ID NO: 17689 - protein, 29 aa, Artificial Sequence
  Description of Artificial Sequence: Synthetic peptide
DEEEIRTTNPVATEMFGSVDSTNLQRGNL

SEQ ID NO: 17690 - protein, 28 aa, Artificial Sequence
  Description of Artificial Sequence: Synthetic peptide
DEEEIRTTNPVATEQYGSVSTDLQQGET

SEQ ID NO: 17691 - protein, 31 aa, Artificial Sequence
  Description of Artificial Sequence: Synthetic polypeptide
DEEEIRTTNPVATEQYGSVDSTDLQRDGNER

SEQ ID NO: 17692 - protein, 30 aa, Artificial Sequence
  Description of Artificial Sequence: Synthetic polypeptide
DEEEIRTTNPVATEQYGSVSTNLQEVGNDI

SEQ ID NO: 17693 - protein, 30 aa, Artificial Sequence
  Description of Artificial Sequence: Synthetic polypeptide
DEEEIRTTNPVATEQYGDVSTNNLQRFGNL

SEQ ID NO: 17694 - protein, 28 aa, Artificial Sequence
  Description of Artificial Sequence: Synthetic peptide
DENEIRTTNPVATEQYGDASTNLQRFNR

SEQ ID NO: 17695 - protein, 28 aa, Artificial Sequence
  Description of Artificial Sequence: Synthetic peptide
DEEEIRTTNPVATEQYGSVSTDLERGES

SEQ ID NO: 17696 - protein, 28 aa, Artificial Sequence
  Description of Artificial Sequence: Synthetic peptide
DEEEIRTTNPVATEQFGSVFTNLFRGNS

SEQ ID NO: 17697 - protein, 28 aa, Artificial Sequence
  Description of Artificial Sequence: Synthetic peptide
DEEEIATTNPVATEQYGSVSTDLQVGNQ

SEQ ID NO: 17698 - protein, 30 aa, Artificial Sequence
  Description of Artificial Sequence: Synthetic polypeptide
DEEEIRTTNPVATEQYGSVSTMNLQIGDNG

SEQ ID NO: 17699 - protein, 28 aa, Artificial Sequence
  Description of Artificial Sequence: Synthetic peptide
DEEEIRTTNPVATEQYGSVSTDPQDGNE

SEQ ID NO: 17700 - protein, 28 aa, Artificial Sequence
  Description of Artificial Sequence: Synthetic peptide
DEEEIVTTNPVATEQYGSCSENLQRGNA

SEQ ID NO: 17701 - protein, 28 aa, Artificial Sequence
  Description of Artificial Sequence: Synthetic peptide
DEEEIRSTNIVATEQYGSVSTNLMYGNR

SEQ ID NO: 17702 - protein, 28 aa, Artificial Sequence
  Description of Artificial Sequence: Synthetic peptide
DENEIRTTNPVATEQWGSVSTNLQQGNF

SEQ ID NO: 17703 - protein, 28 aa, Artificial Sequence
  Description of Artificial Sequence: Synthetic peptide
DEEEIRATNIVATEQYGSVSTNLQRLNF

SEQ ID NO: 17704 - protein, 30 aa, Artificial Sequence
  Description of Artificial Sequence: Synthetic polypeptide
DEEEIRTTNPVATEQYGSVDTNLMNRAGNR

SEQ ID NO: 17705 - protein, 28 aa, Artificial Sequence
  Description of Artificial Sequence: Synthetic peptide
DEEEIRTTNPTATETYGSVSEDLQRGNR

SEQ ID NO: 17706 - protein, 29 aa, Artificial Sequence
  Description of Artificial Sequence: Synthetic peptide
DENEIRTTNPVSTEQYGSVSENLQRAGNR

SEQ ID NO: 17707 - protein, 28 aa, Artificial Sequence
  Description of Artificial Sequence: Synthetic peptide
DEEEIGTTNPVSTEQYGEVSTNLQQGNR

SEQ ID NO: 17708 - protein, 30 aa, Artificial Sequence
  Description of Artificial Sequence: Synthetic polypeptide
DEEEIRTTNPVATEQYGSVSATNLQDVGER

SEQ ID NO: 17709 - protein, 29 aa, Artificial Sequence
  Description of Artificial Sequence: Synthetic peptide
DEEEIATTNPVATEQYGSVSTNQQRNGER

SEQ ID NO: 17710 - protein, 30 aa, Artificial Sequence
  Description of Artificial Sequence: Synthetic polypeptide
DEEEIRTTNPVATEQYGSVETNLQVEGENR

SEQ ID NO: 17711 - protein, 28 aa, Artificial Sequence
  Description of Artificial Sequence: Synthetic peptide
DEEEIRTTNPFATEQYGSVSTNLDPGNP

SEQ ID NO: 17712 - protein, 29 aa, Artificial Sequence
  Description of Artificial Sequence: Synthetic peptide
DEEEIRTTNPVATEIYGSVSTPLQNKGNR

SEQ ID NO: 17713 - protein, 28 aa, Artificial Sequence
  Description of Artificial Sequence: Synthetic peptide
DENEIAQTNPVATEQYGSVDTNLQRGNR

SEQ ID NO: 17714 - protein, 28 aa, Artificial Sequence
  Description of Artificial Sequence: Synthetic peptide
DEEEIVTTNPVATEQYGEVSTNLQIGTR

SEQ ID NO: 17715 - protein, 29 aa, Artificial Sequence
  Description of Artificial Sequence: Synthetic peptide
DEEEIRTTNPVATEQYGSVSTNLEMLGNL

SEQ ID NO: 17716 - protein, 28 aa, Artificial Sequence
  Description of Artificial Sequence: Synthetic peptide
DEEEIRTTNPVATEPYGSISTTLQRGNH

SEQ ID NO: 17717 - protein, 28 aa, Artificial Sequence
  Description of Artificial Sequence: Synthetic peptide
SEEEIRTTNPVATEQYGSVSANLQIGPR

SEQ ID NO: 17718 - protein, 28 aa, Artificial Sequence
  Description of Artificial Sequence: Synthetic peptide
DEEEICTTNPVATEQYGSVDTNLQHGNI

SEQ ID NO: 17719 - protein, 28 aa, Artificial Sequence
  Description of Artificial Sequence: Synthetic peptide
DEEEIRTVNPVATECYGSVSTNLQLGDR

SEQ ID NO: 17720 - protein, 28 aa, Artificial Sequence
  Description of Artificial Sequence: Synthetic peptide
DENEIRTTNIVATEQYGSASTNLQHGNR

SEQ ID NO: 17721 - protein, 29 aa, Artificial Sequence
  Description of Artificial Sequence: Synthetic peptide
DEEEIRTTNPVATECYGSVSTNLQRDGEQ

SEQ ID NO: 17722 - protein, 30 aa, Artificial Sequence
  Description of Artificial Sequence: Synthetic polypeptide
DEEEIRTTNPVATEQYGSVSTNLQENGNDF

SEQ ID NO: 17723 - protein, 30 aa, Artificial Sequence
  Description of Artificial Sequence: Synthetic polypeptide
DEEEIRTTNPVATEQYGSVSTNLVQENGNM

SEQ ID NO: 17724 - protein, 30 aa, Artificial Sequence
  Description of Artificial Sequence: Synthetic polypeptide
DEEEIRTTNPVATEQYGSVSTIDLERGNDR

SEQ ID NO: 17725 - protein, 28 aa, Artificial Sequence
  Description of Artificial Sequence: Synthetic peptide
DDEEIRTTNPVASEQYGSVATNLQRGDR

SEQ ID NO: 17726 - protein, 29 aa, Artificial Sequence
  Description of Artificial Sequence: Synthetic peptide
DEVEIAATNPVATEQYGSVSTNLQRGENR

SEQ ID NO: 17727 - protein, 29 aa, Artificial Sequence
  Description of Artificial Sequence: Synthetic peptide
DEEEIRTTNPVATEQYGSVSTELQDRGEM

SEQ ID NO: 17728 - protein, 31 aa, Artificial Sequence
  Description of Artificial Sequence: Synthetic polypeptide
DEEEIRTTNPVATEQYGSVDSETNLERGDNR

SEQ ID NO: 17729 - protein, 28 aa, Artificial Sequence
  Description of Artificial Sequence: Synthetic peptide
DEEEIRTTNPVATEQYGSVETNDQIGNY

SEQ ID NO: 17730 - protein, 29 aa, Artificial Sequence
  Description of Artificial Sequence: Synthetic peptide
DEEEIRTTNPVATEQWGSVSTNLSRGDNS

SEQ ID NO: 17731 - protein, 28 aa, Artificial Sequence
  Description of Artificial Sequence: Synthetic peptide
DEEEIRTTNPVATEQYGSVSTGPYRGNF

SEQ ID NO: 17732 - protein, 28 aa, Artificial Sequence
  Description of Artificial Sequence: Synthetic peptide
DEEEIRTTNPVATECYGSVSENLQNGNF

SEQ ID NO: 17733 - protein, 28 aa, Artificial Sequence
  Description of Artificial Sequence: Synthetic peptide
DEEEIRTTNPVATEQYGSVSTNLEAGEQ

SEQ ID NO: 17734 - protein, 28 aa, Artificial Sequence
  Description of Artificial Sequence: Synthetic peptide
DEEEIRSTNIVATEQYGEVSTNLQLGNR

SEQ ID NO: 17735 - protein, 28 aa, Artificial Sequence
  Description of Artificial Sequence: Synthetic peptide
DEEEIRTTNPVATEQYGSVSTELQLGEQ

SEQ ID NO: 17736 - protein, 28 aa, Artificial Sequence
  Description of Artificial Sequence: Synthetic peptide
DEEEIATTNPVCTEGYGSVSTNLQRGPR

SEQ ID NO: 17737 - protein, 28 aa, Artificial Sequence
  Description of Artificial Sequence: Synthetic peptide
DEEEIVTTNPVATETYGDVSTNLQRGDR

SEQ ID NO: 17738 - protein, 28 aa, Artificial Sequence
  Description of Artificial Sequence: Synthetic peptide
DEEEIRQTNPVATEMYGSVSTNLERGDR

SEQ ID NO: 17739 - protein, 30 aa, Artificial Sequence
  Description of Artificial Sequence: Synthetic polypeptide
DEEEIRTTNPVATEQYGKTSTLNLQRGDNR

SEQ ID NO: 17740 - protein, 29 aa, Artificial Sequence
  Description of Artificial Sequence: Synthetic peptide
DEEEIRTTNPVATEQYGSVSDNIQRSLNR

SEQ ID NO: 17741 - protein, 28 aa, Artificial Sequence
  Description of Artificial Sequence: Synthetic peptide
DEEEIRTTNPVAYAQWGSVSTNLQRGNL

SEQ ID NO: 17742 - protein, 29 aa, Artificial Sequence
  Description of Artificial Sequence: Synthetic peptide
DEEEIRTTNPVSTEQYGSVSTDLQFGDNR

SEQ ID NO: 17743 - protein, 29 aa, Artificial Sequence
  Description of Artificial Sequence: Synthetic peptide
DEECIRTTNPVATEQYGSVSTPLTLRGNR

SEQ ID NO: 17744 - protein, 30 aa, Artificial Sequence
  Description of Artificial Sequence: Synthetic polypeptide
DEEEIRTTNPVATEQYGSVSTNLQEIGNDF

SEQ ID NO: 17745 - protein, 30 aa, Artificial Sequence
  Description of Artificial Sequence: Synthetic polypeptide
DEEEIRTTNPVATEQYGSVSENLQNRGNYM

SEQ ID NO: 17746 - protein, 28 aa, Artificial Sequence
  Description of Artificial Sequence: Synthetic peptide
DEQEIRCTNPVATEQYGCVSTNLQRGNA

SEQ ID NO: 17747 - protein, 28 aa, Artificial Sequence
  Description of Artificial Sequence: Synthetic peptide
DEEEIRTTNIVATEQYGSMATNLQHGNR

SEQ ID NO: 17748 - protein, 31 aa, Artificial Sequence
  Description of Artificial Sequence: Synthetic polypeptide
DEEEIRTTNPVATEQYGSVSCTNLQCRGNDA

SEQ ID NO: 17749 - protein, 28 aa, Artificial Sequence
  Description of Artificial Sequence: Synthetic peptide
DEEEIRTTNPVATEQYGSVSTNPQFGTN

SEQ ID NO: 17750 - protein, 29 aa, Artificial Sequence
  Description of Artificial Sequence: Synthetic peptide
DEEEIRTTNPVATEQYGSVSENLMIRGNA

SEQ ID NO: 17751 - protein, 28 aa, Artificial Sequence
  Description of Artificial Sequence: Synthetic peptide
DEEEIRTTNPVATEQYGSHSQNDQRGER

SEQ ID NO: 17752 - protein, 28 aa, Artificial Sequence
  Description of Artificial Sequence: Synthetic peptide
AEEEIRATNPVATEQYGSVSENLQRGQR

SEQ ID NO: 17753 - protein, 28 aa, Artificial Sequence
  Description of Artificial Sequence: Synthetic peptide
DEQEIRTTNPVATEQWGSVSTNLMRGNA

SEQ ID NO: 17754 - protein, 28 aa, Artificial Sequence
  Description of Artificial Sequence: Synthetic peptide
DEEEIRTVNPVATEQYGSVGTVLQHGNR

SEQ ID NO: 17755 - protein, 28 aa, Artificial Sequence
  Description of Artificial Sequence: Synthetic peptide
DEEELATTNPVATEVYGWVSTNLQRGNR

SEQ ID NO: 17756 - protein, 31 aa, Artificial Sequence
  Description of Artificial Sequence: Synthetic polypeptide
DEEEIRTTNPVATEQYGSVQSTENLIQLGNR

SEQ ID NO: 17757 - protein, 28 aa, Artificial Sequence
  Description of Artificial Sequence: Synthetic peptide
DEQEIATTNPVATEPYGVVSTNLQRGNR

SEQ ID NO: 17758 - protein, 28 aa, Artificial Sequence
  Description of Artificial Sequence: Synthetic peptide
QENEIRTTNPVATEQYGDVSTNLQRGER

SEQ ID NO: 17759 - protein, 28 aa, Artificial Sequence
  Description of Artificial Sequence: Synthetic peptide
DDEEIRTTNPIATEHYGSVSTNLQIGNR

SEQ ID NO: 17760 - protein, 28 aa, Artificial Sequence
  Description of Artificial Sequence: Synthetic peptide
DEEEIRTTNPVATMQYGSTSTNLERGNA

SEQ ID NO: 17761 - protein, 28 aa, Artificial Sequence
  Description of Artificial Sequence: Synthetic peptide
DEEEIRTTNPVATEQYGSVSTNLENGEV

SEQ ID NO: 17762 - protein, 29 aa, Artificial Sequence
  Description of Artificial Sequence: Synthetic peptide
DEEEIATTNPVATEQYGSVSTNLEHEGNR

SEQ ID NO: 17763 - protein, 28 aa, Artificial Sequence
  Description of Artificial Sequence: Synthetic peptide
DEEEIRTTNPVATEQYGSVDTDLQAGNA

SEQ ID NO: 17764 - protein, 28 aa, Artificial Sequence
  Description of Artificial Sequence: Synthetic peptide
DEEEIRTTNPDATQQYGSVSTNLQPGNP

SEQ ID NO: 17765 - protein, 30 aa, Artificial Sequence
  Description of Artificial Sequence: Synthetic polypeptide
DEEEIRTTNPVATEQYGSVSTNLQELGNDF

SEQ ID NO: 17766 - protein, 28 aa, Artificial Sequence
  Description of Artificial Sequence: Synthetic peptide
DEEEIRPTNPVATEQYGSVDTNDQTGNR

SEQ ID NO: 17767 - protein, 29 aa, Artificial Sequence
  Description of Artificial Sequence: Synthetic peptide
DEEEIRTTNPVATEQYGSVSTELEREGND

SEQ ID NO: 17768 - protein, 28 aa, Artificial Sequence
  Description of Artificial Sequence: Synthetic peptide
DEEEIRTTNPVATEQYGSYHENLQRGDR

SEQ ID NO: 17769 - protein, 28 aa, Artificial Sequence
  Description of Artificial Sequence: Synthetic peptide
DEEEIRTTNPVAVECYGSCSTNLQRGNM

SEQ ID NO: 17770 - protein, 30 aa, Artificial Sequence
  Description of Artificial Sequence: Synthetic polypeptide
DEEEIRTTNPVATEQYGSVSETNLERGENE

SEQ ID NO: 17771 - protein, 29 aa, Artificial Sequence
  Description of Artificial Sequence: Synthetic peptide
DEEEIRTVNPVATEQYGIVSTNLQVAGNR

SEQ ID NO: 17772 - protein, 30 aa, Artificial Sequence
  Description of Artificial Sequence: Synthetic polypeptide
DEEEIRTTNPVATEQYGSVSPTNLTRGENL

SEQ ID NO: 17773 - protein, 29 aa, Artificial Sequence
  Description of Artificial Sequence: Synthetic peptide
DEEEIRTTNPVATEQYGSYSLTNLQHGNA

SEQ ID NO: 17774 - protein, 31 aa, Artificial Sequence
  Description of Artificial Sequence: Synthetic polypeptide
DEEEIRTTNPVATEQYGSVDSTNPQRKGNPR

SEQ ID NO: 17775 - protein, 28 aa, Artificial Sequence
  Description of Artificial Sequence: Synthetic peptide
AEEEIATTNPVATEQYGSVSTDQQRGNR

SEQ ID NO: 17776 - protein, 28 aa, Artificial Sequence
  Description of Artificial Sequence: Synthetic peptide
DEEEIRTTNIVATEIYGSVSTNLERGNN

SEQ ID NO: 17777 - protein, 31 aa, Artificial Sequence
  Description of Artificial Sequence: Synthetic polypeptide
DEEEIRTTNPVATEQYGSVSTNLQDREGEER

SEQ ID NO: 17778 - protein, 28 aa, Artificial Sequence
  Description of Artificial Sequence: Synthetic peptide
MEEEIRTTNPVATEQYGSVSENLQNGNA

SEQ ID NO: 17779 - protein, 30 aa, Artificial Sequence
  Description of Artificial Sequence: Synthetic polypeptide
DEEEIRATNPVATETYGSVSTMDNLQRGNR

SEQ ID NO: 17780 - protein, 28 aa, Artificial Sequence
  Description of Artificial Sequence: Synthetic peptide
DEEEIRATNPVATEQYGSVSAGLQRGDR

SEQ ID NO: 17781 - protein, 29 aa, Artificial Sequence
  Description of Artificial Sequence: Synthetic peptide
DEEEIRCTNPVATEIYGSVSMNLQRNGNR

SEQ ID NO: 17782 - protein, 28 aa, Artificial Sequence
  Description of Artificial Sequence: Synthetic peptide
DEEEIRTTNPVATEPYGSVSENLQWGQR

SEQ ID NO: 17783 - protein, 28 aa, Artificial Sequence
  Description of Artificial Sequence: Synthetic peptide
DENEIRTTNPVATEQYGSVSTNLMIGTR

SEQ ID NO: 17784 - protein, 28 aa, Artificial Sequence
  Description of Artificial Sequence: Synthetic peptide
DEQEISTTNPVATEVYGWVSTNLQRGNR

SEQ ID NO: 17785 - protein, 28 aa, Artificial Sequence
  Description of Artificial Sequence: Synthetic peptide
DEEEIVTTNPVATEQYGSVSTADQRGNY

SEQ ID NO: 17786 - protein, 28 aa, Artificial Sequence
  Description of Artificial Sequence: Synthetic peptide
DEQEIATTNPVATEIYGWVSTNLQRGNR

SEQ ID NO: 17787 - protein, 28 aa, Artificial Sequence
  Description of Artificial Sequence: Synthetic peptide
DEEEIRTTNPVATEQYGDASTALQDGNR

SEQ ID NO: 17788 - protein, 30 aa, Artificial Sequence
  Description of Artificial Sequence: Synthetic polypeptide
DDEEIRTTNPVATEQYGSVSTELQERAGNR

SEQ ID NO: 17789 - protein, 28 aa, Artificial Sequence
  Description of Artificial Sequence: Synthetic peptide
SEEEIATTNPVATYQYGSVSTNLQRGDR

SEQ ID NO: 17790 - protein, 28 aa, Artificial Sequence
  Description of Artificial Sequence: Synthetic peptide
DESEVRTVNPVATEQYGNVSTNLQRGNR

SEQ ID NO: 17791 - protein, 28 aa, Artificial Sequence
  Description of Artificial Sequence: Synthetic peptide
DENEIRTTNPVATEWYGSVSTELQRGNA

SEQ ID NO: 17792 - protein, 29 aa, Artificial Sequence
  Description of Artificial Sequence: Synthetic peptide
DEEEIRTTNPVATECYGSVSTDLQERGNI

SEQ ID NO: 17793 - protein, 29 aa, Artificial Sequence
  Description of Artificial Sequence: Synthetic peptide
DEEEIRTTNPTATEQYGSVSTNPQLHGNR

SEQ ID NO: 17794 - protein, 28 aa, Artificial Sequence
  Description of Artificial Sequence: Synthetic peptide
MEEEIATTNPVATEQYGSVSTNLQNGNW

SEQ ID NO: 17795 - protein, 28 aa, Artificial Sequence
  Description of Artificial Sequence: Synthetic peptide
DEVEISTTNPVCTEQYGSVSTNLQHGNR

SEQ ID NO: 17796 - protein, 30 aa, Artificial Sequence
  Description of Artificial Sequence: Synthetic polypeptide
DEEEIRTTNPVATEQYGSVNSTNQQRGNEN

SEQ ID NO: 17797 - protein, 28 aa, Artificial Sequence
  Description of Artificial Sequence: Synthetic peptide
DEEEIMTTNPVATEWYGQVSTNLQDGNR

SEQ ID NO: 17798 - protein, 29 aa, Artificial Sequence
  Description of Artificial Sequence: Synthetic peptide
SEEEIRTTNPVATEQYGSVSTNLQDNGNT

SEQ ID NO: 17799 - protein, 28 aa, Artificial Sequence
  Description of Artificial Sequence: Synthetic peptide
DEQEIATTNPVSTEQYGWVSTNLQRGNR

SEQ ID NO: 17800 - protein, 28 aa, Artificial Sequence
  Description of Artificial Sequence: Synthetic peptide
DEEEIRTTNPVATEQYGSVACILQRGGR

SEQ ID NO: 17801 - protein, 31 aa, Artificial Sequence
  Description of Artificial Sequence: Synthetic polypeptide
DEEEIRTTNPVATEQYGSVSTMNLQDRGDNG

SEQ ID NO: 17802 - protein, 28 aa, Artificial Sequence
  Description of Artificial Sequence: Synthetic peptide
DEEEIRTTNIVATEMYGSVSTNLEQGNR

SEQ ID NO: 17803 - protein, 29 aa, Artificial Sequence
  Description of Artificial Sequence: Synthetic peptide
YEEEIRTTNPVATEQYGSVSTPLQIHGNR

SEQ ID NO: 17804 - protein, 28 aa, Artificial Sequence
  Description of Artificial Sequence: Synthetic peptide
DEEEIRCTNIVASECYGSVSTNLQRGNR

SEQ ID NO: 17805 - protein, 28 aa, Artificial Sequence
  Description of Artificial Sequence: Synthetic peptide
DEEEIRTTNPVATELYGSVSENLMQGNR

SEQ ID NO: 17806 - protein, 30 aa, Artificial Sequence
  Description of Artificial Sequence: Synthetic polypeptide
DEEEIAATNPVATEQYGSVSTNLPQREGNR

SEQ ID NO: 17807 - protein, 28 aa, Artificial Sequence
  Description of Artificial Sequence: Synthetic peptide
DEEEIRTTNPAATEQFGSVSENLQQGNR

SEQ ID NO: 17808 - protein, 28 aa, Artificial Sequence
  Description of Artificial Sequence: Synthetic peptide
DEEEIRTTNIEATEQYGSVSEDLQRGNR

SEQ ID NO: 17809 - protein, 29 aa, Artificial Sequence
  Description of Artificial Sequence: Synthetic peptide
DEEEIRTTNPVATECYGSVSTCEQRGNDR

SEQ ID NO: 17810 - protein, 29 aa, Artificial Sequence
  Description of Artificial Sequence: Synthetic peptide
DEQEIRTTNPVATEQYGSVSTNLEDRGND

SEQ ID NO: 17811 - protein, 28 aa, Artificial Sequence
  Description of Artificial Sequence: Synthetic peptide
DEEVIRTTNPVATEWYGSVSHNDQRGNR

SEQ ID NO: 17812 - protein, 31 aa, Artificial Sequence
  Description of Artificial Sequence: Synthetic polypeptide
DEEEIRTTNPVATEQYGSVDSTNLQREGNFF

SEQ ID NO: 17813 - protein, 28 aa, Artificial Sequence
  Description of Artificial Sequence: Synthetic peptide
DEDEIATTNPVATELYGSVATNLQRGNR

SEQ ID NO: 17814 - protein, 29 aa, Artificial Sequence
  Description of Artificial Sequence: Synthetic peptide
DEEEVRTTNPVATEIYGSVSTNLERNGNR

SEQ ID NO: 17815 - protein, 30 aa, Artificial Sequence
  Description of Artificial Sequence: Synthetic polypeptide
DEEEIRTTNPVATEQYGSVSTNLQVEGNDD

SEQ ID NO: 17816 - protein, 28 aa, Artificial Sequence
  Description of Artificial Sequence: Synthetic peptide
DENEIRTTNPVATEQYGSVSTILMRGNA

SEQ ID NO: 17817 - protein, 28 aa, Artificial Sequence
  Description of Artificial Sequence: Synthetic peptide
DEEEIRTTNPVATEQYGSVSTDLEEGNS

SEQ ID NO: 17818 - protein, 28 aa, Artificial Sequence
  Description of Artificial Sequence: Synthetic peptide
DEFEIRTTNPVATETYGDVSTNLQSGNR

SEQ ID NO: 17819 - protein, 29 aa, Artificial Sequence
  Description of Artificial Sequence: Synthetic peptide
KEEEIRTTNPVATEQYGSVSTDLQDIGNR

SEQ ID NO: 17820 - protein, 28 aa, Artificial Sequence
  Description of Artificial Sequence: Synthetic peptide
DEEEIRTTNIVATEMYGSVSTNLQLGND

SEQ ID NO: 17821 - protein, 29 aa, Artificial Sequence
  Description of Artificial Sequence: Synthetic peptide
DEEEIRTTNPVATECYGVVSTNLQREGNA

SEQ ID NO: 17822 - protein, 29 aa, Artificial Sequence
  Description of Artificial Sequence: Synthetic peptide
KEEEIRTTNPVATEQYGSVSTNLQIGNDE

SEQ ID NO: 17823 - protein, 28 aa, Artificial Sequence
  Description of Artificial Sequence: Synthetic peptide
DEEEIRTTNPVATEQYGDVSENLQHGNI

SEQ ID NO: 17824 - protein, 28 aa, Artificial Sequence
  Description of Artificial Sequence: Synthetic peptide
VESEIRATNPVATEQYGAVSTNLQRGNR

SEQ ID NO: 17825 - protein, 29 aa, Artificial Sequence
  Description of Artificial Sequence: Synthetic peptide
DEEEIRTTNPVATEQYGSVSTNLQNNGEI

SEQ ID NO: 17826 - protein, 29 aa, Artificial Sequence
  Description of Artificial Sequence: Synthetic peptide
DEEEIRTTNPVATEQYGSVETQPLQRGNN

SEQ ID NO: 17827 - protein, 28 aa, Artificial Sequence
  Description of Artificial Sequence: Synthetic peptide
NEEEIRTTNPVATEVYGSVSMNLQRGNQ

SEQ ID NO: 17828 - protein, 28 aa, Artificial Sequence
  Description of Artificial Sequence: Synthetic peptide
DEEEIRTTNPVATSQWGSVDTNLQRGSR

SEQ ID NO: 17829 - protein, 28 aa, Artificial Sequence
  Description of Artificial Sequence: Synthetic peptide
DEEEIRCTNIVATEQYGSASTNLERGNR

SEQ ID NO: 17830 - protein, 29 aa, Artificial Sequence
  Description of Artificial Sequence: Synthetic peptide
DEEEIRTTNPEATEQYGSVSTDPQQRGNR

SEQ ID NO: 17831 - protein, 28 aa, Artificial Sequence
  Description of Artificial Sequence: Synthetic peptide
DETEIRTTNPVATEQYGWVSTNLQHGNN

SEQ ID NO: 17832 - protein, 28 aa, Artificial Sequence
  Description of Artificial Sequence: Synthetic peptide
DEEEIMTTNPVATETYGSVSTGLQTGNR

SEQ ID NO: 17833 - protein, 28 aa, Artificial Sequence
  Description of Artificial Sequence: Synthetic peptide
DEEEIRTTNPVCTEQYGCVSTNLQGGTR

SEQ ID NO: 17834 - protein, 29 aa, Artificial Sequence
  Description of Artificial Sequence: Synthetic peptide
DEEEIRTTNPVATEQYGEVSENLQRGNFF

SEQ ID NO: 17835 - protein, 30 aa, Artificial Sequence
  Description of Artificial Sequence: Synthetic polypeptide
DEEEIRTTNPVATEQYGSVSTNLQEVGNDF

SEQ ID NO: 17836 - protein, 28 aa, Artificial Sequence
  Description of Artificial Sequence: Synthetic peptide
DEEEIRTTNPVATEQYGSVETPLQEGNH

SEQ ID NO: 17837 - protein, 28 aa, Artificial Sequence
  Description of Artificial Sequence: Synthetic peptide
DEEEIATTNPVATEVYGDVSTNLQHGNR

SEQ ID NO: 17838 - protein, 29 aa, Artificial Sequence
  Description of Artificial Sequence: Synthetic peptide
DEEEIRAVNPVATEQYGSVSTNLQERGER

SEQ ID NO: 17839 - protein, 30 aa, Artificial Sequence
  Description of Artificial Sequence: Synthetic polypeptide
DEEEIRTTNPVATEQYGSVSTLNLIDRGER

SEQ ID NO: 17840 - protein, 28 aa, Artificial Sequence
  Description of Artificial Sequence: Synthetic peptide
GEEEIRTTNPVATEQYGSVSTNVQRMNS

SEQ ID NO: 17841 - protein, 28 aa, Artificial Sequence
  Description of Artificial Sequence: Synthetic peptide
DEEEIRSVNPCATEQYGSVSTNLQRGNV

SEQ ID NO: 17842 - protein, 28 aa, Artificial Sequence
  Description of Artificial Sequence: Synthetic peptide
DEEEIRTTNPTATEQYGSVSTNLQHGPF

SEQ ID NO: 17843 - protein, 30 aa, Artificial Sequence
  Description of Artificial Sequence: Synthetic polypeptide
DEEEIRTTNPVATEQYGDVSTTNLQRGEND

SEQ ID NO: 17844 - protein, 32 aa, Artificial Sequence
  Description of Artificial Sequence: Synthetic polypeptide
DEEEIRTTNPVATEQYGSVESCTNLDQRGTNR

SEQ ID NO: 17845 - protein, 28 aa, Artificial Sequence
  Description of Artificial Sequence: Synthetic peptide
DESEIRATNPVATENYGVVSTNLQRGNR

SEQ ID NO: 17846 - protein, 28 aa, Artificial Sequence
  Description of Artificial Sequence: Synthetic peptide
DEEEIRTTNPVATENYGSVSDNWQRGNQ

SEQ ID NO: 17847 - protein, 28 aa, Artificial Sequence
  Description of Artificial Sequence: Synthetic peptide
DEEEIRTTNPVATECYGSVPTDLQRENR

SEQ ID NO: 17848 - protein, 28 aa, Artificial Sequence
  Description of Artificial Sequence: Synthetic peptide
SEEEIRTTNPVATEVYGSVSTELQIGNR

SEQ ID NO: 17849 - protein, 28 aa, Artificial Sequence
  Description of Artificial Sequence: Synthetic peptide
DEEEICTTNPVGTEQYGSVSTNLQYGMR

SEQ ID NO: 17850 - protein, 28 aa, Artificial Sequence
  Description of Artificial Sequence: Synthetic peptide
DEEEIRTTNIVATESYGSVSTILQRGNY

SEQ ID NO: 17851 - protein, 28 aa, Artificial Sequence
  Description of Artificial Sequence: Synthetic peptide
DEEEIRTTNPVYTEQYGSVSVNVQGGNR

SEQ ID NO: 17852 - protein, 28 aa, Artificial Sequence
  Description of Artificial Sequence: Synthetic peptide
DEEEIRTTNPTATEQYGSVSTNGMRGNF

SEQ ID NO: 17853 - protein, 28 aa, Artificial Sequence
  Description of Artificial Sequence: Synthetic peptide
DEEEIRTTNPVATEQYGSVSEDLERGER

SEQ ID NO: 17854 - protein, 28 aa, Artificial Sequence
  Description of Artificial Sequence: Synthetic peptide
DEEEIRTTNPVATEQYGSVDTDLQNGNL

SEQ ID NO: 17855 - protein, 30 aa, Artificial Sequence
  Description of Artificial Sequence: Synthetic polypeptide
DEEEIRTTNPVATEQYGSWSITNEVQRGNR

SEQ ID NO: 17856 - protein, 28 aa, Artificial Sequence
  Description of Artificial Sequence: Synthetic peptide
DEQEIRCTNPVSTEQYGSVSTNLQRGDR

SEQ ID NO: 17857 - protein, 29 aa, Artificial Sequence
  Description of Artificial Sequence: Synthetic peptide
DEEEIRTTNPVATEQYGCVSDNLQRAGER

SEQ ID NO: 17858 - protein, 29 aa, Artificial Sequence
  Description of Artificial Sequence: Synthetic peptide
DEEEIRTTNPVATEQYGSVDSTNDQRENH

SEQ ID NO: 17859 - protein, 29 aa, Artificial Sequence
  Description of Artificial Sequence: Synthetic peptide
DEECIRTTNPVATEQYGSVESTNLQREER

SEQ ID NO: 17860 - protein, 28 aa, Artificial Sequence
  Description of Artificial Sequence: Synthetic peptide
SEAEIVTTNPVATEQYGSVSTNLQFGNR

SEQ ID NO: 17861 - protein, 28 aa, Artificial Sequence
  Description of Artificial Sequence: Synthetic peptide
DEMEIRTTNPVATEQYGEVSTNLQHGMR

SEQ ID NO: 17862 - protein, 31 aa, Artificial Sequence
  Description of Artificial Sequence: Synthetic polypeptide
DEEEIRTTNPVATEQYGSVYSTLNLQRGLTR

SEQ ID NO: 17863 - protein, 28 aa, Artificial Sequence
  Description of Artificial Sequence: Synthetic peptide
SEEEIRTTNPVATEQYGTVSTNLQRGPQ

SEQ ID NO: 17864 - protein, 28 aa, Artificial Sequence
  Description of Artificial Sequence: Synthetic peptide
DEQEIRTTNIVATEQYGSVSTNIQRGNH

SEQ ID NO: 17865 - protein, 29 aa, Artificial Sequence
  Description of Artificial Sequence: Synthetic peptide
DEEEIYTTNPVATEQYGSVSITNLQLGNP

SEQ ID NO: 17866 - protein, 28 aa, Artificial Sequence
  Description of Artificial Sequence: Synthetic peptide
DEEEIRTTNIVATEQYGSVSENIQRGNF

SEQ ID NO: 17867 - protein, 28 aa, Artificial Sequence
  Description of Artificial Sequence: Synthetic peptide
DEEEIRTTNIVATECYGSVSENLQRGNF

SEQ ID NO: 17868 - protein, 29 aa, Artificial Sequence
  Description of Artificial Sequence: Synthetic peptide
DENEISTTNPVATEQYGDVSTNLQRAGNR

SEQ ID NO: 17869 - protein, 28 aa, Artificial Sequence
  Description of Artificial Sequence: Synthetic peptide
DEQEIRTTNPVCTEQYGDVSTNLQRGNA

SEQ ID NO: 17870 - protein, 30 aa, Artificial Sequence
  Description of Artificial Sequence: Synthetic polypeptide
DEEEIRTTNPTATEQYGSVSTMNLQREGNI

SEQ ID NO: 17871 - protein, 28 aa, Artificial Sequence
  Description of Artificial Sequence: Synthetic peptide
GEEEIWTTNPVATEWYGSVSENLQRGNR

SEQ ID NO: 17872 - protein, 30 aa, Artificial Sequence
  Description of Artificial Sequence: Synthetic polypeptide
DEEEIRTTNPVATECYGSVSTNLQEDKGNR

SEQ ID NO: 17873 - protein, 28 aa, Artificial Sequence
  Description of Artificial Sequence: Synthetic peptide
AEEEVRTTNPVATEQYGSVGTNLQRGTR

SEQ ID NO: 17874 - protein, 28 aa, Artificial Sequence
  Description of Artificial Sequence: Synthetic peptide
DEEEIRTTNPVATEQFGSVSTNMQNGNS

SEQ ID NO: 17875 - protein, 29 aa, Artificial Sequence
  Description of Artificial Sequence: Synthetic peptide
MEEEIRTTNPVATEQYGSVSTDLQERGNM

SEQ ID NO: 17876 - protein, 29 aa, Artificial Sequence
  Description of Artificial Sequence: Synthetic peptide
DEEEIRTTNPVATEQYGSVSCENLQQGNC

SEQ ID NO: 17877 - protein, 28 aa, Artificial Sequence
  Description of Artificial Sequence: Synthetic peptide
DEEEIATTNPVATEQYGSVDENLQVGNR

SEQ ID NO: 17878 - protein, 29 aa, Artificial Sequence
  Description of Artificial Sequence: Synthetic peptide
QEEEIRTTNPVATEQYGSVSTNLQRNGET

SEQ ID NO: 17879 - protein, 28 aa, Artificial Sequence
  Description of Artificial Sequence: Synthetic peptide
DEEEIRTTNPVATEQYGSVSTPLEIGNI

SEQ ID NO: 17880 - protein, 29 aa, Artificial Sequence
  Description of Artificial Sequence: Synthetic peptide
DEEEIRTTNPVATEQYGSVSTNLQEEGDH

SEQ ID NO: 17881 - protein, 28 aa, Artificial Sequence
  Description of Artificial Sequence: Synthetic peptide
DEEEIRTTNPVATEQYGSVDTDLQNGNS

SEQ ID NO: 17882 - protein, 28 aa, Artificial Sequence
  Description of Artificial Sequence: Synthetic peptide
SEEEITTTNPVATEQYGSVSTNDQNGNR

SEQ ID NO: 17883 - protein, 28 aa, Artificial Sequence
  Description of Artificial Sequence: Synthetic peptide
DEEEIRTTNPVATEQYGSVSTDPQNGNI

SEQ ID NO: 17884 - protein, 28 aa, Artificial Sequence
  Description of Artificial Sequence: Synthetic peptide
DEEEIRTTNPVATEQYGSVDTPEQRGNS

SEQ ID NO: 17885 - protein, 28 aa, Artificial Sequence
  Description of Artificial Sequence: Synthetic peptide
DEQEIACTNPVATEQYGWVSTNLQRGNR

SEQ ID NO: 17886 - protein, 28 aa, Artificial Sequence
  Description of Artificial Sequence: Synthetic peptide
KEEEIRTTNPDATEQYGSVSTNLQNENR

SEQ ID NO: 17887 - protein, 29 aa, Artificial Sequence
  Description of Artificial Sequence: Synthetic peptide
DEEEIRTTNPVATEQYGSVSTMNEQNGNF

SEQ ID NO: 17888 - protein, 28 aa, Artificial Sequence
  Description of Artificial Sequence: Synthetic peptide
DEEEIRTTNPVATEQYGSVDTELQRGDN

SEQ ID NO: 17889 - protein, 28 aa, Artificial Sequence
  Description of Artificial Sequence: Synthetic peptide
DEEEIRTTNPFATEQYGSVSTEDQRGNT

SEQ ID NO: 17890 - protein, 28 aa, Artificial Sequence
  Description of Artificial Sequence: Synthetic peptide
SEEEIAATNPVATEQFGSVSTNLQRGNR

SEQ ID NO: 17891 - protein, 31 aa, Artificial Sequence
  Description of Artificial Sequence: Synthetic polypeptide
DETEIRTTNPVATEQYGSVSTYNPLQDRGNR

SEQ ID NO: 17892 - protein, 28 aa, Artificial Sequence
  Description of Artificial Sequence: Synthetic peptide
DEEEIRATNIVATEMYGSVSTNLQRGNG

SEQ ID NO: 17893 - protein, 28 aa, Artificial Sequence
  Description of Artificial Sequence: Synthetic peptide
DEQEIITTNPVATEQYGSVSENLQRGNG

SEQ ID NO: 17894 - protein, 29 aa, Artificial Sequence
  Description of Artificial Sequence: Synthetic peptide
DEEEIATTNPVATEQYGSVSTNLEDRGNL

SEQ ID NO: 17895 - protein, 28 aa, Artificial Sequence
  Description of Artificial Sequence: Synthetic peptide
DEGEIRCTNPVATEQYGSVSTNLQHGNF

SEQ ID NO: 17896 - protein, 28 aa, Artificial Sequence
  Description of Artificial Sequence: Synthetic peptide
DEEEIATTNPVATEQYGTASTNLQQGNR

SEQ ID NO: 17897 - protein, 29 aa, Artificial Sequence
  Description of Artificial Sequence: Synthetic peptide
DENEIRTTNPVATEQYGSVSTDLQRGEDR

SEQ ID NO: 17898 - protein, 28 aa, Artificial Sequence
  Description of Artificial Sequence: Synthetic peptide
DEEEIYTTNPTATEIYGSVSTNLQSGNR

SEQ ID NO: 17899 - protein, 28 aa, Artificial Sequence
  Description of Artificial Sequence: Synthetic peptide
DEEEIRCTNIVATEQYGSVSTNLDRGGR

SEQ ID NO: 17900 - protein, 28 aa, Artificial Sequence
  Description of Artificial Sequence: Synthetic peptide
DEEEIRTTNPVATEQYGDVSEDLQRGNH

SEQ ID NO: 17901 - protein, 28 aa, Artificial Sequence
  Description of Artificial Sequence: Synthetic peptide
KEEEIRTTNPVATECYGSVSTNLQQGNV

SEQ ID NO: 17902 - protein, 28 aa, Artificial Sequence
  Description of Artificial Sequence: Synthetic peptide
DEEEIRTTNPVATEQYGSVETNEDVGNR

SEQ ID NO: 17903 - protein, 32 aa, Artificial Sequence
  Description of Artificial Sequence: Synthetic polypeptide
DEEEIRTTNPVATEQYGSVSTANLQLREGENR

SEQ ID NO: 17904 - protein, 28 aa, Artificial Sequence
  Description of Artificial Sequence: Synthetic peptide
DEQEIATTNPVATEQYGEVSDNLQRGNR

SEQ ID NO: 17905 - protein, 28 aa, Artificial Sequence
  Description of Artificial Sequence: Synthetic peptide
DEEEIRSTNPVASEQYGSVSENYQRGNR

SEQ ID NO: 17906 - protein, 28 aa, Artificial Sequence
  Description of Artificial Sequence: Synthetic peptide
VEEEIRCTNPVCTEQYGSVATNLQRGNR

SEQ ID NO: 17907 - protein, 28 aa, Artificial Sequence
  Description of Artificial Sequence: Synthetic peptide
DEEEIRCTNPVATEQYGDVSTNLQRGTI

SEQ ID NO: 17908 - protein, 30 aa, Artificial Sequence
  Description of Artificial Sequence: Synthetic polypeptide
DEEEIRTTNPVATEQYGSVSETDLEERGNR

SEQ ID NO: 17909 - protein, 28 aa, Artificial Sequence
  Description of Artificial Sequence: Synthetic peptide
DEEEIRTTNPVATELWGSVSTNLMRGNF

SEQ ID NO: 17910 - protein, 28 aa, Artificial Sequence
  Description of Artificial Sequence: Synthetic peptide
DEEEIATTNIVATEQYGSASTNLQRGNC

SEQ ID NO: 17911 - protein, 28 aa, Artificial Sequence
  Description of Artificial Sequence: Synthetic peptide
DEEEIRTVNPVSTEQYGCVATNLQRGNR

SEQ ID NO: 17912 - protein, 28 aa, Artificial Sequence
  Description of Artificial Sequence: Synthetic peptide
DEEEIVTTNPVATEQYGWVSENDQRGNR

SEQ ID NO: 17913 - protein, 29 aa, Artificial Sequence
  Description of Artificial Sequence: Synthetic peptide
SEEEIRTTNPAATEMYGSVSTNLQREGNR

SEQ ID NO: 17914 - protein, 28 aa, Artificial Sequence
  Description of Artificial Sequence: Synthetic peptide
DEEEIRTTNPVATEGYGLVATNLQRGER

SEQ ID NO: 17915 - protein, 28 aa, Artificial Sequence
  Description of Artificial Sequence: Synthetic peptide
DEEEIRTTNPVCTEQYGVVSTNLQSGNQ

SEQ ID NO: 17916 - protein, 31 aa, Artificial Sequence
  Description of Artificial Sequence: Synthetic polypeptide
DEEEIRTTNPVATEQYGSVSTNLVQMEGINR

SEQ ID NO: 17917 - protein, 28 aa, Artificial Sequence
  Description of Artificial Sequence: Synthetic peptide
DEEEIRSTNPVCTEQYGSVSENLQHGNR

SEQ ID NO: 17918 - protein, 28 aa, Artificial Sequence
  Description of Artificial Sequence: Synthetic peptide
DEEEIRTTNPVATEPYGSVATNLQYGND

SEQ ID NO: 17919 - protein, 28 aa, Artificial Sequence
  Description of Artificial Sequence: Synthetic peptide
DENEIRATNPVSTEQYGSVSTNLQRGNF

SEQ ID NO: 17920 - protein, 28 aa, Artificial Sequence
  Description of Artificial Sequence: Synthetic peptide
DEEPINTTNPVATEQYGSVSENLQQGNR

SEQ ID NO: 17921 - protein, 28 aa, Artificial Sequence
  Description of Artificial Sequence: Synthetic peptide
SEEEIRTTNPVATEQYGSVATNLQQGMR

SEQ ID NO: 17922 - protein, 28 aa, Artificial Sequence
  Description of Artificial Sequence: Synthetic peptide
DEEEIRTTNPEATEQYGSVSTNLEREER

SEQ ID NO: 17923 - protein, 29 aa, Artificial Sequence
  Description of Artificial Sequence: Synthetic peptide
DEQEIRTTNPVATEQYGSVSTAEQRGNDR

SEQ ID NO: 17924 - protein, 28 aa, Artificial Sequence
  Description of Artificial Sequence: Synthetic peptide
SEEEIRATNPTATEQYGSVSTNLQRGNF

SEQ ID NO: 17925 - protein, 31 aa, Artificial Sequence
  Description of Artificial Sequence: Synthetic polypeptide
DEEEIATTNPVATEQYGSVSATNLQREGNDR

SEQ ID NO: 17926 - protein, 28 aa, Artificial Sequence
  Description of Artificial Sequence: Synthetic peptide
AENEIRQTNPVATEQYGSVSDNLQRGNR

SEQ ID NO: 17927 - protein, 30 aa, Artificial Sequence
  Description of Artificial Sequence: Synthetic polypeptide
DEGEIRTTNPVATEQYGVSSVSTNLQWGNR

SEQ ID NO: 17928 - protein, 28 aa, Artificial Sequence
  Description of Artificial Sequence: Synthetic peptide
DEEEIRTTNIVATEQYGSVSEDLGRGNR

SEQ ID NO: 17929 - protein, 28 aa, Artificial Sequence
  Description of Artificial Sequence: Synthetic peptide
AENEIRTTNPVATEQYGSVGTNLQRGER

SEQ ID NO: 17930 - protein, 28 aa, Artificial Sequence
  Description of Artificial Sequence: Synthetic peptide
DEEEIRTTNPVATEQYGSVETNLQIGES

SEQ ID NO: 17931 - protein, 28 aa, Artificial Sequence
  Description of Artificial Sequence: Synthetic peptide
DEEEIRTTNPVATEQYGEVSENLQRGDH

SEQ ID NO: 17932 - protein, 28 aa, Artificial Sequence
  Description of Artificial Sequence: Synthetic peptide
DEEEIRTTNPVATEQYGSVSENLQTGEI

SEQ ID NO: 17933 - protein, 28 aa, Artificial Sequence
  Description of Artificial Sequence: Synthetic peptide
DEEEIRTTNIVATEQYGETSENLQRGNR

SEQ ID NO: 17934 - protein, 29 aa, Artificial Sequence
  Description of Artificial Sequence: Synthetic peptide
DEEEIRTTNPEATEQYGSVSTNLQMQGDR

SEQ ID NO: 17935 - protein, 30 aa, Artificial Sequence
  Description of Artificial Sequence: Synthetic polypeptide
DEEEIRTTNPVATEQYGSVSCENLQQGNDR

SEQ ID NO: 17936 - protein, 28 aa, Artificial Sequence
  Description of Artificial Sequence: Synthetic peptide
DEEEICTTNPVATEQYGSVSANLQRGTY

SEQ ID NO: 17937 - protein, 30 aa, Artificial Sequence
  Description of Artificial Sequence: Synthetic polypeptide
DEEEIRTTNPEATEQYGSVSTNLQIRGEDR

SEQ ID NO: 17938 - protein, 28 aa, Artificial Sequence
  Description of Artificial Sequence: Synthetic peptide
DEEEIRTTNPDATEQYGMVSTNLQDGNP

SEQ ID NO: 17939 - protein, 28 aa, Artificial Sequence
  Description of Artificial Sequence: Synthetic peptide
DEAEITTTNPVATEQYGSVSTDLQRGNM

SEQ ID NO: 17940 - protein, 30 aa, Artificial Sequence
  Description of Artificial Sequence: Synthetic polypeptide
DEEEIRTTNPTATEQYGSVSTMNPQRGNTR

SEQ ID NO: 17941 - protein, 28 aa, Artificial Sequence
  Description of Artificial Sequence: Synthetic peptide
MEEEITTTNPVATEQYGSVSYNQQRGNR

SEQ ID NO: 17942 - protein, 30 aa, Artificial Sequence
  Description of Artificial Sequence: Synthetic polypeptide
DEEEIRTTNPVATEQYGSVSTNLQEVEGNI

SEQ ID NO: 17943 - protein, 28 aa, Artificial Sequence
  Description of Artificial Sequence: Synthetic peptide
DEEEIRSTNPVATECYGSVSTALQRGDR

SEQ ID NO: 17944 - protein, 30 aa, Artificial Sequence
  Description of Artificial Sequence: Synthetic polypeptide
DEEEIRTTNPVATEQYGSVSTNLQEAGNDM

SEQ ID NO: 17945 - protein, 28 aa, Artificial Sequence
  Description of Artificial Sequence: Synthetic peptide
DEYEIWTTNIVATEQYGSVSANLQRGNR

SEQ ID NO: 17946 - protein, 30 aa, Artificial Sequence
  Description of Artificial Sequence: Synthetic polypeptide
DEEEIRTTNPVATEQYGSMSTNLQREGNDM

SEQ ID NO: 17947 - protein, 28 aa, Artificial Sequence
  Description of Artificial Sequence: Synthetic peptide
DEEEIRTTNPVATEQYGSVSTGLELGNE

SEQ ID NO: 17948 - protein, 31 aa, Artificial Sequence
  Description of Artificial Sequence: Synthetic polypeptide
DEEEIRTTNPVATEQYGSVSETNLERDGENR

SEQ ID NO: 17949 - protein, 28 aa, Artificial Sequence
  Description of Artificial Sequence: Synthetic peptide
KEEEIRTVNPVATEQYGSVSTDLQQGNR

SEQ ID NO: 17950 - protein, 28 aa, Artificial Sequence
  Description of Artificial Sequence: Synthetic peptide
DEEEIVTTNPVATESYGSVSTNLQRLNT

SEQ ID NO: 17951 - protein, 29 aa, Artificial Sequence
  Description of Artificial Sequence: Synthetic peptide
DEEEIRTTNPAATEQYGSVSENLQMQGNR

SEQ ID NO: 17952 - protein, 29 aa, Artificial Sequence
  Description of Artificial Sequence: Synthetic peptide
DEEEIRTTNPVATEQYGSVDTNDQRGDER

SEQ ID NO: 17953 - protein, 30 aa, Artificial Sequence
  Description of Artificial Sequence: Synthetic polypeptide
DEEEIRTTNPVATEQYGSVSTNLEERGNDI

SEQ ID NO: 17954 - protein, 28 aa, Artificial Sequence
  Description of Artificial Sequence: Synthetic peptide
DEMEIRTTNPVATECYGSVPTNLQRGMR

SEQ ID NO: 17955 - protein, 28 aa, Artificial Sequence
  Description of Artificial Sequence: Synthetic peptide
DEEEIRTTNPVATEQYGSVETDDERGNR

SEQ ID NO: 17956 - protein, 28 aa, Artificial Sequence
  Description of Artificial Sequence: Synthetic peptide
DEEEICTTNPVATETYGSVSTNLQTGNE

SEQ ID NO: 17957 - protein, 28 aa, Artificial Sequence
  Description of Artificial Sequence: Synthetic peptide
DEEEIRTTNPVATEQWGSVSTNEMRGNF

SEQ ID NO: 17958 - protein, 30 aa, Artificial Sequence
  Description of Artificial Sequence: Synthetic polypeptide
NEEEIRTTNPVATEQYGSVSTNLQQERGNQ

SEQ ID NO: 17959 - protein, 28 aa, Artificial Sequence
  Description of Artificial Sequence: Synthetic peptide
HEEEIRTTNPVASEQYGVVSTNDQRGNR

SEQ ID NO: 17960 - protein, 29 aa, Artificial Sequence
  Description of Artificial Sequence: Synthetic peptide
DEEEIVTTNPVATEQYGSVWSTNLQRGEY

SEQ ID NO: 17961 - protein, 29 aa, Artificial Sequence
  Description of Artificial Sequence: Synthetic peptide
DEEEIRTTNPVATEQYGSVSTDLQEQGNI

SEQ ID NO: 17962 - protein, 29 aa, Artificial Sequence
  Description of Artificial Sequence: Synthetic peptide
DEEEIRTTNPVATEQYGSVETDNEQRGNF

SEQ ID NO: 17963 - protein, 30 aa, Artificial Sequence
  Description of Artificial Sequence: Synthetic polypeptide
DEEEIRTTNPVATELYGSVSCTNLQQRGNG

SEQ ID NO: 17964 - protein, 28 aa, Artificial Sequence
  Description of Artificial Sequence: Synthetic peptide
SEEEIRTVNPCSTEQYGSVSTNLQRGNR

SEQ ID NO: 17965 - protein, 28 aa, Artificial Sequence
  Description of Artificial Sequence: Synthetic peptide
SEEEIRTTNIVATEQYGSVSENIQRGNR

SEQ ID NO: 17966 - protein, 28 aa, Artificial Sequence
  Description of Artificial Sequence: Synthetic peptide
DEVEIRTTNIVATEQYGSVATDLQRGNR

SEQ ID NO: 17967 - protein, 28 aa, Artificial Sequence
  Description of Artificial Sequence: Synthetic peptide
DEEEIATTNPVATEQYGSVPTNLMRENR

SEQ ID NO: 17968 - protein, 28 aa, Artificial Sequence
  Description of Artificial Sequence: Synthetic peptide
DEEEIRTTNPVGTECYGWVSTNLQRGNQ

SEQ ID NO: 17969 - protein, 28 aa, Artificial Sequence
  Description of Artificial Sequence: Synthetic peptide
DEEEIRTTNPVATEQFGVVSTNLQFGTR

SEQ ID NO: 17970 - protein, 29 aa, Artificial Sequence
  Description of Artificial Sequence: Synthetic peptide
DEEEIATTNPVATEQYGSVSTNLQNGDNL

SEQ ID NO: 17971 - protein, 28 aa, Artificial Sequence
  Description of Artificial Sequence: Synthetic peptide
DEEEIRTTNIVATEQYGCVSTDLERGNR

SEQ ID NO: 17972 - protein, 31 aa, Artificial Sequence
  Description of Artificial Sequence: Synthetic polypeptide
DEEEIRTTNPTATEQYGSVSTMNLQERGNTR

SEQ ID NO: 17973 - protein, 28 aa, Artificial Sequence
  Description of Artificial Sequence: Synthetic peptide
DEMEIRTTNPVATEQYGIVSTNLQWGNN

SEQ ID NO: 17974 - protein, 28 aa, Artificial Sequence
  Description of Artificial Sequence: Synthetic peptide
SEEEIRTTNPVATEQYGSASTNGQRGNQ

SEQ ID NO: 17975 - protein, 30 aa, Artificial Sequence
  Description of Artificial Sequence: Synthetic polypeptide
DEEEIRTTNPVATEQYGSVSTNLQDHGNDW

SEQ ID NO: 17976 - protein, 28 aa, Artificial Sequence
  Description of Artificial Sequence: Synthetic peptide
DEEEIRTTNPVATEIYGSVSTNLDEGNP

SEQ ID NO: 17977 - protein, 28 aa, Artificial Sequence
  Description of Artificial Sequence: Synthetic peptide
DEEEIATTNPVATEQYGSVSTALQEGNN

SEQ ID NO: 17978 - protein, 28 aa, Artificial Sequence
  Description of Artificial Sequence: Synthetic peptide
DEEELRTTNPVATEAYGSVSTNVQYGNR

SEQ ID NO: 17979 - protein, 28 aa, Artificial Sequence
  Description of Artificial Sequence: Synthetic peptide
DEEEIRTTNIVATEQYGSVSTIEERGNR

SEQ ID NO: 17980 - protein, 31 aa, Artificial Sequence
  Description of Artificial Sequence: Synthetic polypeptide
DEEEIRTTNPVATEQYGSVSTNGDQERDGNR

SEQ ID NO: 17981 - protein, 28 aa, Artificial Sequence
  Description of Artificial Sequence: Synthetic peptide
DEEEIRCTNPVATEQWGSVSENLQQGNR

SEQ ID NO: 17982 - protein, 29 aa, Artificial Sequence
  Description of Artificial Sequence: Synthetic peptide
DEEEIRTTNPVATEQYGSVSTNLQELGDT

SEQ ID NO: 17983 - protein, 28 aa, Artificial Sequence
  Description of Artificial Sequence: Synthetic peptide
DEDEIRTTNPVATEQYGSVSTGLNRGNY

SEQ ID NO: 17984 - protein, 28 aa, Artificial Sequence
  Description of Artificial Sequence: Synthetic peptide
CEEEIRTVNPVATEVYGSVSTNLQIGNR

SEQ ID NO: 17985 - protein, 29 aa, Artificial Sequence
  Description of Artificial Sequence: Synthetic peptide
DEEEVRTVNPVATEQYGSVSTNLQTKGNR

SEQ ID NO: 17986 - protein, 28 aa, Artificial Sequence
  Description of Artificial Sequence: Synthetic peptide
DEEEIRTTNPVATEQYGSVSTNLETGED

SEQ ID NO: 17987 - protein, 28 aa, Artificial Sequence
  Description of Artificial Sequence: Synthetic peptide
DEEEIRTTNPVATEQYGSVDTNLEAGNP

SEQ ID NO: 17988 - protein, 28 aa, Artificial Sequence
  Description of Artificial Sequence: Synthetic peptide
DESEIRTTNPVATEQYGSVSDNLQHGNT

SEQ ID NO: 17989 - protein, 29 aa, Artificial Sequence
  Description of Artificial Sequence: Synthetic peptide
DEEEIGTTNPVGTEQYGSVSTNIQNRGNR

SEQ ID NO: 17990 - protein, 28 aa, Artificial Sequence
  Description of Artificial Sequence: Synthetic peptide
DEEEIRTTNPVATEQWGSVSTNEMRGNA

SEQ ID NO: 17991 - protein, 28 aa, Artificial Sequence
  Description of Artificial Sequence: Synthetic peptide
DESEIRTTNPVCTEQYGSVSTNLQRGTQ

SEQ ID NO: 17992 - protein, 28 aa, Artificial Sequence
  Description of Artificial Sequence: Synthetic peptide
DEEEIRTTNPVATEQYGSVDTDLQNGND

SEQ ID NO: 17993 - protein, 28 aa, Artificial Sequence
  Description of Artificial Sequence: Synthetic peptide
DEEEIATTNIVATEQYGSVETNLQRGNQ

SEQ ID NO: 17994 - protein, 28 aa, Artificial Sequence
  Description of Artificial Sequence: Synthetic peptide
DEEELRTTNPVATEQYGSVSDNLQQGNL

SEQ ID NO: 17995 - protein, 30 aa, Artificial Sequence
  Description of Artificial Sequence: Synthetic polypeptide
DEEEIGTTNPVATEQYGSVSTNLQMIGMNR

SEQ ID NO: 17996 - protein, 28 aa, Artificial Sequence
  Description of Artificial Sequence: Synthetic peptide
DCEEIRTTNPAATEQYGSVSTNLQRGPP

SEQ ID NO: 17997 - protein, 30 aa, Artificial Sequence
  Description of Artificial Sequence: Synthetic polypeptide
DEEEIRTTNPVATEVYGTVSTTNLQRNGNR

SEQ ID NO: 17998 - protein, 28 aa, Artificial Sequence
  Description of Artificial Sequence: Synthetic peptide
DEENIRTTNPVATEQYGSVNTNLQKGNN

SEQ ID NO: 17999 - protein, 28 aa, Artificial Sequence
  Description of Artificial Sequence: Synthetic peptide
DEEEIRTTNPVATEQYGSVSTDLEIGNS

SEQ ID NO: 18000 - protein, 28 aa, Artificial Sequence
  Description of Artificial Sequence: Synthetic peptide
DEEEIRTTNPVATEQYGSVDTNEEEGNR

SEQ ID NO: 18001 - protein, 28 aa, Artificial Sequence
  Description of Artificial Sequence: Synthetic peptide
DEEEIASTNPVATETYGSVSTNLQRENR

SEQ ID NO: 18002 - protein, 29 aa, Artificial Sequence
  Description of Artificial Sequence: Synthetic peptide
DENEIRTTNPFATEQYGSVSTNLQRGEER

SEQ ID NO: 18003 - protein, 28 aa, Artificial Sequence
  Description of Artificial Sequence: Synthetic peptide
DEEEVRTTNPVATEQYGSVSYDLERGNR

SEQ ID NO: 18004 - protein, 30 aa, Artificial Sequence
  Description of Artificial Sequence: Synthetic polypeptide
DEEEIMTTNPVATEQYGSVSTNDPQREGNR

SEQ ID NO: 18005 - protein, 28 aa, Artificial Sequence
  Description of Artificial Sequence: Synthetic peptide
SEEEIRTTNITATEQYGSVSDNLQRGNR

SEQ ID NO: 18006 - protein, 30 aa, Artificial Sequence
  Description of Artificial Sequence: Synthetic polypeptide
DEEEIRTTNPVATEQYGRVSYTNELQYGNR

SEQ ID NO: 18007 - protein, 28 aa, Artificial Sequence
  Description of Artificial Sequence: Synthetic peptide
DEEEIAQTNPVATEQYGSVSTNLMRGQR

SEQ ID NO: 18008 - protein, 31 aa, Artificial Sequence
  Description of Artificial Sequence: Synthetic polypeptide
DEEEIRTTNPVATEQYGSVSDTNLQIGENDR

SEQ ID NO: 18009 - protein, 28 aa, Artificial Sequence
  Description of Artificial Sequence: Synthetic peptide
DEEEIRTTNPVATAQYGEVSTNLARGNL

SEQ ID NO: 18010 - protein, 30 aa, Artificial Sequence
  Description of Artificial Sequence: Synthetic polypeptide
DEEEIRTTNPVATEQYGSVSTNLQERGEDM

SEQ ID NO: 18011 - protein, 28 aa, Artificial Sequence
  Description of Artificial Sequence: Synthetic peptide
DEEEIRTTNPVATEQYGSVETNLQIEER

SEQ ID NO: 18012 - protein, 29 aa, Artificial Sequence
  Description of Artificial Sequence: Synthetic peptide
DEEEIRTTNPVATECYGSVSTNDQREGNH

SEQ ID NO: 18013 - protein, 28 aa, Artificial Sequence
  Description of Artificial Sequence: Synthetic peptide
DEEEIRTTNPVATEQYGSVDANLQHGNI

SEQ ID NO: 18014 - protein, 28 aa, Artificial Sequence
  Description of Artificial Sequence: Synthetic peptide
DEEEIRTTNIVATEQYGSVDTNLQRGDF

SEQ ID NO: 18015 - protein, 31 aa, Artificial Sequence
  Description of Artificial Sequence: Synthetic polypeptide
DEEEIRTTNPVATEQYGSVSTNLQDRDGNDH

SEQ ID NO: 18016 - protein, 28 aa, Artificial Sequence
  Description of Artificial Sequence: Synthetic peptide
DEQEIRTTNIVATEQFGSVSENLQRGNR

SEQ ID NO: 18017 - protein, 29 aa, Artificial Sequence
  Description of Artificial Sequence: Synthetic peptide
DEEELRQTNPVATEQYGSVSTNNLQRGNP

SEQ ID NO: 18018 - protein, 30 aa, Artificial Sequence
  Description of Artificial Sequence: Synthetic polypeptide
DEEEIRTTNPVATEQYGSVSTNLIQFDGER

SEQ ID NO: 18019 - protein, 30 aa, Artificial Sequence
  Description of Artificial Sequence: Synthetic polypeptide
DEEEIRTTNPVATEQYGSVSTNDQRDGDNQ

SEQ ID NO: 18020 - protein, 28 aa, Artificial Sequence
  Description of Artificial Sequence: Synthetic peptide
DEEEIRCTNPVATEIYGAVSMNLQRGNR

SEQ ID NO: 18021 - protein, 31 aa, Artificial Sequence
  Description of Artificial Sequence: Synthetic polypeptide
DEEEIRTTNPVATEQYGSVSTNLQERGDNDD

SEQ ID NO: 18022 - protein, 28 aa, Artificial Sequence
  Description of Artificial Sequence: Synthetic peptide
AETEIRTTNPVATEQYGWVSENLQRGNR

SEQ ID NO: 18023 - protein, 30 aa, Artificial Sequence
  Description of Artificial Sequence: Synthetic polypeptide
DEEEIRTTNPVATEQYGSVISTANEQRGDR

SEQ ID NO: 18024 - protein, 28 aa, Artificial Sequence
  Description of Artificial Sequence: Synthetic peptide
DEEEIRCTNIVATEQYGSASTNLQRGNM

SEQ ID NO: 18025 - protein, 28 aa, Artificial Sequence
  Description of Artificial Sequence: Synthetic peptide
DEEEIRTTNPVATECYGSVSTDLQQGER

SEQ ID NO: 18026 - protein, 28 aa, Artificial Sequence
  Description of Artificial Sequence: Synthetic peptide
DEEEIRATNPVASEQYGVVSTNLQGGNR

SEQ ID NO: 18027 - protein, 28 aa, Artificial Sequence
  Description of Artificial Sequence: Synthetic peptide
DEEEIRTTNPVATEQYGSVSTDLDYGNA

SEQ ID NO: 18028 - protein, 28 aa, Artificial Sequence
  Description of Artificial Sequence: Synthetic peptide
NEEVIDTTNIVATEQYGSVSTNLQRGNR

SEQ ID NO: 18029 - protein, 28 aa, Artificial Sequence
  Description of Artificial Sequence: Synthetic peptide
DEEEIRTTNPVATEQYGSVDTNLQEGDM

SEQ ID NO: 18030 - protein, 28 aa, Artificial Sequence
  Description of Artificial Sequence: Synthetic peptide
AEEEIVTTNPVATEQYGSVSTCLQRGER

SEQ ID NO: 18031 - protein, 29 aa, Artificial Sequence
  Description of Artificial Sequence: Synthetic peptide
DEEEINTTNPVATEMYGSVSTLLQRAGNR

SEQ ID NO: 18032 - protein, 30 aa, Artificial Sequence
  Description of Artificial Sequence: Synthetic polypeptide
DEEEIRTTNPVATEQYGSVSTINEQRGDDR

SEQ ID NO: 18033 - protein, 29 aa, Artificial Sequence
  Description of Artificial Sequence: Synthetic peptide
SEEEITTTNPVATEQYGSVSTANEQRGNR

SEQ ID NO: 18034 - protein, 28 aa, Artificial Sequence
  Description of Artificial Sequence: Synthetic peptide
DEEEIRTTNPVATEQYGSVSTNQIRGET

SEQ ID NO: 18035 - protein, 28 aa, Artificial Sequence
  Description of Artificial Sequence: Synthetic peptide
DEEEIRTTNPVATEQYGSVSENLQLFNT

SEQ ID NO: 18036 - protein, 28 aa, Artificial Sequence
  Description of Artificial Sequence: Synthetic peptide
DEEEIRTTNIISTEQYGSVSTNLQRGNA

SEQ ID NO: 18037 - protein, 29 aa, Artificial Sequence
  Description of Artificial Sequence: Synthetic peptide
DEEEIRTTNPFATEQYGSVSTNLFREGND

SEQ ID NO: 18038 - protein, 28 aa, Artificial Sequence
  Description of Artificial Sequence: Synthetic peptide
DEEEIRTTNPVATEQYGSVETPDQDGNR

SEQ ID NO: 18039 - protein, 30 aa, Artificial Sequence
  Description of Artificial Sequence: Synthetic polypeptide
DEEEIRTTNPVATECYGSVSTNLQERGEDR

SEQ ID NO: 18040 - protein, 31 aa, Artificial Sequence
  Description of Artificial Sequence: Synthetic polypeptide
DEEEIRTTNPVATEQYGSVSNTLNLIQIGNR

SEQ ID NO: 18041 - protein, 30 aa, Artificial Sequence
  Description of Artificial Sequence: Synthetic polypeptide
DEEEIRTTNPVATEQYGCSVNSTNLQLENR

SEQ ID NO: 18042 - protein, 29 aa, Artificial Sequence
  Description of Artificial Sequence: Synthetic peptide
DEEEIRTTNPEATEQYGSVSTNDQDGNER

SEQ ID NO: 18043 - protein, 28 aa, Artificial Sequence
  Description of Artificial Sequence: Synthetic peptide
QEQEIRTTNPVATECYGSVSTNLQRGNF

SEQ ID NO: 18044 - protein, 28 aa, Artificial Sequence
  Description of Artificial Sequence: Synthetic peptide
HEEEIRSTNPVATEIYGGVSTNLQRGNR

SEQ ID NO: 18045 - protein, 29 aa, Artificial Sequence
  Description of Artificial Sequence: Synthetic peptide
DEEEIRTTNPVATEQYGSVSTNLQSEGEF

SEQ ID NO: 18046 - protein, 28 aa, Artificial Sequence
  Description of Artificial Sequence: Synthetic peptide
DEEEIATTNPVATEMYGSVSVNLQQGNR

SEQ ID NO: 18047 - protein, 28 aa, Artificial Sequence
  Description of Artificial Sequence: Synthetic peptide
DEEEIRATNPVATEQYGSVSTNWQIGTR

SEQ ID NO: 18048 - protein, 28 aa, Artificial Sequence
  Description of Artificial Sequence: Synthetic peptide
CESEIRTTNPVATEQYGQVSTNDQRGNR

SEQ ID NO: 18049 - protein, 28 aa, Artificial Sequence
  Description of Artificial Sequence: Synthetic peptide
DEEEIRTTNPVATEQYGSVSTNLENGEN

SEQ ID NO: 18050 - protein, 28 aa, Artificial Sequence
  Description of Artificial Sequence: Synthetic peptide
DESEIRTTNPCATECYGSVSTNLQNGNR

SEQ ID NO: 18051 - protein, 28 aa, Artificial Sequence
  Description of Artificial Sequence: Synthetic peptide
DEEEIRCTNPVATEQYGSVSTELDHGNR

SEQ ID NO: 18052 - protein, 28 aa, Artificial Sequence
  Description of Artificial Sequence: Synthetic peptide
DEEEIRTTNPEATECYGSVSTNLQVGNE

SEQ ID NO: 18053 - protein, 30 aa, Artificial Sequence
  Description of Artificial Sequence: Synthetic polypeptide
DEEEIRTTNPVATEQYGMSVSTNDQEGLNR

SEQ ID NO: 18054 - protein, 28 aa, Artificial Sequence
  Description of Artificial Sequence: Synthetic peptide
DEEEIRTTNPEATEQYGSVSTDLQWGER

SEQ ID NO: 18055 - protein, 28 aa, Artificial Sequence
  Description of Artificial Sequence: Synthetic peptide
DEEEIRTTNPVATEQYGSVSTTLQHGTL

SEQ ID NO: 18056 - protein, 31 aa, Artificial Sequence
  Description of Artificial Sequence: Synthetic polypeptide
DEEEIRTTNPVATEQYGSVSETELQDRDGNR

SEQ ID NO: 18057 - protein, 28 aa, Artificial Sequence
  Description of Artificial Sequence: Synthetic peptide
DEEEISTTNPVSTEQYGSVSENLQRGNF

SEQ ID NO: 18058 - protein, 29 aa, Artificial Sequence
  Description of Artificial Sequence: Synthetic peptide
DEEEIRTTNPVATEQYGSVSTNLQEAGEH

SEQ ID NO: 18059 - protein, 31 aa, Artificial Sequence
  Description of Artificial Sequence: Synthetic polypeptide
DEEEIRTTNPVATEQYGSVSTDLQDRNGNDR

SEQ ID NO: 18060 - protein, 28 aa, Artificial Sequence
  Description of Artificial Sequence: Synthetic peptide
DECEIRTTNPVATEQYGTVDTNLQRGNA

SEQ ID NO: 18061 - protein, 28 aa, Artificial Sequence
  Description of Artificial Sequence: Synthetic peptide
DEEEIRTTNPVATEQYGSVSTELQFGDQ

SEQ ID NO: 18062 - protein, 29 aa, Artificial Sequence
  Description of Artificial Sequence: Synthetic peptide
DETEIRTTNPVCTEQYGSVSTDLQRGENR

SEQ ID NO: 18063 - protein, 29 aa, Artificial Sequence
  Description of Artificial Sequence: Synthetic peptide
DEEEIRTTNPVATVQYGSVSTNLQRGLPE

SEQ ID NO: 18064 - protein, 30 aa, Artificial Sequence
  Description of Artificial Sequence: Synthetic polypeptide
DEEEIRTTNPVATEQYGSVSTNLQREGEDM

SEQ ID NO: 18065 - protein, 28 aa, Artificial Sequence
  Description of Artificial Sequence: Synthetic peptide
DEEEVATTNPVCTEQYGSVSTNLERGNR

SEQ ID NO: 18066 - protein, 29 aa, Artificial Sequence
  Description of Artificial Sequence: Synthetic peptide
DEECIRTTNPVATEQYGSVETNLQRGEPR

SEQ ID NO: 18067 - protein, 28 aa, Artificial Sequence
  Description of Artificial Sequence: Synthetic peptide
DEEEIRTTNPVSTEQWGSYSTNLQGGNR

SEQ ID NO: 18068 - protein, 28 aa, Artificial Sequence
  Description of Artificial Sequence: Synthetic peptide
DEQEIATTNPVATEMYGGVSTNLQRGNR

SEQ ID NO: 18069 - protein, 28 aa, Artificial Sequence
  Description of Artificial Sequence: Synthetic peptide
DEEEIRTTNPVATEQWGSVSTNEMRGNW

SEQ ID NO: 18070 - protein, 28 aa, Artificial Sequence
  Description of Artificial Sequence: Synthetic peptide
DEQEIVATNPVATEQYGWVSTNLQRGNR

SEQ ID NO: 18071 - protein, 28 aa, Artificial Sequence
  Description of Artificial Sequence: Synthetic peptide
SEEEIRTTNPVATEQYGIVSTNDQRGNT

SEQ ID NO: 18072 - protein, 28 aa, Artificial Sequence
  Description of Artificial Sequence: Synthetic peptide
DEEEIATTNIVSTEQYGWVSTNLQRGNR

SEQ ID NO: 18073 - protein, 28 aa, Artificial Sequence
  Description of Artificial Sequence: Synthetic peptide
DEGEIVTTNPVATEQYGSVSTNLQRGGA

SEQ ID NO: 18074 - protein, 31 aa, Artificial Sequence
  Description of Artificial Sequence: Synthetic polypeptide
DEEEIRSTNPVATEQYGSVSITNGLNQRGNR

SEQ ID NO: 18075 - protein, 28 aa, Artificial Sequence
  Description of Artificial Sequence: Synthetic peptide
DEEEIRTTNPVATEQYGSVSTDDQPGNP

SEQ ID NO: 18076 - protein, 28 aa, Artificial Sequence
  Description of Artificial Sequence: Synthetic peptide
DEQEIGTTNPVATEQYGSVSTPLQDGNR

SEQ ID NO: 18077 - protein, 28 aa, Artificial Sequence
  Description of Artificial Sequence: Synthetic peptide
QEQEIRTTNPVATEQYGDVSDNLQRGNR

SEQ ID NO: 18078 - protein, 28 aa, Artificial Sequence
  Description of Artificial Sequence: Synthetic peptide
DENEIRTTNIVATEQYGSVSTNLDMGNR

SEQ ID NO: 18079 - protein, 28 aa, Artificial Sequence
  Description of Artificial Sequence: Synthetic peptide
DEEEIRTTNPVATECYGSVSTNLELGNE

SEQ ID NO: 18080 - protein, 29 aa, Artificial Sequence
  Description of Artificial Sequence: Synthetic peptide
DEEEICTTNPVSTEQYGSVSATVLQRGNR

SEQ ID NO: 18081 - protein, 28 aa, Artificial Sequence
  Description of Artificial Sequence: Synthetic peptide
DEGEIRTTNPVATEQYGSVSTNLQGGLF

SEQ ID NO: 18082 - protein, 30 aa, Artificial Sequence
  Description of Artificial Sequence: Synthetic polypeptide
DEEEIRTTNPVATEQYGSVSTNEQRGDNDE

SEQ ID NO: 18083 - protein, 29 aa, Artificial Sequence
  Description of Artificial Sequence: Synthetic peptide
DEEEIRTTNPVATEQYGSVDTNNLQAGNP

SEQ ID NO: 18084 - protein, 28 aa, Artificial Sequence
  Description of Artificial Sequence: Synthetic peptide
DEGEIRTTNPVATESYGQVSCNLQRGNR

SEQ ID NO: 18085 - protein, 31 aa, Artificial Sequence
  Description of Artificial Sequence: Synthetic polypeptide
DEEEIRTTNPVATEQYGSYVSITGLQRGDNR

SEQ ID NO: 18086 - protein, 29 aa, Artificial Sequence
  Description of Artificial Sequence: Synthetic peptide
DEEEIVTTNPVATEQYGSVSEMNLQRGNA

SEQ ID NO: 18087 - protein, 29 aa, Artificial Sequence
  Description of Artificial Sequence: Synthetic peptide
GEEEIRTTNPVATEVYGAVSTNLQREGNR

SEQ ID NO: 18088 - protein, 30 aa, Artificial Sequence
  Description of Artificial Sequence: Synthetic polypeptide
DEQEIRTTNPVATEQYGSVSTNLEERGDNR

SEQ ID NO: 18089 - protein, 28 aa, Artificial Sequence
  Description of Artificial Sequence: Synthetic peptide
DEEEIRTTNPVATEQYGSVSTELEHGNH

SEQ ID NO: 18090 - protein, 28 aa, Artificial Sequence
  Description of Artificial Sequence: Synthetic peptide
DEGEIRTTNPVATEVYGSVSTNLQVGNF

SEQ ID NO: 18091 - protein, 28 aa, Artificial Sequence
  Description of Artificial Sequence: Synthetic peptide
DETEIRTTNPVATEQYGSVTTNLIRGND

SEQ ID NO: 18092 - protein, 28 aa, Artificial Sequence
  Description of Artificial Sequence: Synthetic peptide
DEEEIRTTNPEATEQYGSVSTDDQRGNN

SEQ ID NO: 18093 - protein, 28 aa, Artificial Sequence
  Description of Artificial Sequence: Synthetic peptide
DENEIKTTNPVATEQYGSVSTNEQRGTR

SEQ ID NO: 18094 - protein, 29 aa, Artificial Sequence
  Description of Artificial Sequence: Synthetic peptide
DEEEIRTTNPVATEQYGSVSTNEQNGNTQ

SEQ ID NO: 18095 - protein, 30 aa, Artificial Sequence
  Description of Artificial Sequence: Synthetic polypeptide
DEFSIRTTNPVATEQYGSVSTNPLQRGDNR

SEQ ID NO: 18096 - protein, 28 aa, Artificial Sequence
  Description of Artificial Sequence: Synthetic peptide
DEEEIATVNPVATEQYGEVSTNLQRGNL

SEQ ID NO: 18097 - protein, 31 aa, Artificial Sequence
  Description of Artificial Sequence: Synthetic polypeptide
DEEEIRTTNPVATEQYGSVSTNLQEREGNDM

SEQ ID NO: 18098 - protein, 28 aa, Artificial Sequence
  Description of Artificial Sequence: Synthetic peptide
DEEEIRTTNPVSTEQWGSVSTNLMRGNA

SEQ ID NO: 18099 - protein, 28 aa, Artificial Sequence
  Description of Artificial Sequence: Synthetic peptide
DEEEIRPTNPVATEQYGYVSTPLQEGNR

SEQ ID NO: 18100 - protein, 28 aa, Artificial Sequence
  Description of Artificial Sequence: Synthetic peptide
DDEEIATTNPVASEQYGSVSTELQRGNR

SEQ ID NO: 18101 - protein, 28 aa, Artificial Sequence
  Description of Artificial Sequence: Synthetic peptide
SEEEIRTTNPVATEQYGSVSTNLQIGDG

SEQ ID NO: 18102 - protein, 28 aa, Artificial Sequence
  Description of Artificial Sequence: Synthetic peptide
DEEEIRSTNPVATEQYGDVSTNLQHGNP

SEQ ID NO: 18103 - protein, 31 aa, Artificial Sequence
  Description of Artificial Sequence: Synthetic polypeptide
DEEEIRTTNPVATEQYGSVSCTMNLQCRGND

SEQ ID NO: 18104 - protein, 29 aa, Artificial Sequence
  Description of Artificial Sequence: Synthetic peptide
DEELIRTTNPVATEQYGSVSETGLQRGNW

SEQ ID NO: 18105 - protein, 28 aa, Artificial Sequence
  Description of Artificial Sequence: Synthetic peptide
DEEEIYTTNPVATEQYGEVSNNLQRGNL

SEQ ID NO: 18106 - protein, 30 aa, Artificial Sequence
  Description of Artificial Sequence: Synthetic polypeptide
DEEEIRTTNPVATEQYGSVSTNGLVEHGNR

SEQ ID NO: 18107 - protein, 28 aa, Artificial Sequence
  Description of Artificial Sequence: Synthetic peptide
DEEEIRTTNPDATEQYGSVSTNDQIGER

SEQ ID NO: 18108 - protein, 28 aa, Artificial Sequence
  Description of Artificial Sequence: Synthetic peptide
DEEEIRTTNPVATEQYGSVSTEEQGGNV

SEQ ID NO: 18109 - protein, 28 aa, Artificial Sequence
  Description of Artificial Sequence: Synthetic peptide
DEEEIRTTNPVATEQYGSVETNLQFENE

SEQ ID NO: 18110 - protein, 30 aa, Artificial Sequence
  Description of Artificial Sequence: Synthetic polypeptide
DEEEIRTTNPVATEQYGSVSTEPLQELGNR

SEQ ID NO: 18111 - protein, 28 aa, Artificial Sequence
  Description of Artificial Sequence: Synthetic peptide
DEEEIRTTNPVATEQYGSVSTNDLTGER

SEQ ID NO: 18112 - protein, 28 aa, Artificial Sequence
  Description of Artificial Sequence: Synthetic peptide
FEEEIRTTNPVATEQYGGVSTNLQQGND

SEQ ID NO: 18113 - protein, 28 aa, Artificial Sequence
  Description of Artificial Sequence: Synthetic peptide
DEEEIRQTNPVATEQYGSVSTNQEVGNR

SEQ ID NO: 18114 - protein, 31 aa, Artificial Sequence
  Description of Artificial Sequence: Synthetic polypeptide
DEEEICTTNPVATEQYGSVSTENGLQDRGNR

SEQ ID NO: 18115 - protein, 30 aa, Artificial Sequence
  Description of Artificial Sequence: Synthetic polypeptide
DEEEIRTTNPVATEQYGSVSTNLQEREGEM

SEQ ID NO: 18116 - protein, 28 aa, Artificial Sequence
  Description of Artificial Sequence: Synthetic peptide
AEEEIRTTNPVATEQYGWVSENLQRGER

SEQ ID NO: 18117 - protein, 28 aa, Artificial Sequence
  Description of Artificial Sequence: Synthetic peptide
DEEEIRTTNPVATEMYGSASTCLQGGNR

SEQ ID NO: 18118 - protein, 30 aa, Artificial Sequence
  Description of Artificial Sequence: Synthetic polypeptide
DEEEIRTTNPVATEQYGSVSTDLQERGNDN

SEQ ID NO: 18119 - protein, 28 aa, Artificial Sequence
  Description of Artificial Sequence: Synthetic peptide
DEEEIATTNPVATEQYGSVSENLQHGQR

SEQ ID NO: 18120 - protein, 28 aa, Artificial Sequence
  Description of Artificial Sequence: Synthetic peptide
DEEEISGTNPVATEQYGSVSDNLQRGER

SEQ ID NO: 18121 - protein, 31 aa, Artificial Sequence
  Description of Artificial Sequence: Synthetic polypeptide
DEEEIRTTNPFATEQYGSVSTNPLQQRGNDR

SEQ ID NO: 18122 - protein, 30 aa, Artificial Sequence
  Description of Artificial Sequence: Synthetic polypeptide
DEEEIRTTNPVATEQYGSVSTENEQRGDER

SEQ ID NO: 18123 - protein, 28 aa, Artificial Sequence
  Description of Artificial Sequence: Synthetic peptide
DEEEVRTTNPVSTEQYGVVSTNLQRGTR

SEQ ID NO: 18124 - protein, 28 aa, Artificial Sequence
  Description of Artificial Sequence: Synthetic peptide
DEEEIRTTNPVATENYGAVSTELQRGNF

SEQ ID NO: 18125 - protein, 28 aa, Artificial Sequence
  Description of Artificial Sequence: Synthetic peptide
DEEEIYTTNPVATEQYGSVSTELNRGNS

SEQ ID NO: 18126 - protein, 30 aa, Artificial Sequence
  Description of Artificial Sequence: Synthetic polypeptide
DEEEIRTTNPVATEQYGSYVSTPLQREGER

SEQ ID NO: 18127 - protein, 28 aa, Artificial Sequence
  Description of Artificial Sequence: Synthetic peptide
DEQEIRTTNPVATEQYGGVSTNEQRGNG

SEQ ID NO: 18128 - protein, 28 aa, Artificial Sequence
  Description of Artificial Sequence: Synthetic peptide
DEEEIATTNPVATEQYGVVSENLQRGDR

SEQ ID NO: 18129 - protein, 30 aa, Artificial Sequence
  Description of Artificial Sequence: Synthetic polypeptide
DEEEIRTTNPVATEQYGSVSTNLEEIGNDR

SEQ ID NO: 18130 - protein, 28 aa, Artificial Sequence
  Description of Artificial Sequence: Synthetic peptide
DETEIRATNPVATENYGTVSTNLQRGNR

SEQ ID NO: 18131 - protein, 28 aa, Artificial Sequence
  Description of Artificial Sequence: Synthetic peptide
DEEEIRTTNIVATEQYGSVSEELQRGNF

SEQ ID NO: 18132 - protein, 29 aa, Artificial Sequence
  Description of Artificial Sequence: Synthetic peptide
DEEEIRTTNPIAIEQYGSVSTNMQREGNR

SEQ ID NO: 18133 - protein, 28 aa, Artificial Sequence
  Description of Artificial Sequence: Synthetic peptide
DEEEIRTTNPVSTEQFGCVSTNLQRGTR

SEQ ID NO: 18134 - protein, 31 aa, Artificial Sequence
  Description of Artificial Sequence: Synthetic polypeptide
DEEEIRTTNPVATEQYGSVSTNLEERNGNDR

SEQ ID NO: 18135 - protein, 28 aa, Artificial Sequence
  Description of Artificial Sequence: Synthetic peptide
DEEEIRTTNPVATEQYGWVSENLQMGNT

SEQ ID NO: 18136 - protein, 28 aa, Artificial Sequence
  Description of Artificial Sequence: Synthetic peptide
DEEEIATTNIVATEQYGSVDTNLQRGNL

SEQ ID NO: 18137 - protein, 28 aa, Artificial Sequence
  Description of Artificial Sequence: Synthetic peptide
NEEEIRTTNPCATEQYGSASTNLQRLNR

SEQ ID NO: 18138 - protein, 30 aa, Artificial Sequence
  Description of Artificial Sequence: Synthetic polypeptide
DEEEIATTNPVATEQYGSVSTNLQEREGNF

SEQ ID NO: 18139 - protein, 30 aa, Artificial Sequence
  Description of Artificial Sequence: Synthetic polypeptide
DEEEIRTTNPVATEQYGSVSATNLQLVGND

SEQ ID NO: 18140 - protein, 28 aa, Artificial Sequence
  Description of Artificial Sequence: Synthetic peptide
DEECIRTTNPDATEQYGSVSTNDQRGNP

SEQ ID NO: 18141 - protein, 28 aa, Artificial Sequence
  Description of Artificial Sequence: Synthetic peptide
DEEEIRTTNPVATEGYGEVSTIQQRGNR

SEQ ID NO: 18142 - protein, 30 aa, Artificial Sequence
  Description of Artificial Sequence: Synthetic polypeptide
DEEEIRTTNPVATEQYGSVSTNLQQREENQ

SEQ ID NO: 18143 - protein, 28 aa, Artificial Sequence
  Description of Artificial Sequence: Synthetic peptide
DEEEIRTTNPVSTEQYGEVSTNLQRLNA

SEQ ID NO: 18144 - protein, 28 aa, Artificial Sequence
  Description of Artificial Sequence: Synthetic peptide
DEEEIRATNIVATEQYGSVSTNLQVGNF

SEQ ID NO: 18145 - protein, 29 aa, Artificial Sequence
  Description of Artificial Sequence: Synthetic peptide
DENEIRTTNPVATEQYGCVSTNLQRGNDA

SEQ ID NO: 18146 - protein, 30 aa, Artificial Sequence
  Description of Artificial Sequence: Synthetic polypeptide
DEEEIRTTNPVATEQYGSVSTNLQDDDGER

SEQ ID NO: 18147 - protein, 28 aa, Artificial Sequence
  Description of Artificial Sequence: Synthetic peptide
DEEEIRTTNPVATEQYGSVSTNLEDGEL

SEQ ID NO: 18148 - protein, 28 aa, Artificial Sequence
  Description of Artificial Sequence: Synthetic peptide
DEEEIRTTNPVATECWGSVSTNLQTGNF

SEQ ID NO: 18149 - protein, 28 aa, Artificial Sequence
  Description of Artificial Sequence: Synthetic peptide
DEEEIRTTNPVATELYGIVSTNLQRGTQ

SEQ ID NO: 18150 - protein, 28 aa, Artificial Sequence
  Description of Artificial Sequence: Synthetic peptide
DEEEIRTTNIVATMQYGSVYTNLQRGNE

SEQ ID NO: 18151 - protein, 28 aa, Artificial Sequence
  Description of Artificial Sequence: Synthetic peptide
NEEEIRTTNPVATQQYGSVSTEDQRGNR

SEQ ID NO: 18152 - protein, 28 aa, Artificial Sequence
  Description of Artificial Sequence: Synthetic peptide
SEEEIRTTNPDATEQYGSVSTNLQVGNY

SEQ ID NO: 18153 - protein, 30 aa, Artificial Sequence
  Description of Artificial Sequence: Synthetic polypeptide
DEEEIRTTNPVATEQYGSSSTGNLQLEGNR

SEQ ID NO: 18154 - protein, 29 aa, Artificial Sequence
  Description of Artificial Sequence: Synthetic peptide
DEEEIRTTNPVATEQYGSVSCENLQQGNL

SEQ ID NO: 18155 - protein, 30 aa, Artificial Sequence
  Description of Artificial Sequence: Synthetic polypeptide
DEEEIRTTNPDATEQYGSVSTMNNDQRGNR

SEQ ID NO: 18156 - protein, 28 aa, Artificial Sequence
  Description of Artificial Sequence: Synthetic peptide
DEEEIRTTNPVSTEIYGAVSTELQRGNR

SEQ ID NO: 18157 - protein, 28 aa, Artificial Sequence
  Description of Artificial Sequence: Synthetic peptide
TEEEIATTNPVATEIYGSVSDNLQRGNR

SEQ ID NO: 18158 - protein, 28 aa, Artificial Sequence
  Description of Artificial Sequence: Synthetic peptide
DEEEIRTTNPVATEQYGWVSTALQGGNV

SEQ ID NO: 18159 - protein, 29 aa, Artificial Sequence
  Description of Artificial Sequence: Synthetic peptide
DEEEISTTNPVATEQYGSVESTNLQEGNL

SEQ ID NO: 18160 - protein, 30 aa, Artificial Sequence
  Description of Artificial Sequence: Synthetic polypeptide
SEEEIRTTNPVATEQYGSVSTNLQREGTDR

SEQ ID NO: 18161 - protein, 30 aa, Artificial Sequence
  Description of Artificial Sequence: Synthetic polypeptide
DEEEIRTTNPVATEQYGSVSTNLVQVHGNL

SEQ ID NO: 18162 - protein, 30 aa, Artificial Sequence
  Description of Artificial Sequence: Synthetic polypeptide
DEEEIRTTNPVATEQYGSHVSENLQNRGDR

SEQ ID NO: 18163 - protein, 28 aa, Artificial Sequence
  Description of Artificial Sequence: Synthetic peptide
GEEEIRTTNPVATEQYGVVSTNLENGNR

SEQ ID NO: 18164 - protein, 28 aa, Artificial Sequence
  Description of Artificial Sequence: Synthetic peptide
DEEEIRTTNIVATEQYGDVSTNLQRGQA

SEQ ID NO: 18165 - protein, 28 aa, Artificial Sequence
  Description of Artificial Sequence: Synthetic peptide
FEEEIRTTNPVATENYGSVSENLQRGGR

SEQ ID NO: 18166 - protein, 30 aa, Artificial Sequence
  Description of Artificial Sequence: Synthetic polypeptide
DEEEIRTTNPVATESYGSVSCSNLQRGDNR

SEQ ID NO: 18167 - protein, 28 aa, Artificial Sequence
  Description of Artificial Sequence: Synthetic peptide
DEEEIRTTNPVATEQYGEVSENLQRGEC

SEQ ID NO: 18168 - protein, 28 aa, Artificial Sequence
  Description of Artificial Sequence: Synthetic peptide
DEECIRTTNPVATAQYGSWSTNLQDGNR

SEQ ID NO: 18169 - protein, 28 aa, Artificial Sequence
  Description of Artificial Sequence: Synthetic peptide
DEQEIAATNPVATELYGSVSTNLQRGNR

SEQ ID NO: 18170 - protein, 28 aa, Artificial Sequence
  Description of Artificial Sequence: Synthetic peptide
DEEELRTTNPVATECYGSASCNLQRGNR

SEQ ID NO: 18171 - protein, 28 aa, Artificial Sequence
  Description of Artificial Sequence: Synthetic peptide
DEEEIRTTNPVATEQYGSVETNLQIGEM

SEQ ID NO: 18172 - protein, 30 aa, Artificial Sequence
  Description of Artificial Sequence: Synthetic polypeptide
DEEEIRTTNPVATEQYGSVSTDLQHEGNDR

SEQ ID NO: 18173 - protein, 30 aa, Artificial Sequence
  Description of Artificial Sequence: Synthetic polypeptide
DEEEIRTTNPVATEQYGSVSTNLVQELGNN

SEQ ID NO: 18174 - protein, 28 aa, Artificial Sequence
  Description of Artificial Sequence: Synthetic peptide
DENEIVTTNPVATEVYGSVSTNDQRGNR

SEQ ID NO: 18175 - protein, 28 aa, Artificial Sequence
  Description of Artificial Sequence: Synthetic peptide
DEEEIRTTNPVATEGYGSVSENLQRGQI

SEQ ID NO: 18176 - protein, 30 aa, Artificial Sequence
  Description of Artificial Sequence: Synthetic polypeptide
DEEEIRTTNPVASEMYGSVSATNLQREGNR

SEQ ID NO: 18177 - protein, 28 aa, Artificial Sequence
  Description of Artificial Sequence: Synthetic peptide
DEEEIGTTNIVATEQYGSVSHNLQRGNT

SEQ ID NO: 18178 - protein, 28 aa, Artificial Sequence
  Description of Artificial Sequence: Synthetic peptide
DEEEIRTTNIVATEWYGSVSENLERGNR

SEQ ID NO: 18179 - protein, 28 aa, Artificial Sequence
  Description of Artificial Sequence: Synthetic peptide
QEQEIVTTNPVATEQYGIVSTNLQRGNR

SEQ ID NO: 18180 - protein, 28 aa, Artificial Sequence
  Description of Artificial Sequence: Synthetic peptide
QEEEIRTTNPVSTEQYGSASENLQRGNR

SEQ ID NO: 18181 - protein, 28 aa, Artificial Sequence
  Description of Artificial Sequence: Synthetic peptide
DEEEIRTTNPVATEQYGSVSTELEDGNE

SEQ ID NO: 18182 - protein, 28 aa, Artificial Sequence
  Description of Artificial Sequence: Synthetic peptide
DENEIACTNPVATEQYGWVSTNLQRGNR

SEQ ID NO: 18183 - protein, 28 aa, Artificial Sequence
  Description of Artificial Sequence: Synthetic peptide
DEEEIRTTNIVATEIYGVVSTNLQRGNT

SEQ ID NO: 18184 - protein, 28 aa, Artificial Sequence
  Description of Artificial Sequence: Synthetic peptide
DEGEIRTTNPVATEQYGEVATNGQRGNR

SEQ ID NO: 18185 - protein, 30 aa, Artificial Sequence
  Description of Artificial Sequence: Synthetic polypeptide
DEEEIRTTNPVATEQYGSVDCTNLCRGNDR

SEQ ID NO: 18186 - protein, 28 aa, Artificial Sequence
  Description of Artificial Sequence: Synthetic peptide
DEEEIRTTNPVATESYGWVSTNVQRGNS

SEQ ID NO: 18187 - protein, 28 aa, Artificial Sequence
  Description of Artificial Sequence: Synthetic peptide
DEIEIRTTNPVATEQYGTVSTNLQLGNF

SEQ ID NO: 18188 - protein, 28 aa, Artificial Sequence
  Description of Artificial Sequence: Synthetic peptide
DEEEIRTTNIVATEQYGSASTNLMAGNR

SEQ ID NO: 18189 - protein, 28 aa, Artificial Sequence
  Description of Artificial Sequence: Synthetic peptide
DEQEIRATNIVATEQYGSVSTELQRGNR

SEQ ID NO: 18190 - protein, 31 aa, Artificial Sequence
  Description of Artificial Sequence: Synthetic polypeptide
DEEEIRTTNPVATEQYGSVSTNLQELEGNDR

SEQ ID NO: 18191 - protein, 31 aa, Artificial Sequence
  Description of Artificial Sequence: Synthetic polypeptide
DEEEIRTTNPVATEQYGSVDSDTNDQRNGNR

SEQ ID NO: 18192 - protein, 28 aa, Artificial Sequence
  Description of Artificial Sequence: Synthetic peptide
DEQEIRTVNIVATEQYGSVSTNLQRGNS

SEQ ID NO: 18193 - protein, 28 aa, Artificial Sequence
  Description of Artificial Sequence: Synthetic peptide
DEQEIATTNPVATEQYGWVSDNLQRGNR

SEQ ID NO: 18194 - protein, 30 aa, Artificial Sequence
  Description of Artificial Sequence: Synthetic polypeptide
DEEEIRTTNPVATEQYGSVSTNLVQEIGNE

SEQ ID NO: 18195 - protein, 28 aa, Artificial Sequence
  Description of Artificial Sequence: Synthetic peptide
DEEEIRATNPVATEQYGVVSTDLQRGER

SEQ ID NO: 18196 - protein, 28 aa, Artificial Sequence
  Description of Artificial Sequence: Synthetic peptide
DEAEIVTTNPVATEGYGSVSTNLQVGNR

SEQ ID NO: 18197 - protein, 31 aa, Artificial Sequence
  Description of Artificial Sequence: Synthetic polypeptide
DEEEIRTTNPVATEQYGSVSDTNNLDRGNER

SEQ ID NO: 18198 - protein, 28 aa, Artificial Sequence
  Description of Artificial Sequence: Synthetic peptide
DEEEIRTTNPVATEQYGDVSTDLERGND

SEQ ID NO: 18199 - protein, 28 aa, Artificial Sequence
  Description of Artificial Sequence: Synthetic peptide
DEEEIRTTNPVATECYGSVSTNLYNGLR

SEQ ID NO: 18200 - protein, 28 aa, Artificial Sequence
  Description of Artificial Sequence: Synthetic peptide
SEEEIRTTNPVATEQFGGVSENLQRGNR

SEQ ID NO: 18201 - protein, 28 aa, Artificial Sequence
  Description of Artificial Sequence: Synthetic peptide
DEEEIRSTNPVATEVYGSVSTELNRGNR

SEQ ID NO: 18202 - protein, 28 aa, Artificial Sequence
  Description of Artificial Sequence: Synthetic peptide
DEEEIRTTNPVATEQYGSVSTAEERGNY

SEQ ID NO: 18203 - protein, 28 aa, Artificial Sequence
  Description of Artificial Sequence: Synthetic peptide
DEEEIRTTNIVATEMYGSVSTALQRGND

SEQ ID NO: 18204 - protein, 28 aa, Artificial Sequence
  Description of Artificial Sequence: Synthetic peptide
DEEEIATTNPVATEQYGSVDENLQRENR

SEQ ID NO: 18205 - protein, 29 aa, Artificial Sequence
  Description of Artificial Sequence: Synthetic peptide
DEEEIRTTNPTATEQFGSVSTINLQVGNR

SEQ ID NO: 18206 - protein, 29 aa, Artificial Sequence
  Description of Artificial Sequence: Synthetic peptide
DEEEIRTTNPVATEQYGSVSTVNDQSGNF

SEQ ID NO: 18207 - protein, 29 aa, Artificial Sequence
  Description of Artificial Sequence: Synthetic peptide
DELEIRTTNPVATEQYGSVSTKNLQLENR

SEQ ID NO: 18208 - protein, 28 aa, Artificial Sequence
  Description of Artificial Sequence: Synthetic peptide
DEEEIRTTNPDATEQYGSVSTNLEDGNS

SEQ ID NO: 18209 - protein, 28 aa, Artificial Sequence
  Description of Artificial Sequence: Synthetic peptide
DEEEIRATNPVATEQFGSVSENEQRGNR

SEQ ID NO: 18210 - protein, 30 aa, Artificial Sequence
  Description of Artificial Sequence: Synthetic polypeptide
DEEEIRTTNPVATEMFGSVSTMNLQERGNR

SEQ ID NO: 18211 - protein, 30 aa, Artificial Sequence
  Description of Artificial Sequence: Synthetic polypeptide
DEEEIRTTNPVATEQYGSVSTDLQDHGNDR

SEQ ID NO: 18212 - protein, 28 aa, Artificial Sequence
  Description of Artificial Sequence: Synthetic peptide
DEEEIRTTNPVATEQYGSVSTCGDGGNR

SEQ ID NO: 18213 - protein, 29 aa, Artificial Sequence
  Description of Artificial Sequence: Synthetic peptide
DEEEIRTTNPVATECYGSVSTNLQMVGDR

SEQ ID NO: 18214 - protein, 28 aa, Artificial Sequence
  Description of Artificial Sequence: Synthetic peptide
DEIEIRTTNIVATEQYGSVSTNLQRMNE

SEQ ID NO: 18215 - protein, 28 aa, Artificial Sequence
  Description of Artificial Sequence: Synthetic peptide
DEGEIRTTNIVATECWGSVSTNLQRGNR

SEQ ID NO: 18216 - protein, 28 aa, Artificial Sequence
  Description of Artificial Sequence: Synthetic peptide
DEEEIRTVNPVATEIYGTVSTNLQVGNR

SEQ ID NO: 18217 - protein, 30 aa, Artificial Sequence
  Description of Artificial Sequence: Synthetic polypeptide
DEEEIRTTNPVATEQYGSVSTNLQEAGNDN

SEQ ID NO: 18218 - protein, 28 aa, Artificial Sequence
  Description of Artificial Sequence: Synthetic peptide
DEEEIRTTNIVSTEQYGSVSDNLQHGNR

SEQ ID NO: 18219 - protein, 28 aa, Artificial Sequence
  Description of Artificial Sequence: Synthetic peptide
DEEEIRTTNPVATEHYGTVSTALQRGNF

SEQ ID NO: 18220 - protein, 28 aa, Artificial Sequence
  Description of Artificial Sequence: Synthetic peptide
DEEEIRTTNPVATEMFGSVSTNEQQGNR

SEQ ID NO: 18221 - protein, 31 aa, Artificial Sequence
  Description of Artificial Sequence: Synthetic polypeptide
DEEEIRTTNPVATEQYGSVSDTNLQLPNGNR

SEQ ID NO: 18222 - protein, 30 aa, Artificial Sequence
  Description of Artificial Sequence: Synthetic polypeptide
DEEEIRTTNPVSTEQYGSASATNLQRAGNR

SEQ ID NO: 18223 - protein, 28 aa, Artificial Sequence
  Description of Artificial Sequence: Synthetic peptide
DEEEIRATNPVATEQYGSVSTNLEYGNI

SEQ ID NO: 18224 - protein, 28 aa, Artificial Sequence
  Description of Artificial Sequence: Synthetic peptide
DEEEIRTTNPVATEQYGSVSTNDDRGEE

SEQ ID NO: 18225 - protein, 31 aa, Artificial Sequence
  Description of Artificial Sequence: Synthetic polypeptide
DEEEIRTTNPVATEQYGSVSTTTNLERGNDR

SEQ ID NO: 18226 - protein, 29 aa, Artificial Sequence
  Description of Artificial Sequence: Synthetic peptide
DEEEIATTNPVATEQYGSVDENLQQRGNR

SEQ ID NO: 18227 - protein, 29 aa, Artificial Sequence
  Description of Artificial Sequence: Synthetic peptide
DEEEIRTTNPVATETYGSVSTTLQRAGDR

SEQ ID NO: 18228 - protein, 28 aa, Artificial Sequence
  Description of Artificial Sequence: Synthetic peptide
DEEEISTTNPVATEVYGSVSENLQTGNR

SEQ ID NO: 18229 - protein, 28 aa, Artificial Sequence
  Description of Artificial Sequence: Synthetic peptide
DEEEIRSTNPVATENYGVVATNLQRGNR

SEQ ID NO: 18230 - protein, 29 aa, Artificial Sequence
  Description of Artificial Sequence: Synthetic peptide
DEEEIRTTNPVATETYGGVSTNPQRGNTR

SEQ ID NO: 18231 - protein, 28 aa, Artificial Sequence
  Description of Artificial Sequence: Synthetic peptide
DEEEIRTTNPVGCEQYGSVSENCQRGNR

SEQ ID NO: 18232 - protein, 29 aa, Artificial Sequence
  Description of Artificial Sequence: Synthetic peptide
DEEEIRTTNPVSTEQYGSVSTNLERGNET

SEQ ID NO: 18233 - protein, 28 aa, Artificial Sequence
  Description of Artificial Sequence: Synthetic peptide
DEAEIRCTNPVATEVYGSVSTELQRGNR

SEQ ID NO: 18234 - protein, 28 aa, Artificial Sequence
  Description of Artificial Sequence: Synthetic peptide
DEEEIRTTNPVATEWYGSVDTNEQLGNR

SEQ ID NO: 18235 - protein, 29 aa, Artificial Sequence
  Description of Artificial Sequence: Synthetic peptide
DEEEIRTTNPEATEQYGSVSTDLQHKGNR

SEQ ID NO: 18236 - protein, 29 aa, Artificial Sequence
  Description of Artificial Sequence: Synthetic peptide
DEEEIATTNPVATEQYGSVSTNLEREGER

SEQ ID NO: 18237 - protein, 28 aa, Artificial Sequence
  Description of Artificial Sequence: Synthetic peptide
DEEEIRTTNPVATEQYGSVSTEDEEGNR

SEQ ID NO: 18238 - protein, 28 aa, Artificial Sequence
  Description of Artificial Sequence: Synthetic peptide
DEEEIRTTNPVATEQYGSASTNQQDGND

SEQ ID NO: 18239 - protein, 30 aa, Artificial Sequence
  Description of Artificial Sequence: Synthetic polypeptide
DEEVIRTTNPVATEQYGSWSTNLQLRGENR

SEQ ID NO: 18240 - protein, 28 aa, Artificial Sequence
  Description of Artificial Sequence: Synthetic peptide
DENEIRTTNPVATEQYGEVSTLLQRGTR

SEQ ID NO: 18241 - protein, 29 aa, Artificial Sequence
  Description of Artificial Sequence: Synthetic peptide
DEQEIRTTNPVATEQWGSVSENLQMRGNR

SEQ ID NO: 18242 - protein, 31 aa, Artificial Sequence
  Description of Artificial Sequence: Synthetic polypeptide
DEEEIRTTNPVATEQYGYVDSTGNLPQRGNR

SEQ ID NO: 18243 - protein, 28 aa, Artificial Sequence
  Description of Artificial Sequence: Synthetic peptide
DEEEIRTTNPCATEQYGSADTNLQRGNA

SEQ ID NO: 18244 - protein, 29 aa, Artificial Sequence
  Description of Artificial Sequence: Synthetic peptide
DEEEIRATNPVATEQYGSASENLQRAGNR

SEQ ID NO: 18245 - protein, 28 aa, Artificial Sequence
  Description of Artificial Sequence: Synthetic peptide
HEEEIATTNPVATEQYGSASTNIQRGNR

SEQ ID NO: 18246 - protein, 29 aa, Artificial Sequence
  Description of Artificial Sequence: Synthetic peptide
DEEEICATNPVATEQYGSASATNLQRGNR

SEQ ID NO: 18247 - protein, 28 aa, Artificial Sequence
  Description of Artificial Sequence: Synthetic peptide
AEEEIRTTNIVATEQYGSVSTNEQRGNM

SEQ ID NO: 18248 - protein, 28 aa, Artificial Sequence
  Description of Artificial Sequence: Synthetic peptide
DEEEIRTTNPVATEQYGEVSTVLQRLGR

SEQ ID NO: 18249 - protein, 32 aa, Artificial Sequence
  Description of Artificial Sequence: Synthetic polypeptide
DEEEIRTTNPVATEQYGSVSETNLQDRGENER

SEQ ID NO: 18250 - protein, 28 aa, Artificial Sequence
  Description of Artificial Sequence: Synthetic peptide
NEEEIRTTNPVATEPYGCVSTNLQAGNR

SEQ ID NO: 18251 - protein, 29 aa, Artificial Sequence
  Description of Artificial Sequence: Synthetic peptide
DEEEIRTTNPVATEQYGSVDTNLMLRGNW

SEQ ID NO: 18252 - protein, 28 aa, Artificial Sequence
  Description of Artificial Sequence: Synthetic peptide
DEEEIATTNPVATEQYGSVSTDPDRGNR

SEQ ID NO: 18253 - protein, 28 aa, Artificial Sequence
  Description of Artificial Sequence: Synthetic peptide
DEEEIRCTNPVATEQYGEVATNLQRGNH

SEQ ID NO: 18254 - protein, 28 aa, Artificial Sequence
  Description of Artificial Sequence: Synthetic peptide
DEEEIRTTNPVATEQYGSWSTALQFGDR

SEQ ID NO: 18255 - protein, 30 aa, Artificial Sequence
  Description of Artificial Sequence: Synthetic polypeptide
DEEEIRTTNPVATEQYGDVSCTMDLQRGNR

SEQ ID NO: 18256 - protein, 29 aa, Artificial Sequence
  Description of Artificial Sequence: Synthetic peptide
DEEDIRTTNPVATEQYGSVSTNGLQNGNS

SEQ ID NO: 18257 - protein, 29 aa, Artificial Sequence
  Description of Artificial Sequence: Synthetic peptide
DEEEIRTTNPVATEQYGSVSTNLQEGEEN

SEQ ID NO: 18258 - protein, 28 aa, Artificial Sequence
  Description of Artificial Sequence: Synthetic peptide
DEVEIRTTNPVATEQYGEVSTNEQQGNR

SEQ ID NO: 18259 - protein, 28 aa, Artificial Sequence
  Description of Artificial Sequence: Synthetic peptide
DEEEIRATNPVATEQFGSVSTNLQNGNF

SEQ ID NO: 18260 - protein, 30 aa, Artificial Sequence
  Description of Artificial Sequence: Synthetic polypeptide
DENEIRTTNPVATEQYGSVSCTNLDRGYNR

SEQ ID NO: 18261 - protein, 29 aa, Artificial Sequence
  Description of Artificial Sequence: Synthetic peptide
DEEEIATTNPTATEQYGSVSTNLQRGTTR

SEQ ID NO: 18262 - protein, 29 aa, Artificial Sequence
  Description of Artificial Sequence: Synthetic peptide
DEEEIRTTNPVATEQYGSVSCTDLCAGNR

SEQ ID NO: 18263 - protein, 28 aa, Artificial Sequence
  Description of Artificial Sequence: Synthetic peptide
DEEEIRTTNPVATEQYGDVSDVLQRGGR

SEQ ID NO: 18264 - protein, 29 aa, Artificial Sequence
  Description of Artificial Sequence: Synthetic peptide
DEEEICTTNPVATECYGSVSTNLQTNGNR

SEQ ID NO: 18265 - protein, 28 aa, Artificial Sequence
  Description of Artificial Sequence: Synthetic peptide
SEEEIRTTNIVATEQYGSVSENLQVGNR

SEQ ID NO: 18266 - protein, 28 aa, Artificial Sequence
  Description of Artificial Sequence: Synthetic peptide
DEEEIRTTNPVATEQYGSVSTELEEGNP

SEQ ID NO: 18267 - protein, 28 aa, Artificial Sequence
  Description of Artificial Sequence: Synthetic peptide
DEEEIRTTNPQAYEQYGSMSTNLQGGNR

SEQ ID NO: 18268 - protein, 28 aa, Artificial Sequence
  Description of Artificial Sequence: Synthetic peptide
DEEEIRTTNPVATEQYGSVSTPDEEGNR

SEQ ID NO: 18269 - protein, 31 aa, Artificial Sequence
  Description of Artificial Sequence: Synthetic polypeptide
DEEEIRTTNPVATEQYGSVDECTNLQRNGNR

SEQ ID NO: 18270 - protein, 29 aa, Artificial Sequence
  Description of Artificial Sequence: Synthetic peptide
DEEEIRTTNPVATEQYGTVSENLQDRGNA

SEQ ID NO: 18271 - protein, 29 aa, Artificial Sequence
  Description of Artificial Sequence: Synthetic peptide
DEEEIRTTNPVATEQYGIVSENLQWRGTR

SEQ ID NO: 18272 - protein, 31 aa, Artificial Sequence
  Description of Artificial Sequence: Synthetic polypeptide
DEEEIRTTNPVATEQYGSVSETNLQDEGENR

SEQ ID NO: 18273 - protein, 28 aa, Artificial Sequence
  Description of Artificial Sequence: Synthetic peptide
DEEEIVTTNIVATEQYGSVSDNLQQGNR

SEQ ID NO: 18274 - protein, 30 aa, Artificial Sequence
  Description of Artificial Sequence: Synthetic polypeptide
DEEEIRTTNPVATEQYGSVSTNLQREGEDD

SEQ ID NO: 18275 - protein, 29 aa, Artificial Sequence
  Description of Artificial Sequence: Synthetic peptide
NEEEIVTVNPVATEQYGSVSTNLQRGNER

SEQ ID NO: 18276 - protein, 28 aa, Artificial Sequence
  Description of Artificial Sequence: Synthetic peptide
DEEEIRTTNPVATEQYGSVETEEQRGER

SEQ ID NO: 18277 - protein, 30 aa, Artificial Sequence
  Description of Artificial Sequence: Synthetic polypeptide
DEEEIRTTNPVATEQYGSVSTINLQEIGDR

SEQ ID NO: 18278 - protein, 29 aa, Artificial Sequence
  Description of Artificial Sequence: Synthetic peptide
DENEVRTVNPVATEQYGSVSTGNLQRGNR

SEQ ID NO: 18279 - protein, 28 aa, Artificial Sequence
  Description of Artificial Sequence: Synthetic peptide
DEEEIRTTNPVATEQYGSVSTDLEDGNV

SEQ ID NO: 18280 - protein, 30 aa, Artificial Sequence
  Description of Artificial Sequence: Synthetic polypeptide
DEEEIRTTNPVATEQYGSVDSETNLEPGNR

SEQ ID NO: 18281 - protein, 28 aa, Artificial Sequence
  Description of Artificial Sequence: Synthetic peptide
DEEEITTTNIVATEQFGSVSTNLQHGNR

SEQ ID NO: 18282 - protein, 28 aa, Artificial Sequence
  Description of Artificial Sequence: Synthetic peptide
DEEEIRTTNPVATEQYGSVSTELQTGDI

SEQ ID NO: 18283 - protein, 28 aa, Artificial Sequence
  Description of Artificial Sequence: Synthetic peptide
DEEEIRTTNPTATETYGSVSTNLQQGNH

SEQ ID NO: 18284 - protein, 28 aa, Artificial Sequence
  Description of Artificial Sequence: Synthetic peptide
DEGEIRTTNPAATEQYGDVSTNLQRGTR

SEQ ID NO: 18285 - protein, 28 aa, Artificial Sequence
  Description of Artificial Sequence: Synthetic peptide
DEEEIRTTNPVATEQYGDVSENLQHGQR

SEQ ID NO: 18286 - protein, 28 aa, Artificial Sequence
  Description of Artificial Sequence: Synthetic peptide
HEEEIRTTNPDATEQYGSVSTNPQRGNT

SEQ ID NO: 18287 - protein, 28 aa, Artificial Sequence
  Description of Artificial Sequence: Synthetic peptide
DEEEIRTTNPVATEQYGSVDTNEQWLNR

SEQ ID NO: 18288 - protein, 28 aa, Artificial Sequence
  Description of Artificial Sequence: Synthetic peptide
SEEEICATNPVATEQYGSVSTNLQRGTR

SEQ ID NO: 18289 - protein, 28 aa, Artificial Sequence
  Description of Artificial Sequence: Synthetic peptide
DEEEIATTNPVATEQYGVVSTNLQLGNQ

SEQ ID NO: 18290 - protein, 30 aa, Artificial Sequence
  Description of Artificial Sequence: Synthetic polypeptide
DEEEIRTTNPVATQQYGSVSTNMLQEGDNR

SEQ ID NO: 18291 - protein, 28 aa, Artificial Sequence
  Description of Artificial Sequence: Synthetic peptide
DEEEIRTTNPVATEQYGSVDTNDQSGNA

SEQ ID NO: 18292 - protein, 29 aa, Artificial Sequence
  Description of Artificial Sequence: Synthetic peptide
SEEEIRTTNPVATEQYGSVSTMNLQIGTR

SEQ ID NO: 18293 - protein, 31 aa, Artificial Sequence
  Description of Artificial Sequence: Synthetic polypeptide
DEEEIRTTNPVATEQYGSVDSTNLDVREGNR

SEQ ID NO: 18294 - protein, 28 aa, Artificial Sequence
  Description of Artificial Sequence: Synthetic peptide
DEEEIRATNPVATEQYGVVSTNLQRGMT

SEQ ID NO: 18295 - protein, 28 aa, Artificial Sequence
  Description of Artificial Sequence: Synthetic peptide
DEVEICTTNPVSTEQYGSVSTNLQSGNR

SEQ ID NO: 18296 - protein, 28 aa, Artificial Sequence
  Description of Artificial Sequence: Synthetic peptide
DENEIATTNPVATELYGWVSTNLQRGNR

SEQ ID NO: 18297 - protein, 28 aa, Artificial Sequence
  Description of Artificial Sequence: Synthetic peptide
DEEEISTTNIVATEQYGGVSTELQRGNR

SEQ ID NO: 18298 - protein, 29 aa, Artificial Sequence
  Description of Artificial Sequence: Synthetic peptide
DEEEIVTTNPVATEQYGWVSENLQRAGNR

SEQ ID NO: 18299 - protein, 29 aa, Artificial Sequence
  Description of Artificial Sequence: Synthetic peptide
DEEPIATTNPVATEQYGSVSTELQRGLNR

SEQ ID NO: 18300 - protein, 30 aa, Artificial Sequence
  Description of Artificial Sequence: Synthetic polypeptide
DEEEIRTTNPVATEQYGSVSTNLQDVKGER

SEQ ID NO: 18301 - protein, 28 aa, Artificial Sequence
  Description of Artificial Sequence: Synthetic peptide
DEEEIRTTNPVATEQYGSVSTELQLGEG

SEQ ID NO: 18302 - protein, 28 aa, Artificial Sequence
  Description of Artificial Sequence: Synthetic peptide
DEEEIRTTNPEATEQYGSVSTDEQFGNR

SEQ ID NO: 18303 - protein, 28 aa, Artificial Sequence
  Description of Artificial Sequence: Synthetic peptide
DEEEIRTTNIVATEQYGGASTNLQRGNF

SEQ ID NO: 18304 - protein, 31 aa, Artificial Sequence
  Description of Artificial Sequence: Synthetic polypeptide
DEEEIRTTNPVATEQYGSVEETNLQREGENR

SEQ ID NO: 18305 - protein, 29 aa, Artificial Sequence
  Description of Artificial Sequence: Synthetic peptide
DEEEIWCTNPVATEQYGSVSTNLQKIGNR

SEQ ID NO: 18306 - protein, 28 aa, Artificial Sequence
  Description of Artificial Sequence: Synthetic peptide
DEEEIRTTNPEATEQYGSVSTNDQVGER

SEQ ID NO: 18307 - protein, 28 aa, Artificial Sequence
  Description of Artificial Sequence: Synthetic peptide
DEEEIRTTNPVATEQYGSVSEDLQHGNI

SEQ ID NO: 18308 - protein, 31 aa, Artificial Sequence
  Description of Artificial Sequence: Synthetic polypeptide
DEEEIRTTNPVATELYGSVSTANLQEREGNR

SEQ ID NO: 18309 - protein, 29 aa, Artificial Sequence
  Description of Artificial Sequence: Synthetic peptide
DEEEIRTTNPVATEQYGDVSTCLQRAGER

SEQ ID NO: 18310 - protein, 28 aa, Artificial Sequence
  Description of Artificial Sequence: Synthetic peptide
DEEEIRTTNCVATEQYGSISTNLQRGPL

SEQ ID NO: 18311 - protein, 28 aa, Artificial Sequence
  Description of Artificial Sequence: Synthetic peptide
GEEEIVTTNPVATEQYGSVSTNLQRNNH

SEQ ID NO: 18312 - protein, 28 aa, Artificial Sequence
  Description of Artificial Sequence: Synthetic peptide
DEEEIRTTNPTATEQYGSVSTNEQLGNV

SEQ ID NO: 18313 - protein, 28 aa, Artificial Sequence
  Description of Artificial Sequence: Synthetic peptide
DEEEIRTTNPAATEQYGSVSTNPQIGNF

SEQ ID NO: 18314 - protein, 28 aa, Artificial Sequence
  Description of Artificial Sequence: Synthetic peptide
DEGEIRTTNPVATEQYGTVSDNLQRGNA

SEQ ID NO: 18315 - protein, 29 aa, Artificial Sequence
  Description of Artificial Sequence: Synthetic peptide
DEVEIRTTNPVATEQYGSVSATALQRGNF

SEQ ID NO: 18316 - protein, 28 aa, Artificial Sequence
  Description of Artificial Sequence: Synthetic peptide
DEEEIRTTNPVATEQYGSVETNLQIGDM

SEQ ID NO: 18317 - protein, 28 aa, Artificial Sequence
  Description of Artificial Sequence: Synthetic peptide
DEEMIRTTNPVCTEQYGSVSTNDQRGND

SEQ ID NO: 18318 - protein, 29 aa, Artificial Sequence
  Description of Artificial Sequence: Synthetic peptide
DEEEIRTTNPVATEQYGVVSATDLQRGNP

SEQ ID NO: 18319 - protein, 28 aa, Artificial Sequence
  Description of Artificial Sequence: Synthetic peptide
SEEEIRTTNPVATEQYGSVSTNLQVGTN

SEQ ID NO: 18320 - protein, 28 aa, Artificial Sequence
  Description of Artificial Sequence: Synthetic peptide
DEMEIRTTNIVATEQYGSVSEDLQRGNR

SEQ ID NO: 18321 - protein, 28 aa, Artificial Sequence
  Description of Artificial Sequence: Synthetic peptide
DEEEIRCTNIVATEQYGSVSTNLQVGTR

SEQ ID NO: 18322 - protein, 28 aa, Artificial Sequence
  Description of Artificial Sequence: Synthetic peptide
DEEEIRTTNPVATEQYGSVSTELEDGNW

SEQ ID NO: 18323 - protein, 28 aa, Artificial Sequence
  Description of Artificial Sequence: Synthetic peptide
QEQEIRTTNPVATEQYGSVSENLQRGMR

SEQ ID NO: 18324 - protein, 28 aa, Artificial Sequence
  Description of Artificial Sequence: Synthetic peptide
KEEEIRTTNPVATEVYGSVSTNLQNGNT

SEQ ID NO: 18325 - protein, 29 aa, Artificial Sequence
  Description of Artificial Sequence: Synthetic peptide
DEEEIRTTNPVATEQYGSVSTNHVQWGPR

SEQ ID NO: 18326 - protein, 28 aa, Artificial Sequence
  Description of Artificial Sequence: Synthetic peptide
KEEEIRTVNPVATEQYGSVSTNLQRGED

SEQ ID NO: 18327 - protein, 30 aa, Artificial Sequence
  Description of Artificial Sequence: Synthetic polypeptide
DEEEIRTTNPVATEQYGSVETNLCREGNCR

SEQ ID NO: 18328 - protein, 28 aa, Artificial Sequence
  Description of Artificial Sequence: Synthetic peptide
DEHEIRTTNPVATENYGTVSTNLQRGNS

SEQ ID NO: 18329 - protein, 28 aa, Artificial Sequence
  Description of Artificial Sequence: Synthetic peptide
DEGEIETTNPVATEQYGSVSTNLQRGMM

SEQ ID NO: 18330 - protein, 29 aa, Artificial Sequence
  Description of Artificial Sequence: Synthetic peptide
KEEEIRATNPVATEQYGSVSTNLQERGNW

SEQ ID NO: 18331 - protein, 30 aa, Artificial Sequence
  Description of Artificial Sequence: Synthetic polypeptide
DEEEIRTTNPVATEQYGSVDSENLQEGNER

SEQ ID NO: 18332 - protein, 28 aa, Artificial Sequence
  Description of Artificial Sequence: Synthetic peptide
SEEEIRTTNIVATEQFGSVSTNLQIGNR

SEQ ID NO: 18333 - protein, 28 aa, Artificial Sequence
  Description of Artificial Sequence: Synthetic peptide
DENEIMTTNIVATECYGSVSTNLQRGNR

SEQ ID NO: 18334 - protein, 28 aa, Artificial Sequence
  Description of Artificial Sequence: Synthetic peptide
DENEIRTTNPVATEQYGSVSDNLQIGTR

SEQ ID NO: 18335 - protein, 30 aa, Artificial Sequence
  Description of Artificial Sequence: Synthetic polypeptide
DEEEIATTNPVATEQYGGVSTNLQSRGANR

SEQ ID NO: 18336 - protein, 29 aa, Artificial Sequence
  Description of Artificial Sequence: Synthetic peptide
DEEEIRTTNPVATEQYGSVSTTLQMEGNS

SEQ ID NO: 18337 - protein, 29 aa, Artificial Sequence
  Description of Artificial Sequence: Synthetic peptide
DEEEIRTTNPVATECYGSVSTNLQRKGEV

SEQ ID NO: 18338 - protein, 28 aa, Artificial Sequence
  Description of Artificial Sequence: Synthetic peptide
DEEEIRCTNPVATEQYGSVSTNLDVGNQ

SEQ ID NO: 18339 - protein, 31 aa, Artificial Sequence
  Description of Artificial Sequence: Synthetic polypeptide
DEECIRTTNPVATEQYGSVHSTNLQIRGNPR

SEQ ID NO: 18340 - protein, 28 aa, Artificial Sequence
  Description of Artificial Sequence: Synthetic peptide
DEEEISTTNPVATEQYGDVSTNLMRGNQ

SEQ ID NO: 18341 - protein, 28 aa, Artificial Sequence
  Description of Artificial Sequence: Synthetic peptide
KEEEIRSTNPVATEQYGSVSTDLQRQNR

SEQ ID NO: 18342 - protein, 29 aa, Artificial Sequence
  Description of Artificial Sequence: Synthetic peptide
DEEEIRTTNPVATEQYGSVSTPLQVDGER

SEQ ID NO: 18343 - protein, 28 aa, Artificial Sequence
  Description of Artificial Sequence: Synthetic peptide
DEEEICTTNIVATECYGSVSTELQRGNR

SEQ ID NO: 18344 - protein, 28 aa, Artificial Sequence
  Description of Artificial Sequence: Synthetic peptide
DEEEIAQTNIVATEQYGSVSTNLQRGNL

SEQ ID NO: 18345 - protein, 30 aa, Artificial Sequence
  Description of Artificial Sequence: Synthetic polypeptide
DEEEIRTTNPVATEQYGSVSTNGLQPGDLR

SEQ ID NO: 18346 - protein, 28 aa, Artificial Sequence
  Description of Artificial Sequence: Synthetic peptide
DEQEIRTTNPVATEQYGSVETNLQHGER

SEQ ID NO: 18347 - protein, 28 aa, Artificial Sequence
  Description of Artificial Sequence: Synthetic peptide
NEEEIMTTNPVATEQWGSASTNLQRGNR

SEQ ID NO: 18348 - protein, 30 aa, Artificial Sequence
  Description of Artificial Sequence: Synthetic polypeptide
DEEEIRTTNPVATEQYGSVSTEDLQQGMNR

SEQ ID NO: 18349 - protein, 30 aa, Artificial Sequence
  Description of Artificial Sequence: Synthetic polypeptide
DEEEIATTNPVATEQYGSVSATNLQHEGNR

SEQ ID NO: 18350 - protein, 28 aa, Artificial Sequence
  Description of Artificial Sequence: Synthetic peptide
GEAEIRTTNPVATEQYGIVSTNLQRMNR

SEQ ID NO: 18351 - protein, 30 aa, Artificial Sequence
  Description of Artificial Sequence: Synthetic polypeptide
DEEEIRTTNPTATEQYGSVSTNEQDRGDNR

SEQ ID NO: 18352 - protein, 28 aa, Artificial Sequence
  Description of Artificial Sequence: Synthetic peptide
DEEVIRTTNPVATEQYGSVSTDLDRGNN

SEQ ID NO: 18353 - protein, 28 aa, Artificial Sequence
  Description of Artificial Sequence: Synthetic peptide
KEEEIRTTNPVATECYGSVSTNLQQGNY

SEQ ID NO: 18354 - protein, 28 aa, Artificial Sequence
  Description of Artificial Sequence: Synthetic peptide
DEPEIRTTNPVATEQYGAVSTNLQVGNT

SEQ ID NO: 18355 - protein, 28 aa, Artificial Sequence
  Description of Artificial Sequence: Synthetic peptide
DEEEIRTTNPVATEIYGSVSTNLQDGET

SEQ ID NO: 18356 - protein, 28 aa, Artificial Sequence
  Description of Artificial Sequence: Synthetic peptide
DEEEIRTTNPVATEMYGSVATQLQRPNR

SEQ ID NO: 18357 - protein, 28 aa, Artificial Sequence
  Description of Artificial Sequence: Synthetic peptide
DEVEIATTNPVATEQYGSVSTNLQHFNR

SEQ ID NO: 18358 - protein, 29 aa, Artificial Sequence
  Description of Artificial Sequence: Synthetic peptide
DEEEIRATNPVATEQYGTVSTNLQLGNTR

SEQ ID NO: 18359 - protein, 31 aa, Artificial Sequence
  Description of Artificial Sequence: Synthetic polypeptide
DEEEIRTTNPVATEQYGSVSTNLQREGENDD

SEQ ID NO: 18360 - protein, 28 aa, Artificial Sequence
  Description of Artificial Sequence: Synthetic peptide
DEEEIRTVNPVATEQYGTVSTNLQSGNT

SEQ ID NO: 18361 - protein, 30 aa, Artificial Sequence
  Description of Artificial Sequence: Synthetic polypeptide
DEEEIATTNPVATEQYGSVSDTENLQTGNR

SEQ ID NO: 18362 - protein, 28 aa, Artificial Sequence
  Description of Artificial Sequence: Synthetic peptide
DEEEIATTNPVATEHYGGVATNLQRGNR

SEQ ID NO: 18363 - protein, 28 aa, Artificial Sequence
  Description of Artificial Sequence: Synthetic peptide
MEEEIRTTNPVATEQYGSVSTDLQHGNV

SEQ ID NO: 18364 - protein, 29 aa, Artificial Sequence
  Description of Artificial Sequence: Synthetic peptide
DEEEIRTTNPVATEQYGSVSTNGQEIGNQ

SEQ ID NO: 18365 - protein, 28 aa, Artificial Sequence
  Description of Artificial Sequence: Synthetic peptide
DEEEIRTTNPVATECYGSVSTDLQDGNM

SEQ ID NO: 18366 - protein, 28 aa, Artificial Sequence
  Description of Artificial Sequence: Synthetic peptide
DEEEIVTTNPVATEQFGSVSTNLQHNNR

SEQ ID NO: 18367 - protein, 28 aa, Artificial Sequence
  Description of Artificial Sequence: Synthetic peptide
DEQEIRSTNIVATEQYGSVSENLQRGNR

SEQ ID NO: 18368 - protein, 28 aa, Artificial Sequence
  Description of Artificial Sequence: Synthetic peptide
DEEEIVTTNIVSTEQYGSVSTNLQQGNR

SEQ ID NO: 18369 - protein, 30 aa, Artificial Sequence
  Description of Artificial Sequence: Synthetic polypeptide
DEEEIRTTNPVATEMYGSVSTGNLQRGPTR

SEQ ID NO: 18370 - protein, 31 aa, Artificial Sequence
  Description of Artificial Sequence: Synthetic polypeptide
DEEEIRTTNPVATEQYGSVSVTNGLERGINR

SEQ ID NO: 18371 - protein, 29 aa, Artificial Sequence
  Description of Artificial Sequence: Synthetic peptide
DEEEIATTNPVATEQYGSVSTNLQNGQQR

SEQ ID NO: 18372 - protein, 28 aa, Artificial Sequence
  Description of Artificial Sequence: Synthetic peptide
DEEEIRTTNPVATEQYGDVSTQLQRNNE

SEQ ID NO: 18373 - protein, 28 aa, Artificial Sequence
  Description of Artificial Sequence: Synthetic peptide
DEEEIRTTNPVATEQYGSVSTEDQDGNA

SEQ ID NO: 18374 - protein, 28 aa, Artificial Sequence
  Description of Artificial Sequence: Synthetic peptide
DEEEIRCTNIVATEIYGSVSTNDQRGNR

SEQ ID NO: 18375 - protein, 28 aa, Artificial Sequence
  Description of Artificial Sequence: Synthetic peptide
DEQEIRTTNPVSTEQWGSVSTNLQRGNA

SEQ ID NO: 18376 - protein, 29 aa, Artificial Sequence
  Description of Artificial Sequence: Synthetic peptide
DEEEIRATNPVATEQYGSVSTNLQLEGNL

SEQ ID NO: 18377 - protein, 30 aa, Artificial Sequence
  Description of Artificial Sequence: Synthetic polypeptide
DEEEIRTTNPVATEQYGDVSTPLQERHGNR

SEQ ID NO: 18378 - protein, 28 aa, Artificial Sequence
  Description of Artificial Sequence: Synthetic peptide
DEEEVRTTNPVATEIYGCVSTNLERGNR

SEQ ID NO: 18379 - protein, 30 aa, Artificial Sequence
  Description of Artificial Sequence: Synthetic polypeptide
DEEEIRTTNPVATEQYGSVSTGNPLIIGNR

SEQ ID NO: 18380 - protein, 28 aa, Artificial Sequence
  Description of Artificial Sequence: Synthetic peptide
SEVEIRTTNPVATEQYGEVSTNPQRGNR

SEQ ID NO: 18381 - protein, 30 aa, Artificial Sequence
  Description of Artificial Sequence: Synthetic polypeptide
DEEEIRTTNPVATEQYGSVSEMNEQDRGNR

SEQ ID NO: 18382 - protein, 28 aa, Artificial Sequence
  Description of Artificial Sequence: Synthetic peptide
DEEEIRCTNPVATEVYGWVPTNLQRGNR

SEQ ID NO: 18383 - protein, 28 aa, Artificial Sequence
  Description of Artificial Sequence: Synthetic peptide
DENEIKTTNIVATEQYGSVSTNLQVGNR

SEQ ID NO: 18384 - protein, 30 aa, Artificial Sequence
  Description of Artificial Sequence: Synthetic polypeptide
DEEEIRTTNPVATEQYGSVSTNLVQVDGNS

SEQ ID NO: 18385 - protein, 28 aa, Artificial Sequence
  Description of Artificial Sequence: Synthetic peptide
DEAEIRTTNPVATEMYGSTPTNLQRGNR

SEQ ID NO: 18386 - protein, 28 aa, Artificial Sequence
  Description of Artificial Sequence: Synthetic peptide
DEQEIRTTNPVATEQWGDVGTNLQRGNR

SEQ ID NO: 18387 - protein, 28 aa, Artificial Sequence
  Description of Artificial Sequence: Synthetic peptide
DEQEIRTTNPVATEQYGSVSENEQRGNW

SEQ ID NO: 18388 - protein, 28 aa, Artificial Sequence
  Description of Artificial Sequence: Synthetic peptide
DEEEIRATNPVSTEQYGSVSENIQRGNR

SEQ ID NO: 18389 - protein, 30 aa, Artificial Sequence
  Description of Artificial Sequence: Synthetic polypeptide
DEEEIRTTNPVATEQYGSVSCTMNLQHGND

SEQ ID NO: 18390 - protein, 28 aa, Artificial Sequence
  Description of Artificial Sequence: Synthetic peptide
DEEEIAATNPVATEHYGWVSTNLQRGNR

SEQ ID NO: 18391 - protein, 28 aa, Artificial Sequence
  Description of Artificial Sequence: Synthetic peptide
DEEEIRCTNPVATEQYGSVSENLMRGTR

SEQ ID NO: 18392 - protein, 28 aa, Artificial Sequence
  Description of Artificial Sequence: Synthetic peptide
DENEIRTTNPVATEVYGSVSTNLQNGNQ

SEQ ID NO: 18393 - protein, 28 aa, Artificial Sequence
  Description of Artificial Sequence: Synthetic peptide
DENEIATTNPVCTEQYGSVSTNLQRGNQ

SEQ ID NO: 18394 - protein, 28 aa, Artificial Sequence
  Description of Artificial Sequence: Synthetic peptide
DEEEIRTVNPVATEQYGSASTNLMRGER

SEQ ID NO: 18395 - protein, 28 aa, Artificial Sequence
  Description of Artificial Sequence: Synthetic peptide
DEEEIRSTNPVATEQYGSVSESLQNGNR

SEQ ID NO: 18396 - protein, 28 aa, Artificial Sequence
  Description of Artificial Sequence: Synthetic peptide
DENEIMTTNPVATEQYGSTSDNLQRGNR

SEQ ID NO: 18397 - protein, 31 aa, Artificial Sequence
  Description of Artificial Sequence: Synthetic polypeptide
DEEEIRTTNPVATEQYGSVSTNLQDIDGENR

SEQ ID NO: 18398 - protein, 28 aa, Artificial Sequence
  Description of Artificial Sequence: Synthetic peptide
DEEEIRTTNIVATECYGSVSENLQWGNR

SEQ ID NO: 18399 - protein, 28 aa, Artificial Sequence
  Description of Artificial Sequence: Synthetic peptide
DEEEIRTTNPVATEQYGSVSTDLQTGEI

SEQ ID NO: 18400 - protein, 28 aa, Artificial Sequence
  Description of Artificial Sequence: Synthetic peptide
QEEEIRATNPVATEVYGSVSTNLQHGNR

SEQ ID NO: 18401 - protein, 28 aa, Artificial Sequence
  Description of Artificial Sequence: Synthetic peptide
DEEEIRTTNPDATEQYGSVSTNPQYGNL

SEQ ID NO: 18402 - protein, 29 aa, Artificial Sequence
  Description of Artificial Sequence: Synthetic peptide
DEEEIRTTNPTATEQYGSVSTMNLQRGDF

SEQ ID NO: 18403 - protein, 28 aa, Artificial Sequence
  Description of Artificial Sequence: Synthetic peptide
DEVEISTTNPVATEQYGWVSNNLQRGNR

SEQ ID NO: 18404 - protein, 28 aa, Artificial Sequence
  Description of Artificial Sequence: Synthetic peptide
DEEEIRTTNPVATEQYGSCWHELQRGNR

SEQ ID NO: 18405 - protein, 28 aa, Artificial Sequence
  Description of Artificial Sequence: Synthetic peptide
DEEEIRTTNPVATQQYGSVSTNDDRGER

SEQ ID NO: 18406 - protein, 31 aa, Artificial Sequence
  Description of Artificial Sequence: Synthetic polypeptide
DEEEIRTTNPVATEQYGSVSATNLQERNGNE

SEQ ID NO: 18407 - protein, 28 aa, Artificial Sequence
  Description of Artificial Sequence: Synthetic peptide
DEDEIRTTNPVATEMYGSVSTNVQRGTR

SEQ ID NO: 18408 - protein, 28 aa, Artificial Sequence
  Description of Artificial Sequence: Synthetic peptide
DTEEIRTTNPYATEWYGSVSTNDQRGNR

SEQ ID NO: 18409 - protein, 28 aa, Artificial Sequence
  Description of Artificial Sequence: Synthetic peptide
DEEEIRTTNPVATEQYGSVSTELEIGND

SEQ ID NO: 18410 - protein, 28 aa, Artificial Sequence
  Description of Artificial Sequence: Synthetic peptide
DEEEIRTTNPVATEQYGSVSTDLQQGED

SEQ ID NO: 18411 - protein, 28 aa, Artificial Sequence
  Description of Artificial Sequence: Synthetic peptide
DEEEIRTTNPVATEQYGSVSTGLEEGND

SEQ ID NO: 18412 - protein, 28 aa, Artificial Sequence
  Description of Artificial Sequence: Synthetic peptide
DEEEIRTTNPVATEQYGSVSTNLFDGEP

SEQ ID NO: 18413 - protein, 29 aa, Artificial Sequence
  Description of Artificial Sequence: Synthetic peptide
DEEEIRTTNPVATEQYGDVSENLQHAGNR

SEQ ID NO: 18414 - protein, 28 aa, Artificial Sequence
  Description of Artificial Sequence: Synthetic peptide
DEEEIRTVNIVATEQYGSVSTNIQRGER

SEQ ID NO: 18415 - protein, 28 aa, Artificial Sequence
  Description of Artificial Sequence: Synthetic peptide
DESEIATTNPVATEQYGSVSTNLQMGGR

SEQ ID NO: 18416 - protein, 28 aa, Artificial Sequence
  Description of Artificial Sequence: Synthetic peptide
DEEEIRATNIVATEQYGSVSTILQHGNR

SEQ ID NO: 18417 - protein, 28 aa, Artificial Sequence
  Description of Artificial Sequence: Synthetic peptide
MEEEIRTTNPVATEVYGSVSTNLERGNF

SEQ ID NO: 18418 - protein, 28 aa, Artificial Sequence
  Description of Artificial Sequence: Synthetic peptide
DEEEIRTTNPVATEQYGSVSTNLAQGET

SEQ ID NO: 18419 - protein, 29 aa, Artificial Sequence
  Description of Artificial Sequence: Synthetic peptide
DEEEIRATNPVATEQYGSVSTADQRGNER

SEQ ID NO: 18420 - protein, 31 aa, Artificial Sequence
  Description of Artificial Sequence: Synthetic polypeptide
DEEEIRTTNPVATEQYGSVSTNWLEQRGENV

SEQ ID NO: 18421 - protein, 29 aa, Artificial Sequence
  Description of Artificial Sequence: Synthetic peptide
DEEEIRTTNPTATEQYGSVSTNEQREGNG

SEQ ID NO: 18422 - protein, 28 aa, Artificial Sequence
  Description of Artificial Sequence: Synthetic peptide
DEEEIRTTNPVATEQYGSVETNDQREER

SEQ ID NO: 18423 - protein, 29 aa, Artificial Sequence
  Description of Artificial Sequence: Synthetic peptide
DEEEIRTTNPVATEQYGSVSCENLQAGNA

SEQ ID NO: 18424 - protein, 30 aa, Artificial Sequence
  Description of Artificial Sequence: Synthetic polypeptide
DEEEIRTTNPVATEQYGSVSTGLQDEGNDR

SEQ ID NO: 18425 - protein, 29 aa, Artificial Sequence
  Description of Artificial Sequence: Synthetic peptide
DEEEIRTTNPVATEQYGSVSTNLQHGEDN

SEQ ID NO: 18426 - protein, 30 aa, Artificial Sequence
  Description of Artificial Sequence: Synthetic polypeptide
DEEEIRTTNPFATEQYGSVSTNLTQRGEDR

SEQ ID NO: 18427 - protein, 28 aa, Artificial Sequence
  Description of Artificial Sequence: Synthetic peptide
DEEEIRTTNPVATEQWGSVSENLMQGNR

SEQ ID NO: 18428 - protein, 28 aa, Artificial Sequence
  Description of Artificial Sequence: Synthetic peptide
DEEEICTTNPVATEQYGSAPTVLQRGNR

SEQ ID NO: 18429 - protein, 29 aa, Artificial Sequence
  Description of Artificial Sequence: Synthetic peptide
DEEEIRTTNPVATEQYGSVSEDLQRGEND

SEQ ID NO: 18430 - protein, 32 aa, Artificial Sequence
  Description of Artificial Sequence: Synthetic polypeptide
DEEEIRTTNPVATEQYGSVSTNLQERDGENER

SEQ ID NO: 18431 - protein, 28 aa, Artificial Sequence
  Description of Artificial Sequence: Synthetic peptide
DEEEIVTTNPVATEQFGSVSTNPQIGNR

SEQ ID NO: 18432 - protein, 30 aa, Artificial Sequence
  Description of Artificial Sequence: Synthetic polypeptide
DEEEIRTTNPVATEQYGSVDSTNLEVGDNR

SEQ ID NO: 18433 - protein, 28 aa, Artificial Sequence
  Description of Artificial Sequence: Synthetic peptide
DEEEIRTTNPVAWEQFGSVSTNDIRGNR

SEQ ID NO: 18434 - protein, 28 aa, Artificial Sequence
  Description of Artificial Sequence: Synthetic peptide
DEEEICTTNPVATEQYGGVPTNLQQGNR

SEQ ID NO: 18435 - protein, 28 aa, Artificial Sequence
  Description of Artificial Sequence: Synthetic peptide
DEQEIRTTNPIATEVYGCVSTNLQRGNR

SEQ ID NO: 18436 - protein, 29 aa, Artificial Sequence
  Description of Artificial Sequence: Synthetic peptide
DDEEVRTTNPVATEQYGCVSTNLQLRGNR

SEQ ID NO: 18437 - protein, 28 aa, Artificial Sequence
  Description of Artificial Sequence: Synthetic peptide
DEEEIRTTNPFATEQYGDVSTNLERGER

SEQ ID NO: 18438 - protein, 28 aa, Artificial Sequence
  Description of Artificial Sequence: Synthetic peptide
QEEEIRTTNPVATECYGSASENLQRGNR

SEQ ID NO: 18439 - protein, 28 aa, Artificial Sequence
  Description of Artificial Sequence: Synthetic peptide
DEEEVRATNPVAYEQYGSVGTNLQRGNR

SEQ ID NO: 18440 - protein, 30 aa, Artificial Sequence
  Description of Artificial Sequence: Synthetic polypeptide
DEEEIRTTNPVATEQYGSVSTNLQENGNDQ

SEQ ID NO: 18441 - protein, 30 aa, Artificial Sequence
  Description of Artificial Sequence: Synthetic polypeptide
DEEEIRTTNPVCTEQYGSVSDTNLQRGENV

SEQ ID NO: 18442 - protein, 29 aa, Artificial Sequence
  Description of Artificial Sequence: Synthetic peptide
DEEEIRTTNPVSTEQWGSVSTNLQWRGDR

SEQ ID NO: 18443 - protein, 28 aa, Artificial Sequence
  Description of Artificial Sequence: Synthetic peptide
KEQEIRTTNPVATEQYGSVSTDLQRGNM

SEQ ID NO: 18444 - protein, 30 aa, Artificial Sequence
  Description of Artificial Sequence: Synthetic polypeptide
DEEEIRTTNPVATEQYGSVDSTNLEPGNER

SEQ ID NO: 18445 - protein, 28 aa, Artificial Sequence
  Description of Artificial Sequence: Synthetic peptide
DEEEIKTTNPVATEVYGEVSTNLQRGQR

SEQ ID NO: 18446 - protein, 30 aa, Artificial Sequence
  Description of Artificial Sequence: Synthetic polypeptide
DEEEIRTTNPVATEQYGSVSTNLVQVLGNE

SEQ ID NO: 18447 - protein, 28 aa, Artificial Sequence
  Description of Artificial Sequence: Synthetic peptide
DEHEIRTTNPVATEQYGDVSENLQRGNT

SEQ ID NO: 18448 - protein, 28 aa, Artificial Sequence
  Description of Artificial Sequence: Synthetic peptide
DEQEIRTTNPVATEQYGSVETNEQRGNF

SEQ ID NO: 18449 - protein, 28 aa, Artificial Sequence
  Description of Artificial Sequence: Synthetic peptide
DEEEIRTTNPTATEQFGSVSTNLQSGTR

SEQ ID NO: 18450 - protein, 30 aa, Artificial Sequence; identical to SEQ ID NO: 16471
  Description of Artificial Sequence: Synthetic polypeptide

SEQ ID NO: 18451 - protein, 29 aa, Artificial Sequence
  Description of Artificial Sequence: Synthetic peptide
DEEEIRTTNPVATEQWGSVSTNLMNRGNF

SEQ ID NO: 18452 - protein, 30 aa, Artificial Sequence
  Description of Artificial Sequence: Synthetic polypeptide
DEEEIRTTNPVATEQYGSVSTNLQELGNDA

SEQ ID NO: 18453 - protein, 30 aa, Artificial Sequence
  Description of Artificial Sequence: Synthetic polypeptide
DEEEIRTTNPVATEQYGSVSENLQENGNDR

SEQ ID NO: 18454 - protein, 28 aa, Artificial Sequence
  Description of Artificial Sequence: Synthetic peptide
DEEEIRTTNPVATEQYGDVSENLQQGNA

SEQ ID NO: 18455 - protein, 29 aa, Artificial Sequence
  Description of Artificial Sequence: Synthetic peptide
DEEEIRTTNPVATEQYGSVSTNLQENGEM

SEQ ID NO: 18456 - protein, 28 aa, Artificial Sequence
  Description of Artificial Sequence: Synthetic peptide
DEQEIRTTNPVATEQYGSVSENLQQGNA

SEQ ID NO: 18457 - protein, 28 aa, Artificial Sequence
  Description of Artificial Sequence: Synthetic peptide
DEEEICSTNPVATEQYGSVSNNLQRGGR

SEQ ID NO: 18458 - protein, 30 aa, Artificial Sequence
  Description of Artificial Sequence: Synthetic polypeptide
DEEEIRTTNPVATEQYGSVSTNLQEAEGNQ

SEQ ID NO: 18459 - protein, 28 aa, Artificial Sequence
  Description of Artificial Sequence: Synthetic peptide
DEEEIRTTNPVASETYGSVSENLQRMNR

SEQ ID NO: 18460 - protein, 28 aa, Artificial Sequence
  Description of Artificial Sequence: Synthetic peptide
DENEIRVTNPVATEQYGSVSCNLQRGER

SEQ ID NO: 18461 - protein, 32 aa, Artificial Sequence
  Description of Artificial Sequence: Synthetic polypeptide
DEEEIRTTNPVATEQYGSVESDTNPLQRGDNR

SEQ ID NO: 18462 - protein, 29 aa, Artificial Sequence
  Description of Artificial Sequence: Synthetic peptide
DENEIRQTNPVATEQYGSVSENLVQRGNR

SEQ ID NO: 18463 - protein, 28 aa, Artificial Sequence
  Description of Artificial Sequence: Synthetic peptide
DEEEIRTTNPVATEQYGSVSTDLQDGEN

SEQ ID NO: 18464 - protein, 28 aa, Artificial Sequence
  Description of Artificial Sequence: Synthetic peptide
SEEEIRTTNPTATEQFGSVSTLLQRGNR

SEQ ID NO: 18465 - protein, 29 aa, Artificial Sequence
  Description of Artificial Sequence: Synthetic peptide
EEEEIRTTNPTATEQYGSVSTNLPQNGNR

SEQ ID NO: 18466 - protein, 28 aa, Artificial Sequence
  Description of Artificial Sequence: Synthetic peptide
DEDEIGTTNPVATEQYGSVSTILQRGGR

SEQ ID NO: 18467 - protein, 30 aa, Artificial Sequence
  Description of Artificial Sequence: Synthetic polypeptide
DEEEIRTTNPEATEQYGSVSTNLQIRGDDR

SEQ ID NO: 18468 - protein, 30 aa, Artificial Sequence
  Description of Artificial Sequence: Synthetic polypeptide
DEQEIRTTNPIATEQYGSVDSTNLQRGENR

SEQ ID NO: 18469 - protein, 29 aa, Artificial Sequence
  Description of Artificial Sequence: Synthetic peptide
DEEEIRTTNPTATEQYGSVSTNEQNGDNR

SEQ ID NO: 18470 - protein, 28 aa, Artificial Sequence
  Description of Artificial Sequence: Synthetic peptide
DEEEIRTTNPVATEQYGSVSTDDDRGER

SEQ ID NO: 18471 - protein, 28 aa, Artificial Sequence
  Description of Artificial Sequence: Synthetic peptide
DEEEIRTTNPVATEQYGSVSTNDDRGED

SEQ ID NO: 18472 - protein, 28 aa, Artificial Sequence
  Description of Artificial Sequence: Synthetic peptide
DEQEIRTTNIVATEQYGSVSENLQQGNR

SEQ ID NO: 18473 - protein, 28 aa, Artificial Sequence
  Description of Artificial Sequence: Synthetic peptide
DEEEIATTNPVATEQYGSVSTVLMHGNR

SEQ ID NO: 18474 - protein, 28 aa, Artificial Sequence
  Description of Artificial Sequence: Synthetic peptide
DEEEISTVNPVATEQYGCVSMNLQRGNR

SEQ ID NO: 18475 - protein, 28 aa, Artificial Sequence
  Description of Artificial Sequence: Synthetic peptide
DEEEIRATNPVASEQYGSVSTNLQHGNV

SEQ ID NO: 18476 - protein, 28 aa, Artificial Sequence
  Description of Artificial Sequence: Synthetic peptide
DEVEIATTNPVATEQYGSVSTNEQRGNV

SEQ ID NO: 18477 - protein, 29 aa, Artificial Sequence
  Description of Artificial Sequence: Synthetic peptide
DEEEIRTTNPVATECYGVVSTNLQDRGND

SEQ ID NO: 18478 - protein, 30 aa, Artificial Sequence
  Description of Artificial Sequence: Synthetic polypeptide
DEEEIRTTNPVATEQYGSVSTNLQDGEGDR

SEQ ID NO: 18479 - protein, 29 aa, Artificial Sequence
  Description of Artificial Sequence: Synthetic peptide
DEEEIRTTNPVATEQYGSVSCTDLQVGND

SEQ ID NO: 18480 - protein, 28 aa, Artificial Sequence
  Description of Artificial Sequence: Synthetic peptide
DEEEVRATNPVATEQYGSVSMNLERGNR

SEQ ID NO: 18481 - protein, 28 aa, Artificial Sequence
  Description of Artificial Sequence: Synthetic peptide
DEEEIRTTNPVATEQYGSVSTDLEPGNN

SEQ ID NO: 18482 - protein, 30 aa, Artificial Sequence
  Description of Artificial Sequence: Synthetic polypeptide
DEEEIRTTNPVATMQYGSVPSTNLQLRGNG

SEQ ID NO: 18483 - protein, 30 aa, Artificial Sequence
  Description of Artificial Sequence: Synthetic polypeptide
DEEEIRTTNPVATEQYGSVSTNLQIEGEDR

SEQ ID NO: 18484 - protein, 28 aa, Artificial Sequence
  Description of Artificial Sequence: Synthetic peptide
DEEEIRTTNPVATEQYGSVDTNLEGGNI

SEQ ID NO: 18485 - protein, 28 aa, Artificial Sequence
  Description of Artificial Sequence: Synthetic peptide
SEEEIRTTNPVATEQYGSVSENLQFGNA

SEQ ID NO: 18486 - protein, 28 aa, Artificial Sequence
  Description of Artificial Sequence: Synthetic peptide
DEEEIRTTNIVCTEQYGSVSTNLMNGNR

SEQ ID NO: 18487 - protein, 28 aa, Artificial Sequence
  Description of Artificial Sequence: Synthetic peptide
DEGEIRTTNPVATEQYGSVSTNLQILND

SEQ ID NO: 18488 - protein, 29 aa, Artificial Sequence
  Description of Artificial Sequence: Synthetic peptide
DEEEIRTTNPVATEQYGSASTNLQRGMEA

SEQ ID NO: 18489 - protein, 30 aa, Artificial Sequence
  Description of Artificial Sequence: Synthetic polypeptide
DEEEIRTTNPVATEQYGSVSTNLQEIGNDW

SEQ ID NO: 18490 - protein, 28 aa, Artificial Sequence
  Description of Artificial Sequence: Synthetic peptide
DEEEIRTVNPVATENYGVVGTNLQRGNR

SEQ ID NO: 18491 - protein, 28 aa, Artificial Sequence
  Description of Artificial Sequence: Synthetic peptide
DEEEIRTTNPVATEQYGSVSEDLQAGNV

SEQ ID NO: 18492 - protein, 29 aa, Artificial Sequence
  Description of Artificial Sequence: Synthetic peptide
DEEEIRTTNPVATEQYGEVPTNLPQQGNR

SEQ ID NO: 18493 - protein, 28 aa, Artificial Sequence
  Description of Artificial Sequence: Synthetic peptide
QEEEIRTTNPVATEQYGSVSEVLQRGNN

SEQ ID NO: 18494 - protein, 31 aa, Artificial Sequence
  Description of Artificial Sequence: Synthetic polypeptide
DEEEIRTTNPVATEQYGSVSTNPLQEREDNR

SEQ ID NO: 18495 - protein, 30 aa, Artificial Sequence
  Description of Artificial Sequence: Synthetic polypeptide
DEEEIRTTNPEATEQYGSVSTNDQRKGDNR

SEQ ID NO: 18496 - protein, 28 aa, Artificial Sequence
  Description of Artificial Sequence: Synthetic peptide
DEDEISTTNPVATEQFGSVSTNLQRGTR

SEQ ID NO: 18497 - protein, 28 aa, Artificial Sequence
  Description of Artificial Sequence: Synthetic peptide
DEDEIRTTNPVATEQYGSVPENLQRENR

SEQ ID NO: 18498 - protein, 30 aa, Artificial Sequence
  Description of Artificial Sequence: Synthetic polypeptide
DEEEIRTTNPVATEIYGSVTSGTNVQRGNR

SEQ ID NO: 18499 - protein, 30 aa, Artificial Sequence
  Description of Artificial Sequence: Synthetic polypeptide
DEPEIRTTNPVATEQYGSVSIENWLQRGNR

SEQ ID NO: 18500 - protein, 28 aa, Artificial Sequence
  Description of Artificial Sequence: Synthetic peptide
DEEEIRSTNPVATEMYGNVATNLQRGNR

SEQ ID NO: 18501 - protein, 28 aa, Artificial Sequence
  Description of Artificial Sequence: Synthetic peptide
DEEEIRTTNPFATEQYGSVSDNLQRENE

SEQ ID NO: 18502 - protein, 28 aa, Artificial Sequence
  Description of Artificial Sequence: Synthetic peptide
DEEEIRVTNPVATEIYGSVSTNWQHGNR

SEQ ID NO: 18503 - protein, 29 aa, Artificial Sequence
  Description of Artificial Sequence: Synthetic peptide
DEEEIRTTNPVATEQWGSVSTNLQMQGNA

SEQ ID NO: 18504 - protein, 28 aa, Artificial Sequence
  Description of Artificial Sequence: Synthetic peptide
DEQELATTNPVATEQYGSVSTNLQRGNT

SEQ ID NO: 18505 - protein, 28 aa, Artificial Sequence
  Description of Artificial Sequence: Synthetic peptide
DEEEIRTTNPVATEQYGSASEEWQRGNR

SEQ ID NO: 18506 - protein, 29 aa, Artificial Sequence
  Description of Artificial Sequence: Synthetic peptide
DEEEIRTTNPVATEQYGSVSENLQMQGNW

SEQ ID NO: 18507 - protein, 28 aa, Artificial Sequence
  Description of Artificial Sequence: Synthetic peptide
DEEEICTTNPVATEQYGSASDNLQRGGR

SEQ ID NO: 18508 - protein, 30 aa, Artificial Sequence
  Description of Artificial Sequence: Synthetic polypeptide
DEEEIGTTNPVATEQYGSVSMTNLQIGNDR

SEQ ID NO: 18509 - protein, 28 aa, Artificial Sequence
  Description of Artificial Sequence: Synthetic peptide
SEEEIRTTNIVATEQYGSVETNEQRGNR

SEQ ID NO: 18510 - protein, 30 aa, Artificial Sequence
  Description of Artificial Sequence: Synthetic polypeptide
DEEEIVTTNPVATEQYGSVSITNLQDGNDR

SEQ ID NO: 18511 - protein, 28 aa, Artificial Sequence
  Description of Artificial Sequence: Synthetic peptide
DEEEIRTTNPVATEQFGSVSTNEQSGDR

SEQ ID NO: 18512 - protein, 30 aa, Artificial Sequence
  Description of Artificial Sequence: Synthetic polypeptide
DEEEITTTNPVATEQYGSVNSTNLQRGNDN

SEQ ID NO: 18513 - protein, 28 aa, Artificial Sequence
  Description of Artificial Sequence: Synthetic peptide
DEEEIRTTNPVATEMYGEVSTELQAGNR

SEQ ID NO: 18514 - protein, 28 aa, Artificial Sequence
  Description of Artificial Sequence: Synthetic peptide
SEEEICTTNPVATELYGDVSTNLQRGNR

SEQ ID NO: 18515 - protein, 29 aa, Artificial Sequence
  Description of Artificial Sequence: Synthetic peptide
DEEEIRGTNPVATEQYGSVSTMDEQRGNR

SEQ ID NO: 18516 - protein, 28 aa, Artificial Sequence
  Description of Artificial Sequence: Synthetic peptide
SEEEIRTTNPVATECYGSVSTNLQHGNV

SEQ ID NO: 18517 - protein, 28 aa, Artificial Sequence
  Description of Artificial Sequence: Synthetic peptide
DEEEIRTTNPVATEQYGSVSTDQQRGED

SEQ ID NO: 18518 - protein, 30 aa, Artificial Sequence
  Description of Artificial Sequence: Synthetic polypeptide
DEEEIRTTNPVATEQYGSVSATNLQRNGED

SEQ ID NO: 18519 - protein, 28 aa, Artificial Sequence
  Description of Artificial Sequence: Synthetic peptide
DEEEICTTNPVATEFYGSVSENLQRGNF

SEQ ID NO: 18520 - protein, 30 aa, Artificial Sequence
  Description of Artificial Sequence: Synthetic polypeptide
DEEEIRTTNPVATEQYGSVSTNLQEAGNDF

SEQ ID NO: 18521 - protein, 28 aa, Artificial Sequence
  Description of Artificial Sequence: Synthetic peptide
DEEEIRTTNIVATEQYGSVSTNLVTQNR

SEQ ID NO: 18522 - protein, 28 aa, Artificial Sequence
  Description of Artificial Sequence: Synthetic peptide
DEQEIRTTNPCATECYGSVSTNLQRGNS

SEQ ID NO: 18523 - protein, 29 aa, Artificial Sequence
  Description of Artificial Sequence: Synthetic peptide
DEEEIRTTNPVCTEQYGSVSTMELQSGNR

SEQ ID NO: 18524 - protein, 29 aa, Artificial Sequence
  Description of Artificial Sequence: Synthetic peptide
DEEEIRTTNPVATEQYGHSVSTIEQRGDR

SEQ ID NO: 18525 - protein, 28 aa, Artificial Sequence
  Description of Artificial Sequence: Synthetic peptide
DEEEIRATNIVATENYGSVSTNEQRGNR

SEQ ID NO: 18526 - protein, 28 aa, Artificial Sequence
  Description of Artificial Sequence: Synthetic peptide
DEQEIRTTNPVATESYGSVSTNLQLGNA

SEQ ID NO: 18527 - protein, 29 aa, Artificial Sequence
  Description of Artificial Sequence: Synthetic peptide
DEEEIATTNPVATEQYGSVSTNLQYGNEQ

SEQ ID NO: 18528 - protein, 29 aa, Artificial Sequence
  Description of Artificial Sequence: Synthetic peptide
SEEEIRTTNPVATEQYGSVSTNPQLEGNR

SEQ ID NO: 18529 - protein, 31 aa, Artificial Sequence
  Description of Artificial Sequence: Synthetic polypeptide
SEEEIRTTNPVATEQYGSVSTGNLQERGNTR

SEQ ID NO: 18530 - protein, 30 aa, Artificial Sequence
  Description of Artificial Sequence: Synthetic polypeptide
DEEEIRTTNPVATEQYGSVSTNEQERGNTG

SEQ ID NO: 18531 - protein, 29 aa, Artificial Sequence
  Description of Artificial Sequence: Synthetic peptide
DEEEIRTTNPVATELYGSVSENLQNRGNL

SEQ ID NO: 18532 - protein, 28 aa, Artificial Sequence
  Description of Artificial Sequence: Synthetic peptide
DEEEIRTTNPVATECYGSVSTNLQQGEM

SEQ ID NO: 18533 - protein, 28 aa, Artificial Sequence
  Description of Artificial Sequence: Synthetic peptide
DEEETRTTNPVATEVYGSVSENLQAGNR

SEQ ID NO: 18534 - protein, 28 aa, Artificial Sequence
  Description of Artificial Sequence: Synthetic peptide
DEHEIRTTNPVATEQYGEVSTNIQRGPR

SEQ ID NO: 18535 - protein, 28 aa, Artificial Sequence
  Description of Artificial Sequence: Synthetic peptide
DEEEIRTTNPVATEQYGDVSDNLERENR

SEQ ID NO: 18536 - protein, 28 aa, Artificial Sequence
  Description of Artificial Sequence: Synthetic peptide
DEEEIRTTNPDATEQYGSVSTELQYGER

SEQ ID NO: 18537 - protein, 28 aa, Artificial Sequence
  Description of Artificial Sequence: Synthetic peptide
KEEEIRTTNPVATECYGSVSTNLQYGNL

SEQ ID NO: 18538 - protein, 28 aa, Artificial Sequence
  Description of Artificial Sequence: Synthetic peptide
DEEEIRTTNPVATEQYGEVSTVLQHGGR

SEQ ID NO: 18539 - protein, 28 aa, Artificial Sequence
  Description of Artificial Sequence: Synthetic peptide
GEEEIRTTNPVATECYGSVSTNLQIGNV

SEQ ID NO: 18540 - protein, 28 aa, Artificial Sequence
  Description of Artificial Sequence: Synthetic peptide
DEVEIVTTNIVATEQYGSVSTNLQRGNL

SEQ ID NO: 18541 - protein, 30 aa, Artificial Sequence
  Description of Artificial Sequence: Synthetic polypeptide
DEEEIRTTNPVATEQYGSVETNPLQRDGNV

SEQ ID NO: 18542 - protein, 28 aa, Artificial Sequence
  Description of Artificial Sequence: Synthetic peptide
DEEEIRTTNPVATEQWGSVSTNLQQGTQ

SEQ ID NO: 18543 - protein, 28 aa, Artificial Sequence
  Description of Artificial Sequence: Synthetic peptide
DEDEIRATNPVATEQYGSASDNLQRGNR

SEQ ID NO: 18544 - protein, 29 aa, Artificial Sequence
  Description of Artificial Sequence: Synthetic peptide
GEEEIRTTNPVATEQYGSVSTNLQHGENA

SEQ ID NO: 18545 - protein, 28 aa, Artificial Sequence
  Description of Artificial Sequence: Synthetic peptide
DEEEIRTTNPDATEQYGSVSTNDDRENR

SEQ ID NO: 18546 - protein, 28 aa, Artificial Sequence
  Description of Artificial Sequence: Synthetic peptide
GEEEIRTVNPVATEQYGSVATNLQRGNQ

SEQ ID NO: 18547 - protein, 28 aa, Artificial Sequence
  Description of Artificial Sequence: Synthetic peptide
DEQEIRTTNIVATEHYGSVSTNLQVGNR

SEQ ID NO: 18548 - protein, 30 aa, Artificial Sequence
  Description of Artificial Sequence: Synthetic polypeptide
DEEEIRTTNPCATEQYGSVCTMNLQRGSNR

SEQ ID NO: 18549 - protein, 28 aa, Artificial Sequence
  Description of Artificial Sequence: Synthetic peptide
VEEEIRPTNPVATEQYGSVSTNGDRGNR

SEQ ID NO: 18550 - protein, 28 aa, Artificial Sequence
  Description of Artificial Sequence: Synthetic peptide
DEEEIRTTNPCATEQYGSVSTLFQIGNR

SEQ ID NO: 18551 - protein, 28 aa, Artificial Sequence
  Description of Artificial Sequence: Synthetic peptide
DDEEIRTTNPVATEQWGSYSTNLQRGNT

SEQ ID NO: 18552 - protein, 28 aa, Artificial Sequence
  Description of Artificial Sequence: Synthetic peptide
DEEEIRTTNIVASEQYGSVSEGLQRGNR

SEQ ID NO: 18553 - protein, 28 aa, Artificial Sequence
  Description of Artificial Sequence: Synthetic peptide
DEEEIATTNPVATEQYGSVSTNLEHGNM

SEQ ID NO: 18554 - protein, 30 aa, Artificial Sequence
  Description of Artificial Sequence: Synthetic polypeptide
DEEEIRTTNPVATEQYGSVSTRLQMRGNDF

SEQ ID NO: 18555 - protein, 28 aa, Artificial Sequence
  Description of Artificial Sequence: Synthetic peptide
DEMEIRTTNPVSTEPYGSVSTNLQHGNR

SEQ ID NO: 18556 - protein, 28 aa, Artificial Sequence
  Description of Artificial Sequence: Synthetic peptide
DEQEIRATNPVATELYGVVSTNLQRGNR

SEQ ID NO: 18557 - protein, 29 aa, Artificial Sequence
  Description of Artificial Sequence: Synthetic peptide
DEEEIRTTNPVADEQYGDVSTNLQRDGER

SEQ ID NO: 18558 - protein, 28 aa, Artificial Sequence
  Description of Artificial Sequence: Synthetic peptide
DEEEIRTTNPVATEQFGSVSENLQFGDR

SEQ ID NO: 18559 - protein, 28 aa, Artificial Sequence
  Description of Artificial Sequence: Synthetic peptide
VEHEIMTTNPVATEQYGEVSTNLQRGNR

SEQ ID NO: 18560 - protein, 28 aa, Artificial Sequence
  Description of Artificial Sequence: Synthetic peptide
DEEEITTTNPIATEQYGSVSTNEQRGNL

SEQ ID NO: 18561 - protein, 28 aa, Artificial Sequence
  Description of Artificial Sequence: Synthetic peptide
DEEEIRTTNPVATEQYGSVETDLQVGNF

SEQ ID NO: 18562 - protein, 28 aa, Artificial Sequence
  Description of Artificial Sequence: Synthetic peptide
DEQEIVTTNPVATEQYGWVSDNLQRGNR

SEQ ID NO: 18563 - protein, 28 aa, Artificial Sequence
  Description of Artificial Sequence: Synthetic peptide
KEEEIRATNPVATEQYGSVSTNLQTGDR

SEQ ID NO: 18564 - protein, 30 aa, Artificial Sequence
  Description of Artificial Sequence: Synthetic polypeptide
DEEEIRTTNPVATEQYGSVSTDNLDRGDER

SEQ ID NO: 18565 - protein, 28 aa, Artificial Sequence
  Description of Artificial Sequence: Synthetic peptide
DEEEIRCTNPVATELYGDVSTNLQHGNR

SEQ ID NO: 18566 - protein, 29 aa, Artificial Sequence
  Description of Artificial Sequence: Synthetic peptide
AEEEIRTTNPVATEQYGTVSATNLQRGGR

SEQ ID NO: 18567 - protein, 29 aa, Artificial Sequence
  Description of Artificial Sequence: Synthetic peptide
VEEEIRSTNPVATEQYGSVSDNLQRAGNR

SEQ ID NO: 18568 - protein, 29 aa, Artificial Sequence
  Description of Artificial Sequence: Synthetic peptide
DEEEIRTTNPVATEQYGSVSTNLERGEDA

SEQ ID NO: 18569 - protein, 30 aa, Artificial Sequence
  Description of Artificial Sequence: Synthetic polypeptide
DEEEIRTTNPVATEQYGSVSTNLQDDNGNE

SEQ ID NO: 18570 - protein, 28 aa, Artificial Sequence
  Description of Artificial Sequence: Synthetic peptide
DEEEIATTNPVATEMFGSVSENLQRGNR

SEQ ID NO: 18571 - protein, 28 aa, Artificial Sequence
  Description of Artificial Sequence: Synthetic peptide
DEQEIVCTNPVATEQYGVVSTNLQRGNR

SEQ ID NO: 18572 - protein, 28 aa, Artificial Sequence
  Description of Artificial Sequence: Synthetic peptide
DEQEIVTTNPVATENYGVVSTNLQRGNR

SEQ ID NO: 18573 - protein, 28 aa, Artificial Sequence
  Description of Artificial Sequence: Synthetic peptide
DEEEIVTTNPTATEQYGSVSTDLQRGNF

SEQ ID NO: 18574 - protein, 30 aa, Artificial Sequence
  Description of Artificial Sequence: Synthetic polypeptide
DEEHIRTTNPVATEQYGSVESTNDQWRGNR

SEQ ID NO: 18575 - protein, 28 aa, Artificial Sequence
  Description of Artificial Sequence: Synthetic peptide
STEEIRTTNPVAGEQYGSVSTNLQRGDR

SEQ ID NO: 18576 - protein, 31 aa, Artificial Sequence
  Description of Artificial Sequence: Synthetic polypeptide
DEEEIRTTNPVATEQYGSVSTIDLQRDGDNR

SEQ ID NO: 18577 - protein, 29 aa, Artificial Sequence
  Description of Artificial Sequence: Synthetic peptide
DEEEIRTTNPVATEQYGSVSCTNWCHGNR

SEQ ID NO: 18578 - protein, 28 aa, Artificial Sequence
  Description of Artificial Sequence: Synthetic peptide
DEEEIRTTNPEATEQYGSVSTPLQWGNS

SEQ ID NO: 18579 - protein, 28 aa, Artificial Sequence
  Description of Artificial Sequence: Synthetic peptide
MEEEIRTTNPVATECYGSVSTNLQIGNH

SEQ ID NO: 18580 - protein, 28 aa, Artificial Sequence
  Description of Artificial Sequence: Synthetic peptide
DEEEIRTTNPVATECWGSVSTNLQRGDQ

SEQ ID NO: 18581 - protein, 28 aa, Artificial Sequence
  Description of Artificial Sequence: Synthetic peptide
DEEEIRTTNPVATEQYGSVSTDLQVGDS

SEQ ID NO: 18582 - protein, 28 aa, Artificial Sequence
  Description of Artificial Sequence: Synthetic peptide
DEEEIRTTNPVCTEQYGVVSNDLQRGNR

SEQ ID NO: 18583 - protein, 30 aa, Artificial Sequence
  Description of Artificial Sequence: Synthetic polypeptide
DEEEIRTTNPVATETYGSVSTCNLQYRGNC

SEQ ID NO: 18584 - protein, 28 aa, Artificial Sequence
  Description of Artificial Sequence: Synthetic peptide
DEEEIRTTNPVATEQYGSVSTEDERGNG

SEQ ID NO: 18585 - protein, 28 aa, Artificial Sequence
  Description of Artificial Sequence: Synthetic peptide
DEEEIRTTNPVATEQWGSVSENEQRGNM

SEQ ID NO: 18586 - protein, 28 aa, Artificial Sequence
  Description of Artificial Sequence: Synthetic peptide
DEEEIRTTNPTATEQYGSVSTNPQIGNG

SEQ ID NO: 18587 - protein, 29 aa, Artificial Sequence
  Description of Artificial Sequence: Synthetic peptide
DENEIRTTNPVATEQYGSVSTNLQENGNM

SEQ ID NO: 18588 - protein, 29 aa, Artificial Sequence
  Description of Artificial Sequence: Synthetic peptide
KEEEIRTTNPVATEQYGSVSTDLQERGNT

SEQ ID NO: 18589 - protein, 28 aa, Artificial Sequence
  Description of Artificial Sequence: Synthetic peptide
DEQEIRTTNPVATEMYGSVGTNLQRGTR

SEQ ID NO: 18590 - protein, 28 aa, Artificial Sequence
  Description of Artificial Sequence: Synthetic peptide
DEEEIRTTNPFATEQYGSVSTNLDRGDD

SEQ ID NO: 18591 - protein, 30 aa, Artificial Sequence
  Description of Artificial Sequence: Synthetic polypeptide
DEECIRTTNPVATEQYGSCVSTNLQIDGNR

SEQ ID NO: 18592 - protein, 28 aa, Artificial Sequence
  Description of Artificial Sequence: Synthetic peptide
DEEEIRTTNIVATEQYGSVSEELQWGNR

SEQ ID NO: 18593 - protein, 29 aa, Artificial Sequence
  Description of Artificial Sequence: Synthetic peptide
DEEEIRTTNPVATECYGSVSTNLQQGNDF

SEQ ID NO: 18594 - protein, 28 aa, Artificial Sequence
  Description of Artificial Sequence: Synthetic peptide
DEEEIRTTNPVATEMYGSVSENLMLGNR

SEQ ID NO: 18595 - protein, 28 aa, Artificial Sequence
  Description of Artificial Sequence: Synthetic peptide
KEEEIRTTNPVATECYGSVSTNLQGGNT

SEQ ID NO: 18596 - protein, 28 aa, Artificial Sequence
  Description of Artificial Sequence: Synthetic peptide
DEEEIRTTNPVSTEQYGEVAENLQRGNR

SEQ ID NO: 18597 - protein, 28 aa, Artificial Sequence
  Description of Artificial Sequence: Synthetic peptide
QEEEIATTNPVATEQYGWVSDNLQRGNR

SEQ ID NO: 18598 - protein, 28 aa, Artificial Sequence
  Description of Artificial Sequence: Synthetic peptide
DEEEIRTTNPVATEQYGSVSTNDDEGNF

SEQ ID NO: 18599 - protein, 30 aa, Artificial Sequence
  Description of Artificial Sequence: Synthetic polypeptide
DEEVIRTTNPVATEQYGSVETNGLQRGDNR

SEQ ID NO: 18600 - protein, 28 aa, Artificial Sequence
  Description of Artificial Sequence: Synthetic peptide
HEEEIETTNPVATEQYGSVSTNTQRGNT

SEQ ID NO: 18601 - protein, 30 aa, Artificial Sequence
  Description of Artificial Sequence: Synthetic polypeptide
DEEEIRTTNPVATEQYGSVSTNEQERGDNI

SEQ ID NO: 18602 - protein, 28 aa, Artificial Sequence
  Description of Artificial Sequence: Synthetic peptide
DEEEIRTTNPTATEQFGSVSTNEQQGNR

SEQ ID NO: 18603 - protein, 28 aa, Artificial Sequence
  Description of Artificial Sequence: Synthetic peptide
DEEEIRTTNPFATEQYGSVSTPLQPGNP

SEQ ID NO: 18604 - protein, 30 aa, Artificial Sequence
  Description of Artificial Sequence: Synthetic polypeptide
DEEEIRTTNPVATEQYGSVSTCLQREGEPR

SEQ ID NO: 18605 - protein, 28 aa, Artificial Sequence
  Description of Artificial Sequence: Synthetic peptide
DESEVRTTNPVATEQYGSVATNLQRGTR

SEQ ID NO: 18606 - protein, 31 aa, Artificial Sequence
  Description of Artificial Sequence: Synthetic polypeptide
DEEEIRTTNPVATEQYGSVSCTMNLQRGNDS

SEQ ID NO: 18607 - protein, 28 aa, Artificial Sequence
  Description of Artificial Sequence: Synthetic peptide
DEEEIRQTNPVATEQYGSVSTNDEAGNR

SEQ ID NO: 18608 - protein, 28 aa, Artificial Sequence
  Description of Artificial Sequence: Synthetic peptide
DEQEICTTNPVATEQYGSVSTNLQKGNA

SEQ ID NO: 18609 - protein, 31 aa, Artificial Sequence
  Description of Artificial Sequence: Synthetic polypeptide
DEEEIRTTNPVATEQYGSVSTINLQLWGDNR

SEQ ID NO: 18610 - protein, 28 aa, Artificial Sequence
  Description of Artificial Sequence: Synthetic peptide
DEEEIRTTNPVATEQYGSVDTNLQYDNA

SEQ ID NO: 18611 - protein, 30 aa, Artificial Sequence
  Description of Artificial Sequence: Synthetic polypeptide
DEEEIRTTNPVATEQYGGVSTNGLQQEGNR

SEQ ID NO: 18612 - protein, 30 aa, Artificial Sequence
  Description of Artificial Sequence: Synthetic polypeptide
DEEEIRTTNPVATEQYGSVSCTNLQCNGNC

SEQ ID NO: 18613 - protein, 28 aa, Artificial Sequence
  Description of Artificial Sequence: Synthetic peptide
DEEEIRTTNPVATEQYGSVSTNLEDGEV

SEQ ID NO: 18614 - protein, 28 aa, Artificial Sequence
  Description of Artificial Sequence: Synthetic peptide
MEEEIRTTNPVATEIYGSVATNLDRGNR

SEQ ID NO: 18615 - protein, 28 aa, Artificial Sequence
  Description of Artificial Sequence: Synthetic peptide
DENEIRCTNIVATEQYGSVSTNDQRGNR

SEQ ID NO: 18616 - protein, 30 aa, Artificial Sequence
  Description of Artificial Sequence: Synthetic polypeptide
DEEEIRTTNPVATEQYGSVSTNLQRKGEDQ

SEQ ID NO: 18617 - protein, 28 aa, Artificial Sequence
  Description of Artificial Sequence: Synthetic peptide
DEEEIRTTNPVATEMYGSVSTGLQDGND

SEQ ID NO: 18618 - protein, 28 aa, Artificial Sequence
  Description of Artificial Sequence: Synthetic peptide
DEEEICATNPVATEQYGCVSTNLQRGNF

SEQ ID NO: 18619 - protein, 29 aa, Artificial Sequence
  Description of Artificial Sequence: Synthetic peptide
DEQEVRTTNPVATEQYGSCSTNLQRAGNR

SEQ ID NO: 18620 - protein, 28 aa, Artificial Sequence
  Description of Artificial Sequence: Synthetic peptide
DEEEIRTTNIVSTEQYGSVSTDIQRGNR

SEQ ID NO: 18621 - protein, 28 aa, Artificial Sequence
  Description of Artificial Sequence: Synthetic peptide
DEEEIRTTNIVATEQYGWVSTNLQHGNI

SEQ ID NO: 18622 - protein, 31 aa, Artificial Sequence
  Description of Artificial Sequence: Synthetic polypeptide
DEEEIRTTNPVATEQYGSVSTNPLVQDRGND

SEQ ID NO: 18623 - protein, 28 aa, Artificial Sequence
  Description of Artificial Sequence: Synthetic peptide
DEEEIRTTNPVASEMYGWVSTNLQHGNR

SEQ ID NO: 18624 - protein, 28 aa, Artificial Sequence
  Description of Artificial Sequence: Synthetic peptide
DEEEIRTTNPDATQQYGSVSTNLQRENP

SEQ ID NO: 18625 - protein, 29 aa, Artificial Sequence
  Description of Artificial Sequence: Synthetic peptide
DEEEIRTTNPVATEQYGSVSTPPLQDGER

SEQ ID NO: 18626 - protein, 31 aa, Artificial Sequence
  Description of Artificial Sequence: Synthetic polypeptide
DEEEIRTTNPVATEQYGSVDSTNEPQREGNR

SEQ ID NO: 18627 - protein, 28 aa, Artificial Sequence
  Description of Artificial Sequence: Synthetic peptide
DEEEIRTTNITATEQYGEVSTNLQRGGR

SEQ ID NO: 18628 - protein, 28 aa, Artificial Sequence
  Description of Artificial Sequence: Synthetic peptide
DEEEIRCTNPVATEQYGVVSTNIQGGNR

SEQ ID NO: 18629 - protein, 29 aa, Artificial Sequence
  Description of Artificial Sequence: Synthetic peptide
DEEEIRTTNPVATEQYGSVSTELQEGGER

SEQ ID NO: 18630 - protein, 30 aa, Artificial Sequence
  Description of Artificial Sequence: Synthetic polypeptide
DEEEIRTTNPVATEQYGSVESTNPLERGER

SEQ ID NO: 18631 - protein, 29 aa, Artificial Sequence
  Description of Artificial Sequence: Synthetic peptide
DEEEIRTVNPVATEQYGSVSTDLQRGEDR

SEQ ID NO: 18632 - protein, 28 aa, Artificial Sequence
  Description of Artificial Sequence: Synthetic peptide
DEQEIVTTNPVATEVYGVVSTNLQRGNR

SEQ ID NO: 18633 - protein, 29 aa, Artificial Sequence
  Description of Artificial Sequence: Synthetic peptide
DEEEIATTNPVATEQYGSVSTDLQERGND

SEQ ID NO: 18634 - protein, 29 aa, Artificial Sequence
  Description of Artificial Sequence: Synthetic peptide
VEEEIRSTNPVATEQYGSVSTNLEREGNR

SEQ ID NO: 18635 - protein, 28 aa, Artificial Sequence
  Description of Artificial Sequence: Synthetic peptide
DEQEIVTTNPVATEVYGTVSTNLQRGNR

SEQ ID NO: 18636 - protein, 30 aa, Artificial Sequence
  Description of Artificial Sequence: Synthetic polypeptide
DEEEIRTTNPVATEQYGSVSCTNLQYGNDD

SEQ ID NO: 18637 - protein, 28 aa, Artificial Sequence
  Description of Artificial Sequence: Synthetic peptide
QEEEIRTTNPVCTECYGSVSTNLQRGNF

SEQ ID NO: 18638 - protein, 28 aa, Artificial Sequence
  Description of Artificial Sequence: Synthetic peptide
DDEEIRSTNIVATEQYGSVSTNLQRGNM

SEQ ID NO: 18639 - protein, 29 aa, Artificial Sequence
  Description of Artificial Sequence: Synthetic peptide
DEQEIRTTNPIATEQYGVVSATNLQRGNR

SEQ ID NO: 18640 - protein, 29 aa, Artificial Sequence
  Description of Artificial Sequence: Synthetic peptide
DEEEIRTTNPEATEQYGSVSTNPLQAGNA

SEQ ID NO: 18641 - protein, 28 aa, Artificial Sequence
  Description of Artificial Sequence: Synthetic peptide
NEEEIRTTNPVSTEQYGSVAYNLQRGNR

SEQ ID NO: 18642 - protein, 28 aa, Artificial Sequence
  Description of Artificial Sequence: Synthetic peptide
DEYEIAGTNIVATEQYGSVSTNLQRGNR

SEQ ID NO: 18643 - protein, 30 aa, Artificial Sequence
  Description of Artificial Sequence: Synthetic polypeptide
DEEEIRTTNPVATEQYGSVSTDLQGEGNER

SEQ ID NO: 18644 - protein, 28 aa, Artificial Sequence
  Description of Artificial Sequence: Synthetic peptide
DEEEICTTNPVATEQYGEASDNLQRGNR

SEQ ID NO: 18645 - protein, 29 aa, Artificial Sequence
  Description of Artificial Sequence: Synthetic peptide
DEEEIRTTNPVATECYGSVSATNLERGND

SEQ ID NO: 18646 - protein, 30 aa, Artificial Sequence
  Description of Artificial Sequence: Synthetic polypeptide
DEEEIRCTNPVATEQYGSVSTDNLQMGVNR

SEQ ID NO: 18647 - protein, 28 aa, Artificial Sequence
  Description of Artificial Sequence: Synthetic peptide
DEEEIRTTNPVATEQYGSVDTNLQTGDQ

SEQ ID NO: 18648 - protein, 28 aa, Artificial Sequence
  Description of Artificial Sequence: Synthetic peptide
DEEEIRTTNPVATEQYGSVDTDLQQGNQ

SEQ ID NO: 18649 - protein, 30 aa, Artificial Sequence
  Description of Artificial Sequence: Synthetic polypeptide
DEEEIRTTNPVATEQYGSVSTNLQEVEGNM

SEQ ID NO: 18650 - protein, 29 aa, Artificial Sequence
  Description of Artificial Sequence: Synthetic peptide
DEEEIATTNPTATEQYGSVSTNLQIEGNR

SEQ ID NO: 18651 - protein, 31 aa, Artificial Sequence
  Description of Artificial Sequence: Synthetic polypeptide
DEEEIRTTNPVATEQYGSVDSTNLQDQGNDR

SEQ ID NO: 18652 - protein, 28 aa, Artificial Sequence
  Description of Artificial Sequence: Synthetic peptide
DEEEIRTTNIVATEQYGSASTNLQLGNI

SEQ ID NO: 18653 - protein, 29 aa, Artificial Sequence
  Description of Artificial Sequence: Synthetic peptide
DEEEIRTTNPVATEQYGSVSTNLQENGET

SEQ ID NO: 18654 - protein, 28 aa, Artificial Sequence
  Description of Artificial Sequence: Synthetic peptide
DEDEIRTTNIVSTEQYGSVSTNDQRGNR

SEQ ID NO: 18655 - protein, 28 aa, Artificial Sequence
  Description of Artificial Sequence: Synthetic peptide
DEEEISTTNPIATEQYGVVSTNLQRGNI

SEQ ID NO: 18656 - protein, 30 aa, Artificial Sequence
  Description of Artificial Sequence: Synthetic polypeptide
DEEEIRTTNPVATEQYGSVSCENLQCHGNR

SEQ ID NO: 18657 - protein, 28 aa, Artificial Sequence
  Description of Artificial Sequence: Synthetic peptide
SEEEIRTTNPAATETYGSVSTNLQSGNR

SEQ ID NO: 18658 - protein, 29 aa, Artificial Sequence
  Description of Artificial Sequence: Synthetic peptide
DEEEIRTTNPVATEQYGASVSTNLQDGDS

SEQ ID NO: 18659 - protein, 29 aa, Artificial Sequence
  Description of Artificial Sequence: Synthetic peptide
DEECIRTTNPTATAQYGSVSTNLQRGDNR

SEQ ID NO: 18660 - protein, 28 aa, Artificial Sequence
  Description of Artificial Sequence: Synthetic peptide
DEEEIRTTNPVATEQWGSVSENEMRGNR

SEQ ID NO: 18661 - protein, 28 aa, Artificial Sequence
  Description of Artificial Sequence: Synthetic peptide
VEEEIRTTNPVATEQFGSVSTNLGRLNR

SEQ ID NO: 18662 - protein, 28 aa, Artificial Sequence
  Description of Artificial Sequence: Synthetic peptide
DEECIRTTNPVATEQYGSVSTGLQNGLR

SEQ ID NO: 18663 - protein, 29 aa, Artificial Sequence
  Description of Artificial Sequence: Synthetic peptide
DEEEIRTTNPVATEQYGSVSEELQRGNDA

SEQ ID NO: 18664 - protein, 28 aa, Artificial Sequence
  Description of Artificial Sequence: Synthetic peptide
DEEEIRTVNPVATEQYGSMSTDLQRGNF

SEQ ID NO: 18665 - protein, 28 aa, Artificial Sequence
  Description of Artificial Sequence: Synthetic peptide
KEEECATTNPVATEQYGSVSTNLQRGNT

SEQ ID NO: 18666 - protein, 29 aa, Artificial Sequence
  Description of Artificial Sequence: Synthetic peptide
DEEDIRTTNPVATEQYGSVSTNYQMGGNR

SEQ ID NO: 18667 - protein, 28 aa, Artificial Sequence
  Description of Artificial Sequence: Synthetic peptide
DEEEIRTTNPVATEQYGSVDTDLQMGNM

SEQ ID NO: 18668 - protein, 28 aa, Artificial Sequence
  Description of Artificial Sequence: Synthetic peptide
DEMEIATTNPVATEQYGEVSTVLQRGNR

SEQ ID NO: 18669 - protein, 31 aa, Artificial Sequence
  Description of Artificial Sequence: Synthetic polypeptide
DEEEIRTTNPVATEQYGSVSCTMDLQRGNDR

SEQ ID NO: 18670 - protein, 28 aa, Artificial Sequence
  Description of Artificial Sequence: Synthetic peptide
DEEEIRQTNIVSTEQYGSVSTNLQYGNR

SEQ ID NO: 18671 - protein, 28 aa, Artificial Sequence
  Description of Artificial Sequence: Synthetic peptide
DEEEISATNPVATEQYGSVSTNLQRGGT

SEQ ID NO: 18672 - protein, 28 aa, Artificial Sequence
  Description of Artificial Sequence: Synthetic peptide
DEEEIRTTNPVACEQYGGVSTNLQPGNE

SEQ ID NO: 18673 - protein, 29 aa, Artificial Sequence
  Description of Artificial Sequence: Synthetic peptide
DEECIRTTNPVATYQYGSVFSTNLQRGER

SEQ ID NO: 18674 - protein, 28 aa, Artificial Sequence
  Description of Artificial Sequence: Synthetic peptide
DEEEIRTTNPVATEVYGTVSTALQLGNR

SEQ ID NO: 18675 - protein, 28 aa, Artificial Sequence
  Description of Artificial Sequence: Synthetic peptide
DEQEIATTNPVATEIYGVVSTNLQRGNR

SEQ ID NO: 18676 - protein, 29 aa, Artificial Sequence
  Description of Artificial Sequence: Synthetic peptide
DEEEIRTTNPVATEQYGSVSTMELQNGNF

SEQ ID NO: 18677 - protein, 30 aa, Artificial Sequence
  Description of Artificial Sequence: Synthetic polypeptide
DEEEIRTTNPVATEQYGSCVSHNLQRGDLR

SEQ ID NO: 18678 - protein, 29 aa, Artificial Sequence
  Description of Artificial Sequence: Synthetic peptide
DEEEIRTTNPTATEQYGSVSTNLQNGDNV

SEQ ID NO: 18679 - protein, 28 aa, Artificial Sequence
  Description of Artificial Sequence: Synthetic peptide
QEEEIATTNPVATECYGSVSTNLQRGER

SEQ ID NO: 18680 - protein, 29 aa, Artificial Sequence
  Description of Artificial Sequence: Synthetic peptide
DEEEIRTTNPVATEQYGSWSTDLQRGNEP

SEQ ID NO: 18681 - protein, 28 aa, Artificial Sequence
  Description of Artificial Sequence: Synthetic peptide
DEEEIRTTNIVATEQYGSVSNELQRGNF

SEQ ID NO: 18682 - protein, 28 aa, Artificial Sequence
  Description of Artificial Sequence: Synthetic peptide
DETEIRTTNPVATEHYGSVSENLQAGNR

SEQ ID NO: 18683 - protein, 28 aa, Artificial Sequence
  Description of Artificial Sequence: Synthetic peptide
MEQEIATTNPVATEQYGSVSTDLQRGNR

SEQ ID NO: 18684 - protein, 28 aa, Artificial Sequence
  Description of Artificial Sequence: Synthetic peptide
EEVEIRTTNPVATEQYGSVSTNLQHGQR

SEQ ID NO: 18685 - protein, 28 aa, Artificial Sequence
  Description of Artificial Sequence: Synthetic peptide
DTEEIRTTNPVATEQYGSWSTNLQPGNP

SEQ ID NO: 18686 - protein, 28 aa, Artificial Sequence
  Description of Artificial Sequence: Synthetic peptide
DEEEIRTTNPVATEQYGSVSTELQAGDI

SEQ ID NO: 18687 - protein, 28 aa, Artificial Sequence
  Description of Artificial Sequence: Synthetic peptide
DEEEIRTTNPVSTENYGSVGTNLQRGTR

SEQ ID NO: 18688 - protein, 30 aa, Artificial Sequence
  Description of Artificial Sequence: Synthetic polypeptide
DEEEISTTNPVATEQYGSVSTDLQRKGANR

SEQ ID NO: 18689 - protein, 28 aa, Artificial Sequence
  Description of Artificial Sequence: Synthetic peptide
DEEEIRTTNPDATEQYGSVSTNEQNGER

SEQ ID NO: 18690 - protein, 29 aa, Artificial Sequence
  Description of Artificial Sequence: Synthetic peptide
DENEIRCTNPVATEQYGIVSTNLQRGNDR

SEQ ID NO: 18691 - protein, 29 aa, Artificial Sequence
  Description of Artificial Sequence: Synthetic peptide
DEEEIRTTNPVATEQYGSVSCTDLQYGNQ

SEQ ID NO: 18692 - protein, 30 aa, Artificial Sequence
  Description of Artificial Sequence: Synthetic polypeptide
DEEEIRTTNPVATEQYGSVDTNLMLRNGNR

SEQ ID NO: 18693 - protein, 28 aa, Artificial Sequence
  Description of Artificial Sequence: Synthetic peptide
DEEEIRTTNIVASEQYGSVSDNLDRGNR

SEQ ID NO: 18694 - protein, 31 aa, Artificial Sequence
  Description of Artificial Sequence: Synthetic polypeptide
DEEEIRTTNPVATEQYGESVSETDLVQRGNR

SEQ ID NO: 18695 - protein, 30 aa, Artificial Sequence
  Description of Artificial Sequence: Synthetic polypeptide
DEEEIRTTNPVATEQYGSVSTELQEREGNM

SEQ ID NO: 18696 - protein, 31 aa, Artificial Sequence
  Description of Artificial Sequence: Synthetic polypeptide
DEEEIRTTNPTATEQYGSVSDTNLQRDGENR

SEQ ID NO: 18697 - protein, 28 aa, Artificial Sequence
  Description of Artificial Sequence: Synthetic peptide
DEEEIHTTNPVATEAYGSVSTNLLRGNQ

SEQ ID NO: 18698 - protein, 29 aa, Artificial Sequence
  Description of Artificial Sequence: Synthetic peptide
DEEEIRTTNPISTEQYGSVSTNLQPEGNR

SEQ ID NO: 18699 - protein, 28 aa, Artificial Sequence
  Description of Artificial Sequence: Synthetic peptide
DEEEIRTTNPVASENYGAVGTNLQRGNR

SEQ ID NO: 18700 - protein, 28 aa, Artificial Sequence
  Description of Artificial Sequence: Synthetic peptide
DEEEIATTNPTATEQYGSVSTNVQRGDR

SEQ ID NO: 18701 - protein, 28 aa, Artificial Sequence
  Description of Artificial Sequence: Synthetic peptide
DEEEIRTTNPFATEQYGSVSTNLERGDD

SEQ ID NO: 18702 - protein, 28 aa, Artificial Sequence
  Description of Artificial Sequence: Synthetic peptide
SEEEIRTTNPCAGEQYGSVSTNLQRGQR

SEQ ID NO: 18703 - protein, 32 aa, Artificial Sequence
  Description of Artificial Sequence: Synthetic polypeptide
DEEEIRTTNPVATEQYGSVSSLTMNLVQRGNR

SEQ ID NO: 18704 - protein, 28 aa, Artificial Sequence
  Description of Artificial Sequence: Synthetic peptide
DEEEIRTTNPVATEQYGSVSTDLQVGEF

SEQ ID NO: 18705 - protein, 28 aa, Artificial Sequence
  Description of Artificial Sequence: Synthetic peptide
DEQEIRTTNPVATEQWGSVSTNLMIGNR

SEQ ID NO: 18706 - protein, 28 aa, Artificial Sequence
  Description of Artificial Sequence: Synthetic peptide
DENEIRTTNIVATEQYGSVSTNLDRENR

SEQ ID NO: 18707 - protein, 28 aa, Artificial Sequence
  Description of Artificial Sequence: Synthetic peptide
DEQEITTTNPVATEMYGWVSTNLQRGNR

SEQ ID NO: 18708 - protein, 29 aa, Artificial Sequence
  Description of Artificial Sequence: Synthetic peptide
DEMEIRTTNPVATEQYGSVSTNPQQRGND

SEQ ID NO: 18709 - protein, 28 aa, Artificial Sequence
  Description of Artificial Sequence: Synthetic peptide
DEEEIRTTNPVATEQYGSVSTEDELGNR

SEQ ID NO: 18710 - protein, 28 aa, Artificial Sequence
  Description of Artificial Sequence: Synthetic peptide
SEEEIRTTNIVATECYGSVSENLQRGNR

SEQ ID NO: 18711 - protein, 31 aa, Artificial Sequence
  Description of Artificial Sequence: Synthetic polypeptide
DEEEIRTTNPVATEQYGSVSTNLEDRNGNDR

SEQ ID NO: 18712 - protein, 29 aa, Artificial Sequence
  Description of Artificial Sequence: Synthetic peptide
DEEEIRTTNPVATEQYGSVSTNLEDEGNF

SEQ ID NO: 18713 - protein, 28 aa, Artificial Sequence
  Description of Artificial Sequence: Synthetic peptide
DEEEIRTTNIVATEQYGSVETNIQQGNR

SEQ ID NO: 18714 - protein, 28 aa, Artificial Sequence
  Description of Artificial Sequence: Synthetic peptide
DEEEIRTTNIVATECYGSVETNLQQGNR

SEQ ID NO: 18715 - protein, 29 aa, Artificial Sequence
  Description of Artificial Sequence: Synthetic peptide
DEQEIRTTNPVCTEQYGSVSTMNLQRGNA

SEQ ID NO: 18716 - protein, 29 aa, Artificial Sequence
  Description of Artificial Sequence: Synthetic peptide
DEEEIRTTNPVATEQYGSVSSENDQWGNR

SEQ ID NO: 18717 - protein, 28 aa, Artificial Sequence
  Description of Artificial Sequence: Synthetic peptide
MEEEIRTTNPVATEQYGSVSENLQVGNW

SEQ ID NO: 18718 - protein, 28 aa, Artificial Sequence
  Description of Artificial Sequence: Synthetic peptide
DESEIRTTNPVATEVYGSASTILQRGNR

SEQ ID NO: 18719 - protein, 28 aa, Artificial Sequence
  Description of Artificial Sequence: Synthetic peptide
DEEEIRCTNPTATETYGSVSDNLQRGNR

SEQ ID NO: 18720 - protein, 29 aa, Artificial Sequence
  Description of Artificial Sequence: Synthetic peptide
DEEEIRTTNPVATEWWGSVSTNLQNGGNR

SEQ ID NO: 18721 - protein, 28 aa, Artificial Sequence
  Description of Artificial Sequence: Synthetic peptide
DEEQIRTTNIVATEQYGSVSMNEQRGNR

SEQ ID NO: 18722 - protein, 28 aa, Artificial Sequence
  Description of Artificial Sequence: Synthetic peptide
QENEIRATNPVATEQYGSVSTNLQHGNR

SEQ ID NO: 18723 - protein, 28 aa, Artificial Sequence
  Description of Artificial Sequence: Synthetic peptide
DEEEIRTTNPVATEQYGSDSTNLQQGDM

SEQ ID NO: 18724 - protein, 30 aa, Artificial Sequence
  Description of Artificial Sequence: Synthetic polypeptide
DEEEIRTTNPVATEQYGSVSTNLVQEDGNN

SEQ ID NO: 18725 - protein, 28 aa, Artificial Sequence
  Description of Artificial Sequence: Synthetic peptide
DEEEIRTTNIVATEVYGSVSTCLQRGNA

SEQ ID NO: 18726 - protein, 30 aa, Artificial Sequence
  Description of Artificial Sequence: Synthetic polypeptide
DEEEIRTTNPVATEQYGSVSCTMNLQGGNN

SEQ ID NO: 18727 - protein, 28 aa, Artificial Sequence
  Description of Artificial Sequence: Synthetic peptide
DEVEIRTTNPVATEQYGSVSEDLLRGNR

SEQ ID NO: 18728 - protein, 29 aa, Artificial Sequence
  Description of Artificial Sequence: Synthetic peptide
DEEEIRTTNPVATEQYGSVSTDPLQRENS

SEQ ID NO: 18729 - protein, 28 aa, Artificial Sequence
  Description of Artificial Sequence: Synthetic peptide
DEEEIRTTNPVATEQYGSVDTNDQTGNM

SEQ ID NO: 18730 - protein, 31 aa, Artificial Sequence
  Description of Artificial Sequence: Synthetic polypeptide
DEEEIRTTNPVATEQYGSVSTNLQERKGEDR

SEQ ID NO: 18731 - protein, 28 aa, Artificial Sequence
  Description of Artificial Sequence: Synthetic peptide
DEEEIRTTNPVATEQYGSVSTPLENGNV

SEQ ID NO: 18732 - protein, 30 aa, Artificial Sequence
  Description of Artificial Sequence: Synthetic polypeptide
DEEEIRTTNPVATEQYGSVDENLQQREGNR

SEQ ID NO: 18733 - protein, 30 aa, Artificial Sequence
  Description of Artificial Sequence: Synthetic polypeptide
DEEEIVTTNPVATEQYGSVSATNLVQEGNR

SEQ ID NO: 18734 - protein, 28 aa, Artificial Sequence
  Description of Artificial Sequence: Synthetic peptide
DEEEIRTTNPVATEQYGSVSTAPQVGNN

SEQ ID NO: 18735 - protein, 28 aa, Artificial Sequence
  Description of Artificial Sequence: Synthetic peptide
DEEEIRTTNPVATEQYGSVSEDLQQGNT

SEQ ID NO: 18736 - protein, 29 aa, Artificial Sequence
  Description of Artificial Sequence: Synthetic peptide
DEEEIRTTNPVATEQYGSVSTNLEDEGNL

SEQ ID NO: 18737 - protein, 28 aa, Artificial Sequence
  Description of Artificial Sequence: Synthetic peptide
DEEEIGTTNPVATEQYGSVSENLQSGER

SEQ ID NO: 18738 - protein, 28 aa, Artificial Sequence
  Description of Artificial Sequence: Synthetic peptide
DEEEIRTTNPTATEMYGSVSENLQRENR

SEQ ID NO: 18739 - protein, 30 aa, Artificial Sequence
  Description of Artificial Sequence: Synthetic polypeptide
DEEEIRTTNPVATEQYGSVSTNLQEVGNDM

SEQ ID NO: 18740 - protein, 28 aa, Artificial Sequence
  Description of Artificial Sequence: Synthetic peptide
DEQEIRTTNIVATEQYGWVSTNLQRGNE

SEQ ID NO: 18741 - protein, 29 aa, Artificial Sequence
  Description of Artificial Sequence: Synthetic peptide
DEEEIRTTNPVATELWGSVSTNLQLRGNF

SEQ ID NO: 18742 - protein, 28 aa, Artificial Sequence
  Description of Artificial Sequence: Synthetic peptide
DEEEITATNPVATEQYGSVSTLLQRGTR

SEQ ID NO: 18743 - protein, 28 aa, Artificial Sequence
  Description of Artificial Sequence: Synthetic peptide
DEEEIRTTNPVATEQYGSVSTDLEDGNE

SEQ ID NO: 18744 - protein, 30 aa, Artificial Sequence
  Description of Artificial Sequence: Synthetic polypeptide
DEEEIRTTNPVATEQYGSVSTNLQDLEGNQ

SEQ ID NO: 18745 - protein, 28 aa, Artificial Sequence
  Description of Artificial Sequence: Synthetic peptide
DEGEIRQTNPVATEGFGSVSTNLQRGNR

SEQ ID NO: 18746 - protein, 30 aa, Artificial Sequence
  Description of Artificial Sequence: Synthetic polypeptide
AEEEIRTTNPVATEQYGSVDSTNGLQRGND

SEQ ID NO: 18747 - protein, 28 aa, Artificial Sequence
  Description of Artificial Sequence: Synthetic peptide
DEEEIRTTNPVATFQYGSVSTDLERGNP

SEQ ID NO: 18748 - protein, 31 aa, Artificial Sequence
  Description of Artificial Sequence: Synthetic polypeptide
DEEEIRTTNPVATEQYGSVSTNLQDRGENED

SEQ ID NO: 18749 - protein, 30 aa, Artificial Sequence
  Description of Artificial Sequence: Synthetic polypeptide
DEEEIRTTNPVATEQYGSVEATNLQREVNR

SEQ ID NO: 18750 - protein, 28 aa, Artificial Sequence
  Description of Artificial Sequence: Synthetic peptide
DDEEIRTTNPVATEQYGAVSTNQQRGDR

SEQ ID NO: 18751 - protein, 28 aa, Artificial Sequence
  Description of Artificial Sequence: Synthetic peptide
DEEEIRATNPVATEQYGFVSDNLQRGNI

SEQ ID NO: 18752 - protein, 28 aa, Artificial Sequence
  Description of Artificial Sequence: Synthetic peptide
DEEEIRTTNPVATECWGSVSENLQRGNA

SEQ ID NO: 18753 - protein, 29 aa, Artificial Sequence
  Description of Artificial Sequence: Synthetic peptide
DEEEIRTTNPVATEQYGSWSTNLQRDDDR

SEQ ID NO: 18754 - protein, 28 aa, Artificial Sequence
  Description of Artificial Sequence: Synthetic peptide
DEEEIHTTNPLATEAYGSVSTSLQRGNR

SEQ ID NO: 18755 - protein, 28 aa, Artificial Sequence
  Description of Artificial Sequence: Synthetic peptide
DEEEIRTTNPVATEQYGSVSTDLEQGER

SEQ ID NO: 18756 - protein, 28 aa, Artificial Sequence
  Description of Artificial Sequence: Synthetic peptide
DEEEIVTTNIVATEQYGSVSTNDQRGNM

SEQ ID NO: 18757 - protein, 28 aa, Artificial Sequence
  Description of Artificial Sequence: Synthetic peptide
DEEEIRTTNPVAYEQYGSVPTNLQRMNL

SEQ ID NO: 18758 - protein, 28 aa, Artificial Sequence
  Description of Artificial Sequence: Synthetic peptide
DEDEIRTTNPVATECYGEVSINLQRGNR

SEQ ID NO: 18759 - protein, 30 aa, Artificial Sequence
  Description of Artificial Sequence: Synthetic polypeptide
DEEEIRTTNPVASEQYGCVSATNLQRNGNR

SEQ ID NO: 18760 - protein, 28 aa, Artificial Sequence
  Description of Artificial Sequence: Synthetic peptide
DEEEIRTTNPVATEQYGSVSTDDQEGER

SEQ ID NO: 18761 - protein, 29 aa, Artificial Sequence
  Description of Artificial Sequence: Synthetic peptide
DEEEIRTTNPVATEQYGSVSTNLEYGEDR

SEQ ID NO: 18762 - protein, 28 aa, Artificial Sequence
  Description of Artificial Sequence: Synthetic peptide
DEEEIRTTNIVASEQYGSVSENLERGNR

SEQ ID NO: 18763 - protein, 28 aa, Artificial Sequence
  Description of Artificial Sequence: Synthetic peptide
DEQEIRTTNPVATEQYGSVSTNLDEGER

SEQ ID NO: 18764 - protein, 29 aa, Artificial Sequence
  Description of Artificial Sequence: Synthetic peptide
DEEEIRTTNPVATQQYGSVSTPNLQPGND

SEQ ID NO: 18765 - protein, 30 aa, Artificial Sequence
  Description of Artificial Sequence: Synthetic polypeptide
DEEEIRTTNPVATECYGSVSTNLQEREGER

SEQ ID NO: 18766 - protein, 29 aa, Artificial Sequence
  Description of Artificial Sequence: Synthetic peptide
DEEEITTTNPVATEQYGSVSTELQREGNM

SEQ ID NO: 18767 - protein, 30 aa, Artificial Sequence
  Description of Artificial Sequence: Synthetic polypeptide
DEEEIRTTNPVATEQYGWVSTNLQTHGNLR

SEQ ID NO: 18768 - protein, 28 aa, Artificial Sequence
  Description of Artificial Sequence: Synthetic peptide
DEEEIRTTNPVATEQYGSVSTDLDEGNI

SEQ ID NO: 18769 - protein, 30 aa, Artificial Sequence
  Description of Artificial Sequence: Synthetic polypeptide
DEEEIRTTNPVATEQYGSVETNGLQREGNA

SEQ ID NO: 18770 - protein, 28 aa, Artificial Sequence
  Description of Artificial Sequence: Synthetic peptide
DEEEIRTTNPVATEQYGSVSTDLEDGNQ

SEQ ID NO: 18771 - protein, 28 aa, Artificial Sequence
  Description of Artificial Sequence: Synthetic peptide
DEEEIRTTNPTATEQYGSVSTNEQQGNN

SEQ ID NO: 18772 - protein, 28 aa, Artificial Sequence
  Description of Artificial Sequence: Synthetic peptide
DEEEIRTTNPVATEQWGSVSTILQQGDR

SEQ ID NO: 18773 - protein, 29 aa, Artificial Sequence
  Description of Artificial Sequence: Synthetic peptide
DEEEIRTTNPVATEIYGEVSTLLQRAGNR

SEQ ID NO: 18774 - protein, 30 aa, Artificial Sequence
  Description of Artificial Sequence: Synthetic polypeptide
DEEEIRTTNPVATEQYGSVSTEPLQERGNY

SEQ ID NO: 18775 - protein, 29 aa, Artificial Sequence
  Description of Artificial Sequence: Synthetic peptide
DENEIRTTNPVATEQYGSVSTNLEREENR

SEQ ID NO: 18776 - protein, 28 aa, Artificial Sequence
  Description of Artificial Sequence: Synthetic peptide
DENEIRTTNPVATECYGSVSTDLQRGNM

SEQ ID NO: 18777 - protein, 31 aa, Artificial Sequence
  Description of Artificial Sequence: Synthetic polypeptide
DEEEIRTTNPVATEQYGSVISTMNLQNGVNR

SEQ ID NO: 18778 - protein, 28 aa, Artificial Sequence
  Description of Artificial Sequence: Synthetic peptide
DEEEIRTTNIVATEQYGSVSTELQRGEI

SEQ ID NO: 18779 - protein, 29 aa, Artificial Sequence
  Description of Artificial Sequence: Synthetic peptide
DEEEIRTTNPVATEQYGSVSTELTIRGNP

SEQ ID NO: 18780 - protein, 28 aa, Artificial Sequence
  Description of Artificial Sequence: Synthetic peptide
AEEEIRTTNPCATEQYGSVATNLQRGNY

SEQ ID NO: 18781 - protein, 31 aa, Artificial Sequence
  Description of Artificial Sequence: Synthetic polypeptide
DEEEIRTTNPVATEQYGSVSDTDLQRGENDR

SEQ ID NO: 18782 - protein, 28 aa, Artificial Sequence
  Description of Artificial Sequence: Synthetic peptide
DSWEIRTTNPVATEQYGSVSMNLQRGNY

SEQ ID NO: 18783 - protein, 29 aa, Artificial Sequence
  Description of Artificial Sequence: Synthetic peptide
DEEEIRTTNPVATEQYGSVSTNLQEGGEY

SEQ ID NO: 18784 - protein, 28 aa, Artificial Sequence
  Description of Artificial Sequence: Synthetic peptide
DEEEIRATNPTATEIYGSVSTNEQRGNR

SEQ ID NO: 18785 - protein, 28 aa, Artificial Sequence
  Description of Artificial Sequence: Synthetic peptide
DEEEIRTTNPVATEQYGSVSTNLEQGEN

SEQ ID NO: 18786 - protein, 28 aa, Artificial Sequence
  Description of Artificial Sequence: Synthetic peptide
DEEEIRTTNPVATEQYGSVDTNQQEGNQ

SEQ ID NO: 18787 - protein, 28 aa, Artificial Sequence
  Description of Artificial Sequence: Synthetic peptide
DENEIRTTNPVATEIYGTVSTNLQRGNF

SEQ ID NO: 18788 - protein, 28 aa, Artificial Sequence
  Description of Artificial Sequence: Synthetic peptide
DDEEIRTTNPVATEQYGSVATNLQWGNC

SEQ ID NO: 18789 - protein, 28 aa, Artificial Sequence
  Description of Artificial Sequence: Synthetic peptide
DEEEIRTTNPFATEQYGSVSYNLQLGND

SEQ ID NO: 18790 - protein, 28 aa, Artificial Sequence
  Description of Artificial Sequence: Synthetic peptide
DEIEIRTTNPVATEQYGAVSDNLQRGMR

SEQ ID NO: 18791 - protein, 29 aa, Artificial Sequence
  Description of Artificial Sequence: Synthetic peptide
DEEEIRCTNPVATEQYGSVSMALQQRGNR

SEQ ID NO: 18792 - protein, 28 aa, Artificial Sequence
  Description of Artificial Sequence: Synthetic peptide
DEEEIATTNPVATEQYGEVSENLQIGNR

SEQ ID NO: 18793 - protein, 28 aa, Artificial Sequence
  Description of Artificial Sequence: Synthetic peptide
DELEIRSTNPVATEQYGVVSTNLQRGND

SEQ ID NO: 18794 - protein, 28 aa, Artificial Sequence
  Description of Artificial Sequence: Synthetic peptide
DEEEIRTTNPVATEQYGWVSENLAFGNR

SEQ ID NO: 18795 - protein, 28 aa, Artificial Sequence
  Description of Artificial Sequence: Synthetic peptide
KEEEIRTTNIVATEQYGSVSTNDQRGNA

SEQ ID NO: 18796 - protein, 28 aa, Artificial Sequence
  Description of Artificial Sequence: Synthetic peptide
DEDEISTTNPVATEQYGWVSDNLQRGNR

SEQ ID NO: 18797 - protein, 28 aa, Artificial Sequence
  Description of Artificial Sequence: Synthetic peptide
KEEEIRTTNPVATEPYGSVSTNLQHGNC

SEQ ID NO: 18798 - protein, 30 aa, Artificial Sequence
  Description of Artificial Sequence: Synthetic polypeptide
DEEEIRTTNPVATEQYGSVSTNLQEAGNDE

SEQ ID NO: 18799 - protein, 28 aa, Artificial Sequence
  Description of Artificial Sequence: Synthetic peptide
LEEGIRTTNPVATEQYGCVSTNLQRGNF

SEQ ID NO: 18800 - protein, 28 aa, Artificial Sequence
  Description of Artificial Sequence: Synthetic peptide
DEEEIATTNPVATEQYGSVDENDQRGNR

SEQ ID NO: 18801 - protein, 28 aa, Artificial Sequence
  Description of Artificial Sequence: Synthetic peptide
DEEEIRQTNPVATENYGSVSTCLQRGNV

SEQ ID NO: 18802 - protein, 28 aa, Artificial Sequence
  Description of Artificial Sequence: Synthetic peptide
DEQEIRTVNPVATEQYGSVSTELQMGNR

SEQ ID NO: 18803 - protein, 29 aa, Artificial Sequence
  Description of Artificial Sequence: Synthetic peptide
DEEEIRTTNPVATEQYGSVNDNLQAEGNR

SEQ ID NO: 18804 - protein, 28 aa, Artificial Sequence
  Description of Artificial Sequence: Synthetic peptide
AEEEIRTTNPVATEQYGWVSTVLQRGGR

SEQ ID NO: 18805 - protein, 28 aa, Artificial Sequence
  Description of Artificial Sequence: Synthetic peptide
DEEEIATTNPVATEMYGGVSTNEQRGNR

SEQ ID NO: 18806 - protein, 28 aa, Artificial Sequence
  Description of Artificial Sequence: Synthetic peptide
DEEEIRTTNPAATEQYGSVSTNGAHGNR

SEQ ID NO: 18807 - protein, 30 aa, Artificial Sequence
  Description of Artificial Sequence: Synthetic polypeptide
DEEEIRTTNPDATEQYGSVSTNPLQSKGNR

SEQ ID NO: 18808 - protein, 28 aa, Artificial Sequence
  Description of Artificial Sequence: Synthetic peptide
DEEEIRTTNPVATEQYGSVSTNLENEDR

SEQ ID NO: 18809 - protein, 28 aa, Artificial Sequence
  Description of Artificial Sequence: Synthetic peptide
MECEIRTTNPVATEQYGSVSDNVQRGNR

SEQ ID NO: 18810 - protein, 28 aa, Artificial Sequence
  Description of Artificial Sequence: Synthetic peptide
DEEEIRTTNIVATEVYGSVSTELQHGNR

SEQ ID NO: 18811 - protein, 29 aa, Artificial Sequence
  Description of Artificial Sequence: Synthetic peptide
DEEEIRTTNPVATEQYGSVSTDLQHEGER

SEQ ID NO: 18812 - protein, 28 aa, Artificial Sequence
  Description of Artificial Sequence: Synthetic peptide
DEDEIRTTNPVATEIYGSVSTNPQRGNQ

SEQ ID NO: 18813 - protein, 28 aa, Artificial Sequence
  Description of Artificial Sequence: Synthetic peptide
DEEETRTTNIVATEQYGSVSTNLQHGNA

SEQ ID NO: 18814 - protein, 28 aa, Artificial Sequence
  Description of Artificial Sequence: Synthetic peptide
DEEEIRTTNPVATECYGWVATNLQFGNR

SEQ ID NO: 18815 - protein, 28 aa, Artificial Sequence
  Description of Artificial Sequence: Synthetic peptide
MEQEIRTTNPVATEQYGSVSTNLQNGNM

SEQ ID NO: 18816 - protein, 29 aa, Artificial Sequence
  Description of Artificial Sequence: Synthetic peptide
DEEEIRTTNPVATEVYGSVSMENLQRGNY

SEQ ID NO: 18817 - protein, 29 aa, Artificial Sequence
  Description of Artificial Sequence: Synthetic peptide
DEECIRTTNPFATEQYGSVSTNPLQRGNP

SEQ ID NO: 18818 - protein, 28 aa, Artificial Sequence
  Description of Artificial Sequence: Synthetic peptide
DEEEIRTTNIIATEQYGSVSTDLQRGNI

SEQ ID NO: 18819 - protein, 28 aa, Artificial Sequence
  Description of Artificial Sequence: Synthetic peptide
DEESIRTTNPVAVEQYGSVSTNLQRENQ

SEQ ID NO: 18820 - protein, 31 aa, Artificial Sequence
  Description of Artificial Sequence: Synthetic polypeptide
DEEEIRTTNPVATEQYGSVSCTMNLQQGNDR

SEQ ID NO: 18821 - protein, 28 aa, Artificial Sequence
  Description of Artificial Sequence: Synthetic peptide
DEEELRSTNIVATEQYGSVSTNLQRGER

SEQ ID NO: 18822 - protein, 28 aa, Artificial Sequence
  Description of Artificial Sequence: Synthetic peptide
DEEEIATTNPVATEQYGSVSTNLERGED

SEQ ID NO: 18823 - protein, 31 aa, Artificial Sequence
  Description of Artificial Sequence: Synthetic polypeptide
DEEEIRTTNPVATEQYGSVISTMNLQRGDNG

SEQ ID NO: 18824 - protein, 32 aa, Artificial Sequence
  Description of Artificial Sequence: Synthetic polypeptide
DEEEIRTTNPVATEQYGSVSTINPLQVRGNDR

SEQ ID NO: 18825 - protein, 29 aa, Artificial Sequence
  Description of Artificial Sequence: Synthetic peptide
DEEEITTTNPVATEQYGSVSVTGDQRGNR

SEQ ID NO: 18826 - protein, 29 aa, Artificial Sequence
  Description of Artificial Sequence: Synthetic peptide
DEEEIRTTNPVATEQYGSVSTNEQLGNTA

SEQ ID NO: 18827 - protein, 29 aa, Artificial Sequence
  Description of Artificial Sequence: Synthetic peptide
DEEEIRSTNPVATEQYGSVSTNLMERGDR

SEQ ID NO: 18828 - protein, 28 aa, Artificial Sequence
  Description of Artificial Sequence: Synthetic peptide
QEEEIATTNIVSTEQYGSVSTNLQRGNR

SEQ ID NO: 18829 - protein, 29 aa, Artificial Sequence
  Description of Artificial Sequence: Synthetic peptide
DEEEIRCTNPVATEMYGSVAATNLQRGNR

SEQ ID NO: 18830 - protein, 28 aa, Artificial Sequence
  Description of Artificial Sequence: Synthetic peptide
DEDEIRCTNIVATEQYGSVSENLQRGNR

SEQ ID NO: 18831 - protein, 28 aa, Artificial Sequence
  Description of Artificial Sequence: Synthetic peptide
DEEEIATTNPVATEQYGSVSENLQNGNA

SEQ ID NO: 18832 - protein, 28 aa, Artificial Sequence
  Description of Artificial Sequence: Synthetic peptide
DEQEICTTNPVATEIYGSVSTNLQRGNN

SEQ ID NO: 18833 - protein, 28 aa, Artificial Sequence
  Description of Artificial Sequence: Synthetic peptide
DEEEIRTTNPVATEQYGSVSTDLERGEW

SEQ ID NO: 18834 - protein, 28 aa, Artificial Sequence
  Description of Artificial Sequence: Synthetic peptide
DEEEIRTTNIVATEQYGDVATNIQRGNR

SEQ ID NO: 18835 - protein, 28 aa, Artificial Sequence
  Description of Artificial Sequence: Synthetic peptide
DEEEIRTTNPVATEQYGTVSENIQNGNR

SEQ ID NO: 18836 - protein, 28 aa, Artificial Sequence
  Description of Artificial Sequence: Synthetic peptide
DEEEIRTTNIVATDQYGSVDENLQRGNR

SEQ ID NO: 18837 - protein, 29 aa, Artificial Sequence
  Description of Artificial Sequence: Synthetic peptide
DEEEIRTTNPVATEQYGTVSTMNLQVGNL

SEQ ID NO: 18838 - protein, 28 aa, Artificial Sequence
  Description of Artificial Sequence: Synthetic peptide
DEEEIRGTNPVATEQYGGASTNLQGGNR

SEQ ID NO: 18839 - protein, 28 aa, Artificial Sequence
  Description of Artificial Sequence: Synthetic peptide
DEEEIRQTNPVATEMYGSVSENLQAGNR

SEQ ID NO: 18840 - protein, 29 aa, Artificial Sequence
  Description of Artificial Sequence: Synthetic peptide
DEQEIRTTNPVATEQYGSVETNDQRGNDR

SEQ ID NO: 18841 - protein, 29 aa, Artificial Sequence
  Description of Artificial Sequence: Synthetic peptide
DEEEIRCTNPVATEQYGSVDTNLQQRGNG

SEQ ID NO: 18842 - protein, 28 aa, Artificial Sequence
  Description of Artificial Sequence: Synthetic peptide
DENEIAATNPVATEMYGSVSTNLQRGNR

SEQ ID NO: 18843 - protein, 28 aa, Artificial Sequence
  Description of Artificial Sequence: Synthetic peptide
DEEEIRTTNPFATEQYGSVSTALDRGER

SEQ ID NO: 18844 - protein, 28 aa, Artificial Sequence
  Description of Artificial Sequence: Synthetic peptide
DEECIRPTNPVATEQYGVVSTNLDRGNR

SEQ ID NO: 18845 - protein, 30 aa, Artificial Sequence
  Description of Artificial Sequence: Synthetic polypeptide
DEEEIRTTNPVATEQYGSVEETNPDQRGNR

SEQ ID NO: 18846 - protein, 28 aa, Artificial Sequence
  Description of Artificial Sequence: Synthetic peptide
DEEGIRTTNPVATEQYGSVSELLQLGNR

SEQ ID NO: 18847 - protein, 28 aa, Artificial Sequence
  Description of Artificial Sequence: Synthetic peptide
DENEIRQTNPVATEQYGSASTNLQRGER

SEQ ID NO: 18848 - protein, 28 aa, Artificial Sequence
  Description of Artificial Sequence: Synthetic peptide
DECEIHCTNPVATEQYGSVSTDLQRGNR

SEQ ID NO: 18849 - protein, 28 aa, Artificial Sequence
  Description of Artificial Sequence: Synthetic peptide
DEDEIYTTNPVATEQYGSVSTNWQRGNA

SEQ ID NO: 18850 - protein, 28 aa, Artificial Sequence
  Description of Artificial Sequence: Synthetic peptide
DEEEIRTTNPVANEQYGSVSTNLLTGND

SEQ ID NO: 18851 - protein, 30 aa, Artificial Sequence
  Description of Artificial Sequence: Synthetic polypeptide
TEEEIRTTNPVATEQYGSVSITNWNQRGNR

SEQ ID NO: 18852 - protein, 28 aa, Artificial Sequence
  Description of Artificial Sequence: Synthetic peptide
SEEEIRTTNPVATEQYGEVSTNEQRGNH

SEQ ID NO: 18853 - protein, 29 aa, Artificial Sequence
  Description of Artificial Sequence: Synthetic peptide
MEEEIRCTNPVATEQYGSVSTNLQRGDND

SEQ ID NO: 18854 - protein, 29 aa, Artificial Sequence
  Description of Artificial Sequence: Synthetic peptide
DEEEIRTTNPVATECYGSVSTDLQPGNDR

SEQ ID NO: 18855 - protein, 28 aa, Artificial Sequence
  Description of Artificial Sequence: Synthetic peptide
DEEEIRTTNPVATECYGSVSTNLQQGEA

SEQ ID NO: 18856 - protein, 28 aa, Artificial Sequence
  Description of Artificial Sequence: Synthetic peptide
DEEEIRTTNPVATETYGEVSTAIQRGNR

SEQ ID NO: 18857 - protein, 28 aa, Artificial Sequence
  Description of Artificial Sequence: Synthetic peptide
DEEEIRTTNPVATEIYGSVSTNLEHGNA

SEQ ID NO: 18858 - protein, 29 aa, Artificial Sequence
  Description of Artificial Sequence: Synthetic peptide
DEVEIRCTNPVATEQYGSVCSTNLQRGNF

SEQ ID NO: 18859 - protein, 28 aa, Artificial Sequence
  Description of Artificial Sequence: Synthetic peptide
DEEEIMTTNPVATEQFGSVSTAEQRGNR

SEQ ID NO: 18860 - protein, 29 aa, Artificial Sequence
  Description of Artificial Sequence: Synthetic peptide
DEEEIRTTNPVCTETYGSVSTNLQNGNDR

SEQ ID NO: 18861 - protein, 29 aa, Artificial Sequence
  Description of Artificial Sequence: Synthetic peptide
DEEEIRCTNPVATEIYGCVSTNLQRNGNR

SEQ ID NO: 18862 - protein, 29 aa, Artificial Sequence
  Description of Artificial Sequence: Synthetic peptide
DEEEIRTTNPVATEQWGDVSTNLMRAGNR

SEQ ID NO: 18863 - protein, 28 aa, Artificial Sequence
  Description of Artificial Sequence: Synthetic peptide
DEVEIRATNPVATEMYGSVSTNLQQGNR

SEQ ID NO: 18864 - protein, 28 aa, Artificial Sequence
  Description of Artificial Sequence: Synthetic peptide
DENEIRTTNPVATEQYGSVSENEQRGNS

SEQ ID NO: 18865 - protein, 28 aa, Artificial Sequence
  Description of Artificial Sequence: Synthetic peptide
DEEEIRTTNPVATEQYGSVSTGLEDGNN

SEQ ID NO: 18866 - protein, 28 aa, Artificial Sequence
  Description of Artificial Sequence: Synthetic peptide
DEEEIRTTNPVATEQYGSVSTDLEYGNY

SEQ ID NO: 18867 - protein, 28 aa, Artificial Sequence
  Description of Artificial Sequence: Synthetic peptide
DEEEIRTTNPVATEQYGSSSDALQRGNI

SEQ ID NO: 18868 - protein, 28 aa, Artificial Sequence
  Description of Artificial Sequence: Synthetic peptide
DEEEIRTTNPVATEQYGSVSTNLELGEA

SEQ ID NO: 18869 - protein, 28 aa, Artificial Sequence
  Description of Artificial Sequence: Synthetic peptide
DEEEICSTNPVATEQYGDVSTNLQRGNC

SEQ ID NO: 18870 - protein, 30 aa, Artificial Sequence
  Description of Artificial Sequence: Synthetic polypeptide
DEEEIRTTNPVATEQYGSVSTCNPCRGNTR

SEQ ID NO: 18871 - protein, 31 aa, Artificial Sequence
  Description of Artificial Sequence: Synthetic polypeptide
DEQEIRTTNPVATEQYGSVSCTMNLQCRGNR

SEQ ID NO: 18872 - protein, 28 aa, Artificial Sequence
  Description of Artificial Sequence: Synthetic peptide
DTEEIRTTNPVATEKYGSWHTNLQRGNR

SEQ ID NO: 18873 - protein, 31 aa, Artificial Sequence
  Description of Artificial Sequence: Synthetic polypeptide
DEEEIRTTNPVATEQYGSVSTNLPQLRGNLY

SEQ ID NO: 18874 - protein, 31 aa, Artificial Sequence
  Description of Artificial Sequence: Synthetic polypeptide
DEEEIRTTNPVATEQYGSVSTMNPQREGNTR

SEQ ID NO: 18875 - protein, 28 aa, Artificial Sequence
  Description of Artificial Sequence: Synthetic peptide
DEEEIRTTNPVAYEQYGSVSHNLDPGNR

SEQ ID NO: 18876 - protein, 28 aa, Artificial Sequence
  Description of Artificial Sequence: Synthetic peptide
DEVEIATTNPVATEQYGSVSTNLQNGNL

SEQ ID NO: 18877 - protein, 28 aa, Artificial Sequence
  Description of Artificial Sequence: Synthetic peptide
DEQEIRCTNPVASEMYGSVSTNLQRGNR

SEQ ID NO: 18878 - protein, 28 aa, Artificial Sequence
  Description of Artificial Sequence: Synthetic peptide
DENEIRSTNPVATELYGVVSTNLQRGNR

SEQ ID NO: 18879 - protein, 29 aa, Artificial Sequence
  Description of Artificial Sequence: Synthetic peptide
DECEIRTTNPVATEQYGSVSTNNGQRGNL

SEQ ID NO: 18880 - protein, 30 aa, Artificial Sequence
  Description of Artificial Sequence: Synthetic polypeptide
DEEEIRTTNPVATEQYGSVSVTNLQQKGER

SEQ ID NO: 18881 - protein, 28 aa, Artificial Sequence
  Description of Artificial Sequence: Synthetic peptide
DEEEIRTTNPVATECYGDASENLQRGNR

SEQ ID NO: 18882 - protein, 28 aa, Artificial Sequence
  Description of Artificial Sequence: Synthetic peptide
DEEEIRTTNPVATEQYGSVSTDLQQGEA

SEQ ID NO: 18883 - protein, 28 aa, Artificial Sequence
  Description of Artificial Sequence: Synthetic peptide
DEQEIRTTNPVATEQWGSVSTNLMRGNF

SEQ ID NO: 18884 - protein, 30 aa, Artificial Sequence
  Description of Artificial Sequence: Synthetic polypeptide
DEEEIRTTNPVCTEQYGSVSTNLQRKGEND

SEQ ID NO: 18885 - protein, 28 aa, Artificial Sequence
  Description of Artificial Sequence: Synthetic peptide
DEEEIRTTNPVATECYGSVSTNEQIGNF

SEQ ID NO: 18886 - protein, 28 aa, Artificial Sequence
  Description of Artificial Sequence: Synthetic peptide
DEQEIRSTNPVATEVYGWVSTNLQRGNR

SEQ ID NO: 18887 - protein, 28 aa, Artificial Sequence
  Description of Artificial Sequence: Synthetic peptide
DEEEIRTTNPVATEQYGSVSEDLQYGDR

SEQ ID NO: 18888 - protein, 31 aa, Artificial Sequence
  Description of Artificial Sequence: Synthetic polypeptide
DEEEIRTTNPVATEQYGSVSTINLQNQAGNR

SEQ ID NO: 18889 - protein, 29 aa, Artificial Sequence
  Description of Artificial Sequence: Synthetic peptide
MEEEIRTTNPVATEQYGSVSTNLQNGNDM

SEQ ID NO: 18890 - protein, 31 aa, Artificial Sequence
  Description of Artificial Sequence: Synthetic polypeptide
DEEEIRTTNPVATEQYGSVSATNLQRNGNDF

SEQ ID NO: 18891 - protein, 28 aa, Artificial Sequence
  Description of Artificial Sequence: Synthetic peptide
DEQEIRTTNPVATEQYGSVSTDDQIGNR

SEQ ID NO: 18892 - protein, 30 aa, Artificial Sequence
  Description of Artificial Sequence: Synthetic polypeptide
DEEEIRTTNPVATEQYGSVSTMNLQIGDNE

SEQ ID NO: 18893 - protein, 28 aa, Artificial Sequence
  Description of Artificial Sequence: Synthetic peptide
DEDEIRCTNPVSTEIYGSVSTNLQRGNR

SEQ ID NO: 18894 - protein, 28 aa, Artificial Sequence
  Description of Artificial Sequence: Synthetic peptide
DEEEIWTTNPVATEQYGCVSTNLQVGNQ

SEQ ID NO: 18895 - protein, 29 aa, Artificial Sequence
  Description of Artificial Sequence: Synthetic peptide
DEEEIRTTNPVATDMYGSVSTMNLQRGND

SEQ ID NO: 18896 - protein, 30 aa, Artificial Sequence
  Description of Artificial Sequence: Synthetic polypeptide
DEEEIRTTNPVATEQYGSVSTNLVQRENDL

SEQ ID NO: 18897 - protein, 29 aa, Artificial Sequence
  Description of Artificial Sequence: Synthetic peptide
DEEEIRTTNPVATEQYGSVSTNPAFRGFR

SEQ ID NO: 18898 - protein, 29 aa, Artificial Sequence
  Description of Artificial Sequence: Synthetic peptide
DEEEIRATNPVATEQYGSVSETLQIRGNR

SEQ ID NO: 18899 - protein, 29 aa, Artificial Sequence
  Description of Artificial Sequence: Synthetic peptide
DEEEIRTTNPVAWEQYGSVSTNDQRGDLR

SEQ ID NO: 18900 - protein, 29 aa, Artificial Sequence
  Description of Artificial Sequence: Synthetic peptide
DEEMIRTTNPVATEQYGSVSENLQYRGPR

SEQ ID NO: 18901 - protein, 29 aa, Artificial Sequence
  Description of Artificial Sequence: Synthetic peptide
DENEIRTTNPVATEQYGSVSTDLQMGENR

SEQ ID NO: 18902 - protein, 32 aa, Artificial Sequence
  Description of Artificial Sequence: Synthetic polypeptide
DEEEIRTTNPVATEQYGSVNSETNNLDQRGNR

SEQ ID NO: 18903 - protein, 29 aa, Artificial Sequence
  Description of Artificial Sequence: Synthetic peptide
DEEEIRTTNPVATEQYGSVSTNWQDRGTS

SEQ ID NO: 18904 - protein, 28 aa, Artificial Sequence
  Description of Artificial Sequence: Synthetic peptide
DEEEIRATNPVATEQYGVVSTNLQSGNY

SEQ ID NO: 18905 - protein, 28 aa, Artificial Sequence
  Description of Artificial Sequence: Synthetic peptide
DEEEIRTTNPVATEQYGSVSTDPQIGNV

SEQ ID NO: 18906 - protein, 28 aa, Artificial Sequence
  Description of Artificial Sequence: Synthetic peptide
DEEEIRTTNPVATELYGVVSTNLEHGNR

SEQ ID NO: 18907 - protein, 29 aa, Artificial Sequence
  Description of Artificial Sequence: Synthetic peptide
DDEEIRTTNPVATEQYGWVSATNMQRGNR

SEQ ID NO: 18908 - protein, 28 aa, Artificial Sequence
  Description of Artificial Sequence: Synthetic peptide
DECEIRTVNPVATEQYGSVSTNLQRPNP

SEQ ID NO: 18909 - protein, 31 aa, Artificial Sequence
  Description of Artificial Sequence: Synthetic polypeptide
DEEEIRTTNPVATEQYGSVCSTNLQLRNGND

SEQ ID NO: 18910 - protein, 28 aa, Artificial Sequence
  Description of Artificial Sequence: Synthetic peptide
DEEEIRTTNPVASEQYGSVGENLQQGNR

SEQ ID NO: 18911 - protein, 30 aa, Artificial Sequence
  Description of Artificial Sequence: Synthetic polypeptide
DETEIRTTNPVATEQYGSVSMTNLQSGENR

SEQ ID NO: 18912 - protein, 28 aa, Artificial Sequence
  Description of Artificial Sequence: Synthetic peptide
DENEIRATNPVATEMYGVVSTNLQRGNR

SEQ ID NO: 18913 - protein, 28 aa, Artificial Sequence
  Description of Artificial Sequence: Synthetic peptide
KEEEIRTTNPVATQQYGSVSTDLQRGER

SEQ ID NO: 18914 - protein, 28 aa, Artificial Sequence
  Description of Artificial Sequence: Synthetic peptide
NEEEIRTTNPVATEQYGTVSTDDQRGNR

SEQ ID NO: 18915 - protein, 28 aa, Artificial Sequence
  Description of Artificial Sequence: Synthetic peptide
QEEEISTTNPVATEQYGSVSNTLQRGNR

SEQ ID NO: 18916 - protein, 28 aa, Artificial Sequence
  Description of Artificial Sequence: Synthetic peptide
DEFEIRTTNPVATEQYGSVSTTLQRMER

SEQ ID NO: 18917 - protein, 28 aa, Artificial Sequence
  Description of Artificial Sequence: Synthetic peptide
DEEEIRTTNPVATEQYGSVSTCLNRVNS

SEQ ID NO: 18918 - protein, 28 aa, Artificial Sequence
  Description of Artificial Sequence: Synthetic peptide
DEEEIRTTNPVATETYGSVSTNWQGGNA

SEQ ID NO: 18919 - protein, 30 aa, Artificial Sequence
  Description of Artificial Sequence: Synthetic polypeptide
DEEEIRTTNPVATEQYGSVSETELQTGDNR

SEQ ID NO: 18920 - protein, 29 aa, Artificial Sequence
  Description of Artificial Sequence: Synthetic peptide
DEEEIVTTNPAATEQYGSVSTNLQNGNTR

SEQ ID NO: 18921 - protein, 28 aa, Artificial Sequence
  Description of Artificial Sequence: Synthetic peptide
DEEEIRTTNPVATECYGVVSTNLQPGNF

SEQ ID NO: 18922 - protein, 31 aa, Artificial Sequence
  Description of Artificial Sequence: Synthetic polypeptide
DEEEIRQTNPVATEQYGSVSDTNLQRNGDNR

SEQ ID NO: 18923 - protein, 28 aa, Artificial Sequence
  Description of Artificial Sequence: Synthetic peptide
DENEIRTTNPFATEQYGSVSTNLQVGND

SEQ ID NO: 18924 - protein, 28 aa, Artificial Sequence
  Description of Artificial Sequence: Synthetic peptide
DEEEIATTNPCATEQYGSVSTNLQHENR

SEQ ID NO: 18925 - protein, 30 aa, Artificial Sequence
  Description of Artificial Sequence: Synthetic polypeptide
DEEEIRTTNPVATEQYGSHVHTNPLQRGNP

SEQ ID NO: 18926 - protein, 28 aa, Artificial Sequence
  Description of Artificial Sequence: Synthetic peptide
DEQEIRCTNPVASEIYGSVSTNLQRGNR

SEQ ID NO: 18927 - protein, 28 aa, Artificial Sequence
  Description of Artificial Sequence: Synthetic peptide
DENEIRTTNPVATEQYGSVSTDLQQGNM

SEQ ID NO: 18928 - protein, 28 aa, Artificial Sequence
  Description of Artificial Sequence: Synthetic peptide
DEEEIVTTNPVATECYGSVSTNLQTGNQ

SEQ ID NO: 18929 - protein, 30 aa, Artificial Sequence
  Description of Artificial Sequence: Synthetic polypeptide
DEEEIRTTNPVATEMYGSVSTNEQDRGDNR

SEQ ID NO: 18930 - protein, 30 aa, Artificial Sequence
  Description of Artificial Sequence: Synthetic polypeptide
DEEEIRTTNPCATEQYGSVSTDLQQTRGNR

SEQ ID NO: 18931 - protein, 29 aa, Artificial Sequence
  Description of Artificial Sequence: Synthetic peptide
DEEEIRTTNPVATEQYGSVSATNLQQPER

SEQ ID NO: 18932 - protein, 30 aa, Artificial Sequence
  Description of Artificial Sequence: Synthetic polypeptide
DEEEIRTTNPVATEQYGSVSATNLQHAENR

SEQ ID NO: 18933 - protein, 28 aa, Artificial Sequence
  Description of Artificial Sequence: Synthetic peptide
DEEEIRTTNPVATEQYWSVSTPLEPGNR

SEQ ID NO: 18934 - protein, 29 aa, Artificial Sequence
  Description of Artificial Sequence: Synthetic peptide
DEEMIRTTNPVAMEQYGSVSTNLQIEGNR

SEQ ID NO: 18935 - protein, 28 aa, Artificial Sequence
  Description of Artificial Sequence: Synthetic peptide
DENEIRTTNPVATEQYGSVSTELERGNW

SEQ ID NO: 18936 - protein, 29 aa, Artificial Sequence
  Description of Artificial Sequence: Synthetic peptide
DEEEIRTTNPVATEQYGVMSTNLQDGGNR

SEQ ID NO: 18937 - protein, 28 aa, Artificial Sequence
  Description of Artificial Sequence: Synthetic peptide
DEEEIRTTNPVATEQYWSVSTNLQDGEP

SEQ ID NO: 18938 - protein, 28 aa, Artificial Sequence
  Description of Artificial Sequence: Synthetic peptide
DEEEIRTTNPVATEQYGSVSTEPQRENP

SEQ ID NO: 18939 - protein, 28 aa, Artificial Sequence
  Description of Artificial Sequence: Synthetic peptide
DEEEIRATNPTATEQYGSVSTNEQRGNF

SEQ ID NO: 18940 - protein, 28 aa, Artificial Sequence
  Description of Artificial Sequence: Synthetic peptide
DEEEIRTVNPVATEQYGSVSTELQFGNV

SEQ ID NO: 18941 - protein, 31 aa, Artificial Sequence
  Description of Artificial Sequence: Synthetic polypeptide
DEEEIRTTNPVATEQYGSVSTNNLTQMRGNY

SEQ ID NO: 18942 - protein, 29 aa, Artificial Sequence
  Description of Artificial Sequence: Synthetic peptide
DEEEIRTTNPVGTEQYGSVSTGNLQLGNF

SEQ ID NO: 18943 - protein, 29 aa, Artificial Sequence
  Description of Artificial Sequence: Synthetic peptide
DEEEIRATNPVATAQYGSVSTNGLQRLNR

SEQ ID NO: 18944 - protein, 28 aa, Artificial Sequence
  Description of Artificial Sequence: Synthetic peptide
DEEEIRTTNPVATEIYGVVATNLERGNR

SEQ ID NO: 18945 - protein, 29 aa, Artificial Sequence
  Description of Artificial Sequence: Synthetic peptide
DEEEIRTTNPVATEQYGSVSDNLQMGNDN

SEQ ID NO: 18946 - protein, 28 aa, Artificial Sequence
  Description of Artificial Sequence: Synthetic peptide
DEEEIRTTNPVATEQYGSVSENLQWGDL

SEQ ID NO: 18947 - protein, 28 aa, Artificial Sequence
  Description of Artificial Sequence: Synthetic peptide
DEEEIRTTNPVATEQYGSVSEDLQIGNM

SEQ ID NO: 18948 - protein, 30 aa, Artificial Sequence
  Description of Artificial Sequence: Synthetic polypeptide
DEEAIRTTNPVATEQYLGSVSLNLQRGENR

SEQ ID NO: 18949 - protein, 28 aa, Artificial Sequence
  Description of Artificial Sequence: Synthetic peptide
DEEEIRSTNPVATEQYGFVSTNLQIGDR

SEQ ID NO: 18950 - protein, 28 aa, Artificial Sequence
  Description of Artificial Sequence: Synthetic peptide
DEEEIRTVNPEATEQYGSVSTNLQQENR

SEQ ID NO: 18951 - protein, 28 aa, Artificial Sequence
  Description of Artificial Sequence: Synthetic peptide
DEEEIRTTNPVATEQYWSVETNGQRGER

SEQ ID NO: 18952 - protein, 28 aa, Artificial Sequence
  Description of Artificial Sequence: Synthetic peptide
DEEEIRTTNPVATEQYGSVSTELQWGEY

SEQ ID NO: 18953 - protein, 30 aa, Artificial Sequence
  Description of Artificial Sequence: Synthetic polypeptide
DEEEIRTTNPVATEQYGSVSTCNEQRGVNH

SEQ ID NO: 18954 - protein, 30 aa, Artificial Sequence
  Description of Artificial Sequence: Synthetic polypeptide
DEEEIRTTNPVATEQYGSVSCTNLQCYGNC

SEQ ID NO: 18955 - protein, 29 aa, Artificial Sequence
  Description of Artificial Sequence: Synthetic peptide
DEEEIRTTNPVATEQWGSVSTNLQMQGNM

SEQ ID NO: 18956 - protein, 29 aa, Artificial Sequence
  Description of Artificial Sequence: Synthetic peptide
DEEEIRTTNPVATEQWGSVSTNDQNRGNW

SEQ ID NO: 18957 - protein, 28 aa, Artificial Sequence
  Description of Artificial Sequence: Synthetic peptide
DESEIRTTNPVATEQYGSVSTPLQQGNF

SEQ ID NO: 18958 - protein, 28 aa, Artificial Sequence
  Description of Artificial Sequence: Synthetic peptide
DEEEIRTTNPVATEQYGSVSTDPIVGNR

SEQ ID NO: 18959 - protein, 28 aa, Artificial Sequence
  Description of Artificial Sequence: Synthetic peptide
DEQEIRTTNPVATECYGSVSTDLQRGNM

SEQ ID NO: 18960 - protein, 28 aa, Artificial Sequence
  Description of Artificial Sequence: Synthetic peptide
DEEEIRTTNPVATDQYGSVSTELQLDNR

SEQ ID NO: 18961 - protein, 28 aa, Artificial Sequence
  Description of Artificial Sequence: Synthetic peptide
DEEEVRCTNPVSTEQYGCVSTNLQRGNR

SEQ ID NO: 18962 - protein, 30 aa, Artificial Sequence
  Description of Artificial Sequence: Synthetic polypeptide
DEEEIRTTNPVATEQYGSVSTNDQRNGDNA

SEQ ID NO: 18963 - protein, 28 aa, Artificial Sequence
  Description of Artificial Sequence: Synthetic peptide
DEQEIRTTNPVATEQYGSVSDNLGNGNR

SEQ ID NO: 18964 - protein, 28 aa, Artificial Sequence
  Description of Artificial Sequence: Synthetic peptide
DEQEIRTTNPVATEQYGDVSEDLQRGNR

SEQ ID NO: 18965 - protein, 28 aa, Artificial Sequence
  Description of Artificial Sequence: Synthetic peptide
DEEEIATTNPVATEQYGSVSTNLQIENF

SEQ ID NO: 18966 - protein, 28 aa, Artificial Sequence
  Description of Artificial Sequence: Synthetic peptide
DENEIRTVNPVATECYGSVSTNLQAGNR

SEQ ID NO: 18967 - protein, 28 aa, Artificial Sequence
  Description of Artificial Sequence: Synthetic peptide
DETEIRTVNPVATENYGTVSTNLQRGNR

SEQ ID NO: 18968 - protein, 28 aa, Artificial Sequence
  Description of Artificial Sequence: Synthetic peptide
SEEEIRTTNPVATEQYGSVSTNEQQGNE

SEQ ID NO: 18969 - protein, 28 aa, Artificial Sequence
  Description of Artificial Sequence: Synthetic peptide
DEEEIRTTNPYAMEQYGSVHTNLQPGNR

SEQ ID NO: 18970 - protein, 28 aa, Artificial Sequence
  Description of Artificial Sequence: Synthetic peptide
DEEEIRTTNPVATEGYGSVSTNCQHGER

SEQ ID NO: 18971 - protein, 28 aa, Artificial Sequence
  Description of Artificial Sequence: Synthetic peptide
DEEEIRATNPVAYEQYGVVSTNFQRGNR

SEQ ID NO: 18972 - protein, 28 aa, Artificial Sequence
  Description of Artificial Sequence: Synthetic peptide
DEEEIRCTNPVATEQYGSVSTNEQRGDQ

SEQ ID NO: 18973 - protein, 29 aa, Artificial Sequence
  Description of Artificial Sequence: Synthetic peptide
YEEEIRTTNPVATEQYGTISCTNLQRGNR

SEQ ID NO: 18974 - protein, 30 aa, Artificial Sequence
  Description of Artificial Sequence: Synthetic polypeptide
DMEEICTTNPVATEQYGSCVSTNLQRGGNR

SEQ ID NO: 18975 - protein, 29 aa, Artificial Sequence
  Description of Artificial Sequence: Synthetic peptide
DENEIRTTNPVATEQWGSVSTNLQMRGNA

SEQ ID NO: 18976 - protein, 30 aa, Artificial Sequence
  Description of Artificial Sequence: Synthetic polypeptide
DEGEIRTTNPVATEHYGSVSTNLQRDGNDR

SEQ ID NO: 18977 - protein, 28 aa, Artificial Sequence
  Description of Artificial Sequence: Synthetic peptide
DEEEIRTTNPVATCCWGSVSTNLLRGNR

SEQ ID NO: 18978 - protein, 28 aa, Artificial Sequence
  Description of Artificial Sequence: Synthetic peptide
DEEEIRTTNPVATECYGSVSTDLQLGNI

SEQ ID NO: 18979 - protein, 28 aa, Artificial Sequence
  Description of Artificial Sequence: Synthetic peptide
DENEIRTTNPVATEQYGSVSTNLMRGQQ

SEQ ID NO: 18980 - protein, 28 aa, Artificial Sequence
  Description of Artificial Sequence: Synthetic peptide
DEVEIVTTNPAATEQYGSVSTNLQNGNR

SEQ ID NO: 18981 - protein, 29 aa, Artificial Sequence
  Description of Artificial Sequence: Synthetic peptide
DEMEIRTTNPVATECYGSVSTNLQREGNL

SEQ ID NO: 18982 - protein, 28 aa, Artificial Sequence
  Description of Artificial Sequence: Synthetic peptide
DEEEIRTTNPTATEQYGSVSTNEQLGNQ

SEQ ID NO: 18983 - protein, 29 aa, Artificial Sequence
  Description of Artificial Sequence: Synthetic peptide
DEEEIRTTNPVATECYGSVSTELQVGNDR

SEQ ID NO: 18984 - protein, 28 aa, Artificial Sequence
  Description of Artificial Sequence: Synthetic peptide
DEDEIRTTNPVATEQYGSVSTNLQQGTA

SEQ ID NO: 18985 - protein, 28 aa, Artificial Sequence
  Description of Artificial Sequence: Synthetic peptide
DEEEIRTTNPTATEQYGSVSTNEQNGNG

SEQ ID NO: 18986 - protein, 28 aa, Artificial Sequence
  Description of Artificial Sequence: Synthetic peptide
DENEIRTTNPVATEQYGSVSTDLQSGNT

SEQ ID NO: 18987 - protein, 28 aa, Artificial Sequence
  Description of Artificial Sequence: Synthetic peptide
DEEEIRTTNPVATEQYGSVETPLERGER

SEQ ID NO: 18988 - protein, 28 aa, Artificial Sequence
  Description of Artificial Sequence: Synthetic peptide
NEQEIRTTNPVATEIYGCVSTNLQRGNR

SEQ ID NO: 18989 - protein, 31 aa, Artificial Sequence
  Description of Artificial Sequence: Synthetic polypeptide
DEEEIRTTNPVATEQYGSVSTDNLQESKGNR

SEQ ID NO: 18990 - protein, 30 aa, Artificial Sequence
  Description of Artificial Sequence: Synthetic polypeptide
DEEEIATTNPVATEQYGSVSTMNLQDIGNR

SEQ ID NO: 18991 - protein, 28 aa, Artificial Sequence
  Description of Artificial Sequence: Synthetic peptide
DEEEIAATNPVSTEQYGSVSTVLQRGNR

SEQ ID NO: 18992 - protein, 28 aa, Artificial Sequence
  Description of Artificial Sequence: Synthetic peptide
CEEEIRTTNPVATEVYGSVSTNLQRENM

SEQ ID NO: 18993 - protein, 28 aa, Artificial Sequence
  Description of Artificial Sequence: Synthetic peptide
DEEEIRTTNPVATEQYGSVSTNPDVGER

SEQ ID NO: 18994 - protein, 29 aa, Artificial Sequence
  Description of Artificial Sequence: Synthetic peptide
DEEEIVTTNPVATEQYGSVSTNLQPQGNL

SEQ ID NO: 18995 - protein, 28 aa, Artificial Sequence
  Description of Artificial Sequence: Synthetic peptide
DESEIRTTNPVATEKYGSNSTNLQRGNH

SEQ ID NO: 18996 - protein, 28 aa, Artificial Sequence
  Description of Artificial Sequence: Synthetic peptide
DEDELVTTNPVATEQYGNVSTNLQRGNR

SEQ ID NO: 18997 - protein, 29 aa, Artificial Sequence
  Description of Artificial Sequence: Synthetic peptide
DEEEIRATNPVATEQYGWVSTNQQCRGNR

SEQ ID NO: 18998 - protein, 28 aa, Artificial Sequence
  Description of Artificial Sequence: Synthetic peptide
QEEEIATTNPVATECYGSASTNLQRGNR

SEQ ID NO: 18999 - protein, 29 aa, Artificial Sequence
  Description of Artificial Sequence: Synthetic peptide
DEEEIRTTNPVATEQYGSVSTLDLQMGNS

SEQ ID NO: 19000 - protein, 29 aa, Artificial Sequence
  Description of Artificial Sequence: Synthetic peptide
SLEEIRTTNPVATAQYGSVSTNLQREGNR

SEQ ID NO: 19001 - protein, 28 aa, Artificial Sequence
  Description of Artificial Sequence: Synthetic peptide
DEEEIRTTNPVATEQWGSVSTNEMRGNQ

SEQ ID NO: 19002 - protein, 28 aa, Artificial Sequence
  Description of Artificial Sequence: Synthetic peptide
DEEEIRTTNPTATEQYGSVSTNPQIGNN

SEQ ID NO: 19003 - protein, 29 aa, Artificial Sequence
  Description of Artificial Sequence: Synthetic peptide
DEEEIRTTNPVATEQYGDVSENLQCQGNR

SEQ ID NO: 19004 - protein, 28 aa, Artificial Sequence
  Description of Artificial Sequence: Synthetic peptide
DEEEIRTTNPVATEQYGSVSTELQNGEG

SEQ ID NO: 19005 - protein, 28 aa, Artificial Sequence
  Description of Artificial Sequence: Synthetic peptide
DEEEIRTTNPVATEQYGSVSTNLEVGEI

SEQ ID NO: 19006 - protein, 28 aa, Artificial Sequence
  Description of Artificial Sequence: Synthetic peptide
DEEEIRTTNPAATEQFGSVSTNEQRGNS

SEQ ID NO: 19007 - protein, 29 aa, Artificial Sequence
  Description of Artificial Sequence: Synthetic peptide
DEEEIRTTNPVATEQYGTVSTNLQQNGNH

SEQ ID NO: 19008 - protein, 28 aa, Artificial Sequence
  Description of Artificial Sequence: Synthetic peptide
DENEIASTNPVATEQYGTVSTNLQRGNR

SEQ ID NO: 19009 - protein, 30 aa, Artificial Sequence
  Description of Artificial Sequence: Synthetic polypeptide
DEEEIRTTNPVATECYGSVSTNLQERGDDR

SEQ ID NO: 19010 - protein, 28 aa, Artificial Sequence
  Description of Artificial Sequence: Synthetic peptide
DEEEIRTTNPVATEQYGSVSTELCNGNQ

SEQ ID NO: 19011 - protein, 31 aa, Artificial Sequence
  Description of Artificial Sequence: Synthetic polypeptide
DEEEIRTTNPVATEQYGSVDSETPNLQQGNR

SEQ ID NO: 19012 - protein, 28 aa, Artificial Sequence
  Description of Artificial Sequence: Synthetic peptide
DESEIATTNPVATEGYGSVSTNLQRGNI

SEQ ID NO: 19013 - protein, 28 aa, Artificial Sequence
  Description of Artificial Sequence: Synthetic peptide
QEEEIRATNPVCTEVYGSVSTNLQRGNR

SEQ ID NO: 19014 - protein, 28 aa, Artificial Sequence
  Description of Artificial Sequence: Synthetic peptide
DEEEIRTTNPVATEQYGDASENLQRGGR

SEQ ID NO: 19015 - protein, 30 aa, Artificial Sequence
  Description of Artificial Sequence: Synthetic polypeptide
DEEEIRTTNPVATEQYGSVSTNLVQVLGNV

SEQ ID NO: 19016 - protein, 29 aa, Artificial Sequence
  Description of Artificial Sequence: Synthetic peptide
DEQEIRCTNPVATEQYGAVSATNLQRGNR

SEQ ID NO: 19017 - protein, 32 aa, Artificial Sequence
  Description of Artificial Sequence: Synthetic polypeptide
DEEEIRTTNPVATEQYGSVSITNLVQRKGNDR

SEQ ID NO: 19018 - protein, 30 aa, Artificial Sequence
  Description of Artificial Sequence: Synthetic polypeptide
DEEEIRTTNPVSTEQYGGVSATNLQMRGNR

SEQ ID NO: 19019 - protein, 29 aa, Artificial Sequence
  Description of Artificial Sequence: Synthetic peptide
DEEEIRTTNPVATEQWGSVSTNEQRGNDA

SEQ ID NO: 19020 - protein, 28 aa, Artificial Sequence
  Description of Artificial Sequence: Synthetic peptide
QEEEIRTTNPVATEQYGSVSTELQQGNM

SEQ ID NO: 19021 - protein, 28 aa, Artificial Sequence
  Description of Artificial Sequence: Synthetic peptide
DEEEIRTTNPVATEQYGGVSTAGQRGPR

SEQ ID NO: 19022 - protein, 30 aa, Artificial Sequence
  Description of Artificial Sequence: Synthetic polypeptide
DEEEIRTTNPVATEQYGSVSTNPLQENGNF

SEQ ID NO: 19023 - protein, 28 aa, Artificial Sequence
  Description of Artificial Sequence: Synthetic peptide
DEEEIRTTNPVATEQYGSVSTDLEVGNW

SEQ ID NO: 19024 - protein, 28 aa, Artificial Sequence
  Description of Artificial Sequence: Synthetic peptide
DEEEIRTVNPVATEQYGSVSTDLQRGEL

SEQ ID NO: 19025 - protein, 28 aa, Artificial Sequence
  Description of Artificial Sequence: Synthetic peptide
SEEEIRTTNPEATETYGSVSTNLQRGNI

SEQ ID NO: 19026 - protein, 28 aa, Artificial Sequence
  Description of Artificial Sequence: Synthetic peptide
DEEEIYTTNPVCTEHYGSVSTNLQRGNS

SEQ ID NO: 19027 - protein, 28 aa, Artificial Sequence
  Description of Artificial Sequence: Synthetic peptide
DEEEIRTTNPVATEQYGSVSANLQSGPE

SEQ ID NO: 19028 - protein, 28 aa, Artificial Sequence
  Description of Artificial Sequence: Synthetic peptide
DEEEIATTNPVATEQYGSVSTDLQRGEF

SEQ ID NO: 19029 - protein, 28 aa, Artificial Sequence
  Description of Artificial Sequence: Synthetic peptide
DEEEIRTTNPVATEQYGVVSTNLCTGNQ

SEQ ID NO: 19030 - protein, 28 aa, Artificial Sequence
  Description of Artificial Sequence: Synthetic peptide
DEQEIRTTNPVATECYGSVSNNLQRGNI

SEQ ID NO: 19031 - protein, 28 aa, Artificial Sequence
  Description of Artificial Sequence: Synthetic peptide
DENEIRTTNPVATEQWGSVSENLQRGNW

SEQ ID NO: 19032 - protein, 28 aa, Artificial Sequence
  Description of Artificial Sequence: Synthetic peptide
DEDEIRTVNPVATEQYGGVGTNLQRGNR

SEQ ID NO: 19033 - protein, 28 aa, Artificial Sequence
  Description of Artificial Sequence: Synthetic peptide
DEGEIRTTNPAATEQYGSVSTNGQRGTR

SEQ ID NO: 19034 - protein, 28 aa, Artificial Sequence
  Description of Artificial Sequence: Synthetic peptide
DEEEIRTTNPVANEQYGKVSTNLQTGNQ

SEQ ID NO: 19035 - protein, 28 aa, Artificial Sequence
  Description of Artificial Sequence: Synthetic peptide
DEEEIRTTNPVATEQYGWASDVLQRGNR

SEQ ID NO: 19036 - protein, 28 aa, Artificial Sequence
  Description of Artificial Sequence: Synthetic peptide
DEEELRSTNPVATESFGSVSTNLQRGNR

SEQ ID NO: 19037 - protein, 29 aa, Artificial Sequence
  Description of Artificial Sequence: Synthetic peptide
DEAEIRTTNPVATEQYGSTSTNGDQRGNR

SEQ ID NO: 19038 - protein, 28 aa, Artificial Sequence
  Description of Artificial Sequence: Synthetic peptide
DEEEIRTTNPVSYSQYGSVSTNLQRLNR

SEQ ID NO: 19039 - protein, 28 aa, Artificial Sequence
  Description of Artificial Sequence: Synthetic peptide
DEEEIRTTNPVCTEQYGSVSTELQVGNY

SEQ ID NO: 19040 - protein, 31 aa, Artificial Sequence
  Description of Artificial Sequence: Synthetic polypeptide
DEEEIRTTNPVATEQYGSVSDNLQDRGDNWR

SEQ ID NO: 19041 - protein, 30 aa, Artificial Sequence
  Description of Artificial Sequence: Synthetic polypeptide
DEEEIRTTNPVATEVYGSVSTNLQQLWGNR

SEQ ID NO: 19042 - protein, 29 aa, Artificial Sequence
  Description of Artificial Sequence: Synthetic peptide
DENEIRATNPVATEQYGSVSTDLQERGNR

SEQ ID NO: 19043 - protein, 31 aa, Artificial Sequence
  Description of Artificial Sequence: Synthetic polypeptide
DEEEIRTTNPVATEQYGSVSTMNLQDIGDNR

SEQ ID NO: 19044 - protein, 29 aa, Artificial Sequence
  Description of Artificial Sequence: Synthetic peptide
DEEEIRTTNPVATEQYGSVSCTNLCSGNM

SEQ ID NO: 19045 - protein, 28 aa, Artificial Sequence
  Description of Artificial Sequence: Synthetic peptide
DEEEIRQTNPVATEQYGSVSTNLGSGNQ

SEQ ID NO: 19046 - protein, 28 aa, Artificial Sequence
  Description of Artificial Sequence: Synthetic peptide
DEEEIRTTNPVATEQYGSWSDNDQRGNS

SEQ ID NO: 19047 - protein, 29 aa, Artificial Sequence
  Description of Artificial Sequence: Synthetic peptide
DEEEIRTTNPVSTEQYGSVSTNLETGNDR

SEQ ID NO: 19048 - protein, 28 aa, Artificial Sequence
  Description of Artificial Sequence: Synthetic peptide
AEQEIATTNPVATEQYGVVSTNLQRGNR

SEQ ID NO: 19049 - protein, 30 aa, Artificial Sequence
  Description of Artificial Sequence: Synthetic polypeptide
DEQEIRTTNPVATEQYGWVSTNLQQRGNDR

SEQ ID NO: 19050 - protein, 28 aa, Artificial Sequence
  Description of Artificial Sequence: Synthetic peptide
DEEEIRTTNPTATEQYGSVSTNEQFGNF

SEQ ID NO: 19051 - protein, 28 aa, Artificial Sequence
  Description of Artificial Sequence: Synthetic peptide
DEEEIRTTNPVATEQYGSVSTDLQIGEQ

SEQ ID NO: 19052 - protein, 28 aa, Artificial Sequence
  Description of Artificial Sequence: Synthetic peptide
DEEEIKSTNPVATEQYGSVATNLQRGLR

SEQ ID NO: 19053 - protein, 29 aa, Artificial Sequence
  Description of Artificial Sequence: Synthetic peptide
DEEEIRTTNPVYTEQYGSVSTELQQRGGR

SEQ ID NO: 19054 - protein, 28 aa, Artificial Sequence
  Description of Artificial Sequence: Synthetic peptide
DEEEIRTTNPVATEQYGSVSTGLCRGEN

SEQ ID NO: 19055 - protein, 28 aa, Artificial Sequence
  Description of Artificial Sequence: Synthetic peptide
DEEEIRTTNPVATEQYGWVSTLLQHGGR

SEQ ID NO: 19056 - protein, 28 aa, Artificial Sequence
  Description of Artificial Sequence: Synthetic peptide
DEDEIRTTNPVATEQYGSVSDNLQTGNC

SEQ ID NO: 19057 - protein, 29 aa, Artificial Sequence
  Description of Artificial Sequence: Synthetic peptide
DEGEIRTTNPVATECYGSVSTNLQRGNDT

SEQ ID NO: 19058 - protein, 30 aa, Artificial Sequence
  Description of Artificial Sequence: Synthetic polypeptide
DEEEIRTTNPVATEQYGCSVTSTNLERGNF

SEQ ID NO: 19059 - protein, 29 aa, Artificial Sequence
  Description of Artificial Sequence: Synthetic peptide
DEEEIRSTNPVATEGYGSVSATVLQRGNR

SEQ ID NO: 19060 - protein, 29 aa, Artificial Sequence
  Description of Artificial Sequence: Synthetic peptide
DEEEIRTTNPVATEQYGSVSMNEQQRGNI

SEQ ID NO: 19061 - protein, 28 aa, Artificial Sequence
  Description of Artificial Sequence: Synthetic peptide
DEEEIRTTNPVATEQYGDVSTNLVAGNH

SEQ ID NO: 19062 - protein, 28 aa, Artificial Sequence
  Description of Artificial Sequence: Synthetic peptide
DEEEIRTTNPVATEQYGSVSTPDQEGNQ

SEQ ID NO: 19063 - protein, 30 aa, Artificial Sequence
  Description of Artificial Sequence: Synthetic polypeptide
HEEEIRCTNPVATEQYGSVSTNLQNRGTNR

SEQ ID NO: 19064 - protein, 29 aa, Artificial Sequence
  Description of Artificial Sequence: Synthetic peptide
DEEEIRTTNPVASEQYGWVSADNLQRGNR

SEQ ID NO: 19065 - protein, 30 aa, Artificial Sequence
  Description of Artificial Sequence: Synthetic polypeptide
DEEEIRTTNPVATEQYGSVSTDLQTNGNDR

SEQ ID NO: 19066 - protein, 32 aa, Artificial Sequence
  Description of Artificial Sequence: Synthetic polypeptide
DEEEIRTTNPVATEQYGSVDSTNPLVQREGNR

SEQ ID NO: 19067 - protein, 28 aa, Artificial Sequence
  Description of Artificial Sequence: Synthetic peptide
DEEEIMTTNPVATECYGSVSTNLQNGDR

SEQ ID NO: 19068 - protein, 31 aa, Artificial Sequence
  Description of Artificial Sequence: Synthetic polypeptide
DEEEIRTTNPVATEQYGSVSTENLEEREGNR

SEQ ID NO: 19069 - protein, 29 aa, Artificial Sequence
  Description of Artificial Sequence: Synthetic peptide
SEEEIRTTNPVATEQYGSVSTNPQHGNTR

SEQ ID NO: 19070 - protein, 28 aa, Artificial Sequence
  Description of Artificial Sequence: Synthetic peptide
DEEEIRTTNPVATEQWGSVSTPDERGNR

SEQ ID NO: 19071 - protein, 28 aa, Artificial Sequence
  Description of Artificial Sequence: Synthetic peptide
DEETIRTTNPVATEQYWSVSTNLQDGNP

SEQ ID NO: 19072 - protein, 28 aa, Artificial Sequence
  Description of Artificial Sequence: Synthetic peptide
DEEEIATTNPVATEQYGSVSLNLQQGNF

SEQ ID NO: 19073 - protein, 31 aa, Artificial Sequence
  Description of Artificial Sequence: Synthetic polypeptide
DEEEIRTTNPVATEQYGSVSTNLQEDNGNDR

SEQ ID NO: 19074 - protein, 31 aa, Artificial Sequence
  Description of Artificial Sequence: Synthetic polypeptide
DEEEIRTTNPVATESYGSVSMTNLQIREGNR

SEQ ID NO: 19075 - protein, 28 aa, Artificial Sequence
  Description of Artificial Sequence: Synthetic peptide
DEEEIATTNPVATEQYGSVSTELQIGNY

SEQ ID NO: 19076 - protein, 30 aa, Artificial Sequence
  Description of Artificial Sequence: Synthetic polypeptide
DEEEIRTTNPVATEQYGSVSTNLQENGNDT

SEQ ID NO: 19077 - protein, 28 aa, Artificial Sequence
  Description of Artificial Sequence: Synthetic peptide
DEEEIRTTNPTATEQYGSVSTNEQQGNL

SEQ ID NO: 19078 - protein, 29 aa, Artificial Sequence
  Description of Artificial Sequence: Synthetic peptide
DEEEIRTTNPVATECYGSVSTNLQYNGNE

SEQ ID NO: 19079 - protein, 29 aa, Artificial Sequence
  Description of Artificial Sequence: Synthetic peptide
DEDEISTTNPVATEQYGSVSAENLQRGNR

SEQ ID NO: 19080 - protein, 31 aa, Artificial Sequence
  Description of Artificial Sequence: Synthetic polypeptide
DEEEIRTTNPVATEQYGEVISTANLQRGNTR

SEQ ID NO: 19081 - protein, 28 aa, Artificial Sequence
  Description of Artificial Sequence: Synthetic peptide
QEEEIRTTNPVATEQYGDVSTVLQRGER

SEQ ID NO: 19082 - protein, 31 aa, Artificial Sequence
  Description of Artificial Sequence: Synthetic polypeptide
DEEEIRTTNPTATEQYGSVSTGNLQLRGNDR

SEQ ID NO: 19083 - protein, 32 aa, Artificial Sequence
  Description of Artificial Sequence: Synthetic polypeptide
DEEEIRTTNPVATEQYGSVSITPNLVQLRGNR

SEQ ID NO: 19084 - protein, 29 aa, Artificial Sequence
  Description of Artificial Sequence: Synthetic peptide
DEEEIRTVNPVATEQYGSVSTNLQQGEDR

SEQ ID NO: 19085 - protein, 30 aa, Artificial Sequence
  Description of Artificial Sequence: Synthetic polypeptide
DEEEIRTTNPVATEQYGSVSTNLQNEGNDM

SEQ ID NO: 19086 - protein, 28 aa, Artificial Sequence
  Description of Artificial Sequence: Synthetic peptide
DEEEIRTTNPVATEQYGSVGNNLQRGTQ

SEQ ID NO: 19087 - protein, 28 aa, Artificial Sequence
  Description of Artificial Sequence: Synthetic peptide
DEEEIRTTNPVATEQYGEAGTMLQRGNR

SEQ ID NO: 19088 - protein, 28 aa, Artificial Sequence
  Description of Artificial Sequence: Synthetic peptide
DESEIRATNPVATEQYGWVSTNLQRGNC

SEQ ID NO: 19089 - protein, 28 aa, Artificial Sequence
  Description of Artificial Sequence: Synthetic peptide
SEEEIRTTNPVATEQYGTVSTNEQNGNR

SEQ ID NO: 19090 - protein, 28 aa, Artificial Sequence
  Description of Artificial Sequence: Synthetic peptide
QEEEIRTTNPVATEQYGSVSENEQRGNL

SEQ ID NO: 19091 - protein, 29 aa, Artificial Sequence
  Description of Artificial Sequence: Synthetic peptide
DEEEIKTTNPVATEQYGSTTTNLQFRGNR

SEQ ID NO: 19092 - protein, 28 aa, Artificial Sequence
  Description of Artificial Sequence: Synthetic peptide
DEEEIVTTNPVATFMYGSVSTNLQQGNR

SEQ ID NO: 19093 - protein, 28 aa, Artificial Sequence
  Description of Artificial Sequence: Synthetic peptide
DEEEIRTTNPVATEQYGSVETPLEPGNR

SEQ ID NO: 19094 - protein, 28 aa, Artificial Sequence
  Description of Artificial Sequence: Synthetic peptide
VEEEIRTTNPVATELYGCVATNLQRGNR

SEQ ID NO: 19095 - protein, 28 aa, Artificial Sequence
  Description of Artificial Sequence: Synthetic peptide
DEEEIRTTNPIATEVYGSVSTNQQRGDR

SEQ ID NO: 19096 - protein, 28 aa, Artificial Sequence
  Description of Artificial Sequence: Synthetic peptide
QEQEIRTVNPVATEQYGSVSTNLQYGNR

SEQ ID NO: 19097 - protein, 31 aa, Artificial Sequence
  Description of Artificial Sequence: Synthetic polypeptide
DEEEIRTTNPVATEQYGSVSTNLQEREGNDF

SEQ ID NO: 19098 - protein, 28 aa, Artificial Sequence
  Description of Artificial Sequence: Synthetic peptide
DEEEIRTTNPVATEQYGSVSTDLQMEER

SEQ ID NO: 19099 - protein, 28 aa, Artificial Sequence
  Description of Artificial Sequence: Synthetic peptide
DEMEIRTTNPVATEQYGSVSTDLQMGNQ

SEQ ID NO: 19100 - protein, 29 aa, Artificial Sequence
  Description of Artificial Sequence: Synthetic peptide
DEEEIRTTNPVATECYGSVSTDLQIRGNN

SEQ ID NO: 19101 - protein, 28 aa, Artificial Sequence
  Description of Artificial Sequence: Synthetic peptide
DENEIRTTNPVATEQYGSVSENLQLGNS

SEQ ID NO: 19102 - protein, 30 aa, Artificial Sequence
  Description of Artificial Sequence: Synthetic polypeptide
DEQEIATTNPVATEQYGSVSTNLQCRGNDR

SEQ ID NO: 19103 - protein, 28 aa, Artificial Sequence
  Description of Artificial Sequence: Synthetic peptide
DEEEIRTTNPVATEMYGSVSTELQIGNM

SEQ ID NO: 19104 - protein, 29 aa, Artificial Sequence
  Description of Artificial Sequence: Synthetic peptide
DEEEIRTTNPVATEQYGSVDTMDLQRGNF

SEQ ID NO: 19105 - protein, 28 aa, Artificial Sequence
  Description of Artificial Sequence: Synthetic peptide
DEAEITTTNPVSTEIYGSVSTNLQRGNR

SEQ ID NO: 19106 - protein, 28 aa, Artificial Sequence
  Description of Artificial Sequence: Synthetic peptide
DEEEICCTNPVATEQFGSVSTNLQQGNR

SEQ ID NO: 19107 - protein, 28 aa, Artificial Sequence
  Description of Artificial Sequence: Synthetic peptide
DEEEIRTTNPVATECYGSVSTDLQQGNY

SEQ ID NO: 19108 - protein, 32 aa, Artificial Sequence
  Description of Artificial Sequence: Synthetic polypeptide
DEEEIRTTNPVATEQYGESVSTVNLQERGENR

SEQ ID NO: 19109 - protein, 28 aa, Artificial Sequence
  Description of Artificial Sequence: Synthetic peptide
QEQEISTTNPVATEQYGWVSTNLQRGNR

SEQ ID NO: 19110 - protein, 28 aa, Artificial Sequence
  Description of Artificial Sequence: Synthetic peptide
GEEEIRTTNPVATECYGSVSTELQRGNA

SEQ ID NO: 19111 - protein, 29 aa, Artificial Sequence
  Description of Artificial Sequence: Synthetic peptide
DEIEICTTNPVATEQYGSVSVTNLQGGNR

SEQ ID NO: 19112 - protein, 31 aa, Artificial Sequence
  Description of Artificial Sequence: Synthetic polypeptide
DEEEIRTTNPVATEQFGSVSTMNLQRGDNTR

SEQ ID NO: 19113 - protein, 28 aa, Artificial Sequence
  Description of Artificial Sequence: Synthetic peptide
DEEEITTTNPVATECYGSVSENLDRGNR

SEQ ID NO: 19114 - protein, 28 aa, Artificial Sequence
  Description of Artificial Sequence: Synthetic peptide
GEHEITTTNPVATEQYGSVSTPLQRGNR

SEQ ID NO: 19115 - protein, 29 aa, Artificial Sequence
  Description of Artificial Sequence: Synthetic peptide
NEEEIRTTNPVATEQYGSVSTNWQGGNDR

SEQ ID NO: 19116 - protein, 29 aa, Artificial Sequence
  Description of Artificial Sequence: Synthetic peptide
DEEEIRTTNPTATELYGSVSENLQRAGNR

SEQ ID NO: 19117 - protein, 28 aa, Artificial Sequence
  Description of Artificial Sequence: Synthetic peptide
DEEEIRTTNPVATEQYGSVSEDLQQGNA

SEQ ID NO: 19118 - protein, 28 aa, Artificial Sequence
  Description of Artificial Sequence: Synthetic peptide
DEEEIRTVNPVATEQYGWVSTNDQRGDR

SEQ ID NO: 19119 - protein, 28 aa, Artificial Sequence
  Description of Artificial Sequence: Synthetic peptide
DEQEIRTVNPVATEVYGWVSTNLQRGNR

SEQ ID NO: 19120 - protein, 30 aa, Artificial Sequence
  Description of Artificial Sequence: Synthetic polypeptide
DEEEIRTTNPVATEQYGESVSTHNLQWGNF

SEQ ID NO: 19121 - protein, 29 aa, Artificial Sequence
  Description of Artificial Sequence: Synthetic peptide
DEEEIRTTNPVATEQYGSVCCTNPQRGDR

SEQ ID NO: 19122 - protein, 28 aa, Artificial Sequence
  Description of Artificial Sequence: Synthetic peptide
DEEEIRTTNPVATEMFGSVSTNLQIGNL

SEQ ID NO: 19123 - protein, 31 aa, Artificial Sequence
  Description of Artificial Sequence: Synthetic polypeptide
DEEEIRTTNPVATEQYGSVSTNLQDRKGEDR

SEQ ID NO: 19124 - protein, 28 aa, Artificial Sequence
  Description of Artificial Sequence: Synthetic peptide
DEEEIATVNPVATEQYGSVETNLQRGNP

SEQ ID NO: 19125 - protein, 28 aa, Artificial Sequence
  Description of Artificial Sequence: Synthetic peptide
DEEEIRTTNPVATEQYGSVSTNLDTGEM

SEQ ID NO: 19126 - protein, 28 aa, Artificial Sequence
  Description of Artificial Sequence: Synthetic peptide
DEQEITTTNPVATEQYGDVSENLQRGNR

SEQ ID NO: 19127 - protein, 28 aa, Artificial Sequence
  Description of Artificial Sequence: Synthetic peptide
DEEEIRTTNPVATECYGSVSTNLEYGER

SEQ ID NO: 19128 - protein, 28 aa, Artificial Sequence
  Description of Artificial Sequence: Synthetic peptide
DEEEIRTTNPDATQQYGSVSHPLQRGNR

SEQ ID NO: 19129 - protein, 29 aa, Artificial Sequence
  Description of Artificial Sequence: Synthetic peptide
DEEEIRTTNPVSTEQYGSVSTALQRGPND

SEQ ID NO: 19130 - protein, 30 aa, Artificial Sequence
  Description of Artificial Sequence: Synthetic polypeptide
DEEEIRTTNPDATEQYGSVSTLNLQRGNPI

SEQ ID NO: 19131 - protein, 28 aa, Artificial Sequence
  Description of Artificial Sequence: Synthetic peptide
DEEEIRCTNPDCTEQYGSVSTNLQRGNS

SEQ ID NO: 19132 - protein, 30 aa, Artificial Sequence
  Description of Artificial Sequence: Synthetic polypeptide
DEEEIRTTNPVATEQYGSVAMNNLNQRGNR

SEQ ID NO: 19133 - protein, 29 aa, Artificial Sequence
  Description of Artificial Sequence: Synthetic peptide
DEEEIRTTNPVATEIYGSVSTMALQRGNP

SEQ ID NO: 19134 - protein, 30 aa, Artificial Sequence
  Description of Artificial Sequence: Synthetic polypeptide
DEEEIRATNPVATEQYGESVSTNNEQRGNR

SEQ ID NO: 19135 - protein, 28 aa, Artificial Sequence
  Description of Artificial Sequence: Synthetic peptide
DEQEIATTNPVATEVYGVVSTNLQRGNR

SEQ ID NO: 19136 - protein, 30 aa, Artificial Sequence
  Description of Artificial Sequence: Synthetic polypeptide
DEEEIRTTNPVATEVQYGSVSTNEQFRGNE

SEQ ID NO: 19137 - protein, 28 aa, Artificial Sequence
  Description of Artificial Sequence: Synthetic peptide
DEEEIRTTNPVATEQYGSVSTDLQFGES

SEQ ID NO: 19138 - protein, 28 aa, Artificial Sequence
  Description of Artificial Sequence: Synthetic peptide
DEEEIRCTNPVATEQYGSVSTAEQRGNA

SEQ ID NO: 19139 - protein, 28 aa, Artificial Sequence
  Description of Artificial Sequence: Synthetic peptide
DEEEIRTTNPVATEQYGSVDTCDLRGNR

SEQ ID NO: 19140 - protein, 28 aa, Artificial Sequence
  Description of Artificial Sequence: Synthetic peptide
DEDEIRCTNPVATENYGSVATNLQRGNR

SEQ ID NO: 19141 - protein, 28 aa, Artificial Sequence
  Description of Artificial Sequence: Synthetic peptide
DEQEIRTTNPVATEVYGSVSTEVQRGNR

SEQ ID NO: 19142 - protein, 29 aa, Artificial Sequence
  Description of Artificial Sequence: Synthetic peptide
DEEEIRTTNPVATEQYGSVSTGEEQQGNR

SEQ ID NO: 19143 - protein, 31 aa, Artificial Sequence
  Description of Artificial Sequence: Synthetic polypeptide
DEEEIRTTNPVATEQYGSVSTVNLIQWGNPR

SEQ ID NO: 19144 - protein, 28 aa, Artificial Sequence
  Description of Artificial Sequence: Synthetic peptide
DEEEIRTTNPVSTEMYGSVSTNLQVGNM

SEQ ID NO: 19145 - protein, 30 aa, Artificial Sequence
  Description of Artificial Sequence: Synthetic polypeptide
DEEEIRTTNPVATEQYGSVAEVNLQRGFNR

SEQ ID NO: 19146 - protein, 28 aa, Artificial Sequence
  Description of Artificial Sequence: Synthetic peptide
DEEQIRTTNPVATEQYGSVSTHEQRGNT

SEQ ID NO: 19147 - protein, 30 aa, Artificial Sequence
  Description of Artificial Sequence: Synthetic polypeptide
DENEIVTTNPVATEQYGSVSTNLIQDRGNR

SEQ ID NO: 19148 - protein, 29 aa, Artificial Sequence
  Description of Artificial Sequence: Synthetic peptide
DEEEIRTTNPVATEQYGSVSTDLQHEGNL

SEQ ID NO: 19149 - protein, 31 aa, Artificial Sequence
  Description of Artificial Sequence: Synthetic polypeptide
DEEEIRTTNPVATEQYGESVTSTNLQRDGNP

SEQ ID NO: 19150 - protein, 30 aa, Artificial Sequence
  Description of Artificial Sequence: Synthetic polypeptide
DEEEIRTTNPVATEQYGSVSEDLQDREGNR

SEQ ID NO: 19151 - protein, 29 aa, Artificial Sequence
  Description of Artificial Sequence: Synthetic peptide
MEEEIRTTNPVATEQYGSVSTDLQNGNDR

SEQ ID NO: 19152 - protein, 30 aa, Artificial Sequence
  Description of Artificial Sequence: Synthetic polypeptide
NEEEIRTTNPVATEQYGSVSTNLQRAGNDS

SEQ ID NO: 19153 - protein, 30 aa, Artificial Sequence
  Description of Artificial Sequence: Synthetic polypeptide
DEEEIRTTNPVATEQYGSVTSTNQQPRGNS

SEQ ID NO: 19154 - protein, 28 aa, Artificial Sequence
  Description of Artificial Sequence: Synthetic peptide
QEVEIRTTNPVATEQFGSVSTNLQQGNR

SEQ ID NO: 19155 - protein, 28 aa, Artificial Sequence
  Description of Artificial Sequence: Synthetic peptide
CEEEIRTTNPVATEQYGSVDMNLQRGNA

SEQ ID NO: 19156 - protein, 28 aa, Artificial Sequence
  Description of Artificial Sequence: Synthetic peptide
DEEEIRTTNPVATEQYGNVSTNLQNGTV

SEQ ID NO: 19157 - protein, 28 aa, Artificial Sequence
  Description of Artificial Sequence: Synthetic peptide
DEEEIRTTNPVATEQYGSVSTDLEAGNM

SEQ ID NO: 19158 - protein, 28 aa, Artificial Sequence
  Description of Artificial Sequence: Synthetic peptide
DEEEIRTTNPVATEQYGDVSEDLQRGNN

SEQ ID NO: 19159 - protein, 28 aa, Artificial Sequence
  Description of Artificial Sequence: Synthetic peptide
DEEEIRTTNPVATECFGSVSTNLQIGNG

SEQ ID NO: 19160 - protein, 28 aa, Artificial Sequence
  Description of Artificial Sequence: Synthetic peptide
QENEIVTTNPVATEQYGSVSTNLQRGNF

SEQ ID NO: 19161 - protein, 29 aa, Artificial Sequence
  Description of Artificial Sequence: Synthetic peptide
DEEEIRTTNPVATEQYGSVDTNEQLRGNA

SEQ ID NO: 19162 - protein, 28 aa, Artificial Sequence
  Description of Artificial Sequence: Synthetic peptide
DEEEIRCTNPVSTECYGSVATNLQRGNR

SEQ ID NO: 19163 - protein, 29 aa, Artificial Sequence
  Description of Artificial Sequence: Synthetic peptide
DEEEIRGTNPVATEQYGVVSTNEQYRGNR

SEQ ID NO: 19164 - protein, 29 aa, Artificial Sequence
  Description of Artificial Sequence: Synthetic peptide
DEEEIRTTNPVATEQYGSVSTNEQNQGNW

SEQ ID NO: 19165 - protein, 28 aa, Artificial Sequence
  Description of Artificial Sequence: Synthetic peptide
DEEEIRTTNPVATEQYGSVDTELQTGNS

SEQ ID NO: 19166 - protein, 29 aa, Artificial Sequence
  Description of Artificial Sequence: Synthetic peptide
DEEEIRTTNPDATEQYGSVSENEQIRGNR

SEQ ID NO: 19167 - protein, 30 aa, Artificial Sequence
  Description of Artificial Sequence: Synthetic polypeptide
DEREIRTTNPVATEQYGSVSTLNSLQDGNR

SEQ ID NO: 19168 - protein, 28 aa, Artificial Sequence
  Description of Artificial Sequence: Synthetic peptide
DENEIRTTNPVATEQYGSVDTNLMRGNQ

SEQ ID NO: 19169 - protein, 29 aa, Artificial Sequence
  Description of Artificial Sequence: Synthetic peptide
DEEEIRTTNPVATEQYGSVSTCAPQRGER

SEQ ID NO: 19170 - protein, 28 aa, Artificial Sequence
  Description of Artificial Sequence: Synthetic peptide
DEQEIRTTNPVATEQYGWTSTNLQRGPR

SEQ ID NO: 19171 - protein, 28 aa, Artificial Sequence
  Description of Artificial Sequence: Synthetic peptide
DEEEIRTTNPVATEQYGSVSTELEEGND

SEQ ID NO: 19172 - protein, 30 aa, Artificial Sequence
  Description of Artificial Sequence: Synthetic polypeptide
DEEEIRTTNPVATEQYGIVSTCNLQQRGND

SEQ ID NO: 19173 - protein, 29 aa, Artificial Sequence
  Description of Artificial Sequence: Synthetic peptide
DENEIRCTNPVATEVYGSVSTNLQRGNDR

SEQ ID NO: 19174 - protein, 31 aa, Artificial Sequence
  Description of Artificial Sequence: Synthetic polypeptide
DEEEIRTTNPVATEQYGSVESTPNLVQRGNP

SEQ ID NO: 19175 - protein, 28 aa, Artificial Sequence
  Description of Artificial Sequence: Synthetic peptide
DEEEIRTTNPVATEQYGSVSTNEETGNP

SEQ ID NO: 19176 - protein, 29 aa, Artificial Sequence
  Description of Artificial Sequence: Synthetic peptide
DEEEIRTVNPVSTEQYGEVSATNLQRGNR

SEQ ID NO: 19177 - protein, 30 aa, Artificial Sequence
  Description of Artificial Sequence: Synthetic polypeptide
DEEEIRTTNPVATEQYGSISHMNLQLRGNR

SEQ ID NO: 19178 - protein, 28 aa, Artificial Sequence
  Description of Artificial Sequence: Synthetic peptide
DEEEIRTTNPVATEQYGSVSENEQRENM

SEQ ID NO: 19179 - protein, 28 aa, Artificial Sequence
  Description of Artificial Sequence: Synthetic peptide
KEEEIRQTNPVATEQYGSVSTNLQNGNT

SEQ ID NO: 19180 - protein, 30 aa, Artificial Sequence
  Description of Artificial Sequence: Synthetic polypeptide
DEEEIRTTNPVATEQYGSVSTNLQDHGNDA

SEQ ID NO: 19181 - protein, 30 aa, Artificial Sequence
  Description of Artificial Sequence: Synthetic polypeptide
DEEEIRTTNPVATECYGSVDSAGNLQRGNR

SEQ ID NO: 19182 - protein, 28 aa, Artificial Sequence
  Description of Artificial Sequence: Synthetic peptide
DDEEIRTTNPVASEMYGSVSTNLQRGNG

SEQ ID NO: 19183 - protein, 30 aa, Artificial Sequence
  Description of Artificial Sequence: Synthetic polypeptide
DEEEIRTTNPVATEQYGSVSCTNLQCNGNQ

SEQ ID NO: 19184 - protein, 30 aa, Artificial Sequence
  Description of Artificial Sequence: Synthetic polypeptide
MEEEIRTTNPVATEQYGSVSTNLQHEGNDR

SEQ ID NO: 19185 - protein, 29 aa, Artificial Sequence
  Description of Artificial Sequence: Synthetic peptide
DEEEVRTTNPVATEQYGAVSANNLQRGNR

SEQ ID NO: 19186 - protein, 30 aa, Artificial Sequence
  Description of Artificial Sequence: Synthetic polypeptide
CEEEIRPTNPVATEQYGQSVSTNLQRGVNR

SEQ ID NO: 19187 - protein, 28 aa, Artificial Sequence
  Description of Artificial Sequence: Synthetic peptide
DEEEIRTTNPVATEQYGSVSTPPQYGNM

SEQ ID NO: 19188 - protein, 29 aa, Artificial Sequence
  Description of Artificial Sequence: Synthetic peptide
DEEEIRTTNPVATEQYGSVSTNLQIKGES

SEQ ID NO: 19189 - protein, 28 aa, Artificial Sequence
  Description of Artificial Sequence: Synthetic peptide
DEEEIRTTNPVATECYGSVSTNLERGEN

SEQ ID NO: 19190 - protein, 31 aa, Artificial Sequence
  Description of Artificial Sequence: Synthetic polypeptide
DEEEIRTTNPVATEQYGSVSTQNLPQRGDER

SEQ ID NO: 19191 - protein, 28 aa, Artificial Sequence
  Description of Artificial Sequence: Synthetic peptide
DEEEIAATNPVATEMYGVVSTNLQRGNR

SEQ ID NO: 19192 - protein, 29 aa, Artificial Sequence
  Description of Artificial Sequence: Synthetic peptide
DEEEIRTTNPEATEQYGSVSYINLQRGGR

SEQ ID NO: 19193 - protein, 30 aa, Artificial Sequence
  Description of Artificial Sequence: Synthetic polypeptide
DEEEIRTTNPFATEQYGSVETNLVQRGDNR

SEQ ID NO: 19194 - protein, 28 aa, Artificial Sequence
  Description of Artificial Sequence: Synthetic peptide
DEEEIRCTNPVASEMYGAVSTNLQRGNR

SEQ ID NO: 19195 - protein, 28 aa, Artificial Sequence
  Description of Artificial Sequence: Synthetic peptide
QEEEIATTNPVATEQYGSVSTNLQSGTR

SEQ ID NO: 19196 - protein, 29 aa, Artificial Sequence
  Description of Artificial Sequence: Synthetic peptide
DEEEIATTNPVATEQYGSVSTNLQDIGNF

SEQ ID NO: 19197 - protein, 28 aa, Artificial Sequence
  Description of Artificial Sequence: Synthetic peptide
DEEEIATTNPVATEQYGLVSTNIQRGNF

SEQ ID NO: 19198 - protein, 30 aa, Artificial Sequence
  Description of Artificial Sequence: Synthetic polypeptide
DEEEIRTTNPVATEQYGSVEETNLQFGENR

SEQ ID NO: 19199 - protein, 29 aa, Artificial Sequence
  Description of Artificial Sequence: Synthetic peptide
DENEIRTTNPVATECYGSVSTNLQRGNDM

SEQ ID NO: 19200 - protein, 29 aa, Artificial Sequence
  Description of Artificial Sequence: Synthetic peptide
KEEEIRTTNPVATECYGSVSTNLQGEGNR

SEQ ID NO: 19201 - protein, 29 aa, Artificial Sequence
  Description of Artificial Sequence: Synthetic peptide
DTEEIRTTNPYATEQYGSVSTPLQRGNDR

SEQ ID NO: 19202 - protein, 28 aa, Artificial Sequence
  Description of Artificial Sequence: Synthetic peptide
DEETIRTTNPVCTAQYGSVSENLQRGNR

SEQ ID NO: 19203 - protein, 28 aa, Artificial Sequence
  Description of Artificial Sequence: Synthetic peptide
DEEEIATVNPVATEQYGSVSTNLQQGNA

SEQ ID NO: 19204 - protein, 28 aa, Artificial Sequence
  Description of Artificial Sequence: Synthetic peptide
DEQEIHTTNPVATEQYGDVSTNLQRGDR

SEQ ID NO: 19205 - protein, 28 aa, Artificial Sequence
  Description of Artificial Sequence: Synthetic peptide
DEEEIRTTNPVATEQYGSVSTELQYGDW

SEQ ID NO: 19206 - protein, 28 aa, Artificial Sequence
  Description of Artificial Sequence: Synthetic peptide
DEEEIRTTNPVATEMYGSVCTNECRGNR

SEQ ID NO: 19207 - protein, 28 aa, Artificial Sequence
  Description of Artificial Sequence: Synthetic peptide
DEEEIATTNPVATEQYGDVSTALQRGER

SEQ ID NO: 19208 - protein, 28 aa, Artificial Sequence
  Description of Artificial Sequence: Synthetic peptide
DEEEIRATNPVATEQYGSVSTNLEDGNN

SEQ ID NO: 19209 - protein, 28 aa, Artificial Sequence
  Description of Artificial Sequence: Synthetic peptide
DEHEIRTTNPVATEQYGSVSTDLQAGNV

SEQ ID NO: 19210 - protein, 28 aa, Artificial Sequence
  Description of Artificial Sequence: Synthetic peptide
AENEIVTTNPVATEQYGSVSTNLQRGER

SEQ ID NO: 19211 - protein, 28 aa, Artificial Sequence
  Description of Artificial Sequence: Synthetic peptide
GEQEIATTNPVATEVYGSVSTNLQRGNR

SEQ ID NO: 19212 - protein, 28 aa, Artificial Sequence
  Description of Artificial Sequence: Synthetic peptide
EEEEIRTTNPVATEQYGSASTTLLRGNR

SEQ ID NO: 19213 - protein, 28 aa, Artificial Sequence
  Description of Artificial Sequence: Synthetic peptide
DEEEIATTNPVATEQYGSVSTNPQHGNQ

SEQ ID NO: 19214 - protein, 28 aa, Artificial Sequence
  Description of Artificial Sequence: Synthetic peptide
DEEEIRTVNPCATEQYGSASTNLQHGNR

SEQ ID NO: 19215 - protein, 32 aa, Artificial Sequence
  Description of Artificial Sequence: Synthetic polypeptide
DEEEIRTTNPVATEQYGSVSTTDNLVQRGDNR

SEQ ID NO: 19216 - protein, 30 aa, Artificial Sequence
  Description of Artificial Sequence: Synthetic polypeptide
DEEEIRTTNPVATEQYGSVDCTNLERGENR

SEQ ID NO: 19217 - protein, 29 aa, Artificial Sequence
  Description of Artificial Sequence: Synthetic peptide
DEEEIRTTNPVATEQYGVVSTNPQLRGNI

SEQ ID NO: 19218 - protein, 28 aa, Artificial Sequence
  Description of Artificial Sequence: Synthetic peptide
DEEEIRTTNPVATEQYGSVSTCGQTGNF

SEQ ID NO: 19219 - protein, 28 aa, Artificial Sequence
  Description of Artificial Sequence: Synthetic peptide
KEEEIRTTNPVATECYGSVSTNLQVGNW

SEQ ID NO: 19220 - protein, 29 aa, Artificial Sequence
  Description of Artificial Sequence: Synthetic peptide
DEEEIRTTNPVATEQYGSVSTGDIRGDNR

SEQ ID NO: 19221 - protein, 28 aa, Artificial Sequence
  Description of Artificial Sequence: Synthetic peptide
DEEEIRTTNPTATEIFGSVSTNLQRGTR

SEQ ID NO: 19222 - protein, 28 aa, Artificial Sequence
  Description of Artificial Sequence: Synthetic peptide
DEEEIRTTNPVATEQYGSVSTELQGGET

SEQ ID NO: 19223 - protein, 28 aa, Artificial Sequence
  Description of Artificial Sequence: Synthetic peptide
DEEEIRTTNPVATEQYGSVSTELEVGNW

SEQ ID NO: 19224 - protein, 28 aa, Artificial Sequence
  Description of Artificial Sequence: Synthetic peptide
DEEEIRTTNPVATEQYGSVSTEDEVGNR

SEQ ID NO: 19225 - protein, 28 aa, Artificial Sequence
  Description of Artificial Sequence: Synthetic peptide
GEEEIRTTNPCATEQYGDVSTNLQRGQR

SEQ ID NO: 19226 - protein, 28 aa, Artificial Sequence
  Description of Artificial Sequence: Synthetic peptide
DENEIRTTNPVATEQYGSVSTDLQLGNE

SEQ ID NO: 19227 - protein, 29 aa, Artificial Sequence
  Description of Artificial Sequence: Synthetic peptide
DEQEIATTNPVATEQYGSASCTNLQRGNR

SEQ ID NO: 19228 - protein, 28 aa, Artificial Sequence
  Description of Artificial Sequence: Synthetic peptide
DEEEIRQTNPVATEQYGSVSTALQRGEI

SEQ ID NO: 19229 - protein, 29 aa, Artificial Sequence
  Description of Artificial Sequence: Synthetic peptide
DEKEIRTTNPVATEQYGSVWSTNLLRGNH

SEQ ID NO: 19230 - protein, 28 aa, Artificial Sequence
  Description of Artificial Sequence: Synthetic peptide
DEEEIRTVNPVATEQYGSVSTAEQFGNR

SEQ ID NO: 19231 - protein, 30 aa, Artificial Sequence
  Description of Artificial Sequence: Synthetic polypeptide
DEEEIRTTNPVATEQYGSVSTCDLQIRGNS

SEQ ID NO: 19232 - protein, 29 aa, Artificial Sequence
  Description of Artificial Sequence: Synthetic peptide
DEEEIRQTNPVATEQYGSVSTTDLERGNR

SEQ ID NO: 19233 - protein, 28 aa, Artificial Sequence
  Description of Artificial Sequence: Synthetic peptide
DEEEIYTTNPVATEQYGSVSTNLMIGNF

SEQ ID NO: 19234 - protein, 28 aa, Artificial Sequence
  Description of Artificial Sequence: Synthetic peptide
KENEIRTTNPVATEQYGSVSTNLQHGNE

SEQ ID NO: 19235 - protein, 28 aa, Artificial Sequence
  Description of Artificial Sequence: Synthetic peptide
DEEEIRTTNPEATETYGSVSTNDQHGNR

SEQ ID NO: 19236 - protein, 28 aa, Artificial Sequence
  Description of Artificial Sequence: Synthetic peptide
DEEEIAQTNPVATEQYGSVSDVLQRGNR

SEQ ID NO: 19237 - protein, 28 aa, Artificial Sequence
  Description of Artificial Sequence: Synthetic peptide
DDEEIRTTNPVATEQYGSVSTDLQNGNM

SEQ ID NO: 19238 - protein, 28 aa, Artificial Sequence
  Description of Artificial Sequence: Synthetic peptide
DENEIRTTNPVATEQYGIVSTNLMQGNR

SEQ ID NO: 19239 - protein, 28 aa, Artificial Sequence
  Description of Artificial Sequence: Synthetic peptide
DEEEIRTVNPVATEQYGSVSTDLQNGNA

SEQ ID NO: 19240 - protein, 28 aa, Artificial Sequence
  Description of Artificial Sequence: Synthetic peptide
DEEEIRTTNPVATEQYGSVSTDEQQGNG

SEQ ID NO: 19241 - protein, 29 aa, Artificial Sequence
  Description of Artificial Sequence: Synthetic peptide
DEEEIRTTNPVATELYGSVSTNEQNRGNM

SEQ ID NO: 19242 - protein, 28 aa, Artificial Sequence
  Description of Artificial Sequence: Synthetic peptide
DEQEIRTTNPVATEIYGSVATNLERGNR

SEQ ID NO: 19243 - protein, 28 aa, Artificial Sequence
  Description of Artificial Sequence: Synthetic peptide
DENEIRTTNPVATEQWGSVSTNLQQGNA

SEQ ID NO: 19244 - protein, 28 aa, Artificial Sequence
  Description of Artificial Sequence: Synthetic peptide
DEDEIRTTNPVATEPYGSVSTNLQDGNT

SEQ ID NO: 19245 - protein, 28 aa, Artificial Sequence
  Description of Artificial Sequence: Synthetic peptide
DEEEIRTTNPTATEQYGSVSTNPQVGNQ

SEQ ID NO: 19246 - protein, 28 aa, Artificial Sequence
  Description of Artificial Sequence: Synthetic peptide
DEEEIRTTNPVATEQYGSVSTELQAGDT

SEQ ID NO: 19247 - protein, 28 aa, Artificial Sequence
  Description of Artificial Sequence: Synthetic peptide
DEEEIRCTNPVATECYGIVSTNLERGNR

SEQ ID NO: 19248 - protein, 32 aa, Artificial Sequence
  Description of Artificial Sequence: Synthetic polypeptide
DEEEIRTTNPVATEQYGSVSTGNLQDREGDNR

SEQ ID NO: 19249 - protein, 28 aa, Artificial Sequence
  Description of Artificial Sequence: Synthetic peptide
DEEEIRCTNPVATECYGSVSTNLQDGNQ

SEQ ID NO: 19250 - protein, 28 aa, Artificial Sequence
  Description of Artificial Sequence: Synthetic peptide
AEEEIRTTNPVATEQYGDVSTNLEDGNR

SEQ ID NO: 19251 - protein, 30 aa, Artificial Sequence
  Description of Artificial Sequence: Synthetic polypeptide
DEEEIRTTNPVATEQYGSVSTNLGPRDGTR

SEQ ID NO: 19252 - protein, 28 aa, Artificial Sequence
  Description of Artificial Sequence: Synthetic peptide
DEEEIRTTNPVCTEQYGSVSEALQRGNF

SEQ ID NO: 19253 - protein, 28 aa, Artificial Sequence
  Description of Artificial Sequence: Synthetic peptide
DEEEIRTTNPVATEQYGSVSTELQSGEG

SEQ ID NO: 19254 - protein, 29 aa, Artificial Sequence
  Description of Artificial Sequence: Synthetic peptide
DEEEIATTNPVATEQYGSVSENLQRGEDR

SEQ ID NO: 19255 - protein, 28 aa, Artificial Sequence
  Description of Artificial Sequence: Synthetic peptide
DEEEIRAVNPVATECYGTVSTNLQRGNR

SEQ ID NO: 19256 - protein, 28 aa, Artificial Sequence
  Description of Artificial Sequence: Synthetic peptide
DEEEIRTTNPVATEQYGSVSTNDETGER

SEQ ID NO: 19257 - protein, 30 aa, Artificial Sequence
  Description of Artificial Sequence: Synthetic polypeptide
DEEEIRTTNPVATEQYGSVSSNLQVRAGNH

SEQ ID NO: 19258 - protein, 28 aa, Artificial Sequence
  Description of Artificial Sequence: Synthetic peptide
DEEEIRTTNPVATEQYGVVSTNLERGEM

SEQ ID NO: 19259 - protein, 28 aa, Artificial Sequence
  Description of Artificial Sequence: Synthetic peptide
DEEEITTTNPVATEQYGSVSENLQVGNH

SEQ ID NO: 19260 - protein, 31 aa, Artificial Sequence
  Description of Artificial Sequence: Synthetic polypeptide
DEEEIRTTNPVATEQYGHSVSTGPLQRGNYR

SEQ ID NO: 19261 - protein, 30 aa, Artificial Sequence
  Description of Artificial Sequence: Synthetic polypeptide
DEEEIRTTNPVATEQYGSVSTNLVQELGNF

SEQ ID NO: 19262 - protein, 29 aa, Artificial Sequence
  Description of Artificial Sequence: Synthetic peptide
DENEIRTTNPVATEQWGSVSTNLQMRGNF

SEQ ID NO: 19263 - protein, 31 aa, Artificial Sequence
  Description of Artificial Sequence: Synthetic polypeptide
DEEEIRTTNPVATEQYGSVSATNGLQDRGNL

SEQ ID NO: 19264 - protein, 31 aa, Artificial Sequence
  Description of Artificial Sequence: Synthetic polypeptide
DEEEIRTTNPVATEQYGSVSTPLQRNGVNER

SEQ ID NO: 19265 - protein, 28 aa, Artificial Sequence
  Description of Artificial Sequence: Synthetic peptide
MEEEIRTTNPVATEQYGSVSTNLDNGTR

SEQ ID NO: 19266 - protein, 28 aa, Artificial Sequence
  Description of Artificial Sequence: Synthetic peptide
DEEEIRATNPVSTECYGSVATNLQRGNR

SEQ ID NO: 19267 - protein, 28 aa, Artificial Sequence
  Description of Artificial Sequence: Synthetic peptide
DENEIRTTNPVATECYGVVSTNLQRGND

SEQ ID NO: 19268 - protein, 28 aa, Artificial Sequence
  Description of Artificial Sequence: Synthetic peptide
DEEEIAATNPVATELYGSVATNLQRGNR

SEQ ID NO: 19269 - protein, 28 aa, Artificial Sequence
  Description of Artificial Sequence: Synthetic peptide
DEEEINTTNPVATEWYGSVSDNLQRGNQ

SEQ ID NO: 19270 - protein, 28 aa, Artificial Sequence
  Description of Artificial Sequence: Synthetic peptide
DEEEIVTTNPVATEQYGSASTCLQRGND

SEQ ID NO: 19271 - protein, 28 aa, Artificial Sequence
  Description of Artificial Sequence: Synthetic peptide
DEEEVRTTNPCATEQFGSVATNLQRGNR

SEQ ID NO: 19272 - protein, 30 aa, Artificial Sequence
  Description of Artificial Sequence: Synthetic polypeptide
DEEEIRTTNPVATEQYGSVSTCWLQDDGNR

SEQ ID NO: 19273 - protein, 28 aa, Artificial Sequence
  Description of Artificial Sequence: Synthetic peptide
DEEEIRTTNPVATEQYGSVDTNLQRETL

SEQ ID NO: 19274 - protein, 30 aa, Artificial Sequence
  Description of Artificial Sequence: Synthetic polypeptide
DEEEIRTTNPVATEQYGSVSENLQIRAENR

SEQ ID NO: 19275 - protein, 28 aa, Artificial Sequence
  Description of Artificial Sequence: Synthetic peptide
DECEIRTTNPVATESYGSVSTNEQRGNE

SEQ ID NO: 19276 - protein, 29 aa, Artificial Sequence
  Description of Artificial Sequence: Synthetic peptide
DEEEIRTTNPVATEQYGSVSTDLGQRGEP

SEQ ID NO: 19277 - protein, 30 aa, Artificial Sequence
  Description of Artificial Sequence: Synthetic polypeptide
DEEEIRTTNPVATEQYGSVSENLQNRGDDR

SEQ ID NO: 19278 - protein, 29 aa, Artificial Sequence
  Description of Artificial Sequence: Synthetic peptide
DEEEIRTTNPVATECYGSVSTDLQAGNDR

SEQ ID NO: 19279 - protein, 28 aa, Artificial Sequence
  Description of Artificial Sequence: Synthetic peptide
DEEEIRTTNPVATEQYGSVDTNDNRENR

SEQ ID NO: 19280 - protein, 28 aa, Artificial Sequence
  Description of Artificial Sequence: Synthetic peptide
DEEEIRTTNPVATEQYGSVSTADQMGND

SEQ ID NO: 19281 - protein, 28 aa, Artificial Sequence
  Description of Artificial Sequence: Synthetic peptide
DEEEIRTTNPVATEQYGSVSTDLQYGEF

SEQ ID NO: 19282 - protein, 28 aa, Artificial Sequence
  Description of Artificial Sequence: Synthetic peptide
DEEEIRTTNPVATEIYGSVSTVLQHGMR

SEQ ID NO: 19283 - protein, 28 aa, Artificial Sequence
  Description of Artificial Sequence: Synthetic peptide
DEQEIATTNPVATELYGWVSTNLQRGNR

SEQ ID NO: 19284 - protein, 29 aa, Artificial Sequence
  Description of Artificial Sequence: Synthetic peptide
DEEEIRTTNPFAWEQYGSVISTNLQNGNR

SEQ ID NO: 19285 - protein, 28 aa, Artificial Sequence
  Description of Artificial Sequence: Synthetic peptide
DEEEIRTTNPVATESYGSVSTNPQGGNQ

SEQ ID NO: 19286 - protein, 29 aa, Artificial Sequence
  Description of Artificial Sequence: Synthetic peptide
DEEEIRTTNPVATEQYGSASTDLQRGFDR

SEQ ID NO: 19287 - protein, 29 aa, Artificial Sequence
  Description of Artificial Sequence: Synthetic peptide
DEQEIRTTNPVATEQWGSVSTNLQMRGNM

SEQ ID NO: 19288 - protein, 29 aa, Artificial Sequence
  Description of Artificial Sequence: Synthetic peptide
DEEEIRTTNPTATEQYGSASTNLQARGNN

SEQ ID NO: 19289 - protein, 30 aa, Artificial Sequence
  Description of Artificial Sequence: Synthetic polypeptide
DEEEIATTNPVATEQYGVVSTNLQDRKGNR

SEQ ID NO: 19290 - protein, 28 aa, Artificial Sequence
  Description of Artificial Sequence: Synthetic peptide
DEEEIVTTNPVATEQYGSASENLMRGNR

SEQ ID NO: 19291 - protein, 28 aa, Artificial Sequence
  Description of Artificial Sequence: Synthetic peptide
DEEEIRTTNPVATEQYGSVSTQLQPMER

SEQ ID NO: 19292 - protein, 28 aa, Artificial Sequence
  Description of Artificial Sequence: Synthetic peptide
DEEEIATTNPVATEQYGSVSTNLQIGEN

SEQ ID NO: 19293 - protein, 28 aa, Artificial Sequence
  Description of Artificial Sequence: Synthetic peptide
DEEEIRTTNPVATEQYGSVSTALEQGER

SEQ ID NO: 19294 - protein, 29 aa, Artificial Sequence
  Description of Artificial Sequence: Synthetic peptide
DEEEIRTTNPVATEQYGSVSENLCRFENR

SEQ ID NO: 19295 - protein, 29 aa, Artificial Sequence
  Description of Artificial Sequence: Synthetic peptide
QEEEIRTVNPVATEQYGSVSTVLQRAGNR

SEQ ID NO: 19296 - protein, 28 aa, Artificial Sequence
  Description of Artificial Sequence: Synthetic peptide
MENEIRTTNPVATEQYGSVSTDLQRGNF

SEQ ID NO: 19297 - protein, 28 aa, Artificial Sequence
  Description of Artificial Sequence: Synthetic peptide
DEEEIRTTNPVATEMYGSVSTDLQRGDD

SEQ ID NO: 19298 - protein, 29 aa, Artificial Sequence
  Description of Artificial Sequence: Synthetic peptide
DEEEIRTTNPVATEQYGSVSTNLQEIGEC

SEQ ID NO: 19299 - protein, 28 aa, Artificial Sequence
  Description of Artificial Sequence: Synthetic peptide
DEEEIRTTNPVATEQYGSWSTDQQWGNR

SEQ ID NO: 19300 - protein, 28 aa, Artificial Sequence
  Description of Artificial Sequence: Synthetic peptide
DEEEIRCTNPVSTETYGCVSTNLQRGNR

SEQ ID NO: 19301 - protein, 30 aa, Artificial Sequence
  Description of Artificial Sequence: Synthetic polypeptide
DEEEIRTTNPVATEQYGVVSTLNLQRGPNS

SEQ ID NO: 19302 - protein, 28 aa, Artificial Sequence
  Description of Artificial Sequence: Synthetic peptide
VEEEIRTTNPVATEQYGSVSTALQHGNQ

SEQ ID NO: 19303 - protein, 29 aa, Artificial Sequence
  Description of Artificial Sequence: Synthetic peptide
DEQEIRTTNPVATEQWGSVSTNLQMRGNS

SEQ ID NO: 19304 - protein, 28 aa, Artificial Sequence
  Description of Artificial Sequence: Synthetic peptide
DEEEIRTTNPVATEQYGYVSTNWQNGNS

SEQ ID NO: 19305 - protein, 30 aa, Artificial Sequence
  Description of Artificial Sequence: Synthetic polypeptide
DEEEIRTTNPVADEQYGSVSTMNLVRGNTR

SEQ ID NO: 19306 - protein, 30 aa, Artificial Sequence
  Description of Artificial Sequence: Synthetic polypeptide
DEEEIRTTNPDATEQYGSVSTPNLVQRGNI

SEQ ID NO: 19307 - protein, 28 aa, Artificial Sequence
  Description of Artificial Sequence: Synthetic peptide
DEEEIRTTNPVATELYGSASENIQRGNR

SEQ ID NO: 19308 - protein, 28 aa, Artificial Sequence
  Description of Artificial Sequence: Synthetic peptide
DEGEIRTVNPAATEQYGSVSTNLQHGNR

SEQ ID NO: 19309 - protein, 28 aa, Artificial Sequence
  Description of Artificial Sequence: Synthetic peptide
DEEEIRTTNPTATEQYGSVSTNPQNGNF

SEQ ID NO: 19310 - protein, 28 aa, Artificial Sequence
  Description of Artificial Sequence: Synthetic peptide
DEEEIRCTNPAATEQYGSVSANWQRGNR

SEQ ID NO: 19311 - protein, 28 aa, Artificial Sequence
  Description of Artificial Sequence: Synthetic peptide
DEEEIRTTNPDAAQQYGSVSTNLQPGNR

SEQ ID NO: 19312 - protein, 32 aa, Artificial Sequence
  Description of Artificial Sequence: Synthetic polypeptide
DEEEIRTTNPVATEQYGSVSDTENLQREGENR

SEQ ID NO: 19313 - protein, 31 aa, Artificial Sequence
  Description of Artificial Sequence: Synthetic polypeptide
DEEEIRTTNPVATEQYGSVDSDLNLQRNGNR

SEQ ID NO: 19314 - protein, 28 aa, Artificial Sequence
  Description of Artificial Sequence: Synthetic peptide
AEEEIAQTNPVATEQYGSVSTDLQRGNR

SEQ ID NO: 19315 - protein, 30 aa, Artificial Sequence
  Description of Artificial Sequence: Synthetic polypeptide
DEQEIATTNPVATEQYGSVSATNLQRGENR

SEQ ID NO: 19316 - protein, 28 aa, Artificial Sequence
  Description of Artificial Sequence: Synthetic peptide
DEEEIRTTNPVATEQYGSVSTNLCNGEN

SEQ ID NO: 19317 - protein, 28 aa, Artificial Sequence
  Description of Artificial Sequence: Synthetic peptide
DEQEIRQTNPVATEVYGVVSTNLQRGNR

SEQ ID NO: 19318 - protein, 28 aa, Artificial Sequence
  Description of Artificial Sequence: Synthetic peptide
SEEEIRTTNPVATEVYGSYSENLQRGNR

SEQ ID NO: 19319 - protein, 30 aa, Artificial Sequence
  Description of Artificial Sequence: Synthetic polypeptide
DEEEIRTTNPVATEQYGSVSTNDQMRNENR

SEQ ID NO: 19320 - protein, 29 aa, Artificial Sequence
  Description of Artificial Sequence: Synthetic peptide
DEEEIRTTNPVATEQYGSVSTNLQYGEEH

SEQ ID NO: 19321 - protein, 30 aa, Artificial Sequence
  Description of Artificial Sequence: Synthetic polypeptide
DEEEIRTTNPVATEQYGSEVCSTGLQRGNA

SEQ ID NO: 19322 - protein, 29 aa, Artificial Sequence
  Description of Artificial Sequence: Synthetic peptide
DEEEIRTTNPVATECYGSVSTNLQDAGNA

SEQ ID NO: 19323 - protein, 28 aa, Artificial Sequence
  Description of Artificial Sequence: Synthetic peptide
DESEIRTTNPDATEQYGSVSTPHQRGNR

SEQ ID NO: 19324 - protein, 28 aa, Artificial Sequence
  Description of Artificial Sequence: Synthetic peptide
DEQEIRTTNPVATEQYGSVETNLQVGNF

SEQ ID NO: 19325 - protein, 28 aa, Artificial Sequence
  Description of Artificial Sequence: Synthetic peptide
DEEEIRQTNPVATEQYGWCSTNLQRGNM

SEQ ID NO: 19326 - protein, 28 aa, Artificial Sequence
  Description of Artificial Sequence: Synthetic peptide
DETEIRTTNPVAVEQYGSVNTNLQIGNR

SEQ ID NO: 19327 - protein, 28 aa, Artificial Sequence
  Description of Artificial Sequence: Synthetic peptide
GEEEIGTTNPVATEGYGIVSTNLQRGNR

SEQ ID NO: 19328 - protein, 30 aa, Artificial Sequence
  Description of Artificial Sequence: Synthetic polypeptide
DEEEIATTNPVATEQYGSVSETPNLQRGDR

SEQ ID NO: 19329 - protein, 28 aa, Artificial Sequence
  Description of Artificial Sequence: Synthetic peptide
DEAEIRTTNPVATEQYGSVGTNLQRGDG

SEQ ID NO: 19330 - protein, 28 aa, Artificial Sequence
  Description of Artificial Sequence: Synthetic peptide
DEEEIRTTNPVATEQYGSCSTNLIIGNQ

SEQ ID NO: 19331 - protein, 28 aa, Artificial Sequence
  Description of Artificial Sequence: Synthetic peptide
DEEEIRTTNPVATEQYGDVSENLQHGDR

SEQ ID NO: 19332 - protein, 31 aa, Artificial Sequence
  Description of Artificial Sequence: Synthetic polypeptide
DEEEIRTTNPVATEQYGSVESETNLERGENR

SEQ ID NO: 19333 - protein, 28 aa, Artificial Sequence
  Description of Artificial Sequence: Synthetic peptide
DEEEIRTTNPAATEQYGSVSANLQFGNF

SEQ ID NO: 19334 - protein, 28 aa, Artificial Sequence
  Description of Artificial Sequence: Synthetic peptide
GEEEIRTTNPVATEHYGSVSTNLQRGTQ

SEQ ID NO: 19335 - protein, 29 aa, Artificial Sequence
  Description of Artificial Sequence: Synthetic peptide
DEEEIATTNPVATEQYGEVSAENLQRGNR

SEQ ID NO: 19336 - protein, 28 aa, Artificial Sequence
  Description of Artificial Sequence: Synthetic peptide
DEEEIRTTNPVATECYGSVSTELQLGNT

SEQ ID NO: 19337 - protein, 29 aa, Artificial Sequence
  Description of Artificial Sequence: Synthetic peptide
DEEEIRTTNPVATEQYGSYVSTNPERENR

SEQ ID NO: 19338 - protein, 28 aa, Artificial Sequence
  Description of Artificial Sequence: Synthetic peptide
DEEEIMTTNPEATEIYGVVSTNLQRGNR

SEQ ID NO: 19339 - protein, 28 aa, Artificial Sequence
  Description of Artificial Sequence: Synthetic peptide
DEEEIRATNPVATEQYGSVSTDLQVGNN

SEQ ID NO: 19340 - protein, 30 aa, Artificial Sequence
  Description of Artificial Sequence: Synthetic polypeptide
AEEEIRTTNPVATEQYGSVSTTNLTLRGNR

SEQ ID NO: 19341 - protein, 28 aa, Artificial Sequence
  Description of Artificial Sequence: Synthetic peptide
DEEEIRTTNPTATEQYGSVSTNEMRGNQ

SEQ ID NO: 19342 - protein, 28 aa, Artificial Sequence
  Description of Artificial Sequence: Synthetic peptide
DEEEIRTTNPVATECYGWVSTNLQQGNL

SEQ ID NO: 19343 - protein, 28 aa, Artificial Sequence
  Description of Artificial Sequence: Synthetic peptide
DEEEIRTTNPVATEQYGSVSTDLQYGEI

SEQ ID NO: 19344 - protein, 28 aa, Artificial Sequence
  Description of Artificial Sequence: Synthetic peptide
DEEEIRTTNPTATEQYGSVSTNEQQGNS

SEQ ID NO: 19345 - protein, 28 aa, Artificial Sequence
  Description of Artificial Sequence: Synthetic peptide
DEQEIRSTNPVATEIYGSVSSNLQRGNR

SEQ ID NO: 19346 - protein, 29 aa, Artificial Sequence
  Description of Artificial Sequence: Synthetic peptide
DEEEIVTTNPVATEQYGDVSAENLQRGNR

SEQ ID NO: 19347 - protein, 28 aa, Artificial Sequence
  Description of Artificial Sequence: Synthetic peptide
DEEEIRTTNPVATEQWGSYSTNEQRENR

SEQ ID NO: 19348 - protein, 28 aa, Artificial Sequence
  Description of Artificial Sequence: Synthetic peptide
DENEIRTTNPVATEQYGSVSENLMRGNA

SEQ ID NO: 19349 - protein, 29 aa, Artificial Sequence
  Description of Artificial Sequence: Synthetic peptide
GEEEIATTNPVATEQYGSVSTNLQEYGNR

SEQ ID NO: 19350 - protein, 28 aa, Artificial Sequence
  Description of Artificial Sequence: Synthetic peptide
DEEEIVTTNPVATEQYGSVSTNLETGER

SEQ ID NO: 19351 - protein, 30 aa, Artificial Sequence
  Description of Artificial Sequence: Synthetic polypeptide
DEEEIRTTNPTATEQYGSVSTANPQRGDNR

SEQ ID NO: 19352 - protein, 30 aa, Artificial Sequence
  Description of Artificial Sequence: Synthetic polypeptide
DEEEIRTTNPVATEQFGSVSTLNLQLRGNE

SEQ ID NO: 19353 - protein, 28 aa, Artificial Sequence
  Description of Artificial Sequence: Synthetic peptide
GEEEIRTTNPVSTEQYGSVSTVLQRGQR

SEQ ID NO: 19354 - protein, 28 aa, Artificial Sequence
  Description of Artificial Sequence: Synthetic peptide
QEIEIRTTNPVATEGYGSVSTVLQRGNR

SEQ ID NO: 19355 - protein, 28 aa, Artificial Sequence
  Description of Artificial Sequence: Synthetic peptide
QEEEISTTNPTATEQYGSVSTNPQRGNR

SEQ ID NO: 19356 - protein, 29 aa, Artificial Sequence
  Description of Artificial Sequence: Synthetic peptide
QEEEIRTTNPVATEQYGEVSADNLQRGNR

SEQ ID NO: 19357 - protein, 28 aa, Artificial Sequence
  Description of Artificial Sequence: Synthetic peptide
DEEEIRTTNPVATEQYGSVSTELDSGER

SEQ ID NO: 19358 - protein, 28 aa, Artificial Sequence
  Description of Artificial Sequence: Synthetic peptide
DEEEIATTNPVATECYGSVSTNLQRGDT

SEQ ID NO: 19359 - protein, 30 aa, Artificial Sequence
  Description of Artificial Sequence: Synthetic polypeptide
DEENIRTTNPVATEQYGSVESTLNLQNGNR

SEQ ID NO: 19360 - protein, 30 aa, Artificial Sequence
  Description of Artificial Sequence: Synthetic polypeptide
DEEEIRTTNPVAWEQYGSVSTTNLMQRGNS

SEQ ID NO: 19361 - protein, 28 aa, Artificial Sequence
  Description of Artificial Sequence: Synthetic peptide
DEDEIRTTNPVATEQYGSVPTQLQRGNN

SEQ ID NO: 19362 - protein, 29 aa, Artificial Sequence
  Description of Artificial Sequence: Synthetic peptide
DEEEIRCTNPVATEQYGIYSTNLQRAGNR

SEQ ID NO: 19363 - protein, 28 aa, Artificial Sequence
  Description of Artificial Sequence: Synthetic peptide
DEQEIRTTNPVATEQYGSVVTNLQVGNF

SEQ ID NO: 19364 - protein, 28 aa, Artificial Sequence
  Description of Artificial Sequence: Synthetic peptide
DEQEIRTTNPEATEQYGSVSTNLDLGNR

SEQ ID NO: 19365 - protein, 30 aa, Artificial Sequence
  Description of Artificial Sequence: Synthetic polypeptide
DEEEIRTTNPVATEQYGSVSDTADQRGENR

SEQ ID NO: 19366 - protein, 28 aa, Artificial Sequence
  Description of Artificial Sequence: Synthetic peptide
DEEEIRTTNPVATEQYGSVSTGLQPGET

SEQ ID NO: 19367 - protein, 29 aa, Artificial Sequence
  Description of Artificial Sequence: Synthetic peptide
DEQEIRTTNPVATECYGSVSTNLQRGNDY

SEQ ID NO: 19368 - protein, 28 aa, Artificial Sequence
  Description of Artificial Sequence: Synthetic peptide
KEEEIRTTNPVATEQYGSVSTDLQNGNT

SEQ ID NO: 19369 - protein, 28 aa, Artificial Sequence
  Description of Artificial Sequence: Synthetic peptide
DEEEIRQTNPVATEQYGVVSTNLERGDR

SEQ ID NO: 19370 - protein, 31 aa, Artificial Sequence
  Description of Artificial Sequence: Synthetic polypeptide
DEEEIRTTNPVATEQYGSVSATNLQRKGENV

SEQ ID NO: 19371 - protein, 28 aa, Artificial Sequence
  Description of Artificial Sequence: Synthetic peptide
QEEEIRTTNPVATEQYGSVSTELQQGNH

SEQ ID NO: 19372 - protein, 28 aa, Artificial Sequence
  Description of Artificial Sequence: Synthetic peptide
DEEEIRTTNPVSTEQYGSVSTNLQVGLH

SEQ ID NO: 19373 - protein, 30 aa, Artificial Sequence
  Description of Artificial Sequence: Synthetic polypeptide
DEEEIRTTNPVATEQYGSVSTNLQCRTGED

SEQ ID NO: 19374 - protein, 30 aa, Artificial Sequence
  Description of Artificial Sequence: Synthetic polypeptide
DEETIRTTNPVATEQYGSTVSTNLTQRINR

SEQ ID NO: 19375 - protein, 29 aa, Artificial Sequence
  Description of Artificial Sequence: Synthetic peptide
DEEEIRCVNPVATEQYGSVPTNLQQRGNR

SEQ ID NO: 19376 - protein, 28 aa, Artificial Sequence
  Description of Artificial Sequence: Synthetic peptide
KENEIRTTNPVATEQYGTVSTNLQRGNM

SEQ ID NO: 19377 - protein, 28 aa, Artificial Sequence
  Description of Artificial Sequence: Synthetic peptide
QENEIRTTNPVATEQYGWVSENLQRGNR

SEQ ID NO: 19378 - protein, 28 aa, Artificial Sequence
  Description of Artificial Sequence: Synthetic peptide
GEEEITTTNPVATEQYGSVSTNIQRGNM

SEQ ID NO: 19379 - protein, 29 aa, Artificial Sequence
  Description of Artificial Sequence: Synthetic peptide
NEEEIRTTNPVATEQYGSVSHDLVQRGNR

SEQ ID NO: 19380 - protein, 28 aa, Artificial Sequence
  Description of Artificial Sequence: Synthetic peptide
DEEEIRTTNPVATEQYGSVSTDLQAGDD

SEQ ID NO: 19381 - protein, 28 aa, Artificial Sequence
  Description of Artificial Sequence: Synthetic peptide
DEEEIRTTNPVATECYGSVSTNLQTGEA

SEQ ID NO: 19382 - protein, 30 aa, Artificial Sequence
  Description of Artificial Sequence: Synthetic polypeptide
DEEEIRTTNPVATEQYGSVSTEPLQVIGNR

SEQ ID NO: 19383 - protein, 28 aa, Artificial Sequence
  Description of Artificial Sequence: Synthetic peptide
DEGEIRTTNPVATEQYGSVSENLQHGNT

SEQ ID NO: 19384 - protein, 29 aa, Artificial Sequence
  Description of Artificial Sequence: Synthetic peptide
SEEEIRTTNPTATEQYGSVSTNPQERGNR

SEQ ID NO: 19385 - protein, 28 aa, Artificial Sequence
  Description of Artificial Sequence: Synthetic peptide
DEEEIRTTNPVATEQYGSVSTELQIGET

SEQ ID NO: 19386 - protein, 28 aa, Artificial Sequence
  Description of Artificial Sequence: Synthetic peptide
DEQEIRTTNPVATEQYGSVMTNLQWGNP

SEQ ID NO: 19387 - protein, 28 aa, Artificial Sequence
  Description of Artificial Sequence: Synthetic peptide
DEEEIRTTNPVATEQYGSVSTNDMQGNY

SEQ ID NO: 19388 - protein, 29 aa, Artificial Sequence
  Description of Artificial Sequence: Synthetic peptide
DEEEIRTTNPTATEQYGSVSTNEQQEGNR

SEQ ID NO: 19389 - protein, 30 aa, Artificial Sequence
  Description of Artificial Sequence: Synthetic polypeptide
DEEEIRTTNPVATEQYGSVSTVNLQRNETR

SEQ ID NO: 19390 - protein, 28 aa, Artificial Sequence
  Description of Artificial Sequence: Synthetic peptide
AEEEIRTTNPVATECYGTVATNLQRGNR

SEQ ID NO: 19391 - protein, 28 aa, Artificial Sequence
  Description of Artificial Sequence: Synthetic peptide
DENEIRTTNPVATEQWGSVSTNLMRGNA

SEQ ID NO: 19392 - protein, 28 aa, Artificial Sequence
  Description of Artificial Sequence: Synthetic peptide
DEEEIRTTNPVCTEQYGSVSTDEQQGNR

SEQ ID NO: 19393 - protein, 28 aa, Artificial Sequence
  Description of Artificial Sequence: Synthetic peptide
DENEIRCTNPDATEQYGSVSTELQRGNR

SEQ ID NO: 19394 - protein, 28 aa, Artificial Sequence
  Description of Artificial Sequence: Synthetic peptide
DENEIRTTNPVATEQYGSMSTFLQQGNR

SEQ ID NO: 19395 - protein, 29 aa, Artificial Sequence
  Description of Artificial Sequence: Synthetic peptide
DEEEIRTTNPVATEQYGSVSATELQYGNN

SEQ ID NO: 19396 - protein, 28 aa, Artificial Sequence
  Description of Artificial Sequence: Synthetic peptide
DEEEIVTTNPVATETYGDVSTNMQRGNR

SEQ ID NO: 19397 - protein, 28 aa, Artificial Sequence
  Description of Artificial Sequence: Synthetic peptide
DEEEIRTTNPCATEQYGSVSTEDQVGNR

SEQ ID NO: 19398 - protein, 28 aa, Artificial Sequence
  Description of Artificial Sequence: Synthetic peptide
DEQEIRTTNPVATEQYGSVSTNDQFGNF

SEQ ID NO: 19399 - protein, 28 aa, Artificial Sequence
  Description of Artificial Sequence: Synthetic peptide
QEAEIRTTNPVATEIYGSISTNLQRGNR

SEQ ID NO: 19400 - protein, 28 aa, Artificial Sequence
  Description of Artificial Sequence: Synthetic peptide
DEEEIRATNPCATEQYGLVSENLQRGNR

SEQ ID NO: 19401 - protein, 28 aa, Artificial Sequence
  Description of Artificial Sequence: Synthetic peptide
DEEEIRTTNPVATEQYGVVSTELQYGNT

SEQ ID NO: 19402 - protein, 29 aa, Artificial Sequence
  Description of Artificial Sequence: Synthetic peptide
DEEEIRTTNPVATEQYGSVSDNLERGEER

SEQ ID NO: 19403 - protein, 28 aa, Artificial Sequence
  Description of Artificial Sequence: Synthetic peptide
DEEELRTTNPVATEQFGSVSTNLQPGTR

SEQ ID NO: 19404 - protein, 28 aa, Artificial Sequence
  Description of Artificial Sequence: Synthetic peptide
DELEIRTTNPVATEQYGSVSTNLQFNAR

SEQ ID NO: 19405 - protein, 28 aa, Artificial Sequence
  Description of Artificial Sequence: Synthetic peptide
DEEEIRTTNPVATEQYGIVSTELQYGNL

SEQ ID NO: 19406 - protein, 28 aa, Artificial Sequence
  Description of Artificial Sequence: Synthetic peptide
DEEEIATTNPTATEQYGSVSTNEQQGNR

SEQ ID NO: 19407 - protein, 28 aa, Artificial Sequence
  Description of Artificial Sequence: Synthetic peptide
DEQEIRCTNPVAYEIYGSVSTNLQRGNR

SEQ ID NO: 19408 - protein, 30 aa, Artificial Sequence
  Description of Artificial Sequence: Synthetic polypeptide
DEEEIRTTNPVATEQYGSVSTNLQQDGNDC

SEQ ID NO: 19409 - protein, 28 aa, Artificial Sequence
  Description of Artificial Sequence: Synthetic peptide
QEEEIRTTNPVATEQYGSVPTVLQRGER

SEQ ID NO: 19410 - protein, 28 aa, Artificial Sequence
  Description of Artificial Sequence: Synthetic peptide
DEQEIRTTNPEATEQYGDVSTNLQRGNN

SEQ ID NO: 19411 - protein, 30 aa, Artificial Sequence
  Description of Artificial Sequence: Synthetic polypeptide
DEEEIRTTNPVATEQYGSVSTMNLQAGNDA

SEQ ID NO: 19412 - protein, 31 aa, Artificial Sequence
  Description of Artificial Sequence: Synthetic polypeptide
DEEEIRTTNPVATECYGSVSATNLQDRGNDR

SEQ ID NO: 19413 - protein, 28 aa, Artificial Sequence
  Description of Artificial Sequence: Synthetic peptide
DEEEISTTNPVATEQYGSVSDNLQNGNY

SEQ ID NO: 19414 - protein, 29 aa, Artificial Sequence
  Description of Artificial Sequence: Synthetic peptide
DEEEIRTTNPVATECYGSVSTDLQEHGNR

SEQ ID NO: 19415 - protein, 31 aa, Artificial Sequence
  Description of Artificial Sequence: Synthetic polypeptide
DEEEIRTTNPVATEQYGSVSTANLQEQGNTR

SEQ ID NO: 19416 - protein, 28 aa, Artificial Sequence
  Description of Artificial Sequence: Synthetic peptide
AEEEIRTTNPVATEQYGSVSENLQRGEA

SEQ ID NO: 19417 - protein, 30 aa, Artificial Sequence
  Description of Artificial Sequence: Synthetic polypeptide
MEEEIRTTNPVATEQYGSVSTNLQEVEGNR

SEQ ID NO: 19418 - protein, 29 aa, Artificial Sequence
  Description of Artificial Sequence: Synthetic peptide
DEEEIRTTGPVATEQYGSVSTNLQCNENR

SEQ ID NO: 19419 - protein, 28 aa, Artificial Sequence
  Description of Artificial Sequence: Synthetic peptide
MEEEIRPTNPVATEQYGSASTNDQRGNR

SEQ ID NO: 19420 - protein, 28 aa, Artificial Sequence
  Description of Artificial Sequence: Synthetic peptide
DEEEIRTTNPVATEQFGSVSVNLQLGNF

SEQ ID NO: 19421 - protein, 28 aa, Artificial Sequence
  Description of Artificial Sequence: Synthetic peptide
DEEEIRTTNPVATEQYGSVSTDLDPGER

SEQ ID NO: 19422 - protein, 28 aa, Artificial Sequence
  Description of Artificial Sequence: Synthetic peptide
DEEEIMTTNPVATEQYGSVSTNIQRGGT

SEQ ID NO: 19423 - protein, 29 aa, Artificial Sequence
  Description of Artificial Sequence: Synthetic peptide
DEEEIRTTNPVATECYGSVSTNLQDSGNM

SEQ ID NO: 19424 - protein, 28 aa, Artificial Sequence
  Description of Artificial Sequence: Synthetic peptide
DEEEIRTTNPVATEQYGSVSTAPQLGNQ

SEQ ID NO: 19425 - protein, 29 aa, Artificial Sequence
  Description of Artificial Sequence: Synthetic peptide
NEEEIRTTNPVATEQYGSVSMDLQRGNDR

SEQ ID NO: 19426 - protein, 28 aa, Artificial Sequence
  Description of Artificial Sequence: Synthetic peptide
DENEIRTTNPVATELYGSVSTNEQRGNA

SEQ ID NO: 19427 - protein, 28 aa, Artificial Sequence
  Description of Artificial Sequence: Synthetic peptide
DEEEIRTTNCVATEQWGIVSTNLERGNR

SEQ ID NO: 19428 - protein, 28 aa, Artificial Sequence
  Description of Artificial Sequence: Synthetic peptide
DEEEIRTTNPVATEQFGSVSENEQQGNR

SEQ ID NO: 19429 - protein, 29 aa, Artificial Sequence
  Description of Artificial Sequence: Synthetic peptide
DEEEIRTTNPVATEPYGSVSSELQRGDNR

SEQ ID NO: 19430 - protein, 29 aa, Artificial Sequence
  Description of Artificial Sequence: Synthetic peptide
DEEEIRTTNPVATEQYGSVSTDLQEIGNH

SEQ ID NO: 19431 - protein, 28 aa, Artificial Sequence
  Description of Artificial Sequence: Synthetic peptide
DENEIASTNPVATEHYGSVSTNLQRGNR

SEQ ID NO: 19432 - protein, 28 aa, Artificial Sequence
  Description of Artificial Sequence: Synthetic peptide
DEEEIATTNPVAWEQYWSVSTNLQQGNR

SEQ ID NO: 19433 - protein, 28 aa, Artificial Sequence
  Description of Artificial Sequence: Synthetic peptide
DEEEIRTTNPMATEQYGSVLTGLNRGNR

SEQ ID NO: 19434 - protein, 28 aa, Artificial Sequence
  Description of Artificial Sequence: Synthetic peptide
DEEEIRPTNPMATEQYGSISTNLQRPNR

SEQ ID NO: 19435 - protein, 28 aa, Artificial Sequence
  Description of Artificial Sequence: Synthetic peptide
DEQEIATTNPVATECYGVVSTNLQRGNR

SEQ ID NO: 19436 - protein, 28 aa, Artificial Sequence
  Description of Artificial Sequence: Synthetic peptide
DEQEIRTTNPVATEQYGCVATNLERGNR

SEQ ID NO: 19437 - protein, 28 aa, Artificial Sequence
  Description of Artificial Sequence: Synthetic peptide
DEEEVRTTNPVATEQYGSVSTNDQDGNN

SEQ ID NO: 19438 - protein, 30 aa, Artificial Sequence
  Description of Artificial Sequence: Synthetic polypeptide
DEEEIRTTNPVATEQYGSVSTELQILGNDR

SEQ ID NO: 19439 - protein, 29 aa, Artificial Sequence
  Description of Artificial Sequence: Synthetic peptide
DEVEIRTTNPVATEQYGGVISTNLQQGNR

SEQ ID NO: 19440 - protein, 28 aa, Artificial Sequence
  Description of Artificial Sequence: Synthetic peptide
QEEEIRTTNPVSTEQYGSASTNLQHGNR

SEQ ID NO: 19441 - protein, 32 aa, Artificial Sequence
  Description of Artificial Sequence: Synthetic polypeptide
DEEEIRTTNPVATEQYGSVSITNPLQRGDNPR

SEQ ID NO: 19442 - protein, 28 aa, Artificial Sequence
  Description of Artificial Sequence: Synthetic peptide
QEQEIRTTNPVATEQYGWVSDNLQRGNR

SEQ ID NO: 19443 - protein, 28 aa, Artificial Sequence
  Description of Artificial Sequence: Synthetic peptide
DEEEIRSVNPVATEQYGEVSTNAQRGNR

SEQ ID NO: 19444 - protein, 30 aa, Artificial Sequence
  Description of Artificial Sequence: Synthetic polypeptide
DEEEIRTTNPVATEQYGSVSETEDLQRGNF

SEQ ID NO: 19445 - protein, 30 aa, Artificial Sequence
  Description of Artificial Sequence: Synthetic polypeptide
DEEEIRTTNPVATEQYGSVSTNGLQILGER

SEQ ID NO: 19446 - protein, 28 aa, Artificial Sequence
  Description of Artificial Sequence: Synthetic peptide
DEEEIRCTNPVATEQYGSVSTELQRGEA

SEQ ID NO: 19447 - protein, 29 aa, Artificial Sequence
  Description of Artificial Sequence: Synthetic peptide
DEEEIRTTNPVATEQYGSVSTDLQSGEDR

SEQ ID NO: 19448 - protein, 28 aa, Artificial Sequence
  Description of Artificial Sequence: Synthetic peptide
DEDEIVTTNPVATEQYGSVPTNLQRGQR

SEQ ID NO: 19449 - protein, 28 aa, Artificial Sequence
  Description of Artificial Sequence: Synthetic peptide
DEEEISTTNPVATEQYGSVSDELQRGAR

SEQ ID NO: 19450 - protein, 28 aa, Artificial Sequence
  Description of Artificial Sequence: Synthetic peptide
DEVEIRTTNPVATEIYGSVSTNDQRGNS

SEQ ID NO: 19451 - protein, 29 aa, Artificial Sequence
  Description of Artificial Sequence: Synthetic peptide
SEEEITTTNPVATEQYGSVSTNLQQRGNF

SEQ ID NO: 19452 - protein, 28 aa, Artificial Sequence
  Description of Artificial Sequence: Synthetic peptide
DEEEIRTTNPVATECYGSVSNNLERGER

SEQ ID NO: 19453 - protein, 28 aa, Artificial Sequence
  Description of Artificial Sequence: Synthetic peptide
SEEEIRTTNPVCTEQYGCVSTNLQGGNR

SEQ ID NO: 19454 - protein, 29 aa, Artificial Sequence
  Description of Artificial Sequence: Synthetic peptide
DEDEIVTTNPVATEQYGSVSADNLQRGNR

SEQ ID NO: 19455 - protein, 28 aa, Artificial Sequence
  Description of Artificial Sequence: Synthetic peptide
DEEEIRTVNPVATEMYGSMSTNLQRGER

SEQ ID NO: 19456 - protein, 28 aa, Artificial Sequence
  Description of Artificial Sequence: Synthetic peptide
DENEIVATNPVATEMYGSVSTNLQRGNR

SEQ ID NO: 19457 - protein, 28 aa, Artificial Sequence
  Description of Artificial Sequence: Synthetic peptide
DEEEIRTTNPVATECYGVVSTNLQLGNS

SEQ ID NO: 19458 - protein, 28 aa, Artificial Sequence
  Description of Artificial Sequence: Synthetic peptide
DEEPIRTTNPVATAQYGSVSTNLIRINR

SEQ ID NO: 19459 - protein, 28 aa, Artificial Sequence
  Description of Artificial Sequence: Synthetic peptide
DEEEIRTTNPVATEQYGSVSTELQYGEW

SEQ ID NO: 19460 - protein, 28 aa, Artificial Sequence
  Description of Artificial Sequence: Synthetic peptide
DEEEIRTTNPVATEQYGEVSTMLQLGKR

SEQ ID NO: 19461 - protein, 28 aa, Artificial Sequence
  Description of Artificial Sequence: Synthetic peptide
DEEEIRTTNPVATECYGSVSTDLERGND

SEQ ID NO: 19462 - protein, 30 aa, Artificial Sequence
  Description of Artificial Sequence: Synthetic polypeptide
DEEEIRTTNPVATEQYGSVSTNLQESGNDQ

SEQ ID NO: 19463 - protein, 29 aa, Artificial Sequence
  Description of Artificial Sequence: Synthetic peptide
DEEEIRTTNPVATEPYGSVSIDNLQRGNY

SEQ ID NO: 19464 - protein, 28 aa, Artificial Sequence
  Description of Artificial Sequence: Synthetic peptide
DEEEIRTTNPVASENYGAVSMNLQRGNR

SEQ ID NO: 19465 - protein, 28 aa, Artificial Sequence
  Description of Artificial Sequence: Synthetic peptide
DEEEIRTTNPVATEQYGSVSTDLQYNND

SEQ ID NO: 19466 - protein, 28 aa, Artificial Sequence
  Description of Artificial Sequence: Synthetic peptide
DEEEIRTTNPGATEQYGSVSYEDQRGNR

SEQ ID NO: 19467 - protein, 28 aa, Artificial Sequence
  Description of Artificial Sequence: Synthetic peptide
DEEEIRTTNPVATEQYGVVSTVLQAGNY

SEQ ID NO: 19468 - protein, 30 aa, Artificial Sequence
  Description of Artificial Sequence: Synthetic polypeptide
DEEEIRTTNPVATEQYGSVSTMNEQDIGNR

SEQ ID NO: 19469 - protein, 30 aa, Artificial Sequence
  Description of Artificial Sequence: Synthetic polypeptide
DEEEIRTTNPVATEQYGSVSTNPLQRGDEP

SEQ ID NO: 19470 - protein, 28 aa, Artificial Sequence
  Description of Artificial Sequence: Synthetic peptide
DEVEIRTTNPVATEQFGSVSTNEQNGNR

SEQ ID NO: 19471 - protein, 31 aa, Artificial Sequence
  Description of Artificial Sequence: Synthetic polypeptide
DEEEIRTTNPVATEQYGSVSTNLQEREGNDY

SEQ ID NO: 19472 - protein, 28 aa, Artificial Sequence
  Description of Artificial Sequence: Synthetic peptide
DEEEQRTTNPVAWEQYGSVSTNLQNGNV

SEQ ID NO: 19473 - protein, 29 aa, Artificial Sequence
  Description of Artificial Sequence: Synthetic peptide
DEEEIRTTNPVATEQYGSVSTDLQRKGEI

SEQ ID NO: 19474 - protein, 28 aa, Artificial Sequence
  Description of Artificial Sequence: Synthetic peptide
DEEEIRTTNPVATEQYGSVSTGLEPGNV

SEQ ID NO: 19475 - protein, 29 aa, Artificial Sequence
  Description of Artificial Sequence: Synthetic peptide
DEEEIRPTNPVATEQYGSVQHTNPQRGNR

SEQ ID NO: 19476 - protein, 28 aa, Artificial Sequence
  Description of Artificial Sequence: Synthetic peptide
DDEEVRCTNPVATEQYGSVSTNLERGNR

SEQ ID NO: 19477 - protein, 31 aa, Artificial Sequence
  Description of Artificial Sequence: Synthetic polypeptide
DEEEIRSTNPVATEQYGHSVSTNLQPRGNNR

SEQ ID NO: 19478 - protein, 29 aa, Artificial Sequence
  Description of Artificial Sequence: Synthetic peptide
DEMEICTTNPVATEQYGSLVSTNLQRGNV

SEQ ID NO: 19479 - protein, 28 aa, Artificial Sequence
  Description of Artificial Sequence: Synthetic peptide
DEQEIRTTNPVATEQYGSVSTDDQRGNF

SEQ ID NO: 19480 - protein, 30 aa, Artificial Sequence
  Description of Artificial Sequence: Synthetic polypeptide
DEQEIRTTNPVATESYGSVSTTNLQRGENR

SEQ ID NO: 19481 - protein, 28 aa, Artificial Sequence
  Description of Artificial Sequence: Synthetic peptide
DEEEIRCTNPVSTEQYGTVSTDLQRGNR

SEQ ID NO: 19482 - protein, 29 aa, Artificial Sequence
  Description of Artificial Sequence: Synthetic peptide
DEEEIRTTNPVATEQYGTVSTGDLQRGNI

SEQ ID NO: 19483 - protein, 29 aa, Artificial Sequence
  Description of Artificial Sequence: Synthetic peptide
DEEEIRTTNPVATEQWGSVSENEQMRGNR

SEQ ID NO: 19484 - protein, 28 aa, Artificial Sequence
  Description of Artificial Sequence: Synthetic peptide
DEEEIRTTNPVATCQYGSVSENLMEGNR

SEQ ID NO: 19485 - protein, 30 aa, Artificial Sequence
  Description of Artificial Sequence: Synthetic polypeptide
DEEEIRTTNPTATEQYGSVSTCNLQDRGNS

SEQ ID NO: 19486 - protein, 28 aa, Artificial Sequence
  Description of Artificial Sequence: Synthetic peptide
DENEIRTTNPVATEQYGIVSENLQIGNR

SEQ ID NO: 19487 - protein, 28 aa, Artificial Sequence
  Description of Artificial Sequence: Synthetic peptide
DESEIRCTNPVATEQYGSASTNLQWGNR

SEQ ID NO: 19488 - protein, 28 aa, Artificial Sequence
  Description of Artificial Sequence: Synthetic peptide
LEEEIVTTNPVATEQYGSTSGNLQRGNR

SEQ ID NO: 19489 - protein, 28 aa, Artificial Sequence
  Description of Artificial Sequence: Synthetic peptide
DEEEIATTNPVATEHYGVVSTNLQRGNQ

SEQ ID NO: 19490 - protein, 30 aa, Artificial Sequence
  Description of Artificial Sequence: Synthetic polypeptide
MEEEIRTTNPVATEQYGSVSTNLQNEGNDR

SEQ ID NO: 19491 - protein, 29 aa, Artificial Sequence
  Description of Artificial Sequence: Synthetic peptide
DEEEIETTNPVATEMWGSVSTNNLQRGNR

SEQ ID NO: 19492 - protein, 28 aa, Artificial Sequence
  Description of Artificial Sequence: Synthetic peptide
DEEEIRTTNPVATEQYGSVCTDLQREER

SEQ ID NO: 19493 - protein, 29 aa, Artificial Sequence
  Description of Artificial Sequence: Synthetic peptide
DEGEIRTTNPVATEQYGSVEENLQRTGNR

SEQ ID NO: 19494 - protein, 28 aa, Artificial Sequence
  Description of Artificial Sequence: Synthetic peptide
DEEEICTTNPVATEQYGSVSDNLQRGMG

SEQ ID NO: 19495 - protein, 28 aa, Artificial Sequence
  Description of Artificial Sequence: Synthetic peptide
DEEEIRTTNPVCTAQYGSVSSGLQRGNR

SEQ ID NO: 19496 - protein, 28 aa, Artificial Sequence
  Description of Artificial Sequence: Synthetic peptide
DEEEIRTTNPVATEQYGSSSENDQRLNR

SEQ ID NO: 19497 - protein, 28 aa, Artificial Sequence
  Description of Artificial Sequence: Synthetic peptide
DEQEIRTTNPVATEQWGSVSENLMRGNR

SEQ ID NO: 19498 - protein, 28 aa, Artificial Sequence
  Description of Artificial Sequence: Synthetic peptide
DEEEIRTTNPVATELYGSVSENEQRGNA

SEQ ID NO: 19499 - protein, 31 aa, Artificial Sequence
  Description of Artificial Sequence: Synthetic polypeptide
DEEEIRTTNPVATEQYGSVDSTNLQRGLNYY

SEQ ID NO: 19500 - protein, 28 aa, Artificial Sequence
  Description of Artificial Sequence: Synthetic peptide
DEEEIRTTNPVATEMYGSVGSNLERGNR

SEQ ID NO: 19501 - protein, 28 aa, Artificial Sequence
  Description of Artificial Sequence: Synthetic peptide
DEVEIRTTNPVATEQWGSCSTILQRGNR

SEQ ID NO: 19502 - protein, 28 aa, Artificial Sequence
  Description of Artificial Sequence: Synthetic peptide
NEEEIATTNPVSTEIYGSVSTNLQRGNR

SEQ ID NO: 19503 - protein, 28 aa, Artificial Sequence
  Description of Artificial Sequence: Synthetic peptide
DEEEIRTTNPVATEQYGSVITCLQRGAM

SEQ ID NO: 19504 - protein, 28 aa, Artificial Sequence
  Description of Artificial Sequence: Synthetic peptide
CEEEIRTTNPVATEQYGAVSTNELRGNR

SEQ ID NO: 19505 - protein, 28 aa, Artificial Sequence
  Description of Artificial Sequence: Synthetic peptide
DEEEIRTTNPVATEMYGSVSTNEQQGNF

SEQ ID NO: 19506 - protein, 28 aa, Artificial Sequence
  Description of Artificial Sequence: Synthetic peptide
DEEEIRTTNPVATNAYGSVFTNLQSGNR

SEQ ID NO: 19507 - protein, 29 aa, Artificial Sequence
  Description of Artificial Sequence: Synthetic peptide
DEEEIRTTNPVATEQYGSVSTDLQNGNDQ

SEQ ID NO: 19508 - protein, 30 aa, Artificial Sequence
  Description of Artificial Sequence: Synthetic polypeptide
DEEEIRTTNPVATEQYGSLSINLQEREGNR

SEQ ID NO: 19509 - protein, 31 aa, Artificial Sequence
  Description of Artificial Sequence: Synthetic polypeptide
DEEEIRTTNPVATEQYGSVSTENLERNGDNR

SEQ ID NO: 19510 - protein, 28 aa, Artificial Sequence
  Description of Artificial Sequence: Synthetic peptide
DEEEIRCTNPACTEQYGSVSTNLQQGNR

SEQ ID NO: 19511 - protein, 29 aa, Artificial Sequence
  Description of Artificial Sequence: Synthetic peptide
DEEEIRTTNPVATEQYGDVSEINLQRGNV

SEQ ID NO: 19512 - protein, 28 aa, Artificial Sequence
  Description of Artificial Sequence: Synthetic peptide
DEEEIRATNPVATEMYGSVSTNLQSGDR

SEQ ID NO: 19513 - protein, 29 aa, Artificial Sequence
  Description of Artificial Sequence: Synthetic peptide
DEEEIRTTNPVATEQYGSVSATNLILGNP

SEQ ID NO: 19514 - protein, 28 aa, Artificial Sequence
  Description of Artificial Sequence: Synthetic peptide
SEGEIRTTNPVATEMYGSVSTNLQRGNM

SEQ ID NO: 19515 - protein, 30 aa, Artificial Sequence
  Description of Artificial Sequence: Synthetic polypeptide
DEEEIRTTNPVATEQYGSVSTELQPNGDNR

SEQ ID NO: 19516 - protein, 29 aa, Artificial Sequence
  Description of Artificial Sequence: Synthetic peptide
SEEEIRTTNPVATEQYGSVSTLLQREGDR

SEQ ID NO: 19517 - protein, 29 aa, Artificial Sequence
  Description of Artificial Sequence: Synthetic peptide
DEEEIRTTNPVATEQYGSVSTGNDQPDNR

SEQ ID NO: 19518 - protein, 29 aa, Artificial Sequence
  Description of Artificial Sequence: Synthetic peptide
DEEEIRTTNPVATEQYGSVSENLQEDGNN

SEQ ID NO: 19519 - protein, 30 aa, Artificial Sequence
  Description of Artificial Sequence: Synthetic polypeptide
DEEEIRTTNPVATEQYGSVSTNLQRKGEEM

SEQ ID NO: 19520 - protein, 28 aa, Artificial Sequence
  Description of Artificial Sequence: Synthetic peptide
DEEEIRTTNPVATEQYGSVGSNLQIENR

SEQ ID NO: 19521 - protein, 28 aa, Artificial Sequence
  Description of Artificial Sequence: Synthetic peptide
DEQEIRTTNPVATEQYGDVDTNLQHGNR

SEQ ID NO: 19522 - protein, 30 aa, Artificial Sequence
  Description of Artificial Sequence: Synthetic polypeptide
DEQEIRSTNPVATEQYGSVSTGNLQDRGNR

SEQ ID NO: 19523 - protein, 28 aa, Artificial Sequence
  Description of Artificial Sequence: Synthetic peptide
DDEEIRTTNPVATECYGAVATNLQRGNR

SEQ ID NO: 19524 - protein, 28 aa, Artificial Sequence
  Description of Artificial Sequence: Synthetic peptide
NEHEIRTTNPVCTEQYGSASTNLQRGNR

SEQ ID NO: 19525 - protein, 28 aa, Artificial Sequence
  Description of Artificial Sequence: Synthetic peptide
AESEIRTTNPVATEQYGSVSTNLQAGNQ

SEQ ID NO: 19526 - protein, 29 aa, Artificial Sequence
  Description of Artificial Sequence: Synthetic peptide
DEEEIRTTNPCATEQYGCVCTNLQREGNR

SEQ ID NO: 19527 - protein, 28 aa, Artificial Sequence
  Description of Artificial Sequence: Synthetic peptide
DENEIRTTNPVATEIYGSVSTNLQRGTF

SEQ ID NO: 19528 - protein, 29 aa, Artificial Sequence
  Description of Artificial Sequence: Synthetic peptide
DEEEIRTTNPVATEQYGSVSTTPLQLGNN

SEQ ID NO: 19529 - protein, 28 aa, Artificial Sequence
  Description of Artificial Sequence: Synthetic peptide
DEQEIRTTNPCATEQYGCVSNNLQRGNR

SEQ ID NO: 19530 - protein, 28 aa, Artificial Sequence
  Description of Artificial Sequence: Synthetic peptide
DEEEIRTTNPVATEQYGDVDENLQHGNR

SEQ ID NO: 19531 - protein, 29 aa, Artificial Sequence
  Description of Artificial Sequence: Synthetic peptide
DEEEIRTTNPVATEQYGSVSTNLEIQGER

SEQ ID NO: 19532 - protein, 28 aa, Artificial Sequence
  Description of Artificial Sequence: Synthetic peptide
DEEEIRTTNPVATEGYGSVSTNDQYGNM

SEQ ID NO: 19533 - protein, 28 aa, Artificial Sequence
  Description of Artificial Sequence: Synthetic peptide
DEEEIRTTNPVATEQYGSASENLQRGMI

SEQ ID NO: 19534 - protein, 28 aa, Artificial Sequence
  Description of Artificial Sequence: Synthetic peptide
DETEIRTTNPVATEQYGSVSTNLDIGNE

SEQ ID NO: 19535 - protein, 30 aa, Artificial Sequence
  Description of Artificial Sequence: Synthetic polypeptide
DEEEIRTTNPVATEQYGSVSTNLEVGENDR

SEQ ID NO: 19536 - protein, 28 aa, Artificial Sequence
  Description of Artificial Sequence: Synthetic peptide
DEEEIRTSNPVATECYGSVSTNLQRGDQ

SEQ ID NO: 19537 - protein, 28 aa, Artificial Sequence
  Description of Artificial Sequence: Synthetic peptide
DEEEIRTTNPVATECYGSVSTDLQTGNS

SEQ ID NO: 19538 - protein, 29 aa, Artificial Sequence
  Description of Artificial Sequence: Synthetic peptide
DEEEIRTTNPVATEQYGSVSCENLQHGNS

SEQ ID NO: 19539 - protein, 29 aa, Artificial Sequence
  Description of Artificial Sequence: Synthetic peptide
DEEEIRTTNPVATEQYGSVSTANEQLGNV

SEQ ID NO: 19540 - protein, 28 aa, Artificial Sequence
  Description of Artificial Sequence: Synthetic peptide
DEEEIRQTNPVATEQYGSASTGLQRGNN

SEQ ID NO: 19541 - protein, 32 aa, Artificial Sequence
  Description of Artificial Sequence: Synthetic polypeptide
DEEEIRTTNPVATEQYGSVSETNLVQERDGNR

SEQ ID NO: 19542 - protein, 28 aa, Artificial Sequence
  Description of Artificial Sequence: Synthetic peptide
DEQEIVSTNPVATEQYGVVSTNLQRGNR

SEQ ID NO: 19543 - protein, 28 aa, Artificial Sequence
  Description of Artificial Sequence: Synthetic peptide
DENEIRTTNPVATELWGSVSTNLMRGNR

SEQ ID NO: 19544 - protein, 30 aa, Artificial Sequence
  Description of Artificial Sequence: Synthetic polypeptide
AEEEIRTTNPVATEQYGSASTCNPLQRGNR

SEQ ID NO: 19545 - protein, 28 aa, Artificial Sequence
  Description of Artificial Sequence: Synthetic peptide
DEEEIATTNPVATEQYGSVPTCLQHGNR

SEQ ID NO: 19546 - protein, 28 aa, Artificial Sequence
  Description of Artificial Sequence: Synthetic peptide
DEEEIAATNPVATENYGSVATNLQRGNR

SEQ ID NO: 19547 - protein, 28 aa, Artificial Sequence
  Description of Artificial Sequence: Synthetic peptide
DEMEIRTTNPVATEQYGGVSTNLQGGNI

SEQ ID NO: 19548 - protein, 28 aa, Artificial Sequence
  Description of Artificial Sequence: Synthetic peptide
DEEEIRTTNPVATEQYGSVPTLLENGNR

SEQ ID NO: 19549 - protein, 28 aa, Artificial Sequence
  Description of Artificial Sequence: Synthetic peptide
DETEIRTTNPVATEQYGSVSTALQQGNI

SEQ ID NO: 19550 - protein, 29 aa, Artificial Sequence
  Description of Artificial Sequence: Synthetic peptide
GEEEIRTTNPVATEQYGSVSEGNLQGGNR

SEQ ID NO: 19551 - protein, 28 aa, Artificial Sequence
  Description of Artificial Sequence: Synthetic peptide
DEEEIRTTNPVATEQYGSVSENLQHGEA

SEQ ID NO: 19552 - protein, 29 aa, Artificial Sequence
  Description of Artificial Sequence: Synthetic peptide
DEEEIRTTNPVATEQYGSVSENLQAGNDM

SEQ ID NO: 19553 - protein, 29 aa, Artificial Sequence
  Description of Artificial Sequence: Synthetic peptide
DEEEIRTTNPVATEQYGSVSENEMMRGNR

SEQ ID NO: 19554 - protein, 28 aa, Artificial Sequence
  Description of Artificial Sequence: Synthetic peptide
DEEEIRTTNPVATEQYGSVSTNDQDGED

SEQ ID NO: 19555 - protein, 28 aa, Artificial Sequence
  Description of Artificial Sequence: Synthetic peptide
DEEEIATTNPVATEQYGSVSTDLQIGNT

SEQ ID NO: 19556 - protein, 29 aa, Artificial Sequence
  Description of Artificial Sequence: Synthetic peptide
QEEEIRTTNPVATEQYGSVSENLQDHGNR

SEQ ID NO: 19557 - protein, 28 aa, Artificial Sequence
  Description of Artificial Sequence: Synthetic peptide
DEEEIRTTNPVATEQYGSVSTELQNGDS

SEQ ID NO: 19558 - protein, 29 aa, Artificial Sequence
  Description of Artificial Sequence: Synthetic peptide
DDEEIRTTNPVATEMYGWVSTNLQMRGNR

SEQ ID NO: 19559 - protein, 28 aa, Artificial Sequence
  Description of Artificial Sequence: Synthetic peptide
KENEIRTTNPVATEQYGSVSENLQRGNQ

SEQ ID NO: 19560 - protein, 28 aa, Artificial Sequence
  Description of Artificial Sequence: Synthetic peptide
DEQEIRTTNPVATEQYGSVSTDLQRENF

SEQ ID NO: 19561 - protein, 31 aa, Artificial Sequence
  Description of Artificial Sequence: Synthetic polypeptide
DEEEIRTTNPVATEQYGSVSTNNLQVSGNDR

SEQ ID NO: 19562 - protein, 28 aa, Artificial Sequence
  Description of Artificial Sequence: Synthetic peptide
QEEEIATTNPVATEQYGSVSTNLQHGNN

SEQ ID NO: 19563 - protein, 28 aa, Artificial Sequence
  Description of Artificial Sequence: Synthetic peptide
DEEEIRCTNPVATEQYGSYSTNLQLGNF

SEQ ID NO: 19564 - protein, 30 aa, Artificial Sequence
  Description of Artificial Sequence: Synthetic polypeptide
DEEEIRTTNPVATEQYGSVSTGNPQRGENL

SEQ ID NO: 19565 - protein, 29 aa, Artificial Sequence
  Description of Artificial Sequence: Synthetic peptide
DEEETRATNPVATEQYGSVSTNLQQRGGR

SEQ ID NO: 19566 - protein, 30 aa, Artificial Sequence
  Description of Artificial Sequence: Synthetic polypeptide
DEEEIRTTNPVATEQYGSVSTDNDDERGNR

SEQ ID NO: 19567 - protein, 30 aa, Artificial Sequence
  Description of Artificial Sequence: Synthetic polypeptide
DEEEIRTTNPVATEQYGSVSTGNPQIEGNR

SEQ ID NO: 19568 - protein, 31 aa, Artificial Sequence
  Description of Artificial Sequence: Synthetic polypeptide
DEEEIRTTNPVATEQYGSISTNLQYRAGNDR

SEQ ID NO: 19569 - protein, 28 aa, Artificial Sequence
  Description of Artificial Sequence: Synthetic peptide
MENEIRTTNPVATEQYGSVSTNLQNGNQ

SEQ ID NO: 19570 - protein, 31 aa, Artificial Sequence
  Description of Artificial Sequence: Synthetic polypeptide
DEEEIRTTNPVATEQYGSVSTNLQLRNGNDT

SEQ ID NO: 19571 - protein, 28 aa, Artificial Sequence
  Description of Artificial Sequence: Synthetic peptide
KEEEIRTTNPVATEQYGESGTNLQRGNR

SEQ ID NO: 19572 - protein, 28 aa, Artificial Sequence
  Description of Artificial Sequence: Synthetic peptide
DEEEIRTTNPVATEQYGSYSENLMIGNR

SEQ ID NO: 19573 - protein, 28 aa, Artificial Sequence
  Description of Artificial Sequence: Synthetic peptide
DEAEIYTTNPVATEQYGSVSTDLQRGNI

SEQ ID NO: 19574 - protein, 28 aa, Artificial Sequence
  Description of Artificial Sequence: Synthetic peptide
DEEEIRQTNPVATEQYGQVSTELQEGNR

SEQ ID NO: 19575 - protein, 28 aa, Artificial Sequence
  Description of Artificial Sequence: Synthetic peptide
MEEEIRTTNPVATECYGSVSTDLQRGNQ

SEQ ID NO: 19576 - protein, 28 aa, Artificial Sequence
  Description of Artificial Sequence: Synthetic peptide
DEQEIRTTNPVATEQYGSVSTNLQGGDM

SEQ ID NO: 19577 - protein, 28 aa, Artificial Sequence
  Description of Artificial Sequence: Synthetic peptide
DEEEIRTTNPVACEIYGSVSTNLQSGNL

SEQ ID NO: 19578 - protein, 29 aa, Artificial Sequence
  Description of Artificial Sequence: Synthetic peptide
DEEEIRTTNPVATEQYGSVSENLQDTGNH

SEQ ID NO: 19579 - protein, 31 aa, Artificial Sequence
  Description of Artificial Sequence: Synthetic polypeptide
DEEEIRTTNPVATEQYGSVSTPNLTQNKGNR

SEQ ID NO: 19580 - protein, 28 aa, Artificial Sequence
  Description of Artificial Sequence: Synthetic peptide
DEEEIATTNPVATEQYGIVGTNLQRGTR

SEQ ID NO: 19581 - protein, 28 aa, Artificial Sequence
  Description of Artificial Sequence: Synthetic peptide
DEEEIRTTNPVATELYGSVSTAWQRGND

SEQ ID NO: 19582 - protein, 28 aa, Artificial Sequence
  Description of Artificial Sequence: Synthetic peptide
DEEEIRTTNPVATEQYGSVSTNLEDGEQ

SEQ ID NO: 19583 - protein, 28 aa, Artificial Sequence
  Description of Artificial Sequence: Synthetic peptide
DEEEIRTTNPVATECWGSVSTNLQIGDR

SEQ ID NO: 19584 - protein, 31 aa, Artificial Sequence
  Description of Artificial Sequence: Synthetic polypeptide
DEECIRTTNPVATEQYWGSVESTNLQRGDNR

SEQ ID NO: 19585 - protein, 29 aa, Artificial Sequence
  Description of Artificial Sequence: Synthetic peptide
DEEEIRTTNPVATEQYGSVSTMDLQAGNN

SEQ ID NO: 19586 - protein, 28 aa, Artificial Sequence
  Description of Artificial Sequence: Synthetic peptide
DEEEIRTTNPVATECYGSASTNEQRENR

SEQ ID NO: 19587 - protein, 30 aa, Artificial Sequence
  Description of Artificial Sequence: Synthetic polypeptide
DEEEIRTTNPVATEQYGEVSTNLVQHGTNR

SEQ ID NO: 19588 - protein, 28 aa, Artificial Sequence
  Description of Artificial Sequence: Synthetic peptide
DEEEIRTTNPVATETYGGVSTDLQRGNY

SEQ ID NO: 19589 - protein, 28 aa, Artificial Sequence
  Description of Artificial Sequence: Synthetic peptide
DEQEIRTTNPVATEQYGDVDTNLQQGNR

SEQ ID NO: 19590 - protein, 30 aa, Artificial Sequence
  Description of Artificial Sequence: Synthetic polypeptide
DEEEIRTTNPVATEQYGSVSDTDLQHGENR

SEQ ID NO: 19591 - protein, 28 aa, Artificial Sequence
  Description of Artificial Sequence: Synthetic peptide
DEEEIRCTNPVSTEQYGGVGTNLQRGNR

SEQ ID NO: 19592 - protein, 28 aa, Artificial Sequence
  Description of Artificial Sequence: Synthetic peptide
SEEEIRTTNPVATEMFGSVSTNLQSGNR

SEQ ID NO: 19593 - protein, 28 aa, Artificial Sequence
  Description of Artificial Sequence: Synthetic peptide
DEEEIATTNPVATEQYGSVSTNLEHGNA

SEQ ID NO: 19594 - protein, 29 aa, Artificial Sequence
  Description of Artificial Sequence: Synthetic peptide
MEEEIRTTNPVATEQYGSVSTNLQEHGNW

SEQ ID NO: 19595 - protein, 28 aa, Artificial Sequence
  Description of Artificial Sequence: Synthetic peptide
DDEEIRTVNPVATEQYGSVASNLQRGNR

SEQ ID NO: 19596 - protein, 28 aa, Artificial Sequence
  Description of Artificial Sequence: Synthetic peptide
DEEEIRTTNPVATEQYGSVSTELQAGDE

SEQ ID NO: 19597 - protein, 30 aa, Artificial Sequence
  Description of Artificial Sequence: Synthetic polypeptide
DEEEIRTTNPVATEQYGSVSCTELQCRGNF

SEQ ID NO: 19598 - protein, 28 aa, Artificial Sequence
  Description of Artificial Sequence: Synthetic peptide
DEEEIRTTNPVATEQYGTVSTDLQVGNA

SEQ ID NO: 19599 - protein, 28 aa, Artificial Sequence
  Description of Artificial Sequence: Synthetic peptide
MEEEIVTTNPVATEQYGSVSEELQRGNR

SEQ ID NO: 19600 - protein, 28 aa, Artificial Sequence
  Description of Artificial Sequence: Synthetic peptide
DEEEIRTTNPVATEQYGSVSTEGQTGNL

SEQ ID NO: 19601 - protein, 30 aa, Artificial Sequence
  Description of Artificial Sequence: Synthetic polypeptide
DEEEIRTTNPVATEQYGSVSTNLQESGNDI

SEQ ID NO: 19602 - protein, 28 aa, Artificial Sequence
  Description of Artificial Sequence: Synthetic peptide
DEHEIRTTNPVATEQYGDVSTDLQGGNR

SEQ ID NO: 19603 - protein, 28 aa, Artificial Sequence
  Description of Artificial Sequence: Synthetic peptide
DEEEIATTNPTATEQYGSVSTNPQRGNA

SEQ ID NO: 19604 - protein, 28 aa, Artificial Sequence
  Description of Artificial Sequence: Synthetic peptide
DENEIRTTNPVATEQYGSVSTNLMRMNQ

SEQ ID NO: 19605 - protein, 28 aa, Artificial Sequence
  Description of Artificial Sequence: Synthetic peptide
DEEEIRTTNPVATEQYGSVSEDLCRGNC

SEQ ID NO: 19606 - protein, 28 aa, Artificial Sequence
  Description of Artificial Sequence: Synthetic peptide
DEQEIRTTNPVATEQYGDVSTNDQHGNR

SEQ ID NO: 19607 - protein, 28 aa, Artificial Sequence
  Description of Artificial Sequence: Synthetic peptide
DEEEICTTNPVATELYGSVGTELQRGNR

SEQ ID NO: 19608 - protein, 30 aa, Artificial Sequence
  Description of Artificial Sequence: Synthetic polypeptide
DEEEIRTTNPVATEQYGSVNGTNLQERLNR

SEQ ID NO: 19609 - protein, 28 aa, Artificial Sequence
  Description of Artificial Sequence: Synthetic peptide
SESEIRTTNPVATEVYGSVSTNLQGGNR

SEQ ID NO: 19610 - protein, 28 aa, Artificial Sequence
  Description of Artificial Sequence: Synthetic peptide
DEEEIRTTNPTATEQYGSVSTNPQLGNQ

SEQ ID NO: 19611 - protein, 28 aa, Artificial Sequence
  Description of Artificial Sequence: Synthetic peptide
DEEEITGTNPVATEQYGSVDTNLQRGNV

SEQ ID NO: 19612 - protein, 28 aa, Artificial Sequence
  Description of Artificial Sequence: Synthetic peptide
DEEEIRTTNPTATEQYGSVSTNEQVGNL

SEQ ID NO: 19613 - protein, 28 aa, Artificial Sequence
  Description of Artificial Sequence: Synthetic peptide
SEEEIATTNPVATEQFGSVSTNLQRGDR

SEQ ID NO: 19614 - protein, 28 aa, Artificial Sequence
  Description of Artificial Sequence: Synthetic peptide
DEEQIRTTNPVATEQWGWVSTNLQRGNI

SEQ ID NO: 19615 - protein, 30 aa, Artificial Sequence
  Description of Artificial Sequence: Synthetic polypeptide
DEQEIRTTNPVATEQYGSVSCTMNLCRGNR

SEQ ID NO: 19616 - protein, 28 aa, Artificial Sequence
  Description of Artificial Sequence: Synthetic peptide
DEEEIRSTNPVATEQYGAVSTNLQQGNF

SEQ ID NO: 19617 - protein, 28 aa, Artificial Sequence
  Description of Artificial Sequence: Synthetic peptide
DELEIRTTNPVATEQYGSVSENLQNGNV

SEQ ID NO: 19618 - protein, 30 aa, Artificial Sequence
  Description of Artificial Sequence: Synthetic polypeptide
DEECIRTTNPVATEQYGESYVETNLQRGNR

SEQ ID NO: 19619 - protein, 30 aa, Artificial Sequence
  Description of Artificial Sequence: Synthetic polypeptide
DEQEIRTTNPVATEIYGSVSATNLQREGNR

SEQ ID NO: 19620 - protein, 28 aa, Artificial Sequence
  Description of Artificial Sequence: Synthetic peptide
DEEEIRTTNPVATEQYGSVSTNLEHGEW

SEQ ID NO: 19621 - protein, 29 aa, Artificial Sequence
  Description of Artificial Sequence: Synthetic peptide
MEEEIRTTNPVATEQYGSVSTNLQEIGNN

SEQ ID NO: 19622 - protein, 28 aa, Artificial Sequence
  Description of Artificial Sequence: Synthetic peptide
DEEEIRTTNPVATEQYGSVSTGPYRGNG

SEQ ID NO: 19623 - protein, 28 aa, Artificial Sequence
  Description of Artificial Sequence: Synthetic peptide
DEEEIRTTNPVATEQYGSVSTEPQEGNY

SEQ ID NO: 19624 - protein, 30 aa, Artificial Sequence
  Description of Artificial Sequence: Synthetic polypeptide
DEEEIRTTNPVATMQYGSVSTNRLQSGNPR

SEQ ID NO: 19625 - protein, 28 aa, Artificial Sequence
  Description of Artificial Sequence: Synthetic peptide
DEQEIRTTNPVATEQYGSVSTNLQSGDQ

SEQ ID NO: 19626 - protein, 30 aa, Artificial Sequence
  Description of Artificial Sequence: Synthetic polypeptide
DEEEIRCTNPVATEQYGSVSTNNLVRGNER

SEQ ID NO: 19627 - protein, 30 aa, Artificial Sequence
  Description of Artificial Sequence: Synthetic polypeptide
AEEEIRTTNPVATEQYGSVSTDLQLREGNR

SEQ ID NO: 19628 - protein, 29 aa, Artificial Sequence
  Description of Artificial Sequence: Synthetic peptide
DEEEIRTTNPVATEQYGDVSCEDLQRGNR

SEQ ID NO: 19629 - protein, 29 aa, Artificial Sequence
  Description of Artificial Sequence: Synthetic peptide
DEEEIRTTNPDATFQYGSVSTNLQPGNDR

SEQ ID NO: 19630 - protein, 30 aa, Artificial Sequence
  Description of Artificial Sequence: Synthetic polypeptide
DEEEIRTTNPVATEQYGSVSTNLQEAGNDC

SEQ ID NO: 19631 - protein, 29 aa, Artificial Sequence
  Description of Artificial Sequence: Synthetic peptide
DEEEIATVNPVATEVYGSVSTNLQRAGNR

SEQ ID NO: 19632 - protein, 28 aa, Artificial Sequence
  Description of Artificial Sequence: Synthetic peptide
DEEEIRTTNPDATEQYGSVSTNLDMGER

SEQ ID NO: 19633 - protein, 29 aa, Artificial Sequence
  Description of Artificial Sequence: Synthetic peptide
DEEEIRTTNPEATEQYGSVSTIDLQRGNI

SEQ ID NO: 19634 - protein, 28 aa, Artificial Sequence
  Description of Artificial Sequence: Synthetic peptide
DENEIRTTNPVATECYGDVSTNLQRGER

SEQ ID NO: 19635 - protein, 30 aa, Artificial Sequence
  Description of Artificial Sequence: Synthetic polypeptide
DEQEIRTTNPVATEVYGSVSATNLQREGNR

SEQ ID NO: 19636 - protein, 29 aa, Artificial Sequence
  Description of Artificial Sequence: Synthetic peptide
DEEEIRTTNPVATEQYGIVSAENLQRGQR

SEQ ID NO: 19637 - protein, 28 aa, Artificial Sequence
  Description of Artificial Sequence: Synthetic peptide
DEEEIRATNPIATEQFGSVSSNLQRGNR

SEQ ID NO: 19638 - protein, 28 aa, Artificial Sequence
  Description of Artificial Sequence: Synthetic peptide
SEEEIRTTNPVATEVYGCVSTNLERGNR

SEQ ID NO: 19639 - protein, 31 aa, Artificial Sequence
  Description of Artificial Sequence: Synthetic polypeptide
DEEEIRTTNPVATEQYGDSYVSTNPLQRGER

SEQ ID NO: 19640 - protein, 28 aa, Artificial Sequence
  Description of Artificial Sequence: Synthetic peptide
DEEEIRTTNPVATECYGSVSTDLQRGEP

SEQ ID NO: 19641 - protein, 28 aa, Artificial Sequence
  Description of Artificial Sequence: Synthetic peptide
DEEEIRTTNPVATEQWGSVSENLQIGNF

SEQ ID NO: 19642 - protein, 28 aa, Artificial Sequence
  Description of Artificial Sequence: Synthetic peptide
DEEEIMTTNPLATEQYGSVSEDLQRGNR

SEQ ID NO: 19643 - protein, 28 aa, Artificial Sequence
  Description of Artificial Sequence: Synthetic peptide
PEEEIRTTNPVATEQYGYVSTNLQNGER

SEQ ID NO: 19644 - protein, 28 aa, Artificial Sequence
  Description of Artificial Sequence: Synthetic peptide
DEEEIRTTNPCATEQYGSVSTGLQRGTD

SEQ ID NO: 19645 - protein, 30 aa, Artificial Sequence
  Description of Artificial Sequence: Synthetic polypeptide
DEEEIRTTNPVATEQYGSVSTNLQEHGNDF

SEQ ID NO: 19646 - protein, 29 aa, Artificial Sequence
  Description of Artificial Sequence: Synthetic peptide
QEEEIRTTNPVATEQYGEVSAENLQRGNR

SEQ ID NO: 19647 - protein, 28 aa, Artificial Sequence
  Description of Artificial Sequence: Synthetic peptide
DEEEIRTTNPVGTEQYGEVSTPLQRGND

SEQ ID NO: 19648 - protein, 28 aa, Artificial Sequence
  Description of Artificial Sequence: Synthetic peptide
DEEEIRTTNPVSTEQYGTVGTNLQDGNR

SEQ ID NO: 19649 - protein, 28 aa, Artificial Sequence
  Description of Artificial Sequence: Synthetic peptide
DEAEIRTTNPVATEQYGSVSMNLQVGNY

SEQ ID NO: 19650 - protein, 29 aa, Artificial Sequence
  Description of Artificial Sequence: Synthetic peptide
DENEIRTTNPVATEQYGSVSTNLQSGVNF

SEQ ID NO: 19651 - protein, 28 aa, Artificial Sequence
  Description of Artificial Sequence: Synthetic peptide
DEEEIRCTNPVATEQYGAVSMALQRGNR

SEQ ID NO: 19652 - protein, 28 aa, Artificial Sequence
  Description of Artificial Sequence: Synthetic peptide
DEEEIRTTNPVSTEQYGSMSTTIQRGNR

SEQ ID NO: 19653 - protein, 28 aa, Artificial Sequence
  Description of Artificial Sequence: Synthetic peptide
DEEEIRTTNPVATEQYGDVSTNLQHENA

SEQ ID NO: 19654 - protein, 29 aa, Artificial Sequence
  Description of Artificial Sequence: Synthetic peptide
DEQEIRTTNPVATEQYGSVSTNLEIRGND

SEQ ID NO: 19655 - protein, 28 aa, Artificial Sequence
  Description of Artificial Sequence: Synthetic peptide
DEEEIRTTNPVATEQYGDVSTTDQRGNA

SEQ ID NO: 19656 - protein, 29 aa, Artificial Sequence
  Description of Artificial Sequence: Synthetic peptide
DETEIGTTNPVATEQYGSVSTNLQRGDDR

SEQ ID NO: 19657 - protein, 31 aa, Artificial Sequence
  Description of Artificial Sequence: Synthetic polypeptide
DEEEIRTTNPVATEQYGSVSDTNLEREGENR

SEQ ID NO: 19658 - protein, 30 aa, Artificial Sequence
  Description of Artificial Sequence: Synthetic polypeptide
DEEEIRTTNPVATEQYGSVEDHNLQRGDNR

SEQ ID NO: 19659 - protein, 29 aa, Artificial Sequence
  Description of Artificial Sequence: Synthetic peptide
DEQEIRTTNPVATEVYGCVSATNLQRGNR

SEQ ID NO: 19660 - protein, 28 aa, Artificial Sequence
  Description of Artificial Sequence: Synthetic peptide
DEEEIRTTNPVATEQYGSVSTDLQQGEI

SEQ ID NO: 19661 - protein, 28 aa, Artificial Sequence
  Description of Artificial Sequence: Synthetic peptide
DEEEIATTNPVATEQYGSVSTDLQSGNW

SEQ ID NO: 19662 - protein, 28 aa, Artificial Sequence
  Description of Artificial Sequence: Synthetic peptide
QENEIRTTNPVATECYGDVSTNLQRGNR

SEQ ID NO: 19663 - protein, 28 aa, Artificial Sequence
  Description of Artificial Sequence: Synthetic peptide
DEEEIRTTNPVATEQYGIVSTNLQVGDL

SEQ ID NO: 19664 - protein, 28 aa, Artificial Sequence
  Description of Artificial Sequence: Synthetic peptide
MEEEIRTTNPVATEQYGSVSTNEQHGNQ

SEQ ID NO: 19665 - protein, 28 aa, Artificial Sequence
  Description of Artificial Sequence: Synthetic peptide
DEEEIRTTNPCATECYGCVSTDLQRGNR

SEQ ID NO: 19666 - protein, 28 aa, Artificial Sequence
  Description of Artificial Sequence: Synthetic peptide
DEGEIRTTNPVATEQYGSVSTNLIYGER

SEQ ID NO: 19667 - protein, 28 aa, Artificial Sequence
  Description of Artificial Sequence: Synthetic peptide
DENEIRTTNPVATEQYGSVSTNLMIGNA

SEQ ID NO: 19668 - protein, 31 aa, Artificial Sequence
  Description of Artificial Sequence: Synthetic polypeptide
DEEEIRTTNPVATEQYGSVSTNLTQFNGENR

SEQ ID NO: 19669 - protein, 28 aa, Artificial Sequence
  Description of Artificial Sequence: Synthetic peptide
DEQEIVTTNPVSTEHYGSVSTNLQRGNR

SEQ ID NO: 19670 - protein, 30 aa, Artificial Sequence
  Description of Artificial Sequence: Synthetic polypeptide
DEEEIRTTNPVATEQYGSVDSTNLEPGDNR

SEQ ID NO: 19671 - protein, 28 aa, Artificial Sequence
  Description of Artificial Sequence: Synthetic peptide
DEQEIRCTNPVATMQYGSVSTNLERGNR

SEQ ID NO: 19672 - protein, 29 aa, Artificial Sequence
  Description of Artificial Sequence: Synthetic peptide
DEEEIRTTNPTATEQYGSVSTMNEQQGNR

SEQ ID NO: 19673 - protein, 28 aa, Artificial Sequence
  Description of Artificial Sequence: Synthetic peptide
QEQEIATTNPVATEQYGSVSTNLQRGGR

SEQ ID NO: 19674 - protein, 28 aa, Artificial Sequence
  Description of Artificial Sequence: Synthetic peptide
DEEEIRTTNPVATEQYGSWSENPQRENR

SEQ ID NO: 19675 - protein, 28 aa, Artificial Sequence
  Description of Artificial Sequence: Synthetic peptide
DEEEIRQTNPVATEQYGSVSTDLQHGNL

SEQ ID NO: 19676 - protein, 28 aa, Artificial Sequence
  Description of Artificial Sequence: Synthetic peptide
DEQEIRTTNPVASEQYGNVSTNIQRGNR

SEQ ID NO: 19677 - protein, 28 aa, Artificial Sequence
  Description of Artificial Sequence: Synthetic peptide
DEEEIRTTNPVATEQYGSVSTADQYGNQ

SEQ ID NO: 19678 - protein, 28 aa, Artificial Sequence
  Description of Artificial Sequence: Synthetic peptide
DEEEIRTTNPVAYEQYGSVSTNLLQGNG

SEQ ID NO: 19679 - protein, 28 aa, Artificial Sequence
  Description of Artificial Sequence: Synthetic peptide
DEEEIRTTNPVATEQYGDVSENLQTGNN

SEQ ID NO: 19680 - protein, 29 aa, Artificial Sequence
  Description of Artificial Sequence: Synthetic peptide
DEEEIRTTNPVATEQYGSVSTPTLQPGNI

SEQ ID NO: 19681 - protein, 29 aa, Artificial Sequence
  Description of Artificial Sequence: Synthetic peptide
DEEEIRTTNPVATEQYGIVSTNLMRGDDR

SEQ ID NO: 19682 - protein, 28 aa, Artificial Sequence
  Description of Artificial Sequence: Synthetic peptide
DEEEIRTTNPVASEVYGSVANNLQRGNR

SEQ ID NO: 19683 - protein, 28 aa, Artificial Sequence
  Description of Artificial Sequence: Synthetic peptide
DEEELRAVNPVATEQYGSVSMNLQRGNR

SEQ ID NO: 19684 - protein, 30 aa, Artificial Sequence
  Description of Artificial Sequence: Synthetic polypeptide
YEEEIRTTNPVATEQYGSVVSTNLFRSGNR

SEQ ID NO: 19685 - protein, 29 aa, Artificial Sequence
  Description of Artificial Sequence: Synthetic peptide
KEEEIRTTNPVATEQYGSVSTNLQTEGNT

SEQ ID NO: 19686 - protein, 28 aa, Artificial Sequence
  Description of Artificial Sequence: Synthetic peptide
QETEIRTTNPVSTEQYGSVSTNLQRGPR

SEQ ID NO: 19687 - protein, 28 aa, Artificial Sequence
  Description of Artificial Sequence: Synthetic peptide
DEEEIRTTNPVATEQYGSVSENEMRGNA

SEQ ID NO: 19688 - protein, 28 aa, Artificial Sequence
  Description of Artificial Sequence: Synthetic peptide
DEEEIRTTNPVATEQYGDVSENLQHGNA

SEQ ID NO: 19689 - protein, 28 aa, Artificial Sequence
  Description of Artificial Sequence: Synthetic peptide
DEEEVRTTNPVATEQYGCVANNLQRGNR

SEQ ID NO: 19690 - protein, 28 aa, Artificial Sequence
  Description of Artificial Sequence: Synthetic peptide
DEEEIRTTNPVATEQYGSVDTELQYGNM

SEQ ID NO: 19691 - protein, 28 aa, Artificial Sequence
  Description of Artificial Sequence: Synthetic peptide
DEEEIRTTNPVATEQYGSVETNDQPGNG

SEQ ID NO: 19692 - protein, 28 aa, Artificial Sequence
  Description of Artificial Sequence: Synthetic peptide
QEEEIRTTNPVATEQYGSVSTELQRGEQ

SEQ ID NO: 19693 - protein, 28 aa, Artificial Sequence
  Description of Artificial Sequence: Synthetic peptide
DEEEIATTNPVATECYGSVSTNLQRGEN

SEQ ID NO: 19694 - protein, 31 aa, Artificial Sequence
  Description of Artificial Sequence: Synthetic polypeptide
DEEEIRTTNPVATEQYGSVSVTGNLQQRGNA

SEQ ID NO: 19695 - protein, 30 aa, Artificial Sequence
  Description of Artificial Sequence: Synthetic polypeptide
AETEIRTTNPVATEQYGSVSTNLQLRGNLR

SEQ ID NO: 19696 - protein, 29 aa, Artificial Sequence
  Description of Artificial Sequence: Synthetic peptide
DESEIRCTNPVATEQYGAVSTNLQLRGNR

SEQ ID NO: 19697 - protein, 28 aa, Artificial Sequence
  Description of Artificial Sequence: Synthetic peptide
VEEELRTTNPVSTEQYGSVSTNLQRGTR

SEQ ID NO: 19698 - protein, 31 aa, Artificial Sequence
  Description of Artificial Sequence: Synthetic polypeptide
DEEEIRTTNPVATEQYGSVSTMNLQCCVGNR

SEQ ID NO: 19699 - protein, 28 aa, Artificial Sequence
  Description of Artificial Sequence: Synthetic peptide
DEEEINTTNPVSTEQYGSVSTNLQHGQR

SEQ ID NO: 19700 - protein, 28 aa, Artificial Sequence
  Description of Artificial Sequence: Synthetic peptide
DEEEISTTNPVATFQYGSVSTNLQQGNF

SEQ ID NO: 19701 - protein, 28 aa, Artificial Sequence
  Description of Artificial Sequence: Synthetic peptide
DEEEIATTNPTATEQYGSVSTNLQNGNI

SEQ ID NO: 19702 - protein, 29 aa, Artificial Sequence
  Description of Artificial Sequence: Synthetic peptide
DEEEIRTTNPVATEQYGSVSTMDLQHGND

SEQ ID NO: 19703 - protein, 30 aa, Artificial Sequence
  Description of Artificial Sequence: Synthetic polypeptide
DEEEIRTTNPVATEQYGSVSDTNPDQVGNR

SEQ ID NO: 19704 - protein, 28 aa, Artificial Sequence
  Description of Artificial Sequence: Synthetic peptide
DEEEIRTTNPVATEIYGDVSTNLNLGNR

SEQ ID NO: 19705 - protein, 32 aa, Artificial Sequence
  Description of Artificial Sequence: Synthetic polypeptide
DEEEIRTTNPVATEQYGSVYSTNGLQLRGVNR

SEQ ID NO: 19706 - protein, 29 aa, Artificial Sequence
  Description of Artificial Sequence: Synthetic peptide
QEEEIRTTNPVSTEQYGSVSATVLQRGNR

SEQ ID NO: 19707 - protein, 31 aa, Artificial Sequence
  Description of Artificial Sequence: Synthetic polypeptide
DEEEIRTTNPVATEQYGSVSTTDNLLRGDNR

SEQ ID NO: 19708 - protein, 30 aa, Artificial Sequence
  Description of Artificial Sequence: Synthetic polypeptide
DEEEIRTTNPVATELYGGVSTNLPQRGDNR

SEQ ID NO: 19709 - protein, 31 aa, Artificial Sequence
  Description of Artificial Sequence: Synthetic polypeptide
DEEEIRTTNPVATEQYGSVDSTNLQERGVNN

SEQ ID NO: 19710 - protein, 28 aa, Artificial Sequence
  Description of Artificial Sequence: Synthetic peptide
DEEEIRTTNPFATEQYGSVSTCLERGNE

SEQ ID NO: 19711 - protein, 28 aa, Artificial Sequence
  Description of Artificial Sequence: Synthetic peptide
DEAEIRTTNPVATEQYGSAACNLQRGNR

SEQ ID NO: 19712 - protein, 28 aa, Artificial Sequence
  Description of Artificial Sequence: Synthetic peptide
DEEEIATTNPVATEGYGSVSTCLQRGNF

SEQ ID NO: 19713 - protein, 28 aa, Artificial Sequence
  Description of Artificial Sequence: Synthetic peptide
QETEIRATNPVATEQYGVVSTNLQRGNR

SEQ ID NO: 19714 - protein, 29 aa, Artificial Sequence
  Description of Artificial Sequence: Synthetic peptide
DEEEIRCTNPVATEIYGSVSATNLERGNR

SEQ ID NO: 19715 - protein, 28 aa, Artificial Sequence
  Description of Artificial Sequence: Synthetic peptide
DEEEIRTTNPVATENYGSVSENLERGNH

SEQ ID NO: 19716 - protein, 31 aa, Artificial Sequence
  Description of Artificial Sequence: Synthetic polypeptide
DEEEIRTTNPVATEQYGSVSDTANGQDRGNR

SEQ ID NO: 19717 - protein, 28 aa, Artificial Sequence
  Description of Artificial Sequence: Synthetic peptide
AEQEIRQTNPVATEQYGSVSTVLQRGNR

SEQ ID NO: 19718 - protein, 28 aa, Artificial Sequence
  Description of Artificial Sequence: Synthetic peptide
DEEEIRTTNPVATEQYGSGSDCLQHGNR

SEQ ID NO: 19719 - protein, 30 aa, Artificial Sequence
  Description of Artificial Sequence: Synthetic polypeptide
DENEIRTTNPVATEQYGDVSETNLQQRGNR

SEQ ID NO: 19720 - protein, 28 aa, Artificial Sequence
  Description of Artificial Sequence: Synthetic peptide
DEEEIRCTNPVATEQYGSVSTNLTSGER

SEQ ID NO: 19721 - protein, 29 aa, Artificial Sequence
  Description of Artificial Sequence: Synthetic peptide
DEQEIRTTNPVATEQYGSASENLQRIGNR

SEQ ID NO: 19722 - protein, 28 aa, Artificial Sequence
  Description of Artificial Sequence: Synthetic peptide
DEEEIRTTNPVATEWYGSVSTNDQQGNM

SEQ ID NO: 19723 - protein, 28 aa, Artificial Sequence
  Description of Artificial Sequence: Synthetic peptide
DEEEIRTTNPVATEQYGDVSENLQRGEN

SEQ ID NO: 19724 - protein, 28 aa, Artificial Sequence
  Description of Artificial Sequence: Synthetic peptide
DEEEIRTTNPVVTEYYGSVSTNLQAHNR

SEQ ID NO: 19725 - protein, 28 aa, Artificial Sequence
  Description of Artificial Sequence: Synthetic peptide
DETEIATTNPVATEQYGVVGTNLQRGNR

SEQ ID NO: 19726 - protein, 28 aa, Artificial Sequence
  Description of Artificial Sequence: Synthetic peptide
DEEEIRTVNPVATEQYGSVSTNLQLGES

SEQ ID NO: 19727 - protein, 28 aa, Artificial Sequence
  Description of Artificial Sequence: Synthetic peptide
DEEEIVTTNPDATEQYGSVSTNLQNGNF

SEQ ID NO: 19728 - protein, 31 aa, Artificial Sequence
  Description of Artificial Sequence: Synthetic polypeptide
DEEEIRTTNPVATEQYGSVSCTMDLQCRGNR

SEQ ID NO: 19729 - protein, 28 aa, Artificial Sequence
  Description of Artificial Sequence: Synthetic peptide
DEEEIRTTNPVATECYGSVSTDLQVGNH

SEQ ID NO: 19730 - protein, 28 aa, Artificial Sequence
  Description of Artificial Sequence: Synthetic peptide
DEEEIRTTNPVATEQWGSVDTNDERGNR

SEQ ID NO: 19731 - protein, 28 aa, Artificial Sequence
  Description of Artificial Sequence: Synthetic peptide
DEEEIRTTNPVATEQYGSVSTNLEPGES

SEQ ID NO: 19732 - protein, 31 aa, Artificial Sequence
  Description of Artificial Sequence: Synthetic polypeptide
DEEEIRTTNPVAGEQYGSVSTNLQIRGGNPR

SEQ ID NO: 19733 - protein, 28 aa, Artificial Sequence
  Description of Artificial Sequence: Synthetic peptide
DEEEIRTTNPVATEQYGSVDTELQYGNI

SEQ ID NO: 19734 - protein, 29 aa, Artificial Sequence
  Description of Artificial Sequence: Synthetic peptide
DEEEIRTTNPVATEQYGSVDTNLQDGGNG

SEQ ID NO: 19735 - protein, 28 aa, Artificial Sequence
  Description of Artificial Sequence: Synthetic peptide
DEEEIRTTNPTATEQYGGVSENLQQGNR

SEQ ID NO: 19736 - protein, 28 aa, Artificial Sequence
  Description of Artificial Sequence: Synthetic peptide
DEEEIRTTNPVATEQYGSVSTNLEVGEM

SEQ ID NO: 19737 - protein, 28 aa, Artificial Sequence
  Description of Artificial Sequence: Synthetic peptide
DENEIRTTNPVATEQYGVVSTNLQVGER

SEQ ID NO: 19738 - protein, 30 aa, Artificial Sequence
  Description of Artificial Sequence: Synthetic polypeptide
DEEEIRTTNPVATECYGSVSDTDLQRGENR

SEQ ID NO: 19739 - protein, 28 aa, Artificial Sequence
  Description of Artificial Sequence: Synthetic peptide
DEEEIRTTNPVATECYGSVSTNLQYGET

SEQ ID NO: 19740 - protein, 28 aa, Artificial Sequence
  Description of Artificial Sequence: Synthetic peptide
DEEEIRTTNPDATEQYGSVSTNDDNGNR

SEQ ID NO: 19741 - protein, 28 aa, Artificial Sequence
  Description of Artificial Sequence: Synthetic peptide
DEEEIRTTNPVATEQYGVVSTTLQRGGA

SEQ ID NO: 19742 - protein, 28 aa, Artificial Sequence
  Description of Artificial Sequence: Synthetic peptide
DENEIRTTNPVATEQYGSASENLQHGNR

SEQ ID NO: 19743 - protein, 28 aa, Artificial Sequence
  Description of Artificial Sequence: Synthetic peptide
DEEEVRCTNPIATEQYGAVSTNLQRGNR

SEQ ID NO: 19744 - protein, 29 aa, Artificial Sequence
  Description of Artificial Sequence: Synthetic peptide
DEEEIRTTNPVATEQYGSVSENLQMQGNA

SEQ ID NO: 19745 - protein, 29 aa, Artificial Sequence
  Description of Artificial Sequence: Synthetic peptide
DEEEIRTTNPVCTEQYGWVSTNLQQHGNR

SEQ ID NO: 19746 - protein, 30 aa, Artificial Sequence
  Description of Artificial Sequence: Synthetic polypeptide
DEEEIRTTNPVATEIYGSVSTNLQCRAGQR

SEQ ID NO: 19747 - protein, 28 aa, Artificial Sequence
  Description of Artificial Sequence: Synthetic peptide
DEEEIRTTNPVATEQYGSVSNHLWPGNR

SEQ ID NO: 19748 - protein, 28 aa, Artificial Sequence
  Description of Artificial Sequence: Synthetic peptide
DEEEIRTTNPVATEQYGECSTNLQHGER

SEQ ID NO: 19749 - protein, 29 aa, Artificial Sequence
  Description of Artificial Sequence: Synthetic peptide
DEQEIRTTNPVATEQYGSVSTNLEEEGNR

SEQ ID NO: 19750 - protein, 28 aa, Artificial Sequence
  Description of Artificial Sequence: Synthetic peptide
DEEEIRTTNPVATEMYGAVSMNLERGNR

SEQ ID NO: 19751 - protein, 31 aa, Artificial Sequence
  Description of Artificial Sequence: Synthetic polypeptide
DEEEIRTTNPVATEQYGSVSENLVQRNGENR

SEQ ID NO: 19752 - protein, 28 aa, Artificial Sequence
  Description of Artificial Sequence: Synthetic peptide
DEQEIRCTNPVATEQYGWVSTELQRGNR

SEQ ID NO: 19753 - protein, 28 aa, Artificial Sequence
  Description of Artificial Sequence: Synthetic peptide
DEEEIRTTNPVATECYGSVSTNLQHGEM

SEQ ID NO: 19754 - protein, 28 aa, Artificial Sequence
  Description of Artificial Sequence: Synthetic peptide
HEEEIRTTNPVCTEQYGSVSNLIQRGNR

SEQ ID NO: 19755 - protein, 28 aa, Artificial Sequence
  Description of Artificial Sequence: Synthetic peptide
QENEIRTTNPVGTEQYGSVSTNLQRGDR

SEQ ID NO: 19756 - protein, 30 aa, Artificial Sequence
  Description of Artificial Sequence: Synthetic polypeptide
DEEEIRTTNPVATEQYWSVSDTTLVQRGNR

SEQ ID NO: 19757 - protein, 28 aa, Artificial Sequence
  Description of Artificial Sequence: Synthetic peptide
DEQEIRCTNPVATEVYGCVSTNLQRGNR

SEQ ID NO: 19758 - protein, 28 aa, Artificial Sequence
  Description of Artificial Sequence: Synthetic peptide
DEGEIRTTNPVATEQYGSMSVNLQIGNR

SEQ ID NO: 19759 - protein, 28 aa, Artificial Sequence
  Description of Artificial Sequence: Synthetic peptide
DEEEIRTTNPVATELYGSVSTNEQIGNM

SEQ ID NO: 19760 - protein, 28 aa, Artificial Sequence
  Description of Artificial Sequence: Synthetic peptide
DEEEIRTTNPVATEQYGIVSTNEMQGNR

SEQ ID NO: 19761 - protein, 29 aa, Artificial Sequence
  Description of Artificial Sequence: Synthetic peptide
DDEEIRCTNPVATEQYGSVSYPNLQRGNR

SEQ ID NO: 19762 - protein, 28 aa, Artificial Sequence
  Description of Artificial Sequence: Synthetic peptide
DEEEINSTNPRATEQYGSVSTNQQRGNR

SEQ ID NO: 19763 - protein, 29 aa, Artificial Sequence
  Description of Artificial Sequence: Synthetic peptide
DEEEIRTTNPVATECYGSVSTNLQESGNN

SEQ ID NO: 19764 - protein, 29 aa, Artificial Sequence
  Description of Artificial Sequence: Synthetic peptide
DEEEIRTTNPVATEQWGIVSTNLEQAGNR

SEQ ID NO: 19765 - protein, 32 aa, Artificial Sequence
  Description of Artificial Sequence: Synthetic polypeptide
DEEEIRTTNPVATEQYGSVASTNLQQRGENPR

SEQ ID NO: 19766 - protein, 28 aa, Artificial Sequence
  Description of Artificial Sequence: Synthetic peptide
DEEEIRTTNPVATECYGSVSTNEQIGNM

SEQ ID NO: 19767 - protein, 30 aa, Artificial Sequence
  Description of Artificial Sequence: Synthetic polypeptide
DEEEIRTTNPVATEQYGSVDSTGNLQHGNF

SEQ ID NO: 19768 - protein, 28 aa, Artificial Sequence
  Description of Artificial Sequence: Synthetic peptide
DENEIATTNPVATEQYGSVSTDLQRGER

SEQ ID NO: 19769 - protein, 28 aa, Artificial Sequence
  Description of Artificial Sequence: Synthetic peptide
DENEIRTTNPVATEQYGSVSENLMRGNM

SEQ ID NO: 19770 - protein, 28 aa, Artificial Sequence
  Description of Artificial Sequence: Synthetic peptide
DEEEIRTTNPVATESYGCVSTPLQRGND

SEQ ID NO: 19771 - protein, 31 aa, Artificial Sequence
  Description of Artificial Sequence: Synthetic polypeptide
DEEEIRTTNPVATEQYGVSVSGNPLSQRGNR

SEQ ID NO: 19772 - protein, 30 aa, Artificial Sequence
  Description of Artificial Sequence: Synthetic polypeptide
AEEEIRTTNPFATEQYGSVSTNLQLRGENR

SEQ ID NO: 19773 - protein, 28 aa, Artificial Sequence
  Description of Artificial Sequence: Synthetic peptide
DEEEIRSTNPVATELYGSVSTNLQRGDF

SEQ ID NO: 19774 - protein, 28 aa, Artificial Sequence
  Description of Artificial Sequence: Synthetic peptide
DEEEIRTTNPVATQQYGSVPTLEQRGNR

SEQ ID NO: 19775 - protein, 28 aa, Artificial Sequence
  Description of Artificial Sequence: Synthetic peptide
DENEIATTNPVATEIYGWVSTNLQRGNR

SEQ ID NO: 19776 - protein, 30 aa, Artificial Sequence
  Description of Artificial Sequence: Synthetic polypeptide
DEEEIRTTNPVATEQYGSVSTMNEQRGDNF

SEQ ID NO: 19777 - protein, 28 aa, Artificial Sequence
  Description of Artificial Sequence: Synthetic peptide
DEEEIRATNPTATEQYGSVNTNLQQGNR

SEQ ID NO: 19778 - protein, 28 aa, Artificial Sequence
  Description of Artificial Sequence: Synthetic peptide
DEEEIRSTNPVATELYGCVSMNLQRGNR

SEQ ID NO: 19779 - protein, 30 aa, Artificial Sequence
  Description of Artificial Sequence: Synthetic polypeptide
DEEEIRTTNPVATEQYGSVSTNLQINNENR

SEQ ID NO: 19780 - protein, 28 aa, Artificial Sequence
  Description of Artificial Sequence: Synthetic peptide
DEEEIRPTNPVATEQYGSVSTCIQHGNR

SEQ ID NO: 19781 - protein, 28 aa, Artificial Sequence
  Description of Artificial Sequence: Synthetic peptide
DEQEIRTTNPVSTEQYGSCSENLQRGNR

SEQ ID NO: 19782 - protein, 28 aa, Artificial Sequence
  Description of Artificial Sequence: Synthetic peptide
DEEEIRTTNPVATEQYGEVSTDLQIGER

SEQ ID NO: 19783 - protein, 28 aa, Artificial Sequence
  Description of Artificial Sequence: Synthetic peptide
DENEIRTTNPVATEQWGSVSENLMRGNR

SEQ ID NO: 19784 - protein, 28 aa, Artificial Sequence
  Description of Artificial Sequence: Synthetic peptide
DEEEICTTNPVCTEQYGSVSTNLQWGNQ

SEQ ID NO: 19785 - protein, 28 aa, Artificial Sequence
  Description of Artificial Sequence: Synthetic peptide
NEEEIRATNPVATEQYGSVSNNLQRGNG

SEQ ID NO: 19786 - protein, 29 aa, Artificial Sequence
  Description of Artificial Sequence: Synthetic peptide
DEEEIRTTNPVATEQYGSVASTCEQRGNN

SEQ ID NO: 19787 - protein, 28 aa, Artificial Sequence
  Description of Artificial Sequence: Synthetic peptide
DEEEIATTNPVATEQYGSVSENEQRGTR

SEQ ID NO: 19788 - protein, 29 aa, Artificial Sequence
  Description of Artificial Sequence: Synthetic peptide
DEEEIRTTNPVAVEQYGSVSTNLQLGNDQ

SEQ ID NO: 19789 - protein, 29 aa, Artificial Sequence
  Description of Artificial Sequence: Synthetic peptide
DENEIRTTNPVATECYGSVSTNLQREGNL

SEQ ID NO: 19790 - protein, 28 aa, Artificial Sequence
  Description of Artificial Sequence: Synthetic peptide
DETEIRSTNPVSTEHYGSVSTNLQRGNR

SEQ ID NO: 19791 - protein, 28 aa, Artificial Sequence
  Description of Artificial Sequence: Synthetic peptide
DEQEIRATNPVATEIYGSVSMNLQRGNR

SEQ ID NO: 19792 - protein, 28 aa, Artificial Sequence
  Description of Artificial Sequence: Synthetic peptide
DENEIRTTNPVATEQYGSVSTNLQQGTQ

SEQ ID NO: 19793 - protein, 28 aa, Artificial Sequence
  Description of Artificial Sequence: Synthetic peptide
DEEVIRPTNPVATEQYGSVNTPLQRGNR

SEQ ID NO: 19794 - protein, 28 aa, Artificial Sequence
  Description of Artificial Sequence: Synthetic peptide
DEQEIRTTNPVATEQYGSVETNDERGNR

SEQ ID NO: 19795 - protein, 29 aa, Artificial Sequence
  Description of Artificial Sequence: Synthetic peptide
KEEEIRTTNPVATEQYGSVSTNLQEHGNA

SEQ ID NO: 19796 - protein, 29 aa, Artificial Sequence
  Description of Artificial Sequence: Synthetic peptide
DEECIRTTNPVATECYGFVSTPNLQRGNR

SEQ ID NO: 19797 - protein, 31 aa, Artificial Sequence
  Description of Artificial Sequence: Synthetic polypeptide
DEEEIRTTNPVATEQYGSVSTENGLQRGENG

SEQ ID NO: 19798 - protein, 28 aa, Artificial Sequence
  Description of Artificial Sequence: Synthetic peptide
DEEEIRTTNPTATECFGSVSTNWQRGNR

SEQ ID NO: 19799 - protein, 28 aa, Artificial Sequence
  Description of Artificial Sequence: Synthetic peptide
DEEEIRTTNPVATEQYGSVSTDLEYGNT

SEQ ID NO: 19800 - protein, 29 aa, Artificial Sequence
  Description of Artificial Sequence: Synthetic peptide
DEEEIRTTNPVATEQYGSVSTNLMMQGNM

SEQ ID NO: 19801 - protein, 29 aa, Artificial Sequence
  Description of Artificial Sequence: Synthetic peptide
MENEIRTTNPVATEQYGSVSTNLQDRGNM

SEQ ID NO: 19802 - protein, 28 aa, Artificial Sequence
  Description of Artificial Sequence: Synthetic peptide
DEEEIRTTNPVATEQYGSVSTELQGGES

SEQ ID NO: 19803 - protein, 28 aa, Artificial Sequence
  Description of Artificial Sequence: Synthetic peptide
DEEEIRTTNPIATEIYGTVATNLQRGNR

SEQ ID NO: 19804 - protein, 28 aa, Artificial Sequence
  Description of Artificial Sequence: Synthetic peptide
DENEIAATNPVATELYGSVSTNLQRGNR

SEQ ID NO: 19805 - protein, 28 aa, Artificial Sequence
  Description of Artificial Sequence: Synthetic peptide
DEQEVRTTNPVATEQYGCVSNNLQRGNR

SEQ ID NO: 19806 - protein, 30 aa, Artificial Sequence
  Description of Artificial Sequence: Synthetic polypeptide
DEEEIATTNPVATEQYGSVSATNLQDHGNR

SEQ ID NO: 19807 - protein, 32 aa, Artificial Sequence
  Description of Artificial Sequence: Synthetic polypeptide
DEEEIRTTNPVATEQYGSVESCTNLVQREGNR

SEQ ID NO: 19808 - protein, 28 aa, Artificial Sequence
  Description of Artificial Sequence: Synthetic peptide
DEEEIRTTNPVATECYGSVSTELQYGNN

SEQ ID NO: 19809 - protein, 29 aa, Artificial Sequence
  Description of Artificial Sequence: Synthetic peptide
DEEEIRTTNPVATEQYGSVSTNEMRELNR

SEQ ID NO: 19810 - protein, 28 aa, Artificial Sequence
  Description of Artificial Sequence: Synthetic peptide
DEEEIRSTNPVATEQYGVVSTNLIQGNR

SEQ ID NO: 19811 - protein, 28 aa, Artificial Sequence
  Description of Artificial Sequence: Synthetic peptide
DEEEIRTTNPVATEQYGSVSTDLQLGEP

SEQ ID NO: 19812 - protein, 28 aa, Artificial Sequence
  Description of Artificial Sequence: Synthetic peptide
DEEEIRTTNPVATEQYGSVSTPLETGNH

SEQ ID NO: 19813 - protein, 31 aa, Artificial Sequence
  Description of Artificial Sequence: Synthetic polypeptide
DEEEIRTTNPVATEQYGSVSTINLQREGANQ

SEQ ID NO: 19814 - protein, 28 aa, Artificial Sequence
  Description of Artificial Sequence: Synthetic peptide
DEQEIRTTNPVATEQYGSVSENLQLGNV

SEQ ID NO: 19815 - protein, 30 aa, Artificial Sequence
  Description of Artificial Sequence: Synthetic polypeptide
DEEEIRTTNPVATEQYGSVSTNLQVQGNDH

SEQ ID NO: 19816 - protein, 30 aa, Artificial Sequence
  Description of Artificial Sequence: Synthetic polypeptide
DEVEIRTTNPVATEQFGSVISTNLQREGNR

SEQ ID NO: 19817 - protein, 30 aa, Artificial Sequence
  Description of Artificial Sequence: Synthetic polypeptide
DEEEIRTTNPVATEQYGSVSTNDMLRGNDR

SEQ ID NO: 19818 - protein, 28 aa, Artificial Sequence
  Description of Artificial Sequence: Synthetic peptide
DEEEIYTTNPVATEQFGSVSTNLQIENR

SEQ ID NO: 19819 - protein, 28 aa, Artificial Sequence
  Description of Artificial Sequence: Synthetic peptide
DEEEIRTTNPEATEQYGSVSDDLQRGNG

SEQ ID NO: 19820 - protein, 29 aa, Artificial Sequence
  Description of Artificial Sequence: Synthetic peptide
DEQEITTTNPVATEQYGSVSADNLQRGNR

SEQ ID NO: 19821 - protein, 28 aa, Artificial Sequence
  Description of Artificial Sequence: Synthetic peptide
DEGEIYTTNPVATEQYGEVSCNLQRGNR

SEQ ID NO: 19822 - protein, 28 aa, Artificial Sequence
  Description of Artificial Sequence: Synthetic peptide
DEEEIRTTNPVATEQYGSVSTELEIGNL

SEQ ID NO: 19823 - protein, 28 aa, Artificial Sequence
  Description of Artificial Sequence: Synthetic peptide
DEEEIRTTNPEATETYGEVSTNLQRGNQ

SEQ ID NO: 19824 - protein, 30 aa, Artificial Sequence
  Description of Artificial Sequence: Synthetic polypeptide
DEQEIRTTNPVATEQYGSVSTNLQRGEEDR

SEQ ID NO: 19825 - protein, 28 aa, Artificial Sequence
  Description of Artificial Sequence: Synthetic peptide
DENEIRTTNPVATECYGSVSTDLQRGER

SEQ ID NO: 19826 - protein, 29 aa, Artificial Sequence
  Description of Artificial Sequence: Synthetic peptide
DEEEIRTTNPVAYEQWGSVSDTGLQRGNR

SEQ ID NO: 19827 - protein, 31 aa, Artificial Sequence
  Description of Artificial Sequence: Synthetic polypeptide
DEEEIRTTNPVATEQYGSVSTMNLQERGNDI

SEQ ID NO: 19828 - protein, 28 aa, Artificial Sequence
  Description of Artificial Sequence: Synthetic peptide
DEEEIRSTNPVSTELYGSVGTNLQRGNR

SEQ ID NO: 19829 - protein, 28 aa, Artificial Sequence
  Description of Artificial Sequence: Synthetic peptide
MEEEISTTNPVATEQYGSMSDNLQRGNR

SEQ ID NO: 19830 - protein, 28 aa, Artificial Sequence
  Description of Artificial Sequence: Synthetic peptide
MEEEIRTTNPVATEQYGSVSTNLQGGES

SEQ ID NO: 19831 - protein, 29 aa, Artificial Sequence
  Description of Artificial Sequence: Synthetic peptide
DEEEIRTTNPYATEQYGSVSTDGQRGLNR

SEQ ID NO: 19832 - protein, 29 aa, Artificial Sequence
  Description of Artificial Sequence: Synthetic peptide
DEEEIRTTNPVACEQYWSVHTNLQPRGNR

SEQ ID NO: 19833 - protein, 31 aa, Artificial Sequence
  Description of Artificial Sequence: Synthetic polypeptide
DEEEIRTTNPVATEQYGSVSTEALQERGDNR

SEQ ID NO: 19834 - protein, 28 aa, Artificial Sequence
  Description of Artificial Sequence: Synthetic peptide
DEEEIRTTNPVATECYGSVSTDLQNGNS

SEQ ID NO: 19835 - protein, 28 aa, Artificial Sequence
  Description of Artificial Sequence: Synthetic peptide
DEEEIRTTNPVATEQYGSVDTNGQRGDP

SEQ ID NO: 19836 - protein, 28 aa, Artificial Sequence
  Description of Artificial Sequence: Synthetic peptide
DEEEIRTTNPVATECYGSVSYNDQRGER

SEQ ID NO: 19837 - protein, 28 aa, Artificial Sequence
  Description of Artificial Sequence: Synthetic peptide
VEEEIRTTNPVASEQYGSVSTNLQRLPR

SEQ ID NO: 19838 - protein, 29 aa, Artificial Sequence
  Description of Artificial Sequence: Synthetic peptide
DEEEIRTTNPVATEQYGSVSTDLQIGNDT

SEQ ID NO: 19839 - protein, 29 aa, Artificial Sequence
  Description of Artificial Sequence: Synthetic peptide
DEEEIRTTNPVATEQYGSVDSTNLDYGER

SEQ ID NO: 19840 - protein, 30 aa, Artificial Sequence
  Description of Artificial Sequence: Synthetic polypeptide
DEEEIRTTNPCATEQYGSVSTIPLQRNGNR

SEQ ID NO: 19841 - protein, 29 aa, Artificial Sequence
  Description of Artificial Sequence: Synthetic peptide
DEEEICTTNPVATEDYGSVSTMLQRGENR

SEQ ID NO: 19842 - protein, 28 aa, Artificial Sequence
  Description of Artificial Sequence: Synthetic peptide
DESEIRTTNPVATEVYGSVSYNLQRGNA

SEQ ID NO: 19843 - protein, 28 aa, Artificial Sequence
  Description of Artificial Sequence: Synthetic peptide
DEEEIATVNPVATEQYGSVSTNDQRGNI

SEQ ID NO: 19844 - protein, 28 aa, Artificial Sequence
  Description of Artificial Sequence: Synthetic peptide
DEEEIATTNPVATEQYGSVSELLQRGMR

SEQ ID NO: 19845 - protein, 28 aa, Artificial Sequence
  Description of Artificial Sequence: Synthetic peptide
DEEEIRATNPVCTEQYGSVSTWLNRGNR

SEQ ID NO: 19846 - protein, 28 aa, Artificial Sequence
  Description of Artificial Sequence: Synthetic peptide
DEEEIRTTNPVATEQWGSVSENLMRGNW

SEQ ID NO: 19847 - protein, 28 aa, Artificial Sequence
  Description of Artificial Sequence: Synthetic peptide
DEEEIRTTNPVATECYGSVSTNLMIGNF

SEQ ID NO: 19848 - protein, 29 aa, Artificial Sequence
  Description of Artificial Sequence: Synthetic peptide
EEEEIRTTNPVATEQYGSVSTANLQVGNG

SEQ ID NO: 19849 - protein, 29 aa, Artificial Sequence
  Description of Artificial Sequence: Synthetic peptide
DEEEIRTTNPVATEQYGSVSTDLQTGNDI

SEQ ID NO: 19850 - protein, 28 aa, Artificial Sequence
  Description of Artificial Sequence: Synthetic peptide
DEEEIRTTNPVATEQYGSVSTDLQVGED

SEQ ID NO: 19851 - protein, 28 aa, Artificial Sequence
  Description of Artificial Sequence: Synthetic peptide
DEEEIRTTNPVATEQWGSVSTNEQIGNF

SEQ ID NO: 19852 - protein, 29 aa, Artificial Sequence
  Description of Artificial Sequence: Synthetic peptide
DEEEIRTTNPVATECWGSVSTNLMNRGNR

SEQ ID NO: 19853 - protein, 29 aa, Artificial Sequence
  Description of Artificial Sequence: Synthetic peptide
DEEEIRTTNPDAYEQYGSVSTPLTQRGNR

SEQ ID NO: 19854 - protein, 28 aa, Artificial Sequence
  Description of Artificial Sequence: Synthetic peptide
DEFEIRTTNPVATEQYGSVGTDLERGNR

SEQ ID NO: 19855 - protein, 28 aa, Artificial Sequence
  Description of Artificial Sequence: Synthetic peptide
AEDEISTTNPVATEQYGWVSTNLQRGNR

SEQ ID NO: 19856 - protein, 28 aa, Artificial Sequence
  Description of Artificial Sequence: Synthetic peptide
DEVEIRTTNPVATELYGSVSTNLQTGNF

SEQ ID NO: 19857 - protein, 28 aa, Artificial Sequence
  Description of Artificial Sequence: Synthetic peptide
DAEEIRTTNPVATENYGSVSTGLQRMNR

SEQ ID NO: 19858 - protein, 30 aa, Artificial Sequence
  Description of Artificial Sequence: Synthetic polypeptide
DEEEIRTTNPVATEQYGSVSTNLVEERGNL

SEQ ID NO: 19859 - protein, 28 aa, Artificial Sequence
  Description of Artificial Sequence: Synthetic peptide
DENEIRTTNPVATEQYGSYSTNLMRENR

SEQ ID NO: 19860 - protein, 28 aa, Artificial Sequence
  Description of Artificial Sequence: Synthetic peptide
DEDEIRTTNPVATEQYGSVSTWLERGNG

SEQ ID NO: 19861 - protein, 28 aa, Artificial Sequence
  Description of Artificial Sequence: Synthetic peptide
DEEEIRTTNPVATEQYGSVSTCLLRGEM

SEQ ID NO: 19862 - protein, 29 aa, Artificial Sequence
  Description of Artificial Sequence: Synthetic peptide
DEQEIRTTNPVATEQYGSVSTNEQQDGNR

SEQ ID NO: 19863 - protein, 30 aa, Artificial Sequence
  Description of Artificial Sequence: Synthetic polypeptide
DEEEIRTTNPVATEQYGSVASTNPQRGNLA

SEQ ID NO: 19864 - protein, 28 aa, Artificial Sequence
  Description of Artificial Sequence: Synthetic peptide
DEEEIRTTNPVATECYGSVSMNLQRGTS

SEQ ID NO: 19865 - protein, 28 aa, Artificial Sequence
  Description of Artificial Sequence: Synthetic peptide
DEEEIRATNPVSSEQYGCVSTNLQRGNR

SEQ ID NO: 19866 - protein, 28 aa, Artificial Sequence
  Description of Artificial Sequence: Synthetic peptide
DENEIRTTNPVATEQYGDVSTNLQRENL

SEQ ID NO: 19867 - protein, 28 aa, Artificial Sequence
  Description of Artificial Sequence: Synthetic peptide
DEEEIRTTNPCATELYGSVSTNWQTGNR

SEQ ID NO: 19868 - protein, 28 aa, Artificial Sequence
  Description of Artificial Sequence: Synthetic peptide
DEEEIRTTNPVATEQYGWVSTQLDRGTR

SEQ ID NO: 19869 - protein, 28 aa, Artificial Sequence
  Description of Artificial Sequence: Synthetic peptide
QEEEIRTVNPVATEQYGSVATNLQRGNM

SEQ ID NO: 19870 - protein, 29 aa, Artificial Sequence
  Description of Artificial Sequence: Synthetic peptide
DEEEIRTTNPCATELYGSVSTNLQQRGNY

SEQ ID NO: 19871 - protein, 29 aa, Artificial Sequence
  Description of Artificial Sequence: Synthetic peptide
DEEEIRTTNPVATEQYGSVSTNLQDAGED

SEQ ID NO: 19872 - protein, 28 aa, Artificial Sequence
  Description of Artificial Sequence: Synthetic peptide
DPEEIRTTNPVATEQYGSVSTNLNFGLR

SEQ ID NO: 19873 - protein, 28 aa, Artificial Sequence
  Description of Artificial Sequence: Synthetic peptide
HEEEIRTTNPVATEQYGAVSTNVQRGND

SEQ ID NO: 19874 - protein, 28 aa, Artificial Sequence
  Description of Artificial Sequence: Synthetic peptide
DEEEIRTTNPVATELWGSVSTNLQIGNS

SEQ ID NO: 19875 - protein, 29 aa, Artificial Sequence
  Description of Artificial Sequence: Synthetic peptide
DEEEIRTTNPVATELYGSVSTNLQMQGNM

SEQ ID NO: 19876 - protein, 28 aa, Artificial Sequence
  Description of Artificial Sequence: Synthetic peptide
DEEEIRTTNPVSTEQYGSVPENEQRGNR

SEQ ID NO: 19877 - protein, 28 aa, Artificial Sequence
  Description of Artificial Sequence: Synthetic peptide
DEEEIRTTNPVATEQYGSMSDDLQRGDR

SEQ ID NO: 19878 - protein, 28 aa, Artificial Sequence
  Description of Artificial Sequence: Synthetic peptide
DEMEIRTTNPVATEQYGVVGNNLQRGNR

SEQ ID NO: 19879 - protein, 28 aa, Artificial Sequence
  Description of Artificial Sequence: Synthetic peptide
DEEEIRTTNPVATEQYGDVSENLQMGNA

SEQ ID NO: 19880 - protein, 28 aa, Artificial Sequence
  Description of Artificial Sequence: Synthetic peptide
QEEEIVTTNPVATEQYGSVSTNLQRGEE

SEQ ID NO: 19881 - protein, 28 aa, Artificial Sequence
  Description of Artificial Sequence: Synthetic peptide
DEEEIRTVNPIATEQYGAVSNNLQRGNR

SEQ ID NO: 19882 - protein, 28 aa, Artificial Sequence
  Description of Artificial Sequence: Synthetic peptide
QEEEIRTTNPVATENYGSVSTDLQPGNR

SEQ ID NO: 19883 - protein, 29 aa, Artificial Sequence
  Description of Artificial Sequence: Synthetic peptide
DEQEIRTTNPVATEQYGSVSTDLERNGNR

SEQ ID NO: 19884 - protein, 29 aa, Artificial Sequence
  Description of Artificial Sequence: Synthetic peptide
DEEEIRTTNPVATEQYGSVSTNLQEFGEY

SEQ ID NO: 19885 - protein, 28 aa, Artificial Sequence
  Description of Artificial Sequence: Synthetic peptide
DEGEIRTTNPVATELYGSVSTNLQGGNF

SEQ ID NO: 19886 - protein, 28 aa, Artificial Sequence
  Description of Artificial Sequence: Synthetic peptide
DETEIETTNPVATEVYGIVSTNLQRGNR

SEQ ID NO: 19887 - protein, 29 aa, Artificial Sequence
  Description of Artificial Sequence: Synthetic peptide
DEEEIRTTNPVATEQYGSVSTNLQHGEDC

SEQ ID NO: 19888 - protein, 28 aa, Artificial Sequence
  Description of Artificial Sequence: Synthetic peptide
DEEEIRTTNPTATEQYGSVSTNEQNGNL

SEQ ID NO: 19889 - protein, 28 aa, Artificial Sequence
  Description of Artificial Sequence: Synthetic peptide
DENEIRTTNPVATEQYGSVSTDLQNGNA

SEQ ID NO: 19890 - protein, 28 aa, Artificial Sequence
  Description of Artificial Sequence: Synthetic peptide
DEEEIRTTNCVATEQYGSVSNNLQQGNF

SEQ ID NO: 19891 - protein, 28 aa, Artificial Sequence
  Description of Artificial Sequence: Synthetic peptide
DEEEIAQTNPVATEQYGSVSTNLQIGNH

SEQ ID NO: 19892 - protein, 28 aa, Artificial Sequence
  Description of Artificial Sequence: Synthetic peptide
DEEEIRTTNPVATEQYGSVDTDEQRGND

SEQ ID NO: 19893 - protein, 28 aa, Artificial Sequence
  Description of Artificial Sequence: Synthetic peptide
DEEEIRTTNPVATEQYGSVSTDDEPGNR

SEQ ID NO: 19894 - protein, 30 aa, Artificial Sequence
  Description of Artificial Sequence: Synthetic polypeptide
DEEEIRTTNPVATEQYGSVSCTNLQCAGNC

SEQ ID NO: 19895 - protein, 28 aa, Artificial Sequence
  Description of Artificial Sequence: Synthetic peptide
DEQEIATTNPVATENYGWVSTNLQRGNR

SEQ ID NO: 19896 - protein, 30 aa, Artificial Sequence
  Description of Artificial Sequence: Synthetic polypeptide
DEEEIRCTNPVATENYGSVSATNLQRGNDR

SEQ ID NO: 19897 - protein, 31 aa, Artificial Sequence
  Description of Artificial Sequence: Synthetic polypeptide
DEEEIRTTNPVATEQYGSVSTNLQEMKGNDR

SEQ ID NO: 19898 - protein, 28 aa, Artificial Sequence
  Description of Artificial Sequence: Synthetic peptide
DEEEIRQTNPVAVEQYGEVSTNLQAGNR

SEQ ID NO: 19899 - protein, 28 aa, Artificial Sequence
  Description of Artificial Sequence: Synthetic peptide
DEVEIRTTNPVATEQFGSVSTNLQRGTF

SEQ ID NO: 19900 - protein, 28 aa, Artificial Sequence
  Description of Artificial Sequence: Synthetic peptide
DEEEIRTTNPTATEIYGCVSTNLQPGNR

SEQ ID NO: 19901 - protein, 28 aa, Artificial Sequence
  Description of Artificial Sequence: Synthetic peptide
DENEIRTTNPVGTEQYGSVSTNLMRGDR

SEQ ID NO: 19902 - protein, 28 aa, Artificial Sequence
  Description of Artificial Sequence: Synthetic peptide
DEVEIRTTNPVATEWYGSVSTNLQLGNF

SEQ ID NO: 19903 - protein, 28 aa, Artificial Sequence
  Description of Artificial Sequence: Synthetic peptide
DESEIRATNPVATEVYGWVSTNLQRGNR

SEQ ID NO: 19904 - protein, 28 aa, Artificial Sequence
  Description of Artificial Sequence: Synthetic peptide
DEEEIRTTNPVATEQYGSVSTELELGNA

SEQ ID NO: 19905 - protein, 28 aa, Artificial Sequence
  Description of Artificial Sequence: Synthetic peptide
DEEEIRTTNPVATEQYGDVSTNEMRGNA

SEQ ID NO: 19906 - protein, 28 aa, Artificial Sequence
  Description of Artificial Sequence: Synthetic peptide
DENEIRTTNPVATEMYGSVSTDLQRGNF

SEQ ID NO: 19907 - protein, 30 aa, Artificial Sequence
  Description of Artificial Sequence: Synthetic polypeptide
DEEEIRTTNPVATECYGSVSTNLQERGNDL

SEQ ID NO: 19908 - protein, 28 aa, Artificial Sequence
  Description of Artificial Sequence: Synthetic peptide
DEEEIRSCNPVATEQYGSVSTNWQRGNI

SEQ ID NO: 19909 - protein, 28 aa, Artificial Sequence
  Description of Artificial Sequence: Synthetic peptide
DEEEIACTNPVSTEQYGWVSTNLQRGNR

SEQ ID NO: 19910 - protein, 28 aa, Artificial Sequence
  Description of Artificial Sequence: Synthetic peptide
DEIEIRTTNPVATEQYGSVSTDLQPGNQ

SEQ ID NO: 19911 - protein, 29 aa, Artificial Sequence
  Description of Artificial Sequence: Synthetic peptide
TEDELRTTNPVATEQYGSVSTNLQRVGNR

SEQ ID NO: 19912 - protein, 28 aa, Artificial Sequence
  Description of Artificial Sequence: Synthetic peptide
DEEEIATTNPVATELYGGVSTNLQRGNQ

SEQ ID NO: 19913 - protein, 31 aa, Artificial Sequence
  Description of Artificial Sequence: Synthetic polypeptide
DEEEIRTTNPVATEQYGSVSTCNLQRGDNTQ

SEQ ID NO: 19914 - protein, 28 aa, Artificial Sequence
  Description of Artificial Sequence: Synthetic peptide
DEEEIVTTNPVATEQYGSVSTDPQDGNR

SEQ ID NO: 19915 - protein, 28 aa, Artificial Sequence
  Description of Artificial Sequence: Synthetic peptide
DEEEIRTTNPVATEQYGSVSTNLEQGEF

SEQ ID NO: 19916 - protein, 28 aa, Artificial Sequence
  Description of Artificial Sequence: Synthetic peptide
DENEIRTTNPVATEWYGEVSINLQRGNR

SEQ ID NO: 19917 - protein, 29 aa, Artificial Sequence
  Description of Artificial Sequence: Synthetic peptide
DEEEIRTTNPVATEQYGSVSCENLQNGNQ

SEQ ID NO: 19918 - protein, 29 aa, Artificial Sequence
  Description of Artificial Sequence: Synthetic peptide
DEEEVRTTNPVATEQYGSVSDNLQSKGNR

SEQ ID NO: 19919 - protein, 30 aa, Artificial Sequence
  Description of Artificial Sequence: Synthetic polypeptide
DEEEIRATNPVATEQYGGVISTNLQREGNR

SEQ ID NO: 19920 - protein, 29 aa, Artificial Sequence
  Description of Artificial Sequence: Synthetic peptide
DEEEVRATNPVATEQYGSVSENLQGRGNR

SEQ ID NO: 19921 - protein, 31 aa, Artificial Sequence
  Description of Artificial Sequence: Synthetic polypeptide
DEEEIRTTNPVATEQYGSVSTDLPQDRDGNR

SEQ ID NO: 19922 - protein, 30 aa, Artificial Sequence
  Description of Artificial Sequence: Synthetic polypeptide
DEEEIRTTNPVATEQYGSVESDTNLDPGNR

SEQ ID NO: 19923 - protein, 28 aa, Artificial Sequence
  Description of Artificial Sequence: Synthetic peptide
DEEEITTTNPVATEVYGSVFENLQRGNR

SEQ ID NO: 19924 - protein, 29 aa, Artificial Sequence
  Description of Artificial Sequence: Synthetic peptide
DEEEIRTTNPVATEQYGSVDTMNLCRGNC

SEQ ID NO: 19925 - protein, 28 aa, Artificial Sequence
  Description of Artificial Sequence: Synthetic peptide
DEQEIRTTNPEATEQYGSVSTNLQVGNH

SEQ ID NO: 19926 - protein, 28 aa, Artificial Sequence
  Description of Artificial Sequence: Synthetic peptide
QEEEIRTTNPVATEQYGSASTVLQRGGR

SEQ ID NO: 19927 - protein, 28 aa, Artificial Sequence
  Description of Artificial Sequence: Synthetic peptide
DEEEIRCTNPVASEVYGAVSTNLQRGNR

SEQ ID NO: 19928 - protein, 28 aa, Artificial Sequence
  Description of Artificial Sequence: Synthetic peptide
DEEEIRTTNPVATEQYGSVSTGLEVGNS

SEQ ID NO: 19929 - protein, 28 aa, Artificial Sequence
  Description of Artificial Sequence: Synthetic peptide
DEQEIRTTNPVATEQYGSVSTNDQGGER

SEQ ID NO: 19930 - protein, 29 aa, Artificial Sequence
  Description of Artificial Sequence: Synthetic peptide
DEEEIRTTNPVATEQYGSVSTNLMNQGNA

SEQ ID NO: 19931 - protein, 29 aa, Artificial Sequence
  Description of Artificial Sequence: Synthetic peptide
DEEEIRTTNPVATEQYGDVSENLQCRGER

SEQ ID NO: 19932 - protein, 28 aa, Artificial Sequence
  Description of Artificial Sequence: Synthetic peptide
DEEEIRTTNPVATEQYGSYSEILQRGNA

SEQ ID NO: 19933 - protein, 31 aa, Artificial Sequence
  Description of Artificial Sequence: Synthetic polypeptide
DEEEIRTTNPVATEQYGSVSETNLQVRGENN

SEQ ID NO: 19934 - protein, 28 aa, Artificial Sequence
  Description of Artificial Sequence: Synthetic peptide
KEEEIRTTNPCATEQYGSVSTNLQRENQ

SEQ ID NO: 19935 - protein, 28 aa, Artificial Sequence
  Description of Artificial Sequence: Synthetic peptide
DEEEIYTTNPVATEQYGQVSTNLQVGNC

SEQ ID NO: 19936 - protein, 28 aa, Artificial Sequence
  Description of Artificial Sequence: Synthetic peptide
DEEEVRCTNPVATEIYGSVSTNLERGNR

SEQ ID NO: 19937 - protein, 28 aa, Artificial Sequence
  Description of Artificial Sequence: Synthetic peptide
DEEEIRATNPVCTEQYGSVSTNLQSGNA

SEQ ID NO: 19938 - protein, 29 aa, Artificial Sequence
  Description of Artificial Sequence: Synthetic peptide
DEEEIRTTNPVATEQYGSVSTNLMMIGNQ

SEQ ID NO: 19939 - protein, 28 aa, Artificial Sequence
  Description of Artificial Sequence: Synthetic peptide
DEEEIRTTNPCATEQYGSTSTNIQRGNG

SEQ ID NO: 19940 - protein, 29 aa, Artificial Sequence
  Description of Artificial Sequence: Synthetic peptide
DEEEIRTTNPVATEQWGIVDTNLQWRGNR

SEQ ID NO: 19941 - protein, 28 aa, Artificial Sequence
  Description of Artificial Sequence: Synthetic peptide
DEEEIRTTNPVATECYGVVSTNLQRGEM

SEQ ID NO: 19942 - protein, 31 aa, Artificial Sequence
  Description of Artificial Sequence: Synthetic polypeptide
DEEEIRTTNPVATEQYGAVSTENLQRAGNDR

SEQ ID NO: 19943 - protein, 28 aa, Artificial Sequence
  Description of Artificial Sequence: Synthetic peptide
DEEEIRTTNPVATEQYGSVSENEQVGNA

SEQ ID NO: 19944 - protein, 28 aa, Artificial Sequence
  Description of Artificial Sequence: Synthetic peptide
MENEIRTTNPVATECYGSVSTNLQNGNR

SEQ ID NO: 19945 - protein, 29 aa, Artificial Sequence
  Description of Artificial Sequence: Synthetic peptide
DENEIRTTNPVATEQYGSVDTNLQRGNDV

SEQ ID NO: 19946 - protein, 28 aa, Artificial Sequence
  Description of Artificial Sequence: Synthetic peptide
DEEEITTTNPVCTEQYGSVSENLQRGNT

SEQ ID NO: 19947 - protein, 30 aa, Artificial Sequence
  Description of Artificial Sequence: Synthetic polypeptide
DEEEIRTTNPVATEQYGSVSITNDQMAGNR

SEQ ID NO: 19948 - protein, 29 aa, Artificial Sequence
  Description of Artificial Sequence: Synthetic peptide
DEEEIRTTNPVATEQYGCVSETNLQRLIR

SEQ ID NO: 19949 - protein, 32 aa, Artificial Sequence
  Description of Artificial Sequence: Synthetic polypeptide
DEEEIRTTNPVATEQYWGSVSDTPNPLQRGNR

SEQ ID NO: 19950 - protein, 30 aa, Artificial Sequence
  Description of Artificial Sequence: Synthetic polypeptide
DEEEIRTTNPVATEQYGSVDSTDPLQRGNF

SEQ ID NO: 19951 - protein, 29 aa, Artificial Sequence
  Description of Artificial Sequence: Synthetic peptide
DEEEIATTNPVATEQYGDVSAENLQRGNR

SEQ ID NO: 19952 - protein, 28 aa, Artificial Sequence
  Description of Artificial Sequence: Synthetic peptide
DEAEIRTTNPVATEQYGVVSTNLQYGNL

SEQ ID NO: 19953 - protein, 28 aa, Artificial Sequence
  Description of Artificial Sequence: Synthetic peptide
DEEEIRTTNPVATECYGSVSTDLQYGNW

SEQ ID NO: 19954 - protein, 31 aa, Artificial Sequence
  Description of Artificial Sequence: Synthetic polypeptide
DEEEIRTTNPVATEQYGSVSTGNPQREGNTR

SEQ ID NO: 19955 - protein, 28 aa, Artificial Sequence
  Description of Artificial Sequence: Synthetic peptide
DEEEIRTTNPVATELYGSVDTNLQGGNA

SEQ ID NO: 19956 - protein, 29 aa, Artificial Sequence
  Description of Artificial Sequence: Synthetic peptide
DEEEIRTTNPVATEQYGCVSMNLQRGTER

SEQ ID NO: 19957 - protein, 28 aa, Artificial Sequence
  Description of Artificial Sequence: Synthetic peptide
DEEEIRTTNPVATEQYGSVSTDDDRGNQ

SEQ ID NO: 19958 - protein, 28 aa, Artificial Sequence
  Description of Artificial Sequence: Synthetic peptide
DENEIKTTNPVATEQYGGVCTNLQRGNR

SEQ ID NO: 19959 - protein, 29 aa, Artificial Sequence
  Description of Artificial Sequence: Synthetic peptide
DEEEIRTTNPVATEQYWDYDSTNLQRGNR

SEQ ID NO: 19960 - protein, 28 aa, Artificial Sequence
  Description of Artificial Sequence: Synthetic peptide
DENEIRTTNPVATEQWGSVSTNEQRGNW

SEQ ID NO: 19961 - protein, 30 aa, Artificial Sequence
  Description of Artificial Sequence: Synthetic polypeptide
DEEEIRTTNPVATEQYGSADTENGLQRGNR

SEQ ID NO: 19962 - protein, 28 aa, Artificial Sequence
  Description of Artificial Sequence: Synthetic peptide
DEEEIRTTNPVATEQYGIVSENLDFGNR

SEQ ID NO: 19963 - protein, 28 aa, Artificial Sequence
  Description of Artificial Sequence: Synthetic peptide
DEEEIAATNPVATEQYGSASTNLQRGGR

SEQ ID NO: 19964 - protein, 30 aa, Artificial Sequence
  Description of Artificial Sequence: Synthetic polypeptide
DEEEIRTTNPVATEQYGEVSTNLQDRGNLF

SEQ ID NO: 19965 - protein, 30 aa, Artificial Sequence
  Description of Artificial Sequence: Synthetic polypeptide
DEEEIRTTNPVATEQYGSVSTDLQNEGNDR

SEQ ID NO: 19966 - protein, 28 aa, Artificial Sequence
  Description of Artificial Sequence: Synthetic peptide
DEQEIRTTNPVATEQYGSVDTDLERGNR

SEQ ID NO: 19967 - protein, 31 aa, Artificial Sequence
  Description of Artificial Sequence: Synthetic polypeptide
DEEEIRTTNPVATEQYGSVSETYNLQRGDER

SEQ ID NO: 19968 - protein, 28 aa, Artificial Sequence
  Description of Artificial Sequence: Synthetic peptide
DEDNIRTTNPVATEEYGEVSTNLQRGNR

SEQ ID NO: 19969 - protein, 28 aa, Artificial Sequence
  Description of Artificial Sequence: Synthetic peptide
DEEEIRTTNPVATENYGSVSTNPQRENL

SEQ ID NO: 19970 - protein, 30 aa, Artificial Sequence
  Description of Artificial Sequence: Synthetic polypeptide
DEEEIRTTNPVATEQYGSVDSTNGQQVGNR

SEQ ID NO: 19971 - protein, 28 aa, Artificial Sequence
  Description of Artificial Sequence: Synthetic peptide
DEEEIRTTNPVATEQYGSMSTDLQFGNV

SEQ ID NO: 19972 - protein, 28 aa, Artificial Sequence
  Description of Artificial Sequence: Synthetic peptide
CEEEIRCTNPVAVECYGSVSTNLQRGNR

SEQ ID NO: 19973 - protein, 28 aa, Artificial Sequence
  Description of Artificial Sequence: Synthetic peptide
DEEEIATTNPVATEQYGVVSTELQYGNR

SEQ ID NO: 19974 - protein, 28 aa, Artificial Sequence
  Description of Artificial Sequence: Synthetic peptide
DEEEIRTVNPVATEQYGSVGENLQRGPR

SEQ ID NO: 19975 - protein, 30 aa, Artificial Sequence
  Description of Artificial Sequence: Synthetic polypeptide
DEEEIRTTNPVATEQYGSVCSTVYLQRGNF

SEQ ID NO: 19976 - protein, 28 aa, Artificial Sequence
  Description of Artificial Sequence: Synthetic peptide
AEEEIATTNPVATEQYGSVSTNQQRGER

SEQ ID NO: 19977 - protein, 29 aa, Artificial Sequence
  Description of Artificial Sequence: Synthetic peptide
DEEEIVTTNPVATEQYGVVSENLQERGNR

SEQ ID NO: 19978 - protein, 29 aa, Artificial Sequence
  Description of Artificial Sequence: Synthetic peptide
DEEEIRTTNPVATEQYGSVSTNLNFPGNA

SEQ ID NO: 19979 - protein, 28 aa, Artificial Sequence
  Description of Artificial Sequence: Synthetic peptide
DEEEIRTTNPVATEQYGSVSTDLQQGEN

SEQ ID NO: 19980 - protein, 29 aa, Artificial Sequence
  Description of Artificial Sequence: Synthetic peptide
MEEEIRTTNPVATEQYGSVSTDLQNEGNR

SEQ ID NO: 19981 - protein, 29 aa, Artificial Sequence
  Description of Artificial Sequence: Synthetic peptide
DEEEIRTTNPVATEQYGSASTLLCRGNTR

SEQ ID NO: 19982 - protein, 28 aa, Artificial Sequence
  Description of Artificial Sequence: Synthetic peptide
DEEEIRTVNPVATEQYGSVSTDLQLGNM

SEQ ID NO: 19983 - protein, 28 aa, Artificial Sequence
  Description of Artificial Sequence: Synthetic peptide
DEEEIRTTNPVATEQYGSVSTELCYGNA

SEQ ID NO: 19984 - protein, 28 aa, Artificial Sequence
  Description of Artificial Sequence: Synthetic peptide
DEEEIRTTNPVATEQYGIVSDNLQDGDR

SEQ ID NO: 19985 - protein, 28 aa, Artificial Sequence
  Description of Artificial Sequence: Synthetic peptide
DEEEIRTVNPVATEQYGSVSANPQRGNP

SEQ ID NO: 19986 - protein, 28 aa, Artificial Sequence
  Description of Artificial Sequence: Synthetic peptide
DEEEIRCTNPCATEQYGAVSTCLQRGNR

SEQ ID NO: 19987 - protein, 28 aa, Artificial Sequence
  Description of Artificial Sequence: Synthetic peptide
MENEIRTTNPVATEQYGSVSTNLQNGNN

SEQ ID NO: 19988 - protein, 28 aa, Artificial Sequence
  Description of Artificial Sequence: Synthetic peptide
DEEEVRTTNPVATSQYGSVSTALQRGNG

SEQ ID NO: 19989 - protein, 28 aa, Artificial Sequence
  Description of Artificial Sequence: Synthetic peptide
DEEEIRTTNPVATQQYGSVFTPLQRGER

SEQ ID NO: 19990 - protein, 31 aa, Artificial Sequence
  Description of Artificial Sequence: Synthetic polypeptide
DEEEIRTTNPVATEQYGSVSTNLEREGENER

SEQ ID NO: 19991 - protein, 28 aa, Artificial Sequence
  Description of Artificial Sequence: Synthetic peptide
DEEEIRTTNPVATECYGSVSTELQHGNV

SEQ ID NO: 19992 - protein, 28 aa, Artificial Sequence
  Description of Artificial Sequence: Synthetic peptide
AEEEIRTVNPVATEQYGSVANNLQRGNR

SEQ ID NO: 19993 - protein, 28 aa, Artificial Sequence
  Description of Artificial Sequence: Synthetic peptide
DEEEISTTNPVATEQFGLVSTNLQRGNM

SEQ ID NO: 19994 - protein, 28 aa, Artificial Sequence
  Description of Artificial Sequence: Synthetic peptide
DEEEIRTTNPVATEQYGIVSTNLMIGTR

SEQ ID NO: 19995 - protein, 28 aa, Artificial Sequence
  Description of Artificial Sequence: Synthetic peptide
AEEEITTTNPVATEQYGSVSTNLQLGNA

SEQ ID NO: 19996 - protein, 28 aa, Artificial Sequence
  Description of Artificial Sequence: Synthetic peptide
DEEQIRTTNPVATQQYGSVSHNLQRGNP

SEQ ID NO: 19997 - protein, 28 aa, Artificial Sequence
  Description of Artificial Sequence: Synthetic peptide
DEEEIRTTNPVATEQYGSVSENEMRGNM

SEQ ID NO: 19998 - protein, 31 aa, Artificial Sequence
  Description of Artificial Sequence: Synthetic polypeptide
DEEEIRTTNPVATEQYGSVDSTNGLQRGEDR

SEQ ID NO: 19999 - protein, 30 aa, Artificial Sequence
  Description of Artificial Sequence: Synthetic polypeptide
DEEEIRTTNPVATEQYGSVSTNLPQYKGND

SEQ ID NO: 20000 - protein, 28 aa, Artificial Sequence
  Description of Artificial Sequence: Synthetic peptide
DEEEIACTNPVATEQYGSVSTVLQHGNR

SEQ ID NO: 20001 - protein, 32 aa, Artificial Sequence
  Description of Artificial Sequence: Synthetic polypeptide
DEEEIRTTNPVATEQYGSVSTNLVQIRDGNPR

SEQ ID NO: 20002 - protein, 30 aa, Artificial Sequence
  Description of Artificial Sequence: Synthetic polypeptide
DEEEIRTTNPVATEQYGSVSTNLQDRKGEN

SEQ ID NO: 20003 - protein, 30 aa, Artificial Sequence
  Description of Artificial Sequence: Synthetic polypeptide
DEEEIRTTNPVATEQYGSVSTNGLVQRGEG

SEQ ID NO: 20004 - protein, 28 aa, Artificial Sequence
  Description of Artificial Sequence: Synthetic peptide
DEEEIRTTNPVATEQYGSCSTQLQNGNQ

SEQ ID NO: 20005 - protein, 29 aa, Artificial Sequence
  Description of Artificial Sequence: Synthetic peptide
DEEEIRTTNPVATEQYGSVSTNLTIPGNP

SEQ ID NO: 20006 - protein, 28 aa, Artificial Sequence
  Description of Artificial Sequence: Synthetic peptide
WEEEIRTTNPVATCQYGSVSTNLQRGVI

SEQ ID NO: 20007 - protein, 29 aa, Artificial Sequence
  Description of Artificial Sequence: Synthetic peptide
DDEEIRTTNPVATEQYGSVSTLNLQNGNG

SEQ ID NO: 20008 - protein, 30 aa, Artificial Sequence
  Description of Artificial Sequence: Synthetic polypeptide
DEEEIRTTNPVATEQYGSVSTDLQENEGNR

SEQ ID NO: 20009 - protein, 28 aa, Artificial Sequence
  Description of Artificial Sequence: Synthetic peptide
DEEEIRTTNPVATEFYGSVSTDLQHGNQ

SEQ ID NO: 20010 - protein, 28 aa, Artificial Sequence
  Description of Artificial Sequence: Synthetic peptide
DEEEIRATNPVATEQYGSVSTDLQHGER

SEQ ID NO: 20011 - protein, 28 aa, Artificial Sequence
  Description of Artificial Sequence: Synthetic peptide
DEQEIVTTNPVATELYGWVSTNLQRGNR

SEQ ID NO: 20012 - protein, 28 aa, Artificial Sequence
  Description of Artificial Sequence: Synthetic peptide
DENEIATTNPVATEQYGSVSTNLQTGND

SEQ ID NO: 20013 - protein, 28 aa, Artificial Sequence
  Description of Artificial Sequence: Synthetic peptide
DEEEIRTTNPVATEQYGSVEDDLQRGNG

SEQ ID NO: 20014 - protein, 29 aa, Artificial Sequence
  Description of Artificial Sequence: Synthetic peptide
DEEEICTTNPVATEQYGTVCSTNLERGNR

SEQ ID NO: 20015 - protein, 28 aa, Artificial Sequence
  Description of Artificial Sequence: Synthetic peptide
GEEEIRTTNPVATEQYGAVSTNLERGER

SEQ ID NO: 20016 - protein, 30 aa, Artificial Sequence
  Description of Artificial Sequence: Synthetic polypeptide
DEEEIRTTNPVAYEQYGSVDCTNLQMRGNR

SEQ ID NO: 20017 - protein, 28 aa, Artificial Sequence
  Description of Artificial Sequence: Synthetic peptide
CEEEIRTTNPVATEQYGSVSTNPERGND

SEQ ID NO: 20018 - protein, 28 aa, Artificial Sequence
  Description of Artificial Sequence: Synthetic peptide
DEEEIRATNPVATEMYGSVSTNLEYGNR

SEQ ID NO: 20019 - protein, 28 aa, Artificial Sequence
  Description of Artificial Sequence: Synthetic peptide
DTEEIRTTNPVATEQYGSVSTNDQPGNP

SEQ ID NO: 20020 - protein, 28 aa, Artificial Sequence
  Description of Artificial Sequence: Synthetic peptide
DEQEIRTTNPVATECYGSYDTNLQRGNR

SEQ ID NO: 20021 - protein, 30 aa, Artificial Sequence
  Description of Artificial Sequence: Synthetic polypeptide
DEEELRTTNPVATEQYGSVSTNGLQYNGNR

SEQ ID NO: 20022 - protein, 28 aa, Artificial Sequence
  Description of Artificial Sequence: Synthetic peptide
QEEEIRTTNPVATEQYGSVSTNIQHGGR

SEQ ID NO: 20023 - protein, 28 aa, Artificial Sequence
  Description of Artificial Sequence: Synthetic peptide
DEQEIRTVNPVATEQYGSVSTNLQQGNW

SEQ ID NO: 20024 - protein, 30 aa, Artificial Sequence
  Description of Artificial Sequence: Synthetic polypeptide
DEEEIRTTNPVATEQYGSVWTPGPLQRGNR

SEQ ID NO: 20025 - protein, 28 aa, Artificial Sequence
  Description of Artificial Sequence: Synthetic peptide
DEEEIRTTNPVATEQYGSVSTNVQSGDF

SEQ ID NO: 20026 - protein, 28 aa, Artificial Sequence
  Description of Artificial Sequence: Synthetic peptide
DEEEIRTTNPVATEQYGSVSTNLEHGEF

SEQ ID NO: 20027 - protein, 29 aa, Artificial Sequence
  Description of Artificial Sequence: Synthetic peptide
DEEEIRTTNPVCTEQYGSVSCENLCRGNR

SEQ ID NO: 20028 - protein, 28 aa, Artificial Sequence
  Description of Artificial Sequence: Synthetic peptide
DEEEIRTTNPVGTEQYGSVTTALQRGIR

SEQ ID NO: 20029 - protein, 28 aa, Artificial Sequence
  Description of Artificial Sequence: Synthetic peptide
DEEEIRTTNPVATQQYGSVSTNDQNGNG

SEQ ID NO: 20030 - protein, 31 aa, Artificial Sequence
  Description of Artificial Sequence: Synthetic polypeptide
DEEEIRTTNPVATENYGSVTSETVNLQRGNR

SEQ ID NO: 20031 - protein, 28 aa, Artificial Sequence
  Description of Artificial Sequence: Synthetic peptide
DEQEIRTTNPVATEQYGCVATNLQRGND

SEQ ID NO: 20032 - protein, 30 aa, Artificial Sequence
  Description of Artificial Sequence: Synthetic polypeptide
DEEEIRTTNPVATEQYGSVSTNLVQVDGNN

SEQ ID NO: 20033 - protein, 28 aa, Artificial Sequence
  Description of Artificial Sequence: Synthetic peptide
DEQEIRTTNPVATEQYGSVSTELQIGER

SEQ ID NO: 20034 - protein, 28 aa, Artificial Sequence
  Description of Artificial Sequence: Synthetic peptide
DEEEIRTTNPVATEVYGSYSTNLQTGTR

SEQ ID NO: 20035 - protein, 29 aa, Artificial Sequence
  Description of Artificial Sequence: Synthetic peptide
DEEEIRTTNPVATEQYGSVSTNEPNRGNH

SEQ ID NO: 20036 - protein, 28 aa, Artificial Sequence
  Description of Artificial Sequence: Synthetic peptide
DEEEIRCTNPVATEQYGSVSTPLQYGNM

SEQ ID NO: 20037 - protein, 28 aa, Artificial Sequence
  Description of Artificial Sequence: Synthetic peptide
DEEEIRTTNPVATEQYGVVSTELQIGNM

SEQ ID NO: 20038 - protein, 30 aa, Artificial Sequence
  Description of Artificial Sequence: Synthetic polypeptide
DEEEIRTTNCVATEQYGSVSATNLQAGNDR

SEQ ID NO: 20039 - protein, 28 aa, Artificial Sequence
  Description of Artificial Sequence: Synthetic peptide
DEEEIRTTNPVATEQYGSVSTEPQYGNA

SEQ ID NO: 20040 - protein, 29 aa, Artificial Sequence
  Description of Artificial Sequence: Synthetic peptide
DEEEIRTTNPFATEQYGSVATANLQRGNL

SEQ ID NO: 20041 - protein, 29 aa, Artificial Sequence
  Description of Artificial Sequence: Synthetic peptide
LEEEIRTTNPVATEQYGAVSENLQSRGNR

SEQ ID NO: 20042 - protein, 30 aa, Artificial Sequence
  Description of Artificial Sequence: Synthetic polypeptide
MEEEIRTTNPVATEQYGSVSTNLQENEGNR

SEQ ID NO: 20043 - protein, 28 aa, Artificial Sequence
  Description of Artificial Sequence: Synthetic peptide
DHEEIRTTNPVATEQYGSVSTNLDPGNP

SEQ ID NO: 20044 - protein, 30 aa, Artificial Sequence
  Description of Artificial Sequence: Synthetic polypeptide
DEMEISTTNPVATEQYGSVSTTNLQRGNIR

SEQ ID NO: 20045 - protein, 29 aa, Artificial Sequence
  Description of Artificial Sequence: Synthetic peptide
DEEEIRTTNPVATEQYGSVSTNLILRGET

SEQ ID NO: 20046 - protein, 28 aa, Artificial Sequence
  Description of Artificial Sequence: Synthetic peptide
DEVEIRTTNPVATEQYGDVSTNLQRLNM

SEQ ID NO: 20047 - protein, 29 aa, Artificial Sequence
  Description of Artificial Sequence: Synthetic peptide
DEEPIRTTNPVATEQYYGSVSQNLQRNNR

SEQ ID NO: 20048 - protein, 28 aa, Artificial Sequence
  Description of Artificial Sequence: Synthetic peptide
YEEEIRTVNPVATEGYGNVSTNLQRGNR

SEQ ID NO: 20049 - protein, 29 aa, Artificial Sequence
  Description of Artificial Sequence: Synthetic peptide
DENEIRTTNPVATEQYGWVSTNLQIEGNR

SEQ ID NO: 20050 - protein, 28 aa, Artificial Sequence
  Description of Artificial Sequence: Synthetic peptide
DEEEIRTTNPVATEQYGSVSTDLELGNS

SEQ ID NO: 20051 - protein, 28 aa, Artificial Sequence
  Description of Artificial Sequence: Synthetic peptide
DETEIRQTNPVATEQYGSVSTNLQQGNN

SEQ ID NO: 20052 - protein, 28 aa, Artificial Sequence
  Description of Artificial Sequence: Synthetic peptide
DDEEIATTNPVATEMYGSVSTNLQRGNS

SEQ ID NO: 20053 - protein, 28 aa, Artificial Sequence
  Description of Artificial Sequence: Synthetic peptide
DEEEIRTTNPVATEQYGSVSTELEGGNV

SEQ ID NO: 20054 - protein, 28 aa, Artificial Sequence
  Description of Artificial Sequence: Synthetic peptide
DEEEIRTTNPVATEQYGSVSTDLEHGNQ

SEQ ID NO: 20055 - protein, 28 aa, Artificial Sequence
  Description of Artificial Sequence: Synthetic peptide
DEQEIRTTNPVATEQYGSVSTNEMRGNA

SEQ ID NO: 20056 - protein, 28 aa, Artificial Sequence
  Description of Artificial Sequence: Synthetic peptide
NEEEIGTTNPVATEQYGSVSTNLQDGNT

SEQ ID NO: 20057 - protein, 28 aa, Artificial Sequence
  Description of Artificial Sequence: Synthetic peptide
DEEEIATVNPVATEQYGSVSENLQRGND

SEQ ID NO: 20058 - protein, 28 aa, Artificial Sequence
  Description of Artificial Sequence: Synthetic peptide
DEEEIVTTNPVATEQYGSVATNLERGNQ

SEQ ID NO: 20059 - protein, 28 aa, Artificial Sequence
  Description of Artificial Sequence: Synthetic peptide
DENEIVCTNPVATEHYGSVSTNLQRGNR

SEQ ID NO: 20060 - protein, 28 aa, Artificial Sequence
  Description of Artificial Sequence: Synthetic peptide
REEEIRTTNPVATEQYGSVDTNLQRGIP

SEQ ID NO: 20061 - protein, 30 aa, Artificial Sequence
  Description of Artificial Sequence: Synthetic polypeptide
DEEEIRATNPVATEQYGSVSSTINLQRLNR

SEQ ID NO: 20062 - protein, 31 aa, Artificial Sequence
  Description of Artificial Sequence: Synthetic polypeptide
DEEEIRTTNPAATEQYGSVSTLNLPQRGDNR

SEQ ID NO: 20063 - protein, 28 aa, Artificial Sequence
  Description of Artificial Sequence: Synthetic peptide
DEEEIRTTNPVASEIYGSVSTDLDRGNR

SEQ ID NO: 20064 - protein, 28 aa, Artificial Sequence
  Description of Artificial Sequence: Synthetic peptide
DEQEIRTTNPVATEIYGSVSTNLQRGEI

SEQ ID NO: 20065 - protein, 28 aa, Artificial Sequence
  Description of Artificial Sequence: Synthetic peptide
DEEEIRTTNPVATECYGSVSTNLQVGEN

SEQ ID NO: 20066 - protein, 28 aa, Artificial Sequence
  Description of Artificial Sequence: Synthetic peptide
DEIEIRQTNPVATEIYGSVSTNLQQGNR

SEQ ID NO: 20067 - protein, 28 aa, Artificial Sequence
  Description of Artificial Sequence: Synthetic peptide
DENEIRTTNPVATEQYGSVSTNEQRGDL

SEQ ID NO: 20068 - protein, 28 aa, Artificial Sequence
  Description of Artificial Sequence: Synthetic peptide
DEEEIVTTNPVATECYGSVSTNLQLGNY

SEQ ID NO: 20069 - protein, 28 aa, Artificial Sequence
  Description of Artificial Sequence: Synthetic peptide
DEEEIRPTNPVATEQYGSVSTPLQYGNN

SEQ ID NO: 20070 - protein, 28 aa, Artificial Sequence
  Description of Artificial Sequence: Synthetic peptide
DEDEIRTTNPVATEQYGSVSSDLQRGNN

SEQ ID NO: 20071 - protein, 28 aa, Artificial Sequence
  Description of Artificial Sequence: Synthetic peptide
VEEEIRTTNPVATEIYGQVSTNLQRGTR

SEQ ID NO: 20072 - protein, 28 aa, Artificial Sequence
  Description of Artificial Sequence: Synthetic peptide
DEQEICTTNPVATEQYGSVSTNLQLGNE

SEQ ID NO: 20073 - protein, 28 aa, Artificial Sequence
  Description of Artificial Sequence: Synthetic peptide
DEEEIRTTNPVATEQYGSVETNDDRGER

SEQ ID NO: 20074 - protein, 30 aa, Artificial Sequence
  Description of Artificial Sequence: Synthetic polypeptide
DEEEIRTTNPVATEQYGSVSTDLQDHGENR

SEQ ID NO: 20075 - protein, 29 aa, Artificial Sequence
  Description of Artificial Sequence: Synthetic peptide
DEEEIRQTNPVATEQYGSVSTNLDRNGNA

SEQ ID NO: 20076 - protein, 29 aa, Artificial Sequence
  Description of Artificial Sequence: Synthetic peptide
DENEIRTTNPVATEQWGSVSENLQNRGNR

SEQ ID NO: 20077 - protein, 28 aa, Artificial Sequence
  Description of Artificial Sequence: Synthetic peptide
DEEEIATTNPVATEQYGSVSTELQIGNL

SEQ ID NO: 20078 - protein, 30 aa, Artificial Sequence
  Description of Artificial Sequence: Synthetic polypeptide
DEEEIRTTNPVATEQYGSVSTNLQMRGETF

SEQ ID NO: 20079 - protein, 30 aa, Artificial Sequence
  Description of Artificial Sequence: Synthetic polypeptide
DEEEIRTTNPVATEQYGSVESNTNEQRGDR

SEQ ID NO: 20080 - protein, 28 aa, Artificial Sequence
  Description of Artificial Sequence: Synthetic peptide
KEEEIRTTNPVATEQYGDVSTNLQHGNM

SEQ ID NO: 20081 - protein, 28 aa, Artificial Sequence
  Description of Artificial Sequence: Synthetic peptide
AEEEIVTTNPVATEQYGSVSTNPIRGNR

SEQ ID NO: 20082 - protein, 30 aa, Artificial Sequence
  Description of Artificial Sequence: Synthetic polypeptide
DEEEIRTTNPVATEQYGCVSATNLERNGNR

SEQ ID NO: 20083 - protein, 30 aa, Artificial Sequence
  Description of Artificial Sequence: Synthetic polypeptide
DGEEIRTTNPVATEQYGSVNSTNDQRGNLR

SEQ ID NO: 20084 - protein, 28 aa, Artificial Sequence
  Description of Artificial Sequence: Synthetic peptide
DEEEIRTTNPTSTEQYGSVSTDDQRGNR

SEQ ID NO: 20085 - protein, 29 aa, Artificial Sequence
  Description of Artificial Sequence: Synthetic peptide
DEEEIRTTNPVATEQYGSAVSTNIQGLNR

SEQ ID NO: 20086 - protein, 29 aa, Artificial Sequence
  Description of Artificial Sequence: Synthetic peptide
DEEEIRTTNPVASEIYGCVSATNLQRGNR

SEQ ID NO: 20087 - protein, 28 aa, Artificial Sequence
  Description of Artificial Sequence: Synthetic peptide
DEEEIRTTNPVATEQYGSVSTDLETGNI

SEQ ID NO: 20088 - protein, 28 aa, Artificial Sequence
  Description of Artificial Sequence: Synthetic peptide
AEQEIRSTNPVATEVYGSVSTNLQRGNR

SEQ ID NO: 20089 - protein, 28 aa, Artificial Sequence
  Description of Artificial Sequence: Synthetic peptide
DEEEIRTTNPVAYEMYWSVSTNLQNGNR

SEQ ID NO: 20090 - protein, 28 aa, Artificial Sequence
  Description of Artificial Sequence: Synthetic peptide
CEEEIRTVNPVATEQYGSVSTDLGRGNR

SEQ ID NO: 20091 - protein, 29 aa, Artificial Sequence
  Description of Artificial Sequence: Synthetic peptide
DENEIRTTNPVATEQYGSVSTDLQDTGNR

SEQ ID NO: 20092 - protein, 30 aa, Artificial Sequence
  Description of Artificial Sequence: Synthetic polypeptide
DEEEIRSTNPVATEQYGSVSEMNLQERGNR

SEQ ID NO: 20093 - protein, 28 aa, Artificial Sequence
  Description of Artificial Sequence: Synthetic peptide
KENEIRTVNPVATEQYGSVSTNLQHGNR

SEQ ID NO: 20094 - protein, 29 aa, Artificial Sequence
  Description of Artificial Sequence: Synthetic peptide
SEEEIRTTNPVATEQFGSVISTNLQQGNR

SEQ ID NO: 20095 - protein, 28 aa, Artificial Sequence
  Description of Artificial Sequence: Synthetic peptide
DEEEIRCTNPVATEQYGSVSTNDERGNL

SEQ ID NO: 20096 - protein, 28 aa, Artificial Sequence
  Description of Artificial Sequence: Synthetic peptide
QEEEIRTTNPVATEMYGNVSTTLQRGNR

SEQ ID NO: 20097 - protein, 28 aa, Artificial Sequence
  Description of Artificial Sequence: Synthetic peptide
DEEEVRTTNPVATEIYGSVSENLQRGMR

SEQ ID NO: 20098 - protein, 28 aa, Artificial Sequence
  Description of Artificial Sequence: Synthetic peptide
DEEEVRTTNPVATEQYGSVCTNLQPGVR

SEQ ID NO: 20099 - protein, 28 aa, Artificial Sequence
  Description of Artificial Sequence: Synthetic peptide
VEEEIRTVNPVASEQYGSVATNLQRGNR

SEQ ID NO: 20100 - protein, 28 aa, Artificial Sequence
  Description of Artificial Sequence: Synthetic peptide
DEEEIRTTNPVATEQYGGASTNLQAGNM

SEQ ID NO: 20101 - protein, 28 aa, Artificial Sequence
  Description of Artificial Sequence: Synthetic peptide
AEMEIVTTNPVATECYGSVSTNLQRGNR

SEQ ID NO: 20102 - protein, 28 aa, Artificial Sequence
  Description of Artificial Sequence: Synthetic peptide
DEEEIRTTNPVATEQYGSVSTDPQPGER

SEQ ID NO: 20103 - protein, 28 aa, Artificial Sequence
  Description of Artificial Sequence: Synthetic peptide
DEIEIRTTNPVATEQYGVASTNLQHGNR

SEQ ID NO: 20104 - protein, 30 aa, Artificial Sequence
  Description of Artificial Sequence: Synthetic polypeptide
DEEEIRTTNPVATEMYGSVSTANLQRGNPV

SEQ ID NO: 20105 - protein, 28 aa, Artificial Sequence
  Description of Artificial Sequence: Synthetic peptide
DESEIRTTNPVCTELYGSVSTNLQGGNR

SEQ ID NO: 20106 - protein, 29 aa, Artificial Sequence
  Description of Artificial Sequence: Synthetic peptide
DEEEIRTTNPVATECYGSVSTNLERGDMR

SEQ ID NO: 20107 - protein, 28 aa, Artificial Sequence
  Description of Artificial Sequence: Synthetic peptide
DEEEIRTTNPVSTEQYGSVSTQLQHGQR

SEQ ID NO: 20108 - protein, 28 aa, Artificial Sequence
  Description of Artificial Sequence: Synthetic peptide
DEEEIRTTNPVATEQYGSVSTNDDPGNW

SEQ ID NO: 20109 - protein, 28 aa, Artificial Sequence
  Description of Artificial Sequence: Synthetic peptide
DEEVIRTTNPVGTEQYGSVSTMLQRGNM

SEQ ID NO: 20110 - protein, 28 aa, Artificial Sequence
  Description of Artificial Sequence: Synthetic peptide
DEEEIRTTNPVCTEQYGSVSEDEQRGNR

SEQ ID NO: 20111 - protein, 29 aa, Artificial Sequence
  Description of Artificial Sequence: Synthetic peptide
DEEEIRTTNPVATECYGSVSTNLQHEGNV

SEQ ID NO: 20112 - protein, 28 aa, Artificial Sequence
  Description of Artificial Sequence: Synthetic peptide
DEEEIRTTNPVATECYGSVSTELQHGNQ

SEQ ID NO: 20113 - protein, 30 aa, Artificial Sequence
  Description of Artificial Sequence: Synthetic polypeptide
DEQEIRTTNPVATEQYGSVSTNNLQSGINR

SEQ ID NO: 20114 - protein, 28 aa, Artificial Sequence
  Description of Artificial Sequence: Synthetic peptide
DEEEIRTTNPVATEQYGSVSTGLIRGES

SEQ ID NO: 20115 - protein, 28 aa, Artificial Sequence
  Description of Artificial Sequence: Synthetic peptide
DENEIRTTNPVATEQYGSVGTNLMRGNQ

SEQ ID NO: 20116 - protein, 29 aa, Artificial Sequence
  Description of Artificial Sequence: Synthetic peptide
DEEEIRTTNPVATEPYGTVSTELQRGNDR

SEQ ID NO: 20117 - protein, 30 aa, Artificial Sequence
  Description of Artificial Sequence: Synthetic polypeptide
DEEEIRTTNPVCTEQYGSVGTNGLQPRGNR

SEQ ID NO: 20118 - protein, 31 aa, Artificial Sequence
  Description of Artificial Sequence: Synthetic polypeptide
DEEEIRTTNPVATEQYGSVSDTGLQLRGENR

SEQ ID NO: 20119 - protein, 28 aa, Artificial Sequence
  Description of Artificial Sequence: Synthetic peptide
DEEEIRTTNPVATEQYGEVSENEQNGNR

SEQ ID NO: 20120 - protein, 28 aa, Artificial Sequence
  Description of Artificial Sequence: Synthetic peptide
MEQEIRTTNPVATEQYGSVSTDLQRGNM

SEQ ID NO: 20121 - protein, 31 aa, Artificial Sequence
  Description of Artificial Sequence: Synthetic polypeptide
DEEEIATTNPVATEQYGSVSATNLQRGDNDR

SEQ ID NO: 20122 - protein, 29 aa, Artificial Sequence
  Description of Artificial Sequence: Synthetic peptide
DEEEIRTTNPVATEQYGLVGSTPLQRGNC

SEQ ID NO: 20123 - protein, 29 aa, Artificial Sequence
  Description of Artificial Sequence: Synthetic peptide
DEEEIRTTNPVATEQYGDSWSTNDERGNR

SEQ ID NO: 20124 - protein, 28 aa, Artificial Sequence
  Description of Artificial Sequence: Synthetic peptide
DEEEIVTTNPVATEQYGDVSTNLQSGNC

SEQ ID NO: 20125 - protein, 28 aa, Artificial Sequence
  Description of Artificial Sequence: Synthetic peptide
DLEEIRTTNPVATEQFGSVSTNWQRGNF

SEQ ID NO: 20126 - protein, 28 aa, Artificial Sequence
  Description of Artificial Sequence: Synthetic peptide
DEEEIRTTNPVATETFGSVSTNPQFGNR

SEQ ID NO: 20127 - protein, 28 aa, Artificial Sequence
  Description of Artificial Sequence: Synthetic peptide
QEEEIRTTNPVSTEQYGSVSENLQRGNA

SEQ ID NO: 20128 - protein, 29 aa, Artificial Sequence
  Description of Artificial Sequence: Synthetic peptide
DEEEIRTTNPVATEQYGSVSENQQRGFNS

SEQ ID NO: 20129 - protein, 29 aa, Artificial Sequence
  Description of Artificial Sequence: Synthetic peptide
DEEEIRTTNPVCTEQYGSVSTNLQHGNDA

SEQ ID NO: 20130 - protein, 29 aa, Artificial Sequence
  Description of Artificial Sequence: Synthetic peptide
DEEEIRTTNPVATEQYGSVSENLMNRGNW

SEQ ID NO: 20131 - protein, 28 aa, Artificial Sequence
  Description of Artificial Sequence: Synthetic peptide
DENEIRTTNPVATEQYGSVSTDLERGER

SEQ ID NO: 20132 - protein, 28 aa, Artificial Sequence
  Description of Artificial Sequence: Synthetic peptide
DEEEIRTTNPVATELYGSVSTNGQLGNA

SEQ ID NO: 20133 - protein, 30 aa, Artificial Sequence
  Description of Artificial Sequence: Synthetic polypeptide
DEEEIRTTNPVATEQYGSVSTNPLQIQGNH

SEQ ID NO: 20134 - protein, 28 aa, Artificial Sequence
  Description of Artificial Sequence: Synthetic peptide
DEEEIRTTNPVATELYGSVSTNEMQGNR

SEQ ID NO: 20135 - protein, 30 aa, Artificial Sequence
  Description of Artificial Sequence: Synthetic polypeptide
DEEEIRTTNPVATEQYGSVSTGGLQVGENR

SEQ ID NO: 20136 - protein, 28 aa, Artificial Sequence
  Description of Artificial Sequence: Synthetic peptide
DEEEIRTTNPVATEQYGSVSEDLQAGNS

SEQ ID NO: 20137 - protein, 28 aa, Artificial Sequence
  Description of Artificial Sequence: Synthetic peptide
DEEEIRTTNPVATEQYGNVHTDLQRGDR

SEQ ID NO: 20138 - protein, 28 aa, Artificial Sequence
  Description of Artificial Sequence: Synthetic peptide
KEEEIRTTNPVATEQYGSVSTNPQREER

SEQ ID NO: 20139 - protein, 28 aa, Artificial Sequence
  Description of Artificial Sequence: Synthetic peptide
DESEIRTTNPVATEQYGSVSENLQVGNS

SEQ ID NO: 20140 - protein, 28 aa, Artificial Sequence
  Description of Artificial Sequence: Synthetic peptide
DEEEIRCTNPVATEQYGSVSTNDQGGDR

SEQ ID NO: 20141 - protein, 28 aa, Artificial Sequence
  Description of Artificial Sequence: Synthetic peptide
DEEEIRTTNPVAMEQYGSVSTNEQRGDP

SEQ ID NO: 20142 - protein, 29 aa, Artificial Sequence
  Description of Artificial Sequence: Synthetic peptide
MEEEIRTTNPVATEQYGSVSTDLQRGNDM

SEQ ID NO: 20143 - protein, 28 aa, Artificial Sequence
  Description of Artificial Sequence: Synthetic peptide
DEEEIRTTNPVATENYGSVSTHLFRENR

SEQ ID NO: 20144 - protein, 28 aa, Artificial Sequence
  Description of Artificial Sequence: Synthetic peptide
DEQEIRTTNPVATEVYGWVATNLQRGNR

SEQ ID NO: 20145 - protein, 29 aa, Artificial Sequence
  Description of Artificial Sequence: Synthetic peptide
DEEEIRTTNPVATEQYGSVSTNLQESGDW

SEQ ID NO: 20146 - protein, 28 aa, Artificial Sequence
  Description of Artificial Sequence: Synthetic peptide
DEEEIRTTNPVATEQYGSVSTDLENGNF

SEQ ID NO: 20147 - protein, 28 aa, Artificial Sequence
  Description of Artificial Sequence: Synthetic peptide
DEEEIRSTNPVATEVYGNVGTNLQRGNR

SEQ ID NO: 20148 - protein, 28 aa, Artificial Sequence
  Description of Artificial Sequence: Synthetic peptide
DEEEIYTTNPVATEQYGSVSTDLQGGNL

SEQ ID NO: 20149 - protein, 31 aa, Artificial Sequence
  Description of Artificial Sequence: Synthetic polypeptide
AEEEIRTTNPVATEQYGSVSTNYLQHRFGNR

SEQ ID NO: 20150 - protein, 28 aa, Artificial Sequence
  Description of Artificial Sequence: Synthetic peptide
DEEEIRTVNPVSTEQYGNVSTNLQRLNR

SEQ ID NO: 20151 - protein, 28 aa, Artificial Sequence
  Description of Artificial Sequence: Synthetic peptide
DEEEIRTTNPVATEQYGSVEDNDQRGNF

SEQ ID NO: 20152 - protein, 29 aa, Artificial Sequence
  Description of Artificial Sequence: Synthetic peptide
DENEIRTTNPVATEQYGDVSTNLQRGLNW

SEQ ID NO: 20153 - protein, 28 aa, Artificial Sequence
  Description of Artificial Sequence: Synthetic peptide
DEEEITTTNPVCTEQYGSVSENLQRGNA

SEQ ID NO: 20154 - protein, 29 aa, Artificial Sequence
  Description of Artificial Sequence: Synthetic peptide
DEEEIRTTNPVATELYGSVSTNEQNRGNW

SEQ ID NO: 20155 - protein, 28 aa, Artificial Sequence
  Description of Artificial Sequence: Synthetic peptide
DEQEIRTTNPVCTEQYGSVSTDLQHGNR

SEQ ID NO: 20156 - protein, 30 aa, Artificial Sequence
  Description of Artificial Sequence: Synthetic polypeptide
DEEEIRCTNPVATEQYGSVSTMNLQHGNDR

SEQ ID NO: 20157 - protein, 31 aa, Artificial Sequence
  Description of Artificial Sequence: Synthetic polypeptide
DEEEIRTTNPVATEQYGSVSTANLQDRGDNV

SEQ ID NO: 20158 - protein, 29 aa, Artificial Sequence
  Description of Artificial Sequence: Synthetic peptide
DEEEIRTTNPVATLQYGSVSTNDQPNGNR

SEQ ID NO: 20159 - protein, 29 aa, Artificial Sequence
  Description of Artificial Sequence: Synthetic peptide
DTEEIRTTNPVATEKYGSVSTNLMRDGNR

SEQ ID NO: 20160 - protein, 29 aa, Artificial Sequence
  Description of Artificial Sequence: Synthetic peptide
DEEEIRTTNPVATEQYGSVSATNLQIGHG

SEQ ID NO: 20161 - protein, 29 aa, Artificial Sequence
  Description of Artificial Sequence: Synthetic peptide
DEQEIRTTNPVATEQYGSVSTNLQLGENF

SEQ ID NO: 20162 - protein, 31 aa, Artificial Sequence
  Description of Artificial Sequence: Synthetic polypeptide
DEEEIRTTNPVATEQYGESVESTDLQRGENR

SEQ ID NO: 20163 - protein, 29 aa, Artificial Sequence
  Description of Artificial Sequence: Synthetic peptide
DEEEIRTTNPVATECYGSVSMNLQERGNL

SEQ ID NO: 20164 - protein, 31 aa, Artificial Sequence
  Description of Artificial Sequence: Synthetic polypeptide
DEEEIRTTNPVATEQYGSVSCTNLQDRGNDN

SEQ ID NO: 20165 - protein, 28 aa, Artificial Sequence
  Description of Artificial Sequence: Synthetic peptide
DEEEIRCTNPVSTEVYGNVSTNLQRGNR

SEQ ID NO: 20166 - protein, 28 aa, Artificial Sequence
  Description of Artificial Sequence: Synthetic peptide
DAEEIRTTNPVATEQYGSVSTGDQRGND

SEQ ID NO: 20167 - protein, 28 aa, Artificial Sequence
  Description of Artificial Sequence: Synthetic peptide
DEQEISTTNPVATEIYGVVSTNLQRGNR

SEQ ID NO: 20168 - protein, 31 aa, Artificial Sequence
  Description of Artificial Sequence: Synthetic polypeptide
DEEEIRTTNPDATEQYGSVSTNNLQMRGNPR

SEQ ID NO: 20169 - protein, 28 aa, Artificial Sequence
  Description of Artificial Sequence: Synthetic peptide
DEEEIRTTNPVATECYGSVSTDLQHGNH

SEQ ID NO: 20170 - protein, 29 aa, Artificial Sequence
  Description of Artificial Sequence: Synthetic peptide
DECEIRTTNPVATEQYGSMVWWNLQRGNR

SEQ ID NO: 20171 - protein, 28 aa, Artificial Sequence
  Description of Artificial Sequence: Synthetic peptide
DEQEIRTTNPVASEIYGSVSTNLERGNR

SEQ ID NO: 20172 - protein, 28 aa, Artificial Sequence
  Description of Artificial Sequence: Synthetic peptide
DEEEIRCTNPVAYEQYGSVSTNLQIGNL

SEQ ID NO: 20173 - protein, 30 aa, Artificial Sequence
  Description of Artificial Sequence: Synthetic polypeptide
DEEEIRTTNPVATEQYGSVSTDLVQQEGNR

SEQ ID NO: 20174 - protein, 29 aa, Artificial Sequence
  Description of Artificial Sequence: Synthetic peptide
DEEEIRTTNPVATEQYGSVSTNEQNIGNM

SEQ ID NO: 20175 - protein, 28 aa, Artificial Sequence
  Description of Artificial Sequence: Synthetic peptide
GEEEIRTTNPVATEQYGSVSTNLEHGNE

SEQ ID NO: 20176 - protein, 28 aa, Artificial Sequence
  Description of Artificial Sequence: Synthetic peptide
DEDETATTNPVGTEQYGSVSTNLQRGNR

SEQ ID NO: 20177 - protein, 28 aa, Artificial Sequence
  Description of Artificial Sequence: Synthetic peptide
DEQEIRTTNPVATEQYGSVSENDERGNR

SEQ ID NO: 20178 - protein, 29 aa, Artificial Sequence
  Description of Artificial Sequence: Synthetic peptide
DEEGIRTTNPVATEQYGSVVSTGFQRGNR

SEQ ID NO: 20179 - protein, 28 aa, Artificial Sequence
  Description of Artificial Sequence: Synthetic peptide
DEEEIRTTNPVATEQYWSWSTNLQREER

SEQ ID NO: 20180 - protein, 28 aa, Artificial Sequence
  Description of Artificial Sequence: Synthetic peptide
DEEEIRTTNPVATEHYGSVSENLQHGNQ

SEQ ID NO: 20181 - protein, 30 aa, Artificial Sequence
  Description of Artificial Sequence: Synthetic polypeptide
DEEEIRTTNPVATEQYGSVSTNLQEIGDNS

SEQ ID NO: 20182 - protein, 28 aa, Artificial Sequence
  Description of Artificial Sequence: Synthetic peptide
MEEEIRSTNPVATEQYGDVSTNLQRGND

SEQ ID NO: 20183 - protein, 29 aa, Artificial Sequence
  Description of Artificial Sequence: Synthetic peptide
DEEEIRTTNPVATEIYGCVSTNLERNGNR

SEQ ID NO: 20184 - protein, 28 aa, Artificial Sequence
  Description of Artificial Sequence: Synthetic peptide
DEEEIRTTNPVATECYGSVSTNLQVGEA

SEQ ID NO: 20185 - protein, 29 aa, Artificial Sequence
  Description of Artificial Sequence: Synthetic peptide
DEEEIRTTNPVATEQYGESWSHNDQRGNR

SEQ ID NO: 20186 - protein, 31 aa, Artificial Sequence
  Description of Artificial Sequence: Synthetic polypeptide
DEEEIRTTNPVATEQYGSVSSTLNLVQDGNR

SEQ ID NO: 20187 - protein, 28 aa, Artificial Sequence
  Description of Artificial Sequence: Synthetic peptide
DDEEIRATNPCATEQYGSVSTNLQRLNR

SEQ ID NO: 20188 - protein, 28 aa, Artificial Sequence
  Description of Artificial Sequence: Synthetic peptide
DEEEIRTTNPVATEQYGVVSTDLQIGNM

SEQ ID NO: 20189 - protein, 28 aa, Artificial Sequence
  Description of Artificial Sequence: Synthetic peptide
DEEEIRTTNPVGTEQYGSVSTELQQGNS

SEQ ID NO: 20190 - protein, 28 aa, Artificial Sequence
  Description of Artificial Sequence: Synthetic peptide
DEEEIRTTNPVATEQYGSVSTELQQGEF

SEQ ID NO: 20191 - protein, 28 aa, Artificial Sequence
  Description of Artificial Sequence: Synthetic peptide
DEEEIRTTNPVATEQYGSVSTDLQHGEE

SEQ ID NO: 20192 - protein, 31 aa, Artificial Sequence
  Description of Artificial Sequence: Synthetic polypeptide
DEEEIRTTNPVATEQYGSVSTELQRDGENER

SEQ ID NO: 20193 - protein, 30 aa, Artificial Sequence
  Description of Artificial Sequence: Synthetic polypeptide
DEEEIRTTNPVATEQYGSVSETGNLQYGDR

SEQ ID NO: 20194 - protein, 28 aa, Artificial Sequence
  Description of Artificial Sequence: Synthetic peptide
QEEEIVTTNPVATEQYGSVSTNLQTGNV

SEQ ID NO: 20195 - protein, 28 aa, Artificial Sequence
  Description of Artificial Sequence: Synthetic peptide
DEEEIRTTNPVATEQYGSVSTPLQREEE

SEQ ID NO: 20196 - protein, 28 aa, Artificial Sequence
  Description of Artificial Sequence: Synthetic peptide
DEEEIRTTNPVATEQYGDVSENLQQGNF

SEQ ID NO: 20197 - protein, 30 aa, Artificial Sequence
  Description of Artificial Sequence: Synthetic polypeptide
DEEEIRTTNPVATEMYGSVSTNLQRGDDTR

SEQ ID NO: 20198 - protein, 28 aa, Artificial Sequence
  Description of Artificial Sequence: Synthetic peptide
SEEELRCTNPVATEQYGSVSTNLQRGGR

SEQ ID NO: 20199 - protein, 28 aa, Artificial Sequence
  Description of Artificial Sequence: Synthetic peptide
DEEEIRATNPVATEQYGGVSENLQRGNG

SEQ ID NO: 20200 - protein, 32 aa, Artificial Sequence
  Description of Artificial Sequence: Synthetic polypeptide
DEEEIRTTNPVATEQYGSVSDTGNLQIRGDNR

SEQ ID NO: 20201 - protein, 28 aa, Artificial Sequence
  Description of Artificial Sequence: Synthetic peptide
DENEIRTTNPVATEQYGIVSTNLQTGNQ

SEQ ID NO: 20202 - protein, 29 aa, Artificial Sequence
  Description of Artificial Sequence: Synthetic peptide
DEEEIRTVNPVATEQYGVVSTNLQRGDDR

SEQ ID NO: 20203 - protein, 28 aa, Artificial Sequence
  Description of Artificial Sequence: Synthetic peptide
DEEEIRTTNPVATEQYGSVSTDEQMGNA

SEQ ID NO: 20204 - protein, 28 aa, Artificial Sequence
  Description of Artificial Sequence: Synthetic peptide
DENEIATTNPVATEQYGSVPTNLQRENR

SEQ ID NO: 20205 - protein, 28 aa, Artificial Sequence
  Description of Artificial Sequence: Synthetic peptide
DEEEIRTTNPVATEQYGIVSTNLMLGDR

SEQ ID NO: 20206 - protein, 28 aa, Artificial Sequence
  Description of Artificial Sequence: Synthetic peptide
DEEELRTTNPVATEGYGSVSTLLQHGNR

SEQ ID NO: 20207 - protein, 28 aa, Artificial Sequence
  Description of Artificial Sequence: Synthetic peptide
QEEEIRTVNPVATEQYGSASENLQRGNR

SEQ ID NO: 20208 - protein, 31 aa, Artificial Sequence
  Description of Artificial Sequence: Synthetic polypeptide
DEEEIRTTNPVATEQYGSVSTNLEEREGNDR

SEQ ID NO: 20209 - protein, 28 aa, Artificial Sequence
  Description of Artificial Sequence: Synthetic peptide
DEEEIRTTNPVATETYGSVSTNWQLGNH

SEQ ID NO: 20210 - protein, 28 aa, Artificial Sequence
  Description of Artificial Sequence: Synthetic peptide
DENEIRTTNPVATEQYGSVSTNLERGTL

SEQ ID NO: 20211 - protein, 29 aa, Artificial Sequence
  Description of Artificial Sequence: Synthetic peptide
DEEEIRTTNPTATEQYGSVISTNLQIGNQ

SEQ ID NO: 20212 - protein, 28 aa, Artificial Sequence
  Description of Artificial Sequence: Synthetic peptide
VEEEIRTTNPVATEQYGVVATNLQRPNR

SEQ ID NO: 20213 - protein, 28 aa, Artificial Sequence
  Description of Artificial Sequence: Synthetic peptide
DEEEIVTTNPVATEQYGSVSTPLQRGEG

SEQ ID NO: 20214 - protein, 28 aa, Artificial Sequence
  Description of Artificial Sequence: Synthetic peptide
DEEEIRTTNPTATEQYGSVSTNEQVGNY

SEQ ID NO: 20215 - protein, 28 aa, Artificial Sequence
  Description of Artificial Sequence: Synthetic peptide
DEEEITCTNPVATEMYGIVSTNLQRGNR

SEQ ID NO: 20216 - protein, 28 aa, Artificial Sequence
  Description of Artificial Sequence: Synthetic peptide
MENEIRTTNPVATEQYGSVSTNLQNGNM

SEQ ID NO: 20217 - protein, 29 aa, Artificial Sequence
  Description of Artificial Sequence: Synthetic peptide
DEEEIRTTNPVATEQYGSVSTELQIKGNL

SEQ ID NO: 20218 - protein, 28 aa, Artificial Sequence
  Description of Artificial Sequence: Synthetic peptide
DENEIRTTNPVATEQWGSVSTNLQVGNL

SEQ ID NO: 20219 - protein, 28 aa, Artificial Sequence
  Description of Artificial Sequence: Synthetic peptide
MEQEIRTTNPVATEQYGSVSTDLQNGNR

SEQ ID NO: 20220 - protein, 28 aa, Artificial Sequence
  Description of Artificial Sequence: Synthetic peptide
DEEEVRTTNPVSTEHYGSVSTNLERGNR

SEQ ID NO: 20221 - protein, 28 aa, Artificial Sequence
  Description of Artificial Sequence: Synthetic peptide
DENEIRTTNPVATEQWGSVSTNLMQGNR

SEQ ID NO: 20222 - protein, 28 aa, Artificial Sequence
  Description of Artificial Sequence: Synthetic peptide
DEEEIRAVNPVATEQYGSVSTNLQQGDR

SEQ ID NO: 20223 - protein, 28 aa, Artificial Sequence
  Description of Artificial Sequence: Synthetic peptide
DENEITTTNPVATEQYGSASTNLQRGGR

SEQ ID NO: 20224 - protein, 29 aa, Artificial Sequence
  Description of Artificial Sequence: Synthetic peptide
DEEEIRTTNPVATEQYGSVSDTELQLGNV

SEQ ID NO: 20225 - protein, 28 aa, Artificial Sequence
  Description of Artificial Sequence: Synthetic peptide
AEEEIRTTNPVATEQYGSVSTDQQVGNR

SEQ ID NO: 20226 - protein, 28 aa, Artificial Sequence
  Description of Artificial Sequence: Synthetic peptide
AENEIRTTNPVSTEQYGSVSTNLQRGNW

SEQ ID NO: 20227 - protein, 30 aa, Artificial Sequence
  Description of Artificial Sequence: Synthetic polypeptide
DEVEIRTTNPVATEQYGSVSCTELQRGNDR

SEQ ID NO: 20228 - protein, 28 aa, Artificial Sequence
  Description of Artificial Sequence: Synthetic peptide
DEEEIRTTNPVATELWGSVSTNEQRGNA

SEQ ID NO: 20229 - protein, 28 aa, Artificial Sequence
  Description of Artificial Sequence: Synthetic peptide
DEEEIRTTNPVATEQGGSVSTNLQHGAQ

SEQ ID NO: 20230 - protein, 30 aa, Artificial Sequence
  Description of Artificial Sequence: Synthetic polypeptide
HEEEIRTTNPVATEQYGSVSTDLQDRKGNR

SEQ ID NO: 20231 - protein, 30 aa, Artificial Sequence
  Description of Artificial Sequence: Synthetic polypeptide
DEECIRTTNPVATAQYGSVSTMNGLQRGNR

SEQ ID NO: 20232 - protein, 29 aa, Artificial Sequence
  Description of Artificial Sequence: Synthetic peptide
DEEEIRTTNPVATEQYGCVGANNLQRGNR

SEQ ID NO: 20233 - protein, 31 aa, Artificial Sequence
  Description of Artificial Sequence: Synthetic polypeptide
DEEEIRTTNPVATEQYGSMTSHTMNLQRGNR

SEQ ID NO: 20234 - protein, 28 aa, Artificial Sequence
  Description of Artificial Sequence: Synthetic peptide
DEEEIRTCNPVATEQYGEVATNLQFGNR

SEQ ID NO: 20235 - protein, 28 aa, Artificial Sequence
  Description of Artificial Sequence: Synthetic peptide
DEQEVRTTNPVATEQYGSVATNLERGNR

SEQ ID NO: 20236 - protein, 28 aa, Artificial Sequence
  Description of Artificial Sequence: Synthetic peptide
DEEEIATTNPVATEQYGDVSEDLQRGNR

SEQ ID NO: 20237 - protein, 28 aa, Artificial Sequence
  Description of Artificial Sequence: Synthetic peptide
DEDEIVTTNPVATEQYGSVSTEWQRGNR

SEQ ID NO: 20238 - protein, 28 aa, Artificial Sequence
  Description of Artificial Sequence: Synthetic peptide
DEEEIRTTNTCATEQYGSVSTELQDGNR

SEQ ID NO: 20239 - protein, 29 aa, Artificial Sequence
  Description of Artificial Sequence: Synthetic peptide
MEEEIRTTNPVATEQYGSVSTNLQSEGNM

SEQ ID NO: 20240 - protein, 30 aa, Artificial Sequence
  Description of Artificial Sequence: Synthetic polypeptide
DEQEIRTTNPVATEQYGSVSTNPLQREGNF

SEQ ID NO: 20241 - protein, 28 aa, Artificial Sequence
  Description of Artificial Sequence: Synthetic peptide
MENEIRTTNPVATEQYGSVSTNLQIGNS

SEQ ID NO: 20242 - protein, 30 aa, Artificial Sequence
  Description of Artificial Sequence: Synthetic polypeptide
DEEEIRTTNPEATEQYGSVSETENLERGNR

SEQ ID NO: 20243 - protein, 28 aa, Artificial Sequence
  Description of Artificial Sequence: Synthetic peptide
DEQEIRTTNPVATEIYGSVATNLQRGND

SEQ ID NO: 20244 - protein, 28 aa, Artificial Sequence
  Description of Artificial Sequence: Synthetic peptide
DEEEIRTTNPVATEQYGSVSEDLQGGNF

SEQ ID NO: 20245 - protein, 30 aa, Artificial Sequence
  Description of Artificial Sequence: Synthetic polypeptide
DEEEIRTTNPVATEQYGSVSTVDLQPMGNR

SEQ ID NO: 20246 - protein, 28 aa, Artificial Sequence
  Description of Artificial Sequence: Synthetic peptide
DEEEIRTTNPVSSEGYGSVSTNLQRGPR

SEQ ID NO: 20247 - protein, 30 aa, Artificial Sequence
  Description of Artificial Sequence: Synthetic polypeptide
DEEEIRTTNPVATEQYGSVSTANEQRGNTQ

SEQ ID NO: 20248 - protein, 29 aa, Artificial Sequence
  Description of Artificial Sequence: Synthetic peptide
DEEEIATTNPVATEQYGSVSTDLQHGNDR

SEQ ID NO: 20249 - protein, 28 aa, Artificial Sequence
  Description of Artificial Sequence: Synthetic peptide
DEEEIRTTNPVATEQYGSVSTALNGGNF

SEQ ID NO: 20250 - protein, 29 aa, Artificial Sequence
  Description of Artificial Sequence: Synthetic peptide
MEEEIRTTNPVATEQYGSVSTNLQNGEDR

SEQ ID NO: 20251 - protein, 29 aa, Artificial Sequence
  Description of Artificial Sequence: Synthetic peptide
DEEEIATTNPVATEQYGSVSTGNLAIGNR

SEQ ID NO: 20252 - protein, 28 aa, Artificial Sequence
  Description of Artificial Sequence: Synthetic peptide
DEEEIATTNPVATEQYGWVSTNLQNLNR

SEQ ID NO: 20253 - protein, 28 aa, Artificial Sequence
  Description of Artificial Sequence: Synthetic peptide
NEEEIRTTNPVAFEQYGSVFTGLQRGNR

SEQ ID NO: 20254 - protein, 28 aa, Artificial Sequence
  Description of Artificial Sequence: Synthetic peptide
DEEEITTTNPVATEVYGSVSTNDQQGNR

SEQ ID NO: 20255 - protein, 28 aa, Artificial Sequence
  Description of Artificial Sequence: Synthetic peptide
DEEEIRTVNPVATEQYGSVCDNLQRGQR

SEQ ID NO: 20256 - protein, 28 aa, Artificial Sequence
  Description of Artificial Sequence: Synthetic peptide
GEEEIATTNPVATEIYGSVSTVLQRGNR

SEQ ID NO: 20257 - protein, 29 aa, Artificial Sequence
  Description of Artificial Sequence: Synthetic peptide
DESEIRTTNPVATEIYGSVSNNLQREGNR

SEQ ID NO: 20258 - protein, 28 aa, Artificial Sequence
  Description of Artificial Sequence: Synthetic peptide
DEEEIRTTNPVATEQYGDVSTNLCHGNA

SEQ ID NO: 20259 - protein, 28 aa, Artificial Sequence
  Description of Artificial Sequence: Synthetic peptide
DEEEIRTTNPVATEQYGSASENEQRGNI

SEQ ID NO: 20260 - protein, 28 aa, Artificial Sequence
  Description of Artificial Sequence: Synthetic peptide
DEEEIRTTNPVATEQYGSVSENEMQGNR

SEQ ID NO: 20261 - protein, 28 aa, Artificial Sequence
  Description of Artificial Sequence: Synthetic peptide
DEEEIRTTNPVATEQYGSVSTELQFGDH

SEQ ID NO: 20262 - protein, 31 aa, Artificial Sequence
  Description of Artificial Sequence: Synthetic polypeptide
DEEEIRTTNPVATEQYGSVSTTNLQLRGEND

SEQ ID NO: 20263 - protein, 31 aa, Artificial Sequence
  Description of Artificial Sequence: Synthetic polypeptide
DEEEIRTTNPVATEQYGAVASTMNLQRGNQR

SEQ ID NO: 20264 - protein, 28 aa, Artificial Sequence
  Description of Artificial Sequence: Synthetic peptide
DEEEIRTTNPVATEQYGSVSTPDQRGEY

SEQ ID NO: 20265 - protein, 31 aa, Artificial Sequence
  Description of Artificial Sequence: Synthetic polypeptide
DEEEIRTTNPVATEQYGSVSATNLQDRNGNM

SEQ ID NO: 20266 - protein, 28 aa, Artificial Sequence
  Description of Artificial Sequence: Synthetic peptide
DEEEIAQTNPVATECYGSVSTNLQRGER

SEQ ID NO: 20267 - protein, 29 aa, Artificial Sequence
  Description of Artificial Sequence: Synthetic peptide
DEEEIRTTNPVATEQYGSVSTNPQREEDR

SEQ ID NO: 20268 - protein, 28 aa, Artificial Sequence
  Description of Artificial Sequence: Synthetic peptide
DENEIATTNPVATEQYGSVSTNLQRGED

SEQ ID NO: 20269 - protein, 31 aa, Artificial Sequence
  Description of Artificial Sequence: Synthetic polypeptide
DEEEIRTTNPVATEQYGSVASTNVLQRHDNR

SEQ ID NO: 20270 - protein, 28 aa, Artificial Sequence
  Description of Artificial Sequence: Synthetic peptide
DEEEVRTTNPVSTEQWGSVSTNLQRGIR

SEQ ID NO: 20271 - protein, 28 aa, Artificial Sequence
  Description of Artificial Sequence: Synthetic peptide
DEEEIETTNPVATEQYGSVATNIQRGGR

SEQ ID NO: 20272 - protein, 28 aa, Artificial Sequence
  Description of Artificial Sequence: Synthetic peptide
DEEEIRTVNPVATEAYGSVSTNLQHGPR

SEQ ID NO: 20273 - protein, 28 aa, Artificial Sequence
  Description of Artificial Sequence: Synthetic peptide
DEEEIRATNPVATEQYGVVSTALQAGNR

SEQ ID NO: 20274 - protein, 28 aa, Artificial Sequence
  Description of Artificial Sequence: Synthetic peptide
DEEEIRTTNPVATETYGSVSTNWQLGNF

SEQ ID NO: 20275 - protein, 29 aa, Artificial Sequence
  Description of Artificial Sequence: Synthetic peptide
DEEEIRTTNPVATEQYGSVSDVLQHAGNR

SEQ ID NO: 20276 - protein, 29 aa, Artificial Sequence
  Description of Artificial Sequence: Synthetic peptide
DEEEIRTTNPVATEQYGSVSTPLQGEGER

SEQ ID NO: 20277 - protein, 28 aa, Artificial Sequence
  Description of Artificial Sequence: Synthetic peptide
DDGEIRTTNPVASEHYGSVSTNLQRGNR

SEQ ID NO: 20278 - protein, 30 aa, Artificial Sequence
  Description of Artificial Sequence: Synthetic polypeptide
DEEEIRTTNPVATEQYGSVSTNLVQVNGNQ

SEQ ID NO: 20279 - protein, 28 aa, Artificial Sequence
  Description of Artificial Sequence: Synthetic peptide
DEEEIRTTNPCATEQYGSVDNNLERGNR

SEQ ID NO: 20280 - protein, 29 aa, Artificial Sequence
  Description of Artificial Sequence: Synthetic peptide
DEEEIRTTNPVSTEQYGDVSENLQRAGNR

SEQ ID NO: 20281 - protein, 28 aa, Artificial Sequence
  Description of Artificial Sequence: Synthetic peptide
KENEIRTTNPVATECYGSVSTNLQRGNY

SEQ ID NO: 20282 - protein, 29 aa, Artificial Sequence
  Description of Artificial Sequence: Synthetic peptide
DEEEIRTTNPVATEQYGSVFENLQTKGNR

SEQ ID NO: 20283 - protein, 28 aa, Artificial Sequence
  Description of Artificial Sequence: Synthetic peptide
DEEEIRTTNPVATEQYGSVSTDLQQGEM

SEQ ID NO: 20284 - protein, 28 aa, Artificial Sequence
  Description of Artificial Sequence: Synthetic peptide
DEEEIRTTNPVATEQFGSVSVNGQRGNP

SEQ ID NO: 20285 - protein, 28 aa, Artificial Sequence
  Description of Artificial Sequence: Synthetic peptide
DEEEIATTNPTATEQYGSVSTNLQNGNF

SEQ ID NO: 20286 - protein, 28 aa, Artificial Sequence
  Description of Artificial Sequence: Synthetic peptide
DEEEIRTTNPVATEQYWSVETNLQRGEP

SEQ ID NO: 20287 - protein, 30 aa, Artificial Sequence
  Description of Artificial Sequence: Synthetic polypeptide
DEEEIRTTNPVATEQYGSVSTMNEQDRGNF

SEQ ID NO: 20288 - protein, 28 aa, Artificial Sequence
  Description of Artificial Sequence: Synthetic peptide
AEEEIRTTNPFATEQYGDVSTNLQRGND

SEQ ID NO: 20289 - protein, 28 aa, Artificial Sequence
  Description of Artificial Sequence: Synthetic peptide
DEEEVRTTNPVASEQYGSVSTNLQRLNE

SEQ ID NO: 20290 - protein, 29 aa, Artificial Sequence
  Description of Artificial Sequence: Synthetic peptide
DEEEIRTTNPVATEQYGVVSTNWQRGDFR

SEQ ID NO: 20291 - protein, 28 aa, Artificial Sequence
  Description of Artificial Sequence: Synthetic peptide
QEEEIVTTNPVATEQYGSVSTNLQQGND

SEQ ID NO: 20292 - protein, 28 aa, Artificial Sequence
  Description of Artificial Sequence: Synthetic peptide
DEVEIRTTNPVATEIYGSVSTNLQRGDF

SEQ ID NO: 20293 - protein, 28 aa, Artificial Sequence
  Description of Artificial Sequence: Synthetic peptide
DENEIRTTNPVATEQYGSVSTNEMRLNR

SEQ ID NO: 20294 - protein, 30 aa, Artificial Sequence
  Description of Artificial Sequence: Synthetic polypeptide
MEQEIRTTNPVATEQYGSVSTNLQEREGNR

SEQ ID NO: 20295 - protein, 28 aa, Artificial Sequence
  Description of Artificial Sequence: Synthetic peptide
DEEEIRSVNPVATEQYGCVATNLQRGNR

SEQ ID NO: 20296 - protein, 28 aa, Artificial Sequence
  Description of Artificial Sequence: Synthetic peptide
DEEEIRTTNPVATEQYGSVDTELQVGNV

SEQ ID NO: 20297 - protein, 28 aa, Artificial Sequence
  Description of Artificial Sequence: Synthetic peptide
DEEEIRTTNPVATEQYGSVSTNEMQGNA

SEQ ID NO: 20298 - protein, 28 aa, Artificial Sequence
  Description of Artificial Sequence: Synthetic peptide
DEEEIRTTNPVATECYGSVSENEQRGNF

SEQ ID NO: 20299 - protein, 28 aa, Artificial Sequence
  Description of Artificial Sequence: Synthetic peptide
DEEEIATTNPTATEQYGSVSTNEQNGNR

SEQ ID NO: 20300 - protein, 28 aa, Artificial Sequence
  Description of Artificial Sequence: Synthetic peptide
DEEEIRSTNPVATECYGSVSTNLQVGNA

SEQ ID NO: 20301 - protein, 28 aa, Artificial Sequence
  Description of Artificial Sequence: Synthetic peptide
DEEEIATTNPTATEQYGSVSTNEQRGNI

SEQ ID NO: 20302 - protein, 30 aa, Artificial Sequence
  Description of Artificial Sequence: Synthetic polypeptide
DEEEIRTTNPVATEQYGSTSTNLQMREGER

SEQ ID NO: 20303 - protein, 30 aa, Artificial Sequence
  Description of Artificial Sequence: Synthetic polypeptide
DENEIRTTNPVATEQYGSVSTEPLQRGNER

SEQ ID NO: 20304 - protein, 28 aa, Artificial Sequence
  Description of Artificial Sequence: Synthetic peptide
DEEEIRTTNPVATEQYGSVSHNDQRGLD

SEQ ID NO: 20305 - protein, 28 aa, Artificial Sequence
  Description of Artificial Sequence: Synthetic peptide
DEEEIRTVNPDATEQYGSVSTDLQNGNR

SEQ ID NO: 20306 - protein, 30 aa, Artificial Sequence
  Description of Artificial Sequence: Synthetic polypeptide
DEEEIRTTNPVATEQYGSVSTCNLQELGNL

SEQ ID NO: 20307 - protein, 28 aa, Artificial Sequence
  Description of Artificial Sequence: Synthetic peptide
DEEEIRTTNPTATEQYGSVSTNEQQGNF

SEQ ID NO: 20308 - protein, 28 aa, Artificial Sequence
  Description of Artificial Sequence: Synthetic peptide
DEEEICCTNPVCTEQYGSVSTNLQQGNR

SEQ ID NO: 20309 - protein, 29 aa, Artificial Sequence
  Description of Artificial Sequence: Synthetic peptide
DEQEIRTTNPVATEQYGSVSTNLQMIGNA

SEQ ID NO: 20310 - protein, 28 aa, Artificial Sequence
  Description of Artificial Sequence: Synthetic peptide
DEEEIRTTNPDATEQYGSVSTCDDRGNR

SEQ ID NO: 20311 - protein, 28 aa, Artificial Sequence
  Description of Artificial Sequence: Synthetic peptide
DEEEIRTTNPAATECYGSVSTNLQFGNN

SEQ ID NO: 20312 - protein, 28 aa, Artificial Sequence
  Description of Artificial Sequence: Synthetic peptide
DEEEIRTTNPVATEQYGSVSTNEETGTR

SEQ ID NO: 20313 - protein, 29 aa, Artificial Sequence
  Description of Artificial Sequence: Synthetic peptide
DEEEIRTTNPVATEQYGSVSTNLQNAGTV

SEQ ID NO: 20314 - protein, 28 aa, Artificial Sequence
  Description of Artificial Sequence: Synthetic peptide
DEEEVRTTNPVATELYGTVATNLQRGNR

SEQ ID NO: 20315 - protein, 28 aa, Artificial Sequence
  Description of Artificial Sequence: Synthetic peptide
DDEEIRTTNPVATEQWGSVSTDLMRGNR

SEQ ID NO: 20316 - protein, 28 aa, Artificial Sequence
  Description of Artificial Sequence: Synthetic peptide
DEQEIATTNPVATEIYGNVSTNLQRGNR

SEQ ID NO: 20317 - protein, 28 aa, Artificial Sequence
  Description of Artificial Sequence: Synthetic peptide
KEQEIRTTNPVATEQYGSVSTNLQSGNS

SEQ ID NO: 20318 - protein, 28 aa, Artificial Sequence
  Description of Artificial Sequence: Synthetic peptide
AEEEIRTTNPVATEQYGDTSTNLQRGTR

SEQ ID NO: 20319 - protein, 31 aa, Artificial Sequence
  Description of Artificial Sequence: Synthetic polypeptide
DEEEIRTTNPVATEQYGSVSETENLQIRGNN

SEQ ID NO: 20320 - protein, 30 aa, Artificial Sequence
  Description of Artificial Sequence: Synthetic polypeptide
DEEEIRTTNPVATEQYGSVSTAGWLQRGTR

SEQ ID NO: 20321 - protein, 31 aa, Artificial Sequence
  Description of Artificial Sequence: Synthetic polypeptide
DEEEIRTTNPVATEQYGSVSTNPDQRGVNPR

SEQ ID NO: 20322 - protein, 28 aa, Artificial Sequence
  Description of Artificial Sequence: Synthetic peptide
DEEEITTTNPVATEQYGSVSENLQRMNI

SEQ ID NO: 20323 - protein, 28 aa, Artificial Sequence
  Description of Artificial Sequence: Synthetic peptide
DEEEIRTTNPTATEQYGSVSTNEQNGNF

SEQ ID NO: 20324 - protein, 28 aa, Artificial Sequence
  Description of Artificial Sequence: Synthetic peptide
DEEEIRTTNPVATEQYGSVSTELCYGNH

SEQ ID NO: 20325 - protein, 28 aa, Artificial Sequence
  Description of Artificial Sequence: Synthetic peptide
SEEEIRTTNPEATEQYGSVSTCLERGNR

SEQ ID NO: 20326 - protein, 29 aa, Artificial Sequence
  Description of Artificial Sequence: Synthetic peptide
DENEIRTTNPVATEQWGSVSTNLMNRGNR

SEQ ID NO: 20327 - protein, 30 aa, Artificial Sequence
  Description of Artificial Sequence: Synthetic polypeptide
SEEEIRTTNPVATEQYGSVSTANPQREGNR

SEQ ID NO: 20328 - protein, 28 aa, Artificial Sequence
  Description of Artificial Sequence: Synthetic peptide
DEEEITSTNPVATEQYGSVSTNLQGGNN

SEQ ID NO: 20329 - protein, 30 aa, Artificial Sequence
  Description of Artificial Sequence: Synthetic polypeptide
DEEEIRTTNPVATEQYGSVSTNLQRENNNE

SEQ ID NO: 20330 - protein, 28 aa, Artificial Sequence
  Description of Artificial Sequence: Synthetic peptide
DEEEIRTTNPVATEQYGSVASALERGNR

SEQ ID NO: 20331 - protein, 28 aa, Artificial Sequence
  Description of Artificial Sequence: Synthetic peptide
DEEEIRTTNPVCTEQYGSVSTEDQRGNA

SEQ ID NO: 20332 - protein, 29 aa, Artificial Sequence
  Description of Artificial Sequence: Synthetic peptide
DENEIRTTNPVATEQYGSVSTNLQDPGER

SEQ ID NO: 20333 - protein, 28 aa, Artificial Sequence
  Description of Artificial Sequence: Synthetic peptide
DEDEIVTTNPVATEVYGSVATNLQRGNR

SEQ ID NO: 20334 - protein, 31 aa, Artificial Sequence
  Description of Artificial Sequence: Synthetic polypeptide
DEEEIRTTNPVATEQYGSVSTNLQDREGNDF

SEQ ID NO: 20335 - protein, 28 aa, Artificial Sequence
  Description of Artificial Sequence: Synthetic peptide
DEEEITTTNPVATEVYGSVSTNLQRGTN

SEQ ID NO: 20336 - protein, 29 aa, Artificial Sequence
  Description of Artificial Sequence: Synthetic peptide
DEEEIRTTNPFATEAYGSVSLTNLQRGQR

SEQ ID NO: 20337 - protein, 28 aa, Artificial Sequence
  Description of Artificial Sequence: Synthetic peptide
DEEEIRTTNPVATEMYGCVSTNWQRGTR

SEQ ID NO: 20338 - protein, 30 aa, Artificial Sequence
  Description of Artificial Sequence: Synthetic polypeptide
DEEEIRTTNPEATEQYGSVSTELQERGNDR

SEQ ID NO: 20339 - protein, 28 aa, Artificial Sequence
  Description of Artificial Sequence: Synthetic peptide
SEEEIRTTNPVATEQFGSVSTNEQRGNG

SEQ ID NO: 20340 - protein, 28 aa, Artificial Sequence
  Description of Artificial Sequence: Synthetic peptide
HEEEIRSTNPVATEQYGSVSTNLERGNI

SEQ ID NO: 20341 - protein, 30 aa, Artificial Sequence
  Description of Artificial Sequence: Synthetic polypeptide
DEEEIRTTNPVATEQYGSVSTNPQEIGNTR

SEQ ID NO: 20342 - protein, 28 aa, Artificial Sequence
  Description of Artificial Sequence: Synthetic peptide
DEEEIRTTNPVAYEIYGGVATNLQRGNR

SEQ ID NO: 20343 - protein, 28 aa, Artificial Sequence
  Description of Artificial Sequence: Synthetic peptide
MENEIRTTNPVATEQYGSVSTNLQRGDY

SEQ ID NO: 20344 - protein, 30 aa, Artificial Sequence
  Description of Artificial Sequence: Synthetic polypeptide
DEQEIRTTNPVATEQYGSVDSTNGDQRGNR

SEQ ID NO: 20345 - protein, 28 aa, Artificial Sequence
  Description of Artificial Sequence: Synthetic peptide
DEEEIRTTNPVATCQYGDVSTGLQEGNR

SEQ ID NO: 20346 - protein, 30 aa, Artificial Sequence
  Description of Artificial Sequence: Synthetic polypeptide
DENEIRTTNPVATEQYGSVSATENLQRGPR

SEQ ID NO: 20347 - protein, 28 aa, Artificial Sequence
  Description of Artificial Sequence: Synthetic peptide
DENEIRTTNPVATELYGSVSENLMRGNR

SEQ ID NO: 20348 - protein, 30 aa, Artificial Sequence
  Description of Artificial Sequence: Synthetic polypeptide
DEEEIRTTNPVATEQYGSVSTNLVQVDGNQ

SEQ ID NO: 20349 - protein, 28 aa, Artificial Sequence
  Description of Artificial Sequence: Synthetic peptide
GEEEIRTVNPVATEMYGSVSTNLQRGDR

SEQ ID NO: 20350 - protein, 28 aa, Artificial Sequence
  Description of Artificial Sequence: Synthetic peptide
DEEEIRQTNPVATEMYGSASTNLQRPNR

SEQ ID NO: 20351 - protein, 28 aa, Artificial Sequence
  Description of Artificial Sequence: Synthetic peptide
DEEEIRPTNPVATDQYGSVSTNDQRGHR

SEQ ID NO: 20352 - protein, 28 aa, Artificial Sequence
  Description of Artificial Sequence: Synthetic peptide
DEEEIRTTNPVATEQYGSVSTGLEIGND

SEQ ID NO: 20353 - protein, 30 aa, Artificial Sequence
  Description of Artificial Sequence: Synthetic polypeptide
DEEEIRTTNPVATEQYGCSVDTGLQERGNR

SEQ ID NO: 20354 - protein, 28 aa, Artificial Sequence
  Description of Artificial Sequence: Synthetic peptide
DEEEIRTTNPVATEQYGSVSTDQERGER

SEQ ID NO: 20355 - protein, 29 aa, Artificial Sequence
  Description of Artificial Sequence: Synthetic peptide
DEEEIRTTNPVASEIYGSVSSNLQFRGNR

SEQ ID NO: 20356 - protein, 28 aa, Artificial Sequence
  Description of Artificial Sequence: Synthetic peptide
DEQEIRTTNPVATEQYGSVSDCLQRDNR

SEQ ID NO: 20357 - protein, 28 aa, Artificial Sequence
  Description of Artificial Sequence: Synthetic peptide
DEEEIRTTNPVATECYGSVDTNLQIGNM

SEQ ID NO: 20358 - protein, 28 aa, Artificial Sequence
  Description of Artificial Sequence: Synthetic peptide
DEEEIATTNPVATEQYGSVSTNLEHGER

SEQ ID NO: 20359 - protein, 29 aa, Artificial Sequence
  Description of Artificial Sequence: Synthetic peptide
DEEEIRTTNPVATEQYGSVSETNDQIGER

SEQ ID NO: 20360 - protein, 29 aa, Artificial Sequence
  Description of Artificial Sequence: Synthetic peptide
DEQEIRTVNPVATEVYGSVSATNLQRGNR

SEQ ID NO: 20361 - protein, 28 aa, Artificial Sequence
  Description of Artificial Sequence: Synthetic peptide
QEEEIRTTNPVATEQYGSVSTELQSGNQ

SEQ ID NO: 20362 - protein, 28 aa, Artificial Sequence
  Description of Artificial Sequence: Synthetic peptide
DEEEIRTTNPCATEQYGSVSENLQRGEV

SEQ ID NO: 20363 - protein, 28 aa, Artificial Sequence
  Description of Artificial Sequence: Synthetic peptide
NEEEIRTTNPVCTEQYGSVHTNLQDGNR

SEQ ID NO: 20364 - protein, 29 aa, Artificial Sequence
  Description of Artificial Sequence: Synthetic peptide
DENEIRTTNPVATEQYGSVSTDLQNGNDR

SEQ ID NO: 20365 - protein, 29 aa, Artificial Sequence
  Description of Artificial Sequence: Synthetic peptide
DEEEIRTTNPVATEQYGSVSTNPQLGNTQ

SEQ ID NO: 20366 - protein, 28 aa, Artificial Sequence
  Description of Artificial Sequence: Synthetic peptide
DEEEIRTTNPVATEQYGSVSTNDQIGEI

SEQ ID NO: 20367 - protein, 28 aa, Artificial Sequence
  Description of Artificial Sequence: Synthetic peptide
VEDEIWTTNPVATEQYGSVSTNLQRGLR

SEQ ID NO: 20368 - protein, 28 aa, Artificial Sequence
  Description of Artificial Sequence: Synthetic peptide
DEQEIRPTNPVATEIYGCVSTNLQRGNR

SEQ ID NO: 20369 - protein, 28 aa, Artificial Sequence
  Description of Artificial Sequence: Synthetic peptide
DENEIATTNPVATEQYGDVSTNDQRGNR

SEQ ID NO: 20370 - protein, 30 aa, Artificial Sequence
  Description of Artificial Sequence: Synthetic polypeptide
DEEEIRTTNPVATEQYGSVSTEPLQIRGNI

SEQ ID NO: 20371 - protein, 28 aa, Artificial Sequence
  Description of Artificial Sequence: Synthetic peptide
DEEEIVTTNPVATEQYGSVSTDLQYGNV

SEQ ID NO: 20372 - protein, 28 aa, Artificial Sequence
  Description of Artificial Sequence: Synthetic peptide
DEEEIRTTNPVATEQYGSVSTNDQMGEV

SEQ ID NO: 20373 - protein, 28 aa, Artificial Sequence
  Description of Artificial Sequence: Synthetic peptide
DEEEIATTNPVATEQYGSVSENLQREER

SEQ ID NO: 20374 - protein, 28 aa, Artificial Sequence
  Description of Artificial Sequence: Synthetic peptide
DEEEIRTTNPTATEQFGSVSTNLQFGNN

SEQ ID NO: 20375 - protein, 28 aa, Artificial Sequence
  Description of Artificial Sequence: Synthetic peptide
YEEEIRTTNPVATEQYGEVSTVLQRGNH

SEQ ID NO: 20376 - protein, 28 aa, Artificial Sequence
  Description of Artificial Sequence: Synthetic peptide
SEEEIATTNPVATEQYGSVSTNEQRGDR

SEQ ID NO: 20377 - protein, 29 aa, Artificial Sequence
  Description of Artificial Sequence: Synthetic peptide
DEEEIRATNPTATEMYGSVSTNLQREGNR

SEQ ID NO: 20378 - protein, 29 aa, Artificial Sequence
  Description of Artificial Sequence: Synthetic peptide
DEEEISTTNPVATECYGSVSTNLQREGNT

SEQ ID NO: 20379 - protein, 28 aa, Artificial Sequence
  Description of Artificial Sequence: Synthetic peptide
DEEEIRTTNPVATELFGVVSTNLQRLNR

SEQ ID NO: 20380 - protein, 28 aa, Artificial Sequence
  Description of Artificial Sequence: Synthetic peptide
DEEEIRTTNPEATEQYGSVSNCEQRGNR

SEQ ID NO: 20381 - protein, 28 aa, Artificial Sequence
  Description of Artificial Sequence: Synthetic peptide
DEEEIRTTNPVATEQYGSVSTELQGGDF

SEQ ID NO: 20382 - protein, 28 aa, Artificial Sequence
  Description of Artificial Sequence: Synthetic peptide
SEEEICTTNPVATEQYGEVSTNEQRGNR

SEQ ID NO: 20383 - protein, 29 aa, Artificial Sequence
  Description of Artificial Sequence: Synthetic peptide
DEEEIRTTNPVATEHYGTVSTGNLQRGNE

SEQ ID NO: 20384 - protein, 31 aa, Artificial Sequence
  Description of Artificial Sequence: Synthetic polypeptide
DEEEIRTTNPVATEQYGSVSTNLQRDGDDPR

SEQ ID NO: 20385 - protein, 31 aa, Artificial Sequence
  Description of Artificial Sequence: Synthetic polypeptide
DEEEIRTTNPVATEQYGSVSTGNLQIRLGNM

SEQ ID NO: 20386 - protein, 29 aa, Artificial Sequence
  Description of Artificial Sequence: Synthetic peptide
DEEEIRTTNPVATEQYGSVSTNGQMSGER

SEQ ID NO: 20387 - protein, 31 aa, Artificial Sequence
  Description of Artificial Sequence: Synthetic polypeptide
DEEEIRTTNPVATEQYGSVSTNPLPQRDGER

SEQ ID NO: 20388 - protein, 28 aa, Artificial Sequence
  Description of Artificial Sequence: Synthetic peptide
VEEEIRTTNPVATEQYGSACTNEQRGNR

SEQ ID NO: 20389 - protein, 28 aa, Artificial Sequence
  Description of Artificial Sequence: Synthetic peptide
KEEEVRTTNPVATEGYGSVSTNLQVGNR

SEQ ID NO: 20390 - protein, 29 aa, Artificial Sequence
  Description of Artificial Sequence: Synthetic peptide
DEEEIRTTNPVATEQYGSVSENEQMRGNM

SEQ ID NO: 20391 - protein, 28 aa, Artificial Sequence
  Description of Artificial Sequence: Synthetic peptide
DEEEIRTVNPVATEPYGSVSYNLQRLNR

SEQ ID NO: 20392 - protein, 28 aa, Artificial Sequence
  Description of Artificial Sequence: Synthetic peptide
DEEEIYTTNPVATEQYGSASENLQWGNR

SEQ ID NO: 20393 - protein, 29 aa, Artificial Sequence
  Description of Artificial Sequence: Synthetic peptide
DEEEIRTTNPVCTEQYGSVSDNLQDHGNR

SEQ ID NO: 20394 - protein, 30 aa, Artificial Sequence
  Description of Artificial Sequence: Synthetic polypeptide
DEVEIRCTNPVATEQYGSVSTMNLQDRGNR

SEQ ID NO: 20395 - protein, 28 aa, Artificial Sequence
  Description of Artificial Sequence: Synthetic peptide
GEEEIRTTNPVATEQYGSVSEGLQHGNR

SEQ ID NO: 20396 - protein, 29 aa, Artificial Sequence
  Description of Artificial Sequence: Synthetic peptide
DEEEIATTNPVATEQYGSVSITNPQRGNS

SEQ ID NO: 20397 - protein, 29 aa, Artificial Sequence
  Description of Artificial Sequence: Synthetic peptide
DEEEIGTTNPVATEQYGSVAYINLQRGNR

SEQ ID NO: 20398 - protein, 28 aa, Artificial Sequence
  Description of Artificial Sequence: Synthetic peptide
DEEEIRATNPVATEQYGSVDTNLQLGNS

SEQ ID NO: 20399 - protein, 29 aa, Artificial Sequence
  Description of Artificial Sequence: Synthetic peptide
MEEEIRTTNPVATECYGSVSTNLQNEGNR

SEQ ID NO: 20400 - protein, 28 aa, Artificial Sequence
  Description of Artificial Sequence: Synthetic peptide
DEEEIRTTNPTATEQYGSVSTNEQIGNF

SEQ ID NO: 20401 - protein, 29 aa, Artificial Sequence
  Description of Artificial Sequence: Synthetic peptide
DEVEIRTTNPVATEQYGSVSTGNLQGGNG

SEQ ID NO: 20402 - protein, 28 aa, Artificial Sequence
  Description of Artificial Sequence: Synthetic peptide
DEEEIRTTNPVATEQYGSVSENEQIGNW

SEQ ID NO: 20403 - protein, 29 aa, Artificial Sequence
  Description of Artificial Sequence: Synthetic peptide
DEEEIRTTNPVATEQYGSVSENLQCMGNA

SEQ ID NO: 20404 - protein, 28 aa, Artificial Sequence
  Description of Artificial Sequence: Synthetic peptide
DECEILTTNPVATEQYGSQSTNFQRGNR

SEQ ID NO: 20405 - protein, 28 aa, Artificial Sequence
  Description of Artificial Sequence: Synthetic peptide
DEQEIRTTNPVATEQYGSVSTNLDPGDR

SEQ ID NO: 20406 - protein, 31 aa, Artificial Sequence
  Description of Artificial Sequence: Synthetic polypeptide
DEEEIRTTNPVATEIYGSVSTPNLTQLRGNR

SEQ ID NO: 20407 - protein, 29 aa, Artificial Sequence
  Description of Artificial Sequence: Synthetic peptide
SEEEIRTTNPVATEQYGSVSTINWQRGNQ

SEQ ID NO: 20408 - protein, 29 aa, Artificial Sequence
  Description of Artificial Sequence: Synthetic peptide
KENEIRTTNPVATEQYGSVSTNLQREGNE

SEQ ID NO: 20409 - protein, 28 aa, Artificial Sequence
  Description of Artificial Sequence: Synthetic peptide
DEQEIAQTNPVATEQYGSVSTNQQRGNR

SEQ ID NO: 20410 - protein, 28 aa, Artificial Sequence
  Description of Artificial Sequence: Synthetic peptide
DEEEIRTTNPVATEQYGSVSEDLQAGNL

SEQ ID NO: 20411 - protein, 28 aa, Artificial Sequence
  Description of Artificial Sequence: Synthetic peptide
DEEEIRTTNPTATEQYGSVSTNPQLGNA

SEQ ID NO: 20412 - protein, 28 aa, Artificial Sequence
  Description of Artificial Sequence: Synthetic peptide
AEEEIRSTNPVATEQYGVVSTNLQGGNR

SEQ ID NO: 20413 - protein, 29 aa, Artificial Sequence
  Description of Artificial Sequence: Synthetic peptide
DEEEIRTTNPVATEQYGTVSNNLQDYGNR

SEQ ID NO: 20414 - protein, 28 aa, Artificial Sequence
  Description of Artificial Sequence: Synthetic peptide
KEEEIRTTNPVATEQYGSVSTDLQNGDR

SEQ ID NO: 20415 - protein, 28 aa, Artificial Sequence
  Description of Artificial Sequence: Synthetic peptide
DEQEIRTTNPVATEQWGSVSTNDQVGNR

SEQ ID NO: 20416 - protein, 28 aa, Artificial Sequence
  Description of Artificial Sequence: Synthetic peptide
DEEEIRTTNPVATEQYGGVSTNLETGNQ

SEQ ID NO: 20417 - protein, 28 aa, Artificial Sequence
  Description of Artificial Sequence: Synthetic peptide
DEEEIRTTNPVATEQYGSVSTDEQHGER

SEQ ID NO: 20418 - protein, 28 aa, Artificial Sequence
  Description of Artificial Sequence: Synthetic peptide
DEEEIRTTNPVATEQYGSVSTDLERGEN

SEQ ID NO: 20419 - protein, 30 aa, Artificial Sequence
  Description of Artificial Sequence: Synthetic polypeptide
DENEIRTTNPVATEQYGSVSTNLQERGNDM

SEQ ID NO: 20420 - protein, 28 aa, Artificial Sequence
  Description of Artificial Sequence: Synthetic peptide
DEQEIRTTNPVATEVYGSVGTNLQRGGR

SEQ ID NO: 20421 - protein, 30 aa, Artificial Sequence
  Description of Artificial Sequence: Synthetic polypeptide
DEIEIRTTNPVATEQYGSVSTGNPQRGNWR

SEQ ID NO: 20422 - protein, 30 aa, Artificial Sequence
  Description of Artificial Sequence: Synthetic polypeptide
DEEEIRTTNPVATEQYGSAPTCNLQRGVNR

SEQ ID NO: 20423 - protein, 28 aa, Artificial Sequence
  Description of Artificial Sequence: Synthetic peptide
DEEEIRTTNPVATECYGWVSTNLERGNA

SEQ ID NO: 20424 - protein, 28 aa, Artificial Sequence
  Description of Artificial Sequence: Synthetic peptide
DEEEIRTTNPCATEQYGSASENLERGNR

SEQ ID NO: 20425 - protein, 30 aa, Artificial Sequence
  Description of Artificial Sequence: Synthetic polypeptide
DEEEIRTTNPVATEQYGSVSTNLQREGEDL

SEQ ID NO: 20426 - protein, 29 aa, Artificial Sequence
  Description of Artificial Sequence: Synthetic peptide
DEEEIRTTNPVAMLQWGSVSTNLQRGDNR

SEQ ID NO: 20427 - protein, 29 aa, Artificial Sequence
  Description of Artificial Sequence: Synthetic peptide
DENEIRQTNPVATEQYGVVSTNGLQRGNR

SEQ ID NO: 20428 - protein, 28 aa, Artificial Sequence
  Description of Artificial Sequence: Synthetic peptide
DENEIRTTNPVATECYGSASTCLQRGNR

SEQ ID NO: 20429 - protein, 28 aa, Artificial Sequence
  Description of Artificial Sequence: Synthetic peptide
DEVEIATTNPTATEQYGSVSTNPQRGNR

SEQ ID NO: 20430 - protein, 28 aa, Artificial Sequence
  Description of Artificial Sequence: Synthetic peptide
DEQEIRCTNPVATEQYGCVSNNLQRGNR

SEQ ID NO: 20431 - protein, 30 aa, Artificial Sequence
  Description of Artificial Sequence: Synthetic polypeptide
DEEEIRTTNPVATEQYGSVSTMDLQRGNDS

SEQ ID NO: 20432 - protein, 29 aa, Artificial Sequence
  Description of Artificial Sequence: Synthetic peptide
DEEEIRSTNPTATEQYGSVSTNLQVGENR

SEQ ID NO: 20433 - protein, 28 aa, Artificial Sequence
  Description of Artificial Sequence: Synthetic peptide
DEEEIRTTNPVATEQYGSVSTELQLGDT

SEQ ID NO: 20434 - protein, 28 aa, Artificial Sequence
  Description of Artificial Sequence: Synthetic peptide
DEEEIRTTNPVATEQYGVVSMNLERGNG

SEQ ID NO: 20435 - protein, 30 aa, Artificial Sequence
  Description of Artificial Sequence: Synthetic polypeptide
DEEEIRTTNPVATEQYGSVSITNLQTGHNH

SEQ ID NO: 20436 - protein, 28 aa, Artificial Sequence
  Description of Artificial Sequence: Synthetic peptide
DEEEIGTTNPVATEQYGDVSMNLQRGND

SEQ ID NO: 20437 - protein, 28 aa, Artificial Sequence
  Description of Artificial Sequence: Synthetic peptide
DEEEIVTTNPVATEQYGSVSNGLQDGNR

SEQ ID NO: 20438 - protein, 28 aa, Artificial Sequence
  Description of Artificial Sequence: Synthetic peptide
DEEEIRTTNPVASEQYGSVSENLQIGNG

SEQ ID NO: 20439 - protein, 28 aa, Artificial Sequence
  Description of Artificial Sequence: Synthetic peptide
DEEEIRTTNPIATECYGSVSTNLQIGND

SEQ ID NO: 20440 - protein, 28 aa, Artificial Sequence
  Description of Artificial Sequence: Synthetic peptide
DEEEIRTTNPVCTEQWGSVSTDLTRGNR

SEQ ID NO: 20441 - protein, 28 aa, Artificial Sequence
  Description of Artificial Sequence: Synthetic peptide
DEEHIRTTNPVATQQYGSVSTNLERPNR

SEQ ID NO: 20442 - protein, 28 aa, Artificial Sequence
  Description of Artificial Sequence: Synthetic peptide
DEEEIATTNPVATEQYGSVSTNLQQETR

SEQ ID NO: 20443 - protein, 29 aa, Artificial Sequence
  Description of Artificial Sequence: Synthetic peptide
DEEEIRTTNPVATEQYGSVTETNLEMGNR

SEQ ID NO: 20444 - protein, 29 aa, Artificial Sequence
  Description of Artificial Sequence: Synthetic peptide
DEEEIRTTNPVATEQYGDVSENLQCYGNR

SEQ ID NO: 20445 - protein, 28 aa, Artificial Sequence
  Description of Artificial Sequence: Synthetic peptide
DEEEIRTTNPVATEQYGSVSTDLEGGER

SEQ ID NO: 20446 - protein, 28 aa, Artificial Sequence
  Description of Artificial Sequence: Synthetic peptide
DEEEIRTTNPTATEQYGSVSTNEQQGNV

SEQ ID NO: 20447 - protein, 28 aa, Artificial Sequence
  Description of Artificial Sequence: Synthetic peptide
DEEEIRTTNPEATEQYGSVSTNLQNGEC

SEQ ID NO: 20448 - protein, 28 aa, Artificial Sequence
  Description of Artificial Sequence: Synthetic peptide
DEEHIRTTNPVATEVYGVVSTNLQRGNN

SEQ ID NO: 20449 - protein, 28 aa, Artificial Sequence
  Description of Artificial Sequence: Synthetic peptide
DDEEIRTTNPVATECYGSVSAGLQRGNR

SEQ ID NO: 20450 - protein, 28 aa, Artificial Sequence
  Description of Artificial Sequence: Synthetic peptide
DEEEIRTTNPVATEQYGVVDTNLQMGNS

SEQ ID NO: 20451 - protein, 28 aa, Artificial Sequence
  Description of Artificial Sequence: Synthetic peptide
DEQEIRTTNPVATEQYGSVSTNLQAGED

SEQ ID NO: 20452 - protein, 29 aa, Artificial Sequence
  Description of Artificial Sequence: Synthetic peptide
MENEIRTTNPVATEQYGSVSTNLQDTGNR

SEQ ID NO: 20453 - protein, 28 aa, Artificial Sequence
  Description of Artificial Sequence: Synthetic peptide
DEEEIRTTNPVATECYGTVSTNLQRGEI

SEQ ID NO: 20454 - protein, 30 aa, Artificial Sequence
  Description of Artificial Sequence: Synthetic polypeptide
DEEEIRTTNPVATEQYGSVSENELQRGINH

SEQ ID NO: 20455 - protein, 30 aa, Artificial Sequence
  Description of Artificial Sequence: Synthetic polypeptide
DEEEIRTTNPVATEQYGSVVSCTNLQRGLD

SEQ ID NO: 20456 - protein, 30 aa, Artificial Sequence
  Description of Artificial Sequence: Synthetic polypeptide
DEEEIRTTNPVATEQYGSVSSDNLTRGVNR

SEQ ID NO: 20457 - protein, 28 aa, Artificial Sequence
  Description of Artificial Sequence: Synthetic peptide
DESEIRATNPVASEQYGTVSTNLQRGNR

SEQ ID NO: 20458 - protein, 28 aa, Artificial Sequence
  Description of Artificial Sequence: Synthetic peptide
DEEEIRTTNPVATECYGSVSTNLQPGEE

SEQ ID NO: 20459 - protein, 29 aa, Artificial Sequence
  Description of Artificial Sequence: Synthetic peptide
DENEIRTTNPVATEQYGIVSTNLQNRGNM

SEQ ID NO: 20460 - protein, 31 aa, Artificial Sequence
  Description of Artificial Sequence: Synthetic polypeptide
DEEEIRTTNPVATEQYGSVSTNLEDRGENDR

SEQ ID NO: 20461 - protein, 28 aa, Artificial Sequence
  Description of Artificial Sequence: Synthetic peptide
DEEEIRTTNPVATEQYGSVSTNLETGEM

SEQ ID NO: 20462 - protein, 28 aa, Artificial Sequence
  Description of Artificial Sequence: Synthetic peptide
SEEEIRTTNPVATEQYGIVSTNLMLGNR

SEQ ID NO: 20463 - protein, 29 aa, Artificial Sequence
  Description of Artificial Sequence: Synthetic peptide
DEEEIRTTNPVATEQYGKSVSTNLYEGPR

SEQ ID NO: 20464 - protein, 28 aa, Artificial Sequence
  Description of Artificial Sequence: Synthetic peptide
DEEYIRTTNPVATEQYGSVSTNPDNGNR

SEQ ID NO: 20465 - protein, 29 aa, Artificial Sequence
  Description of Artificial Sequence: Synthetic peptide
DEEEIRTTNPVATEQYGSVSTNLQVKGEF

SEQ ID NO: 20466 - protein, 28 aa, Artificial Sequence
  Description of Artificial Sequence: Synthetic peptide
GEEEIRTTNPVATEQYGWVSTDLQRGNI

SEQ ID NO: 20467 - protein, 31 aa, Artificial Sequence
  Description of Artificial Sequence: Synthetic polypeptide
DEEEIRTTNPVATEQYGSVSTNPLDEREGNR

SEQ ID NO: 20468 - protein, 28 aa, Artificial Sequence
  Description of Artificial Sequence: Synthetic peptide
DEEEIRTTNCVATEQYGECSTNLQLGNR

SEQ ID NO: 20469 - protein, 28 aa, Artificial Sequence
  Description of Artificial Sequence: Synthetic peptide
DEEEITTTNPVATEQYGSVSTNLMRGTI

SEQ ID NO: 20470 - protein, 28 aa, Artificial Sequence
  Description of Artificial Sequence: Synthetic peptide
SEEEIRATNPVATEQFGSVSTNLQRGTR

SEQ ID NO: 20471 - protein, 28 aa, Artificial Sequence
  Description of Artificial Sequence: Synthetic peptide
AEEEIRTTNPCATEQYGSVSTNIQRENR

SEQ ID NO: 20472 - protein, 30 aa, Artificial Sequence
  Description of Artificial Sequence: Synthetic polypeptide
DEEEIRTTNPVATEQYGSVISEMNLQRGNF

SEQ ID NO: 20473 - protein, 28 aa, Artificial Sequence
  Description of Artificial Sequence: Synthetic peptide
SEEEIRTTNPVATEQYGIYSTNLQRGNL

SEQ ID NO: 20474 - protein, 28 aa, Artificial Sequence
  Description of Artificial Sequence: Synthetic peptide
DEEEIRATNPVATEQYGTVSTNLQTGNC

SEQ ID NO: 20475 - protein, 29 aa, Artificial Sequence
  Description of Artificial Sequence: Synthetic peptide
DEEEIRTTNPVATMQYGSVSVNLNRGNIR

SEQ ID NO: 20476 - protein, 28 aa, Artificial Sequence
  Description of Artificial Sequence: Synthetic peptide
DDEEIRTVNPVATEQYGSVSTNYERGNR

SEQ ID NO: 20477 - protein, 28 aa, Artificial Sequence
  Description of Artificial Sequence: Synthetic peptide
DEVEIRTTNPVATEQYGSVSENLQTGNG

SEQ ID NO: 20478 - protein, 28 aa, Artificial Sequence
  Description of Artificial Sequence: Synthetic peptide
DEEEIRTTNPVATEQYGWCSTELQRGER

SEQ ID NO: 20479 - protein, 30 aa, Artificial Sequence
  Description of Artificial Sequence: Synthetic polypeptide
DEEEIRTTNPVATEQYGSVSEANLQRGNTV

SEQ ID NO: 20480 - protein, 29 aa, Artificial Sequence
  Description of Artificial Sequence: Synthetic peptide
SEEEIRTTNPVATEQYGSVSTNPQEFGNR

SEQ ID NO: 20481 - protein, 28 aa, Artificial Sequence
  Description of Artificial Sequence: Synthetic peptide
DENEIRTTNPVATEQWGSVSTNLQLGNF

SEQ ID NO: 20482 - protein, 31 aa, Artificial Sequence
  Description of Artificial Sequence: Synthetic polypeptide
DEEEIRTTNPVATEQYGSVSDTNLIQRKGNS

SEQ ID NO: 20483 - protein, 29 aa, Artificial Sequence
  Description of Artificial Sequence: Synthetic peptide
DEEEIRTTNPVATEQYGSVSTNLQENGDW

SEQ ID NO: 20484 - protein, 29 aa, Artificial Sequence
  Description of Artificial Sequence: Synthetic peptide
DEEEICTTNPVATEQYGSASTNLQRGGDR

SEQ ID NO: 20485 - protein, 28 aa, Artificial Sequence
  Description of Artificial Sequence: Synthetic peptide
DEEEIRTTNPVATEQYGSVDTNEQDGNH

SEQ ID NO: 20486 - protein, 29 aa, Artificial Sequence
  Description of Artificial Sequence: Synthetic peptide
DEEEIRTTNPVATEQYGWVSTDLQDQGNR

SEQ ID NO: 20487 - protein, 28 aa, Artificial Sequence
  Description of Artificial Sequence: Synthetic peptide
QEEEIVTTNPVATEQYGSVSTNEQRGLR

SEQ ID NO: 20488 - protein, 28 aa, Artificial Sequence
  Description of Artificial Sequence: Synthetic peptide
DEEEIATTNPVATEQYGVVSTNLQVGNH

SEQ ID NO: 20489 - protein, 28 aa, Artificial Sequence
  Description of Artificial Sequence: Synthetic peptide
DEEEIRTTNPVATEQYGSVPTCLQSENR

SEQ ID NO: 20490 - protein, 28 aa, Artificial Sequence
  Description of Artificial Sequence: Synthetic peptide
DEEEIRTTNPVATEQYGSVSTNDIMGND

SEQ ID NO: 20491 - protein, 29 aa, Artificial Sequence
  Description of Artificial Sequence: Synthetic peptide
DEEEIRQTNPVATEQYGSVSTDLQHGNDR

SEQ ID NO: 20492 - protein, 28 aa, Artificial Sequence
  Description of Artificial Sequence: Synthetic peptide
DEEEIRTVNPVSTENYGSVATNLQRGNR

SEQ ID NO: 20493 - protein, 28 aa, Artificial Sequence
  Description of Artificial Sequence: Synthetic peptide
DEFELGTTNPVCTEQYGSVSTNLQRGNR

SEQ ID NO: 20494 - protein, 28 aa, Artificial Sequence
  Description of Artificial Sequence: Synthetic peptide
DEEEIRTTNPVATEQYGGVSTNVQCLNR

SEQ ID NO: 20495 - protein, 29 aa, Artificial Sequence
  Description of Artificial Sequence: Synthetic peptide
KEEEIRTTNPVATEQYGSVSDNLQDGQNR

SEQ ID NO: 20496 - protein, 28 aa, Artificial Sequence
  Description of Artificial Sequence: Synthetic peptide
DEEEIRTTNPVATEQYGSVSTTVLIGNR

SEQ ID NO: 20497 - protein, 28 aa, Artificial Sequence
  Description of Artificial Sequence: Synthetic peptide
DEEEIRTTNPVSTEGYGEVSENLQRGNR

SEQ ID NO: 20498 - protein, 28 aa, Artificial Sequence
  Description of Artificial Sequence: Synthetic peptide
DEEEIRTTNPVAYEPYGCVSMNLQRGNR

SEQ ID NO: 20499 - protein, 28 aa, Artificial Sequence
  Description of Artificial Sequence: Synthetic peptide
DEEEIRCTNPVATEMYGSVSTNLQSENR

SEQ ID NO: 20500 - protein, 28 aa, Artificial Sequence
  Description of Artificial Sequence: Synthetic peptide
DEEEIRTTNPVATEQYGSVSTALETGNA

SEQ ID NO: 20501 - protein, 29 aa, Artificial Sequence
  Description of Artificial Sequence: Synthetic peptide
DEEEIRTTNPVATECWGSVSTNLQIQGNR

SEQ ID NO: 20502 - protein, 28 aa, Artificial Sequence
  Description of Artificial Sequence: Synthetic peptide
DEEEIRTTNPVATEQYGSVETNDQFGNF

SEQ ID NO: 20503 - protein, 28 aa, Artificial Sequence
  Description of Artificial Sequence: Synthetic peptide
DEEEIRTTNPVATEQYGVVSENLQHGNH

SEQ ID NO: 20504 - protein, 29 aa, Artificial Sequence
  Description of Artificial Sequence: Synthetic peptide
DEEEIYTTNPVATEQYGSVSEDNLQRGNL

SEQ ID NO: 20505 - protein, 28 aa, Artificial Sequence
  Description of Artificial Sequence: Synthetic peptide
DENEIAATNPVATEHYGSVSTNLQRGNR

SEQ ID NO: 20506 - protein, 28 aa, Artificial Sequence
  Description of Artificial Sequence: Synthetic peptide
DEEEIRTTNPVATECYGWVSTDLQRGNQ

SEQ ID NO: 20507 - protein, 29 aa, Artificial Sequence
  Description of Artificial Sequence: Synthetic peptide
DEEEIRTTNPVATEQYGDASTMNLQRGER

SEQ ID NO: 20508 - protein, 28 aa, Artificial Sequence
  Description of Artificial Sequence: Synthetic peptide
DEEEIRCTNPVSTETYGSVGTNLQRGNR

SEQ ID NO: 20509 - protein, 29 aa, Artificial Sequence
  Description of Artificial Sequence: Synthetic peptide
DEEEIRTTNPVATEQYGSVSDNLCGGNDR

SEQ ID NO: 20510 - protein, 28 aa, Artificial Sequence
  Description of Artificial Sequence: Synthetic peptide
MEEEIRTTNPVATEQYGSVSTDLQYGNI

SEQ ID NO: 20511 - protein, 31 aa, Artificial Sequence
  Description of Artificial Sequence: Synthetic polypeptide
DEEEIRTTNPVATEQYGSVSITELQSRGNLR

SEQ ID NO: 20512 - protein, 28 aa, Artificial Sequence
  Description of Artificial Sequence: Synthetic peptide
DEEEIKTTNPVGTEHYGSVSDNLQRGNR

SEQ ID NO: 20513 - protein, 29 aa, Artificial Sequence
  Description of Artificial Sequence: Synthetic peptide
DEEEIRCTNPVATEQYGSVSTNLQSEGNL

SEQ ID NO: 20514 - protein, 29 aa, Artificial Sequence
  Description of Artificial Sequence: Synthetic peptide
DENEIRTTNPVATEQYGSVSTDLQVGNDR

SEQ ID NO: 20515 - protein, 28 aa, Artificial Sequence
  Description of Artificial Sequence: Synthetic peptide
DEVEIATTNPVATEQYGSVSTNLQNGNE

SEQ ID NO: 20516 - protein, 30 aa, Artificial Sequence
  Description of Artificial Sequence: Synthetic polypeptide
DEEEIRTTNPVATEQYGSVSTNLQNEGNDA

SEQ ID NO: 20517 - protein, 28 aa, Artificial Sequence
  Description of Artificial Sequence: Synthetic peptide
DEEEIRTTNPVATEQYGSVDTPLQRGEQ

SEQ ID NO: 20518 - protein, 28 aa, Artificial Sequence
  Description of Artificial Sequence: Synthetic peptide
DEEEIRTTNPVASEQYGCVSMNLERGNR

SEQ ID NO: 20519 - protein, 31 aa, Artificial Sequence
  Description of Artificial Sequence: Synthetic polypeptide
DEEEIRTTNPVATEQYGSNVSTNYLQRPGGR

SEQ ID NO: 20520 - protein, 28 aa, Artificial Sequence
  Description of Artificial Sequence: Synthetic peptide
DECEIRTTNPVATEQYGSVSELLQRGGR

SEQ ID NO: 20521 - protein, 28 aa, Artificial Sequence
  Description of Artificial Sequence: Synthetic peptide
DEEEIRSTNPVASEIYGVVSTNLQRGNR

SEQ ID NO: 20522 - protein, 29 aa, Artificial Sequence
  Description of Artificial Sequence: Synthetic peptide
VEEEIRTTNPVATEQYGSVSTSLKQIGNR

SEQ ID NO: 20523 - protein, 28 aa, Artificial Sequence
  Description of Artificial Sequence: Synthetic peptide
DEEEIRTTNPDATEQYGSTSTMLQRGNP

SEQ ID NO: 20524 - protein, 28 aa, Artificial Sequence
  Description of Artificial Sequence: Synthetic peptide
SEEEIVSTNPVATEQYGSVGTNLQRGNR

SEQ ID NO: 20525 - protein, 28 aa, Artificial Sequence
  Description of Artificial Sequence: Synthetic peptide
DEVEITTTNPVATEQYGSVSTNLERGNQ

SEQ ID NO: 20526 - protein, 30 aa, Artificial Sequence
  Description of Artificial Sequence: Synthetic polypeptide
DEEEIRTTNPVATEQYGSVDETNLQRKGDR

SEQ ID NO: 20527 - protein, 32 aa, Artificial Sequence
  Description of Artificial Sequence: Synthetic polypeptide
DEEEIRTTNPVATEQYGSVISTCNLPQRGDNR

SEQ ID NO: 20528 - protein, 28 aa, Artificial Sequence
  Description of Artificial Sequence: Synthetic peptide
DEEEIRTTNPVATEQYGSVSTELQNGDW

SEQ ID NO: 20529 - protein, 28 aa, Artificial Sequence
  Description of Artificial Sequence: Synthetic peptide
DEEEIATTNPVATEQYGSVSTDLQNGNE

SEQ ID NO: 20530 - protein, 29 aa, Artificial Sequence
  Description of Artificial Sequence: Synthetic peptide
DEEEIRTTNPVATEQYGIYSTNLQRGNDL

SEQ ID NO: 20531 - protein, 28 aa, Artificial Sequence
  Description of Artificial Sequence: Synthetic peptide
DEEEIAQTNPVATEQYGSVSTNLQREER

SEQ ID NO: 20532 - protein, 30 aa, Artificial Sequence
  Description of Artificial Sequence: Synthetic polypeptide
DENEIRTTNPVATEQYGMSVHTNPLQRGNR

SEQ ID NO: 20533 - protein, 28 aa, Artificial Sequence
  Description of Artificial Sequence: Synthetic peptide
DEEYIRTTNPVATEQYGSVSTNPDRGER

SEQ ID NO: 20534 - protein, 28 aa, Artificial Sequence
  Description of Artificial Sequence: Synthetic peptide
DEQEIRTTNPDATEQYGSVSTNLQQGNF

SEQ ID NO: 20535 - protein, 28 aa, Artificial Sequence
  Description of Artificial Sequence: Synthetic peptide
DEEEVRATNPVATETYGSVSTNLERGNR

SEQ ID NO: 20536 - protein, 28 aa, Artificial Sequence
  Description of Artificial Sequence: Synthetic peptide
DEMEIRTTNPVAVECYGEVSTNLQRGNR

SEQ ID NO: 20537 - protein, 31 aa, Artificial Sequence
  Description of Artificial Sequence: Synthetic polypeptide
DEEEIRTTNPVATEQYGSVSETNLLDRGNPR

SEQ ID NO: 20538 - protein, 28 aa, Artificial Sequence
  Description of Artificial Sequence: Synthetic peptide
DEEEIRSTNPVATEQYGSVSTNWQSGNF

SEQ ID NO: 20539 - protein, 28 aa, Artificial Sequence
  Description of Artificial Sequence: Synthetic peptide
DEEEIATTNPVATEMYGSASTVLQRGNR

SEQ ID NO: 20540 - protein, 31 aa, Artificial Sequence
  Description of Artificial Sequence: Synthetic polypeptide
DEEEIRTTNPVATEQYGSVSTMNGLQLGNTR

SEQ ID NO: 20541 - protein, 28 aa, Artificial Sequence
  Description of Artificial Sequence: Synthetic peptide
DEVEIRTTNPVATELYGSVSENLQRGNF

SEQ ID NO: 20542 - protein, 29 aa, Artificial Sequence
  Description of Artificial Sequence: Synthetic peptide
DEEEIRTTNPVATEQYGDVSTMDLQRGNV

SEQ ID NO: 20543 - protein, 28 aa, Artificial Sequence
  Description of Artificial Sequence: Synthetic peptide
DEEEIATTNPTATEQYGSVSTNEQRGNF

SEQ ID NO: 20544 - protein, 28 aa, Artificial Sequence
  Description of Artificial Sequence: Synthetic peptide
DEEEIRTTNPVATEQYGSVSTCLIRGET

SEQ ID NO: 20545 - protein, 28 aa, Artificial Sequence
  Description of Artificial Sequence: Synthetic peptide
DEEEIRTTNPVSTEQFGSVSTNLQRGDF

SEQ ID NO: 20546 - protein, 28 aa, Artificial Sequence
  Description of Artificial Sequence: Synthetic peptide
DEEEIRTTNPTATEQYGSVSTNEQLGNF

SEQ ID NO: 20547 - protein, 28 aa, Artificial Sequence
  Description of Artificial Sequence: Synthetic peptide
SEEEIRTTNPVATEQYGVVSTNLQRGLF

SEQ ID NO: 20548 - protein, 28 aa, Artificial Sequence
  Description of Artificial Sequence: Synthetic peptide
DEEEIRTTNPVATEQYGSVSTDLQVGEN

SEQ ID NO: 20549 - protein, 28 aa, Artificial Sequence
  Description of Artificial Sequence: Synthetic peptide
DEEEIRTTNPVATEQYGSVSTGDDRGNL

SEQ ID NO: 20550 - protein, 31 aa, Artificial Sequence
  Description of Artificial Sequence: Synthetic polypeptide
DEEEIRTTNPVATEQYGSVDSTNLQHRGENA

SEQ ID NO: 20551 - protein, 28 aa, Artificial Sequence
  Description of Artificial Sequence: Synthetic peptide
HEEEIRTTNPVSTEIYGSVGTNLQRGNR

SEQ ID NO: 20552 - protein, 29 aa, Artificial Sequence
  Description of Artificial Sequence: Synthetic peptide
DEEEIRTTNPVATEQYGSVSTELQIRGEG

SEQ ID NO: 20553 - protein, 28 aa, Artificial Sequence
  Description of Artificial Sequence: Synthetic peptide
DEQEIRTTNPEATEQYGSVSTNLERGER

SEQ ID NO: 20554 - protein, 28 aa, Artificial Sequence
  Description of Artificial Sequence: Synthetic peptide
DEEEIRTTNPVATEQYGCVSENLERGNG

SEQ ID NO: 20555 - protein, 28 aa, Artificial Sequence
  Description of Artificial Sequence: Synthetic peptide
DEQEIRTTNPVATEQYGSVSTDLQHGER

SEQ ID NO: 20556 - protein, 28 aa, Artificial Sequence
  Description of Artificial Sequence: Synthetic peptide
MEEEIRTTNPVATEQYGSVSTNLQHGDE

SEQ ID NO: 20557 - protein, 28 aa, Artificial Sequence
  Description of Artificial Sequence: Synthetic peptide
DEEEIRTTNPVATEMYGGVSTNLQQGNF

SEQ ID NO: 20558 - protein, 28 aa, Artificial Sequence
  Description of Artificial Sequence: Synthetic peptide
DEVEIAATNPVATEQYGSVSTNLQRGDR

SEQ ID NO: 20559 - protein, 29 aa, Artificial Sequence
  Description of Artificial Sequence: Synthetic peptide
DEEEIRATNPVATEQFGSVIPTNLQRGNR

SEQ ID NO: 20560 - protein, 28 aa, Artificial Sequence
  Description of Artificial Sequence: Synthetic peptide
DAEEIKTTNPVATEQFGSVSTNLNRGNR

SEQ ID NO: 20561 - protein, 29 aa, Artificial Sequence
  Description of Artificial Sequence: Synthetic peptide
DEEEIRTTNPVATEQYGIYSTALQRGENR

SEQ ID NO: 20562 - protein, 29 aa, Artificial Sequence
  Description of Artificial Sequence: Synthetic peptide
SENEIRTTNPVATEQYGNVSTNLQNRGNR

SEQ ID NO: 20563 - protein, 28 aa, Artificial Sequence
  Description of Artificial Sequence: Synthetic peptide
DEEEIRTTNPVATEQYGSVCTYLERGNS

SEQ ID NO: 20564 - protein, 30 aa, Artificial Sequence
  Description of Artificial Sequence: Synthetic polypeptide
DEEEIRTTNPVATEQYGSVSTVNDNQRGTR

SEQ ID NO: 20565 - protein, 28 aa, Artificial Sequence
  Description of Artificial Sequence: Synthetic peptide
DEEEIRTTNPVATECYGSVSTDLQVGNL

SEQ ID NO: 20566 - protein, 28 aa, Artificial Sequence
  Description of Artificial Sequence: Synthetic peptide
DEEEIRTTNPVATEQYGSVSTNEMIGNQ

SEQ ID NO: 20567 - protein, 30 aa, Artificial Sequence
  Description of Artificial Sequence: Synthetic polypeptide
DEEEIRTTNPVATEQYGVVSTNNLQLRGND

SEQ ID NO: 20568 - protein, 30 aa, Artificial Sequence
  Description of Artificial Sequence: Synthetic polypeptide
DEEEIRTTNPVATEQYGSVSTNLQEYEGNS

SEQ ID NO: 20569 - protein, 28 aa, Artificial Sequence
  Description of Artificial Sequence: Synthetic peptide
DEEEIRTTNPVATEQYGSVITELQVGNF

SEQ ID NO: 20570 - protein, 28 aa, Artificial Sequence
  Description of Artificial Sequence: Synthetic peptide
SEDEIRTTNPAATEQYGSVSENLQRGNR

SEQ ID NO: 20571 - protein, 28 aa, Artificial Sequence
  Description of Artificial Sequence: Synthetic peptide
DEEEIRATNPVATEQYGVVSTNLEVGNR

SEQ ID NO: 20572 - protein, 28 aa, Artificial Sequence
  Description of Artificial Sequence: Synthetic peptide
DEEEIATTNPVATECYGSVSTNLQEGNL

SEQ ID NO: 20573 - protein, 28 aa, Artificial Sequence
  Description of Artificial Sequence: Synthetic peptide
DEEEIRTTNPVATEQYGSVGTNLENGNG

SEQ ID NO: 20574 - protein, 29 aa, Artificial Sequence
  Description of Artificial Sequence: Synthetic peptide
DEEEIRTTNPVATEQYGSVSENEQNRGNW

SEQ ID NO: 20575 - protein, 28 aa, Artificial Sequence
  Description of Artificial Sequence: Synthetic peptide
DEEEIITTNPVATEQYGSVSTCLQRMNL

SEQ ID NO: 20576 - protein, 28 aa, Artificial Sequence
  Description of Artificial Sequence: Synthetic peptide
DEEEIRTTNPVASEQYGCVSTNLEPGNR

SEQ ID NO: 20577 - protein, 30 aa, Artificial Sequence
  Description of Artificial Sequence: Synthetic polypeptide
DEEEIRTTNPVATEQYGSVDTCNLQRNDNR

SEQ ID NO: 20578 - protein, 28 aa, Artificial Sequence
  Description of Artificial Sequence: Synthetic peptide
DEQEIRCTNPVATEQYGSVSTDLQQGNR

SEQ ID NO: 20579 - protein, 30 aa, Artificial Sequence
  Description of Artificial Sequence: Synthetic polypeptide
DEEEIRTTNPVATEQYGSVSATGLQRGNDD

SEQ ID NO: 20580 - protein, 29 aa, Artificial Sequence
  Description of Artificial Sequence: Synthetic peptide
DEEEIRTTNPVATEQYGSCATNLQRGDDR

SEQ ID NO: 20581 - protein, 28 aa, Artificial Sequence
  Description of Artificial Sequence: Synthetic peptide
DEEEIRTTNPVATEQYGSVSTAPQDGNF

SEQ ID NO: 20582 - protein, 30 aa, Artificial Sequence
  Description of Artificial Sequence: Synthetic polypeptide
DEEEIRTTNPVAWEQYGVSVDCTNLQRGNR

SEQ ID NO: 20583 - protein, 28 aa, Artificial Sequence
  Description of Artificial Sequence: Synthetic peptide
DEEEIRTTNPVATECYGSVSENLQEGNI

SEQ ID NO: 20584 - protein, 28 aa, Artificial Sequence
  Description of Artificial Sequence: Synthetic peptide
SEEEIRTTNPVATEQYGSVSTNPQHGNG

SEQ ID NO: 20585 - protein, 30 aa, Artificial Sequence
  Description of Artificial Sequence: Synthetic polypeptide
DEEEIRTTNPVATEQYGVVSTNLQLRKGER

SEQ ID NO: 20586 - protein, 29 aa, Artificial Sequence
  Description of Artificial Sequence: Synthetic peptide
DEEEIRTTNPVATECYGSVSTNLQLKGNW

SEQ ID NO: 20587 - protein, 28 aa, Artificial Sequence
  Description of Artificial Sequence: Synthetic peptide
DEECIRTTNPVATEQYWSVEHNLQRGNR

SEQ ID NO: 20588 - protein, 30 aa, Artificial Sequence
  Description of Artificial Sequence: Synthetic polypeptide
DEEEIRTTNPVCTEQYGSVSLTNLQRGTLR

SEQ ID NO: 20589 - protein, 30 aa, Artificial Sequence
  Description of Artificial Sequence: Synthetic polypeptide
DEEEIRTTNPVATEQYGSVSTNLQENGNDN

SEQ ID NO: 20590 - protein, 28 aa, Artificial Sequence
  Description of Artificial Sequence: Synthetic peptide
DEEEIRTTNPVATEQYGSVSTGLELGNN

SEQ ID NO: 20591 - protein, 30 aa, Artificial Sequence
  Description of Artificial Sequence: Synthetic polypeptide
DEEEIRTTNPVATEQYGSSVWTPELQRGNR

SEQ ID NO: 20592 - protein, 29 aa, Artificial Sequence
  Description of Artificial Sequence: Synthetic peptide
SEEEIRTTNPTATEQYGSVSTNLQRGDTR

SEQ ID NO: 20593 - protein, 30 aa, Artificial Sequence
  Description of Artificial Sequence: Synthetic polypeptide
DEEEIRTTNPVATEQYGSVSTANPQLGNTR

SEQ ID NO: 20594 - protein, 31 aa, Artificial Sequence
  Description of Artificial Sequence: Synthetic polypeptide
DEEEIRTTNPVATEQYGSVSTNLQENEGNDR

SEQ ID NO: 20595 - protein, 28 aa, Artificial Sequence
  Description of Artificial Sequence: Synthetic peptide
DEEEIRTTNPVATEQYGSVDEDLQGGNR

SEQ ID NO: 20596 - protein, 28 aa, Artificial Sequence
  Description of Artificial Sequence: Synthetic peptide
DEEEIRTTNPVATEQYGSVSTELQPGEQ

SEQ ID NO: 20597 - protein, 29 aa, Artificial Sequence
  Description of Artificial Sequence: Synthetic peptide
DEEEIRTTNPTATEQYGSVATNLEFRGNR

SEQ ID NO: 20598 - protein, 31 aa, Artificial Sequence
  Description of Artificial Sequence: Synthetic polypeptide
DEEEIRTTNPVATEQYGSVADSTALTQRGNR

SEQ ID NO: 20599 - protein, 28 aa, Artificial Sequence
  Description of Artificial Sequence: Synthetic peptide
DEEEIRATNPVATEIYGCVSNNLQRGNR

SEQ ID NO: 20600 - protein, 28 aa, Artificial Sequence
  Description of Artificial Sequence: Synthetic peptide
DEHEIRTTNPVCTEQYGDVSTNLQRGNQ

SEQ ID NO: 20601 - protein, 28 aa, Artificial Sequence
  Description of Artificial Sequence: Synthetic peptide
GEEEISTTNPVATEVYGSVSTNLQRGNH

SEQ ID NO: 20602 - protein, 30 aa, Artificial Sequence
  Description of Artificial Sequence: Synthetic polypeptide
DENEIRTTNPVATEQYGSVSETDGLQRGNR

SEQ ID NO: 20603 - protein, 28 aa, Artificial Sequence
  Description of Artificial Sequence: Synthetic peptide
DEEEIRTTNPTATEQYGSVSTNEQHGNP

SEQ ID NO: 20604 - protein, 28 aa, Artificial Sequence
  Description of Artificial Sequence: Synthetic peptide
DEEEIRTTNPVATEQYGSVSTELQAGDA

SEQ ID NO: 20605 - protein, 28 aa, Artificial Sequence
  Description of Artificial Sequence: Synthetic peptide
DEEEIRATNPVATEMYGAVATNLQRGNR

SEQ ID NO: 20606 - protein, 28 aa, Artificial Sequence
  Description of Artificial Sequence: Synthetic peptide
DEEEIRTTNPVATEQYGSVSTAPQPGNG

SEQ ID NO: 20607 - protein, 30 aa, Artificial Sequence
  Description of Artificial Sequence: Synthetic polypeptide
DEECIRTTNPVATEQVYGSVSTNLQREGNG

SEQ ID NO: 20608 - protein, 28 aa, Artificial Sequence
  Description of Artificial Sequence: Synthetic peptide
DENEIRTTNPVATEQYGSVSTNLQSGEL

SEQ ID NO: 20609 - protein, 28 aa, Artificial Sequence
  Description of Artificial Sequence: Synthetic peptide
DEEEIATTNPVCTEQYGSVSTALQRGNA

SEQ ID NO: 20610 - protein, 28 aa, Artificial Sequence
  Description of Artificial Sequence: Synthetic peptide
DEEEIVTTNPVATEMFGSVSTNLQRGNN

SEQ ID NO: 20611 - protein, 29 aa, Artificial Sequence
  Description of Artificial Sequence: Synthetic peptide
VEEEIRATNPVATEQYGSVSTNLELRGNR

SEQ ID NO: 20612 - protein, 28 aa, Artificial Sequence
  Description of Artificial Sequence: Synthetic peptide
SEEEIRTTNPTATEQYGSVSTNLQLGNE

SEQ ID NO: 20613 - protein, 28 aa, Artificial Sequence
  Description of Artificial Sequence: Synthetic peptide
DEEEIRTTNPVATEQYGSVSTGLEVGNV

SEQ ID NO: 20614 - protein, 28 aa, Artificial Sequence
  Description of Artificial Sequence: Synthetic peptide
DEEEVRTTNPEATEQYGSVSTNLERGER

SEQ ID NO: 20615 - protein, 28 aa, Artificial Sequence
  Description of Artificial Sequence: Synthetic peptide
DEEEIRTTNPVATEIYGSVSTNPQRGDN

SEQ ID NO: 20616 - protein, 28 aa, Artificial Sequence
  Description of Artificial Sequence: Synthetic peptide
DEEEIRTTNPVATEQYGSVSTEDDRGNN

SEQ ID NO: 20617 - protein, 29 aa, Artificial Sequence
  Description of Artificial Sequence: Synthetic peptide
DEEEIATTNPVATEQYGEVSADNLQRGNR

SEQ ID NO: 20618 - protein, 31 aa, Artificial Sequence
  Description of Artificial Sequence: Synthetic polypeptide
DETEIRTTNPVATEQYGSVSTNLPQERGENR

SEQ ID NO: 20619 - protein, 28 aa, Artificial Sequence
  Description of Artificial Sequence: Synthetic peptide
DEEEIRTTNPVATEQYGSVSENLAGGNW

SEQ ID NO: 20620 - protein, 28 aa, Artificial Sequence
  Description of Artificial Sequence: Synthetic peptide
DEEEIRTTNPVATEQYGSVHTGLQDGER

SEQ ID NO: 20621 - protein, 28 aa, Artificial Sequence
  Description of Artificial Sequence: Synthetic peptide
DEEEIRTTNPVATEQYGSVSTPLQFENY

SEQ ID NO: 20622 - protein, 28 aa, Artificial Sequence
  Description of Artificial Sequence: Synthetic peptide
DENEIRTTNPVATEQYGSVSTDLQNGNM

SEQ ID NO: 20623 - protein, 28 aa, Artificial Sequence
  Description of Artificial Sequence: Synthetic peptide
DEEEIRTTNPVATEQYGSVSTPQQIGNL

SEQ ID NO: 20624 - protein, 28 aa, Artificial Sequence
  Description of Artificial Sequence: Synthetic peptide
DEEEIRTTNPVATEQYWSVSENLEHGNR

SEQ ID NO: 20625 - protein, 28 aa, Artificial Sequence
  Description of Artificial Sequence: Synthetic peptide
DEVEIVTTNPVATEVYGSVSTNLQRGDR

SEQ ID NO: 20626 - protein, 28 aa, Artificial Sequence
  Description of Artificial Sequence: Synthetic peptide
DEEEIRTTNPVATEQYGEVSTNLQLGPF

SEQ ID NO: 20627 - protein, 30 aa, Artificial Sequence
  Description of Artificial Sequence: Synthetic polypeptide
DEEEIRTTNPVATEQYGSVSTNLVQELGNE

SEQ ID NO: 20628 - protein, 31 aa, Artificial Sequence
  Description of Artificial Sequence: Synthetic polypeptide
DEEEIRTTNPVATEQYGESVSTMNLIQRGNL

SEQ ID NO: 20629 - protein, 28 aa, Artificial Sequence
  Description of Artificial Sequence: Synthetic peptide
DEEEIRTTNPVATEIYGSVSTNLEHGND

SEQ ID NO: 20630 - protein, 28 aa, Artificial Sequence
  Description of Artificial Sequence: Synthetic peptide
DEEEIRTTNPVATEQYGSVETELQYGER

SEQ ID NO: 20631 - protein, 28 aa, Artificial Sequence
  Description of Artificial Sequence: Synthetic peptide
DEEEIRTTNPVATEQYGSVSTELQQGES

SEQ ID NO: 20632 - protein, 28 aa, Artificial Sequence
  Description of Artificial Sequence: Synthetic peptide
DEEEIRSVNPVATEQYGSVSTNLQLGGR

SEQ ID NO: 20633 - protein, 28 aa, Artificial Sequence
  Description of Artificial Sequence: Synthetic peptide
HEEEVCTTNPVATEQYGWVSTNLQRGNR

SEQ ID NO: 20634 - protein, 28 aa, Artificial Sequence
  Description of Artificial Sequence: Synthetic peptide
DEEEIRTTNPVATEQYGSVSTDLQREPV

SEQ ID NO: 20635 - protein, 28 aa, Artificial Sequence
  Description of Artificial Sequence: Synthetic peptide
SEEEIYATNPVATECYGSVSTNLQRGNR

SEQ ID NO: 20636 - protein, 28 aa, Artificial Sequence
  Description of Artificial Sequence: Synthetic peptide
DDEEIRTTNPVATEQYGSVAMNLQRGTR

SEQ ID NO: 20637 - protein, 29 aa, Artificial Sequence
  Description of Artificial Sequence: Synthetic peptide
DEEEIRTTNPVATEQYGSVSTNLEVEGER

SEQ ID NO: 20638 - protein, 28 aa, Artificial Sequence
  Description of Artificial Sequence: Synthetic peptide
DEHEIRTTNPVCTEVYGSVSTNLQRGNI

SEQ ID NO: 20639 - protein, 28 aa, Artificial Sequence
  Description of Artificial Sequence: Synthetic peptide
DEEEIRTTNPVSSEVYGSVSSNLQRGNR

SEQ ID NO: 20640 - protein, 30 aa, Artificial Sequence
  Description of Artificial Sequence: Synthetic polypeptide
DEHEIRTTNPVATEQYGSVSEMNLQRNGNR

SEQ ID NO: 20641 - protein, 28 aa, Artificial Sequence
  Description of Artificial Sequence: Synthetic peptide
DEEEIRTTNPVASEQYGNVSMNLQRGTR

SEQ ID NO: 20642 - protein, 28 aa, Artificial Sequence
  Description of Artificial Sequence: Synthetic peptide
DEEEIRTTNPVATEQYGSVSEDLQHGNC

SEQ ID NO: 20643 - protein, 29 aa, Artificial Sequence
  Description of Artificial Sequence: Synthetic peptide
DEEEIMTVNPCATEQYGSVSTNLQQRGNR

SEQ ID NO: 20644 - protein, 28 aa, Artificial Sequence
  Description of Artificial Sequence: Synthetic peptide
DEEEIRTTNPVATEQWGSVSTNEQQGNF

SEQ ID NO: 20645 - protein, 28 aa, Artificial Sequence
  Description of Artificial Sequence: Synthetic peptide
DEEEIAQTNPVATEVYGSVSENLQRGNR

SEQ ID NO: 20646 - protein, 28 aa, Artificial Sequence
  Description of Artificial Sequence: Synthetic peptide
DENEIRTTNPVATELYGSVSTNLQRGTA

SEQ ID NO: 20647 - protein, 28 aa, Artificial Sequence
  Description of Artificial Sequence: Synthetic peptide
DEEEIRTTNPVATEQYGCVSSEDQRGNR

SEQ ID NO: 20648 - protein, 28 aa, Artificial Sequence
  Description of Artificial Sequence: Synthetic peptide
DEEEIVTTNPVATEQYGSVSTELQVGNS

SEQ ID NO: 20649 - protein, 28 aa, Artificial Sequence
  Description of Artificial Sequence: Synthetic peptide
DEEEIRTTNPVATEQFGSVSTNLQGGTE

SEQ ID NO: 20650 - protein, 28 aa, Artificial Sequence
  Description of Artificial Sequence: Synthetic peptide
DEEEIRTTNPVATEQYGVVSEELQRGNF

SEQ ID NO: 20651 - protein, 28 aa, Artificial Sequence
  Description of Artificial Sequence: Synthetic peptide
DEGEIRTTNPVATEQYGGVSTNLQTGNS

SEQ ID NO: 20652 - protein, 29 aa, Artificial Sequence
  Description of Artificial Sequence: Synthetic peptide
DEEEIRTTNPVATEQYGSVETNLDMKGNR

SEQ ID NO: 20653 - protein, 28 aa, Artificial Sequence
  Description of Artificial Sequence: Synthetic peptide
SEEEIRTTNPVATEQYGSYSTNDQQGNR

SEQ ID NO: 20654 - protein, 29 aa, Artificial Sequence
  Description of Artificial Sequence: Synthetic peptide
DENEIATTNPVATEQYGSVSTNLQRGEND

SEQ ID NO: 20655 - protein, 28 aa, Artificial Sequence
  Description of Artificial Sequence: Synthetic peptide
DEEEIRTTNPVATEQYGSVSTNPQEGEF

SEQ ID NO: 20656 - protein, 30 aa, Artificial Sequence
  Description of Artificial Sequence: Synthetic polypeptide
DEEEIRTTNPVATEQYGSVSTNLVQVGGNM

SEQ ID NO: 20657 - protein, 28 aa, Artificial Sequence
  Description of Artificial Sequence: Synthetic peptide
DEQEIRATNPVATEIYGSVATNLQRGNR

SEQ ID NO: 20658 - protein, 28 aa, Artificial Sequence
  Description of Artificial Sequence: Synthetic peptide
DEEEIRTTNPVATEQYGSVSTELQAGEF

SEQ ID NO: 20659 - protein, 28 aa, Artificial Sequence
  Description of Artificial Sequence: Synthetic peptide
DEQEIRCTNPVATEVYGAVSTNLQRGNR

SEQ ID NO: 20660 - protein, 28 aa, Artificial Sequence
  Description of Artificial Sequence: Synthetic peptide
DEEEIRTTNPVATEQYGSVDTELQHGNF

SEQ ID NO: 20661 - protein, 30 aa, Artificial Sequence
  Description of Artificial Sequence: Synthetic polypeptide
DEEEIRTTNPVATEQFGVVSTENLQERGNR

SEQ ID NO: 20662 - protein, 28 aa, Artificial Sequence
  Description of Artificial Sequence: Synthetic peptide
DEEEIRTTNPVATECYGSISTNECRGNR

SEQ ID NO: 20663 - protein, 28 aa, Artificial Sequence
  Description of Artificial Sequence: Synthetic peptide
DEEEIRTTNPVATEQYGSVSTNQEVGNI

SEQ ID NO: 20664 - protein, 29 aa, Artificial Sequence
  Description of Artificial Sequence: Synthetic peptide
DEEEIRTTNPVATEKWGMSVSTNDQRGNR

SEQ ID NO: 20665 - protein, 28 aa, Artificial Sequence
  Description of Artificial Sequence: Synthetic peptide
DEEEIRTTNPVATEYYGSYSTNLQGGNN

SEQ ID NO: 20666 - protein, 28 aa, Artificial Sequence
  Description of Artificial Sequence: Synthetic peptide
VEEEIRTTNPVATEQYGSVSTNDDPGNR

SEQ ID NO: 20667 - protein, 29 aa, Artificial Sequence
  Description of Artificial Sequence: Synthetic peptide
DEEEIRTTNPVATEQYGSVSTDLQNGNDM

SEQ ID NO: 20668 - protein, 28 aa, Artificial Sequence
  Description of Artificial Sequence: Synthetic peptide
DEEEIRATNPVSTELYGTVSTNLQRGNR

SEQ ID NO: 20669 - protein, 28 aa, Artificial Sequence
  Description of Artificial Sequence: Synthetic peptide
DEEEIRPTNPVATEQYGSVSTNLIIGNT

SEQ ID NO: 20670 - protein, 29 aa, Artificial Sequence
  Description of Artificial Sequence: Synthetic peptide
DEIEIRTTNPVATEQYGSVSTNLQSGPNA

SEQ ID NO: 20671 - protein, 29 aa, Artificial Sequence
  Description of Artificial Sequence: Synthetic peptide
NEEEIATTNPVATEQYGSVSTMNLQRGNS

SEQ ID NO: 20672 - protein, 28 aa, Artificial Sequence
  Description of Artificial Sequence: Synthetic peptide
DEEEIRTTNPVATEQYGSVSTPDDRGNL

SEQ ID NO: 20673 - protein, 28 aa, Artificial Sequence
  Description of Artificial Sequence: Synthetic peptide
DEEEIRTTNPCATEPYGAVSSNLQRGNR

SEQ ID NO: 20674 - protein, 30 aa, Artificial Sequence
  Description of Artificial Sequence: Synthetic polypeptide
DEEEIRTTNPVATEQYGSMVSTYLQYRGNA

SEQ ID NO: 20675 - protein, 28 aa, Artificial Sequence
  Description of Artificial Sequence: Synthetic peptide
MEEEIRTVNPVATEQYGSVSTELQRGNH

SEQ ID NO: 20676 - protein, 28 aa, Artificial Sequence
  Description of Artificial Sequence: Synthetic peptide
KENEIRTTNPVATEQYGSVSTDLQRGNN

SEQ ID NO: 20677 - protein, 28 aa, Artificial Sequence
  Description of Artificial Sequence: Synthetic peptide
DENEIRTTNPVATEQYGSVSTDLQSGNA

SEQ ID NO: 20678 - protein, 28 aa, Artificial Sequence
  Description of Artificial Sequence: Synthetic peptide
DEEEIRATNPVSTEQYGSVSTNDQRGNA

SEQ ID NO: 20679 - protein, 28 aa, Artificial Sequence
  Description of Artificial Sequence: Synthetic peptide
DEEEIRTTNPVATDQYGSVSTNLQHLNP

SEQ ID NO: 20680 - protein, 29 aa, Artificial Sequence
  Description of Artificial Sequence: Synthetic peptide
DEEEIATTNPVATECYGSVDTNLQRGNDR

SEQ ID NO: 20681 - protein, 30 aa, Artificial Sequence
  Description of Artificial Sequence: Synthetic polypeptide
NEEEIRTTNPVATEQYGMSVSQNNLQRGNR

SEQ ID NO: 20682 - protein, 28 aa, Artificial Sequence
  Description of Artificial Sequence: Synthetic peptide
DEEEIRTTNPVATEIYGSVSTDLQAGNI

SEQ ID NO: 20683 - protein, 28 aa, Artificial Sequence
  Description of Artificial Sequence: Synthetic peptide
DENEIATTNPVATEQYGSVSDNLQVGNR

SEQ ID NO: 20684 - protein, 28 aa, Artificial Sequence
  Description of Artificial Sequence: Synthetic peptide
DEAEIRTTNPVATEQYGSVSENTQRGDR

SEQ ID NO: 20685 - protein, 28 aa, Artificial Sequence
  Description of Artificial Sequence: Synthetic peptide
DEQEIVTTNPVATECYGWVSTNLQRGNR

SEQ ID NO: 20686 - protein, 30 aa, Artificial Sequence
  Description of Artificial Sequence: Synthetic polypeptide
DENEIRTTNPVATEQYGSVSTNLQENGNDR

SEQ ID NO: 20687 - protein, 28 aa, Artificial Sequence
  Description of Artificial Sequence: Synthetic peptide
DEEEIRTTNPVATEQFGSVSENEQRGNG

SEQ ID NO: 20688 - protein, 30 aa, Artificial Sequence
  Description of Artificial Sequence: Synthetic polypeptide
DEEEIRTTNPVATEHYGSLVCFTNLQRGNR

SEQ ID NO: 20689 - protein, 28 aa, Artificial Sequence
  Description of Artificial Sequence: Synthetic peptide
NEEEIRATNPVATECYGSVSYNLQRGNR

SEQ ID NO: 20690 - protein, 28 aa, Artificial Sequence
  Description of Artificial Sequence: Synthetic peptide
QENEIRTTNPVATECYGSVSTNLQRGNT

SEQ ID NO: 20691 - protein, 32 aa, Artificial Sequence
  Description of Artificial Sequence: Synthetic polypeptide
DEEEIRTTNPVATEQYGESVDSTNLIQVRGNR

SEQ ID NO: 20692 - protein, 28 aa, Artificial Sequence
  Description of Artificial Sequence: Synthetic peptide
DEEEIRTTNPDATEQYGSVSTPLQRGEN

SEQ ID NO: 20693 - protein, 28 aa, Artificial Sequence
  Description of Artificial Sequence: Synthetic peptide
DEEEIRTTNPVATEQYGDVSEDLQNGNR

SEQ ID NO: 20694 - protein, 29 aa, Artificial Sequence
  Description of Artificial Sequence: Synthetic peptide
DEEEIRTTNPVATEQWGSVSTNLQMTGNF

SEQ ID NO: 20695 - protein, 29 aa, Artificial Sequence
  Description of Artificial Sequence: Synthetic peptide
DEDEIRTTNPVATEQYGSVSTDLPQRGNF

SEQ ID NO: 20696 - protein, 28 aa, Artificial Sequence
  Description of Artificial Sequence: Synthetic peptide
NEEEIRTTNPVATEQYGSASTPLTRGNR

SEQ ID NO: 20697 - protein, 28 aa, Artificial Sequence
  Description of Artificial Sequence: Synthetic peptide
QEEEIVTTNPVATEQYGSASTVLQRGNR

SEQ ID NO: 20698 - protein, 28 aa, Artificial Sequence
  Description of Artificial Sequence: Synthetic peptide
DEEEIRCTNPVSTEWYGSVSTNLQRGNF

SEQ ID NO: 20699 - protein, 28 aa, Artificial Sequence
  Description of Artificial Sequence: Synthetic peptide
DEEEIRCTNPVATELYGSVSTNLQNGNI

SEQ ID NO: 20700 - protein, 29 aa, Artificial Sequence
  Description of Artificial Sequence: Synthetic peptide
DEEEIRTTNPVATEQYGGSVSNNLQRGEF

SEQ ID NO: 20701 - protein, 30 aa, Artificial Sequence
  Description of Artificial Sequence: Synthetic polypeptide
DEEEIRTTNPVATEQYGSVSSTNPLQDGNF

SEQ ID NO: 20702 - protein, 28 aa, Artificial Sequence
  Description of Artificial Sequence: Synthetic peptide
KEEEISTTNPVATEQYGSVFTMLQRGNR

SEQ ID NO: 20703 - protein, 28 aa, Artificial Sequence
  Description of Artificial Sequence: Synthetic peptide
NEEEIWTTNPVSTEQYGSTSTNLQRGNR

SEQ ID NO: 20704 - protein, 30 aa, Artificial Sequence
  Description of Artificial Sequence: Synthetic polypeptide
DEEEIRTTNPVATEQYGSVSTDLQQRAGNA

SEQ ID NO: 20705 - protein, 28 aa, Artificial Sequence
  Description of Artificial Sequence: Synthetic peptide
DEVEIRTTNPVATEMYGEVGTNLQRGNR

SEQ ID NO: 20706 - protein, 29 aa, Artificial Sequence
  Description of Artificial Sequence: Synthetic peptide
DEEEIRTTNPVATEQYGVIVETNLQRGTR

SEQ ID NO: 20707 - protein, 31 aa, Artificial Sequence
  Description of Artificial Sequence: Synthetic polypeptide
DEEEIRTTNPVATEQYGSVSSATNLQPGQNR

SEQ ID NO: 20708 - protein, 30 aa, Artificial Sequence
  Description of Artificial Sequence: Synthetic polypeptide
DEEEIRTTNPDATEQYGSVSCTNLIRGTNR

SEQ ID NO: 20709 - protein, 28 aa, Artificial Sequence
  Description of Artificial Sequence: Synthetic peptide
DEEEIRCTNPVATEQYGSVSNDLQRGND

SEQ ID NO: 20710 - protein, 28 aa, Artificial Sequence
  Description of Artificial Sequence: Synthetic peptide
DEEEIRSTNPCATEQYGSVDTNEQRGNR

SEQ ID NO: 20711 - protein, 28 aa, Artificial Sequence
  Description of Artificial Sequence: Synthetic peptide
DEGEIRTTNPVATEQYGSVSTNLQLGTF

SEQ ID NO: 20712 - protein, 28 aa, Artificial Sequence
  Description of Artificial Sequence: Synthetic peptide
DEEEIRTTNPVATQQYGSVSTGDQRGER

SEQ ID NO: 20713 - protein, 28 aa, Artificial Sequence
  Description of Artificial Sequence: Synthetic peptide
DEEEIRATNPVATEQYGSVSDNLQQGNQ

SEQ ID NO: 20714 - protein, 28 aa, Artificial Sequence
  Description of Artificial Sequence: Synthetic peptide
DEEEIRTTNPVATEQYGSVSTCPQYGER

SEQ ID NO: 20715 - protein, 30 aa, Artificial Sequence
  Description of Artificial Sequence: Synthetic polypeptide
DEEEIRTTNPVAIEQYGSVSTANLTRGDNR

SEQ ID NO: 20716 - protein, 28 aa, Artificial Sequence
  Description of Artificial Sequence: Synthetic peptide
DEEEIRTTNPVATEQYGSVSTNLEIGEN

SEQ ID NO: 20717 - protein, 28 aa, Artificial Sequence
  Description of Artificial Sequence: Synthetic peptide
DEEEIRTTNPTATEQFGEVSTLLQRGNR

SEQ ID NO: 20718 - protein, 30 aa, Artificial Sequence
  Description of Artificial Sequence: Synthetic polypeptide
DEEEIRTTNPVATEQYGSVSTLDDQRKGNR

SEQ ID NO: 20719 - protein, 29 aa, Artificial Sequence
  Description of Artificial Sequence: Synthetic peptide
DEEEIRTVNPVATEQYGSASATNLQRGNK

SEQ ID NO: 20720 - protein, 29 aa, Artificial Sequence
  Description of Artificial Sequence: Synthetic peptide
SEEEIRTTNPVATEQFGSVSTNLQRGVNN

SEQ ID NO: 20721 - protein, 28 aa, Artificial Sequence
  Description of Artificial Sequence: Synthetic peptide
DEEEIRTTNPVATELYGSVSTNLQFGLL

SEQ ID NO: 20722 - protein, 28 aa, Artificial Sequence
  Description of Artificial Sequence: Synthetic peptide
DEEEIRTTNPDATEQYGSVETNDQSGNR

SEQ ID NO: 20723 - protein, 29 aa, Artificial Sequence
  Description of Artificial Sequence: Synthetic peptide
DDEEIRTTNPVATEWYGSVSTALQRGNDR

SEQ ID NO: 20724 - protein, 28 aa, Artificial Sequence
  Description of Artificial Sequence: Synthetic peptide
DEQEIRSTNPVATEQYGSVSTNLQNGNS

SEQ ID NO: 20725 - protein, 28 aa, Artificial Sequence
  Description of Artificial Sequence: Synthetic peptide
DEEEIRTTNPVATEQYGSVSTELENGER

SEQ ID NO: 20726 - protein, 30 aa, Artificial Sequence
  Description of Artificial Sequence: Synthetic polypeptide
DEEEIRTTNPVATEQYGVVDTTNGLQRGNR

SEQ ID NO: 20727 - protein, 28 aa, Artificial Sequence
  Description of Artificial Sequence: Synthetic peptide
DEEEIRQTNPVSTEQYGSVSENLQRGGR

SEQ ID NO: 20728 - protein, 28 aa, Artificial Sequence
  Description of Artificial Sequence: Synthetic peptide
DEEEIRATNPVATEQYGSVSTDLENGNR

SEQ ID NO: 20729 - protein, 28 aa, Artificial Sequence
  Description of Artificial Sequence: Synthetic peptide
DEEEIRTTNPVATEQYGSVSTALFQGNV

SEQ ID NO: 20730 - protein, 28 aa, Artificial Sequence
  Description of Artificial Sequence: Synthetic peptide
DEHNIRTTNPVATEQCGSVSTNLQRENR

SEQ ID NO: 20731 - protein, 28 aa, Artificial Sequence
  Description of Artificial Sequence: Synthetic peptide
DEEEIVTTNPVATEQFGSVSTNLQCGER

SEQ ID NO: 20732 - protein, 28 aa, Artificial Sequence
  Description of Artificial Sequence: Synthetic peptide
DEEEITTTNPDATEMYGSVSTNLQRGNT

SEQ ID NO: 20733 - protein, 28 aa, Artificial Sequence
  Description of Artificial Sequence: Synthetic peptide
DEEEIRTTNPVATEQYGSVQGNLQGGNP

SEQ ID NO: 20734 - protein, 28 aa, Artificial Sequence
  Description of Artificial Sequence: Synthetic peptide
DEEEIMGTNPVATEQYGSVSENLQRGNI

SEQ ID NO: 20735 - protein, 28 aa, Artificial Sequence
  Description of Artificial Sequence: Synthetic peptide
DENEIRTTNPVAMEWYGSVSTPLQRGNR

SEQ ID NO: 20736 - protein, 28 aa, Artificial Sequence
  Description of Artificial Sequence: Synthetic peptide
DEEEVRTTNPVATEIYGCVATNLQRGNR

SEQ ID NO: 20737 - protein, 30 aa, Artificial Sequence
  Description of Artificial Sequence: Synthetic polypeptide
DEEEIRTTNPVATEQYGVSVFTNLVQRGLR

SEQ ID NO: 20738 - protein, 28 aa, Artificial Sequence
  Description of Artificial Sequence: Synthetic peptide
DEEEIRSTNPVATEQYGSTSTNLQDGND

SEQ ID NO: 20739 - protein, 28 aa, Artificial Sequence
  Description of Artificial Sequence: Synthetic peptide
DEEEIRTTNPVATEQWGSVSTNEQQGNM

SEQ ID NO: 20740 - protein, 28 aa, Artificial Sequence
  Description of Artificial Sequence: Synthetic peptide
AEGEIRATNPVATEQYGSASTNLQRGNR

SEQ ID NO: 20741 - protein, 28 aa, Artificial Sequence
  Description of Artificial Sequence: Synthetic peptide
DEEEIRTTNPVATEQYGSVDTGPNRGNR

SEQ ID NO: 20742 - protein, 28 aa, Artificial Sequence
  Description of Artificial Sequence: Synthetic peptide
DEEEIRTTNPVATECYGSVSTNLQSGDM

SEQ ID NO: 20743 - protein, 29 aa, Artificial Sequence
  Description of Artificial Sequence: Synthetic peptide
DEEEIRTTNPVATELYGSVSTNLCCSGNR

SEQ ID NO: 20744 - protein, 28 aa, Artificial Sequence
  Description of Artificial Sequence: Synthetic peptide
DEEEIRSTNPVAYEQYGSVSTNLQPGTR

SEQ ID NO: 20745 - protein, 29 aa, Artificial Sequence
  Description of Artificial Sequence: Synthetic peptide
QEEEIRTTNPVATEQYGSVSENLTQRDNR

SEQ ID NO: 20746 - protein, 29 aa, Artificial Sequence
  Description of Artificial Sequence: Synthetic peptide
DEEEIRTTNPVATEQYGVVSTNLQEIGDR

SEQ ID NO: 20747 - protein, 28 aa, Artificial Sequence
  Description of Artificial Sequence: Synthetic peptide
DEQEIAATNPVATEQYGVVSTNLQRGNR

SEQ ID NO: 20748 - protein, 32 aa, Artificial Sequence
  Description of Artificial Sequence: Synthetic polypeptide
DEEEIRTTNPVATEQYGSVSTQNWLQRQGNDR

SEQ ID NO: 20749 - protein, 29 aa, Artificial Sequence
  Description of Artificial Sequence: Synthetic peptide
DEEEIRTTNPVATEQYGGVSDSNLQRGMR

SEQ ID NO: 20750 - protein, 28 aa, Artificial Sequence
  Description of Artificial Sequence: Synthetic peptide
DEEEIRTTNPVATEPYGTVGTNLQRGNF

SEQ ID NO: 20751 - protein, 28 aa, Artificial Sequence
  Description of Artificial Sequence: Synthetic peptide
QEMEIRTTNPVATEQYGSVSEVLQRGNR

SEQ ID NO: 20752 - protein, 28 aa, Artificial Sequence
  Description of Artificial Sequence: Synthetic peptide
DEEEIRTTNPVATEQYGSVHENLMRGNP

SEQ ID NO: 20753 - protein, 28 aa, Artificial Sequence
  Description of Artificial Sequence: Synthetic peptide
DEEEIRTTNPVASEIYGCVSMNLQRGNR

SEQ ID NO: 20754 - protein, 28 aa, Artificial Sequence
  Description of Artificial Sequence: Synthetic peptide
DEEEIRCTNPVATEQYGDVSTTLQRGNH

SEQ ID NO: 20755 - protein, 32 aa, Artificial Sequence
  Description of Artificial Sequence: Synthetic polypeptide
DEEEIRTTNPVATEQYGSVCSTENLQRKGENR

SEQ ID NO: 20756 - protein, 28 aa, Artificial Sequence
  Description of Artificial Sequence: Synthetic peptide
DEEEIRTTNPVATEQYGSVSDNLEHGNW

SEQ ID NO: 20757 - protein, 31 aa, Artificial Sequence
  Description of Artificial Sequence: Synthetic polypeptide
DEEEIRTTNPVCTEQYGSVSTNLQMRDGNER

SEQ ID NO: 20758 - protein, 28 aa, Artificial Sequence
  Description of Artificial Sequence: Synthetic peptide
DEEEIRTTNPVATEQFGSVSTNDQNGLR

SEQ ID NO: 20759 - protein, 28 aa, Artificial Sequence
  Description of Artificial Sequence: Synthetic peptide
DEEEIRTTNPTATEQYGSVSTNEQIGNA

SEQ ID NO: 20760 - protein, 29 aa, Artificial Sequence
  Description of Artificial Sequence: Synthetic peptide
KEEEIRTTNPVATEQYGSVSTMDLQHGNR

SEQ ID NO: 20761 - protein, 29 aa, Artificial Sequence
  Description of Artificial Sequence: Synthetic peptide
DEEEIRATNPVATEQYGSVSMNLQESGNR

SEQ ID NO: 20762 - protein, 30 aa, Artificial Sequence
  Description of Artificial Sequence: Synthetic polypeptide
DEEEIYTTNPVATEQYGTVSTVNLQNRGNR

SEQ ID NO: 20763 - protein, 29 aa, Artificial Sequence
  Description of Artificial Sequence: Synthetic peptide
DEVEIRTTNPTATEQYGSVSTNLQEVGNR

SEQ ID NO: 20764 - protein, 30 aa, Artificial Sequence
  Description of Artificial Sequence: Synthetic polypeptide
DEEEIRTTNPVAYEQYGSVSTCNLQRGNTF

SEQ ID NO: 20765 - protein, 31 aa, Artificial Sequence
  Description of Artificial Sequence: Synthetic polypeptide
QEEEIRTTNPVATEQYGSVCSTNLQRGFNDR

SEQ ID NO: 20766 - protein, 28 aa, Artificial Sequence
  Description of Artificial Sequence: Synthetic peptide
FEEEIRTTNPVATEQYGSVSENIQRGMR

SEQ ID NO: 20767 - protein, 28 aa, Artificial Sequence
  Description of Artificial Sequence: Synthetic peptide
KEEEIRTTNPVATECYGSVSTNLQRGDQ

SEQ ID NO: 20768 - protein, 28 aa, Artificial Sequence
  Description of Artificial Sequence: Synthetic peptide
DEEEIRTTNPVATEQYGSVSTELETGNI

SEQ ID NO: 20769 - protein, 28 aa, Artificial Sequence
  Description of Artificial Sequence: Synthetic peptide
DEEEIRTTNPTATEQYGSVSTNPQFGNE

SEQ ID NO: 20770 - protein, 28 aa, Artificial Sequence
  Description of Artificial Sequence: Synthetic peptide
DETEIIATNPVATEVYGSVSTNLQRGNR

SEQ ID NO: 20771 - protein, 28 aa, Artificial Sequence
  Description of Artificial Sequence: Synthetic peptide
DDEEIRCTNPVATEIYGCVSTNLQRGNR

SEQ ID NO: 20772 - protein, 28 aa, Artificial Sequence
  Description of Artificial Sequence: Synthetic peptide
DEEEIRTTNPVATECYGSVSTNLESGND

SEQ ID NO: 20773 - protein, 28 aa, Artificial Sequence
  Description of Artificial Sequence: Synthetic peptide
DEQEIRTTNPVATEQYGSVSTNLEHGNN

SEQ ID NO: 20774 - protein, 28 aa, Artificial Sequence
  Description of Artificial Sequence: Synthetic peptide
DEEEIRTTNPVATAQYGSVSTGLQNGNG

SEQ ID NO: 20775 - protein, 28 aa, Artificial Sequence
  Description of Artificial Sequence: Synthetic peptide
DEEEIRCTNPVATEIYGSASTNLQRGER

SEQ ID NO: 20776 - protein, 28 aa, Artificial Sequence
  Description of Artificial Sequence: Synthetic peptide
DEEEIRTTNPVATEQYGSVSTCLDRGDD

SEQ ID NO: 20777 - protein, 28 aa, Artificial Sequence
  Description of Artificial Sequence: Synthetic peptide
DEEEIATTNPVATEQYGVVDTNLQRGNN

SEQ ID NO: 20778 - protein, 28 aa, Artificial Sequence
  Description of Artificial Sequence: Synthetic peptide
DEEEIGTTNPVATEQYGSVSENLQEGNC

SEQ ID NO: 20779 - protein, 28 aa, Artificial Sequence
  Description of Artificial Sequence: Synthetic peptide
DEEEIRTTNPVATEQYGSVSEDLQHGNS

SEQ ID NO: 20780 - protein, 28 aa, Artificial Sequence
  Description of Artificial Sequence: Synthetic peptide
DEEEIRTTNPVATEIYGSVSTNLQFGEH

SEQ ID NO: 20781 - protein, 29 aa, Artificial Sequence
  Description of Artificial Sequence: Synthetic peptide
DEEEISTTNPVATEQYGNVSENLQIRGNR

SEQ ID NO: 20782 - protein, 28 aa, Artificial Sequence
  Description of Artificial Sequence: Synthetic peptide
DEEEIRTTNPCCTEQYGSVSTNLQYGNI

SEQ ID NO: 20783 - protein, 28 aa, Artificial Sequence
  Description of Artificial Sequence: Synthetic peptide
DEEEIRTTNPVAYECYGSVSTNLQRGED

SEQ ID NO: 20784 - protein, 31 aa, Artificial Sequence
  Description of Artificial Sequence: Synthetic polypeptide
DEEEIRTTNPVATEQYGSVSMTNLQLRGNLP

SEQ ID NO: 20785 - protein, 28 aa, Artificial Sequence
  Description of Artificial Sequence: Synthetic peptide
DEIEIRTTNPVATEQYGSVSTNLQLGQD

SEQ ID NO: 20786 - protein, 29 aa, Artificial Sequence
  Description of Artificial Sequence: Synthetic peptide
DEEEIRTTNPVATEQCGSVSCTNLCRGND

SEQ ID NO: 20787 - protein, 28 aa, Artificial Sequence
  Description of Artificial Sequence: Synthetic peptide
DEEEIRTTNPVATEQYGSVSTEDQAGNF

SEQ ID NO: 20788 - protein, 28 aa, Artificial Sequence
  Description of Artificial Sequence: Synthetic peptide
DEEEIATTNPVATEQYGSVSTGQERGNR

SEQ ID NO: 20789 - protein, 29 aa, Artificial Sequence
  Description of Artificial Sequence: Synthetic peptide
DEEEIRTTNPVATEQYGDIASTNLQHGNR

SEQ ID NO: 20790 - protein, 28 aa, Artificial Sequence
  Description of Artificial Sequence: Synthetic peptide
DEEEIRTTNPVATQQYGSVSTELQDGNS

SEQ ID NO: 20791 - protein, 28 aa, Artificial Sequence
  Description of Artificial Sequence: Synthetic peptide
DEEEIRTTNPVATEQYGSVSTPPDYGNR

SEQ ID NO: 20792 - protein, 31 aa, Artificial Sequence
  Description of Artificial Sequence: Synthetic polypeptide
DEEEIRTTNPVATEQYGVSVISHNLQRGNNR

SEQ ID NO: 20793 - protein, 28 aa, Artificial Sequence
  Description of Artificial Sequence: Synthetic peptide
GEEEIRATNPCATENYGSVSTNLQRGNR

SEQ ID NO: 20794 - protein, 29 aa, Artificial Sequence
  Description of Artificial Sequence: Synthetic peptide
DEQEIRTTNPVATEQYGSVSTNLQEVGDR

SEQ ID NO: 20795 - protein, 29 aa, Artificial Sequence
  Description of Artificial Sequence: Synthetic peptide
DEEEIRTTNPVATEQYGSVSHPDQRGDNR

SEQ ID NO: 20796 - protein, 30 aa, Artificial Sequence
  Description of Artificial Sequence: Synthetic polypeptide
DEEEIRTTNPVATEQYGSVSTPPDQRGENR

SEQ ID NO: 20797 - protein, 28 aa, Artificial Sequence
  Description of Artificial Sequence: Synthetic peptide
DEEEIRTTNPTATEQYGSVSTNEQVGNF

SEQ ID NO: 20798 - protein, 28 aa, Artificial Sequence
  Description of Artificial Sequence: Synthetic peptide
DEEEIRTTNPVATEWYGIVSTNLERGNS

SEQ ID NO: 20799 - protein, 28 aa, Artificial Sequence
  Description of Artificial Sequence: Synthetic peptide
DEEEIAATNPVATENYGWVSTNLQRGNR

SEQ ID NO: 20800 - protein, 28 aa, Artificial Sequence
  Description of Artificial Sequence: Synthetic peptide
AEAEIRTTNPVATEQYGSVSTLLQRGER

SEQ ID NO: 20801 - protein, 28 aa, Artificial Sequence
  Description of Artificial Sequence: Synthetic peptide
DEQEIRATNPVATEIYGGVSTNLQRGNR

SEQ ID NO: 20802 - protein, 28 aa, Artificial Sequence
  Description of Artificial Sequence: Synthetic peptide
DEEEIRTTNPVATEQYGSVSTNEDWGNQ

SEQ ID NO: 20803 - protein, 29 aa, Artificial Sequence
  Description of Artificial Sequence: Synthetic peptide
DEEEIRTTNPVATEQYWSVSTNPQRDNDR

SEQ ID NO: 20804 - protein, 31 aa, Artificial Sequence
  Description of Artificial Sequence: Synthetic polypeptide
DEEEIRTTNPVATEQYGSVSTDDGLQREGNR

SEQ ID NO: 20805 - protein, 28 aa, Artificial Sequence
  Description of Artificial Sequence: Synthetic peptide
DEEEIRTTNPVATEQYGSVSNNLCHGNN

SEQ ID NO: 20806 - protein, 28 aa, Artificial Sequence
  Description of Artificial Sequence: Synthetic peptide
DEEEIATTNPIATEAYGSVSTNLQRPNR

SEQ ID NO: 20807 - protein, 28 aa, Artificial Sequence
  Description of Artificial Sequence: Synthetic peptide
DEEEIATTNPVATEQYGSVSTNEQQGNA

SEQ ID NO: 20808 - protein, 29 aa, Artificial Sequence
  Description of Artificial Sequence: Synthetic peptide
DEEEIRTTNPVATEQFGSVSTNPLQRFNQ

SEQ ID NO: 20809 - protein, 28 aa, Artificial Sequence
  Description of Artificial Sequence: Synthetic peptide
DEEEIRTTNPVATECYGSVSTDLQRGEH

SEQ ID NO: 20810 - protein, 28 aa, Artificial Sequence
  Description of Artificial Sequence: Synthetic peptide
DEEEIRTTNPVATEMYGCVSTNLQFGNV

SEQ ID NO: 20811 - protein, 30 aa, Artificial Sequence
  Description of Artificial Sequence: Synthetic polypeptide
DEVEIRTTNPVATEQYGGVSTNLQREGDNR

SEQ ID NO: 20812 - protein, 29 aa, Artificial Sequence
  Description of Artificial Sequence: Synthetic peptide
DEEEIRTTNPIATEQYGCVSTNLQFVGNR

SEQ ID NO: 20813 - protein, 28 aa, Artificial Sequence
  Description of Artificial Sequence: Synthetic peptide
DEEEITTVNPVSTEQYGSVATNLQRGNR

SEQ ID NO: 20814 - protein, 28 aa, Artificial Sequence
  Description of Artificial Sequence: Synthetic peptide
QENEIRTTNPVATEQYGSVSTVLQRENR

SEQ ID NO: 20815 - protein, 28 aa, Artificial Sequence
  Description of Artificial Sequence: Synthetic peptide
DEEEIATTNPVATECYGSVSTNLQRGEL

SEQ ID NO: 20816 - protein, 29 aa, Artificial Sequence
  Description of Artificial Sequence: Synthetic peptide
DEEEIRTTNPEATEVYGSVSTNLVNRGNR

SEQ ID NO: 20817 - protein, 30 aa, Artificial Sequence
  Description of Artificial Sequence: Synthetic polypeptide
DEEEIRTTNPVATEQYGSVSTNLERKGEPR

SEQ ID NO: 20818 - protein, 28 aa, Artificial Sequence
  Description of Artificial Sequence: Synthetic peptide
DEEEIRSTNPVATEQYGIVSTCLQVGNR

SEQ ID NO: 20819 - protein, 28 aa, Artificial Sequence
  Description of Artificial Sequence: Synthetic peptide
DEEEIRTTNPVATEQYGSVSTELEGGER

SEQ ID NO: 20820 - protein, 29 aa, Artificial Sequence
  Description of Artificial Sequence: Synthetic peptide
DEEEIRTTNPVATECYGSVSTNLQMQGNM

SEQ ID NO: 20821 - protein, 28 aa, Artificial Sequence
  Description of Artificial Sequence: Synthetic peptide
DEEEIRPTNPVATEQYGSVATGLQRGNI

SEQ ID NO: 20822 - protein, 28 aa, Artificial Sequence
  Description of Artificial Sequence: Synthetic peptide
DEQEIRCTNPIASEQYGSVSTNLQRGNR

SEQ ID NO: 20823 - protein, 28 aa, Artificial Sequence
  Description of Artificial Sequence: Synthetic peptide
KEEEIRTTNPVATEQYGSVSTDLQTGNL

SEQ ID NO: 20824 - protein, 29 aa, Artificial Sequence
  Description of Artificial Sequence: Synthetic peptide
DEVEIATTNPVATEQYGSVSTNLQQGDNR

SEQ ID NO: 20825 - protein, 31 aa, Artificial Sequence
  Description of Artificial Sequence: Synthetic polypeptide
DEEEIRTTNPVATEQYGSVSATNGLVQRGND

SEQ ID NO: 20826 - protein, 28 aa, Artificial Sequence
  Description of Artificial Sequence: Synthetic peptide
VEEEIRTTNPVATEIYGSVSTNLQRPND

SEQ ID NO: 20827 - protein, 30 aa, Artificial Sequence
  Description of Artificial Sequence: Synthetic polypeptide
DEEEIRTTNPVATEQYGGVSTMNLQQEGNR

SEQ ID NO: 20828 - protein, 28 aa, Artificial Sequence
  Description of Artificial Sequence: Synthetic peptide
DEEEIRTTNPTATEQYGSVSTNEQNGNS

SEQ ID NO: 20829 - protein, 28 aa, Artificial Sequence
  Description of Artificial Sequence: Synthetic peptide
DEEEIRCTNPVATEQYGAASTNDQRGNR

SEQ ID NO: 20830 - protein, 28 aa, Artificial Sequence
  Description of Artificial Sequence: Synthetic peptide
DEEEIRTTNPVATEQYGSVSTDLQIGEG

SEQ ID NO: 20831 - protein, 28 aa, Artificial Sequence
  Description of Artificial Sequence: Synthetic peptide
DEEEIRTTNPVATEQYGSVSTDLELGNV

SEQ ID NO: 20832 - protein, 28 aa, Artificial Sequence
  Description of Artificial Sequence: Synthetic peptide
DPEEIRTTNPVATQQYGSVSTNDQDGNR

SEQ ID NO: 20833 - protein, 30 aa, Artificial Sequence
  Description of Artificial Sequence: Synthetic polypeptide
DEVEIRTTNPVATEQYGSVSTNEQRGDNDR

SEQ ID NO: 20834 - protein, 28 aa, Artificial Sequence
  Description of Artificial Sequence: Synthetic peptide
SEEEIRATNPVAWEQYGSVSTNLYRGNR

SEQ ID NO: 20835 - protein, 28 aa, Artificial Sequence
  Description of Artificial Sequence: Synthetic peptide
DEEEIRTTNPVATEQYGVCATNLERGNR

SEQ ID NO: 20836 - protein, 29 aa, Artificial Sequence
  Description of Artificial Sequence: Synthetic peptide
DENEITTTNPVATEQYGSVSTNLQCRGNQ

SEQ ID NO: 20837 - protein, 28 aa, Artificial Sequence
  Description of Artificial Sequence: Synthetic peptide
DEEEIRATNPVATEQYGSASTNLQHGNM

SEQ ID NO: 20838 - protein, 28 aa, Artificial Sequence
  Description of Artificial Sequence: Synthetic peptide
DEEEIRCTNPVATEQYGCVSMNLERGNR

SEQ ID NO: 20839 - protein, 30 aa, Artificial Sequence
  Description of Artificial Sequence: Synthetic polypeptide
DEEEIRTTNPVATEQYGSVSATNLVQHGNA

SEQ ID NO: 20840 - protein, 28 aa, Artificial Sequence
  Description of Artificial Sequence: Synthetic peptide
DEEEIRTTNPVCTEQYGSVSTEDQNGNR

SEQ ID NO: 20841 - protein, 28 aa, Artificial Sequence
  Description of Artificial Sequence: Synthetic peptide
SEEEIRTVNPVCTEQYGSVSTNLIRGNR

SEQ ID NO: 20842 - protein, 28 aa, Artificial Sequence
  Description of Artificial Sequence: Synthetic peptide
DEEEIRTTNPVATEQWGSVSTNLMIGNM

SEQ ID NO: 20843 - protein, 28 aa, Artificial Sequence
  Description of Artificial Sequence: Synthetic peptide
DEEEIRTTNPVATEQYGSVHTNDIPGNR

SEQ ID NO: 20844 - protein, 30 aa, Artificial Sequence
  Description of Artificial Sequence: Synthetic polypeptide
DEEEIRTTNPVATEQYGSVSTGLQERGDNN

SEQ ID NO: 20845 - protein, 28 aa, Artificial Sequence
  Description of Artificial Sequence: Synthetic peptide
DEEEIRTTNPTATEQYGSVSTNEQIGNN

SEQ ID NO: 20846 - protein, 28 aa, Artificial Sequence
  Description of Artificial Sequence: Synthetic peptide
HEEEITTTNPVATNQYGSVSTELQRGNR

SEQ ID NO: 20847 - protein, 28 aa, Artificial Sequence
  Description of Artificial Sequence: Synthetic peptide
QEEEIRTTNPVATEQYGSVSTNLERGEA

SEQ ID NO: 20848 - protein, 28 aa, Artificial Sequence
  Description of Artificial Sequence: Synthetic peptide
DEEEICCTNPVATEQYGSVSTNLQLGNH

SEQ ID NO: 20849 - protein, 28 aa, Artificial Sequence
  Description of Artificial Sequence: Synthetic peptide
DEQEIMTTNPVATEQYGSVSTNYQFGNR

SEQ ID NO: 20850 - protein, 30 aa, Artificial Sequence
  Description of Artificial Sequence: Synthetic polypeptide
DEEEIRTTNPVATEQYGSVSCTDLQHNGNR

SEQ ID NO: 20851 - protein, 28 aa, Artificial Sequence
  Description of Artificial Sequence: Synthetic peptide
DEEEIRTTNPVAYEQYGSVSTPLQRGEN

SEQ ID NO: 20852 - protein, 29 aa, Artificial Sequence
  Description of Artificial Sequence: Synthetic peptide
DEEEIRTTNPVATEQYGSVSTPLQRGEPF

SEQ ID NO: 20853 - protein, 28 aa, Artificial Sequence
  Description of Artificial Sequence: Synthetic peptide
DENEIRTTNPVATEQYGSVSTDLQQGER

SEQ ID NO: 20854 - protein, 29 aa, Artificial Sequence
  Description of Artificial Sequence: Synthetic peptide
DEEEIRTTNPVATEQYGSVETDDLQRGNA

SEQ ID NO: 20855 - protein, 28 aa, Artificial Sequence
  Description of Artificial Sequence: Synthetic peptide
DEEEIRTTNPVATEQYGSVSTELQYGEG

SEQ ID NO: 20856 - protein, 30 aa, Artificial Sequence
  Description of Artificial Sequence: Synthetic polypeptide
DEEEIRTTNPVATQCYGSVSTNPLVQRGNR

SEQ ID NO: 20857 - protein, 28 aa, Artificial Sequence
  Description of Artificial Sequence: Synthetic peptide
DEEEIRTTNPVCTEQWGSVSTNLMRGNF

SEQ ID NO: 20858 - protein, 29 aa, Artificial Sequence
  Description of Artificial Sequence: Synthetic peptide
DENEIRTTNPVATEQYGSVSENEQMRGNR

SEQ ID NO: 20859 - protein, 28 aa, Artificial Sequence
  Description of Artificial Sequence: Synthetic peptide
DENEIRTTNPVATECYGSVSTNLQTGNL

SEQ ID NO: 20860 - protein, 28 aa, Artificial Sequence
  Description of Artificial Sequence: Synthetic peptide
DEEEIRCTNPVATEPYGAVATNLQRGNR

SEQ ID NO: 20861 - protein, 28 aa, Artificial Sequence
  Description of Artificial Sequence: Synthetic peptide
DEEEIRTTNPVATEQYGSVSTDLEVGNL

SEQ ID NO: 20862 - protein, 28 aa, Artificial Sequence
  Description of Artificial Sequence: Synthetic peptide
DEEEIRTVNPVATEQYGSASENLQHGNR

SEQ ID NO: 20863 - protein, 30 aa, Artificial Sequence
  Description of Artificial Sequence: Synthetic polypeptide
DEEEIRTTNPVATEQYGVVSTGNLQDIGNR

SEQ ID NO: 20864 - protein, 30 aa, Artificial Sequence
  Description of Artificial Sequence: Synthetic polypeptide
DEEEIRTTNPVATEQYGSVSTDLQCRGNDA

SEQ ID NO: 20865 - protein, 31 aa, Artificial Sequence
  Description of Artificial Sequence: Synthetic polypeptide
DEEEIRTTNPVATEQYGSVSTMNLQDMGNDR

SEQ ID NO: 20866 - protein, 28 aa, Artificial Sequence
  Description of Artificial Sequence: Synthetic peptide
SEEEIRTTNPVATEQYGSVSANVQRGNP

SEQ ID NO: 20867 - protein, 28 aa, Artificial Sequence
  Description of Artificial Sequence: Synthetic peptide
DEQEIRTTNPVATEQYGGVGCNLQRGNR

SEQ ID NO: 20868 - protein, 28 aa, Artificial Sequence
  Description of Artificial Sequence: Synthetic peptide
DEEEIRTTNPFATEQYGSVSTGLIRGNE

SEQ ID NO: 20869 - protein, 29 aa, Artificial Sequence
  Description of Artificial Sequence: Synthetic peptide
DEQEIRTTNPVATEWYGSVSENLQNRGNR

SEQ ID NO: 20870 - protein, 28 aa, Artificial Sequence
  Description of Artificial Sequence: Synthetic peptide
SEEEIRTTNPTATEQYGSVSTNLQSGNF

SEQ ID NO: 20871 - protein, 28 aa, Artificial Sequence
  Description of Artificial Sequence: Synthetic peptide
DEEEIRTTNPVATEQYGSVSTDLQYGET

SEQ ID NO: 20872 - protein, 28 aa, Artificial Sequence
  Description of Artificial Sequence: Synthetic peptide
DEEEIRPTNPVATEQYGSVSNNDQRGER

SEQ ID NO: 20873 - protein, 28 aa, Artificial Sequence
  Description of Artificial Sequence: Synthetic peptide
DEEEIRTTNPVCTEQYGSVSTNLQHGGA

SEQ ID NO: 20874 - protein, 28 aa, Artificial Sequence
  Description of Artificial Sequence: Synthetic peptide
DEEEIVQTNPVATEQYGSVSTNQQRGNS

SEQ ID NO: 20875 - protein, 28 aa, Artificial Sequence
  Description of Artificial Sequence: Synthetic peptide
DEEEIRATNPFATEQFGSVSANLQRGNR

SEQ ID NO: 20876 - protein, 28 aa, Artificial Sequence
  Description of Artificial Sequence: Synthetic peptide
DENEIRTTNPVATEQYGSVSTNLEMGND

SEQ ID NO: 20877 - protein, 28 aa, Artificial Sequence
  Description of Artificial Sequence: Synthetic peptide
DEEEIRTTNPVATEVYGSVSTELQVGNN

SEQ ID NO: 20878 - protein, 28 aa, Artificial Sequence
  Description of Artificial Sequence: Synthetic peptide
DEQEIRTTNPVATEWYGSVDTNLQRGNL

SEQ ID NO: 20879 - protein, 28 aa, Artificial Sequence
  Description of Artificial Sequence: Synthetic peptide
DEQEIRTTNPDATEQYGSVSTDDQRGNR

SEQ ID NO: 20880 - protein, 28 aa, Artificial Sequence
  Description of Artificial Sequence: Synthetic peptide
QEEEITTTNPVATEQYGSVSTNLQIGER

SEQ ID NO: 20881 - protein, 28 aa, Artificial Sequence
  Description of Artificial Sequence: Synthetic peptide
DEEEVRTTNPVATEIYGSVSNNLERGNR

SEQ ID NO: 20882 - protein, 28 aa, Artificial Sequence
  Description of Artificial Sequence: Synthetic peptide
DEEEIRSTNPVATENYGCVSSNLQRGNR

SEQ ID NO: 20883 - protein, 28 aa, Artificial Sequence
  Description of Artificial Sequence: Synthetic peptide
DEEEIRTTNPVCTEQYGSVSTELQNGNH

SEQ ID NO: 20884 - protein, 28 aa, Artificial Sequence
  Description of Artificial Sequence: Synthetic peptide
NEEEIRTTNPVATEQYGSVSTNEQVGNA

SEQ ID NO: 20885 - protein, 30 aa, Artificial Sequence
  Description of Artificial Sequence: Synthetic polypeptide
QEEEIRTTNPVATEQYGSVSTENLQFNGNR

SEQ ID NO: 20886 - protein, 29 aa, Artificial Sequence
  Description of Artificial Sequence: Synthetic peptide
DENEIRTTNPVATEQYGDVSTTLQRGNGR

SEQ ID NO: 20887 - protein, 28 aa, Artificial Sequence
  Description of Artificial Sequence: Synthetic peptide
DEEEIRTTNPEATDQYGSVSVNLQRGER

SEQ ID NO: 20888 - protein, 29 aa, Artificial Sequence
  Description of Artificial Sequence: Synthetic peptide
DENEIRTTNPVATELYGSVSTNLQIVGNR

SEQ ID NO: 20889 - protein, 29 aa, Artificial Sequence
  Description of Artificial Sequence: Synthetic peptide
DEEEIRTTNPVATEQYGSVWCTNDQRGNV

SEQ ID NO: 20890 - protein, 28 aa, Artificial Sequence
  Description of Artificial Sequence: Synthetic peptide
DEEEIRTTNPVATEQYGSVSTNLEHGEN

SEQ ID NO: 20891 - protein, 28 aa, Artificial Sequence
  Description of Artificial Sequence: Synthetic peptide
DEEEIRTTNPVATEQYGEVSTNLNHGNW

SEQ ID NO: 20892 - protein, 28 aa, Artificial Sequence
  Description of Artificial Sequence: Synthetic peptide
DEEEIMTTNPVATEMYGSVSTNLQNGNQ

SEQ ID NO: 20893 - protein, 28 aa, Artificial Sequence
  Description of Artificial Sequence: Synthetic peptide
DEEEIVTTNPVATEQFGSISTNLQVGNR

SEQ ID NO: 20894 - protein, 28 aa, Artificial Sequence
  Description of Artificial Sequence: Synthetic peptide
DESELYTTNPVATEQYGSVSTLLQRGNR

SEQ ID NO: 20895 - protein, 28 aa, Artificial Sequence
  Description of Artificial Sequence: Synthetic peptide
QDEEIRQTNPVATEQYGEVSTNLQRGNR

SEQ ID NO: 20896 - protein, 28 aa, Artificial Sequence
  Description of Artificial Sequence: Synthetic peptide
MEEEIRTTNPVATECYGSVSTNLQNGND

SEQ ID NO: 20897 - protein, 28 aa, Artificial Sequence
  Description of Artificial Sequence: Synthetic peptide
DEEEIRTTNPVATEQYGSVSTNDEVGNW

SEQ ID NO: 20898 - protein, 30 aa, Artificial Sequence
  Description of Artificial Sequence: Synthetic polypeptide
DEEEIVTTNPVATEQYGSVSTNDQRKGNDR

SEQ ID NO: 20899 - protein, 28 aa, Artificial Sequence
  Description of Artificial Sequence: Synthetic peptide
DEEAIRTTNPVACEQYESVSTILQRGNR

SEQ ID NO: 20900 - protein, 28 aa, Artificial Sequence
  Description of Artificial Sequence: Synthetic peptide
FEEEIRTTNPVATEPYGSVSENLQRGNT

SEQ ID NO: 20901 - protein, 28 aa, Artificial Sequence
  Description of Artificial Sequence: Synthetic peptide
EDEELRTTNPVATEQYGSVGTNLQRGNR

SEQ ID NO: 20902 - protein, 30 aa, Artificial Sequence
  Description of Artificial Sequence: Synthetic polypeptide
DEEEIRTTNPVCTEQWGSVSTNLQRGNNER

SEQ ID NO: 20903 - protein, 30 aa, Artificial Sequence
  Description of Artificial Sequence: Synthetic polypeptide
DEEEIRTTNCVATEQYGSVPSMNLQRGDNR

SEQ ID NO: 20904 - protein, 29 aa, Artificial Sequence
  Description of Artificial Sequence: Synthetic peptide
DEEEIRTTNPVATEQYGSVSTNLQHGPTF

SEQ ID NO: 20905 - protein, 29 aa, Artificial Sequence
  Description of Artificial Sequence: Synthetic peptide
DEEEIRTTNPVATEQYGSVSTDLQNRMNL

SEQ ID NO: 20906 - protein, 28 aa, Artificial Sequence
  Description of Artificial Sequence: Synthetic peptide
DEEEIRTTNPVATEQYGTVSTNLDHGNM

SEQ ID NO: 20907 - protein, 29 aa, Artificial Sequence
  Description of Artificial Sequence: Synthetic peptide
DEEEISTTNPVATEQYGDVSTANLQRGNF

SEQ ID NO: 20908 - protein, 30 aa, Artificial Sequence
  Description of Artificial Sequence: Synthetic polypeptide
DEEEIRTTNPVATEQYGSVSTNGVDRGNPR

SEQ ID NO: 20909 - protein, 28 aa, Artificial Sequence
  Description of Artificial Sequence: Synthetic peptide
DEEEIRATNPVATEQYGSVSENLQIGNQ

SEQ ID NO: 20910 - protein, 29 aa, Artificial Sequence
  Description of Artificial Sequence: Synthetic peptide
DEEEIRTTNPVATEQWGSVSTNLQMQGNF

SEQ ID NO: 20911 - protein, 30 aa, Artificial Sequence
  Description of Artificial Sequence: Synthetic polypeptide
DEEEIRTTNPVATEQYWGSVSDTNDQPGNR

SEQ ID NO: 20912 - protein, 29 aa, Artificial Sequence
  Description of Artificial Sequence: Synthetic peptide
DEEEIRTTNPVATEQYGSVSEALERNGNR

SEQ ID NO: 20913 - protein, 28 aa, Artificial Sequence
  Description of Artificial Sequence: Synthetic peptide
DEEEIRTTNPVSTEQYGSVSTNLMVGNL

SEQ ID NO: 20914 - protein, 28 aa, Artificial Sequence
  Description of Artificial Sequence: Synthetic peptide
DENEIRTTNPVATEQYGSVSTCLCRENR

SEQ ID NO: 20915 - protein, 29 aa, Artificial Sequence
  Description of Artificial Sequence: Synthetic peptide
DEEEIRTTNPVATEQYGSVSTELQYGNDS

SEQ ID NO: 20916 - protein, 28 aa, Artificial Sequence
  Description of Artificial Sequence: Synthetic peptide
DEEEIRTTNPVATEQYGSVSTNPQQGEF

SEQ ID NO: 20917 - protein, 28 aa, Artificial Sequence
  Description of Artificial Sequence: Synthetic peptide
DEEEIRTTNPVATEQYGSVSTFLDNGNF

SEQ ID NO: 20918 - protein, 29 aa, Artificial Sequence
  Description of Artificial Sequence: Synthetic peptide
DEQEIRTTNPVATECYGSVSTNLQRKGNV

SEQ ID NO: 20919 - protein, 28 aa, Artificial Sequence
  Description of Artificial Sequence: Synthetic peptide
DEEEIRSTNPVATEMYGVVSTNLERGNR

SEQ ID NO: 20920 - protein, 29 aa, Artificial Sequence
  Description of Artificial Sequence: Synthetic peptide
DEEEIRTTNPVATEQYGSMSTPPLQRGER

SEQ ID NO: 20921 - protein, 28 aa, Artificial Sequence
  Description of Artificial Sequence: Synthetic peptide
DEQEIRTTNPVATEQYGSVSTNLMLGNF

SEQ ID NO: 20922 - protein, 28 aa, Artificial Sequence
  Description of Artificial Sequence: Synthetic peptide
DEEEIRATNPVSTEVYGSVGTNLQRGNR

SEQ ID NO: 20923 - protein, 29 aa, Artificial Sequence
  Description of Artificial Sequence: Synthetic peptide
DEEEIRTTNPVGTEQYGDVSENLQRVGNR

SEQ ID NO: 20924 - protein, 30 aa, Artificial Sequence
  Description of Artificial Sequence: Synthetic polypeptide
DEEEIRTTNPVATEQYGSVSTMNLQNEGNQ

SEQ ID NO: 20925 - protein, 28 aa, Artificial Sequence
  Description of Artificial Sequence: Synthetic peptide
DEEEIRTTNPVATEQYGSVSTELQPGEF

SEQ ID NO: 20926 - protein, 28 aa, Artificial Sequence
  Description of Artificial Sequence: Synthetic peptide
HEEELRTTNPVASEQYGSVSTELQRGNR

SEQ ID NO: 20927 - protein, 28 aa, Artificial Sequence
  Description of Artificial Sequence: Synthetic peptide
QENEIRTTNPVATECYGSVSTNLQTGNR

SEQ ID NO: 20928 - protein, 28 aa, Artificial Sequence
  Description of Artificial Sequence: Synthetic peptide
DEEEICTTNPVATEIYGSVSTNGQRGNY

SEQ ID NO: 20929 - protein, 28 aa, Artificial Sequence
  Description of Artificial Sequence: Synthetic peptide
DEQEIRTTNPVATEQYGSVSTDLQHGNL

SEQ ID NO: 20930 - protein, 29 aa, Artificial Sequence
  Description of Artificial Sequence: Synthetic peptide
QEEEIRTTNPVATEFYGSVSTNEQRGDNR

SEQ ID NO: 20931 - protein, 28 aa, Artificial Sequence
  Description of Artificial Sequence: Synthetic peptide
DEEEIRTTNPVATEQWGSVSTNLQQENA

SEQ ID NO: 20932 - protein, 29 aa, Artificial Sequence
  Description of Artificial Sequence: Synthetic peptide
QEQEIRTTNPVATEQYGDVSATNLQRGNR

SEQ ID NO: 20933 - protein, 31 aa, Artificial Sequence
  Description of Artificial Sequence: Synthetic polypeptide
DEEEIRTTNPVATEQYGSVSSTENLVDRGNR

SEQ ID NO: 20934 - protein, 28 aa, Artificial Sequence
  Description of Artificial Sequence: Synthetic peptide
DEEEIRTTNPVATEQYGSVSTELQNGDC

SEQ ID NO: 20935 - protein, 28 aa, Artificial Sequence
  Description of Artificial Sequence: Synthetic peptide
DEVEIATTNPVATEQYGSVSTNPQVGNR

SEQ ID NO: 20936 - protein, 28 aa, Artificial Sequence
  Description of Artificial Sequence: Synthetic peptide
DEEEIRATNPVATECYGSVSTNLQIGDR

SEQ ID NO: 20937 - protein, 31 aa, Artificial Sequence
  Description of Artificial Sequence: Synthetic polypeptide
DEEEIRTTNPVATEQYGSVETNLVQREGNDR

SEQ ID NO: 20938 - protein, 28 aa, Artificial Sequence
  Description of Artificial Sequence: Synthetic peptide
DCEEIRATNPVAYEQYGSVSTNLQRGNG

SEQ ID NO: 20939 - protein, 28 aa, Artificial Sequence
  Description of Artificial Sequence: Synthetic peptide
DEEEIRTTNPVATEQYGSVSEILQREER

SEQ ID NO: 20940 - protein, 28 aa, Artificial Sequence
  Description of Artificial Sequence: Synthetic peptide
DEEEIRTTNPVATEQYGSVSTELQHGDH

SEQ ID NO: 20941 - protein, 29 aa, Artificial Sequence
  Description of Artificial Sequence: Synthetic peptide
DEEEIAQTNPVATEQYGSVSTNLQCRGER

SEQ ID NO: 20942 - protein, 28 aa, Artificial Sequence
  Description of Artificial Sequence: Synthetic peptide
DEHEIATVNPVSTEQYGSVSTNLQRGNR

SEQ ID NO: 20943 - protein, 28 aa, Artificial Sequence
  Description of Artificial Sequence: Synthetic peptide
DEEEIRCTNPVCTEQYGSVSTNDQWGNR

SEQ ID NO: 20944 - protein, 28 aa, Artificial Sequence
  Description of Artificial Sequence: Synthetic peptide
QEEEIRGTNPVATEVYGSVSTELQRGNR

SEQ ID NO: 20945 - protein, 28 aa, Artificial Sequence
  Description of Artificial Sequence: Synthetic peptide
DEEEIRTTNPVATEQYGSVETPLDRGNP

SEQ ID NO: 20946 - protein, 29 aa, Artificial Sequence
  Description of Artificial Sequence: Synthetic peptide
DEEEIRTTNPVATEQYGSVSNNMQRGDNL

SEQ ID NO: 20947 - protein, 28 aa, Artificial Sequence
  Description of Artificial Sequence: Synthetic peptide
MEEEIRTTNPVATEQYGSVSTNIQPGNE

SEQ ID NO: 20948 - protein, 28 aa, Artificial Sequence
  Description of Artificial Sequence: Synthetic peptide
DEEEIRTTNPVATEQYGSVSTNEMRGDQ

SEQ ID NO: 20949 - protein, 29 aa, Artificial Sequence
  Description of Artificial Sequence: Synthetic peptide
DEQEIRTTNPVATEQWGSVSTNLQMRGDR

SEQ ID NO: 20950 - protein, 28 aa, Artificial Sequence
  Description of Artificial Sequence: Synthetic peptide
DEEEIRTTNPVATEQWGSVSTNEQQGNW

SEQ ID NO: 20951 - protein, 31 aa, Artificial Sequence
  Description of Artificial Sequence: Synthetic polypeptide
DEEEIRTTNPVATEQYGESVDSTPLQREGNR

SEQ ID NO: 20952 - protein, 28 aa, Artificial Sequence
  Description of Artificial Sequence: Synthetic peptide
DEEEIRSTNPVATEQYGSVSTNLQHGDY

SEQ ID NO: 20953 - protein, 29 aa, Artificial Sequence
  Description of Artificial Sequence: Synthetic peptide
DEEEIRTTNPVATEQWGSVSTNLMMRGDR

SEQ ID NO: 20954 - protein, 30 aa, Artificial Sequence
  Description of Artificial Sequence: Synthetic polypeptide
DEEEIRTTNPVATEQYGSVSDNGLQRKGNM

SEQ ID NO: 20955 - protein, 28 aa, Artificial Sequence
  Description of Artificial Sequence: Synthetic peptide
DEEEIRTTNPVATEQYGSVSTNDEVGNE

SEQ ID NO: 20956 - protein, 28 aa, Artificial Sequence
  Description of Artificial Sequence: Synthetic peptide
DEEEIVSTNPVATEIYGTVSTNLQRGNR

SEQ ID NO: 20957 - protein, 28 aa, Artificial Sequence
  Description of Artificial Sequence: Synthetic peptide
DEEEIRTTNPVATEQYGSVSTELQWGDQ

SEQ ID NO: 20958 - protein, 29 aa, Artificial Sequence
  Description of Artificial Sequence: Synthetic peptide
DEEEIRTTNPVATECYGSVSTELQDKGNR

SEQ ID NO: 20959 - protein, 29 aa, Artificial Sequence
  Description of Artificial Sequence: Synthetic peptide
DEEEIRTTNPVATEQYGSVSTNLQENGEV

SEQ ID NO: 20960 - protein, 28 aa, Artificial Sequence
  Description of Artificial Sequence: Synthetic peptide
DEEEIRTTNPVATEQYGSVSTADQYGNN

SEQ ID NO: 20961 - protein, 30 aa, Artificial Sequence
  Description of Artificial Sequence: Synthetic polypeptide
DEEEIRTTNPVATEQYGSVSTNLQITKGNS

SEQ ID NO: 20962 - protein, 28 aa, Artificial Sequence
  Description of Artificial Sequence: Synthetic peptide
DEEEISSTNPVATEQYGSVSTNLQNGNA

SEQ ID NO: 20963 - protein, 29 aa, Artificial Sequence
  Description of Artificial Sequence: Synthetic peptide
QEEEIRTTNPVATEQYGSVSMNLQVRGNM

SEQ ID NO: 20964 - protein, 29 aa, Artificial Sequence
  Description of Artificial Sequence: Synthetic peptide
DEEEIRTTNPTATEQYGSVSTNWQERGNH

SEQ ID NO: 20965 - protein, 29 aa, Artificial Sequence
  Description of Artificial Sequence: Synthetic peptide
DEEEIRTTNPVATEMFGSVSTNPQRGNDR

SEQ ID NO: 20966 - protein, 29 aa, Artificial Sequence
  Description of Artificial Sequence: Synthetic peptide
DEEEIATTNPVATEQYGSVSTNLQRAENL

SEQ ID NO: 20967 - protein, 28 aa, Artificial Sequence
  Description of Artificial Sequence: Synthetic peptide
DEEEIRTTNPVATECYGSVSTELQDGNC

SEQ ID NO: 20968 - protein, 29 aa, Artificial Sequence
  Description of Artificial Sequence: Synthetic peptide
YEEEIRTVNPVATEQYGSVSTNLQTHGNR

SEQ ID NO: 20969 - protein, 28 aa, Artificial Sequence
  Description of Artificial Sequence: Synthetic peptide
DEEEISATNCVATEQYGSVSTNLQTGNR

SEQ ID NO: 20970 - protein, 28 aa, Artificial Sequence
  Description of Artificial Sequence: Synthetic peptide
DEEEIRTTNPAATEQYGSVSTNWQTGNF

SEQ ID NO: 20971 - protein, 28 aa, Artificial Sequence
  Description of Artificial Sequence: Synthetic peptide
DEEEIRTTNPVSSEQYGTVSTNLQRGTR

SEQ ID NO: 20972 - protein, 29 aa, Artificial Sequence
  Description of Artificial Sequence: Synthetic peptide
DEEEIRTTNPVATENYGTVSTENLQGGNR

SEQ ID NO: 20973 - protein, 30 aa, Artificial Sequence
  Description of Artificial Sequence: Synthetic polypeptide
DEEEIRTTNPVATEQYGSVSTELVERGNDR

SEQ ID NO: 20974 - protein, 28 aa, Artificial Sequence
  Description of Artificial Sequence: Synthetic peptide
DEEEIRTTNPVATEQYGAVSENLQAGNE

SEQ ID NO: 20975 - protein, 28 aa, Artificial Sequence
  Description of Artificial Sequence: Synthetic peptide
QEEEIRTTNPVATEQYGSVSTDLQSGND

SEQ ID NO: 20976 - protein, 28 aa, Artificial Sequence
  Description of Artificial Sequence: Synthetic peptide
CEEEIRTTNPVASEVYGSVSTNLDRGNR

SEQ ID NO: 20977 - protein, 29 aa, Artificial Sequence
  Description of Artificial Sequence: Synthetic peptide
DEEEIRTVNPVATECYGSVSTDLQRGNDR

SEQ ID NO: 20978 - protein, 29 aa, Artificial Sequence
  Description of Artificial Sequence: Synthetic peptide
DEERIRTTNPVATEQYGSVSTNLQRGKDQ

SEQ ID NO: 20979 - protein, 28 aa, Artificial Sequence
  Description of Artificial Sequence: Synthetic peptide
DEQEIRTTNPVATENYGSVSTNLQHGNA

SEQ ID NO: 20980 - protein, 28 aa, Artificial Sequence
  Description of Artificial Sequence: Synthetic peptide
DEFEIRGTNPVATEQYGSVSDNLQRGNA

SEQ ID NO: 20981 - protein, 30 aa, Artificial Sequence
  Description of Artificial Sequence: Synthetic polypeptide
DEEEITTTNPVATECYGSVSATNLQVRGNR

SEQ ID NO: 20982 - protein, 28 aa, Artificial Sequence
  Description of Artificial Sequence: Synthetic peptide
DEEEIRCTNPVAMEQYGSVSTNLQQGNF

SEQ ID NO: 20983 - protein, 29 aa, Artificial Sequence
  Description of Artificial Sequence: Synthetic peptide
QEEEIRTTNPVATEQYGSVSTNLQDRGEA

SEQ ID NO: 20984 - protein, 30 aa, Artificial Sequence
  Description of Artificial Sequence: Synthetic polypeptide
DEEEIRTTNPVATEQYGSVSDTGNPERGNR

SEQ ID NO: 20985 - protein, 28 aa, Artificial Sequence
  Description of Artificial Sequence: Synthetic peptide
DEQEIRTTNPVATEQYGSVSTELQAGNM

SEQ ID NO: 20986 - protein, 28 aa, Artificial Sequence
  Description of Artificial Sequence: Synthetic peptide
DEEEIVCTNPVATECYGWVSTNLQRGNR

SEQ ID NO: 20987 - protein, 30 aa, Artificial Sequence
  Description of Artificial Sequence: Synthetic polypeptide
DEEEIRTTNPVATEQYGSVSTNLVQVIGNE

SEQ ID NO: 20988 - protein, 29 aa, Artificial Sequence
  Description of Artificial Sequence: Synthetic peptide
DEEEIITTNPVATEQYGSVSDNLQHGANR

SEQ ID NO: 20989 - protein, 28 aa, Artificial Sequence
  Description of Artificial Sequence: Synthetic peptide
DEEEIRTTNPEATECYGSVSTNLQHGNF

SEQ ID NO: 20990 - protein, 28 aa, Artificial Sequence
  Description of Artificial Sequence: Synthetic peptide
REEEIRTTNPVATEQYGSVSIALERGNR

SEQ ID NO: 20991 - protein, 29 aa, Artificial Sequence
  Description of Artificial Sequence: Synthetic peptide
DEEEIATTNPVATEQYGSVSATNLQQGNI

SEQ ID NO: 20992 - protein, 29 aa, Artificial Sequence
  Description of Artificial Sequence: Synthetic peptide
DEEEIATTNPVATEQYGSVSTNPQRGPNG

SEQ ID NO: 20993 - protein, 30 aa, Artificial Sequence
  Description of Artificial Sequence: Synthetic polypeptide
DEEEIRTTNPVATEQYGSVDITPLQRGENR

SEQ ID NO: 20994 - protein, 28 aa, Artificial Sequence
  Description of Artificial Sequence: Synthetic peptide
DEEEIRTTNPVATEQYGSVDTNDQNGNV

SEQ ID NO: 20995 - protein, 30 aa, Artificial Sequence
  Description of Artificial Sequence: Synthetic polypeptide
DEEEIRTTNPVATEQYGSVSETNLQDPGNE

SEQ ID NO: 20996 - protein, 30 aa, Artificial Sequence
  Description of Artificial Sequence: Synthetic polypeptide
DEEEIRTTNPVATEQYGSVSTENLEREGER

SEQ ID NO: 20997 - protein, 28 aa, Artificial Sequence
  Description of Artificial Sequence: Synthetic peptide
DECEINSTNPVATEQYGTVSTNLQRGNR

SEQ ID NO: 20998 - protein, 29 aa, Artificial Sequence
  Description of Artificial Sequence: Synthetic peptide
DEEEIRTTNPVATEQYGSVSEANLQSGNS

SEQ ID NO: 20999 - protein, 29 aa, Artificial Sequence
  Description of Artificial Sequence: Synthetic peptide
DEEEIRATNPVATEQYGVVSTMNLQDGNR

SEQ ID NO: 21000 - protein, 29 aa, Artificial Sequence
  Description of Artificial Sequence: Synthetic peptide
DEGEIRCTNPVATEQYGGVSTNLQRGPNR

SEQ ID NO: 21001 - protein, 28 aa, Artificial Sequence
  Description of Artificial Sequence: Synthetic peptide
DECEIWTTNPVASEQYGSVSTNLQRLNR

SEQ ID NO: 21002 - protein, 28 aa, Artificial Sequence
  Description of Artificial Sequence: Synthetic peptide
DEQEIRTTNPVATEQYGSVSTNDQRGEG

SEQ ID NO: 21003 - protein, 28 aa, Artificial Sequence
  Description of Artificial Sequence: Synthetic peptide
DEEEIRTTNPVATEQYGSVSDTLQHGNT

SEQ ID NO: 21004 - protein, 28 aa, Artificial Sequence
  Description of Artificial Sequence: Synthetic peptide
DEEEIRTTNPVATEQYGSVSTDLQQGEL

SEQ ID NO: 21005 - protein, 30 aa, Artificial Sequence
  Description of Artificial Sequence: Synthetic polypeptide
DEEEIRTTNPVATEQYGSVSTMNLQQGNDS

SEQ ID NO: 21006 - protein, 28 aa, Artificial Sequence
  Description of Artificial Sequence: Synthetic peptide
DENEIRTTNPVATECYGSVSTELQIGNR

SEQ ID NO: 21007 - protein, 28 aa, Artificial Sequence
  Description of Artificial Sequence: Synthetic peptide
DEEEIRTTNPCATEQYGSVATDLQRGTR

SEQ ID NO: 21008 - protein, 31 aa, Artificial Sequence
  Description of Artificial Sequence: Synthetic polypeptide
DEEEIRTTNPFATEQYGSVSITNLQQRGVNR

SEQ ID NO: 21009 - protein, 28 aa, Artificial Sequence
  Description of Artificial Sequence: Synthetic peptide
DEEEIRATNPVASEQYGSVSTELQQGNR

SEQ ID NO: 21010 - protein, 30 aa, Artificial Sequence
  Description of Artificial Sequence: Synthetic polypeptide
DEEHIRTTNPVATEQYGSVSATNLERNGNR

SEQ ID NO: 21011 - protein, 30 aa, Artificial Sequence
  Description of Artificial Sequence: Synthetic polypeptide
SEEEIRTTNPVATEQYGSVSDATGLQRGNR

SEQ ID NO: 21012 - protein, 28 aa, Artificial Sequence
  Description of Artificial Sequence: Synthetic peptide
SEEEIRTTNPVATEQYGSVSTAWQHGNR

SEQ ID NO: 21013 - protein, 29 aa, Artificial Sequence
  Description of Artificial Sequence: Synthetic peptide
DEMEIRTTNPVATEQYGSVSTMNVQRGNA

SEQ ID NO: 21014 - protein, 28 aa, Artificial Sequence
  Description of Artificial Sequence: Synthetic peptide
DDQEIRTTNPIATEPYGSVSTNLQRGNR

SEQ ID NO: 21015 - protein, 28 aa, Artificial Sequence
  Description of Artificial Sequence: Synthetic peptide
DEEEIRTTNPVATEQYGSVSTELEPGNG

SEQ ID NO: 21016 - protein, 29 aa, Artificial Sequence
  Description of Artificial Sequence: Synthetic peptide
DEEEIRTTNPVATEQYGSVSTMNEQNGNQ

SEQ ID NO: 21017 - protein, 28 aa, Artificial Sequence
  Description of Artificial Sequence: Synthetic peptide
SEVEIRTTNPTATEQFGSVSTNLQRGNR

SEQ ID NO: 21018 - protein, 28 aa, Artificial Sequence
  Description of Artificial Sequence: Synthetic peptide
DEEEIRTTNPVATECYGWVSTNLQGGNT

SEQ ID NO: 21019 - protein, 28 aa, Artificial Sequence
  Description of Artificial Sequence: Synthetic peptide
DENEIRTTNPVATEQYGSVSTEDERGNR

SEQ ID NO: 21020 - protein, 28 aa, Artificial Sequence
  Description of Artificial Sequence: Synthetic peptide
DEEEIRTTNPCATEIYGSVSTNLQTGNQ

SEQ ID NO: 21021 - protein, 28 aa, Artificial Sequence
  Description of Artificial Sequence: Synthetic peptide
DEEEIRTTNPVATEQYGSVSTNQLPGNN

SEQ ID NO: 21022 - protein, 28 aa, Artificial Sequence
  Description of Artificial Sequence: Synthetic peptide
DEEEIRTTNPTATECYGSVSENLQRGQR

SEQ ID NO: 21023 - protein, 31 aa, Artificial Sequence
  Description of Artificial Sequence: Synthetic polypeptide
DEEEIRTTNPVATEQYGSVSTMNPLQRGEER

SEQ ID NO: 21024 - protein, 30 aa, Artificial Sequence
  Description of Artificial Sequence: Synthetic polypeptide
DEEEIRTTNPCATEQWGSVSTNLIQIRGNR

SEQ ID NO: 21025 - protein, 30 aa, Artificial Sequence
  Description of Artificial Sequence: Synthetic polypeptide
DEEEIRTTNPVATEHYASVSATNMLQRGNR

SEQ ID NO: 21026 - protein, 30 aa, Artificial Sequence
  Description of Artificial Sequence: Synthetic polypeptide
DEEEIRCTNPEATEQYGSVISTNGLQRGNR

SEQ ID NO: 21027 - protein, 28 aa, Artificial Sequence
  Description of Artificial Sequence: Synthetic peptide
DEEEISTTNPVATEQYGSVSTDLQGGNI

SEQ ID NO: 21028 - protein, 28 aa, Artificial Sequence
  Description of Artificial Sequence: Synthetic peptide
DETEIRCTNPVATEQYGSVDTNLQRGNS

SEQ ID NO: 21029 - protein, 28 aa, Artificial Sequence
  Description of Artificial Sequence: Synthetic peptide
DEEEITATNPVATEQYGSVSTNLQGGER

SEQ ID NO: 21030 - protein, 31 aa, Artificial Sequence
  Description of Artificial Sequence: Synthetic polypeptide
DEEEIRTTNPVATEQYGSVDSTGGLVQRGNR

SEQ ID NO: 21031 - protein, 31 aa, Artificial Sequence
  Description of Artificial Sequence: Synthetic polypeptide
DTEEIRTTNPVATEQYGISVMSTNLQHRGNR

SEQ ID NO: 21032 - protein, 28 aa, Artificial Sequence
  Description of Artificial Sequence: Synthetic peptide
DESEIRTTNPVASECYGSVSMNLQRGNR

SEQ ID NO: 21033 - protein, 29 aa, Artificial Sequence
  Description of Artificial Sequence: Synthetic peptide
DEEEIRTTNPVATECYGSVSTNPQERGNL

SEQ ID NO: 21034 - protein, 28 aa, Artificial Sequence
  Description of Artificial Sequence: Synthetic peptide
DEEEIRSTNPVATEMYGSVSTNLEVGNR

SEQ ID NO: 21035 - protein, 28 aa, Artificial Sequence
  Description of Artificial Sequence: Synthetic peptide
DEEEIVTTNPVATEQYGSVSENLTHGNR

SEQ ID NO: 21036 - protein, 28 aa, Artificial Sequence
  Description of Artificial Sequence: Synthetic peptide
DEQEIRTTNPVSTEVYGSVSTVLQRGNR

SEQ ID NO: 21037 - protein, 29 aa, Artificial Sequence
  Description of Artificial Sequence: Synthetic peptide
DEEEITTTNPVATEQYGSCSATNIQRGNR

SEQ ID NO: 21038 - protein, 28 aa, Artificial Sequence
  Description of Artificial Sequence: Synthetic peptide
DEEEISTTNPVATEQYGSVSDNLVIGNR

SEQ ID NO: 21039 - protein, 28 aa, Artificial Sequence
  Description of Artificial Sequence: Synthetic peptide
DEQEISTTNPVASEIYGSVSTNLQRGNR

SEQ ID NO: 21040 - protein, 28 aa, Artificial Sequence
  Description of Artificial Sequence: Synthetic peptide
DEEEIRTTNPVATEQYGSVSDDLQGGNP

SEQ ID NO: 21041 - protein, 28 aa, Artificial Sequence
  Description of Artificial Sequence: Synthetic peptide
DENEICTTNPVATEVYGSVSTNLQRGGR

SEQ ID NO: 21042 - protein, 28 aa, Artificial Sequence
  Description of Artificial Sequence: Synthetic peptide
QEQEIRTTNPVATEQYGEVSENLQRGNR

SEQ ID NO: 21043 - protein, 28 aa, Artificial Sequence
  Description of Artificial Sequence: Synthetic peptide
DEEEIRTTNPVATEQYGSVSENLQFGDI

SEQ ID NO: 21044 - protein, 28 aa, Artificial Sequence
  Description of Artificial Sequence: Synthetic peptide
DEEEICTTNPVATEQYGDASENLQRGNR

SEQ ID NO: 21045 - protein, 28 aa, Artificial Sequence
  Description of Artificial Sequence: Synthetic peptide
NEEEIRTTNPVATQQYGSVWTELQRGNR

SEQ ID NO: 21046 - protein, 30 aa, Artificial Sequence
  Description of Artificial Sequence: Synthetic polypeptide
DEEEIRTTNPVATEQYGSVSCTNLQCYGNV

SEQ ID NO: 21047 - protein, 28 aa, Artificial Sequence
  Description of Artificial Sequence: Synthetic peptide
QEQEICTTNPVATEQYGGVSTNLQRGNR

SEQ ID NO: 21048 - protein, 28 aa, Artificial Sequence
  Description of Artificial Sequence: Synthetic peptide
DEEEIRTTNPVATEQYGSVETNLANGER

SEQ ID NO: 21049 - protein, 28 aa, Artificial Sequence
  Description of Artificial Sequence: Synthetic peptide
DEEEIRTTNPVATECYGSVSTNLQQGDQ

SEQ ID NO: 21050 - protein, 30 aa, Artificial Sequence
  Description of Artificial Sequence: Synthetic polypeptide
DEEEIRTTNPVAYEQYGSVCSGMNLQRGNR

SEQ ID NO: 21051 - protein, 28 aa, Artificial Sequence
  Description of Artificial Sequence: Synthetic peptide
AEEEIRTTNPVATEQYGSASTNLQQGNL

SEQ ID NO: 21052 - protein, 28 aa, Artificial Sequence
  Description of Artificial Sequence: Synthetic peptide
DEEEIRATNPVATELYGSVSENLQRGNF

SEQ ID NO: 21053 - protein, 29 aa, Artificial Sequence
  Description of Artificial Sequence: Synthetic peptide
DEEEIRTTNPVATEQYGSVSTELQVLGNN

SEQ ID NO: 21054 - protein, 28 aa, Artificial Sequence
  Description of Artificial Sequence: Synthetic peptide
DEEEIRTTNPVATEQYGSVSTDLQVGEL

SEQ ID NO: 21055 - protein, 31 aa, Artificial Sequence
  Description of Artificial Sequence: Synthetic polypeptide
DEEEIRTTNPVATEQYGSVSATNLQEVNGNR

SEQ ID NO: 21056 - protein, 28 aa, Artificial Sequence
  Description of Artificial Sequence: Synthetic peptide
DEEEIATTNPVATEQYGSVSTNEQRELR

SEQ ID NO: 21057 - protein, 28 aa, Artificial Sequence
  Description of Artificial Sequence: Synthetic peptide
DEMEIRTTNPVATEQYGSVSTNLMTGNS

SEQ ID NO: 21058 - protein, 28 aa, Artificial Sequence
  Description of Artificial Sequence: Synthetic peptide
DESEIRCTNPVATEQYGWMSTNLQRGNR

SEQ ID NO: 21059 - protein, 29 aa, Artificial Sequence
  Description of Artificial Sequence: Synthetic peptide
DEEEIATTNPVATECYGSVSTNLQDRGER

SEQ ID NO: 21060 - protein, 28 aa, Artificial Sequence
  Description of Artificial Sequence: Synthetic peptide
DEHEVRTTNPVATEQYGSVSTNDQMGNR

SEQ ID NO: 21061 - protein, 28 aa, Artificial Sequence
  Description of Artificial Sequence: Synthetic peptide
DEEEIRTTNPIATEFWGSVCTNLQRGNR

SEQ ID NO: 21062 - protein, 28 aa, Artificial Sequence
  Description of Artificial Sequence: Synthetic peptide
DEEEIRTTNPVATEQYGSVSTPLIIGNS

SEQ ID NO: 21063 - protein, 28 aa, Artificial Sequence
  Description of Artificial Sequence: Synthetic peptide
DEEEIATTNPVATEQYGSVSTNPQNGNS

SEQ ID NO: 21064 - protein, 28 aa, Artificial Sequence
  Description of Artificial Sequence: Synthetic peptide
DEEEIRTTNPVATECYGSVSTDLQYGNT

SEQ ID NO: 21065 - protein, 28 aa, Artificial Sequence
  Description of Artificial Sequence: Synthetic peptide
DEEEIRTTNPVATELYGSVSTDLQAGNI

SEQ ID NO: 21066 - protein, 28 aa, Artificial Sequence
  Description of Artificial Sequence: Synthetic peptide
DEEEIRTTNPVATEQYGGVSTNEQRGTF

SEQ ID NO: 21067 - protein, 28 aa, Artificial Sequence
  Description of Artificial Sequence: Synthetic peptide
DEEEIRTTNPVATEQYGSVSTELQAGET

SEQ ID NO: 21068 - protein, 28 aa, Artificial Sequence
  Description of Artificial Sequence: Synthetic peptide
DEEEIRTTNPVATEQYGSVSEELCQGNR

SEQ ID NO: 21069 - protein, 30 aa, Artificial Sequence
  Description of Artificial Sequence: Synthetic polypeptide
DEEEIRTTNPVATEQYGSVSANNLERNGNR

SEQ ID NO: 21070 - protein, 28 aa, Artificial Sequence
  Description of Artificial Sequence: Synthetic peptide
DEEEINATNPVATEQFGWVSTNLQRGNR

SEQ ID NO: 21071 - protein, 28 aa, Artificial Sequence
  Description of Artificial Sequence: Synthetic peptide
DEEEIRTTNPVATEAYGSVSTNEQLGNN

SEQ ID NO: 21072 - protein, 32 aa, Artificial Sequence
  Description of Artificial Sequence: Synthetic polypeptide
DEEEIRTTNPVATEQYGSVSITTNLQREGDNR

SEQ ID NO: 21073 - protein, 31 aa, Artificial Sequence
  Description of Artificial Sequence: Synthetic polypeptide
DEEEIRTTNPVATEQYGFVSTENDLQRGTNR

SEQ ID NO: 21074 - protein, 28 aa, Artificial Sequence
  Description of Artificial Sequence: Synthetic peptide
GEEEIRTTNPVATEQYGVVSTDLQRGNW

SEQ ID NO: 21075 - protein, 28 aa, Artificial Sequence
  Description of Artificial Sequence: Synthetic peptide
DEEEIATTNPVATECYGSVSTNLQHGND

SEQ ID NO: 21076 - protein, 28 aa, Artificial Sequence
  Description of Artificial Sequence: Synthetic peptide
DEEEIRQTNPVATEQYGFVSTNWQRGNQ

SEQ ID NO: 21077 - protein, 28 aa, Artificial Sequence
  Description of Artificial Sequence: Synthetic peptide
DEEEIRTTNPVATECYGSVSTNLQQGGF

SEQ ID NO: 21078 - protein, 28 aa, Artificial Sequence
  Description of Artificial Sequence: Synthetic peptide
DEEEIRCTNPVATEQYGSVSTDLQRGDT

SEQ ID NO: 21079 - protein, 28 aa, Artificial Sequence
  Description of Artificial Sequence: Synthetic peptide
FEGEIRTTNPVATEMYGDVSTNLQRGNR

SEQ ID NO: 21080 - protein, 28 aa, Artificial Sequence
  Description of Artificial Sequence: Synthetic peptide
QEEEIRTTNPVATEVYGSASTVLQRGNR

SEQ ID NO: 21081 - protein, 30 aa, Artificial Sequence
  Description of Artificial Sequence: Synthetic polypeptide
DENEIRTTNPVATEQYGSVSATNLQVSGNR

SEQ ID NO: 21082 - protein, 30 aa, Artificial Sequence
  Description of Artificial Sequence: Synthetic polypeptide
DEEEIRTTNPVATEQYGSVSLTNGLEQGNR

SEQ ID NO: 21083 - protein, 28 aa, Artificial Sequence
  Description of Artificial Sequence: Synthetic peptide
DEQEIRTTNPVATEQYGSVSTDDERGNR

SEQ ID NO: 21084 - protein, 28 aa, Artificial Sequence
  Description of Artificial Sequence: Synthetic peptide
DEEEIRTTNPVATECYGSVSTNEQIGNS

SEQ ID NO: 21085 - protein, 28 aa, Artificial Sequence
  Description of Artificial Sequence: Synthetic peptide
KEEEIRTTNPVATEQYGSVSTELQRGEW

SEQ ID NO: 21086 - protein, 29 aa, Artificial Sequence
  Description of Artificial Sequence: Synthetic peptide
DENEIRTTNPVATEQYGSVSENLMMRGNR

SEQ ID NO: 21087 - protein, 31 aa, Artificial Sequence
  Description of Artificial Sequence: Synthetic polypeptide
DEEEIRTTNPVATEQYGSVSTDNLVQREGNA

SEQ ID NO: 21088 - protein, 31 aa, Artificial Sequence
  Description of Artificial Sequence: Synthetic polypeptide
DEEEIRTTNPVATEQYGSVSTDGLIQRGNSR

SEQ ID NO: 21089 - protein, 30 aa, Artificial Sequence
  Description of Artificial Sequence: Synthetic polypeptide
GEEEIRTTNPVATEQYGSVSTGNLEVRGNR

SEQ ID NO: 21090 - protein, 28 aa, Artificial Sequence
  Description of Artificial Sequence: Synthetic peptide
DPEEIRTTNPVATEQYGSVHTPLQRGNP

SEQ ID NO: 21091 - protein, 28 aa, Artificial Sequence
  Description of Artificial Sequence: Synthetic peptide
QEEEIMATNPVATEQYGSASTNLQRGNR

SEQ ID NO: 21092 - protein, 28 aa, Artificial Sequence
  Description of Artificial Sequence: Synthetic peptide
DENEIRTTNPVATECYGSVSTNEQRGDR

SEQ ID NO: 21093 - protein, 28 aa, Artificial Sequence
  Description of Artificial Sequence: Synthetic peptide
DEEEIRTTNPVATEQYGDVSEDLQRGNI

SEQ ID NO: 21094 - protein, 28 aa, Artificial Sequence
  Description of Artificial Sequence: Synthetic peptide
DENEIRTTNPVATEQYGSVSTNEMRGNA

SEQ ID NO: 21095 - protein, 29 aa, Artificial Sequence
  Description of Artificial Sequence: Synthetic peptide
DEEEIRTTNPVATEQYGSVSTDLEYGNDR

SEQ ID NO: 21096 - protein, 28 aa, Artificial Sequence
  Description of Artificial Sequence: Synthetic peptide
DEEEIRTTNPVATEQYGSVSENPQAGND

SEQ ID NO: 21097 - protein, 28 aa, Artificial Sequence
  Description of Artificial Sequence: Synthetic peptide
DEEEIRTTNPVATEQYGSVSTELQAGEY

SEQ ID NO: 21098 - protein, 28 aa, Artificial Sequence
  Description of Artificial Sequence: Synthetic peptide
DEQEIRTTNPVATEQYGSVSENLQQGNM

SEQ ID NO: 21099 - protein, 29 aa, Artificial Sequence
  Description of Artificial Sequence: Synthetic peptide
DEEEIRTTNPVATEQYGSVSTNGLQTGTA

SEQ ID NO: 21100 - protein, 28 aa, Artificial Sequence
  Description of Artificial Sequence: Synthetic peptide
GDEEIRATNPVATEQYGSVSTNLQGGNR

SEQ ID NO: 21101 - protein, 29 aa, Artificial Sequence
  Description of Artificial Sequence: Synthetic peptide
DEEEIRTTNPVATEIYGCVATNLQREGNR

SEQ ID NO: 21102 - protein, 31 aa, Artificial Sequence
  Description of Artificial Sequence: Synthetic polypeptide
DEEEIRTTNPVATEQYGSVASTNLQREGNPN

SEQ ID NO: 21103 - protein, 28 aa, Artificial Sequence
  Description of Artificial Sequence: Synthetic peptide
QEEEITTTNPVATEIYGSVSTDLQRGNR

SEQ ID NO: 21104 - protein, 29 aa, Artificial Sequence
  Description of Artificial Sequence: Synthetic peptide
DEEEIRTTNPVATESYGSVSTNEQNGNDR

SEQ ID NO: 21105 - protein, 30 aa, Artificial Sequence
  Description of Artificial Sequence: Synthetic polypeptide
DEEEIRTTNPVATEQYGSYSTNLQFQNGNR

SEQ ID NO: 21106 - protein, 28 aa, Artificial Sequence
  Description of Artificial Sequence: Synthetic peptide
DEQEVRCTNPVATEQYGCVSTNLQRGNR

SEQ ID NO: 21107 - protein, 28 aa, Artificial Sequence
  Description of Artificial Sequence: Synthetic peptide
DEEEIRTTNPVAIEQYGSVSTNDQTGNA

SEQ ID NO: 21108 - protein, 28 aa, Artificial Sequence
  Description of Artificial Sequence: Synthetic peptide
DEEEIRTTNPVATEQYGEVSEVLQRGGR

SEQ ID NO: 21109 - protein, 28 aa, Artificial Sequence
  Description of Artificial Sequence: Synthetic peptide
DNEEIRTTNPVATEQYGEVSTNEQRGNM

SEQ ID NO: 21110 - protein, 28 aa, Artificial Sequence
  Description of Artificial Sequence: Synthetic peptide
DELEIRTTNPVATEQYGIVSTNQQRGND

SEQ ID NO: 21111 - protein, 29 aa, Artificial Sequence
  Description of Artificial Sequence: Synthetic peptide
DEEEIRTTNPVATEQWGIVSTNEQMRGNR

SEQ ID NO: 21112 - protein, 28 aa, Artificial Sequence
  Description of Artificial Sequence: Synthetic peptide
DEAEIRTTNPVATEQYGDVSTNLQFGNF

SEQ ID NO: 21113 - protein, 28 aa, Artificial Sequence
  Description of Artificial Sequence: Synthetic peptide
DEEEIATTNPVATEQYGSASTDLQRENR

SEQ ID NO: 21114 - protein, 28 aa, Artificial Sequence
  Description of Artificial Sequence: Synthetic peptide
YEQEIRTTNPVATEQYGSVSSNLQHGNR

SEQ ID NO: 21115 - protein, 28 aa, Artificial Sequence
  Description of Artificial Sequence: Synthetic peptide
DEEEIRTTNPVATEQYGSVSTALDRENY

SEQ ID NO: 21116 - protein, 28 aa, Artificial Sequence
  Description of Artificial Sequence: Synthetic peptide
QEEEIRTTNPVATEQYGSVSTVLQHGGR

SEQ ID NO: 21117 - protein, 28 aa, Artificial Sequence
  Description of Artificial Sequence: Synthetic peptide
DEEETRTTNPVATEQYGSVSNELQRGQR

SEQ ID NO: 21118 - protein, 29 aa, Artificial Sequence
  Description of Artificial Sequence: Synthetic peptide
DEEEIRTTNPVATEQYGEVSENLQRGDNI

SEQ ID NO: 21119 - protein, 28 aa, Artificial Sequence
  Description of Artificial Sequence: Synthetic peptide
DEEEIRSTNPVSTEQYGCVATNLQRGNR

SEQ ID NO: 21120 - protein, 28 aa, Artificial Sequence
  Description of Artificial Sequence: Synthetic peptide
QEEEIRTTNPVATEVYGDVSENLQRGNR

SEQ ID NO: 21121 - protein, 28 aa, Artificial Sequence
  Description of Artificial Sequence: Synthetic peptide
DESEIRTTNPVATEQYGTVSTNLETGNR

SEQ ID NO: 21122 - protein, 28 aa, Artificial Sequence
  Description of Artificial Sequence: Synthetic peptide
DEQEIAAVNPVATEQYGSVSTNLQRGNR

SEQ ID NO: 21123 - protein, 30 aa, Artificial Sequence
  Description of Artificial Sequence: Synthetic polypeptide
DEEEIRTTNPVATEQYGSVSYTNLEERGNI

SEQ ID NO: 21124 - protein, 28 aa, Artificial Sequence
  Description of Artificial Sequence: Synthetic peptide
SEEEIRTTNPTATEQYGSVSTNLQFGNF

SEQ ID NO: 21125 - protein, 29 aa, Artificial Sequence
  Description of Artificial Sequence: Synthetic peptide
DEEEIRTTNPVATEQYGEVSTNPQDRGNF

SEQ ID NO: 21126 - protein, 28 aa, Artificial Sequence
  Description of Artificial Sequence: Synthetic peptide
DESCIRTTNPVATEQYGSVFTNLQIGNR

SEQ ID NO: 21127 - protein, 28 aa, Artificial Sequence
  Description of Artificial Sequence: Synthetic peptide
DEEEIRTVNPCATEQYGSVSTNDQRGNQ

SEQ ID NO: 21128 - protein, 28 aa, Artificial Sequence
  Description of Artificial Sequence: Synthetic peptide
DEEEIRTTNPVATEQYGNASTNLQQGNM

SEQ ID NO: 21129 - protein, 29 aa, Artificial Sequence
  Description of Artificial Sequence: Synthetic peptide
DEEEIRCTNPVATEQYGVVSTALQRGDNR

SEQ ID NO: 21130 - protein, 28 aa, Artificial Sequence
  Description of Artificial Sequence: Synthetic peptide
QEEEIRTTNPVCYEQGGSVSTNLQRGNR

SEQ ID NO: 21131 - protein, 28 aa, Artificial Sequence
  Description of Artificial Sequence: Synthetic peptide
DEEEIRTTNPVATEQYGSVSTDLQIGET

SEQ ID NO: 21132 - protein, 29 aa, Artificial Sequence
  Description of Artificial Sequence: Synthetic peptide
DEEEIRTTNPVATEVYGSVSDDLQRGNDR

SEQ ID NO: 21133 - protein, 29 aa, Artificial Sequence
  Description of Artificial Sequence: Synthetic peptide
DEEECRTTNPVATEQYGSVSTNLMRGNQN

SEQ ID NO: 21134 - protein, 28 aa, Artificial Sequence
  Description of Artificial Sequence: Synthetic peptide
DEEEIRTTNPVATFQYGSVSTGLLDGNR

SEQ ID NO: 21135 - protein, 31 aa, Artificial Sequence
  Description of Artificial Sequence: Synthetic polypeptide
DEEEIRTTNPVATEQYGSVSSTNLQREGDER

SEQ ID NO: 21136 - protein, 29 aa, Artificial Sequence
  Description of Artificial Sequence: Synthetic peptide
DENEIRTTNPVATEQYGSVSTNLMNRGNF

SEQ ID NO: 21137 - protein, 29 aa, Artificial Sequence
  Description of Artificial Sequence: Synthetic peptide
DEEEINTTNPVATEQYGSVGAMNLQRGNR

SEQ ID NO: 21138 - protein, 28 aa, Artificial Sequence
  Description of Artificial Sequence: Synthetic peptide
QEEEIRQTNPVSTEQYGSVSTNLQRGGR

SEQ ID NO: 21139 - protein, 29 aa, Artificial Sequence
  Description of Artificial Sequence: Synthetic peptide
DEIEISTTNPVSTEQYGSVSTNLQRAGNR

SEQ ID NO: 21140 - protein, 28 aa, Artificial Sequence
  Description of Artificial Sequence: Synthetic peptide
DEEEIRTTNPIATEIYGAVSSNLQRGNR

SEQ ID NO: 21141 - protein, 28 aa, Artificial Sequence
  Description of Artificial Sequence: Synthetic peptide
MEEEIRTTNPVATEQYGSMSENLQRGER

SEQ ID NO: 21142 - protein, 30 aa, Artificial Sequence
  Description of Artificial Sequence: Synthetic polypeptide
DEEEIRTTNPVATEQYGSVNTNLQTRGTER

SEQ ID NO: 21143 - protein, 28 aa, Artificial Sequence
  Description of Artificial Sequence: Synthetic peptide
DEEMIRTTNPVATLQWGSVSTNLQPGNR

SEQ ID NO: 21144 - protein, 30 aa, Artificial Sequence
  Description of Artificial Sequence: Synthetic polypeptide
DEEEIRTTNPVATEQYGSVSTNLVQQSGNF

SEQ ID NO: 21145 - protein, 28 aa, Artificial Sequence
  Description of Artificial Sequence: Synthetic peptide
DEQEIRTTNPVATEQYGSVSMELQRGNA

SEQ ID NO: 21146 - protein, 28 aa, Artificial Sequence
  Description of Artificial Sequence: Synthetic peptide
DEGEIETTNPVATEQYGSVSTNLQSGNQ

SEQ ID NO: 21147 - protein, 30 aa, Artificial Sequence
  Description of Artificial Sequence: Synthetic polypeptide
DEEEIRTTNPVATEQYGSVDSTEELQRGDR

SEQ ID NO: 21148 - protein, 28 aa, Artificial Sequence
  Description of Artificial Sequence: Synthetic peptide
DEEEIRTTNPVASEQYGDVSTQLQRNNR

SEQ ID NO: 21149 - protein, 29 aa, Artificial Sequence
  Description of Artificial Sequence: Synthetic peptide
DEQEIRTTNPVATEQYGSVDETNDQRGNR

SEQ ID NO: 21150 - protein, 28 aa, Artificial Sequence
  Description of Artificial Sequence: Synthetic peptide
DEEEIRTTNPECTEMYGSVSTALQRGNR

SEQ ID NO: 21151 - protein, 28 aa, Artificial Sequence
  Description of Artificial Sequence: Synthetic peptide
DEEEIATTNPTATEQYGSVSTNLQIGNA

SEQ ID NO: 21152 - protein, 28 aa, Artificial Sequence
  Description of Artificial Sequence: Synthetic peptide
VEEEIRTTNPVATEHYGTVSTNLQRGTR

SEQ ID NO: 21153 - protein, 28 aa, Artificial Sequence
  Description of Artificial Sequence: Synthetic peptide
DEEELRTTNPVCTEQYGSVANNLQRGNR

SEQ ID NO: 21154 - protein, 28 aa, Artificial Sequence
  Description of Artificial Sequence: Synthetic peptide
DEHEIRTTNPVATEQYGDVSTNLQAGNT

SEQ ID NO: 21155 - protein, 28 aa, Artificial Sequence
  Description of Artificial Sequence: Synthetic peptide
KEEEIRTTNPVATEQYGSVSENLQVGNA

SEQ ID NO: 21156 - protein, 29 aa, Artificial Sequence
  Description of Artificial Sequence: Synthetic peptide
DEEEIRTTNPVATEQYGSVSTDLQENGNM

SEQ ID NO: 21157 - protein, 31 aa, Artificial Sequence
  Description of Artificial Sequence: Synthetic polypeptide
DEEEIRTTNPDATEQYGSVSVTNLTQRGNPR

SEQ ID NO: 21158 - protein, 32 aa, Artificial Sequence
  Description of Artificial Sequence: Synthetic polypeptide
DEEEIRTTNPVATEQYGSVSCTMNLQRAGFNR

SEQ ID NO: 21159 - protein, 29 aa, Artificial Sequence
  Description of Artificial Sequence: Synthetic peptide
DEEEIRTTNPVATEQYGSVSENEQRGDNF

SEQ ID NO: 21160 - protein, 30 aa, Artificial Sequence
  Description of Artificial Sequence: Synthetic polypeptide
DEEEIRTTNPVATEQYGSVSTNLQEQGNDI

SEQ ID NO: 21161 - protein, 28 aa, Artificial Sequence
  Description of Artificial Sequence: Synthetic peptide
DEEEIRTTNPCATEPYGSVSTNLMRGTR

SEQ ID NO: 21162 - protein, 29 aa, Artificial Sequence
  Description of Artificial Sequence: Synthetic peptide
DEEEIRTTNPVATECYGDVSTNLQIEGNR

SEQ ID NO: 21163 - protein, 29 aa, Artificial Sequence
  Description of Artificial Sequence: Synthetic peptide
DEEEIATTNPVATEQYGSVSTMNLQNGNQ

SEQ ID NO: 21164 - protein, 28 aa, Artificial Sequence
  Description of Artificial Sequence: Synthetic peptide
DEEEIRTTNPVATEQYGDVSTDLQMGNF

SEQ ID NO: 21165 - protein, 28 aa, Artificial Sequence
  Description of Artificial Sequence: Synthetic peptide
DEEEIRTTNPVATEQYWSVDTNDQTGNR

SEQ ID NO: 21166 - protein, 30 aa, Artificial Sequence
  Description of Artificial Sequence: Synthetic polypeptide
DEEEIRTTNPVATEQYGSVSTGLTDERGNR

SEQ ID NO: 21167 - protein, 29 aa, Artificial Sequence
  Description of Artificial Sequence: Synthetic peptide
DEEEIRQTNPVATEQYGVVSTDGLQRGNR

SEQ ID NO: 21168 - protein, 30 aa, Artificial Sequence
  Description of Artificial Sequence: Synthetic polypeptide
DEEEVRTTNPVATEIYGSVSATNLQRNGNR

SEQ ID NO: 21169 - protein, 28 aa, Artificial Sequence
  Description of Artificial Sequence: Synthetic peptide
DEEEIRTTNPTATEVYGSVSTDLQRGND

SEQ ID NO: 21170 - protein, 29 aa, Artificial Sequence
  Description of Artificial Sequence: Synthetic peptide
DEEEIRQTNPVATEQYGEVSTNLQRGEDR

SEQ ID NO: 21171 - protein, 28 aa, Artificial Sequence
  Description of Artificial Sequence: Synthetic peptide
DEEEIRTTNPVATEQYGSVDTELQLGNV

SEQ ID NO: 21172 - protein, 31 aa, Artificial Sequence
  Description of Artificial Sequence: Synthetic polypeptide
DEEEIRTTNPVATEQYGSVSTENLQDGENDR

SEQ ID NO: 21173 - protein, 28 aa, Artificial Sequence
  Description of Artificial Sequence: Synthetic peptide
DEEEIRTTNPVATEQYGSVSTNEMQGNF

SEQ ID NO: 21174 - protein, 29 aa, Artificial Sequence
  Description of Artificial Sequence: Synthetic peptide
DEEEIRTTNPVATEQYGSVSEVLQIGINR

SEQ ID NO: 21175 - protein, 28 aa, Artificial Sequence
  Description of Artificial Sequence: Synthetic peptide
QEEEIRTTNPVSTEQYGSASTVLQRGNR

SEQ ID NO: 21176 - protein, 29 aa, Artificial Sequence
  Description of Artificial Sequence: Synthetic peptide
DEEEIRTTNPFATEQYGLVSTNELQHGNR

SEQ ID NO: 21177 - protein, 28 aa, Artificial Sequence
  Description of Artificial Sequence: Synthetic peptide
DEQEIATTNPVATEQYGSVSTNLQRGET

SEQ ID NO: 21178 - protein, 28 aa, Artificial Sequence
  Description of Artificial Sequence: Synthetic peptide
DEEEIRCTNPAATEQYGSVSTNDQRGPR

SEQ ID NO: 21179 - protein, 28 aa, Artificial Sequence
  Description of Artificial Sequence: Synthetic peptide
DENEIRTTNPVATEQYGVVSTNLQVGNF

SEQ ID NO: 21180 - protein, 28 aa, Artificial Sequence
  Description of Artificial Sequence: Synthetic peptide
DEAEIRTTNPVATEQYGSVDENLQNGNR

SEQ ID NO: 21181 - protein, 30 aa, Artificial Sequence
  Description of Artificial Sequence: Synthetic polypeptide
DEEEIRTTNPVATEQYGESVSTNGLDRGDR

SEQ ID NO: 21182 - protein, 29 aa, Artificial Sequence
  Description of Artificial Sequence: Synthetic peptide
DEEEIRTTNPVATEQYGSVSENLQDIGTR

SEQ ID NO: 21183 - protein, 28 aa, Artificial Sequence
  Description of Artificial Sequence: Synthetic peptide
DEEEIRTTNPVATEFYGSVDTSLQRPNR

SEQ ID NO: 21184 - protein, 28 aa, Artificial Sequence
  Description of Artificial Sequence: Synthetic peptide
DEEEIRTTNPTATEQYGSVSTNPQIGNV

SEQ ID NO: 21185 - protein, 29 aa, Artificial Sequence
  Description of Artificial Sequence: Synthetic peptide
DEEEIRTTNPVATEQYGSVSTNEMNTGNR

SEQ ID NO: 21186 - protein, 29 aa, Artificial Sequence
  Description of Artificial Sequence: Synthetic peptide
DENEIRTTNPEATEQYGSVSTNLQSGNTR

SEQ ID NO: 21187 - protein, 28 aa, Artificial Sequence
  Description of Artificial Sequence: Synthetic peptide
DEEEIRTTNPVATEQYGSVSENLQHGEM

SEQ ID NO: 21188 - protein, 30 aa, Artificial Sequence
  Description of Artificial Sequence: Synthetic polypeptide
DEEEIRTTNPVATEQYGSVSTNLQENGNDS

SEQ ID NO: 21189 - protein, 30 aa, Artificial Sequence
  Description of Artificial Sequence: Synthetic polypeptide
DEEEIRSTNPVATEQYGSVCSTVNGQRGNR

SEQ ID NO: 21190 - protein, 28 aa, Artificial Sequence
  Description of Artificial Sequence: Synthetic peptide
DEEEIVTTNPVSTEQYGSVSTVLQAGNR

SEQ ID NO: 21191 - protein, 29 aa, Artificial Sequence
  Description of Artificial Sequence: Synthetic peptide
DEEEIRTTNPTATEQYGSVSTMNLQQGDR

SEQ ID NO: 21192 - protein, 28 aa, Artificial Sequence
  Description of Artificial Sequence: Synthetic peptide
HESEIRTTNPCATEQYGSVSTNDQRGNR

SEQ ID NO: 21193 - protein, 28 aa, Artificial Sequence
  Description of Artificial Sequence: Synthetic peptide
NEAEIRTTNPVASEQYGSVSMNLQRGNR

SEQ ID NO: 21194 - protein, 28 aa, Artificial Sequence
  Description of Artificial Sequence: Synthetic peptide
DEQEIRTTNPVATECYGSVSTNLQAGNM

SEQ ID NO: 21195 - protein, 28 aa, Artificial Sequence
  Description of Artificial Sequence: Synthetic peptide
DEEEIRTTNPVATEQYGSVSTAPQQGNA

SEQ ID NO: 21196 - protein, 32 aa, Artificial Sequence
  Description of Artificial Sequence: Synthetic polypeptide
DEEEIRTTNPVATEQYGSVSDTENLQRNGNDR

SEQ ID NO: 21197 - protein, 29 aa, Artificial Sequence
  Description of Artificial Sequence: Synthetic peptide
DEQEIVTTNPVATEQYGSVSADNLQRGNR

SEQ ID NO: 21198 - protein, 28 aa, Artificial Sequence
  Description of Artificial Sequence: Synthetic peptide
DEEEIRTTNPCATEIYGSVAMNLQRGNR

SEQ ID NO: 21199 - protein, 28 aa, Artificial Sequence
  Description of Artificial Sequence: Synthetic peptide
AEEEIRTVNPVATECYGSVSTNLQRGND

SEQ ID NO: 21200 - protein, 28 aa, Artificial Sequence
  Description of Artificial Sequence: Synthetic peptide
DEEEIVTTNPVATEQYGSVSECLQVGNR

SEQ ID NO: 21201 - protein, 28 aa, Artificial Sequence
  Description of Artificial Sequence: Synthetic peptide
EESCIRTTNPVATEGYGSVSTNLQRGNR

SEQ ID NO: 21202 - protein, 28 aa, Artificial Sequence
  Description of Artificial Sequence: Synthetic peptide
QEEEIRTTNPVATECYGSVSTNLERGER

SEQ ID NO: 21203 - protein, 29 aa, Artificial Sequence
  Description of Artificial Sequence: Synthetic peptide
DEEEIRTTNPVATEQYGVVSTNLQHGNDT

SEQ ID NO: 21204 - protein, 28 aa, Artificial Sequence
  Description of Artificial Sequence: Synthetic peptide
DEEEIRTVNPVATEIYGCVATNLQRGNR

SEQ ID NO: 21205 - protein, 28 aa, Artificial Sequence
  Description of Artificial Sequence: Synthetic peptide
HEEEIRTTNPVATEQYGSVSTNPQFGNN

SEQ ID NO: 21206 - protein, 28 aa, Artificial Sequence
  Description of Artificial Sequence: Synthetic peptide
DEEEIRTTNPVATEQYGSVSTDLEIGNQ

SEQ ID NO: 21207 - protein, 28 aa, Artificial Sequence
  Description of Artificial Sequence: Synthetic peptide
DEEEIRTTNPVATEQYGSVSTNLETGAQ

SEQ ID NO: 21208 - protein, 28 aa, Artificial Sequence
  Description of Artificial Sequence: Synthetic peptide
DEEEIRTTNPVATECYGSVSENPQRGNN

SEQ ID NO: 21209 - protein, 30 aa, Artificial Sequence
  Description of Artificial Sequence: Synthetic polypeptide
DEEEIRTTNPVATEQYGSVSTENLQPQGNG

SEQ ID NO: 21210 - protein, 28 aa, Artificial Sequence
  Description of Artificial Sequence: Synthetic peptide
DEEEIRTTNPVATEQYGSWSTPLQPGER

SEQ ID NO: 21211 - protein, 28 aa, Artificial Sequence
  Description of Artificial Sequence: Synthetic peptide
KEEEIRTTNPVATEQYGSMATNLQRGER

SEQ ID NO: 21212 - protein, 28 aa, Artificial Sequence
  Description of Artificial Sequence: Synthetic peptide
DEEEIRSTNPVSTETYGSVATNLQRGNR

SEQ ID NO: 21213 - protein, 29 aa, Artificial Sequence
  Description of Artificial Sequence: Synthetic peptide
DEEEIRTTNPIATEQYGCVSTNLQFRGND

SEQ ID NO: 21214 - protein, 28 aa, Artificial Sequence
  Description of Artificial Sequence: Synthetic peptide
DEEEIRTTNPVATEQYWSVSTNLQMGDQ

SEQ ID NO: 21215 - protein, 28 aa, Artificial Sequence
  Description of Artificial Sequence: Synthetic peptide
QEEEIRTTNPVATEQYGSASTCLQRGNN

SEQ ID NO: 21216 - protein, 28 aa, Artificial Sequence
  Description of Artificial Sequence: Synthetic peptide
DEEEIRTTNPVATEQYGSVSTDLQIGEI

SEQ ID NO: 21217 - protein, 30 aa, Artificial Sequence
  Description of Artificial Sequence: Synthetic polypeptide
DEEEIRTTNPTATEQYGSVSTGNEQRGVNR

SEQ ID NO: 21218 - protein, 28 aa, Artificial Sequence
  Description of Artificial Sequence: Synthetic peptide
DEDEIRTTNPVATEQYGSVSTNLQNGEM

SEQ ID NO: 21219 - protein, 28 aa, Artificial Sequence
  Description of Artificial Sequence: Synthetic peptide
DEEEIRTTNPVATEQYGSVETMLQNGNF

SEQ ID NO: 21220 - protein, 32 aa, Artificial Sequence
  Description of Artificial Sequence: Synthetic polypeptide
DEEEIRTTNPVATEQYGSVTSTNPLVQRNGNR

SEQ ID NO: 21221 - protein, 30 aa, Artificial Sequence
  Description of Artificial Sequence: Synthetic polypeptide
DEEEIRTTNPVASEQYGSVSTNQLMRGNHR

SEQ ID NO: 21222 - protein, 29 aa, Artificial Sequence
  Description of Artificial Sequence: Synthetic peptide
DEEEIRTTNPVATEQYGSVSTDLQQNGNL

SEQ ID NO: 21223 - protein, 30 aa, Artificial Sequence
  Description of Artificial Sequence: Synthetic polypeptide
DEEEIRTTNPVATEQYGSVSTNLQFAGNPE

SEQ ID NO: 21224 - protein, 28 aa, Artificial Sequence
  Description of Artificial Sequence: Synthetic peptide
DEEEIATTNPAATEQYGSVSTNLQRGDV

SEQ ID NO: 21225 - protein, 28 aa, Artificial Sequence
  Description of Artificial Sequence: Synthetic peptide
DEEEITTTNPVATEVYGSVGTNCQRGNR

SEQ ID NO: 21226 - protein, 28 aa, Artificial Sequence
  Description of Artificial Sequence: Synthetic peptide
DEEEIRTTNPVATEQYGSVDTNLIQGER

SEQ ID NO: 21227 - protein, 29 aa, Artificial Sequence
  Description of Artificial Sequence: Synthetic peptide
DEEEIRTTNPVATEQYGSVSTTNLQVMER

SEQ ID NO: 21228 - protein, 31 aa, Artificial Sequence
  Description of Artificial Sequence: Synthetic polypeptide
DEEEIRTTNPVATEQYGSVDSTINDQRNGNR

SEQ ID NO: 21229 - protein, 28 aa, Artificial Sequence
  Description of Artificial Sequence: Synthetic peptide
DEEEIRCTNPVATEQYGIVSTNLQIGNL

SEQ ID NO: 21230 - protein, 28 aa, Artificial Sequence
  Description of Artificial Sequence: Synthetic peptide
MEEEICTTNPVATEQYGSVSDNLQRMNR

SEQ ID NO: 21231 - protein, 29 aa, Artificial Sequence
  Description of Artificial Sequence: Synthetic peptide
DEEEIRTTNPCATEQYGSVSEEELQRGNR

SEQ ID NO: 21232 - protein, 28 aa, Artificial Sequence
  Description of Artificial Sequence: Synthetic peptide
DEEAIRTTNPAATEQYGSVSTNLQRMNM

SEQ ID NO: 21233 - protein, 29 aa, Artificial Sequence
  Description of Artificial Sequence: Synthetic peptide
DEEEIRTTNPVACEMYGSVSDNLQRAGNR

SEQ ID NO: 21234 - protein, 28 aa, Artificial Sequence
  Description of Artificial Sequence: Synthetic peptide
DDEEIRTTNPVATEQYGSVATNLGTGNR

SEQ ID NO: 21235 - protein, 28 aa, Artificial Sequence
  Description of Artificial Sequence: Synthetic peptide
DEEEIRTTNPVATECYGSVSECLQRGND

SEQ ID NO: 21236 - protein, 28 aa, Artificial Sequence
  Description of Artificial Sequence: Synthetic peptide
YEEEINTTNPVATEQYGIVSTNLQRGGR

SEQ ID NO: 21237 - protein, 28 aa, Artificial Sequence
  Description of Artificial Sequence: Synthetic peptide
DPEEIRTTNPVATEQWGTVSTNLQRGNE

SEQ ID NO: 21238 - protein, 30 aa, Artificial Sequence
  Description of Artificial Sequence: Synthetic polypeptide
DEEEIRTTNPVATEQYGSVSCTNGLQHGNW

SEQ ID NO: 21239 - protein, 28 aa, Artificial Sequence
  Description of Artificial Sequence: Synthetic peptide
DEEEIRTTNPVATECYGSVSTNPQRGEN

SEQ ID NO: 21240 - protein, 28 aa, Artificial Sequence
  Description of Artificial Sequence: Synthetic peptide
DEEEIRQTNPVATEQYGVVSTGLQEGNR

SEQ ID NO: 21241 - protein, 28 aa, Artificial Sequence
  Description of Artificial Sequence: Synthetic peptide
DEEEIRTTNPVATECYGSVSTDLQIGNN

SEQ ID NO: 21242 - protein, 29 aa, Artificial Sequence
  Description of Artificial Sequence: Synthetic peptide
DEEEIRTTNPVATEQYGSVSTNEQILGNS

SEQ ID NO: 21243 - protein, 28 aa, Artificial Sequence
  Description of Artificial Sequence: Synthetic peptide
DEEEIRTTNPVATEMYGSVSTNPQVGNV

SEQ ID NO: 21244 - protein, 28 aa, Artificial Sequence
  Description of Artificial Sequence: Synthetic peptide
DEQEIATTNPVATEQYGWVGTNLQRGNR

SEQ ID NO: 21245 - protein, 30 aa, Artificial Sequence
  Description of Artificial Sequence: Synthetic polypeptide
DEEEIRTTNPVATEQYGSVTSHNDVQRGNR

SEQ ID NO: 21246 - protein, 28 aa, Artificial Sequence
  Description of Artificial Sequence: Synthetic peptide
DEEEIRTTNPVATCQYGSVSTNLCNGDR

SEQ ID NO: 21247 - protein, 28 aa, Artificial Sequence
  Description of Artificial Sequence: Synthetic peptide
DEEEIRTTNPVATEQYGSVSTELESGNI

SEQ ID NO: 21248 - protein, 30 aa, Artificial Sequence
  Description of Artificial Sequence: Synthetic polypeptide
SEEEIRTTNPVATETYGSVSTNLQREGDNR

SEQ ID NO: 21249 - protein, 29 aa, Artificial Sequence
  Description of Artificial Sequence: Synthetic peptide
DEEEIRTTNPVATEQYGSVSNELQMRGNM

SEQ ID NO: 21250 - protein, 28 aa, Artificial Sequence
  Description of Artificial Sequence: Synthetic peptide
VEEEIRCTNPVATEQYGSVGTNLQRGNQ

SEQ ID NO: 21251 - protein, 28 aa, Artificial Sequence
  Description of Artificial Sequence: Synthetic peptide
DEQEIRTTNPVCTEQYGSVSENLQRGNA

SEQ ID NO: 21252 - protein, 28 aa, Artificial Sequence
  Description of Artificial Sequence: Synthetic peptide
DEEEIATTNPVATEQYGSVSTDLQRGEL

SEQ ID NO: 21253 - protein, 28 aa, Artificial Sequence
  Description of Artificial Sequence: Synthetic peptide
DEEEIDTTNPVATEQYGSVSTDLQNGNA

SEQ ID NO: 21254 - protein, 31 aa, Artificial Sequence
  Description of Artificial Sequence: Synthetic polypeptide
DEEEIRTTNPVATEQYGSVSTNLQERNGNDD

SEQ ID NO: 21255 - protein, 28 aa, Artificial Sequence
  Description of Artificial Sequence: Synthetic peptide
MEEEIRTTNPVATECYGSVSTNLQHGNE

SEQ ID NO: 21256 - protein, 28 aa, Artificial Sequence
  Description of Artificial Sequence: Synthetic peptide
DEEEIRTTNPEATEQYGSVSTLLQFGNM

SEQ ID NO: 21257 - protein, 29 aa, Artificial Sequence
  Description of Artificial Sequence: Synthetic peptide
DEEEIRTTNPVATECYGSVSTNLQYGNDQ

SEQ ID NO: 21258 - protein, 29 aa, Artificial Sequence
  Description of Artificial Sequence: Synthetic peptide
DEEEIRTTNPVATEQYGSVSTNLEMVGNM

SEQ ID NO: 21259 - protein, 28 aa, Artificial Sequence
  Description of Artificial Sequence: Synthetic peptide
DEEEIAQTNPVATEQYGSVSTNLQIGNT

SEQ ID NO: 21260 - protein, 28 aa, Artificial Sequence
  Description of Artificial Sequence: Synthetic peptide
DEEEIRTTNPVSTEQYGSASTNGQVGNR

SEQ ID NO: 21261 - protein, 28 aa, Artificial Sequence
  Description of Artificial Sequence: Synthetic peptide
DEVEIRTTNPVATELYGSVSTNEQHGNR

SEQ ID NO: 21262 - protein, 28 aa, Artificial Sequence
  Description of Artificial Sequence: Synthetic peptide
DDEEIRTTNPVATEIYGSVSSNLERGNR

SEQ ID NO: 21263 - protein, 28 aa, Artificial Sequence
  Description of Artificial Sequence: Synthetic peptide
DEEEITTTNPVAVEQYGSVSTNPQRGNV

SEQ ID NO: 21264 - protein, 28 aa, Artificial Sequence
  Description of Artificial Sequence: Synthetic peptide
DDEEIRTTNPIATEIYGAVSTNLQRGNR

SEQ ID NO: 21265 - protein, 28 aa, Artificial Sequence
  Description of Artificial Sequence: Synthetic peptide
DEEEIRTTNPVATEQWGDVSENLMRGNR

SEQ ID NO: 21266 - protein, 28 aa, Artificial Sequence
  Description of Artificial Sequence: Synthetic peptide
DEVEIVTTNPVATEQYGSVSTNLQVGNQ

SEQ ID NO: 21267 - protein, 29 aa, Artificial Sequence
  Description of Artificial Sequence: Synthetic peptide
DEEEIRTTNPVATEQYGSASTNWQERGNH

SEQ ID NO: 21268 - protein, 28 aa, Artificial Sequence
  Description of Artificial Sequence: Synthetic peptide
DEGEIRTTNPVATEQYGSVSTNLIQGNQ

SEQ ID NO: 21269 - protein, 28 aa, Artificial Sequence
  Description of Artificial Sequence: Synthetic peptide
DEQEIRTTNPVATEQYGSVSTNEMRGTR

SEQ ID NO: 21270 - protein, 31 aa, Artificial Sequence
  Description of Artificial Sequence: Synthetic polypeptide
DEEEIRTTNPVATEQYGSVSTMNLQDRGDNF

SEQ ID NO: 21271 - protein, 29 aa, Artificial Sequence
  Description of Artificial Sequence: Synthetic peptide
DEEEIRTTNPVATEWYGSVSTNLQNVGNY

SEQ ID NO: 21272 - protein, 28 aa, Artificial Sequence
  Description of Artificial Sequence: Synthetic peptide
DEGEIRTTNPVCTEQYGSISTNLQRGNV

SEQ ID NO: 21273 - protein, 28 aa, Artificial Sequence
  Description of Artificial Sequence: Synthetic peptide
DEEEIRTTNPVASELYGSVATNLQRGNQ

SEQ ID NO: 21274 - protein, 28 aa, Artificial Sequence
  Description of Artificial Sequence: Synthetic peptide
DEEEIRTTNPTATEQYGSVSTNEQRGTF

SEQ ID NO: 21275 - protein, 28 aa, Artificial Sequence
  Description of Artificial Sequence: Synthetic peptide
QEVEIRTTNPVATEQFGSVSTNLQRGNS

SEQ ID NO: 21276 - protein, 28 aa, Artificial Sequence
  Description of Artificial Sequence: Synthetic peptide
DEQEVRTTNPVATEQYGCVSMNLQRGNR

SEQ ID NO: 21277 - protein, 31 aa, Artificial Sequence
  Description of Artificial Sequence: Synthetic polypeptide
DEEEIRTTNPVATEQYGSVSTTNLQVEGENR

SEQ ID NO: 21278 - protein, 28 aa, Artificial Sequence
  Description of Artificial Sequence: Synthetic peptide
DEEEIATTNPVSTEQYGSVSTVLQRGGR

SEQ ID NO: 21279 - protein, 28 aa, Artificial Sequence
  Description of Artificial Sequence: Synthetic peptide
DEDEIRTTNPVATEQYGSVSTPLQDGNA

SEQ ID NO: 21280 - protein, 28 aa, Artificial Sequence
  Description of Artificial Sequence: Synthetic peptide
AEEEIRTTNPVATEQYGSVSTDLNEGNR

SEQ ID NO: 21281 - protein, 28 aa, Artificial Sequence
  Description of Artificial Sequence: Synthetic peptide
DEEEIRQTNPVATEQYGCVSTNLQPGDR

SEQ ID NO: 21282 - protein, 30 aa, Artificial Sequence
  Description of Artificial Sequence: Synthetic polypeptide
DEEEIRSTNPVATEQYGSVCSTENLQFGNR

SEQ ID NO: 21283 - protein, 28 aa, Artificial Sequence
  Description of Artificial Sequence: Synthetic peptide
DEEEIRTTNPVATEQYGSVSDDLQLGNQ

SEQ ID NO: 21284 - protein, 31 aa, Artificial Sequence
  Description of Artificial Sequence: Synthetic polypeptide
DEEEIRTTNPVATEQYGSVSETNGLQDGENR

SEQ ID NO: 21285 - protein, 28 aa, Artificial Sequence
  Description of Artificial Sequence: Synthetic peptide
DEQEIATTNPVATEMYGVVSTNLQRGNR

SEQ ID NO: 21286 - protein, 28 aa, Artificial Sequence
  Description of Artificial Sequence: Synthetic peptide
DEEEIRTTNPVATEQYGSVSTDLQQGEQ

SEQ ID NO: 21287 - protein, 29 aa, Artificial Sequence
  Description of Artificial Sequence: Synthetic peptide
DEDEIATTNPVATEQYGSVSTANLQRGNI

SEQ ID NO: 21288 - protein, 30 aa, Artificial Sequence
  Description of Artificial Sequence: Synthetic polypeptide
DEEEIRTTNPVATEQYGEVSTTNPLQRGNQ

SEQ ID NO: 21289 - protein, 28 aa, Artificial Sequence
  Description of Artificial Sequence: Synthetic peptide
DEEEIRTTNPVATEQYGSVSENLEFFNR

SEQ ID NO: 21290 - protein, 28 aa, Artificial Sequence
  Description of Artificial Sequence: Synthetic peptide
DEEEIRTTNPVATEQYGSVETDLQHGWR

SEQ ID NO: 21291 - protein, 30 aa, Artificial Sequence
  Description of Artificial Sequence: Synthetic polypeptide
DEEEIRTTNPDATEQYGSVSTNLVQRNGNP

SEQ ID NO: 21292 - protein, 31 aa, Artificial Sequence
  Description of Artificial Sequence: Synthetic polypeptide
DEEEIRTTNPEATEQYGSVVSTTNVLQRGNR

SEQ ID NO: 21293 - protein, 30 aa, Artificial Sequence
  Description of Artificial Sequence: Synthetic polypeptide
DEEEIRTTNPVATEQYGSVSTMNLQIGDNF

SEQ ID NO: 21294 - protein, 28 aa, Artificial Sequence
  Description of Artificial Sequence: Synthetic peptide
DEEEIRTTNPVATEQYGSVHEHLQHGNR

SEQ ID NO: 21295 - protein, 28 aa, Artificial Sequence
  Description of Artificial Sequence: Synthetic peptide
DEEEIAATNPVATEQYGSVSNNLQRGTR

SEQ ID NO: 21296 - protein, 30 aa, Artificial Sequence
  Description of Artificial Sequence: Synthetic polypeptide
DEESIRTTNPVATEQYGSVSTNLQARGVND

SEQ ID NO: 21297 - protein, 28 aa, Artificial Sequence
  Description of Artificial Sequence: Synthetic peptide
DEEEIRQTNPVATEQYGSVSTDLQVGER

SEQ ID NO: 21298 - protein, 29 aa, Artificial Sequence
  Description of Artificial Sequence: Synthetic peptide
DEEEIRTTNPVATETYGSVSNNLQRGNDF

SEQ ID NO: 21299 - protein, 28 aa, Artificial Sequence
  Description of Artificial Sequence: Synthetic peptide
DEEEIRTTNPVATECYGSVSMNLEVGNR

SEQ ID NO: 21300 - protein, 30 aa, Artificial Sequence
  Description of Artificial Sequence: Synthetic polypeptide
DEHEIRTTNPVATEQYGDVSCTMNLQRGNR

SEQ ID NO: 21301 - protein, 28 aa, Artificial Sequence
  Description of Artificial Sequence: Synthetic peptide
DEEEVRTTNPVASEQYGCVSTNLERGNR

SEQ ID NO: 21302 - protein, 28 aa, Artificial Sequence
  Description of Artificial Sequence: Synthetic peptide
DEEEIRTTNPTATEQYGSVSTNEQIGNE

SEQ ID NO: 21303 - protein, 28 aa, Artificial Sequence
  Description of Artificial Sequence: Synthetic peptide
RENEIRTTNPVATEQYGSVSTNLQLGNA

SEQ ID NO: 21304 - protein, 28 aa, Artificial Sequence
  Description of Artificial Sequence: Synthetic peptide
MEEEIRTVNPVATEQYGSVSTNLQTGER

SEQ ID NO: 21305 - protein, 29 aa, Artificial Sequence
  Description of Artificial Sequence: Synthetic peptide
DEEEIRTTNPVATEQYGSVSENLQCHGNQ

SEQ ID NO: 21306 - protein, 28 aa, Artificial Sequence
  Description of Artificial Sequence: Synthetic peptide
CEEEIRTTNPVATEQYGSVATNLQVGDR

SEQ ID NO: 21307 - protein, 28 aa, Artificial Sequence
  Description of Artificial Sequence: Synthetic peptide
DEEEIRTTNPVCTEQYGSVSTNDQAGNY

SEQ ID NO: 21308 - protein, 28 aa, Artificial Sequence
  Description of Artificial Sequence: Synthetic peptide
DEEEIRTTNPVATEQYGSVSTELEPGNP

SEQ ID NO: 21309 - protein, 28 aa, Artificial Sequence
  Description of Artificial Sequence: Synthetic peptide
DEEEIRTTNPVATEPYGDVSTNLQAGNQ

SEQ ID NO: 21310 - protein, 28 aa, Artificial Sequence
  Description of Artificial Sequence: Synthetic peptide
DEEEIRTTNPVATEQYGDVSENLQLGNV

SEQ ID NO: 21311 - protein, 28 aa, Artificial Sequence
  Description of Artificial Sequence: Synthetic peptide
DEDEIRTTNPVADEQWGSVSTNLQRGFR

SEQ ID NO: 21312 - protein, 28 aa, Artificial Sequence
  Description of Artificial Sequence: Synthetic peptide
DEEEIRTTNPVATEQYGSVSTDLEVGND

SEQ ID NO: 21313 - protein, 30 aa, Artificial Sequence
  Description of Artificial Sequence: Synthetic polypeptide
DEVEIRTTNPVATEQYGSVSTGNLQLGDNR

SEQ ID NO: 21314 - protein, 28 aa, Artificial Sequence
  Description of Artificial Sequence: Synthetic peptide
DEEEIRTTNPVATEQYGDVSTNLQIGEY

SEQ ID NO: 21315 - protein, 28 aa, Artificial Sequence
  Description of Artificial Sequence: Synthetic peptide
KENEIRTTNPVATEQYGSVSTDLQRGNH

SEQ ID NO: 21316 - protein, 28 aa, Artificial Sequence
  Description of Artificial Sequence: Synthetic peptide
FDSEITTTNPVATEQYGSVSTNLQRGNR

SEQ ID NO: 21317 - protein, 29 aa, Artificial Sequence
  Description of Artificial Sequence: Synthetic peptide
HEEEIRTTNPVATEQYGSVSTNGQWAGNR

SEQ ID NO: 21318 - protein, 28 aa, Artificial Sequence
  Description of Artificial Sequence: Synthetic peptide
DESEIRTTNPVATEQYGAVSTNFQDGNR

SEQ ID NO: 21319 - protein, 28 aa, Artificial Sequence
  Description of Artificial Sequence: Synthetic peptide
DEHEIRTTNPVATEQYGSVGTNLQGGNM

SEQ ID NO: 21320 - protein, 28 aa, Artificial Sequence
  Description of Artificial Sequence: Synthetic peptide
DEEEIRTTNPVATEQYGSVSEDLQQGNI

SEQ ID NO: 21321 - protein, 31 aa, Artificial Sequence
  Description of Artificial Sequence: Synthetic polypeptide
DEEEIRTTNPVATEQYGESVSTNLQREDNER

SEQ ID NO: 21322 - protein, 31 aa, Artificial Sequence
  Description of Artificial Sequence: Synthetic polypeptide
DEEEIRTTNPVATEQYGSVSTPNLQERGNPP

SEQ ID NO: 21323 - protein, 28 aa, Artificial Sequence
  Description of Artificial Sequence: Synthetic peptide
DEEEIRCTNPVSTEQYGIVSENLQRGNR

SEQ ID NO: 21324 - protein, 29 aa, Artificial Sequence
  Description of Artificial Sequence: Synthetic peptide
DEEEIRTTNPVATEQYGSVSTNLQILGDY

SEQ ID NO: 21325 - protein, 29 aa, Artificial Sequence
  Description of Artificial Sequence: Synthetic peptide
DEQEIRTTNPVATECYGSVSATNLQHGNR

SEQ ID NO: 21326 - protein, 30 aa, Artificial Sequence
  Description of Artificial Sequence: Synthetic polypeptide
DEEEIRTTNPVATEQYGSVSTNDVQRKGER

SEQ ID NO: 21327 - protein, 31 aa, Artificial Sequence
  Description of Artificial Sequence: Synthetic polypeptide
DEEEIRTTNPVATETYGSVSTMNLQERGNTR

SEQ ID NO: 21328 - protein, 28 aa, Artificial Sequence
  Description of Artificial Sequence: Synthetic peptide
DEEEIRTVNPVASEQYGSVSQNLQRGER

SEQ ID NO: 21329 - protein, 28 aa, Artificial Sequence
  Description of Artificial Sequence: Synthetic peptide
DEEEIRTTNPTATEQYGSVSTNEQVGNQ

SEQ ID NO: 21330 - protein, 28 aa, Artificial Sequence
  Description of Artificial Sequence: Synthetic peptide
DEEEIRTTNPVATECYGSVSTNEQIGNA

SEQ ID NO: 21331 - protein, 30 aa, Artificial Sequence
  Description of Artificial Sequence: Synthetic polypeptide
DEEEIRTTNPVATEQYGSVSTNLQCGGNDS

SEQ ID NO: 21332 - protein, 29 aa, Artificial Sequence
  Description of Artificial Sequence: Synthetic peptide
DEEEIRTTNPVATEQYGVVSCNNLQRFNR

SEQ ID NO: 21333 - protein, 28 aa, Artificial Sequence
  Description of Artificial Sequence: Synthetic peptide
DEEEIRTTNPVACEQYGEVSEVLQRGNR

SEQ ID NO: 21334 - protein, 28 aa, Artificial Sequence
  Description of Artificial Sequence: Synthetic peptide
DEEEIRTTNPVATEQYGSVSTADQNGNF

SEQ ID NO: 21335 - protein, 28 aa, Artificial Sequence
  Description of Artificial Sequence: Synthetic peptide
DEEEIRTTNPVATEQWGSVSENEQRGNA

SEQ ID NO: 21336 - protein, 28 aa, Artificial Sequence
  Description of Artificial Sequence: Synthetic peptide
DENEIAATNPVATEQYGVVSTNLQRGNR

SEQ ID NO: 21337 - protein, 31 aa, Artificial Sequence
  Description of Artificial Sequence: Synthetic polypeptide
DEEEIRTTNPVATEQYGSVSSTNPLVTRGNR

SEQ ID NO: 21338 - protein, 31 aa, Artificial Sequence
  Description of Artificial Sequence: Synthetic polypeptide
DEEEIRCTNPVATEQYGSVSTMNLQPRGDNR

SEQ ID NO: 21339 - protein, 28 aa, Artificial Sequence
  Description of Artificial Sequence: Synthetic peptide
DEEEIRTTNPVATEQYGSVSTADDVGNR

SEQ ID NO: 21340 - protein, 29 aa, Artificial Sequence
  Description of Artificial Sequence: Synthetic peptide
DEEEIRTTNPVATEQYGSVSALNEQRGNV

SEQ ID NO: 21341 - protein, 30 aa, Artificial Sequence
  Description of Artificial Sequence: Synthetic polypeptide
DENEIRTTNPVATEQYGSVSTNLQEREGNM

SEQ ID NO: 21342 - protein, 29 aa, Artificial Sequence
  Description of Artificial Sequence: Synthetic peptide
DEQEIVTTNPVATEQYGSVSAENLQRGNR

SEQ ID NO: 21343 - protein, 28 aa, Artificial Sequence
  Description of Artificial Sequence: Synthetic peptide
DENEIRQTNPVATEQYGSVSTNLQRGED

SEQ ID NO: 21344 - protein, 28 aa, Artificial Sequence
  Description of Artificial Sequence: Synthetic peptide
DEEEIRSTNPVATEMYGGVSSNLQRGNR

SEQ ID NO: 21345 - protein, 28 aa, Artificial Sequence
  Description of Artificial Sequence: Synthetic peptide
MEQEIRTTNPVATEQYGSVSTDLQRGNF

SEQ ID NO: 21346 - protein, 30 aa, Artificial Sequence
  Description of Artificial Sequence: Synthetic polypeptide
DEEEIRTTNPVATEQYGSVSTNPQNEGDNR

SEQ ID NO: 21347 - protein, 29 aa, Artificial Sequence
  Description of Artificial Sequence: Synthetic peptide
DEEEIRTTNPVATEQWGSVSTNLQMQGNL

SEQ ID NO: 21348 - protein, 28 aa, Artificial Sequence
  Description of Artificial Sequence: Synthetic peptide
DENELRSVNPVATEQYGSVSTNLQRGNR

SEQ ID NO: 21349 - protein, 29 aa, Artificial Sequence
  Description of Artificial Sequence: Synthetic peptide
DEFEIRTTNPVATEQYGTVSATNLQRGNE

SEQ ID NO: 21350 - protein, 28 aa, Artificial Sequence
  Description of Artificial Sequence: Synthetic peptide
DEEEIRTTNPVATEQYGDASDNLQRGGR

SEQ ID NO: 21351 - protein, 28 aa, Artificial Sequence
  Description of Artificial Sequence: Synthetic peptide
QEQEIRTTNPVATEQYGSASTNLQRGNA

SEQ ID NO: 21352 - protein, 31 aa, Artificial Sequence
  Description of Artificial Sequence: Synthetic polypeptide
DEEEIRTTNPEATEQYGSVSTNPLVQIRGNR

SEQ ID NO: 21353 - protein, 29 aa, Artificial Sequence
  Description of Artificial Sequence: Synthetic peptide
DEMEIRTTNPVATEQYGSVSTTNLQQGNP

SEQ ID NO: 21354 - protein, 28 aa, Artificial Sequence
  Description of Artificial Sequence: Synthetic peptide
DEEEIRTTNPVATEQYGSVSTNDDPGNG

SEQ ID NO: 21355 - protein, 29 aa, Artificial Sequence
  Description of Artificial Sequence: Synthetic peptide
DEQEIATTNPVATEQYGSVSADNLQRGNR

SEQ ID NO: 21356 - protein, 28 aa, Artificial Sequence
  Description of Artificial Sequence: Synthetic peptide
AEEEVVTTNPVATEQYGSVSTNLQRGQR

SEQ ID NO: 21357 - protein, 28 aa, Artificial Sequence
  Description of Artificial Sequence: Synthetic peptide
DEEEIATTNPVATEQYGSVSTNLEDGNT

SEQ ID NO: 21358 - protein, 30 aa, Artificial Sequence
  Description of Artificial Sequence: Synthetic polypeptide
DEEEIRTTNPVATIQYGSVSLTNLQAGENR

SEQ ID NO: 21359 - protein, 28 aa, Artificial Sequence
  Description of Artificial Sequence: Synthetic peptide
NEEEIRTTNPVCTEQYGSVSTNLQRGLD

SEQ ID NO: 21360 - protein, 28 aa, Artificial Sequence
  Description of Artificial Sequence: Synthetic peptide
DEEEIRTTNPVATEQYGSVSTDPQPGNY

SEQ ID NO: 21361 - protein, 28 aa, Artificial Sequence
  Description of Artificial Sequence: Synthetic peptide
DEEEIRTTNPTATENYGSVSTNEQRGNL

SEQ ID NO: 21362 - protein, 28 aa, Artificial Sequence
  Description of Artificial Sequence: Synthetic peptide
DEEEIRTTNPVATECYGVVSTNLQRGEA

SEQ ID NO: 21363 - protein, 29 aa, Artificial Sequence
  Description of Artificial Sequence: Synthetic peptide
DEEEIRTTNPVATEQYGSVSTDLQTGNDM

SEQ ID NO: 21364 - protein, 28 aa, Artificial Sequence
  Description of Artificial Sequence: Synthetic peptide
REEEIRQTNPVATEQYGEVSTNWQRGNR

SEQ ID NO: 21365 - protein, 31 aa, Artificial Sequence
  Description of Artificial Sequence: Synthetic polypeptide
DEEEIRTTNPVATEQFGSVSTNLQEREGNTR

SEQ ID NO: 21366 - protein, 28 aa, Artificial Sequence
  Description of Artificial Sequence: Synthetic peptide
DEEEIRTTNPVATCFYGSVSTNLSYGNR

SEQ ID NO: 21367 - protein, 30 aa, Artificial Sequence
  Description of Artificial Sequence: Synthetic polypeptide
DEEEIRTTNPVATEQYGSVSTANLQAGNHQ

SEQ ID NO: 21368 - protein, 30 aa, Artificial Sequence
  Description of Artificial Sequence: Synthetic polypeptide
DESEIRTTNPVASEQYGSVSTENLQRGDNR

SEQ ID NO: 21369 - protein, 30 aa, Artificial Sequence
  Description of Artificial Sequence: Synthetic polypeptide
DEEEIRTTNPVATEQYGSVSTNLERKGNDM

SEQ ID NO: 21370 - protein, 28 aa, Artificial Sequence
  Description of Artificial Sequence: Synthetic peptide
DEYEIGPTNPVATEQYGEVSTNLQRGNR

SEQ ID NO: 21371 - protein, 28 aa, Artificial Sequence
  Description of Artificial Sequence: Synthetic peptide
DEEEIRTTNPVATEQYGDVSEDLQVGNR

SEQ ID NO: 21372 - protein, 28 aa, Artificial Sequence
  Description of Artificial Sequence: Synthetic peptide
DEEEIRTTNPVATEQYGSVSTNGDGGNM

SEQ ID NO: 21373 - protein, 30 aa, Artificial Sequence
  Description of Artificial Sequence: Synthetic polypeptide
DEEEIRTTNPVATEQYGSVTSATNLERGNS

SEQ ID NO: 21374 - protein, 30 aa, Artificial Sequence
  Description of Artificial Sequence: Synthetic polypeptide
DEEEIRTTNPVATECYGSVSTNLQTEGNDR

SEQ ID NO: 21375 - protein, 29 aa, Artificial Sequence
  Description of Artificial Sequence: Synthetic peptide
MEEEIRTTNPVATEQYGSVSTNLQTEGNM

SEQ ID NO: 21376 - protein, 30 aa, Artificial Sequence
  Description of Artificial Sequence: Synthetic polypeptide
DEEEIRTTNPVATEQYGSVDSTNGQRGTNQ

SEQ ID NO: 21377 - protein, 31 aa, Artificial Sequence
  Description of Artificial Sequence: Synthetic polypeptide
DEEEIRTTNPVATEQYGSVSTMNDQVRKGNR

SEQ ID NO: 21378 - protein, 28 aa, Artificial Sequence
  Description of Artificial Sequence: Synthetic peptide
DEEEIRTTNPVATEQYGSVSTEPQIGNS

SEQ ID NO: 21379 - protein, 28 aa, Artificial Sequence
  Description of Artificial Sequence: Synthetic peptide
DEVEIRCTNPVATEQYGSVSTNLQHGMR

SEQ ID NO: 21380 - protein, 28 aa, Artificial Sequence
  Description of Artificial Sequence: Synthetic peptide
DEEEIRTTNPVATEQYGSVDTNLMLGNY

SEQ ID NO: 21381 - protein, 29 aa, Artificial Sequence
  Description of Artificial Sequence: Synthetic peptide
DENEIRTTNPVATEQYGSVSTDLQREGER

SEQ ID NO: 21382 - protein, 29 aa, Artificial Sequence
  Description of Artificial Sequence: Synthetic peptide
DDEEIRTTNPVATEQYGQVSTNLQREGAR

SEQ ID NO: 21383 - protein, 28 aa, Artificial Sequence
  Description of Artificial Sequence: Synthetic peptide
DEEEIRQTNPVATEQYGSVSTCLCRGER

SEQ ID NO: 21384 - protein, 30 aa, Artificial Sequence
  Description of Artificial Sequence: Synthetic polypeptide
DEEEIRTTNPVATEQYGSVSTANLQQGNTH

SEQ ID NO: 21385 - protein, 28 aa, Artificial Sequence
  Description of Artificial Sequence: Synthetic peptide
AENEIRTTNPQATEQYGSVSTNLQRGNE

SEQ ID NO: 21386 - protein, 28 aa, Artificial Sequence
  Description of Artificial Sequence: Synthetic peptide
SEEEIRTTNPVATEQYGSVSTNLQVGDA

SEQ ID NO: 21387 - protein, 28 aa, Artificial Sequence
  Description of Artificial Sequence: Synthetic peptide
HEEEIRTTNPVATEQYGSVSMNLQRGMI

SEQ ID NO: 21388 - protein, 28 aa, Artificial Sequence
  Description of Artificial Sequence: Synthetic peptide
DETEIWTTNPVGTEQYGSVSNNLQRGNR

SEQ ID NO: 21389 - protein, 28 aa, Artificial Sequence
  Description of Artificial Sequence: Synthetic peptide
DENEIRTTNPVATEQYGWVSTNLQMGNC

SEQ ID NO: 21390 - protein, 30 aa, Artificial Sequence
  Description of Artificial Sequence: Synthetic polypeptide
DENEIRTTNPVATEQYGSVSSNLQCRNGNR

SEQ ID NO: 21391 - protein, 28 aa, Artificial Sequence
  Description of Artificial Sequence: Synthetic peptide
DEVEIRTTNPVSTEQYGSVGENLQRGNR

SEQ ID NO: 21392 - protein, 30 aa, Artificial Sequence
  Description of Artificial Sequence: Synthetic polypeptide
DEEEIRTTNPVATEQYGEVSATLLQRGPNR

SEQ ID NO: 21393 - protein, 28 aa, Artificial Sequence
  Description of Artificial Sequence: Synthetic peptide
QEVEIRTTNPVATEIYGCVSTNLQRGNR

SEQ ID NO: 21394 - protein, 28 aa, Artificial Sequence
  Description of Artificial Sequence: Synthetic peptide
DEEEIRTTNPVATECYGSVSTNLQHGEW

SEQ ID NO: 21395 - protein, 29 aa, Artificial Sequence
  Description of Artificial Sequence: Synthetic peptide
DEEEIRTTNPVATEQYGDVSENLQNRGNA

SEQ ID NO: 21396 - protein, 28 aa, Artificial Sequence
  Description of Artificial Sequence: Synthetic peptide
DETEIRTTNPVGTEQYGSVSTELLRGNR

SEQ ID NO: 21397 - protein, 28 aa, Artificial Sequence
  Description of Artificial Sequence: Synthetic peptide
DEQEIATTNPVATECYGTVSTNLQRGNR

SEQ ID NO: 21398 - protein, 28 aa, Artificial Sequence
  Description of Artificial Sequence: Synthetic peptide
DEEEIRTTNPVATEVYGGVANNLQRGNR

SEQ ID NO: 21399 - protein, 28 aa, Artificial Sequence
  Description of Artificial Sequence: Synthetic peptide
DEEEIRTTNPVATECYGSVSTDLQNGNM

SEQ ID NO: 21400 - protein, 28 aa, Artificial Sequence
  Description of Artificial Sequence: Synthetic peptide
DEQEIRTTNPVATECYGSVSTNLQAGNE

SEQ ID NO: 21401 - protein, 29 aa, Artificial Sequence
  Description of Artificial Sequence: Synthetic peptide
DEEEIRTTNPVATEQYGSVSTCLQRELER

SEQ ID NO: 21402 - protein, 30 aa, Artificial Sequence
  Description of Artificial Sequence: Synthetic polypeptide
DEEEIRTTNPVATEQYGSVSITADQRGDNR

SEQ ID NO: 21403 - protein, 31 aa, Artificial Sequence
  Description of Artificial Sequence: Synthetic polypeptide
DEETIRTTNPVATEQYGSVSCTMNPLQRGNR

SEQ ID NO: 21404 - protein, 28 aa, Artificial Sequence
  Description of Artificial Sequence: Synthetic peptide
DEEEIRTTNPVATELYGSVSTNEQLGNL

SEQ ID NO: 21405 - protein, 28 aa, Artificial Sequence
  Description of Artificial Sequence: Synthetic peptide
DEEEIRTTNPVCTEQYGSVDTNDQMGNR

SEQ ID NO: 21406 - protein, 28 aa, Artificial Sequence
  Description of Artificial Sequence: Synthetic peptide
DEEEIRTTNPTATEQYGSVSTNEQHGNS

SEQ ID NO: 21407 - protein, 28 aa, Artificial Sequence
  Description of Artificial Sequence: Synthetic peptide
DETEIRTTNPVASEQYGAVSTNLQRGTR

SEQ ID NO: 21408 - protein, 28 aa, Artificial Sequence
  Description of Artificial Sequence: Synthetic peptide
DEEEIRTVNPVATEPYGSVSTNEQRGNF

SEQ ID NO: 21409 - protein, 30 aa, Artificial Sequence
  Description of Artificial Sequence: Synthetic polypeptide
DEEEIRTTNPVATEQYGSVSNDLQREGNFR

SEQ ID NO: 21410 - protein, 28 aa, Artificial Sequence
  Description of Artificial Sequence: Synthetic peptide
DEEEIATTNPVATECYGSVSTNLQIGNV

SEQ ID NO: 21411 - protein, 28 aa, Artificial Sequence
  Description of Artificial Sequence: Synthetic peptide
DEEEVRSTNPVATEQYGSASTNLQPGNR

SEQ ID NO: 21412 - protein, 28 aa, Artificial Sequence
  Description of Artificial Sequence: Synthetic peptide
DEEEIRTTNPVATEQYGSVSTGLEIGNF

SEQ ID NO: 21413 - protein, 28 aa, Artificial Sequence
  Description of Artificial Sequence: Synthetic peptide
DEEEIRTTNPVATEQYGSVDTELQQGNL

SEQ ID NO: 21414 - protein, 29 aa, Artificial Sequence
  Description of Artificial Sequence: Synthetic peptide
DEEEIRTTNPVATEQYGSVSTPLQTGNKA

SEQ ID NO: 21415 - protein, 30 aa, Artificial Sequence
  Description of Artificial Sequence: Synthetic polypeptide
DEEEIRTTNPVATEQYGSVSCTDLQRGNDQ

SEQ ID NO: 21416 - protein, 28 aa, Artificial Sequence
  Description of Artificial Sequence: Synthetic peptide
DEEEIHTTNPVATEQYGSVSTYLMYGNR

SEQ ID NO: 21417 - protein, 28 aa, Artificial Sequence
  Description of Artificial Sequence: Synthetic peptide
DEEEIRTTNPVATEQYGSVSTNLEHGEI

SEQ ID NO: 21418 - protein, 28 aa, Artificial Sequence
  Description of Artificial Sequence: Synthetic peptide
DEEEIRTTNPVATEQYGEVSDNLQQGER

SEQ ID NO: 21419 - protein, 30 aa, Artificial Sequence
  Description of Artificial Sequence: Synthetic polypeptide
DEEEIRTTNPVATEQYGSVSCTNLQCNGNN

SEQ ID NO: 21420 - protein, 28 aa, Artificial Sequence
  Description of Artificial Sequence: Synthetic peptide
DEEEISCTNPVATEQYGSVSTNLQRGDN

SEQ ID NO: 21421 - protein, 28 aa, Artificial Sequence
  Description of Artificial Sequence: Synthetic peptide
DEEEIRCTNPVSTEVYGSVSTELQRGNR

SEQ ID NO: 21422 - protein, 28 aa, Artificial Sequence
  Description of Artificial Sequence: Synthetic peptide
DEEEIRTTNPVSTEQYGSVSTNLQLGTS

SEQ ID NO: 21423 - protein, 28 aa, Artificial Sequence
  Description of Artificial Sequence: Synthetic peptide
DEEEIRQTNPVATEQYGSVSENLQQGNV

SEQ ID NO: 21424 - protein, 28 aa, Artificial Sequence
  Description of Artificial Sequence: Synthetic peptide
DEEEIMTTNPVATEQYGSVITNLQRENY

SEQ ID NO: 21425 - protein, 29 aa, Artificial Sequence
  Description of Artificial Sequence: Synthetic peptide
DEEEIRTTNPVATEQYGSVPATVLQFGNR

SEQ ID NO: 21426 - protein, 28 aa, Artificial Sequence
  Description of Artificial Sequence: Synthetic peptide
DEEEIRTTNPVSTEQYGSASTNLQRLNQ

SEQ ID NO: 21427 - protein, 28 aa, Artificial Sequence
  Description of Artificial Sequence: Synthetic peptide
DEEEIRTTNPTATEQYGSVSTNPQNGNV

SEQ ID NO: 21428 - protein, 29 aa, Artificial Sequence
  Description of Artificial Sequence: Synthetic peptide
DEEEITTTNPVATECYGSVSTDLQRKGNR

SEQ ID NO: 21429 - protein, 29 aa, Artificial Sequence
  Description of Artificial Sequence: Synthetic peptide
DEEEITTTNPVATEQYGSCVSTNLQMSNR

SEQ ID NO: 21430 - protein, 28 aa, Artificial Sequence
  Description of Artificial Sequence: Synthetic peptide
DEEEIRTTNPVATECYGSVSTELETGNR

SEQ ID NO: 21431 - protein, 28 aa, Artificial Sequence
  Description of Artificial Sequence: Synthetic peptide
DENEIRTTNPFATEQYGVVSTDLQRGNR

SEQ ID NO: 21432 - protein, 30 aa, Artificial Sequence
  Description of Artificial Sequence: Synthetic polypeptide
DEEIIRTTNPVATEQYGAVSTNGLQREGNR

SEQ ID NO: 21433 - protein, 28 aa, Artificial Sequence
  Description of Artificial Sequence: Synthetic peptide
DEEEIRATNPCATEMYGSVSTNLERGNR

SEQ ID NO: 21434 - protein, 28 aa, Artificial Sequence
  Description of Artificial Sequence: Synthetic peptide
DEEEIRCTNPVATEMYGNVATNLQRGNR

SEQ ID NO: 21435 - protein, 28 aa, Artificial Sequence
  Description of Artificial Sequence: Synthetic peptide
DEEEIRTTNPVSTETYGCVATNLQRGNR

SEQ ID NO: 21436 - protein, 28 aa, Artificial Sequence
  Description of Artificial Sequence: Synthetic peptide
DEEEIRQTNPVATEVYGSVSTNLQHGGR

SEQ ID NO: 21437 - protein, 30 aa, Artificial Sequence
  Description of Artificial Sequence: Synthetic polypeptide
DEEEIRTTNPVATEQYGSVSTGLQIRGDNY

SEQ ID NO: 21438 - protein, 29 aa, Artificial Sequence
  Description of Artificial Sequence: Synthetic peptide
DEEEIRTTNPVSTEQYGSVSTNLQTNGTR

SEQ ID NO: 21439 - protein, 30 aa, Artificial Sequence
  Description of Artificial Sequence: Synthetic polypeptide
DEEEIRTTNPVATELYGSVSTLNLQVRGNF

SEQ ID NO: 21440 - protein, 28 aa, Artificial Sequence
  Description of Artificial Sequence: Synthetic peptide
DEEEITQTNPVATEQYGSVSTNLQRGEN

SEQ ID NO: 21441 - protein, 29 aa, Artificial Sequence
  Description of Artificial Sequence: Synthetic peptide
DEEEIRTTNPVATEQYGVVSTNLQDAGNM

SEQ ID NO: 21442 - protein, 28 aa, Artificial Sequence
  Description of Artificial Sequence: Synthetic peptide
CEQEIRTTNPVATEQYGSVSTNLQNGNF

SEQ ID NO: 21443 - protein, 28 aa, Artificial Sequence
  Description of Artificial Sequence: Synthetic peptide
DEEEIRTTNPVATEQYGSVSTDPQIGNS

SEQ ID NO: 21444 - protein, 28 aa, Artificial Sequence
  Description of Artificial Sequence: Synthetic peptide
DEEEIRTTNPVATEQYGDVSTNEQRENA

SEQ ID NO: 21445 - protein, 28 aa, Artificial Sequence
  Description of Artificial Sequence: Synthetic peptide
DEEEIRTVNPAATEQYGSVSENLQHGNR

SEQ ID NO: 21446 - protein, 29 aa, Artificial Sequence
  Description of Artificial Sequence: Synthetic peptide
DEEEIGTTNPVATEQYGGVSDMNLQRGNR

SEQ ID NO: 21447 - protein, 29 aa, Artificial Sequence
  Description of Artificial Sequence: Synthetic peptide
DEQEIRTTNPVATEIYGSVSMNLQRNGNR

SEQ ID NO: 21448 - protein, 28 aa, Artificial Sequence
  Description of Artificial Sequence: Synthetic peptide
DEQEIRTTNPVATEQWGSVSTNEQRGNF

SEQ ID NO: 21449 - protein, 30 aa, Artificial Sequence
  Description of Artificial Sequence: Synthetic polypeptide
DEEEIRTTNPVATEQYGSVSTNLQDDGNDD

SEQ ID NO: 21450 - protein, 28 aa, Artificial Sequence
  Description of Artificial Sequence: Synthetic peptide
DENEIRTTNPVATEQYGSVSENEERGNR

SEQ ID NO: 21451 - protein, 31 aa, Artificial Sequence
  Description of Artificial Sequence: Synthetic polypeptide
DEEEIRTTNPVATEQYGSVSTMNNLQRGIER

SEQ ID NO: 21452 - protein, 28 aa, Artificial Sequence
  Description of Artificial Sequence: Synthetic peptide
DEEEIRTTNPVATEQYGSVSTELQTGEV

SEQ ID NO: 21453 - protein, 28 aa, Artificial Sequence
  Description of Artificial Sequence: Synthetic peptide
DEQEIRTTNPVATEQYGSVSTNDQVGNY

SEQ ID NO: 21454 - protein, 28 aa, Artificial Sequence
  Description of Artificial Sequence: Synthetic peptide
DEEEIRTTNPVATEQWGSQSTELQHGNR

SEQ ID NO: 21455 - protein, 28 aa, Artificial Sequence
  Description of Artificial Sequence: Synthetic peptide
DEEEIRATNPCATEQYGSVPTNVQRGNR

SEQ ID NO: 21456 - protein, 29 aa, Artificial Sequence
  Description of Artificial Sequence: Synthetic peptide
DEEEVRTTNPVATEHYGSVGTNLQREGNR

SEQ ID NO: 21457 - protein, 28 aa, Artificial Sequence
  Description of Artificial Sequence: Synthetic peptide
DEEEIRTTNPVATEQYGSVSENEMRGNF

SEQ ID NO: 21458 - protein, 29 aa, Artificial Sequence
  Description of Artificial Sequence: Synthetic peptide
DEEEIRTTNPVATEQYGVVSTNLQMEGNN

SEQ ID NO: 21459 - protein, 28 aa, Artificial Sequence
  Description of Artificial Sequence: Synthetic peptide
DEQEIRTTNPVATEQYGSVSTNDQIGER

SEQ ID NO: 21460 - protein, 28 aa, Artificial Sequence
  Description of Artificial Sequence: Synthetic peptide
DEEEIRTTNPVATEQYGIVSMCLQRGNY

SEQ ID NO: 21461 - protein, 28 aa, Artificial Sequence
  Description of Artificial Sequence: Synthetic peptide
DENEIRTTNPVATEQYGSVSTELQNGNI

SEQ ID NO: 21462 - protein, 30 aa, Artificial Sequence
  Description of Artificial Sequence: Synthetic polypeptide
DEEEIRTTNPVATEQYGSVDTMNLQVGNDR

SEQ ID NO: 21463 - protein, 28 aa, Artificial Sequence
  Description of Artificial Sequence: Synthetic peptide
DEEEIRTTNPVATEQYWSVWTNDQRGNQ

SEQ ID NO: 21464 - protein, 30 aa, Artificial Sequence
  Description of Artificial Sequence: Synthetic polypeptide
DEEEIATTNPVATEQYGSVSATNEQRNGNR

SEQ ID NO: 21465 - protein, 28 aa, Artificial Sequence
  Description of Artificial Sequence: Synthetic peptide
DEEEIRTTNPVATEQYGSISTNVQRLNM

SEQ ID NO: 21466 - protein, 28 aa, Artificial Sequence
  Description of Artificial Sequence: Synthetic peptide
HEEEIRTTNPVATEHYGCVGTNLQRGNR

SEQ ID NO: 21467 - protein, 31 aa, Artificial Sequence
  Description of Artificial Sequence: Synthetic polypeptide
DEEEIRTTNPFATEQYGSVSTLGNLQRGVNR

SEQ ID NO: 21468 - protein, 30 aa, Artificial Sequence
  Description of Artificial Sequence: Synthetic polypeptide
DEEEIRTTNPVATEQYGSVSTALQRGTNYQ

SEQ ID NO: 21469 - protein, 28 aa, Artificial Sequence
  Description of Artificial Sequence: Synthetic peptide
DEIEIRTVNPVATEPYGSVSTNLQRLNR

SEQ ID NO: 21470 - protein, 28 aa, Artificial Sequence
  Description of Artificial Sequence: Synthetic peptide
SEEEIRTTNPVATEQYGSVSTNPQVGNH

SEQ ID NO: 21471 - protein, 29 aa, Artificial Sequence
  Description of Artificial Sequence: Synthetic peptide
DEEEIRTTNPVATECYGSVSTDLQIKGNR

SEQ ID NO: 21472 - protein, 28 aa, Artificial Sequence
  Description of Artificial Sequence: Synthetic peptide
DDEEIRTTNPVATEQYGVVATNLERGNR

SEQ ID NO: 21473 - protein, 28 aa, Artificial Sequence
  Description of Artificial Sequence: Synthetic peptide
DEQEIRTTNPVATECYGSVSTDLQHGNR

SEQ ID NO: 21474 - protein, 28 aa, Artificial Sequence
  Description of Artificial Sequence: Synthetic peptide
DEEEIRTTNPCATEQYGTASTNLQSGNR

SEQ ID NO: 21475 - protein, 28 aa, Artificial Sequence
  Description of Artificial Sequence: Synthetic peptide
DEEEVRQTNPVATEQYGEASTNLQRGNR

SEQ ID NO: 21476 - protein, 28 aa, Artificial Sequence
  Description of Artificial Sequence: Synthetic peptide
DEEEIRTTNPVATEQYGSVSTDDEVGNR

SEQ ID NO: 21477 - protein, 28 aa, Artificial Sequence
  Description of Artificial Sequence: Synthetic peptide
DETEIRSTNPVATELYGVVSTNLQRGNR

SEQ ID NO: 21478 - protein, 28 aa, Artificial Sequence
  Description of Artificial Sequence: Synthetic peptide
DEEEITTTNPVATECYGSVSTNLQHGNC

SEQ ID NO: 21479 - protein, 28 aa, Artificial Sequence
  Description of Artificial Sequence: Synthetic peptide
DEEEIRTTNPVATECYGSVSTDLQVGNQ

SEQ ID NO: 21480 - protein, 29 aa, Artificial Sequence
  Description of Artificial Sequence: Synthetic peptide
DEQEIRTTNPVATEQYGSVSTNLQAEGNM

SEQ ID NO: 21481 - protein, 29 aa, Artificial Sequence
  Description of Artificial Sequence: Synthetic peptide
SEEEIRATNPVATEQYGGVSTNLQREGNR

SEQ ID NO: 21482 - protein, 28 aa, Artificial Sequence
  Description of Artificial Sequence: Synthetic peptide
DEEEIRTTNPVATEQYGTVSTDDQRGNA

SEQ ID NO: 21483 - protein, 28 aa, Artificial Sequence
  Description of Artificial Sequence: Synthetic peptide
DEEEIRTTNPVATEQYGEVSTDLQGGDR

SEQ ID NO: 21484 - protein, 28 aa, Artificial Sequence
  Description of Artificial Sequence: Synthetic peptide
DEEEIRTTNPVATEQYGSVSTNWQQGYI

SEQ ID NO: 21485 - protein, 28 aa, Artificial Sequence
  Description of Artificial Sequence: Synthetic peptide
DEQEIRTTNPVATEQYGCVSTNLQSGNF

SEQ ID NO: 21486 - protein, 28 aa, Artificial Sequence
  Description of Artificial Sequence: Synthetic peptide
DEEEIRSTNPVATECYGSVATNLQRGMR

SEQ ID NO: 21487 - protein, 30 aa, Artificial Sequence
  Description of Artificial Sequence: Synthetic polypeptide
DEEEIRTTNPVATEQYGSVSTEPLQVRGER

SEQ ID NO: 21488 - protein, 32 aa, Artificial Sequence
  Description of Artificial Sequence: Synthetic polypeptide
DEEEIRTTNPVATEQYGSVISTCNGLQRGINR

SEQ ID NO: 21489 - protein, 31 aa, Artificial Sequence
  Description of Artificial Sequence: Synthetic polypeptide
DEEEIRTTNPVATEQYGSVSTNLQIDKGNDR

SEQ ID NO: 21490 - protein, 29 aa, Artificial Sequence
  Description of Artificial Sequence: Synthetic peptide
DEEEIRCTNPVATEQYGCVSMTNLQRGNN

SEQ ID NO: 21491 - protein, 29 aa, Artificial Sequence
  Description of Artificial Sequence: Synthetic peptide
DEQEIRTTNPVATEQYGIVSTNMQNRGNR

SEQ ID NO: 21492 - protein, 29 aa, Artificial Sequence
  Description of Artificial Sequence: Synthetic peptide
DENEIRTTNPVATEQYGSVSTDLQERGNM

SEQ ID NO: 21493 - protein, 28 aa, Artificial Sequence
  Description of Artificial Sequence: Synthetic peptide
DEEEICTTNPVATEQYGSVSTAIQTGNR

SEQ ID NO: 21494 - protein, 28 aa, Artificial Sequence
  Description of Artificial Sequence: Synthetic peptide
DEEEIRTTNPVASECYGTVSTNLERGNR

SEQ ID NO: 21495 - protein, 29 aa, Artificial Sequence
  Description of Artificial Sequence: Synthetic peptide
DEQEIRTTNPVATEVYGSASATNLQRGNR

SEQ ID NO: 21496 - protein, 28 aa, Artificial Sequence
  Description of Artificial Sequence: Synthetic peptide
KEEEIRATNPVATECYGSVSTDLQRGNR

SEQ ID NO: 21497 - protein, 28 aa, Artificial Sequence
  Description of Artificial Sequence: Synthetic peptide
DEEEIRTTNPVATEQYGSVSECLQHGNL

SEQ ID NO: 21498 - protein, 30 aa, Artificial Sequence
  Description of Artificial Sequence: Synthetic polypeptide
DEEEIRTTNPVATEQYGSVSATNLQFNGTR

SEQ ID NO: 21499 - protein, 28 aa, Artificial Sequence
  Description of Artificial Sequence: Synthetic peptide
NEENIRMTNPVATEQYGSVSTNLQPGNR

SEQ ID NO: 21500 - protein, 28 aa, Artificial Sequence
  Description of Artificial Sequence: Synthetic peptide
DESEIASTNPVATELYGSVSTNLQRGNR

SEQ ID NO: 21501 - protein, 28 aa, Artificial Sequence
  Description of Artificial Sequence: Synthetic peptide
DEMEIRTTNPVATEQYGAVSCNLQHGNR

SEQ ID NO: 21502 - protein, 30 aa, Artificial Sequence
  Description of Artificial Sequence: Synthetic polypeptide
DEEEIRTTNPVATEIYGSVSTNLQREGNTH

SEQ ID NO: 21503 - protein, 28 aa, Artificial Sequence
  Description of Artificial Sequence: Synthetic peptide
MEEEIRTTNPVATEQYGSVSEDLQNGNR

SEQ ID NO: 21504 - protein, 28 aa, Artificial Sequence
  Description of Artificial Sequence: Synthetic peptide
DEEEIRTTNPTATETYGSVSENWQRGNR

SEQ ID NO: 21505 - protein, 30 aa, Artificial Sequence
  Description of Artificial Sequence: Synthetic polypeptide
DEEEIRTTNPVATEQYGSVSTGNLQEHGNV

SEQ ID NO: 21506 - protein, 28 aa, Artificial Sequence
  Description of Artificial Sequence: Synthetic peptide
DEQEIRCTNPVATEIYGTVSTNLQRGNR

SEQ ID NO: 21507 - protein, 30 aa, Artificial Sequence
  Description of Artificial Sequence: Synthetic polypeptide
DEEEIRTTNPVCTEQYGSVSVNLPQNRGNR

SEQ ID NO: 21508 - protein, 28 aa, Artificial Sequence
  Description of Artificial Sequence: Synthetic peptide
DEFEIRTTNPVATEQYGSASTNLQHGND

SEQ ID NO: 21509 - protein, 31 aa, Artificial Sequence
  Description of Artificial Sequence: Synthetic polypeptide
DEEEIRTTNPVATEQYGSVSTDLQIRKGENR

SEQ ID NO: 21510 - protein, 28 aa, Artificial Sequence
  Description of Artificial Sequence: Synthetic peptide
DEQEIRTTNPVCTEQYGSVSTNLQHGNA

SEQ ID NO: 21511 - protein, 28 aa, Artificial Sequence
  Description of Artificial Sequence: Synthetic peptide
DDEEIRSTNPVATEQYGTMSTNLQRGNR

SEQ ID NO: 21512 - protein, 28 aa, Artificial Sequence
  Description of Artificial Sequence: Synthetic peptide
DENEIATTNPVATEVYGVVSTNLQRGNR

SEQ ID NO: 21513 - protein, 28 aa, Artificial Sequence
  Description of Artificial Sequence: Synthetic peptide
DEEEIRTTNPVATEQYGSVSTEDQRGEY

SEQ ID NO: 21514 - protein, 28 aa, Artificial Sequence
  Description of Artificial Sequence: Synthetic peptide
AEMEIRTTNPVATEQYGWVSTNLQRGNQ

SEQ ID NO: 21515 - protein, 31 aa, Artificial Sequence
  Description of Artificial Sequence: Synthetic polypeptide
DEEEIRTTNPVATEQYGSVESTNPLQRGDNP

SEQ ID NO: 21516 - protein, 28 aa, Artificial Sequence
  Description of Artificial Sequence: Synthetic peptide
DEEEIRTTNPIATEQYGSTGTNLQRGNI

SEQ ID NO: 21517 - protein, 28 aa, Artificial Sequence
  Description of Artificial Sequence: Synthetic peptide
DEEEIRSTNPVASEQYGSVSTDLQQGNR

SEQ ID NO: 21518 - protein, 31 aa, Artificial Sequence
  Description of Artificial Sequence: Synthetic polypeptide
DEEEIRTTNPVATEQYGSVSTNPLQIRGDDR

SEQ ID NO: 21519 - protein, 28 aa, Artificial Sequence
  Description of Artificial Sequence: Synthetic peptide
DEQEIRTTNPVATEQYGEVATNLQRGNM

SEQ ID NO: 21520 - protein, 30 aa, Artificial Sequence
  Description of Artificial Sequence: Synthetic polypeptide
DEEEIRTTNPVATEQYGEVSTGNLQDVGNR

SEQ ID NO: 21521 - protein, 29 aa, Artificial Sequence
  Description of Artificial Sequence: Synthetic peptide
DEEEIRTTNPVATEIYGSVASTNDQRGNF

SEQ ID NO: 21522 - protein, 28 aa, Artificial Sequence
  Description of Artificial Sequence: Synthetic peptide
DEEEIRTTNPVATEQYGSVSTELQIGDF

SEQ ID NO: 21523 - protein, 30 aa, Artificial Sequence
  Description of Artificial Sequence: Synthetic polypeptide
DEEEIRSTNPVATEQYGSVAATNLQRNGNR

SEQ ID NO: 21524 - protein, 29 aa, Artificial Sequence
  Description of Artificial Sequence: Synthetic peptide
DEGEIRQTNPVATEQYGSVSTNLQRAGMR

SEQ ID NO: 21525 - protein, 29 aa, Artificial Sequence
  Description of Artificial Sequence: Synthetic peptide
DEQEIRTTNPVATEQYGSVSTNTLQSGTR

SEQ ID NO: 21526 - protein, 28 aa, Artificial Sequence
  Description of Artificial Sequence: Synthetic peptide
DEEEISTTNPVGTEQYGSVSTNLQLGND

SEQ ID NO: 21527 - protein, 28 aa, Artificial Sequence
  Description of Artificial Sequence: Synthetic peptide
DEEEIRTTNPVATEQYGSVSTGLENGND

SEQ ID NO: 21528 - protein, 29 aa, Artificial Sequence
  Description of Artificial Sequence: Synthetic peptide
DEEEIRTVNPIATEQYGWVSTNLQRGNDR

SEQ ID NO: 21529 - protein, 31 aa, Artificial Sequence
  Description of Artificial Sequence: Synthetic polypeptide
DEEEIRTTNPVATEQYGSVSETNLEDRGENR

SEQ ID NO: 21530 - protein, 29 aa, Artificial Sequence
  Description of Artificial Sequence: Synthetic peptide
GEEEIRTVNPVATEQYGSVSENLQRGNDR

SEQ ID NO: 21531 - protein, 29 aa, Artificial Sequence
  Description of Artificial Sequence: Synthetic peptide
DENEIRTTNPVATEQYGSVSTDLQREGNM

SEQ ID NO: 21532 - protein, 28 aa, Artificial Sequence
  Description of Artificial Sequence: Synthetic peptide
DESEIRTTNPCATESYGTVSTNLQRGNR

SEQ ID NO: 21533 - protein, 29 aa, Artificial Sequence
  Description of Artificial Sequence: Synthetic peptide
DEQEIRCTNPVASEQYGSVSATNLQRGNR

SEQ ID NO: 21534 - protein, 29 aa, Artificial Sequence
  Description of Artificial Sequence: Synthetic peptide
DEEELRTTNPVASEIYGSVSTNLQREGNR

SEQ ID NO: 21535 - protein, 31 aa, Artificial Sequence
  Description of Artificial Sequence: Synthetic polypeptide
DENEIRTTNPVATEQYGSVDSTNLQREGVNR

SEQ ID NO: 21536 - protein, 29 aa, Artificial Sequence
  Description of Artificial Sequence: Synthetic peptide
DEEEIRTTNPVATEQYGSVSENLMMRGNA

SEQ ID NO: 21537 - protein, 28 aa, Artificial Sequence
  Description of Artificial Sequence: Synthetic peptide
DEEEIRTTNPVSTEVYGSVDTNDQRGNR

SEQ ID NO: 21538 - protein, 28 aa, Artificial Sequence
  Description of Artificial Sequence: Synthetic peptide
SEEEIRTTNPVATEQYGFVSTGPQRGNR

SEQ ID NO: 21539 - protein, 28 aa, Artificial Sequence
  Description of Artificial Sequence: Synthetic peptide
DEEEIRTTNPVATQQYGSVSEGLFRGNR

SEQ ID NO: 21540 - protein, 29 aa, Artificial Sequence
  Description of Artificial Sequence: Synthetic peptide
DEEEIRTTNPVATEQWGSVSTNEQYDGNR

SEQ ID NO: 21541 - protein, 28 aa, Artificial Sequence
  Description of Artificial Sequence: Synthetic peptide
DEEEIRTTNPVATEQYGSVSTGLQHGME

SEQ ID NO: 21542 - protein, 30 aa, Artificial Sequence
  Description of Artificial Sequence: Synthetic polypeptide
DEEEIRTTNPVATECYGSVSTNLQIQKGNR

SEQ ID NO: 21543 - protein, 28 aa, Artificial Sequence
  Description of Artificial Sequence: Synthetic peptide
AENEIRCTNPVATEIYGSVSTNLQRGNR

SEQ ID NO: 21544 - protein, 30 aa, Artificial Sequence
  Description of Artificial Sequence: Synthetic polypeptide
DEEEIRTTNPVATEQYGYVSTINLQREGNF

SEQ ID NO: 21545 - protein, 28 aa, Artificial Sequence
  Description of Artificial Sequence: Synthetic peptide
DEEEIRATNPTATEQYGGVSTNLQRENR

SEQ ID NO: 21546 - protein, 28 aa, Artificial Sequence
  Description of Artificial Sequence: Synthetic peptide
NEEEIATTNPVATEQYGAVSTNLQRGND

SEQ ID NO: 21547 - protein, 29 aa, Artificial Sequence
  Description of Artificial Sequence: Synthetic peptide
DEQEIRTTNPVATEQYGSVSTNLQHGNDL

SEQ ID NO: 21548 - protein, 28 aa, Artificial Sequence
  Description of Artificial Sequence: Synthetic peptide
SEEEIRTTNPVATEQYGSVSTAEMRGNR

SEQ ID NO: 21549 - protein, 29 aa, Artificial Sequence
  Description of Artificial Sequence: Synthetic peptide
DEEEIRTTNPVATEQYGSVSTEPLQNGNM

SEQ ID NO: 21550 - protein, 28 aa, Artificial Sequence
  Description of Artificial Sequence: Synthetic peptide
DEEEIRTTNPVATEWYGSVSTNEQVGNL

SEQ ID NO: 21551 - protein, 28 aa, Artificial Sequence
  Description of Artificial Sequence: Synthetic peptide
NEEEIRTTNPVATEQYGSVDTNWQRGNG

SEQ ID NO: 21552 - protein, 28 aa, Artificial Sequence
  Description of Artificial Sequence: Synthetic peptide
KEEEIRTTNPVATEQYGSASTNLQREER

SEQ ID NO: 21553 - protein, 28 aa, Artificial Sequence
  Description of Artificial Sequence: Synthetic peptide
DESEIRTTNPVSTEQYGSVSTALQDGNR

SEQ ID NO: 21554 - protein, 28 aa, Artificial Sequence
  Description of Artificial Sequence: Synthetic peptide
DEEEIMTTNPVATEQYGVVSTNLQTENR

SEQ ID NO: 21555 - protein, 28 aa, Artificial Sequence
  Description of Artificial Sequence: Synthetic peptide
DEQEIRTTNPVATEQYGSVSTNLEVENR

SEQ ID NO: 21556 - protein, 31 aa, Artificial Sequence
  Description of Artificial Sequence: Synthetic polypeptide
DEEEIRTTNPVATEQYGSVSDTNLERNGENR

SEQ ID NO: 21557 - protein, 29 aa, Artificial Sequence
  Description of Artificial Sequence: Synthetic peptide
KEEEIRTTNPVATEQYGSVSTNLQYGNDM

SEQ ID NO: 21558 - protein, 28 aa, Artificial Sequence
  Description of Artificial Sequence: Synthetic peptide
DEEEIRTTNPVATEQYGSVSTGLEDGNC

SEQ ID NO: 21559 - protein, 31 aa, Artificial Sequence
  Description of Artificial Sequence: Synthetic polypeptide
DEEEIRTTNPVATEQYGSVEETNGLQVRGNR

SEQ ID NO: 21560 - protein, 29 aa, Artificial Sequence
  Description of Artificial Sequence: Synthetic peptide
DETEIRTTNPVATEQYGSVSTPLQARGNS

SEQ ID NO: 21561 - protein, 28 aa, Artificial Sequence
  Description of Artificial Sequence: Synthetic peptide
DDEEIRTTNPVATEQYGSVSDCLQRGIR

SEQ ID NO: 21562 - protein, 28 aa, Artificial Sequence
  Description of Artificial Sequence: Synthetic peptide
GECEIRTTNPVATEQYGEVSTNLERGNR

SEQ ID NO: 21563 - protein, 28 aa, Artificial Sequence
  Description of Artificial Sequence: Synthetic peptide
DEQEIRTTNPVATEQYGSVSTNLEHGNM

SEQ ID NO: 21564 - protein, 31 aa, Artificial Sequence
  Description of Artificial Sequence: Synthetic polypeptide
DEEEIRTTNPVATEQYGSVSETVNLQHGPNR

SEQ ID NO: 21565 - protein, 28 aa, Artificial Sequence
  Description of Artificial Sequence: Synthetic peptide
DEQEIRTTNPVATECYGSVSTNLERGNN

SEQ ID NO: 21566 - protein, 28 aa, Artificial Sequence
  Description of Artificial Sequence: Synthetic peptide
DENEIRTTNPVATECYGSVSTNLQSGNT

SEQ ID NO: 21567 - protein, 28 aa, Artificial Sequence
  Description of Artificial Sequence: Synthetic peptide
DEEEIRTTNPVATEQYGSVSTDLQVGEI

SEQ ID NO: 21568 - protein, 29 aa, Artificial Sequence
  Description of Artificial Sequence: Synthetic peptide
DEEEIRTTNPVATEQYGSVSCENLQYGNQ

SEQ ID NO: 21569 - protein, 28 aa, Artificial Sequence
  Description of Artificial Sequence: Synthetic peptide
DENEIRTTNPVATEQYGSVSTDLQVGND

SEQ ID NO: 21570 - protein, 31 aa, Artificial Sequence
  Description of Artificial Sequence: Synthetic polypeptide
AEEEIRTTNPVATEQYGSVSTGNLQRNGVNR

SEQ ID NO: 21571 - protein, 29 aa, Artificial Sequence
  Description of Artificial Sequence: Synthetic peptide
DEEEITTTNPVATEQYGSVDTNDQQRGNR

SEQ ID NO: 21572 - protein, 28 aa, Artificial Sequence
  Description of Artificial Sequence: Synthetic peptide
DEEEIRTTNPVATEQYGSVSENEQFGTR

SEQ ID NO: 21573 - protein, 28 aa, Artificial Sequence
  Description of Artificial Sequence: Synthetic peptide
DEEEIRCTNPVATEQYGVVSTNLERGNF

SEQ ID NO: 21574 - protein, 28 aa, Artificial Sequence
  Description of Artificial Sequence: Synthetic peptide
DEEEIRTVNPVSTEQYGSVSENLQRGGR

SEQ ID NO: 21575 - protein, 28 aa, Artificial Sequence
  Description of Artificial Sequence: Synthetic peptide
QEGEIRTTNPVATETYGSVSTDLQRGNR

SEQ ID NO: 21576 - protein, 28 aa, Artificial Sequence
  Description of Artificial Sequence: Synthetic peptide
REEEVRTTNPVSTEQYGTVSTNLQRGNR

SEQ ID NO: 21577 - protein, 28 aa, Artificial Sequence
  Description of Artificial Sequence: Synthetic peptide
DEEEIRTTNPVGTEQFGSVSTELQRGNE

SEQ ID NO: 21578 - protein, 28 aa, Artificial Sequence
  Description of Artificial Sequence: Synthetic peptide
DENEIRTTNPVATECYGSVPTNLQRENR

SEQ ID NO: 21579 - protein, 29 aa, Artificial Sequence
  Description of Artificial Sequence: Synthetic peptide
DEEEIRTTNPDGTEQYGSVSTDLQRGENR

SEQ ID NO: 21580 - protein, 28 aa, Artificial Sequence
  Description of Artificial Sequence: Synthetic peptide
DEEEIRTTNPVATEQYGSVSTELQYGEE

SEQ ID NO: 21581 - protein, 29 aa, Artificial Sequence
  Description of Artificial Sequence: Synthetic peptide
DEEEIRATNPVSTEIYGSVSTNLQREGNR

SEQ ID NO: 21582 - protein, 29 aa, Artificial Sequence
  Description of Artificial Sequence: Synthetic peptide
DEEEIRTTNPVATECYGTVSTDLQERGNR

SEQ ID NO: 21583 - protein, 28 aa, Artificial Sequence
  Description of Artificial Sequence: Synthetic peptide
DEEEIRTTNPVATECWGSVSTNLMRGNF

SEQ ID NO: 21584 - protein, 29 aa, Artificial Sequence
  Description of Artificial Sequence: Synthetic peptide
DEEEIRTVNPVATEQYGSVSETLQERGNR

SEQ ID NO: 21585 - protein, 29 aa, Artificial Sequence
  Description of Artificial Sequence: Synthetic peptide
DEEEIRTTNPVATETYGSVSANLPQRGDR

SEQ ID NO: 21586 - protein, 28 aa, Artificial Sequence
  Description of Artificial Sequence: Synthetic peptide
DEEEIRTTNPVATEQYGSTSMNLERGDR

SEQ ID NO: 21587 - protein, 28 aa, Artificial Sequence
  Description of Artificial Sequence: Synthetic peptide
DEEEIATTNPVATEQYGSVSTDLQRGEA

SEQ ID NO: 21588 - protein, 28 aa, Artificial Sequence
  Description of Artificial Sequence: Synthetic peptide
DETEITTTNPVATEQYGSASSNLQRGNR

SEQ ID NO: 21589 - protein, 30 aa, Artificial Sequence
  Description of Artificial Sequence: Synthetic polypeptide
DEEEIRTTNPVATEQYGSWCSDTNLQYGNR

SEQ ID NO: 21590 - protein, 29 aa, Artificial Sequence
  Description of Artificial Sequence: Synthetic peptide
MEEEIRTTNPVATEQYGSVSEDLQERGNR

SEQ ID NO: 21591 - protein, 29 aa, Artificial Sequence
  Description of Artificial Sequence: Synthetic peptide
DEEEIRTTNPVATECYGSVSTALQRGNDS

SEQ ID NO: 21592 - protein, 28 aa, Artificial Sequence
  Description of Artificial Sequence: Synthetic peptide
DENEIRTTNPVATEQYGSVPTNLQRENL

SEQ ID NO: 21593 - protein, 28 aa, Artificial Sequence
  Description of Artificial Sequence: Synthetic peptide
DENEIRTTNPVATEQYGSVSTDLQLGNM

SEQ ID NO: 21594 - protein, 28 aa, Artificial Sequence
  Description of Artificial Sequence: Synthetic peptide
DEEEIRCTNPVATEQWGSVSTNLERGNF

SEQ ID NO: 21595 - protein, 28 aa, Artificial Sequence
  Description of Artificial Sequence: Synthetic peptide
YEEEIRTTNPVATEQYGSVMEILQRGNR

SEQ ID NO: 21596 - protein, 28 aa, Artificial Sequence
  Description of Artificial Sequence: Synthetic peptide
DEEEIRTTNPVATECYGSVSTNLQVGEM

SEQ ID NO: 21597 - protein, 28 aa, Artificial Sequence
  Description of Artificial Sequence: Synthetic peptide
DEEEIRTTNPVATEQYGWVSTDLQHGNQ

SEQ ID NO: 21598 - protein, 28 aa, Artificial Sequence
  Description of Artificial Sequence: Synthetic peptide
DENEIRTTNPVATEQYGDVSENEQRGNR

SEQ ID NO: 21599 - protein, 30 aa, Artificial Sequence
  Description of Artificial Sequence: Synthetic polypeptide
DEEEIRTTNPVATEQYGSVSATNNLQEGDR

SEQ ID NO: 21600 - protein, 28 aa, Artificial Sequence
  Description of Artificial Sequence: Synthetic peptide
DEEEIRTTNPTATEQYGSVSTNEQQGNA

SEQ ID NO: 21601 - protein, 28 aa, Artificial Sequence
  Description of Artificial Sequence: Synthetic peptide
DEEEIRTTNPVATEQWGDVSTNEQRGDR

SEQ ID NO: 21602 - protein, 28 aa, Artificial Sequence
  Description of Artificial Sequence: Synthetic peptide
DEEEIRTTNPVATEQYGWVDTNLQSGNT

SEQ ID NO: 21603 - protein, 29 aa, Artificial Sequence
  Description of Artificial Sequence: Synthetic peptide
ADEEIRTTNPVATEQYGSVSTNPVQRGNR

SEQ ID NO: 21604 - protein, 30 aa, Artificial Sequence
  Description of Artificial Sequence: Synthetic polypeptide
DEEEIRTTNPVATEQYGSVDCTMNLCRGNR

SEQ ID NO: 21605 - protein, 29 aa, Artificial Sequence
  Description of Artificial Sequence: Synthetic peptide
DEEEIRTTNPVATEQYGSVSTNLVEHENR

SEQ ID NO: 21606 - protein, 28 aa, Artificial Sequence
  Description of Artificial Sequence: Synthetic peptide
DEQEIVTTNPVATEMYGWVSTNLQRGNR

SEQ ID NO: 21607 - protein, 28 aa, Artificial Sequence
  Description of Artificial Sequence: Synthetic peptide
GEQEITTTNPVATEQYGSVSTNLQHGNR

SEQ ID NO: 21608 - protein, 28 aa, Artificial Sequence
  Description of Artificial Sequence: Synthetic peptide
DEEEIRTTNPVATEQYGSVSTDLQQGEF

SEQ ID NO: 21609 - protein, 28 aa, Artificial Sequence
  Description of Artificial Sequence: Synthetic peptide
VEEEIRTTNPVATENYGSVSTNLQRLNQ

SEQ ID NO: 21610 - protein, 28 aa, Artificial Sequence
  Description of Artificial Sequence: Synthetic peptide
DEEEICSVNPVATEQYGSVSTNLQRGGR

SEQ ID NO: 21611 - protein, 28 aa, Artificial Sequence
  Description of Artificial Sequence: Synthetic peptide
DEEEIATTNPVATEQYGGVSTNLQRDER

SEQ ID NO: 21612 - protein, 28 aa, Artificial Sequence
  Description of Artificial Sequence: Synthetic peptide
SEVEIRTTNPVATEQYGSVSENLQRGNS

SEQ ID NO: 21613 - protein, 28 aa, Artificial Sequence
  Description of Artificial Sequence: Synthetic peptide
DEEEIRTTNPVATEQYGSVSDDPQRGNP

SEQ ID NO: 21614 - protein, 28 aa, Artificial Sequence
  Description of Artificial Sequence: Synthetic peptide
DEEEIRTTNPVATEQYGSVSTDLEDGNW

SEQ ID NO: 21615 - protein, 28 aa, Artificial Sequence
  Description of Artificial Sequence: Synthetic peptide
DEEEIRATNPVAYEQYGSVSTNLQSGNL

SEQ ID NO: 21616 - protein, 29 aa, Artificial Sequence
  Description of Artificial Sequence: Synthetic peptide
DEQEIRTTNPVATEQYGEVSAENLQRGNR

SEQ ID NO: 21617 - protein, 28 aa, Artificial Sequence
  Description of Artificial Sequence: Synthetic peptide
DEEEIRTTNPVATEQYGSVSLELDRGNA

SEQ ID NO: 21618 - protein, 28 aa, Artificial Sequence
  Description of Artificial Sequence: Synthetic peptide
DEEEIRTTNPEATEQYGSVSDNLQRENM

SEQ ID NO: 21619 - protein, 28 aa, Artificial Sequence
  Description of Artificial Sequence: Synthetic peptide
REEEIRCTNPTATELYGSVSTNLQRGNR

SEQ ID NO: 21620 - protein, 29 aa, Artificial Sequence
  Description of Artificial Sequence: Synthetic peptide
DEEEIRTTNPVATEQYGSVSCENLQHGNA

SEQ ID NO: 21621 - protein, 28 aa, Artificial Sequence
  Description of Artificial Sequence: Synthetic peptide
DEEELRATNPVATEIYGSVSTNLQRGNI

SEQ ID NO: 21622 - protein, 28 aa, Artificial Sequence
  Description of Artificial Sequence: Synthetic peptide
QEGEIRTTNPVATEQFGTVSTNLQRGNR

SEQ ID NO: 21623 - protein, 29 aa, Artificial Sequence
  Description of Artificial Sequence: Synthetic peptide
DEEEIRTTNPVATEQYGSVSTELQERGEH

SEQ ID NO: 21624 - protein, 30 aa, Artificial Sequence
  Description of Artificial Sequence: Synthetic polypeptide
DEQEIRTTNPVATEQYGSVSATNLQVKGNR

SEQ ID NO: 21625 - protein, 28 aa, Artificial Sequence
  Description of Artificial Sequence: Synthetic peptide
QEVEIRTTNPVATEQYGTVSTNLQLGNR

SEQ ID NO: 21626 - protein, 29 aa, Artificial Sequence
  Description of Artificial Sequence: Synthetic peptide
DEEEVRTTNPVATEQYGSVATNLERNGNR

SEQ ID NO: 21627 - protein, 28 aa, Artificial Sequence
  Description of Artificial Sequence: Synthetic peptide
DEEEIRTTNPCATEPYGSVSTNLQRLTR

SEQ ID NO: 21628 - protein, 28 aa, Artificial Sequence
  Description of Artificial Sequence: Synthetic peptide
DEEEIATTNPVATENYGGVSTNLQPGNR

SEQ ID NO: 21629 - protein, 28 aa, Artificial Sequence
  Description of Artificial Sequence: Synthetic peptide
DEQEIRCTNPVASEQYGCVSTNLQRGNR

SEQ ID NO: 21630 - protein, 28 aa, Artificial Sequence
  Description of Artificial Sequence: Synthetic peptide
DEEEIRTTNPVGTETYGSVSTNLQRGPF

SEQ ID NO: 21631 - protein, 28 aa, Artificial Sequence
  Description of Artificial Sequence: Synthetic peptide
SEEEIRTTNPTATELYGSVSTNLQRGNQ

SEQ ID NO: 21632 - protein, 29 aa, Artificial Sequence
  Description of Artificial Sequence: Synthetic peptide
DEEEIRTTNPVATEQYGSVSTDLQRNGEL

SEQ ID NO: 21633 - protein, 29 aa, Artificial Sequence
  Description of Artificial Sequence: Synthetic peptide
DEQEIRTTNPVATEQYGSVSTNLVQRGEF

SEQ ID NO: 21634 - protein, 30 aa, Artificial Sequence
  Description of Artificial Sequence: Synthetic polypeptide
MEEEIRTTNPVATEQYGSVSTNLQREGNDM

SEQ ID NO: 21635 - protein, 29 aa, Artificial Sequence
  Description of Artificial Sequence: Synthetic peptide
DEEEIATTNPVATEQYGSFVSNSLQRGNR

SEQ ID NO: 21636 - protein, 29 aa, Artificial Sequence
  Description of Artificial Sequence: Synthetic peptide
DEEEIRTTNPVATEQYGSVATNLQWGNDY

SEQ ID NO: 21637 - protein, 28 aa, Artificial Sequence
  Description of Artificial Sequence: Synthetic peptide
DEEEIRTTNPVATEQYGSVSTELQFGDS

SEQ ID NO: 21638 - protein, 29 aa, Artificial Sequence
  Description of Artificial Sequence: Synthetic peptide
DEEEIRTTNPVATEQYGSASTNLPQHGNG

SEQ ID NO: 21639 - protein, 30 aa, Artificial Sequence
  Description of Artificial Sequence: Synthetic polypeptide
DENEIRTTNPVATEQYGSVSTENLQNNGNR

SEQ ID NO: 21640 - protein, 28 aa, Artificial Sequence
  Description of Artificial Sequence: Synthetic peptide
DEQEIRTTNPVSTEQYGEVATNLQRGNR

SEQ ID NO: 21641 - protein, 28 aa, Artificial Sequence
  Description of Artificial Sequence: Synthetic peptide
DEGEIRTTNPVATECYGSVDTNLQRGNY

SEQ ID NO: 21642 - protein, 28 aa, Artificial Sequence
  Description of Artificial Sequence: Synthetic peptide
DEEEISTTNPVATEIYGNVSTNDQRGNR

SEQ ID NO: 21643 - protein, 28 aa, Artificial Sequence
  Description of Artificial Sequence: Synthetic peptide
DEEEIRTVNPVATECYGNVSTNLQRGNL

SEQ ID NO: 21644 - protein, 28 aa, Artificial Sequence
  Description of Artificial Sequence: Synthetic peptide
DEEEIRTTNPVATEQYGSVDTGDQPGNR

SEQ ID NO: 21645 - protein, 28 aa, Artificial Sequence
  Description of Artificial Sequence: Synthetic peptide
DEEEIRGTNPVSTEQYGSVSTELQRGNS

SEQ ID NO: 21646 - protein, 28 aa, Artificial Sequence
  Description of Artificial Sequence: Synthetic peptide
DEEEIRTTNIVATEQWGEVSTNLQQGNR

SEQ ID NO: 21647 - protein, 28 aa, Artificial Sequence
  Description of Artificial Sequence: Synthetic peptide
DEDEIRTTNPVATAQYGSVSTNLQMGWR

SEQ ID NO: 21648 - protein, 29 aa, Artificial Sequence
  Description of Artificial Sequence: Synthetic peptide
DEEEIRTTNPVATEQYGSVSTNEQENGNA

SEQ ID NO: 21649 - protein, 29 aa, Artificial Sequence
  Description of Artificial Sequence: Synthetic peptide
QEEEIRTVNPVATEQYGSVSATNLQRGNK

SEQ ID NO: 21650 - protein, 28 aa, Artificial Sequence
  Description of Artificial Sequence: Synthetic peptide
MEQEIRTTNPVATEQYGSVSTNLQNGNS

SEQ ID NO: 21651 - protein, 28 aa, Artificial Sequence
  Description of Artificial Sequence: Synthetic peptide
DEEEIRTTNPVCTEQYGWVSTNWQRGNI

SEQ ID NO: 21652 - protein, 29 aa, Artificial Sequence
  Description of Artificial Sequence: Synthetic peptide
DEEEIRTTNPVATEQYGSVSTEDQCRGNI

SEQ ID NO: 21653 - protein, 28 aa, Artificial Sequence
  Description of Artificial Sequence: Synthetic peptide
DEEEIATTNPTATEQYGSVSTNPQRGNF

SEQ ID NO: 21654 - protein, 28 aa, Artificial Sequence
  Description of Artificial Sequence: Synthetic peptide
DEEEIRTTNPVATELYGSVSTNWQQGNV

SEQ ID NO: 21655 - protein, 29 aa, Artificial Sequence
  Description of Artificial Sequence: Synthetic peptide
DEEEITTTNPVATEQYGSVSTNPQIRGNF

SEQ ID NO: 21656 - protein, 29 aa, Artificial Sequence
  Description of Artificial Sequence: Synthetic peptide
DEEEIRTTNPVATECYGSVSTNLQDSGND

SEQ ID NO: 21657 - protein, 30 aa, Artificial Sequence
  Description of Artificial Sequence: Synthetic polypeptide
DEEVIRTTNPVATEQYGSVSTTNLTERGNR

SEQ ID NO: 21658 - protein, 28 aa, Artificial Sequence
  Description of Artificial Sequence: Synthetic peptide
QEEEITTTNPVATEQYGVVSTNLQVGNR

SEQ ID NO: 21659 - protein, 28 aa, Artificial Sequence
  Description of Artificial Sequence: Synthetic peptide
DEEEIRTTNPVATEQWGSVSTNLMQGNM

SEQ ID NO: 21660 - protein, 30 aa, Artificial Sequence
  Description of Artificial Sequence: Synthetic polypeptide
DEEEIRTTNPVATEQYGSVSCTNLQCAGNV

SEQ ID NO: 21661 - protein, 28 aa, Artificial Sequence
  Description of Artificial Sequence: Synthetic peptide
DEEEIRTTNPVATEQYGSVSTGEIRGND

SEQ ID NO: 21662 - protein, 28 aa, Artificial Sequence
  Description of Artificial Sequence: Synthetic peptide
DEEEIRATNPVATEQYGSVSENLQNGNL

SEQ ID NO: 21663 - protein, 29 aa, Artificial Sequence
  Description of Artificial Sequence: Synthetic peptide
DEEEIVTTNPVATEQYGSVSTNLQLGVNT

SEQ ID NO: 21664 - protein, 28 aa, Artificial Sequence
  Description of Artificial Sequence: Synthetic peptide
DEEEIRTTNPVAYEQYGEVSTNLQRVMR

SEQ ID NO: 21665 - protein, 28 aa, Artificial Sequence
  Description of Artificial Sequence: Synthetic peptide
DEEEIRTTNPTATEQYGSVSTNPQNGNN

SEQ ID NO: 21666 - protein, 28 aa, Artificial Sequence
  Description of Artificial Sequence: Synthetic peptide
DEEEIRTTNPIAYEMYGSVSTNLQRGPR

SEQ ID NO: 21667 - protein, 28 aa, Artificial Sequence
  Description of Artificial Sequence: Synthetic peptide
DTEEIRTTNPVATEQYGSVSTNEMRGNP

SEQ ID NO: 21668 - protein, 28 aa, Artificial Sequence
  Description of Artificial Sequence: Synthetic peptide
DEEEIRCTNPVASEGYGSVSTNLQRGNQ

SEQ ID NO: 21669 - protein, 28 aa, Artificial Sequence
  Description of Artificial Sequence: Synthetic peptide
DEEEIRTTNPVSTEQYGIVSTNLQRGDL

SEQ ID NO: 21670 - protein, 28 aa, Artificial Sequence
  Description of Artificial Sequence: Synthetic peptide
DEEEIATTNIVATEQYGSVSTNLQDGNI

SEQ ID NO: 21671 - protein, 28 aa, Artificial Sequence
  Description of Artificial Sequence: Synthetic peptide
DEEEIRTTNPVATERYGDVSTNLQNYNR

SEQ ID NO: 21672 - protein, 28 aa, Artificial Sequence
  Description of Artificial Sequence: Synthetic peptide
DEEEIRCTNPVCTEVYGSVSSNLQRGNR

SEQ ID NO: 21673 - protein, 28 aa, Artificial Sequence
  Description of Artificial Sequence: Synthetic peptide
DEEEIRTTNPVATEQYGSVSTDLQHGEM

SEQ ID NO: 21674 - protein, 28 aa, Artificial Sequence
  Description of Artificial Sequence: Synthetic peptide
DEEEIRTTNPVATECYGSVSTDLQIGNF

SEQ ID NO: 21675 - protein, 30 aa, Artificial Sequence
  Description of Artificial Sequence: Synthetic polypeptide
DEEEIRTTNPFATEQYGDSVSTNEQRDGNR

SEQ ID NO: 21676 - protein, 28 aa, Artificial Sequence
  Description of Artificial Sequence: Synthetic peptide
DEDEIRTTNPVATECYGSVSTNLQNGNN

SEQ ID NO: 21677 - protein, 28 aa, Artificial Sequence
  Description of Artificial Sequence: Synthetic peptide
DEEEIRTTNPVATEQYGWVHTPLQDGNR

SEQ ID NO: 21678 - protein, 28 aa, Artificial Sequence
  Description of Artificial Sequence: Synthetic peptide
DEEEIRTTNPVATEQYGSVSDNLQNGES

SEQ ID NO: 21679 - protein, 28 aa, Artificial Sequence
  Description of Artificial Sequence: Synthetic peptide
DESEIRTTNPVCTEQYGSASNNLQRGNR

SEQ ID NO: 21680 - protein, 28 aa, Artificial Sequence
  Description of Artificial Sequence: Synthetic peptide
DEEEIRGTNPVATECYGSVSANEQRGNR

SEQ ID NO: 21681 - protein, 30 aa, Artificial Sequence
  Description of Artificial Sequence: Synthetic polypeptide
DENEIRTTNPVATEQYGSTVESTNLQTGNR

SEQ ID NO: 21682 - protein, 28 aa, Artificial Sequence
  Description of Artificial Sequence: Synthetic peptide
DEVEIRTTNPVATEQYGTVSTNLQMGNI

SEQ ID NO: 21683 - protein, 28 aa, Artificial Sequence
  Description of Artificial Sequence: Synthetic peptide
DEEEIRTTNIVATEQWGSVSTNLQQGNH

SEQ ID NO: 21684 - protein, 28 aa, Artificial Sequence
  Description of Artificial Sequence: Synthetic peptide
DEEEIRTTNPVATELYGSVSTNLQIGDA

SEQ ID NO: 21685 - protein, 28 aa, Artificial Sequence
  Description of Artificial Sequence: Synthetic peptide
DEEEITTTNPVATEQYGSVSDCLQNGNR

SEQ ID NO: 21686 - protein, 28 aa, Artificial Sequence
  Description of Artificial Sequence: Synthetic peptide
DEDEIRTTNIVATEQYGSVSTNLQSGND

SEQ ID NO: 21687 - protein, 28 aa, Artificial Sequence
  Description of Artificial Sequence: Synthetic peptide
DEEEIRTTNPVATELYGSVSTNEMIGNR

SEQ ID NO: 21688 - protein, 30 aa, Artificial Sequence
  Description of Artificial Sequence: Synthetic polypeptide
DEEVIRTTNPVATEQYGSVNTNLQRSGNFR

SEQ ID NO: 21689 - protein, 28 aa, Artificial Sequence
  Description of Artificial Sequence: Synthetic peptide
DEEEIRTTNIVATEQYGSVSTNLQNGDL

SEQ ID NO: 21690 - protein, 29 aa, Artificial Sequence
  Description of Artificial Sequence: Synthetic peptide
MEEEIRTTNPVATEQYGSVSTDLQVEGNR

SEQ ID NO: 21691 - protein, 28 aa, Artificial Sequence
  Description of Artificial Sequence: Synthetic peptide
DEEEIRTTNPVATQQYGSVSDNLHRGNK

SEQ ID NO: 21692 - protein, 29 aa, Artificial Sequence
  Description of Artificial Sequence: Synthetic peptide
DEEEIRTTNPVATEQYGSVSTNLQETGDY

SEQ ID NO: 21693 - protein, 28 aa, Artificial Sequence
  Description of Artificial Sequence: Synthetic peptide
DEEEIATTNIVATEQYGSVSTNLQEGNI

SEQ ID NO: 21694 - protein, 28 aa, Artificial Sequence
  Description of Artificial Sequence: Synthetic peptide
NEEEIATTNIVATEQYGSVSTNLQGGNR

SEQ ID NO: 21695 - protein, 28 aa, Artificial Sequence
  Description of Artificial Sequence: Synthetic peptide
DEEEIRTTNIVATEQYGVVATNLQFGNR

SEQ ID NO: 21696 - protein, 30 aa, Artificial Sequence
  Description of Artificial Sequence: Synthetic polypeptide
DEEEIRTTNPVAWEQYGSVWSDTGLQRGNR

SEQ ID NO: 21697 - protein, 28 aa, Artificial Sequence
  Description of Artificial Sequence: Synthetic peptide
DEEEIRTTNPVATEQYGCVSTMLQFGNA

SEQ ID NO: 21698 - protein, 28 aa, Artificial Sequence
  Description of Artificial Sequence: Synthetic peptide
DEEEIRTTNPVATEQYGSVSTEDQNGNV

SEQ ID NO: 21699 - protein, 29 aa, Artificial Sequence
  Description of Artificial Sequence: Synthetic peptide
DEEEIRTTNPVATEQYGSVSTDLQVGNDA

SEQ ID NO: 21700 - protein, 28 aa, Artificial Sequence
  Description of Artificial Sequence: Synthetic peptide
DEEEIRTTNPTATEQYGSVSTNEQNGNA

SEQ ID NO: 21701 - protein, 30 aa, Artificial Sequence
  Description of Artificial Sequence: Synthetic polypeptide
DENEIRTTNPVATEQYGSVTSTNLELRGNR

SEQ ID NO: 21702 - protein, 28 aa, Artificial Sequence
  Description of Artificial Sequence: Synthetic peptide
DEEEIRTTNPVATEQYGSVSTDLEPGNP

SEQ ID NO: 21703 - protein, 29 aa, Artificial Sequence
  Description of Artificial Sequence: Synthetic peptide
DEEEIRTTNPVATEQWGSVSENLQNRGNM

SEQ ID NO: 21704 - protein, 28 aa, Artificial Sequence
  Description of Artificial Sequence: Synthetic peptide
DEEEIRTTNPVCTEQYGSVSTNLERGLD

SEQ ID NO: 21705 - protein, 30 aa, Artificial Sequence
  Description of Artificial Sequence: Synthetic polypeptide
DEEEIRTTNPVATEQYGSVSTGLEDRGNDR

SEQ ID NO: 21706 - protein, 28 aa, Artificial Sequence
  Description of Artificial Sequence: Synthetic peptide
DEQEIRTVNPVATEQYGSVSENLQRGGR

SEQ ID NO: 21707 - protein, 31 aa, Artificial Sequence
  Description of Artificial Sequence: Synthetic polypeptide
DEEEIRTTNPVATEQYGSVSTNLERNGENDR

SEQ ID NO: 21708 - protein, 28 aa, Artificial Sequence
  Description of Artificial Sequence: Synthetic peptide
DEEEIRTTNPVATQCYGSVSTNLQREER

SEQ ID NO: 21709 - protein, 29 aa, Artificial Sequence
  Description of Artificial Sequence: Synthetic peptide
DEEEIRTTNPVATEQYGDASTNLQRQENR

SEQ ID NO: 21710 - protein, 28 aa, Artificial Sequence
  Description of Artificial Sequence: Synthetic peptide
DEEEIRTTNIVATEQYGSVSTNLQSGEI

SEQ ID NO: 21711 - protein, 28 aa, Artificial Sequence
  Description of Artificial Sequence: Synthetic peptide
DEEAIRTTNIVATEQYGSVSTNLQDGNT

SEQ ID NO: 21712 - protein, 28 aa, Artificial Sequence
  Description of Artificial Sequence: Synthetic peptide
DENEIRTTNPVATELYGSVSTNEQRGNW

SEQ ID NO: 21713 - protein, 29 aa, Artificial Sequence
  Description of Artificial Sequence: Synthetic peptide
DEEEIRTTNPVATEQFGDASTNLQTRGNR

SEQ ID NO: 21714 - protein, 28 aa, Artificial Sequence
  Description of Artificial Sequence: Synthetic peptide
DEQEIRTTNPVATEQYGSVETNDQHGNR

SEQ ID NO: 21715 - protein, 30 aa, Artificial Sequence
  Description of Artificial Sequence: Synthetic polypeptide
DEEEIRTTNPVATEQYGSVSTNLELRGNDT

SEQ ID NO: 21716 - protein, 29 aa, Artificial Sequence
  Description of Artificial Sequence: Synthetic peptide
DEEEIRTTNPVATECYGSVSTNLQHGEDR

SEQ ID NO: 21717 - protein, 28 aa, Artificial Sequence
  Description of Artificial Sequence: Synthetic peptide
DEAEIATTNIVATEQYGSVSTNLQRGNT

SEQ ID NO: 21718 - protein, 30 aa, Artificial Sequence
  Description of Artificial Sequence: Synthetic polypeptide
DEEEIRTTNPVATEQYGSVSTNLEEVEGNR

SEQ ID NO: 21719 - protein, 28 aa, Artificial Sequence
  Description of Artificial Sequence: Synthetic peptide
SEEEIRTTNIVATEQYGSVATNLQRGNV

SEQ ID NO: 21720 - protein, 28 aa, Artificial Sequence
  Description of Artificial Sequence: Synthetic peptide
DEEEIRQTNPVATEQYGEVSENCQRGNR

SEQ ID NO: 21721 - protein, 28 aa, Artificial Sequence
  Description of Artificial Sequence: Synthetic peptide
DEEEIRTTNPVATEQYGSVDTDLQAGNQ

SEQ ID NO: 21722 - protein, 30 aa, Artificial Sequence
  Description of Artificial Sequence: Synthetic polypeptide
DEEEIRTTNPVATEQYGSVSTNPQENGNTR

SEQ ID NO: 21723 - protein, 28 aa, Artificial Sequence
  Description of Artificial Sequence: Synthetic peptide
DEECIRTTNPVATEQYGSWDTNDQRGNR

SEQ ID NO: 21724 - protein, 29 aa, Artificial Sequence
  Description of Artificial Sequence: Synthetic peptide
DEEEVRTTNPCATEQYGSVSTNVQRAGNR

SEQ ID NO: 21725 - protein, 31 aa, Artificial Sequence
  Description of Artificial Sequence: Synthetic polypeptide
DEEEIRTTNPVATEQYGSVFITMNLQPRGNR

SEQ ID NO: 21726 - protein, 28 aa, Artificial Sequence
  Description of Artificial Sequence: Synthetic peptide
DEEEIRTTNIVATEQYGSVATGLQRGNL

SEQ ID NO: 21727 - protein, 29 aa, Artificial Sequence
  Description of Artificial Sequence: Synthetic peptide
DEEEIRTTNPVATECYGSVSTNLEREGNM

SEQ ID NO: 21728 - protein, 28 aa, Artificial Sequence
  Description of Artificial Sequence: Synthetic peptide
DEEEIRTTNPVATEQYGSVDTDLQYGNM

SEQ ID NO: 21729 - protein, 28 aa, Artificial Sequence
  Description of Artificial Sequence: Synthetic peptide
DEEEIRTTNPVATEQYGSVSTGLEVGNQ

SEQ ID NO: 21730 - protein, 30 aa, Artificial Sequence
  Description of Artificial Sequence: Synthetic polypeptide
DEEEIRTTNPVATEQYGSVSENLQCRGNDC

SEQ ID NO: 21731 - protein, 28 aa, Artificial Sequence
  Description of Artificial Sequence: Synthetic peptide
DEEEIATTNPVATEVYGSVSTNLQHGNV

SEQ ID NO: 21732 - protein, 29 aa, Artificial Sequence
  Description of Artificial Sequence: Synthetic peptide
DEEEIRTTNPVATEQYGSVDTNLEMRGNM

SEQ ID NO: 21733 - protein, 28 aa, Artificial Sequence
  Description of Artificial Sequence: Synthetic peptide
DEEEIRTVNPCATEQYGSVSTDLQLGNR

SEQ ID NO: 21734 - protein, 28 aa, Artificial Sequence
  Description of Artificial Sequence: Synthetic peptide
DEEEIRTTNPVATECYGSVSTNLQIGEL

SEQ ID NO: 21735 - protein, 28 aa, Artificial Sequence
  Description of Artificial Sequence: Synthetic peptide
REEEIRSVNPVATEQYGEVSTNLQRGNR

SEQ ID NO: 21736 - protein, 31 aa, Artificial Sequence
  Description of Artificial Sequence: Synthetic polypeptide
DEEEIRTTNPVATEQYGSVSSTNLQVRGNEA

SEQ ID NO: 21737 - protein, 28 aa, Artificial Sequence
  Description of Artificial Sequence: Synthetic peptide
DEEEIRTTNPVATEQYGSVSTNLEIGED

SEQ ID NO: 21738 - protein, 28 aa, Artificial Sequence
  Description of Artificial Sequence: Synthetic peptide
AEEEIRQTNPVATEQYGSVSTNLQMGNH

SEQ ID NO: 21739 - protein, 29 aa, Artificial Sequence
  Description of Artificial Sequence: Synthetic peptide
DEEEIRTTNPVATEQYGSVSTNLMRAGDY

SEQ ID NO: 21740 - protein, 28 aa, Artificial Sequence
  Description of Artificial Sequence: Synthetic peptide
DEEEIRTTNPVATEQYGSVSTDLQIGEM

SEQ ID NO: 21741 - protein, 29 aa, Artificial Sequence
  Description of Artificial Sequence: Synthetic peptide
DEEEIRTTNPVATECYGSVSTNLQNIGNQ

SEQ ID NO: 21742 - protein, 28 aa, Artificial Sequence
  Description of Artificial Sequence: Synthetic peptide
DEEEIATTNPVATEQYGSVSTNLQVGEL

SEQ ID NO: 21743 - protein, 29 aa, Artificial Sequence
  Description of Artificial Sequence: Synthetic peptide
DEAEIWTTNPVATEQYGSVSTNLQRGNIS

SEQ ID NO: 21744 - protein, 28 aa, Artificial Sequence
  Description of Artificial Sequence: Synthetic peptide
DEEEIRTTNPVATECYGIVSTNEQGGNR

SEQ ID NO: 21745 - protein, 28 aa, Artificial Sequence
  Description of Artificial Sequence: Synthetic peptide
DESEIRTTNIVATEQYGSVSTNLQRGAV

SEQ ID NO: 21746 - protein, 28 aa, Artificial Sequence
  Description of Artificial Sequence: Synthetic peptide
DEDEIRTTNIVATEQYGSVATNLQNGNR

SEQ ID NO: 21747 - protein, 28 aa, Artificial Sequence
  Description of Artificial Sequence: Synthetic peptide
AEEEIATTNPVATEQYGSVSTNLERGER

SEQ ID NO: 21748 - protein, 31 aa, Artificial Sequence
  Description of Artificial Sequence: Synthetic polypeptide
DEEEIRTTNPVATEQYGSVIETNLPQLRGNR

SEQ ID NO: 21749 - protein, 28 aa, Artificial Sequence
  Description of Artificial Sequence: Synthetic peptide
MEEEIATTNPVATEQYGSVSTNLQNGNT

SEQ ID NO: 21750 - protein, 28 aa, Artificial Sequence
  Description of Artificial Sequence: Synthetic peptide
DEEEVRTTNPVATEQYGSVFTGDQRGNR

SEQ ID NO: 21751 - protein, 28 aa, Artificial Sequence
  Description of Artificial Sequence: Synthetic peptide
VEEEIRATNPVATEQYGSVAMNLQRGNR

SEQ ID NO: 21752 - protein, 29 aa, Artificial Sequence
  Description of Artificial Sequence: Synthetic peptide
DEEEIAATNPVATEQFGSVSTNLQREGNR

SEQ ID NO: 21753 - protein, 28 aa, Artificial Sequence
  Description of Artificial Sequence: Synthetic peptide
DEETIRTTNPVATEMYGSVSTNLQNQNR

SEQ ID NO: 21754 - protein, 28 aa, Artificial Sequence
  Description of Artificial Sequence: Synthetic peptide
DEEEIRTVNPVACEQYGSVSTNLQRYER

SEQ ID NO: 21755 - protein, 28 aa, Artificial Sequence
  Description of Artificial Sequence: Synthetic peptide
DENEIATTNPVATEQYGSVSTNLQQGER

SEQ ID NO: 21756 - protein, 28 aa, Artificial Sequence
  Description of Artificial Sequence: Synthetic peptide
DEEEIRTTNPVATEQYGSVSTNLEHGES

SEQ ID NO: 21757 - protein, 29 aa, Artificial Sequence
  Description of Artificial Sequence: Synthetic peptide
DEEEITTTNPVATEQYGSVSDTNLENGNR

SEQ ID NO: 21758 - protein, 28 aa, Artificial Sequence
  Description of Artificial Sequence: Synthetic peptide
DEEEIRTTNCVATEQWGAVSTNLVRGNR

SEQ ID NO: 21759 - protein, 31 aa, Artificial Sequence
  Description of Artificial Sequence: Synthetic polypeptide
DEEEIRTTNPDATEQYGSVSTTPNLQRNGNR

SEQ ID NO: 21760 - protein, 28 aa, Artificial Sequence
  Description of Artificial Sequence: Synthetic peptide
DEEEIRTTNPVATEQYGSVSTGLEIGNQ

SEQ ID NO: 21761 - protein, 28 aa, Artificial Sequence
  Description of Artificial Sequence: Synthetic peptide
SEEEIRTTNIVATEQYGEVSTNLQAGNR

SEQ ID NO: 21762 - protein, 29 aa, Artificial Sequence
  Description of Artificial Sequence: Synthetic peptide
DEEEIRTTNPVATEQYGSVSTNLQEMGEI

SEQ ID NO: 21763 - protein, 30 aa, Artificial Sequence
  Description of Artificial Sequence: Synthetic polypeptide
DEEEIRTTNPVATEQYGSVSTNLEHEGNDR

SEQ ID NO: 21764 - protein, 31 aa, Artificial Sequence
  Description of Artificial Sequence: Synthetic polypeptide
DEEEIRTTNPVATEQYGSVSATTNGLQRGER

SEQ ID NO: 21765 - protein, 28 aa, Artificial Sequence
  Description of Artificial Sequence: Synthetic peptide
DEEEIRTTNPVATEQFGGVSTNLQQGNF

SEQ ID NO: 21766 - protein, 28 aa, Artificial Sequence
  Description of Artificial Sequence: Synthetic peptide
DEEEIRTTNPVATECYGVVSTNLQAGER

SEQ ID NO: 21767 - protein, 28 aa, Artificial Sequence
  Description of Artificial Sequence: Synthetic peptide
DEEEIRTTNPVATEQYGSVKTNLQSDNG

SEQ ID NO: 21768 - protein, 28 aa, Artificial Sequence
  Description of Artificial Sequence: Synthetic peptide
DEQEIRTTNPVATEGYGEVSTNLQRGNS

SEQ ID NO: 21769 - protein, 29 aa, Artificial Sequence
  Description of Artificial Sequence: Synthetic peptide
DEEEIRTTNPVATEQYGSVSELNLQNGER

SEQ ID NO: 21770 - protein, 29 aa, Artificial Sequence
  Description of Artificial Sequence: Synthetic peptide
DEESIRTTNPVATEQYGAVSFNLQRGNDR

SEQ ID NO: 21771 - protein, 28 aa, Artificial Sequence
  Description of Artificial Sequence: Synthetic peptide
YEEEIRTTNPVATEQYGSVSTDLQRENS

SEQ ID NO: 21772 - protein, 28 aa, Artificial Sequence
  Description of Artificial Sequence: Synthetic peptide
DEEEIRATNPVCTEQYGSVSDNLQYGNR

SEQ ID NO: 21773 - protein, 29 aa, Artificial Sequence
  Description of Artificial Sequence: Synthetic peptide
DEEEIRTTNPVATEQYGSVSTELEQKGNA

SEQ ID NO: 21774 - protein, 30 aa, Artificial Sequence
  Description of Artificial Sequence: Synthetic polypeptide
DEEEIRTTNPVATEQYGNSVETENLQRGNE

SEQ ID NO: 21775 - protein, 28 aa, Artificial Sequence
  Description of Artificial Sequence: Synthetic peptide
DEEEIRTTNPVATEIYGSVGNNLQRGTR

SEQ ID NO: 21776 - protein, 28 aa, Artificial Sequence
  Description of Artificial Sequence: Synthetic peptide
SEEEIRTTNPTATEQFGSVSTNLQSGNR

SEQ ID NO: 21777 - protein, 31 aa, Artificial Sequence
  Description of Artificial Sequence: Synthetic polypeptide
DEEEIRTTNPVATEQYGSVDSTENLEREGNR

SEQ ID NO: 21778 - protein, 29 aa, Artificial Sequence
  Description of Artificial Sequence: Synthetic peptide
DEEEIRTTNPVATECYGSVSTELEQEGNR

SEQ ID NO: 21779 - protein, 28 aa, Artificial Sequence
  Description of Artificial Sequence: Synthetic peptide
DENEIRTTNPVATENYGIASTNLQRGNR

SEQ ID NO: 21780 - protein, 29 aa, Artificial Sequence
  Description of Artificial Sequence: Synthetic peptide
DEEEIRTTNPVATEQFGSVSENEQRGVNR

SEQ ID NO: 21781 - protein, 30 aa, Artificial Sequence
  Description of Artificial Sequence: Synthetic polypeptide
DEEEIRTTNPVATEQYGSVSTNGLQRGTES

SEQ ID NO: 21782 - protein, 28 aa, Artificial Sequence
  Description of Artificial Sequence: Synthetic peptide
DEEEIRTTNPVAYQCYGSVSTNLQRGER

SEQ ID NO: 21783 - protein, 28 aa, Artificial Sequence
  Description of Artificial Sequence: Synthetic peptide
DEEEIRTTNPVATEQYGSFSEFEQRGNR

SEQ ID NO: 21784 - protein, 30 aa, Artificial Sequence
  Description of Artificial Sequence: Synthetic polypeptide
DEEEIRTTNPVCTEQYGSVSTMNLQQRGNA

SEQ ID NO: 21785 - protein, 28 aa, Artificial Sequence
  Description of Artificial Sequence: Synthetic peptide
VEGEIRTTNPVATEQYGAVDTNLQRGNR

SEQ ID NO: 21786 - protein, 28 aa, Artificial Sequence
  Description of Artificial Sequence: Synthetic peptide
DEEEIATTNIVATEQYGSVSTNLDRGER

SEQ ID NO: 21787 - protein, 30 aa, Artificial Sequence
  Description of Artificial Sequence: Synthetic polypeptide
DEEEIRTTNPVATEQYGSVSTNLQDTGNDL

SEQ ID NO: 21788 - protein, 29 aa, Artificial Sequence
  Description of Artificial Sequence: Synthetic peptide
DEEEIRTTNPVATEQYGSVSCENLWRGNL

SEQ ID NO: 21789 - protein, 30 aa, Artificial Sequence
  Description of Artificial Sequence: Synthetic polypeptide
DEEEVRTTNPVATEIYGSVSATNLQREGNR

SEQ ID NO: 21790 - protein, 28 aa, Artificial Sequence
  Description of Artificial Sequence: Synthetic peptide
DENEIRTTNPVATECYGSVSTELQRGNA

SEQ ID NO: 21791 - protein, 28 aa, Artificial Sequence
  Description of Artificial Sequence: Synthetic peptide
DESEIRTTNPVATEQYGSVSTNLQVGEL

SEQ ID NO: 21792 - protein, 28 aa, Artificial Sequence
  Description of Artificial Sequence: Synthetic peptide
DEEEIRCTNPVATEQYGSVSTALQAGNY

SEQ ID NO: 21793 - protein, 28 aa, Artificial Sequence
  Description of Artificial Sequence: Synthetic peptide
DEEEIRTVNPVATEMYGDVSTNLQQGNR

SEQ ID NO: 21794 - protein, 28 aa, Artificial Sequence
  Description of Artificial Sequence: Synthetic peptide
AENEIRTTNPVSTEQYGSVSENLQRGNR

SEQ ID NO: 21795 - protein, 29 aa, Artificial Sequence
  Description of Artificial Sequence: Synthetic peptide
DENEIATTNPVATEQYGSVSTNLQRKGNI

SEQ ID NO: 21796 - protein, 28 aa, Artificial Sequence
  Description of Artificial Sequence: Synthetic peptide
DEEEIRTTNPVATEQYGSVSTGLEHGNQ

SEQ ID NO: 21797 - protein, 28 aa, Artificial Sequence
  Description of Artificial Sequence: Synthetic peptide
SEEEIRTTNPVATEQFGSVSTNLQNGTR

SEQ ID NO: 21798 - protein, 29 aa, Artificial Sequence
  Description of Artificial Sequence: Synthetic peptide
DEEEIRTTNPVATECYGSVSTELQFNGNR

SEQ ID NO: 21799 - protein, 28 aa, Artificial Sequence
  Description of Artificial Sequence: Synthetic peptide
DEEEIVTTNPVATEQYGDASTNLQRGNN

SEQ ID NO: 21800 - protein, 28 aa, Artificial Sequence
  Description of Artificial Sequence: Synthetic peptide
DEEEIRTTNPVATECYGSVSTDLQTGND

SEQ ID NO: 21801 - protein, 28 aa, Artificial Sequence
  Description of Artificial Sequence: Synthetic peptide
DEEEIRTTNPVATEQYGSVSTNVQSGDQ

SEQ ID NO: 21802 - protein, 28 aa, Artificial Sequence
  Description of Artificial Sequence: Synthetic peptide
DEEEIRTTNIVATEHYGSVSTNLQHGER

SEQ ID NO: 21803 - protein, 28 aa, Artificial Sequence
  Description of Artificial Sequence: Synthetic peptide
DEQEIRTTNPVATEQYGSVSENLERGNT

SEQ ID NO: 21804 - protein, 28 aa, Artificial Sequence
  Description of Artificial Sequence: Synthetic peptide
DEMEIRTTNIVATEQYGSVSTNLQNGNT

SEQ ID NO: 21805 - protein, 28 aa, Artificial Sequence
  Description of Artificial Sequence: Synthetic peptide
DEEEIRTTNPVATEQYGSVSTELQQGEI

SEQ ID NO: 21806 - protein, 28 aa, Artificial Sequence
  Description of Artificial Sequence: Synthetic peptide
DEEEIRTTNPVATEQFGSVSTDWQFGNR

SEQ ID NO: 21807 - protein, 28 aa, Artificial Sequence
  Description of Artificial Sequence: Synthetic peptide
DETEIASVNPVATEQYGSVSTNLQRGNR

SEQ ID NO: 21808 - protein, 28 aa, Artificial Sequence
  Description of Artificial Sequence: Synthetic peptide
DEEEIRTTNPVATECYGSYSTNLMRGDR

SEQ ID NO: 21809 - protein, 28 aa, Artificial Sequence
  Description of Artificial Sequence: Synthetic peptide
DEEEIRTTNPVAHEQYGSVSTNLERPTR

SEQ ID NO: 21810 - protein, 28 aa, Artificial Sequence
  Description of Artificial Sequence: Synthetic peptide
DEEEIRTTNPVATEQYGSVSDNLMQGNS

SEQ ID NO: 21811 - protein, 30 aa, Artificial Sequence
  Description of Artificial Sequence: Synthetic polypeptide
DEEEIRTTNPTATEQYGEVSTNLQERAGNR

SEQ ID NO: 21812 - protein, 28 aa, Artificial Sequence
  Description of Artificial Sequence: Synthetic peptide
DEEEIRTTNPVATECYGSVGTDLQRGNL

SEQ ID NO: 21813 - protein, 28 aa, Artificial Sequence
  Description of Artificial Sequence: Synthetic peptide
DEEEIRTTNPVATEQYGSVSTNLDAGMN

SEQ ID NO: 21814 - protein, 29 aa, Artificial Sequence
  Description of Artificial Sequence: Synthetic peptide
DEEEIRTTNPVATEQYGSVSTNLQHGEDM

SEQ ID NO: 21815 - protein, 30 aa, Artificial Sequence
  Description of Artificial Sequence: Synthetic polypeptide
DEEEIRTTNPVATEQYGESVSETNLQRGEE

SEQ ID NO: 21816 - protein, 29 aa, Artificial Sequence
  Description of Artificial Sequence: Synthetic peptide
DEEEIRTTNPVATEQYGSVCPTNPQRENR

SEQ ID NO: 21817 - protein, 28 aa, Artificial Sequence
  Description of Artificial Sequence: Synthetic peptide
DEELIRTTNPVATEQYGSWETNLQRGNP

SEQ ID NO: 21818 - protein, 28 aa, Artificial Sequence
  Description of Artificial Sequence: Synthetic peptide
QEEEIRATNPVATEQYGSASDNLQRGNR

SEQ ID NO: 21819 - protein, 28 aa, Artificial Sequence
  Description of Artificial Sequence: Synthetic peptide
DEEEIRTTNPVAMEQYGSVSTNDQPGNP

SEQ ID NO: 21820 - protein, 28 aa, Artificial Sequence
  Description of Artificial Sequence: Synthetic peptide
DEEEIRTTNPVATEQYGSVSTNDLRGEA

SEQ ID NO: 21821 - protein, 28 aa, Artificial Sequence
  Description of Artificial Sequence: Synthetic peptide
DEEEIRATNIVATEQYGSVSTNLQRGEV

SEQ ID NO: 21822 - protein, 30 aa, Artificial Sequence
  Description of Artificial Sequence: Synthetic polypeptide
DEEEIRSTNPVATEQYGSVSTNLQREGDPR

SEQ ID NO: 21823 - protein, 29 aa, Artificial Sequence
  Description of Artificial Sequence: Synthetic peptide
DEEEIRTTNPVATELYGSVSENWQRGNDR

SEQ ID NO: 21824 - protein, 29 aa, Artificial Sequence
  Description of Artificial Sequence: Synthetic peptide
DEQEIATTNPVATEQYGDVSATNLQRGNR

SEQ ID NO: 21825 - protein, 28 aa, Artificial Sequence
  Description of Artificial Sequence: Synthetic peptide
DEEEIRTTNPVATEQYGSVSTDLELGNF

SEQ ID NO: 21826 - protein, 32 aa, Artificial Sequence
  Description of Artificial Sequence: Synthetic polypeptide
DEEEIRTTNPVATEQYGSVSETNGLQREGENR

SEQ ID NO: 21827 - protein, 28 aa, Artificial Sequence
  Description of Artificial Sequence: Synthetic peptide
DEEEVATTNPVATEIYGSVATNLQRGNR

SEQ ID NO: 21828 - protein, 28 aa, Artificial Sequence
  Description of Artificial Sequence: Synthetic peptide
DEEEIRTTNPVATEQWGSVSTNLMQGNF

SEQ ID NO: 21829 - protein, 28 aa, Artificial Sequence
  Description of Artificial Sequence: Synthetic peptide
DEEEIRTTNPVATECYGVVSTNLQRGEY

SEQ ID NO: 21830 - protein, 28 aa, Artificial Sequence
  Description of Artificial Sequence: Synthetic peptide
DEEEIRTTNPFATEQYGSVSTGLQRENY

SEQ ID NO: 21831 - protein, 28 aa, Artificial Sequence
  Description of Artificial Sequence: Synthetic peptide
DEEEIRTTNPVATEQYGSVDTNLQAGEM

SEQ ID NO: 21832 - protein, 30 aa, Artificial Sequence
  Description of Artificial Sequence: Synthetic polypeptide
DEEEIRTTNPVATEQYGSVSATNLQRAENK

SEQ ID NO: 21833 - protein, 28 aa, Artificial Sequence
  Description of Artificial Sequence: Synthetic peptide
DEEEIATTNIVATEQYGSVSTNLQHGNN

SEQ ID NO: 21834 - protein, 28 aa, Artificial Sequence
  Description of Artificial Sequence: Synthetic peptide
QENEIVTTNPVATEQYGSVSTNLQTGNR

SEQ ID NO: 21835 - protein, 28 aa, Artificial Sequence
  Description of Artificial Sequence: Synthetic peptide
DEEEIVTTNPVATEQYGSASCNLQHGNR

SEQ ID NO: 21836 - protein, 28 aa, Artificial Sequence
  Description of Artificial Sequence: Synthetic peptide
DEEEIRTTNIVAYEQYGSVSTNLDRGER

SEQ ID NO: 21837 - protein, 28 aa, Artificial Sequence
  Description of Artificial Sequence: Synthetic peptide
DEEEIRTTNPVATECYGSMSTNLQGGNN

SEQ ID NO: 21838 - protein, 30 aa, Artificial Sequence
  Description of Artificial Sequence: Synthetic polypeptide
DEEEIRTTNPVATEQYGSVSTNLQELGNDS

SEQ ID NO: 21839 - protein, 28 aa, Artificial Sequence
  Description of Artificial Sequence: Synthetic peptide
DEEEIRTTNPVATEQYGSVSENLQHGEN

SEQ ID NO: 21840 - protein, 28 aa, Artificial Sequence
  Description of Artificial Sequence: Synthetic peptide
DEEEIATTNPTATEQFGSVSTNLQQGNR

SEQ ID NO: 21841 - protein, 28 aa, Artificial Sequence
  Description of Artificial Sequence: Synthetic peptide
DESEIRTTNPVSTEQYGNVSTNLQRGQR

SEQ ID NO: 21842 - protein, 28 aa, Artificial Sequence
  Description of Artificial Sequence: Synthetic peptide
DESEIRTTNIVATEQYGSVSTNLQVGND

SEQ ID NO: 21843 - protein, 28 aa, Artificial Sequence
  Description of Artificial Sequence: Synthetic peptide
DEEEIATTNPVATEQYGSVSTNLEHGNL

SEQ ID NO: 21844 - protein, 29 aa, Artificial Sequence
  Description of Artificial Sequence: Synthetic peptide
DEEEIRTTNPVATEQYGDVSTNLQHGFNQ

SEQ ID NO: 21845 - protein, 28 aa, Artificial Sequence
  Description of Artificial Sequence: Synthetic peptide
DESEIRTTNPVATEQYGSVSDELCRGNR

SEQ ID NO: 21846 - protein, 28 aa, Artificial Sequence
  Description of Artificial Sequence: Synthetic peptide
DEDEIRTTNPVATEQYGSVSTNLQVGGN

SEQ ID NO: 21847 - protein, 31 aa, Artificial Sequence
  Description of Artificial Sequence: Synthetic polypeptide
DEEEIRTTNPVATEQYGSVSTDGLQREGNDR

SEQ ID NO: 21848 - protein, 28 aa, Artificial Sequence
  Description of Artificial Sequence: Synthetic peptide
DEEEIRTTNPCATEQYGSVSENWQRGNG

SEQ ID NO: 21849 - protein, 28 aa, Artificial Sequence
  Description of Artificial Sequence: Synthetic peptide
DEEEIRTTNIVATEQYGSVSTNIQRGDM

SEQ ID NO: 21850 - protein, 28 aa, Artificial Sequence
  Description of Artificial Sequence: Synthetic peptide
DEEEIRCTNPVCTEQYGSVAENLQRGNR

SEQ ID NO: 21851 - protein, 29 aa, Artificial Sequence
  Description of Artificial Sequence: Synthetic peptide
DEREIRTTNPVATEQYGSVGTELMQRGNR

SEQ ID NO: 21852 - protein, 28 aa, Artificial Sequence
  Description of Artificial Sequence: Synthetic peptide
DEEEIRATNPVATEQYGVVSTALQRGNI

SEQ ID NO: 21853 - protein, 28 aa, Artificial Sequence
  Description of Artificial Sequence: Synthetic peptide
DEEEIRTTNIVATEQYGEVSTNLQTGDR

SEQ ID NO: 21854 - protein, 28 aa, Artificial Sequence
  Description of Artificial Sequence: Synthetic peptide
DEEEIRQTNPVATEQYGDVSTNLQHGNC

SEQ ID NO: 21855 - protein, 29 aa, Artificial Sequence
  Description of Artificial Sequence: Synthetic peptide
DEEEIRTTNPVATEQWGIVSTNLQMRGNY

SEQ ID NO: 21856 - protein, 28 aa, Artificial Sequence
  Description of Artificial Sequence: Synthetic peptide
DEEEIRTTNPVATECYGSVSTLLQRENQ

SEQ ID NO: 21857 - protein, 28 aa, Artificial Sequence
  Description of Artificial Sequence: Synthetic peptide
DEEEIRTTNPVATEQYGDVSTNLQYGEL

SEQ ID NO: 21858 - protein, 28 aa, Artificial Sequence
  Description of Artificial Sequence: Synthetic peptide
DEEEIATTNIVATEQYGSVSTNIQRGNF

SEQ ID NO: 21859 - protein, 28 aa, Artificial Sequence
  Description of Artificial Sequence: Synthetic peptide
DEEEIRTTNPVATEQYGDVSTNEQLENR

SEQ ID NO: 21860 - protein, 28 aa, Artificial Sequence
  Description of Artificial Sequence: Synthetic peptide
DEIEIRQTNPVATEQYGEVSTNLQRGNQ

SEQ ID NO: 21861 - protein, 28 aa, Artificial Sequence
  Description of Artificial Sequence: Synthetic peptide
DEEEIRTTNIVATEQYGSVSTNIQSGNT

SEQ ID NO: 21862 - protein, 28 aa, Artificial Sequence
  Description of Artificial Sequence: Synthetic peptide
DEEEIRTTNIVATEQYGSVSTNLQLEND

SEQ ID NO: 21863 - protein, 28 aa, Artificial Sequence
  Description of Artificial Sequence: Synthetic peptide
DEVEIAATNPVATEQYGWVSTNLQRGNR

SEQ ID NO: 21864 - protein, 28 aa, Artificial Sequence
  Description of Artificial Sequence: Synthetic peptide
DEVEIRTTNPTATEQYGSVSTNLQNGNA

SEQ ID NO: 21865 - protein, 28 aa, Artificial Sequence
  Description of Artificial Sequence: Synthetic peptide
DEEEIRTTNPDATQQYGSVSTNLDRGND

SEQ ID NO: 21866 - protein, 28 aa, Artificial Sequence
  Description of Artificial Sequence: Synthetic peptide
DEEEIRTTNPVATEQYGSVSENLQAGEM

SEQ ID NO: 21867 - protein, 29 aa, Artificial Sequence
  Description of Artificial Sequence: Synthetic peptide
AEEEISTTNPVATEQYGSVSAENLQRGNR

SEQ ID NO: 21868 - protein, 28 aa, Artificial Sequence
  Description of Artificial Sequence: Synthetic peptide
KEEEIRATNPVATECYGVVSTNLQRGNR

SEQ ID NO: 21869 - protein, 29 aa, Artificial Sequence
  Description of Artificial Sequence: Synthetic peptide
DEEEIRTTNPDATEQYGSVSTNLDRDGNP

SEQ ID NO: 21870 - protein, 28 aa, Artificial Sequence
  Description of Artificial Sequence: Synthetic peptide
DEEEIRTTNPVATEQYGSVDTNDMRGNF

SEQ ID NO: 21871 - protein, 28 aa, Artificial Sequence
  Description of Artificial Sequence: Synthetic peptide
DENEIRQTNPVATEQYGSVSTGLQRGND

SEQ ID NO: 21872 - protein, 29 aa, Artificial Sequence
  Description of Artificial Sequence: Synthetic peptide
DEEEIGTTNPVATEQYGSVSCVLQRAGNR

SEQ ID NO: 21873 - protein, 28 aa, Artificial Sequence
  Description of Artificial Sequence: Synthetic peptide
DEQEVRTTNPVATEMYGSVSTNLERGNR

SEQ ID NO: 21874 - protein, 28 aa, Artificial Sequence
  Description of Artificial Sequence: Synthetic peptide
DEEEIRTTNPVGTEQYGNVSENLQRGNA

SEQ ID NO: 21875 - protein, 28 aa, Artificial Sequence
  Description of Artificial Sequence: Synthetic peptide
DEEEIRTTNPVATEQYGSVSTNLNNGFT

SEQ ID NO: 21876 - protein, 31 aa, Artificial Sequence
  Description of Artificial Sequence: Synthetic polypeptide
DEEEIRTTNPDATEQYGSVVSTMNLQRGENR

SEQ ID NO: 21877 - protein, 28 aa, Artificial Sequence
  Description of Artificial Sequence: Synthetic peptide
DEEEIATTNPVATEQYGSVSTDLQNGNT

SEQ ID NO: 21878 - protein, 28 aa, Artificial Sequence
  Description of Artificial Sequence: Synthetic peptide
VEEEIRTTNPVAYEVYGSVGTNLQRGNR

SEQ ID NO: 21879 - protein, 28 aa, Artificial Sequence
  Description of Artificial Sequence: Synthetic peptide
DENEIRTTNPVATEQWGSVSENLQRGNA

SEQ ID NO: 21880 - protein, 28 aa, Artificial Sequence
  Description of Artificial Sequence: Synthetic peptide
DEVEIRTTNPVATELYGSVSVNEQRGNR

SEQ ID NO: 21881 - protein, 28 aa, Artificial Sequence
  Description of Artificial Sequence: Synthetic peptide
DEEEIRTVNPVATEQYGSVSTNLQAEER

SEQ ID NO: 21882 - protein, 32 aa, Artificial Sequence
  Description of Artificial Sequence: Synthetic polypeptide
DEEEIRTTNPVATEQYGSVSTANLQDRGDNDR

SEQ ID NO: 21883 - protein, 28 aa, Artificial Sequence
  Description of Artificial Sequence: Synthetic peptide
DENEIRTTNPVATEQWGSVSTNEQRGNA

SEQ ID NO: 21884 - protein, 28 aa, Artificial Sequence
  Description of Artificial Sequence: Synthetic peptide
DEEEIRTTNPVATEQYGVVSTNEQHGNE

SEQ ID NO: 21885 - protein, 28 aa, Artificial Sequence
  Description of Artificial Sequence: Synthetic peptide
DEEEIVCTNPVATEIYGVVSTNLQRGNR

SEQ ID NO: 21886 - protein, 28 aa, Artificial Sequence
  Description of Artificial Sequence: Synthetic peptide
DEEEIRTTNIVATEQYGSVSTNLQTGDS

SEQ ID NO: 21887 - protein, 28 aa, Artificial Sequence
  Description of Artificial Sequence: Synthetic peptide
DEEEIRTTNPVATEQYGSVSTNDEIGNN

SEQ ID NO: 21888 - protein, 28 aa, Artificial Sequence
  Description of Artificial Sequence: Synthetic peptide
DEEEIRTTNPVATEQYGSVDTRLSEGNR

SEQ ID NO: 21889 - protein, 28 aa, Artificial Sequence
  Description of Artificial Sequence: Synthetic peptide
DEEEIRTTNPVCFESYGSVSTNLQAGNR

SEQ ID NO: 21890 - protein, 30 aa, Artificial Sequence
  Description of Artificial Sequence: Synthetic polypeptide
MEQEIRTTNPVATEQYGSVSTNLQERGNDR

SEQ ID NO: 21891 - protein, 28 aa, Artificial Sequence
  Description of Artificial Sequence: Synthetic peptide
DEEEIRTTNPVATECYGVVSTDLQQGNR

SEQ ID NO: 21892 - protein, 28 aa, Artificial Sequence
  Description of Artificial Sequence: Synthetic peptide
DDAEIRTTNPVATEIYGSVSTNLQRGGR

SEQ ID NO: 21893 - protein, 30 aa, Artificial Sequence
  Description of Artificial Sequence: Synthetic polypeptide
DEEEIRTTNPTATEQYGSVSTGNLQDQGNR

SEQ ID NO: 21894 - protein, 28 aa, Artificial Sequence
  Description of Artificial Sequence: Synthetic peptide
DDEEIRTTNPVSTEQYGVVSTNLQRLNR

SEQ ID NO: 21895 - protein, 28 aa, Artificial Sequence
  Description of Artificial Sequence: Synthetic peptide
DEEEIRTTNPVATEQYGSVSEDLQAGNQ

SEQ ID NO: 21896 - protein, 28 aa, Artificial Sequence
  Description of Artificial Sequence: Synthetic peptide
DEEEIRTTNPVATEQYGSVSTNLEHGEA

SEQ ID NO: 21897 - protein, 28 aa, Artificial Sequence
  Description of Artificial Sequence: Synthetic peptide
DEIEIRTTNPVATECYGSVSTNLQRGTI

SEQ ID NO: 21898 - protein, 28 aa, Artificial Sequence
  Description of Artificial Sequence: Synthetic peptide
DEEEIRTTNIVATEQYGVVSTNLQRGDF

SEQ ID NO: 21899 - protein, 29 aa, Artificial Sequence
  Description of Artificial Sequence: Synthetic peptide
DEEEIRTTNPVATELFGTVDSTNLQRGNR

SEQ ID NO: 21900 - protein, 28 aa, Artificial Sequence
  Description of Artificial Sequence: Synthetic peptide
DEQEIRTTNPVATEQYGSVETNDQRGNF

SEQ ID NO: 21901 - protein, 28 aa, Artificial Sequence
  Description of Artificial Sequence: Synthetic peptide
DEEEIATTNIVATEQYGSVSTNIQGGNR

SEQ ID NO: 21902 - protein, 28 aa, Artificial Sequence
  Description of Artificial Sequence: Synthetic peptide
SEEEIRTTNIVATECYGSVSTNLQEGNR

SEQ ID NO: 21903 - protein, 28 aa, Artificial Sequence
  Description of Artificial Sequence: Synthetic peptide
DEEEIRPTNPVATEQYGSVSTGLDRGND

SEQ ID NO: 21904 - protein, 30 aa, Artificial Sequence
  Description of Artificial Sequence: Synthetic polypeptide
DEEEIRTTNPVATEQYGSVSTGPQDRGDNR

SEQ ID NO: 21905 - protein, 28 aa, Artificial Sequence
  Description of Artificial Sequence: Synthetic peptide
DEEEIRSTNIVATEQYGEVSTNLQDGNR

SEQ ID NO: 21906 - protein, 28 aa, Artificial Sequence
  Description of Artificial Sequence: Synthetic peptide
DEEEIRTTNPVATECYGSVSTELQQGNI

SEQ ID NO: 21907 - protein, 29 aa, Artificial Sequence
  Description of Artificial Sequence: Synthetic peptide
DEHEVRTTNPVATEQYGSVFTNLQRGNDR

SEQ ID NO: 21908 - protein, 28 aa, Artificial Sequence
  Description of Artificial Sequence: Synthetic peptide
DEEEIRTTNPHATEQWGSVSEQLQRGNR

SEQ ID NO: 21909 - protein, 28 aa, Artificial Sequence
  Description of Artificial Sequence: Synthetic peptide
DEEEIATTNPVATECYGSVSTNLQRGED

SEQ ID NO: 21910 - protein, 28 aa, Artificial Sequence
  Description of Artificial Sequence: Synthetic peptide
DEEEIRTTNIVATEQWGSVSTNLQRENG

SEQ ID NO: 21911 - protein, 28 aa, Artificial Sequence
  Description of Artificial Sequence: Synthetic peptide
DEEEIRTTNPVATEQYGSVSTGLEDGNF

SEQ ID NO: 21912 - protein, 28 aa, Artificial Sequence
  Description of Artificial Sequence: Synthetic peptide
DEEEIRTTNPVATEQFGSVSEDLQRGNF

SEQ ID NO: 21913 - protein, 28 aa, Artificial Sequence
  Description of Artificial Sequence: Synthetic peptide
DEEEIVTTNPVATEQYGSVSTTLQQGNL

SEQ ID NO: 21914 - protein, 28 aa, Artificial Sequence
  Description of Artificial Sequence: Synthetic peptide
SEEEIATTNPVATEQFGSVSTNLQQGNR

SEQ ID NO: 21915 - protein, 29 aa, Artificial Sequence
  Description of Artificial Sequence: Synthetic peptide
DEEEIRTTNPVATEQYGSVSTEEQLDGNR

SEQ ID NO: 21916 - protein, 30 aa, Artificial Sequence
  Description of Artificial Sequence: Synthetic polypeptide
DEEEIRTTNPVATEQYGSVISENLQRGDNF

SEQ ID NO: 21917 - protein, 28 aa, Artificial Sequence
  Description of Artificial Sequence: Synthetic peptide
DEQEIRTTNPVATEQYGSVSTNLEVGNN

SEQ ID NO: 21918 - protein, 28 aa, Artificial Sequence
  Description of Artificial Sequence: Synthetic peptide
MENEIRTTNPVATEQYGSVSENLQRGNF

SEQ ID NO: 21919 - protein, 28 aa, Artificial Sequence
  Description of Artificial Sequence: Synthetic peptide
DEEEIRTTNPVATEQYGSVSENPQRGDY

SEQ ID NO: 21920 - protein, 28 aa, Artificial Sequence
  Description of Artificial Sequence: Synthetic peptide
DEEEIRTTNIVATEQWGSVATNLQVGNR

SEQ ID NO: 21921 - protein, 28 aa, Artificial Sequence
  Description of Artificial Sequence: Synthetic peptide
DEEEIRTTNIVATECYGSVSTNLQNGER

SEQ ID NO: 21922 - protein, 28 aa, Artificial Sequence
  Description of Artificial Sequence: Synthetic peptide
DEEEIRGTNPVATESYGAVSTNLQRGNC

SEQ ID NO: 21923 - protein, 28 aa, Artificial Sequence
  Description of Artificial Sequence: Synthetic peptide
IEEEIRTTNPVATEQYGDVSDNLQRGLR

SEQ ID NO: 21924 - protein, 28 aa, Artificial Sequence
  Description of Artificial Sequence: Synthetic peptide
DEEEIRTTNPVATEQYGSVWTEDQRGQR

SEQ ID NO: 21925 - protein, 28 aa, Artificial Sequence
  Description of Artificial Sequence: Synthetic peptide
DEEEIRTTNIVATECYGSVGTNLQEGNR

SEQ ID NO: 21926 - protein, 28 aa, Artificial Sequence
  Description of Artificial Sequence: Synthetic peptide
DENEIRTTNPVATELYGSVSTNLQIGNM

SEQ ID NO: 21927 - protein, 28 aa, Artificial Sequence
  Description of Artificial Sequence: Synthetic peptide
DEDEIRTTNPVASEQYGSVSTPLQRENR

SEQ ID NO: 21928 - protein, 28 aa, Artificial Sequence
  Description of Artificial Sequence: Synthetic peptide
DEEEIKTTNPVATEQYGSVSTAEYRGNR

SEQ ID NO: 21929 - protein, 29 aa, Artificial Sequence
  Description of Artificial Sequence: Synthetic peptide
DENEIATTNPVATEQYGSVSTDLQRGNDR

SEQ ID NO: 21930 - protein, 29 aa, Artificial Sequence
  Description of Artificial Sequence: Synthetic peptide
DEEEIRTTNPVATEQYGSWSTPLDFRGNR

SEQ ID NO: 21931 - protein, 28 aa, Artificial Sequence
  Description of Artificial Sequence: Synthetic peptide
DEREIVATNPVSTEQYGSVSTNLQRGNR

SEQ ID NO: 21932 - protein, 28 aa, Artificial Sequence
  Description of Artificial Sequence: Synthetic peptide
DEEEIRTTNIVATEQYGSVSTNLQIGEL

SEQ ID NO: 21933 - protein, 29 aa, Artificial Sequence
  Description of Artificial Sequence: Synthetic peptide
DEEEIRTTNPEATEQYGSVSTNPLQHGER

SEQ ID NO: 21934 - protein, 28 aa, Artificial Sequence
  Description of Artificial Sequence: Synthetic peptide
GEEEIVTTNPVATEQYGVVSTNLQRGNC

SEQ ID NO: 21935 - protein, 28 aa, Artificial Sequence
  Description of Artificial Sequence: Synthetic peptide
DEEETRTTNPVATEQYGAVSTVLQRGNS

SEQ ID NO: 21936 - protein, 31 aa, Artificial Sequence
  Description of Artificial Sequence: Synthetic polypeptide
DEEEIRTTNPVATEQYGSVSTTGNLTDRGNR

SEQ ID NO: 21937 - protein, 28 aa, Artificial Sequence
  Description of Artificial Sequence: Synthetic peptide
DEEEIRTVNPVATEQYGSMSTNLQNGER

SEQ ID NO: 21938 - protein, 31 aa, Artificial Sequence
  Description of Artificial Sequence: Synthetic polypeptide
DEEEIRTTNPVATEQYGSVSDTNLQPDGENR

SEQ ID NO: 21939 - protein, 29 aa, Artificial Sequence
  Description of Artificial Sequence: Synthetic peptide
DEEEIATTNPVATEMYGSVSTNLQRPNTR

SEQ ID NO: 21940 - protein, 30 aa, Artificial Sequence
  Description of Artificial Sequence: Synthetic polypeptide
DEEEIRTTNPVATEQYWDSVSTNLQRENER

SEQ ID NO: 21941 - protein, 30 aa, Artificial Sequence
  Description of Artificial Sequence: Synthetic polypeptide
QEEEIRTTNPVATEQYGSVSTCNLQGEGNR

SEQ ID NO: 21942 - protein, 28 aa, Artificial Sequence
  Description of Artificial Sequence: Synthetic peptide
DEEEIRTTNPTATEQFGSVSTNLQVGTR

SEQ ID NO: 21943 - protein, 29 aa, Artificial Sequence
  Description of Artificial Sequence: Synthetic peptide
KEEEIRTTNPVATEQYGSVSTNLQESGNV

SEQ ID NO: 21944 - protein, 31 aa, Artificial Sequence
  Description of Artificial Sequence: Synthetic polypeptide
DEEEIRTTNPVATEQYGSYVSTNLERKGNPR

SEQ ID NO: 21945 - protein, 28 aa, Artificial Sequence
  Description of Artificial Sequence: Synthetic peptide
DEEEIRTTNPVATEQYGSVETELQRGDG

SEQ ID NO: 21946 - protein, 28 aa, Artificial Sequence
  Description of Artificial Sequence: Synthetic peptide
DEEEIRTTNPVATEQYGSVSTADQIGNI

SEQ ID NO: 21947 - protein, 28 aa, Artificial Sequence
  Description of Artificial Sequence: Synthetic peptide
DEEEIRTTNPVATEQYGYVSDNLQVGNF

SEQ ID NO: 21948 - protein, 28 aa, Artificial Sequence
  Description of Artificial Sequence: Synthetic peptide
DEEEIRCTNPVATEQYGSVSTELQQGND

SEQ ID NO: 21949 - protein, 32 aa, Artificial Sequence
  Description of Artificial Sequence: Synthetic polypeptide
DEEEIRTTNPVATEQYGSVSVTNLVQRGDNPR

SEQ ID NO: 21950 - protein, 28 aa, Artificial Sequence
  Description of Artificial Sequence: Synthetic peptide
NEEEIRTTNPIATEQYGSISNNLQRGNR

SEQ ID NO: 21951 - protein, 30 aa, Artificial Sequence
  Description of Artificial Sequence: Synthetic polypeptide
DEEEIRTTNPVATEQYGSVTSTPGLLRGNR

SEQ ID NO: 21952 - protein, 31 aa, Artificial Sequence
  Description of Artificial Sequence: Synthetic polypeptide
DEEEIRTTNPVATEQYGSVWCTNPLQRGFNR

SEQ ID NO: 21953 - protein, 28 aa, Artificial Sequence
  Description of Artificial Sequence: Synthetic peptide
DEEELRTTNPVASEQYGSISTNLQVGNR

SEQ ID NO: 21954 - protein, 31 aa, Artificial Sequence
  Description of Artificial Sequence: Synthetic polypeptide
DEEEIRTTNPVATEQYGSVSVTNLQQVTGNR

SEQ ID NO: 21955 - protein, 28 aa, Artificial Sequence
  Description of Artificial Sequence: Synthetic peptide
DEEEIRTVNPVSTEQYGSVSTNLQRGEK

SEQ ID NO: 21956 - protein, 28 aa, Artificial Sequence
  Description of Artificial Sequence: Synthetic peptide
DEEEIRTTNPVATEQYGSVSTAEQWGNE

SEQ ID NO: 21957 - protein, 28 aa, Artificial Sequence
  Description of Artificial Sequence: Synthetic peptide
DEEEIRTTNPVATEQYGSVSTMLQPGDF

SEQ ID NO: 21958 - protein, 29 aa, Artificial Sequence
  Description of Artificial Sequence: Synthetic peptide
DEEEIRTTNPVAHEQYGSVPSTGLNRGNR

SEQ ID NO: 21959 - protein, 28 aa, Artificial Sequence
  Description of Artificial Sequence: Synthetic peptide
DEEEIRTTNPVATEQYGSVSTEDERGNL

SEQ ID NO: 21960 - protein, 28 aa, Artificial Sequence
  Description of Artificial Sequence: Synthetic peptide
SEEEIRTTNPVATEQYGSVSTNLQHGTV

SEQ ID NO: 21961 - protein, 28 aa, Artificial Sequence
  Description of Artificial Sequence: Synthetic peptide
DEQEIASTNPVATEQYGVVSTNLQRGNR

SEQ ID NO: 21962 - protein, 28 aa, Artificial Sequence
  Description of Artificial Sequence: Synthetic peptide
DEEEIRQTNPVATEQYGDVSTPLQHGNR

SEQ ID NO: 21963 - protein, 28 aa, Artificial Sequence
  Description of Artificial Sequence: Synthetic peptide
DEEEIRTTNPVATEQYGSVSDNDQNGNI

SEQ ID NO: 21964 - protein, 29 aa, Artificial Sequence
  Description of Artificial Sequence: Synthetic peptide
DEEEIRTTNPVATEQYGGVSTNLQLGDNP

SEQ ID NO: 21965 - protein, 29 aa, Artificial Sequence
  Description of Artificial Sequence: Synthetic peptide
DEEEIATTNPTATEQYGSVSTNLQQGDNR

SEQ ID NO: 21966 - protein, 30 aa, Artificial Sequence
  Description of Artificial Sequence: Synthetic polypeptide
DEEEIRTTNPVATEQYGSASCTNLQRAENR

SEQ ID NO: 21967 - protein, 30 aa, Artificial Sequence
  Description of Artificial Sequence: Synthetic polypeptide
DEEEIRTTNPVATEIYGSVSTNEQRNGENR

SEQ ID NO: 21968 - protein, 30 aa, Artificial Sequence
  Description of Artificial Sequence: Synthetic polypeptide
QEQEIRTTNPVATEQYGSVSTVNLQRGNDR

SEQ ID NO: 21969 - protein, 28 aa, Artificial Sequence
  Description of Artificial Sequence: Synthetic peptide
DEEEIRTTNPVATEQYGSVSTELQYGEA

SEQ ID NO: 21970 - protein, 28 aa, Artificial Sequence
  Description of Artificial Sequence: Synthetic peptide
DEEEIRATNPVATLQYGSVSTNDLRGNR

SEQ ID NO: 21971 - protein, 28 aa, Artificial Sequence
  Description of Artificial Sequence: Synthetic peptide
DEQEIRTTNIVATEQYGSVSTGLQRGER

SEQ ID NO: 21972 - protein, 28 aa, Artificial Sequence
  Description of Artificial Sequence: Synthetic peptide
DEEEIRTTNPVATEQYGSVSTNLMLGTW

SEQ ID NO: 21973 - protein, 28 aa, Artificial Sequence
  Description of Artificial Sequence: Synthetic peptide
DEEEIRATNPVCTEQYGSVSTNLQHGNM

SEQ ID NO: 21974 - protein, 30 aa, Artificial Sequence
  Description of Artificial Sequence: Synthetic polypeptide
DEEEIRTTNPVATEQYGSVDSTNLDEPGNR

SEQ ID NO: 21975 - protein, 28 aa, Artificial Sequence
  Description of Artificial Sequence: Synthetic peptide
DENEIATTNPVATEQYGSASTNLQRFNR

SEQ ID NO: 21976 - protein, 29 aa, Artificial Sequence
  Description of Artificial Sequence: Synthetic peptide
DEEEIRTTNPVATEQWGIVSTNLQRGNDQ

SEQ ID NO: 21977 - protein, 28 aa, Artificial Sequence
  Description of Artificial Sequence: Synthetic peptide
GEEEIATTNPVATEMYGSVSTDLQRGNR

SEQ ID NO: 21978 - protein, 28 aa, Artificial Sequence
  Description of Artificial Sequence: Synthetic peptide
SEEEIRTTNPTATEQYGSVSTNEQRGTR

SEQ ID NO: 21979 - protein, 31 aa, Artificial Sequence
  Description of Artificial Sequence: Synthetic polypeptide
DEEEIRTTNPVATEQYGSVSETNLQRGDNDV

SEQ ID NO: 21980 - protein, 30 aa, Artificial Sequence
  Description of Artificial Sequence: Synthetic polypeptide
DEEEIATTNPVATEQYGSVSENLQERGYNR

SEQ ID NO: 21981 - protein, 28 aa, Artificial Sequence
  Description of Artificial Sequence: Synthetic peptide
EEEEIRTTNPVATDQYGEVPTNLQRGNR

SEQ ID NO: 21982 - protein, 29 aa, Artificial Sequence
  Description of Artificial Sequence: Synthetic peptide
QEEEIATTNPVATEQYGSVSADNLQRGNR

SEQ ID NO: 21983 - protein, 29 aa, Artificial Sequence
  Description of Artificial Sequence: Synthetic peptide
DEEEIRTTNPVATEQYGSVSTELQGEGDR

SEQ ID NO: 21984 - protein, 31 aa, Artificial Sequence
  Description of Artificial Sequence: Synthetic polypeptide
DEEEIRTTNPVATEQYGSVSTNLQDREGEDR

SEQ ID NO: 21985 - protein, 28 aa, Artificial Sequence
  Description of Artificial Sequence: Synthetic peptide
DEEEIRTTNPVATEQYGSVSTAQQRGEH

SEQ ID NO: 21986 - protein, 28 aa, Artificial Sequence
  Description of Artificial Sequence: Synthetic peptide
DEEEIRQTNPVSTEQYGEVSTNIQRGNR

SEQ ID NO: 21987 - protein, 29 aa, Artificial Sequence
  Description of Artificial Sequence: Synthetic peptide
DEEEIRTTNPVATEQYGSVSDNLQVHENR

SEQ ID NO: 21988 - protein, 28 aa, Artificial Sequence
  Description of Artificial Sequence: Synthetic peptide
KEEEIRTVNPVATECYGWVSTNLQRGNR

SEQ ID NO: 21989 - protein, 29 aa, Artificial Sequence
  Description of Artificial Sequence: Synthetic peptide
DEEEIRTTNPVATEQYGSVSTELQEHGER

SEQ ID NO: 21990 - protein, 28 aa, Artificial Sequence
  Description of Artificial Sequence: Synthetic peptide
DEEEIRTTNPTATECFGSVSTNLQNGNR

SEQ ID NO: 21991 - protein, 28 aa, Artificial Sequence
  Description of Artificial Sequence: Synthetic peptide
DELEIRTTNPVATEMYGSVSTNEQRGNF

SEQ ID NO: 21992 - protein, 28 aa, Artificial Sequence
  Description of Artificial Sequence: Synthetic peptide
DEEEIRTTNPSATTQYGSVSTNLNDGNR

SEQ ID NO: 21993 - protein, 29 aa, Artificial Sequence
  Description of Artificial Sequence: Synthetic peptide
DEEEIRTTNPVATEQYGSVSTNEEWRGNQ

SEQ ID NO: 21994 - protein, 29 aa, Artificial Sequence
  Description of Artificial Sequence: Synthetic peptide
AEEEIRTTNPVATEQYGLVSNNLQSRGNR

SEQ ID NO: 21995 - protein, 28 aa, Artificial Sequence
  Description of Artificial Sequence: Synthetic peptide
DEEEIRTTNIVATEQYGSVSNNLQGGNF

SEQ ID NO: 21996 - protein, 28 aa, Artificial Sequence
  Description of Artificial Sequence: Synthetic peptide
DEEEIRTVNPVAWEQYGSVSTELQFGNR

SEQ ID NO: 21997 - protein, 28 aa, Artificial Sequence
  Description of Artificial Sequence: Synthetic peptide
DEQEIRTTNPVATEQWGSVSTNLERGNA

SEQ ID NO: 21998 - protein, 31 aa, Artificial Sequence
  Description of Artificial Sequence: Synthetic polypeptide
DEEEIRTTNPVATEQYGSVSTVNLQRGDNPT

SEQ ID NO: 21999 - protein, 29 aa, Artificial Sequence
  Description of Artificial Sequence: Synthetic peptide
DEEEIRTTNPSATEQYGSVSCTEYQRGNR

SEQ ID NO: 22000 - protein, 29 aa, Artificial Sequence
  Description of Artificial Sequence: Synthetic peptide
DEEEIRTTNPVATEQYGSVSTNEMNRGNF

SEQ ID NO: 22001 - protein, 28 aa, Artificial Sequence
  Description of Artificial Sequence: Synthetic peptide
MEEEIRTTNPVATEMYGSVSTNLQVGNT

SEQ ID NO: 22002 - protein, 28 aa, Artificial Sequence
  Description of Artificial Sequence: Synthetic peptide
GEEEIATTNPVATEQYGSVSTDLQVGNR

SEQ ID NO: 22003 - protein, 28 aa, Artificial Sequence
  Description of Artificial Sequence: Synthetic peptide
DENEIRTTNPVATEQYGWVSTNLQHGNA

SEQ ID NO: 22004 - protein, 29 aa, Artificial Sequence
  Description of Artificial Sequence: Synthetic peptide
EEEEIRTTNPVATEQYGIVISTNLQNGNR

SEQ ID NO: 22005 - protein, 28 aa, Artificial Sequence
  Description of Artificial Sequence: Synthetic peptide
KEEEIRTTNPVATECYGSVSTNLQVGNI

SEQ ID NO: 22006 - protein, 28 aa, Artificial Sequence
  Description of Artificial Sequence: Synthetic peptide
DEDEIRTTNPVATEQYGSVSEVEQRGNR

SEQ ID NO: 22007 - protein, 28 aa, Artificial Sequence
  Description of Artificial Sequence: Synthetic peptide
MEEEIRTTNPVATEQYGSVSTDLQNGNF

SEQ ID NO: 22008 - protein, 28 aa, Artificial Sequence
  Description of Artificial Sequence: Synthetic peptide
DEEEIRTTNPVATEQYGSVDTNLQWENY

SEQ ID NO: 22009 - protein, 29 aa, Artificial Sequence
  Description of Artificial Sequence: Synthetic peptide
DEEEIRTTNPTATEVYGTVSTNNLQRGNR

SEQ ID NO: 22010 - protein, 29 aa, Artificial Sequence
  Description of Artificial Sequence: Synthetic peptide
DEEEIRTTNPVATEQYGDASTLNLQVGNR

SEQ ID NO: 22011 - protein, 28 aa, Artificial Sequence
  Description of Artificial Sequence: Synthetic peptide
DEEEIRSTNPVATEQYGSVSTPLQRGDV

SEQ ID NO: 22012 - protein, 28 aa, Artificial Sequence
  Description of Artificial Sequence: Synthetic peptide
DEEEIRATNPVATEQYGGVSTNLERGNF

SEQ ID NO: 22013 - protein, 28 aa, Artificial Sequence
  Description of Artificial Sequence: Synthetic peptide
DEEEIRTTNIVATEQYGSVATNLERGNG

SEQ ID NO: 22014 - protein, 28 aa, Artificial Sequence
  Description of Artificial Sequence: Synthetic peptide
DEEEIRTTNPEATELYGSVSTNDQRGDR

SEQ ID NO: 22015 - protein, 28 aa, Artificial Sequence
  Description of Artificial Sequence: Synthetic peptide
DEEEIRTTNPVATQQYGSVSTPDDRGNR

SEQ ID NO: 22016 - protein, 28 aa, Artificial Sequence
  Description of Artificial Sequence: Synthetic peptide
DEEEIATTNIVATEQYGSVSTNLQRGGK

SEQ ID NO: 22017 - protein, 28 aa, Artificial Sequence
  Description of Artificial Sequence: Synthetic peptide
DESEVRGTNPVATEQYGTVSTNLQRGNR

SEQ ID NO: 22018 - protein, 28 aa, Artificial Sequence
  Description of Artificial Sequence: Synthetic peptide
KEEEIRTTNPVATEQYGSVSTDLQGGNV

SEQ ID NO: 22019 - protein, 29 aa, Artificial Sequence
  Description of Artificial Sequence: Synthetic peptide
DEEEIRCTNPVATEQYGSVSTDGLQRGNG

SEQ ID NO: 22020 - protein, 28 aa, Artificial Sequence
  Description of Artificial Sequence: Synthetic peptide
DEMEIVTTNPVATEQYGSVSTALQRGNE

SEQ ID NO: 22021 - protein, 28 aa, Artificial Sequence
  Description of Artificial Sequence: Synthetic peptide
AEEEIRQTNPVATEQYGSVSTGLERGNR

SEQ ID NO: 22022 - protein, 31 aa, Artificial Sequence
  Description of Artificial Sequence: Synthetic polypeptide
DEEEIRTTNPVATEQYGSVSTTNLQEREGER

SEQ ID NO: 22023 - protein, 28 aa, Artificial Sequence
  Description of Artificial Sequence: Synthetic peptide
DEQEIRCTNPVATELYGSVSMNLQRGNR

SEQ ID NO: 22024 - protein, 31 aa, Artificial Sequence
  Description of Artificial Sequence: Synthetic polypeptide
DEEEIRTTNPVATEQYGSVSATDLQERGNDR

SEQ ID NO: 22025 - protein, 29 aa, Artificial Sequence
  Description of Artificial Sequence: Synthetic peptide
DEEEIRTTNPVATEQYGSVSTNLERGEEE

SEQ ID NO: 22026 - protein, 30 aa, Artificial Sequence
  Description of Artificial Sequence: Synthetic polypeptide
DEEEIRTTNPVATEQYGSVSTMNLQQGNDQ

SEQ ID NO: 22027 - protein, 31 aa, Artificial Sequence
  Description of Artificial Sequence: Synthetic polypeptide
DEEEIRTTNPVATEQYGSVSTPNPLQDYGNR

SEQ ID NO: 22028 - protein, 28 aa, Artificial Sequence
  Description of Artificial Sequence: Synthetic peptide
DEEEIRTTNPEATDQYGSVSTNLQLGNL

SEQ ID NO: 22029 - protein, 28 aa, Artificial Sequence
  Description of Artificial Sequence: Synthetic peptide
SEEEITTTNPVATEQYGEVSTNLQFGNR

SEQ ID NO: 22030 - protein, 30 aa, Artificial Sequence
  Description of Artificial Sequence: Synthetic polypeptide
DEEEIRCTNPVATEQYGSVSTNLQCDEGNR

SEQ ID NO: 22031 - protein, 28 aa, Artificial Sequence
  Description of Artificial Sequence: Synthetic peptide
DEEEIRTTNIVATENYGSVSTNLQRGED

SEQ ID NO: 22032 - protein, 28 aa, Artificial Sequence
  Description of Artificial Sequence: Synthetic peptide
KEEEIRTTNPVATEQYGSVSTDLQSGNM

SEQ ID NO: 22033 - protein, 28 aa, Artificial Sequence
  Description of Artificial Sequence: Synthetic peptide
DEEEIRTTNITATEQYGSVSTNLQRGED

SEQ ID NO: 22034 - protein, 28 aa, Artificial Sequence
  Description of Artificial Sequence: Synthetic peptide
DEEEIRTTNPVATEQYGSVSTELEMGNA

SEQ ID NO: 22035 - protein, 28 aa, Artificial Sequence
  Description of Artificial Sequence: Synthetic peptide
DEEEIRTTNPVATEQYGSVSTGQDEGNR

SEQ ID NO: 22036 - protein, 30 aa, Artificial Sequence
  Description of Artificial Sequence: Synthetic polypeptide
DEEEIRTTNPVATEMYGSVISTMNLQRGNF

SEQ ID NO: 22037 - protein, 28 aa, Artificial Sequence
  Description of Artificial Sequence: Synthetic peptide
DEEEIRTTNPVATEQYGSVSTNECQGNA

SEQ ID NO: 22038 - protein, 28 aa, Artificial Sequence
  Description of Artificial Sequence: Synthetic peptide
DEEEVRTTNPVATENYGSVAMNLQRGNR

SEQ ID NO: 22039 - protein, 28 aa, Artificial Sequence
  Description of Artificial Sequence: Synthetic peptide
DENEIRCTNPVATEQYGSVSENLQRGTR

SEQ ID NO: 22040 - protein, 30 aa, Artificial Sequence
  Description of Artificial Sequence: Synthetic polypeptide
DEEEIRTTNPVCTEQYGSVSTMNLQDYGNR

SEQ ID NO: 22041 - protein, 28 aa, Artificial Sequence
  Description of Artificial Sequence: Synthetic peptide
NEEEIRTTNPVAFESYGSVSTNLQRENR

SEQ ID NO: 22042 - protein, 30 aa, Artificial Sequence
  Description of Artificial Sequence: Synthetic polypeptide
DEEEIRTTNPVATEQYGSVSCTDLQCRGND

SEQ ID NO: 22043 - protein, 28 aa, Artificial Sequence
  Description of Artificial Sequence: Synthetic peptide
DEQEIRATNPVATENYGVVSTNLQRGNR

SEQ ID NO: 22044 - protein, 30 aa, Artificial Sequence
  Description of Artificial Sequence: Synthetic polypeptide
DEEEIRTTNPVATEQYGSVSATNLQEPGND

SEQ ID NO: 22045 - protein, 28 aa, Artificial Sequence
  Description of Artificial Sequence: Synthetic peptide
DEEEIRTTNPVASELYGSVSTNLQRGTQ

SEQ ID NO: 22046 - protein, 28 aa, Artificial Sequence
  Description of Artificial Sequence: Synthetic peptide
QEEEIRQTNPVATEQYGEVSTNLQRGGR

SEQ ID NO: 22047 - protein, 29 aa, Artificial Sequence
  Description of Artificial Sequence: Synthetic peptide
DEEEIRTTNPVATEQYGSVSTELQDNGNI

SEQ ID NO: 22048 - protein, 28 aa, Artificial Sequence
  Description of Artificial Sequence: Synthetic peptide
DEMEIRTTNPVSTEQYGWVSTNLQAGNR

SEQ ID NO: 22049 - protein, 28 aa, Artificial Sequence
  Description of Artificial Sequence: Synthetic peptide
DEEEIRTTNPVASEQYGSVPDNLQRENR

SEQ ID NO: 22050 - protein, 28 aa, Artificial Sequence
  Description of Artificial Sequence: Synthetic peptide
DEETIRTTNPVATLQYGSVSTSLQRGNF

SEQ ID NO: 22051 - protein, 29 aa, Artificial Sequence
  Description of Artificial Sequence: Synthetic peptide
DEEEIRTTNPVATEQYGSVSTDLQEQGNE

SEQ ID NO: 22052 - protein, 28 aa, Artificial Sequence
  Description of Artificial Sequence: Synthetic peptide
DEEEIRTTNPVATEQYGSVSTALNVGNY

SEQ ID NO: 22053 - protein, 30 aa, Artificial Sequence
  Description of Artificial Sequence: Synthetic polypeptide
DEEEIRTTNPVATEQYGSVSENLQIRSGND

SEQ ID NO: 22054 - protein, 28 aa, Artificial Sequence
  Description of Artificial Sequence: Synthetic peptide
DEEEIRCTNPVATETYGSTSSNLQRGNR

SEQ ID NO: 22055 - protein, 28 aa, Artificial Sequence
  Description of Artificial Sequence: Synthetic peptide
DEEEIRCTNPVATEQYGSVSTNDQLGNM

SEQ ID NO: 22056 - protein, 30 aa, Artificial Sequence
  Description of Artificial Sequence: Synthetic polypeptide
DEEEIRTTNPVATEQYGWVSTNLQDNEGNR

SEQ ID NO: 22057 - protein, 31 aa, Artificial Sequence
  Description of Artificial Sequence: Synthetic polypeptide
DEEEIRTTNPVATEQYGSVSTLNLPQEVGNR

SEQ ID NO: 22058 - protein, 28 aa, Artificial Sequence
  Description of Artificial Sequence: Synthetic peptide
DEHEIRTTNPVATEQYGDVSEDLQRGNR

SEQ ID NO: 22059 - protein, 31 aa, Artificial Sequence
  Description of Artificial Sequence: Synthetic polypeptide
DEEEIRTTNPVATEQYGSVSDTGNLERKGNR

SEQ ID NO: 22060 - protein, 28 aa, Artificial Sequence
  Description of Artificial Sequence: Synthetic peptide
DEEEIRTTNPVATELYGSVSTNLEIGNF

SEQ ID NO: 22061 - protein, 28 aa, Artificial Sequence
  Description of Artificial Sequence: Synthetic peptide
DEQEIRTTNPVATEQYGSVSTNLERENA

SEQ ID NO: 22062 - protein, 28 aa, Artificial Sequence
  Description of Artificial Sequence: Synthetic peptide
SEEEIRTTNPEATEQYGSVSANLQQGNR

SEQ ID NO: 22063 - protein, 31 aa, Artificial Sequence
  Description of Artificial Sequence: Synthetic polypeptide
DEEEIRTTNPVATEQYGSVSITNLQVTGVNR

SEQ ID NO: 22064 - protein, 28 aa, Artificial Sequence
  Description of Artificial Sequence: Synthetic peptide
DEEEIRTTNPVATEQYGSWSTDEQTGNR

SEQ ID NO: 22065 - protein, 30 aa, Artificial Sequence
  Description of Artificial Sequence: Synthetic polypeptide
DEEEIRTTNPVATEQYGSVSCTDEQRGFNR

SEQ ID NO: 22066 - protein, 28 aa, Artificial Sequence
  Description of Artificial Sequence: Synthetic peptide
DEEEIRTTNPVATEQYGSVETDDQRGNY

SEQ ID NO: 22067 - protein, 30 aa, Artificial Sequence
  Description of Artificial Sequence: Synthetic polypeptide
DEEEIRTTNPVATEQYGSVESTNLERGNPH

SEQ ID NO: 22068 - protein, 28 aa, Artificial Sequence
  Description of Artificial Sequence: Synthetic peptide
DEEEIRTTNPECTEVYGSVATNLQRGNR

SEQ ID NO: 22069 - protein, 28 aa, Artificial Sequence
  Description of Artificial Sequence: Synthetic peptide
DEEEIRTTNPVATECYGDVSTNLQLGND

SEQ ID NO: 22070 - protein, 28 aa, Artificial Sequence
  Description of Artificial Sequence: Synthetic peptide
DEEEIRTTNPESTEQYGSVSTDLQRGNQ

SEQ ID NO: 22071 - protein, 28 aa, Artificial Sequence
  Description of Artificial Sequence: Synthetic peptide
DENEIRTTNPVATEQYGSVATNLQGGNN

SEQ ID NO: 22072 - protein, 28 aa, Artificial Sequence
  Description of Artificial Sequence: Synthetic peptide
DEEEIRTTNPVATEQYGSVEYNEQRGNE

SEQ ID NO: 22073 - protein, 30 aa, Artificial Sequence
  Description of Artificial Sequence: Synthetic polypeptide
DEEEIRTTNPVATEPYGSVSCTDLQQRGNR

SEQ ID NO: 22074 - protein, 28 aa, Artificial Sequence
  Description of Artificial Sequence: Synthetic peptide
SEEEIRTTNPVATEQYGGVSENLQQGNR

SEQ ID NO: 22075 - protein, 30 aa, Artificial Sequence
  Description of Artificial Sequence: Synthetic polypeptide
DEEEIRTTNPVATEQYGSKVSTNAQSPGNR

SEQ ID NO: 22076 - protein, 28 aa, Artificial Sequence
  Description of Artificial Sequence: Synthetic peptide
DENEIRTTNPVATEQYGGVSENLQRGNN

SEQ ID NO: 22077 - protein, 29 aa, Artificial Sequence
  Description of Artificial Sequence: Synthetic peptide
DEEEIRTTNPVATEQYGLVSVNLQRGNDF

SEQ ID NO: 22078 - protein, 28 aa, Artificial Sequence
  Description of Artificial Sequence: Synthetic peptide
DEEEIRTTNIVATEQYGTVSTNLQNGNV

SEQ ID NO: 22079 - protein, 28 aa, Artificial Sequence
  Description of Artificial Sequence: Synthetic peptide
DEEEIRCTNPVATEMYGCVGTNLQRGNR

SEQ ID NO: 22080 - protein, 28 aa, Artificial Sequence
  Description of Artificial Sequence: Synthetic peptide
DEEEIRTTNPVATEQWGSVSTNLQTGTF

SEQ ID NO: 22081 - protein, 29 aa, Artificial Sequence
  Description of Artificial Sequence: Synthetic peptide
KEEEIRTTNPVATECYGSVSTNLQRGNDI

SEQ ID NO: 22082 - protein, 30 aa, Artificial Sequence
  Description of Artificial Sequence: Synthetic polypeptide
DEEEIRTTNPVATEQYGSVSDTNPLLRGER

SEQ ID NO: 22083 - protein, 30 aa, Artificial Sequence
  Description of Artificial Sequence: Synthetic polypeptide
DEEEIRTTNPVATEQYGSVSACNLQRGNDS

SEQ ID NO: 22084 - protein, 31 aa, Artificial Sequence
  Description of Artificial Sequence: Synthetic polypeptide
DEEEIRTTNPDATEQYGSVSTNLQVREGNPR

SEQ ID NO: 22085 - protein, 28 aa, Artificial Sequence
  Description of Artificial Sequence: Synthetic peptide
DEEEIRTTNPVATEQYWSWSTDLQRGER

SEQ ID NO: 22086 - protein, 29 aa, Artificial Sequence
  Description of Artificial Sequence: Synthetic peptide
DEEEIRTTNPVATEQYGSVSCENLQAGNS

SEQ ID NO: 22087 - protein, 31 aa, Artificial Sequence
  Description of Artificial Sequence: Synthetic polypeptide
DEEQIRTTNPVATEQYGSVTSTPNPLQRGNR

SEQ ID NO: 22088 - protein, 30 aa, Artificial Sequence
  Description of Artificial Sequence: Synthetic polypeptide
DEEEIRTTNPVATEQYGSVSDNLIQTSGNR

SEQ ID NO: 22089 - protein, 29 aa, Artificial Sequence
  Description of Artificial Sequence: Synthetic peptide
DEEEIRATNPVATEQYGSVSTELQGNGNR

SEQ ID NO: 22090 - protein, 30 aa, Artificial Sequence
  Description of Artificial Sequence: Synthetic polypeptide
MEEEIRTTNPVATEQYGSVSTNLQERGNDM

SEQ ID NO: 22091 - protein, 28 aa, Artificial Sequence
  Description of Artificial Sequence: Synthetic peptide
DCEEIRTTNPVATEQYGSVSTGLQRQNS

SEQ ID NO: 22092 - protein, 28 aa, Artificial Sequence
  Description of Artificial Sequence: Synthetic peptide
DEEEIRTTNPVATEQYGDVSEDLQRGNA

SEQ ID NO: 22093 - protein, 29 aa, Artificial Sequence
  Description of Artificial Sequence: Synthetic peptide
DEEEIRTTNPVATEQYGSVSENLQNVGNA

SEQ ID NO: 22094 - protein, 30 aa, Artificial Sequence
  Description of Artificial Sequence: Synthetic polypeptide
DEEEIATTNPVATEQYGSVSTDLQRGENDR

SEQ ID NO: 22095 - protein, 28 aa, Artificial Sequence
  Description of Artificial Sequence: Synthetic peptide
DEEEIRTTNPVATEVYGDVSTNLQHGNQ

SEQ ID NO: 22096 - protein, 31 aa, Artificial Sequence
  Description of Artificial Sequence: Synthetic polypeptide
DEEEIRTTNPVATEQYGSVDSTDLQSRDGNR

SEQ ID NO: 22097 - protein, 30 aa, Artificial Sequence
  Description of Artificial Sequence: Synthetic polypeptide
DEEEIRTTNPVATEQYGSVSMTGLPQTGNR

SEQ ID NO: 22098 - protein, 30 aa, Artificial Sequence
  Description of Artificial Sequence: Synthetic polypeptide
DEEEIRTTNPVATEQYGSVSTENLPNRDNR

SEQ ID NO: 22099 - protein, 30 aa, Artificial Sequence
  Description of Artificial Sequence: Synthetic polypeptide
DEEEIRTTNPVATEQYGSVSTNLQRHGMHA

SEQ ID NO: 22100 - protein, 28 aa, Artificial Sequence
  Description of Artificial Sequence: Synthetic peptide
SEEEIRTTNPVATEQFGSVSTNPQRGNN

SEQ ID NO: 22101 - protein, 29 aa, Artificial Sequence
  Description of Artificial Sequence: Synthetic peptide
DEEEIRTTNPVATEQWGSVSTNEQIRGNS

SEQ ID NO: 22102 - protein, 29 aa, Artificial Sequence
  Description of Artificial Sequence: Synthetic peptide
DEEEIRTTNPVATEQYGSTSTNDQRKGNV

SEQ ID NO: 22103 - protein, 31 aa, Artificial Sequence
  Description of Artificial Sequence: Synthetic polypeptide
DEEEIRTTNPVATEQYGSVSETNLVQQGDNR

SEQ ID NO: 22104 - protein, 28 aa, Artificial Sequence
  Description of Artificial Sequence: Synthetic peptide
DEQEIAATNPVATEQYGWVSTNLQRGNR

SEQ ID NO: 22105 - protein, 28 aa, Artificial Sequence
  Description of Artificial Sequence: Synthetic peptide
DTEEIRTTNPFATEQYGSVSTNPQRGNT

SEQ ID NO: 22106 - protein, 28 aa, Artificial Sequence
  Description of Artificial Sequence: Synthetic peptide
DEEEIRTTNPVATEQYGSVSTELQMGDA

SEQ ID NO: 22107 - protein, 30 aa, Artificial Sequence
  Description of Artificial Sequence: Synthetic polypeptide
DEEEIRTTNPVATEQYGSVSTANLQATGNW

SEQ ID NO: 22108 - protein, 29 aa, Artificial Sequence
  Description of Artificial Sequence: Synthetic peptide
DEEEIRTTNPVATEQYGSVDTNDQRAGNL

SEQ ID NO: 22109 - protein, 28 aa, Artificial Sequence
  Description of Artificial Sequence: Synthetic peptide
DEEEIRSTNPVATEIYGAVSNNLQRGNR

SEQ ID NO: 22110 - protein, 28 aa, Artificial Sequence
  Description of Artificial Sequence: Synthetic peptide
DEEEIRTTNPVATEQYGSVSTPLEVGNI

SEQ ID NO: 22111 - protein, 28 aa, Artificial Sequence
  Description of Artificial Sequence: Synthetic peptide
QEEEISTTNPVATEQYGWVSTNLQRGGR

SEQ ID NO: 22112 - protein, 29 aa, Artificial Sequence
  Description of Artificial Sequence: Synthetic peptide
DEEEIRTTNPVATEMYGSMSTNLQREGNY

SEQ ID NO: 22113 - protein, 28 aa, Artificial Sequence
  Description of Artificial Sequence: Synthetic peptide
DEEEIRTTNPVATEQYGSVSTDLQIGEN

SEQ ID NO: 22114 - protein, 30 aa, Artificial Sequence
  Description of Artificial Sequence: Synthetic polypeptide
QEEEIRTTNPVATEPYGSVSTNLQQRGNDR

SEQ ID NO: 22115 - protein, 29 aa, Artificial Sequence
  Description of Artificial Sequence: Synthetic peptide
DENEIRTTNPVATEQYGSVSTNLQEHGER

SEQ ID NO: 22116 - protein, 28 aa, Artificial Sequence
  Description of Artificial Sequence: Synthetic peptide
DEEEIATTNPVATEQYGSVSTNEQNGNV

SEQ ID NO: 22117 - protein, 32 aa, Artificial Sequence
  Description of Artificial Sequence: Synthetic polypeptide
DEEEIRTTNPVATEQYGSVSTDNPLQRGENDR

SEQ ID NO: 22118 - protein, 29 aa, Artificial Sequence
  Description of Artificial Sequence: Synthetic peptide
IEEEIRTTNPVATEQYGSVSTGLTQRPNR

SEQ ID NO: 22119 - protein, 31 aa, Artificial Sequence
  Description of Artificial Sequence: Synthetic polypeptide
DEEEIRTTNPVATEQYGSVDSDTDPLQRGNR

SEQ ID NO: 22120 - protein, 28 aa, Artificial Sequence
  Description of Artificial Sequence: Synthetic peptide
DEEEIRTTNPVATECYGSASTNLQTGNI

SEQ ID NO: 22121 - protein, 30 aa, Artificial Sequence
  Description of Artificial Sequence: Synthetic polypeptide
GEEEIRTTNPVATEQYGSVSENLQVRGNDR

SEQ ID NO: 22122 - protein, 28 aa, Artificial Sequence
  Description of Artificial Sequence: Synthetic peptide
DEEEIATTNPVATEQYGSVPTNLQHGNL

SEQ ID NO: 22123 - protein, 28 aa, Artificial Sequence
  Description of Artificial Sequence: Synthetic peptide
DEEEIATTNIVATEQWGSVSTNLQRGNI

SEQ ID NO: 22124 - protein, 28 aa, Artificial Sequence
  Description of Artificial Sequence: Synthetic peptide
DEQEIRTTNPVATENYGSVSNNLERGNR

SEQ ID NO: 22125 - protein, 28 aa, Artificial Sequence
  Description of Artificial Sequence: Synthetic peptide
DEQEIATTNPVATEQYGSVSTDLQRGER

SEQ ID NO: 22126 - protein, 28 aa, Artificial Sequence
  Description of Artificial Sequence: Synthetic peptide
DEEEIRTTNPVATEQYGSVSTELQIGDY

SEQ ID NO: 22127 - protein, 28 aa, Artificial Sequence
  Description of Artificial Sequence: Synthetic peptide
DEEEIRTTNPVATEQYGSVSTNEQIGTL

SEQ ID NO: 22128 - protein, 29 aa, Artificial Sequence
  Description of Artificial Sequence: Synthetic peptide
NESEIRTTNPVATEQYGCVSTNLQRGNDR

SEQ ID NO: 22129 - protein, 28 aa, Artificial Sequence
  Description of Artificial Sequence: Synthetic peptide
SEEEISTTNPVATEQYGSVSTNEQRGNS

SEQ ID NO: 22130 - protein, 31 aa, Artificial Sequence
  Description of Artificial Sequence: Synthetic polypeptide
MEEEIRTTNPVATEQYGSVSTNLQEREGNDR

SEQ ID NO: 22131 - protein, 28 aa, Artificial Sequence
  Description of Artificial Sequence: Synthetic peptide
SDEEIRTTNPVATEQYGSVATNLQRGER

SEQ ID NO: 22132 - protein, 28 aa, Artificial Sequence
  Description of Artificial Sequence: Synthetic peptide
DEEEIRTTNPVSTEMYGSVSTDLQRGNV

SEQ ID NO: 22133 - protein, 31 aa, Artificial Sequence
  Description of Artificial Sequence: Synthetic polypeptide
DEEEIRTTNPVATEQYGSVVGSNTNLQRGND

SEQ ID NO: 22134 - protein, 28 aa, Artificial Sequence
  Description of Artificial Sequence: Synthetic peptide
DEEEIRTTNPVATEQYGSVSTPLPAGNY

SEQ ID NO: 22135 - protein, 28 aa, Artificial Sequence
  Description of Artificial Sequence: Synthetic peptide
DEGEIRTTNIVATEQYGSVSTNLQAGDR

SEQ ID NO: 22136 - protein, 28 aa, Artificial Sequence
  Description of Artificial Sequence: Synthetic peptide
DEESIRTTNPVATEQYGSVSTNLQVLNM

SEQ ID NO: 22137 - protein, 28 aa, Artificial Sequence
  Description of Artificial Sequence: Synthetic peptide
DEEEIRTTNPCATEQYGSVATNLERGNL

SEQ ID NO: 22138 - protein, 28 aa, Artificial Sequence
  Description of Artificial Sequence: Synthetic peptide
DEEEIRTTNPVATEQYGSVDTNEQRGDQ

SEQ ID NO: 22139 - protein, 28 aa, Artificial Sequence
  Description of Artificial Sequence: Synthetic peptide
DEEEIRTVNPVASEQYGAVSTNLQRGNQ

SEQ ID NO: 22140 - protein, 29 aa, Artificial Sequence
  Description of Artificial Sequence: Synthetic peptide
DEVEIRTTNPVATEQYGGVSENLQRGDNR

SEQ ID NO: 22141 - protein, 28 aa, Artificial Sequence
  Description of Artificial Sequence: Synthetic peptide
DEEEIRCTNPVATEMYGSVSDNLQEGNR

SEQ ID NO: 22142 - protein, 30 aa, Artificial Sequence
  Description of Artificial Sequence: Synthetic polypeptide
DEEPIRTTNPVATEQYGSVSVDNLQLRGNR

SEQ ID NO: 22143 - protein, 30 aa, Artificial Sequence
  Description of Artificial Sequence: Synthetic polypeptide
DEEEIRTTNPVATEQYGSVSTNLQDLGNDW

SEQ ID NO: 22144 - protein, 28 aa, Artificial Sequence
  Description of Artificial Sequence: Synthetic peptide
DEEEIRTTNPVATEQYGTVSTDLQSGNT

SEQ ID NO: 22145 - protein, 28 aa, Artificial Sequence
  Description of Artificial Sequence: Synthetic peptide
DEEEIRTTNPVATEQYGDVSTNLQRDQG

SEQ ID NO: 22146 - protein, 30 aa, Artificial Sequence
  Description of Artificial Sequence: Synthetic polypeptide
DEEEIRTTNPVATECYGSVSTNGLQERGNT

SEQ ID NO: 22147 - protein, 28 aa, Artificial Sequence
  Description of Artificial Sequence: Synthetic peptide
DEEEIRTTNPVATEQYGSVSENLLGGMR

SEQ ID NO: 22148 - protein, 31 aa, Artificial Sequence
  Description of Artificial Sequence: Synthetic polypeptide
IEEEIRTTNPVATEQYGSVSTENLQDRGNDR

SEQ ID NO: 22149 - protein, 28 aa, Artificial Sequence
  Description of Artificial Sequence: Synthetic peptide
DENEIRTTNPVSSECYGSVSTNLQRGNR

SEQ ID NO: 22150 - protein, 28 aa, Artificial Sequence
  Description of Artificial Sequence: Synthetic peptide
DEEEIRTTNPVATEQYGSVDTNLERGEL

SEQ ID NO: 22151 - protein, 29 aa, Artificial Sequence
  Description of Artificial Sequence: Synthetic peptide
DEEEIRTTNPVATEQWGSVSENLQMRGNQ

SEQ ID NO: 22152 - protein, 28 aa, Artificial Sequence
  Description of Artificial Sequence: Synthetic peptide
DEQEIRTTNPVATEVYGVVGTNLQRGNR

SEQ ID NO: 22153 - protein, 28 aa, Artificial Sequence
  Description of Artificial Sequence: Synthetic peptide
DEQEIRTTNPVATEQYGSVSTNLMQGNF

SEQ ID NO: 22154 - protein, 28 aa, Artificial Sequence
  Description of Artificial Sequence: Synthetic peptide
DEEEIRTTNPVATEQYGEVSTDLQSGNY

SEQ ID NO: 22155 - protein, 28 aa, Artificial Sequence
  Description of Artificial Sequence: Synthetic peptide
SEDEIRTTNPVATEQYGSVSTNLQRGEI

SEQ ID NO: 22156 - protein, 28 aa, Artificial Sequence
  Description of Artificial Sequence: Synthetic peptide
DEQEIRTTNPVATEQYGSVETNLQWGNV

SEQ ID NO: 22157 - protein, 28 aa, Artificial Sequence
  Description of Artificial Sequence: Synthetic peptide
DEEEIRGTNPVSTEQYGSVSTNLQFGDR

SEQ ID NO: 22158 - protein, 29 aa, Artificial Sequence
  Description of Artificial Sequence: Synthetic peptide
DEEEIRTTNPVATECYGSVSTNLQHEGER

SEQ ID NO: 22159 - protein, 28 aa, Artificial Sequence
  Description of Artificial Sequence: Synthetic peptide
FEEEIRTTNPVATEQYGETATNLQRGNR

SEQ ID NO: 22160 - protein, 28 aa, Artificial Sequence
  Description of Artificial Sequence: Synthetic peptide
NEEEVRTTNPVATETYGSVSTNLQRGTR

SEQ ID NO: 22161 - protein, 28 aa, Artificial Sequence
  Description of Artificial Sequence: Synthetic peptide
DEEEIRTTNPTATEQYGDVSTNEQNGNR

SEQ ID NO: 22162 - protein, 29 aa, Artificial Sequence
  Description of Artificial Sequence: Synthetic peptide
NETEIRTTNPVATEQYGEVSTNLQSRGNR

SEQ ID NO: 22163 - protein, 29 aa, Artificial Sequence
  Description of Artificial Sequence: Synthetic peptide
GEEEIRTTNPVATEQYGSVSATNLQQGNI

SEQ ID NO: 22164 - protein, 28 aa, Artificial Sequence
  Description of Artificial Sequence: Synthetic peptide
DEQEIRTTNPVSTEIYGSVSTNLQRGNM

SEQ ID NO: 22165 - protein, 28 aa, Artificial Sequence
  Description of Artificial Sequence: Synthetic peptide
DEEEIRTTNPVATEQYGSVTTNLGYGNG

SEQ ID NO: 22166 - protein, 28 aa, Artificial Sequence
  Description of Artificial Sequence: Synthetic peptide
DEGEIYTTNPVATEQYGTVSTDLQRGNR

SEQ ID NO: 22167 - protein, 28 aa, Artificial Sequence
  Description of Artificial Sequence: Synthetic peptide
DEEEIRTTNPVATEQYGDVSTNDQRGEA

SEQ ID NO: 22168 - protein, 28 aa, Artificial Sequence
  Description of Artificial Sequence: Synthetic peptide
NDEEIRTTNPVATEQYGSNSTNLQRGNE

SEQ ID NO: 22169 - protein, 28 aa, Artificial Sequence
  Description of Artificial Sequence: Synthetic peptide
DEEEIRSTNPVATQQYGSVSTGLQRGER

SEQ ID NO: 22170 - protein, 28 aa, Artificial Sequence
  Description of Artificial Sequence: Synthetic peptide
DEEEIRTTNPTATEQYGDVSTNLQIGNQ

SEQ ID NO: 22171 - protein, 28 aa, Artificial Sequence
  Description of Artificial Sequence: Synthetic peptide
DEEEIRTTNPVATEQYGSVETPLDRGER

SEQ ID NO: 22172 - protein, 28 aa, Artificial Sequence
  Description of Artificial Sequence: Synthetic peptide
DEDEIRTTNPVATEQYGSVSTGLQHGNY

SEQ ID NO: 22173 - protein, 28 aa, Artificial Sequence
  Description of Artificial Sequence: Synthetic peptide
DEHEIRATNPVATEQYGWVSTNLQRGNA

SEQ ID NO: 22174 - protein, 28 aa, Artificial Sequence
  Description of Artificial Sequence: Synthetic peptide
DEEEIRTVNPVCTEQYGSVSTNLQRGGM

SEQ ID NO: 22175 - protein, 28 aa, Artificial Sequence
  Description of Artificial Sequence: Synthetic peptide
DEEEIRTTNPVATECYGSVSTDLEQGNR

SEQ ID NO: 22176 - protein, 30 aa, Artificial Sequence
  Description of Artificial Sequence: Synthetic polypeptide
DEEEIRTTNPVATEQYGIVSTDPLQTRGNR

SEQ ID NO: 22177 - protein, 28 aa, Artificial Sequence
  Description of Artificial Sequence: Synthetic peptide
DEEEIRTTNPVATEQYGSVSTDLEPGNW

SEQ ID NO: 22178 - protein, 29 aa, Artificial Sequence
  Description of Artificial Sequence: Synthetic peptide
DCEEIRTTNPVATGQYGSVSTNLSRGNYR

SEQ ID NO: 22179 - protein, 28 aa, Artificial Sequence
  Description of Artificial Sequence: Synthetic peptide
DEEEIRTTNPVATEQYGSVSTGDQGGNF

SEQ ID NO: 22180 - protein, 28 aa, Artificial Sequence
  Description of Artificial Sequence: Synthetic peptide
DEEEIATTNPVATEQYGSVATNLQNGNT

SEQ ID NO: 22181 - protein, 28 aa, Artificial Sequence
  Description of Artificial Sequence: Synthetic peptide
DEEEIRTTNPVATEQYGSVETPDDRGNR

SEQ ID NO: 22182 - protein, 28 aa, Artificial Sequence
  Description of Artificial Sequence: Synthetic peptide
DEEEIRTTNIVATEQYGSISTNLQRGEL

SEQ ID NO: 22183 - protein, 28 aa, Artificial Sequence
  Description of Artificial Sequence: Synthetic peptide
DEEEIRTTNPVATEQYGSVATNLQRLPQ

SEQ ID NO: 22184 - protein, 28 aa, Artificial Sequence
  Description of Artificial Sequence: Synthetic peptide
MENEIRTTNPVATECYGSVSTNLQQGNR

SEQ ID NO: 22185 - protein, 28 aa, Artificial Sequence
  Description of Artificial Sequence: Synthetic peptide
DEEEIRTTNPVATEQYGSVSTNEQSGEP

SEQ ID NO: 22186 - protein, 28 aa, Artificial Sequence
  Description of Artificial Sequence: Synthetic peptide
DEEEIRTTNPVATEQYGLVSTNEQPGNE

SEQ ID NO: 22187 - protein, 28 aa, Artificial Sequence
  Description of Artificial Sequence: Synthetic peptide
DEEEIRTTNPVCTEVYGAVSTNLQRGNN

SEQ ID NO: 22188 - protein, 29 aa, Artificial Sequence
  Description of Artificial Sequence: Synthetic peptide
DEEEIRTTNPVATEQYGSVSHGDQREGNR

SEQ ID NO: 22189 - protein, 28 aa, Artificial Sequence
  Description of Artificial Sequence: Synthetic peptide
DEEEIRTTNPVATEGYGSCSCNLQRGNL

SEQ ID NO: 22190 - protein, 30 aa, Artificial Sequence
  Description of Artificial Sequence: Synthetic polypeptide
SEEEIRTTNPTATEQYGSVSTGNLQERGNR

SEQ ID NO: 22191 - protein, 28 aa, Artificial Sequence
  Description of Artificial Sequence: Synthetic peptide
DEEEIRTTNPVATEQYGSVSEELQLGNH

SEQ ID NO: 22192 - protein, 28 aa, Artificial Sequence
  Description of Artificial Sequence: Synthetic peptide
DEEEIATTNPVATEQYGGVSTNLQNGNT

SEQ ID NO: 22193 - protein, 32 aa, Artificial Sequence
  Description of Artificial Sequence: Synthetic polypeptide
DEEEIRTTNPVATEQYGSVSTSNLKQRGENYR

SEQ ID NO: 22194 - protein, 29 aa, Artificial Sequence
  Description of Artificial Sequence: Synthetic peptide
DEEEIRTTNPVATEQWGSVSENLQQVGNR

SEQ ID NO: 22195 - protein, 29 aa, Artificial Sequence
  Description of Artificial Sequence: Synthetic peptide
DEEEIATTNPVATELYGSVSTNEQREGNR

SEQ ID NO: 22196 - protein, 31 aa, Artificial Sequence
  Description of Artificial Sequence: Synthetic polypeptide
DEEEIRTTNPVATEQYGSVSTENLQQGENDR

SEQ ID NO: 22197 - protein, 28 aa, Artificial Sequence
  Description of Artificial Sequence: Synthetic peptide
DEEEIRTTNIDATEQYGSVSTNLQDGTR

SEQ ID NO: 22198 - protein, 28 aa, Artificial Sequence
  Description of Artificial Sequence: Synthetic peptide
VEQEIATTNPVATEQYGVVSTNLQRGNR

SEQ ID NO: 22199 - protein, 28 aa, Artificial Sequence
  Description of Artificial Sequence: Synthetic peptide
DEEEVACTNPVATEQYGSVATNLQRGNR

SEQ ID NO: 22200 - protein, 30 aa, Artificial Sequence
  Description of Artificial Sequence: Synthetic polypeptide
DEEEIRTTNPVATEQYGSVSTNLQDSGNDA

SEQ ID NO: 22201 - protein, 28 aa, Artificial Sequence
  Description of Artificial Sequence: Synthetic peptide
DEEEIATTNPVATEQYGSVSTNQQLGNF

SEQ ID NO: 22202 - protein, 30 aa, Artificial Sequence
  Description of Artificial Sequence: Synthetic polypeptide
DEEEIRTTNPVATETYGSVDSTNLQREGNS

SEQ ID NO: 22203 - protein, 28 aa, Artificial Sequence
  Description of Artificial Sequence: Synthetic peptide
DEEEIAATNPVATEQYGVVSTDLQRGNR

SEQ ID NO: 22204 - protein, 32 aa, Artificial Sequence
  Description of Artificial Sequence: Synthetic polypeptide
DEEEIRTTNPVATEQYGSVSTTPNLPQRGNPR

SEQ ID NO: 22205 - protein, 30 aa, Artificial Sequence
  Description of Artificial Sequence: Synthetic polypeptide
DEEEIRQTNPVATEQYGSVSDTNLQLRGNT

SEQ ID NO: 22206 - protein, 29 aa, Artificial Sequence
  Description of Artificial Sequence: Synthetic peptide
DEEEIVCTNPVATEQYGSVSATNLQRGMR

SEQ ID NO: 22207 - protein, 28 aa, Artificial Sequence
  Description of Artificial Sequence: Synthetic peptide
DEEEIAATNIVATEQYGSVSTNLQIGNR

SEQ ID NO: 22208 - protein, 28 aa, Artificial Sequence
  Description of Artificial Sequence: Synthetic peptide
DEVEIRTTNPVCTEQYGSVSANLQRGNS

SEQ ID NO: 22209 - protein, 28 aa, Artificial Sequence
  Description of Artificial Sequence: Synthetic peptide
DENEIRTTNPVATEQYGSVSINEQRGNS

SEQ ID NO: 22210 - protein, 28 aa, Artificial Sequence
  Description of Artificial Sequence: Synthetic peptide
DEEEIRTTNPVATEQYGSVSTNEMSGNF

SEQ ID NO: 22211 - protein, 28 aa, Artificial Sequence
  Description of Artificial Sequence: Synthetic peptide
DEQEIRTTNPVATEIYGCVSTNLERGNR

SEQ ID NO: 22212 - protein, 28 aa, Artificial Sequence
  Description of Artificial Sequence: Synthetic peptide
DEEEIRTTNPCATEQYGSVSTDLQWGND

SEQ ID NO: 22213 - protein, 28 aa, Artificial Sequence
  Description of Artificial Sequence: Synthetic peptide
DMEEIRTTNPVATEQYGSSSTNMQRGNN

SEQ ID NO: 22214 - protein, 28 aa, Artificial Sequence
  Description of Artificial Sequence: Synthetic peptide
DEEEIRTTNIVATEMWGSVSTNLQRGND

SEQ ID NO: 22215 - protein, 28 aa, Artificial Sequence
  Description of Artificial Sequence: Synthetic peptide
QEEEIRTTNIVATEQYGTVSTNLQHGNR

SEQ ID NO: 22216 - protein, 28 aa, Artificial Sequence
  Description of Artificial Sequence: Synthetic peptide
DEEEIRTTNPTATEQYGSVSTNEQQGNQ

SEQ ID NO: 22217 - protein, 31 aa, Artificial Sequence
  Description of Artificial Sequence: Synthetic polypeptide
DEEEIRTTNPVATEQYGSVSTLNLQREGDNG

SEQ ID NO: 22218 - protein, 28 aa, Artificial Sequence
  Description of Artificial Sequence: Synthetic peptide
DEEEIRTTNIIATEQYGSVSTNLQNGTR

SEQ ID NO: 22219 - protein, 28 aa, Artificial Sequence
  Description of Artificial Sequence: Synthetic peptide
NECEIRTTNPVATEQYGSVSTNLQQGNI

SEQ ID NO: 22220 - protein, 31 aa, Artificial Sequence
  Description of Artificial Sequence: Synthetic polypeptide
DEEEIRTTNPVATEQYGSVSTPEPLQIRGNR

SEQ ID NO: 22221 - protein, 30 aa, Artificial Sequence
  Description of Artificial Sequence: Synthetic polypeptide
DENEIRTTNPVATECYGSVSDTNLQRGNDR

SEQ ID NO: 22222 - protein, 28 aa, Artificial Sequence
  Description of Artificial Sequence: Synthetic peptide
AEDEIGCTNPVATEQYGSVSTNLQRGNR

SEQ ID NO: 22223 - protein, 29 aa, Artificial Sequence
  Description of Artificial Sequence: Synthetic peptide
DEEEIRTTNPVATEQYGSVSCTDLCNGNR

SEQ ID NO: 22224 - protein, 28 aa, Artificial Sequence
  Description of Artificial Sequence: Synthetic peptide
KEEEIDTTNPVATQQYGSVSTNLQTGNR

SEQ ID NO: 22225 - protein, 28 aa, Artificial Sequence
  Description of Artificial Sequence: Synthetic peptide
DEEEIRTTNIVATEQWGSVSTDLQRGNF

SEQ ID NO: 22226 - protein, 28 aa, Artificial Sequence
  Description of Artificial Sequence: Synthetic peptide
DEQEIATTNPVATEVYGCVSTNLQRGNR

SEQ ID NO: 22227 - protein, 28 aa, Artificial Sequence
  Description of Artificial Sequence: Synthetic peptide
DEEEIRTTNPVAWEQYGSVETGLQRGNF

SEQ ID NO: 22228 - protein, 28 aa, Artificial Sequence
  Description of Artificial Sequence: Synthetic peptide
DEEEIATTNIVATEQYGSVSTNLQRGTT

SEQ ID NO: 22229 - protein, 28 aa, Artificial Sequence
  Description of Artificial Sequence: Synthetic peptide
DEGEIRTTNIVATEQYGSVSTNLQIGDR

SEQ ID NO: 22230 - protein, 28 aa, Artificial Sequence
  Description of Artificial Sequence: Synthetic peptide
DEEEIRTTNPVATEQYGSVSEELQRMNQ

SEQ ID NO: 22231 - protein, 28 aa, Artificial Sequence
  Description of Artificial Sequence: Synthetic peptide
DEEEIRTTNIVATEQFGSVSTNLQQGNL

SEQ ID NO: 22232 - protein, 29 aa, Artificial Sequence
  Description of Artificial Sequence: Synthetic peptide
DEEEIRTTNPVATEQYGQVSTGNLTRGND

SEQ ID NO: 22233 - protein, 28 aa, Artificial Sequence
  Description of Artificial Sequence: Synthetic peptide
DENEITTTNPVATEQYGSVSTNLQNGNE

SEQ ID NO: 22234 - protein, 28 aa, Artificial Sequence
  Description of Artificial Sequence: Synthetic peptide
DEEEIRTTNPDATEQYGSVSTNLMNGNF

SEQ ID NO: 22235 - protein, 28 aa, Artificial Sequence
  Description of Artificial Sequence: Synthetic peptide
REEEIRTTNPVATEQYGSVSTNLDTGNW

SEQ ID NO: 22236 - protein, 29 aa, Artificial Sequence
  Description of Artificial Sequence: Synthetic peptide
QEHEIRTTNPVATEQYGEVSTNLQRFGNR

SEQ ID NO: 22237 - protein, 31 aa, Artificial Sequence
  Description of Artificial Sequence: Synthetic polypeptide
DEEEIRTTNPVATEQYGSVSTMNEQDRGDNR

SEQ ID NO: 22238 - protein, 32 aa, Artificial Sequence
  Description of Artificial Sequence: Synthetic polypeptide
DEEEIRTTNPVATEQYGSVSATNLQDRNGNDR

SEQ ID NO: 22239 - protein, 28 aa, Artificial Sequence
  Description of Artificial Sequence: Synthetic peptide
DEEELATTNPVATEQYGSVSTNLQHGER

SEQ ID NO: 22240 - protein, 31 aa, Artificial Sequence
  Description of Artificial Sequence: Synthetic polypeptide
DEEEIRTTNPVATEQYGSVSFTNLPQRGNTF

SEQ ID NO: 22241 - protein, 30 aa, Artificial Sequence
  Description of Artificial Sequence: Synthetic polypeptide
DEEEIRTTNPVATEQYGSVTSTNLQTGGNS

SEQ ID NO: 22242 - protein, 30 aa, Artificial Sequence
  Description of Artificial Sequence: Synthetic polypeptide
DEEEIRTTNPVATEQWGSVSTNLQDRGENG

SEQ ID NO: 22243 - protein, 30 aa, Artificial Sequence
  Description of Artificial Sequence: Synthetic polypeptide
DEHEIRTTNPVATEQYGSASTNLQREGNDR

SEQ ID NO: 22244 - protein, 31 aa, Artificial Sequence
  Description of Artificial Sequence: Synthetic polypeptide
DEEEIRTTNPVATEQYGSVSTELQRKGTNER

SEQ ID NO: 22245 - protein, 28 aa, Artificial Sequence
  Description of Artificial Sequence: Synthetic peptide
DEEEIATTNPVATEQYGSVSTNLQHGEL

SEQ ID NO: 22246 - protein, 30 aa, Artificial Sequence
  Description of Artificial Sequence: Synthetic polypeptide
DEQEIRTTNPVATECYGSVSTNLQDRNGNR

SEQ ID NO: 22247 - protein, 28 aa, Artificial Sequence
  Description of Artificial Sequence: Synthetic peptide
DEEEIRTTNPVATEQYGSVSTPLQNGDD

SEQ ID NO: 22248 - protein, 28 aa, Artificial Sequence
  Description of Artificial Sequence: Synthetic peptide
DESEIRTTNIVATEQYGSVSTNLQLGTR

SEQ ID NO: 22249 - protein, 31 aa, Artificial Sequence
  Description of Artificial Sequence: Synthetic polypeptide
DEEEIRTTNPVATEQYGSVDSETENLDRGNR

SEQ ID NO: 22250 - protein, 30 aa, Artificial Sequence
  Description of Artificial Sequence: Synthetic polypeptide
DEQEIRTTNPVATEQYGSVSETNLQRDGNA

SEQ ID NO: 22251 - protein, 30 aa, Artificial Sequence
  Description of Artificial Sequence: Synthetic polypeptide
DEEEIRTTNPVATEQYGSVSENLQRNGNLN

SEQ ID NO: 22252 - protein, 28 aa, Artificial Sequence
  Description of Artificial Sequence: Synthetic peptide
DEEEIRTTNPVATEQYGSVSTALQVGEL

SEQ ID NO: 22253 - protein, 28 aa, Artificial Sequence
  Description of Artificial Sequence: Synthetic peptide
DEEEIRTTNIVASEQYGSVSTNLQDGTR

SEQ ID NO: 22254 - protein, 28 aa, Artificial Sequence
  Description of Artificial Sequence: Synthetic peptide
DEEEIRTTNPFATEQYGSVSTNLIPGNP

SEQ ID NO: 22255 - protein, 28 aa, Artificial Sequence
  Description of Artificial Sequence: Synthetic peptide
DEEEIRTTNPEATEQYGTVSTGLQSGNR

SEQ ID NO: 22256 - protein, 28 aa, Artificial Sequence
  Description of Artificial Sequence: Synthetic peptide
DEEEIRATNPVATEQYGYVSTNVQRGNS

SEQ ID NO: 22257 - protein, 29 aa, Artificial Sequence
  Description of Artificial Sequence: Synthetic peptide
DEEEIRTTNPVATEQWGSVSENLQMRGNF

SEQ ID NO: 22258 - protein, 28 aa, Artificial Sequence
  Description of Artificial Sequence: Synthetic peptide
DEEEIRCTNPVATEQYGSVSTNLQPGEY

SEQ ID NO: 22259 - protein, 28 aa, Artificial Sequence
  Description of Artificial Sequence: Synthetic peptide
DEQEIRTTNPVATEQYGIVSTNEQRGNA

SEQ ID NO: 22260 - protein, 28 aa, Artificial Sequence
  Description of Artificial Sequence: Synthetic peptide
DEEEIATTNIEATEQYGSVSTNLQTGNR

SEQ ID NO: 22261 - protein, 28 aa, Artificial Sequence
  Description of Artificial Sequence: Synthetic peptide
QEEEIRTTNIVATEQYGSVATNLQHGNR

SEQ ID NO: 22262 - protein, 30 aa, Artificial Sequence
  Description of Artificial Sequence: Synthetic polypeptide
DEEEIRTTNPTATEQYGSVSTMNEQRGDNR

SEQ ID NO: 22263 - protein, 28 aa, Artificial Sequence
  Description of Artificial Sequence: Synthetic peptide
YEEEIRTTNPVATESYGSVSTNWQRENR

SEQ ID NO: 22264 - protein, 28 aa, Artificial Sequence
  Description of Artificial Sequence: Synthetic peptide
DEEEIRTTNPVATEQYGLVSDNLQRGAM

SEQ ID NO: 22265 - protein, 28 aa, Artificial Sequence
  Description of Artificial Sequence: Synthetic peptide
DEEEIATTNIVATEIYGSVSTNLQRGNE

SEQ ID NO: 22266 - protein, 28 aa, Artificial Sequence
  Description of Artificial Sequence: Synthetic peptide
GEEEIRSTNPVATEQYGSVSTNLQTGNL

SEQ ID NO: 22267 - protein, 28 aa, Artificial Sequence
  Description of Artificial Sequence: Synthetic peptide
DEEEIRTTNPVATELYGSVSTNEQIGNQ

SEQ ID NO: 22268 - protein, 28 aa, Artificial Sequence
  Description of Artificial Sequence: Synthetic peptide
DEAEIRTTNPVATEQYGTVSENLQLGNR

SEQ ID NO: 22269 - protein, 28 aa, Artificial Sequence
  Description of Artificial Sequence: Synthetic peptide
DENEIRTTNPVATETYGSVSDNLQRGNQ

SEQ ID NO: 22270 - protein, 30 aa, Artificial Sequence
  Description of Artificial Sequence: Synthetic polypeptide
DEEEIRTTNPVATEQYGGVSATNLQNGNDR

SEQ ID NO: 22271 - protein, 28 aa, Artificial Sequence
  Description of Artificial Sequence: Synthetic peptide
DEEEIRTTNIVATEQYGSVSTNLQWGDA

SEQ ID NO: 22272 - protein, 31 aa, Artificial Sequence
  Description of Artificial Sequence: Synthetic polypeptide
DEEEIRTTNPVATEQYGSVDVTNPLQRKGNR

SEQ ID NO: 22273 - protein, 30 aa, Artificial Sequence
  Description of Artificial Sequence: Synthetic polypeptide
DEEEIRTTNPVATEQYGSVSTPNLQHEGNA

SEQ ID NO: 22274 - protein, 28 aa, Artificial Sequence
  Description of Artificial Sequence: Synthetic peptide
NEEEIRTTNPVATEQYGSVGNNLQRGTR

SEQ ID NO: 22275 - protein, 29 aa, Artificial Sequence
  Description of Artificial Sequence: Synthetic peptide
DEEEIRTTNPVATEQYGSVDTNLMIRGNW

SEQ ID NO: 22276 - protein, 28 aa, Artificial Sequence
  Description of Artificial Sequence: Synthetic peptide
DEEEIRTTNIVATEQYGSVSTDLQDGNL

SEQ ID NO: 22277 - protein, 28 aa, Artificial Sequence
  Description of Artificial Sequence: Synthetic peptide
DEEEIRTTNPVATEQYGSVSTDDERGER

SEQ ID NO: 22278 - protein, 30 aa, Artificial Sequence
  Description of Artificial Sequence: Synthetic polypeptide
DEEEIRTTNPVCTEQYGSVSCTNLQQHGNR

SEQ ID NO: 22279 - protein, 29 aa, Artificial Sequence
  Description of Artificial Sequence: Synthetic peptide
DENEIRTTNPVATEQYGVVSTNLQREGER

SEQ ID NO: 22280 - protein, 28 aa, Artificial Sequence
  Description of Artificial Sequence: Synthetic peptide
DEEEIRTTNIVATEQYGSVSTNLQVGED

SEQ ID NO: 22281 - protein, 28 aa, Artificial Sequence
  Description of Artificial Sequence: Synthetic peptide
DEEEIRTTNIVATEQYGSVSTNLQKINV

SEQ ID NO: 22282 - protein, 28 aa, Artificial Sequence
  Description of Artificial Sequence: Synthetic peptide
DEEEIKTTNPVATEGYGSVSDLLQRGNR

SEQ ID NO: 22283 - protein, 30 aa, Artificial Sequence
  Description of Artificial Sequence: Synthetic polypeptide
DEEEIRTTNPVATEQYGSVSTNLQEVGNDQ

SEQ ID NO: 22284 - protein, 28 aa, Artificial Sequence
  Description of Artificial Sequence: Synthetic peptide
DEEEIRTTNPVATEQYGSVSTNLEMGDD

SEQ ID NO: 22285 - protein, 28 aa, Artificial Sequence
  Description of Artificial Sequence: Synthetic peptide
DEEEIRTTNPEGTEQYGSVSENLQNGNR

SEQ ID NO: 22286 - protein, 28 aa, Artificial Sequence
  Description of Artificial Sequence: Synthetic peptide
DEECIRTTNPVATEQYWSVSTNDDRGNR

SEQ ID NO: 22287 - protein, 30 aa, Artificial Sequence
  Description of Artificial Sequence: Synthetic polypeptide
DEEEIRQTNPVATEQYGSVSTTNLERGNDR

SEQ ID NO: 22288 - protein, 28 aa, Artificial Sequence
  Description of Artificial Sequence: Synthetic peptide
DEEEIATTNIVATEQFGSVSTNLQRGNT

SEQ ID NO: 22289 - protein, 28 aa, Artificial Sequence
  Description of Artificial Sequence: Synthetic peptide
DEEEIRTTNPVATEQYGSVSTPGQFGER

SEQ ID NO: 22290 - protein, 28 aa, Artificial Sequence
  Description of Artificial Sequence: Synthetic peptide
DEEEIRTVNPVATEIYGSVATNLQRGNQ

SEQ ID NO: 22291 - protein, 28 aa, Artificial Sequence
  Description of Artificial Sequence: Synthetic peptide
DEEEIRTTNPVATEWYGSVASNLERGNR

SEQ ID NO: 22292 - protein, 28 aa, Artificial Sequence
  Description of Artificial Sequence: Synthetic peptide
DEEEIRTTNIVATEQWGSVSTNLQHGNW

SEQ ID NO: 22293 - protein, 28 aa, Artificial Sequence
  Description of Artificial Sequence: Synthetic peptide
DEGEIRTTNPVATEQYGSVSTDEQHGNR

SEQ ID NO: 22294 - protein, 28 aa, Artificial Sequence
  Description of Artificial Sequence: Synthetic peptide
DEEEIRTTNPVATELYGSYSTNLQQGNA

SEQ ID NO: 22295 - protein, 30 aa, Artificial Sequence
  Description of Artificial Sequence: Synthetic polypeptide
DEEEIATTNPVATEQYGSVSTNLQREGEDR

SEQ ID NO: 22296 - protein, 28 aa, Artificial Sequence
  Description of Artificial Sequence: Synthetic peptide
DEEEIRTTNPVATEQYGSVFTNLDNENR

SEQ ID NO: 22297 - protein, 30 aa, Artificial Sequence
  Description of Artificial Sequence: Synthetic polypeptide
DEEEIRTTNPVATEQYGSVSTNLQEIGNDA

SEQ ID NO: 22298 - protein, 30 aa, Artificial Sequence
  Description of Artificial Sequence: Synthetic polypeptide
DEEEIRTTNPVATEQYGSVSTNLQDQGNDS

SEQ ID NO: 22299 - protein, 28 aa, Artificial Sequence
  Description of Artificial Sequence: Synthetic peptide
KEEEIRTTNPVATEQYGSVSTNLQIGDE

SEQ ID NO: 22300 - protein, 28 aa, Artificial Sequence
  Description of Artificial Sequence: Synthetic peptide
QEEEIGTTNPVATEIYGSVSTNLQNGNR

SEQ ID NO: 22301 - protein, 28 aa, Artificial Sequence
  Description of Artificial Sequence: Synthetic peptide
DEEEIATTNPVATEQYGSVSTNEQNGNA

SEQ ID NO: 22302 - protein, 28 aa, Artificial Sequence
  Description of Artificial Sequence: Synthetic peptide
DEEEIRTTNPVATECYGSVSTNLQQGEL

SEQ ID NO: 22303 - protein, 30 aa, Artificial Sequence
  Description of Artificial Sequence: Synthetic polypeptide
MEEEIRCTNPVATEQYGSVSDTNLQRGNPR

SEQ ID NO: 22304 - protein, 28 aa, Artificial Sequence
  Description of Artificial Sequence: Synthetic peptide
DEEEIMTTNPVCTEQYGSVSTNLQTGNH

SEQ ID NO: 22305 - protein, 28 aa, Artificial Sequence
  Description of Artificial Sequence: Synthetic peptide
DEEEIRTVNPVSTEHYGSVSDNLQRGNR

SEQ ID NO: 22306 - protein, 30 aa, Artificial Sequence
  Description of Artificial Sequence: Synthetic polypeptide
DEEEIRTTNPVATEQYGESVSDTNLNRGNI

SEQ ID NO: 22307 - protein, 28 aa, Artificial Sequence
  Description of Artificial Sequence: Synthetic peptide
DEEEIATVNPVATEQYGSASTNEQRGNR

SEQ ID NO: 22308 - protein, 28 aa, Artificial Sequence
  Description of Artificial Sequence: Synthetic peptide
QEQEIRTTNPVATEQYGSVSENLQRGNA

SEQ ID NO: 22309 - protein, 28 aa, Artificial Sequence
  Description of Artificial Sequence: Synthetic peptide
DEEEIRTTNITATEQYGSVSTNLQHGNQ

SEQ ID NO: 22310 - protein, 28 aa, Artificial Sequence
  Description of Artificial Sequence: Synthetic peptide
QEEEIKTTNPVATEQYGSVSTNVQRNNR

SEQ ID NO: 22311 - protein, 28 aa, Artificial Sequence
  Description of Artificial Sequence: Synthetic peptide
DEEEIRTTNPVATEQYGSVSTELEPGNI

SEQ ID NO: 22312 - protein, 31 aa, Artificial Sequence
  Description of Artificial Sequence: Synthetic polypeptide
DEEEIRTTNPVATEQYGSVCSTNLQFRGVND

SEQ ID NO: 22313 - protein, 28 aa, Artificial Sequence
  Description of Artificial Sequence: Synthetic peptide
DEEEIRTTNPVATEQYGSVVDDLQRGNQ

SEQ ID NO: 22314 - protein, 29 aa, Artificial Sequence
  Description of Artificial Sequence: Synthetic peptide
DEEEIRTTNPVATEQYGDVSTNNLQRGVG

SEQ ID NO: 22315 - protein, 28 aa, Artificial Sequence
  Description of Artificial Sequence: Synthetic peptide
DELEIRTTNPVATEQYGSVSTNPQLGTR

SEQ ID NO: 22316 - protein, 28 aa, Artificial Sequence
  Description of Artificial Sequence: Synthetic peptide
DENEIVTTNPVATEMYGWVSTNLQRGNR

SEQ ID NO: 22317 - protein, 28 aa, Artificial Sequence
  Description of Artificial Sequence: Synthetic peptide
DESEIRTTNPVATEQYGSVGTNLQYGNA

SEQ ID NO: 22318 - protein, 28 aa, Artificial Sequence
  Description of Artificial Sequence: Synthetic peptide
DEEEIRTTNIVSTEQYGSVSTNLQNGDR

SEQ ID NO: 22319 - protein, 28 aa, Artificial Sequence
  Description of Artificial Sequence: Synthetic peptide
MEEEIRTTNPVATEQYGSVSTDLQNGNM

SEQ ID NO: 22320 - protein, 29 aa, Artificial Sequence
  Description of Artificial Sequence: Synthetic peptide
DEEEIRTTNPVATEKWGSVLSTNLQEGNR

SEQ ID NO: 22321 - protein, 30 aa, Artificial Sequence
  Description of Artificial Sequence: Synthetic polypeptide
DEEEIRTTNPVATEQYGSVSQTTGDQRGNR

SEQ ID NO: 22322 - protein, 28 aa, Artificial Sequence
  Description of Artificial Sequence: Synthetic peptide
DEQEIVTTNPVATEIYGWVSTNLQRGNR

SEQ ID NO: 22323 - protein, 31 aa, Artificial Sequence
  Description of Artificial Sequence: Synthetic polypeptide
DEEEIRTTNPVATEQYGSVDCTMNLQCRGNR

SEQ ID NO: 22324 - protein, 28 aa, Artificial Sequence
  Description of Artificial Sequence: Synthetic peptide
DEEEIRTTNPECTEQYGSVSTNLQLGNV

SEQ ID NO: 22325 - protein, 28 aa, Artificial Sequence
  Description of Artificial Sequence: Synthetic peptide
DEEEIRTTNPVCTEQYGSVSTNLCHGNC

SEQ ID NO: 22326 - protein, 28 aa, Artificial Sequence
  Description of Artificial Sequence: Synthetic peptide
DEEEIETTNPVATEQYGSVSTNLQRPCC

SEQ ID NO: 22327 - protein, 29 aa, Artificial Sequence
  Description of Artificial Sequence: Synthetic peptide
DEEEIRTTNPVATEIYGSVSTNLQELGNF

SEQ ID NO: 22328 - protein, 28 aa, Artificial Sequence
  Description of Artificial Sequence: Synthetic peptide
DEEEIRCTNPVATELWGSVSENLQRGNR

SEQ ID NO: 22329 - protein, 28 aa, Artificial Sequence
  Description of Artificial Sequence: Synthetic peptide
SEEEIRTTNPVATEQYGSVSENLQRGMF

SEQ ID NO: 22330 - protein, 31 aa, Artificial Sequence
  Description of Artificial Sequence: Synthetic polypeptide
DEEEIRTTNPVATEQYGESVSETNLVQRGNH

SEQ ID NO: 22331 - protein, 28 aa, Artificial Sequence
  Description of Artificial Sequence: Synthetic peptide
DEQEIRTVNPVATEQYGEVSENLQRGNR

SEQ ID NO: 22332 - protein, 28 aa, Artificial Sequence
  Description of Artificial Sequence: Synthetic peptide
DEEEIRTTNPVATEQYGSVSLCLQRGEL

SEQ ID NO: 22333 - protein, 28 aa, Artificial Sequence
  Description of Artificial Sequence: Synthetic peptide
DEVEIRTTNPVATEQYGWVSTNGQRGNG

SEQ ID NO: 22334 - protein, 28 aa, Artificial Sequence
  Description of Artificial Sequence: Synthetic peptide
DEMEIVTTNPVATEQYGCVSMNLQRGNR

SEQ ID NO: 22335 - protein, 28 aa, Artificial Sequence
  Description of Artificial Sequence: Synthetic peptide
DEQEIRTTNIVATEQYGSVSTNIQRGNT

SEQ ID NO: 22336 - protein, 30 aa, Artificial Sequence
  Description of Artificial Sequence: Synthetic polypeptide
DEEEIRTTNPVATEQYGSVSTNLLRFGLNV

SEQ ID NO: 22337 - protein, 28 aa, Artificial Sequence
  Description of Artificial Sequence: Synthetic peptide
DEECIRTTNPVATEQYGSVSHNDQRGER

SEQ ID NO: 22338 - protein, 28 aa, Artificial Sequence
  Description of Artificial Sequence: Synthetic peptide
DEEEIRTTNPVSTEIYGSVSTADQRGNR

SEQ ID NO: 22339 - protein, 28 aa, Artificial Sequence
  Description of Artificial Sequence: Synthetic peptide
DEEEITTTNPVGTEIYGSVSENLQRGNR

SEQ ID NO: 22340 - protein, 28 aa, Artificial Sequence
  Description of Artificial Sequence: Synthetic peptide
DEEEIRTTNPVATEWYGSVSENLQRGQC

SEQ ID NO: 22341 - protein, 28 aa, Artificial Sequence
  Description of Artificial Sequence: Synthetic peptide
DEEEIRTTNIVATEQYGSVSTNIQRGTD

SEQ ID NO: 22342 - protein, 30 aa, Artificial Sequence
  Description of Artificial Sequence: Synthetic polypeptide
QEEEIRTTNPVATEQYGSVSENLQRAGNDR

SEQ ID NO: 22343 - protein, 28 aa, Artificial Sequence
  Description of Artificial Sequence: Synthetic peptide
DEQEIRTTNPVATEQYGSVSEALQRGNE

SEQ ID NO: 22344 - protein, 28 aa, Artificial Sequence
  Description of Artificial Sequence: Synthetic peptide
DLEEIRTTNPVATEMYGSVSTNLQRGDF

SEQ ID NO: 22345 - protein, 28 aa, Artificial Sequence
  Description of Artificial Sequence: Synthetic peptide
DEEEIRTTNPVATEQWGGACTNLQRGNR

SEQ ID NO: 22346 - protein, 28 aa, Artificial Sequence
  Description of Artificial Sequence: Synthetic peptide
DEVEIRTTNPVATEQYGSVSTNEQHGNN

SEQ ID NO: 22347 - protein, 30 aa, Artificial Sequence
  Description of Artificial Sequence: Synthetic polypeptide
DEEEIRTTNPVATEQYGSVDSDTELQRGNP

SEQ ID NO: 22348 - protein, 29 aa, Artificial Sequence
  Description of Artificial Sequence: Synthetic peptide
DEEEIRTTNPFATEQYGSVSTPNLTRGNW

SEQ ID NO: 22349 - protein, 29 aa, Artificial Sequence
  Description of Artificial Sequence: Synthetic peptide
DEEEIRTTNPVATEQYGSVSTNLQEWGET

SEQ ID NO: 22350 - protein, 28 aa, Artificial Sequence
  Description of Artificial Sequence: Synthetic peptide
DEGEIRTTNIVATEQYGSVSTNLQLGNA

SEQ ID NO: 22351 - protein, 31 aa, Artificial Sequence
  Description of Artificial Sequence: Synthetic polypeptide
DEEEIRTTNPVATEQYGSVSETNLPEREGNR

SEQ ID NO: 22352 - protein, 28 aa, Artificial Sequence
  Description of Artificial Sequence: Synthetic peptide
QENEIRTTNPVATEQYGSVSENGQRGNR

SEQ ID NO: 22353 - protein, 28 aa, Artificial Sequence
  Description of Artificial Sequence: Synthetic peptide
GEEEIATVNPVATEQYGSVSTNLQRGQR

SEQ ID NO: 22354 - protein, 31 aa, Artificial Sequence
  Description of Artificial Sequence: Synthetic polypeptide
DEEEIRTTNPVATEQYGSVSTNLQDREGNDN

SEQ ID NO: 22355 - protein, 28 aa, Artificial Sequence
  Description of Artificial Sequence: Synthetic peptide
NEEEIRTTNPCATEQYGSVSMDLQRGNR

SEQ ID NO: 22356 - protein, 28 aa, Artificial Sequence
  Description of Artificial Sequence: Synthetic peptide
DENEIRTTNPVATEQYGSVSENEQRGNA

SEQ ID NO: 22357 - protein, 28 aa, Artificial Sequence
  Description of Artificial Sequence: Synthetic peptide
DENEIATTNPVATEVYGWVSTNLQRGNR

SEQ ID NO: 22358 - protein, 28 aa, Artificial Sequence
  Description of Artificial Sequence: Synthetic peptide
DEEEIRTTNPVATECYGSVSTDLERGNL

SEQ ID NO: 22359 - protein, 28 aa, Artificial Sequence
  Description of Artificial Sequence: Synthetic peptide
DEDEIRATNPVATEQYGCVSTNEQRGNR

SEQ ID NO: 22360 - protein, 28 aa, Artificial Sequence
  Description of Artificial Sequence: Synthetic peptide
DEEEIRTTNPVCTEQYGSVSEEDQRGNR

SEQ ID NO: 22361 - protein, 28 aa, Artificial Sequence
  Description of Artificial Sequence: Synthetic peptide
DEEEIATVNIVATEQYGSVSTNLQEGNR

SEQ ID NO: 22362 - protein, 28 aa, Artificial Sequence
  Description of Artificial Sequence: Synthetic peptide
DEEEIRTTNIVATEQYGSVSTGLERGNQ

SEQ ID NO: 22363 - protein, 30 aa, Artificial Sequence
  Description of Artificial Sequence: Synthetic polypeptide
DEEEIRTTNPVATEQYGISVQSTNLQRGED

SEQ ID NO: 22364 - protein, 28 aa, Artificial Sequence
  Description of Artificial Sequence: Synthetic peptide
DEEEIRTTNPVATEQYGSVSTDLQQGDM

SEQ ID NO: 22365 - protein, 28 aa, Artificial Sequence
  Description of Artificial Sequence: Synthetic peptide
DEEEIRTTNPVATECWGSVSTNLQIGNA

SEQ ID NO: 22366 - protein, 30 aa, Artificial Sequence
  Description of Artificial Sequence: Synthetic polypeptide
DENEIRTTNPVATEQYGSVSDFNLLQRGNR

SEQ ID NO: 22367 - protein, 29 aa, Artificial Sequence
  Description of Artificial Sequence: Synthetic peptide
DEEEIRTTNPCATEQYGSVSMNLQRGNDI

SEQ ID NO: 22368 - protein, 29 aa, Artificial Sequence
  Description of Artificial Sequence: Synthetic peptide
DEEEIRTTNPVATEQYGSVSDNLQVGPNI

SEQ ID NO: 22369 - protein, 28 aa, Artificial Sequence
  Description of Artificial Sequence: Synthetic peptide
DEEEIRTTNIVATEMWGSVSTNLQRGNQ

SEQ ID NO: 22370 - protein, 29 aa, Artificial Sequence
  Description of Artificial Sequence: Synthetic peptide
DEGEIRTTNPVATAQYGSVSCTNLQRGNC

SEQ ID NO: 22371 - protein, 29 aa, Artificial Sequence
  Description of Artificial Sequence: Synthetic peptide
DENEIRTTNPVCTEQYGSVSTNLQREGNT

SEQ ID NO: 22372 - protein, 28 aa, Artificial Sequence
  Description of Artificial Sequence: Synthetic peptide
DEEEIRTTNPVATEQYGSVSTGLENGNS

SEQ ID NO: 22373 - protein, 28 aa, Artificial Sequence
  Description of Artificial Sequence: Synthetic peptide
MEEEIRTTNPVATEQYGSVSTDLQAGND

SEQ ID NO: 22374 - protein, 28 aa, Artificial Sequence
  Description of Artificial Sequence: Synthetic peptide
QEEEIRTTNPVATEQYGSVPTNLQRENL

SEQ ID NO: 22375 - protein, 28 aa, Artificial Sequence
  Description of Artificial Sequence: Synthetic peptide
KEEEIRTTNPVATEQYGSVSTNLQVGEL

SEQ ID NO: 22376 - protein, 28 aa, Artificial Sequence
  Description of Artificial Sequence: Synthetic peptide
DEEEIRTTNIVATEQYGSVSTNDQGGNN

SEQ ID NO: 22377 - protein, 28 aa, Artificial Sequence
  Description of Artificial Sequence: Synthetic peptide
DEEEIRTTNPVATEQYGSVSPNLMTGNS

SEQ ID NO: 22378 - protein, 28 aa, Artificial Sequence
  Description of Artificial Sequence: Synthetic peptide
DEEEIRTTNIVATEQYGSVSENLQDGND

SEQ ID NO: 22379 - protein, 29 aa, Artificial Sequence
  Description of Artificial Sequence: Synthetic peptide
DEEEIRTTNPVATEQYGSVSTDDQSGDNR

SEQ ID NO: 22380 - protein, 28 aa, Artificial Sequence
  Description of Artificial Sequence: Synthetic peptide
DEEEISTTNPVATECYGSVATNLQHGNR

SEQ ID NO: 22381 - protein, 28 aa, Artificial Sequence
  Description of Artificial Sequence: Synthetic peptide
DEEEIMTTNPVATEQYGSVSTNGQIGNA

SEQ ID NO: 22382 - protein, 28 aa, Artificial Sequence
  Description of Artificial Sequence: Synthetic peptide
DEEEIRTTNPVATEQYGSVSTDEQSGNE

SEQ ID NO: 22383 - protein, 30 aa, Artificial Sequence
  Description of Artificial Sequence: Synthetic polypeptide
DEEEIRTTNPDATEQYGSISVTNLQRGDNR

SEQ ID NO: 22384 - protein, 28 aa, Artificial Sequence
  Description of Artificial Sequence: Synthetic peptide
DEEEIRTTNPVATEIYGSVSTNLENGND

SEQ ID NO: 22385 - protein, 29 aa, Artificial Sequence
  Description of Artificial Sequence: Synthetic peptide
MEEEIRTTNPVASEQYGSVSTNLQEIGNR

SEQ ID NO: 22386 - protein, 28 aa, Artificial Sequence
  Description of Artificial Sequence: Synthetic peptide
DEEEIRTTNPVATEQYGSVSENLQLGDS

SEQ ID NO: 22387 - protein, 29 aa, Artificial Sequence
  Description of Artificial Sequence: Synthetic peptide
DEEEIRTTNPVATEMYGSVSTNDVQRGND

SEQ ID NO: 22388 - protein, 31 aa, Artificial Sequence
  Description of Artificial Sequence: Synthetic polypeptide
DEEEIRTTNPVATEQYGSVSTINLDQERGNT

SEQ ID NO: 22389 - protein, 28 aa, Artificial Sequence
  Description of Artificial Sequence: Synthetic peptide
DESEIRTTNPVASEQYGWVATNLQRGNR

SEQ ID NO: 22390 - protein, 28 aa, Artificial Sequence
  Description of Artificial Sequence: Synthetic peptide
DEEEIRTTNPVATECYGSVSTDLQHGNL

SEQ ID NO: 22391 - protein, 31 aa, Artificial Sequence
  Description of Artificial Sequence: Synthetic polypeptide
DEEEIRTTNPDATEQYGSVSDTNLQDRGENR

SEQ ID NO: 22392 - protein, 28 aa, Artificial Sequence
  Description of Artificial Sequence: Synthetic peptide
DEEEIRTTNPVATECYGSVADELQRGNR

SEQ ID NO: 22393 - protein, 29 aa, Artificial Sequence
  Description of Artificial Sequence: Synthetic peptide
DEEEIRTTNPVATEQYGEVSTQLQRSGQR

SEQ ID NO: 22394 - protein, 28 aa, Artificial Sequence
  Description of Artificial Sequence: Synthetic peptide
DEEEIRTTNIVATEEYGQVSTNLQNGNR

SEQ ID NO: 22395 - protein, 28 aa, Artificial Sequence
  Description of Artificial Sequence: Synthetic peptide
DEEEIRTTNPYAYEQYGDVSTPLQRGNR

SEQ ID NO: 22396 - protein, 28 aa, Artificial Sequence
  Description of Artificial Sequence: Synthetic peptide
DEEEIRTTNIVATEQYGTVSTNWQRGER

SEQ ID NO: 22397 - protein, 28 aa, Artificial Sequence
  Description of Artificial Sequence: Synthetic peptide
SEEEIRTTNPTATEQFGSVSTNPQRGNR

SEQ ID NO: 22398 - protein, 30 aa, Artificial Sequence
  Description of Artificial Sequence: Synthetic polypeptide
QEEEIRTTNPVATEQYGSVSATNLQRGENH

SEQ ID NO: 22399 - protein, 28 aa, Artificial Sequence
  Description of Artificial Sequence: Synthetic peptide
DEEEIATTNPVCTETYGSVSTNLQRGNQ

SEQ ID NO: 22400 - protein, 31 aa, Artificial Sequence
  Description of Artificial Sequence: Synthetic polypeptide
DEEEIRTTNPVATEQYGSVSTNPLQRGMEER

SEQ ID NO: 22401 - protein, 28 aa, Artificial Sequence
  Description of Artificial Sequence: Synthetic peptide
SEEEIRTTNPVATEQYGEVSENEQRGNR

SEQ ID NO: 22402 - protein, 28 aa, Artificial Sequence
  Description of Artificial Sequence: Synthetic peptide
DEEEIRTTNPVATEQYGSVSTNLELGEH

SEQ ID NO: 22403 - protein, 28 aa, Artificial Sequence
  Description of Artificial Sequence: Synthetic peptide
DESEVRCTNPVATEQYGVVSTNLQRGNR

SEQ ID NO: 22404 - protein, 28 aa, Artificial Sequence
  Description of Artificial Sequence: Synthetic peptide
FEEEIRTTNPVATEQYGSVSDNIQRGGR

SEQ ID NO: 22405 - protein, 28 aa, Artificial Sequence
  Description of Artificial Sequence: Synthetic peptide
DEDEIRTTNPVATEQYGSVSDNLQGGNV

SEQ ID NO: 22406 - protein, 28 aa, Artificial Sequence
  Description of Artificial Sequence: Synthetic peptide
EEEEIRTTNPVATEQYGEVSTNLQQGNF

SEQ ID NO: 22407 - protein, 30 aa, Artificial Sequence
  Description of Artificial Sequence: Synthetic polypeptide
DEEEIRTTNPVATEQYGSVSITELQEVGNR

SEQ ID NO: 22408 - protein, 28 aa, Artificial Sequence
  Description of Artificial Sequence: Synthetic peptide
DEEEIRTTNIVATEQYGSVSTALQDGNL

SEQ ID NO: 22409 - protein, 29 aa, Artificial Sequence
  Description of Artificial Sequence: Synthetic peptide
DEEEIRTTNPVATEQYGSVSSNLQREPND

SEQ ID NO: 22410 - protein, 28 aa, Artificial Sequence
  Description of Artificial Sequence: Synthetic peptide
DEEEIRTTNPVATEQYGSVSTDLEDGNT

SEQ ID NO: 22411 - protein, 30 aa, Artificial Sequence
  Description of Artificial Sequence: Synthetic polypeptide
DEEEIRTTNPVAVEQYGSVSTNLQPQDGNR

SEQ ID NO: 22412 - protein, 29 aa, Artificial Sequence
  Description of Artificial Sequence: Synthetic peptide
DEEEIRTTNPVATEQYGSVSTNEQIGNTN

SEQ ID NO: 22413 - protein, 28 aa, Artificial Sequence
  Description of Artificial Sequence: Synthetic peptide
DEGEIRTTNIVATEQYGSVSTNLQIGNG

SEQ ID NO: 22414 - protein, 28 aa, Artificial Sequence
  Description of Artificial Sequence: Synthetic peptide
DEEEIRTTNPTATEQYGSVSTNEQVGNV

SEQ ID NO: 22415 - protein, 28 aa, Artificial Sequence
  Description of Artificial Sequence: Synthetic peptide
DEEEIRTTNPEATEQYGSVSTDEQRGDR

SEQ ID NO: 22416 - protein, 28 aa, Artificial Sequence
  Description of Artificial Sequence: Synthetic peptide
DEVEIKATNPVATEQYGSVSTNLQHGNR

SEQ ID NO: 22417 - protein, 28 aa, Artificial Sequence
  Description of Artificial Sequence: Synthetic peptide
DENEIRTTNPVATEQYGSVSENEMRGNR

SEQ ID NO: 22418 - protein, 28 aa, Artificial Sequence
  Description of Artificial Sequence: Synthetic peptide
DENEIRTTNPVATECYGSVSECLQRGNR

SEQ ID NO: 22419 - protein, 28 aa, Artificial Sequence
  Description of Artificial Sequence: Synthetic peptide
DEEEIRGTNPVATEQYGSVSTNLQHLNS

SEQ ID NO: 22420 - protein, 28 aa, Artificial Sequence
  Description of Artificial Sequence: Synthetic peptide
DEEEIRTTNPVATEQYGSVPTNLNFGNM

SEQ ID NO: 22421 - protein, 28 aa, Artificial Sequence
  Description of Artificial Sequence: Synthetic peptide
DEDEIRTTNIVATEQYGVVSTNLQRGNM

SEQ ID NO: 22422 - protein, 28 aa, Artificial Sequence
  Description of Artificial Sequence: Synthetic peptide
DESEIRTTNPVATECYGLVSTNLQRGNP

SEQ ID NO: 22423 - protein, 28 aa, Artificial Sequence
  Description of Artificial Sequence: Synthetic peptide
DEEEIRTTNIVAWEQYGSVSTDLQHGNR

SEQ ID NO: 22424 - protein, 28 aa, Artificial Sequence
  Description of Artificial Sequence: Synthetic peptide
DEECIRTTNPVAWEQFGSVSTNLQQGNR

SEQ ID NO: 22425 - protein, 30 aa, Artificial Sequence
  Description of Artificial Sequence: Synthetic polypeptide
DEEEIRTTNPVCTEQYGSVDCTMNLQRGNR

SEQ ID NO: 22426 - protein, 28 aa, Artificial Sequence
  Description of Artificial Sequence: Synthetic peptide
DEEEIRSTNPVATEQYGCVSTCLQRGND

SEQ ID NO: 22427 - protein, 28 aa, Artificial Sequence
  Description of Artificial Sequence: Synthetic peptide
SEEEIRTVNIVATEQYGSVSTNLQGGNR

SEQ ID NO: 22428 - protein, 30 aa, Artificial Sequence
  Description of Artificial Sequence: Synthetic polypeptide
DEEEIRTTNPVATEQYGSVSTENPERGVNR

SEQ ID NO: 22429 - protein, 31 aa, Artificial Sequence
  Description of Artificial Sequence: Synthetic polypeptide
DEEEIRTTNPVATEQYGSVSTNLELRNGENR

SEQ ID NO: 22430 - protein, 30 aa, Artificial Sequence
  Description of Artificial Sequence: Synthetic polypeptide
DEEEITTTNPVATEQYGSVSTMNLQAGANR

SEQ ID NO: 22431 - protein, 28 aa, Artificial Sequence
  Description of Artificial Sequence: Synthetic peptide
DEEEIRTTNPVATEQYGTVSADLQRGPR

SEQ ID NO: 22432 - protein, 28 aa, Artificial Sequence
  Description of Artificial Sequence: Synthetic peptide
DEEEIRTTNPVATEQYGTMSTLLQRNNR

SEQ ID NO: 22433 - protein, 30 aa, Artificial Sequence
  Description of Artificial Sequence: Synthetic polypeptide
DEQEIRTTNPVATEQYGSVDETNGLQRGNR

SEQ ID NO: 22434 - protein, 28 aa, Artificial Sequence
  Description of Artificial Sequence: Synthetic peptide
DEEEIRTTNPTATEQYGSVSTNPQLGNF

SEQ ID NO: 22435 - protein, 28 aa, Artificial Sequence
  Description of Artificial Sequence: Synthetic peptide
SEEEIRTTNPVATEQFGEVSTNLQSGNR

SEQ ID NO: 22436 - protein, 30 aa, Artificial Sequence
  Description of Artificial Sequence: Synthetic polypeptide
DEEEIRTTNPVATECYGSVSATNLQRDGNM

SEQ ID NO: 22437 - protein, 28 aa, Artificial Sequence
  Description of Artificial Sequence: Synthetic peptide
DEEEIRTTNPVATEQYGSVSTDLQNGES

SEQ ID NO: 22438 - protein, 30 aa, Artificial Sequence
  Description of Artificial Sequence: Synthetic polypeptide
DEEDIATTNPVATEQYGSVSTNLPQRGNTR

SEQ ID NO: 22439 - protein, 29 aa, Artificial Sequence
  Description of Artificial Sequence: Synthetic peptide
DEQEIRTTNPVATEQYGTVSTNLQVGNDR

SEQ ID NO: 22440 - protein, 28 aa, Artificial Sequence
  Description of Artificial Sequence: Synthetic peptide
DEVEIRTTNPCATEQYGTVSTALQRGNR

SEQ ID NO: 22441 - protein, 28 aa, Artificial Sequence
  Description of Artificial Sequence: Synthetic peptide
DEEEIRTTNIVATECYGSVSTNLQQGNS

SEQ ID NO: 22442 - protein, 28 aa, Artificial Sequence
  Description of Artificial Sequence: Synthetic peptide
DEEEIRTTNPVATEQYGSVSTNLETGEA

SEQ ID NO: 22443 - protein, 29 aa, Artificial Sequence
  Description of Artificial Sequence: Synthetic peptide
DEEEIATTNPVATEGYGSVSTNLQNHGNR

SEQ ID NO: 22444 - protein, 28 aa, Artificial Sequence
  Description of Artificial Sequence: Synthetic peptide
KESEIRTTNPVATEQYGSVSTNLQYGNS

SEQ ID NO: 22445 - protein, 31 aa, Artificial Sequence
  Description of Artificial Sequence: Synthetic polypeptide
DEEEIRTTNPVATEQYGSVQTANSLQRGINR

SEQ ID NO: 22446 - protein, 28 aa, Artificial Sequence
  Description of Artificial Sequence: Synthetic peptide
MEEEIRTTNIVATEQYGEVSTNLQAGNR

SEQ ID NO: 22447 - protein, 31 aa, Artificial Sequence
  Description of Artificial Sequence: Synthetic polypeptide
DEEEIRTTNPVATEQYGYVSITDNLQRGNIR

SEQ ID NO: 22448 - protein, 29 aa, Artificial Sequence
  Description of Artificial Sequence: Synthetic peptide
QEEEIRTTNPVATEQYGSASTVLQRAGNR

SEQ ID NO: 22449 - protein, 28 aa, Artificial Sequence
  Description of Artificial Sequence: Synthetic peptide
DEMEIRTTNPVATEQYGVVSTNLQWGNE

SEQ ID NO: 22450 - protein, 28 aa, Artificial Sequence
  Description of Artificial Sequence: Synthetic peptide
SEEEIRTTNPEATEQYGSVSTNLQQGLR

SEQ ID NO: 22451 - protein, 28 aa, Artificial Sequence
  Description of Artificial Sequence: Synthetic peptide
DEQEIRTTNIVATEQYGSVSTNLQAGNH

SEQ ID NO: 22452 - protein, 31 aa, Artificial Sequence
  Description of Artificial Sequence: Synthetic polypeptide
DEEEIRTTNPVATEQYGSVSTVANLQSGINR

SEQ ID NO: 22453 - protein, 28 aa, Artificial Sequence
  Description of Artificial Sequence: Synthetic peptide
DEQEIATTNPVATENYGVVSTNLQRGNR

SEQ ID NO: 22454 - protein, 29 aa, Artificial Sequence
  Description of Artificial Sequence: Synthetic peptide
DEEEIRTTNPVATEQYGSVSETNLEAGNW

SEQ ID NO: 22455 - protein, 28 aa, Artificial Sequence
  Description of Artificial Sequence: Synthetic peptide
DEEEIRTTNPVATEQYGSVSTDLQIGEF

SEQ ID NO: 22456 - protein, 29 aa, Artificial Sequence
  Description of Artificial Sequence: Synthetic peptide
DEEEIRTTNPEATEQYGSVDSTNEQRGER

SEQ ID NO: 22457 - protein, 29 aa, Artificial Sequence
  Description of Artificial Sequence: Synthetic peptide
DEEEIRTTNPVATEQFGGVSTANLQRGNQ

SEQ ID NO: 22458 - protein, 31 aa, Artificial Sequence
  Description of Artificial Sequence: Synthetic polypeptide
DEEEIRTTNPVATEQYGSVETNLQDRKGINR

SEQ ID NO: 22459 - protein, 30 aa, Artificial Sequence
  Description of Artificial Sequence: Synthetic polypeptide
DEEEIRTTNPVATEQYGSVSTDLQDRKGER

SEQ ID NO: 22460 - protein, 28 aa, Artificial Sequence
  Description of Artificial Sequence: Synthetic peptide
DEEEIRTTNPVATEWWGSVSTNLMRGNA

SEQ ID NO: 22461 - protein, 28 aa, Artificial Sequence
  Description of Artificial Sequence: Synthetic peptide
SEEEIRTTNIVATEQYGSVSTNIQRGER

SEQ ID NO: 22462 - protein, 28 aa, Artificial Sequence
  Description of Artificial Sequence: Synthetic peptide
DEEEIRTTNPVATEQYGSVSTDLEVGNV

SEQ ID NO: 22463 - protein, 28 aa, Artificial Sequence
  Description of Artificial Sequence: Synthetic peptide
DEEEIRTTNPVATELYGEVSTNEQRGNF

SEQ ID NO: 22464 - protein, 29 aa, Artificial Sequence
  Description of Artificial Sequence: Synthetic peptide
DEEEIRTTNPVATEQYGSASATVLQRGGR

SEQ ID NO: 22465 - protein, 29 aa, Artificial Sequence
  Description of Artificial Sequence: Synthetic peptide
DEEEIRTTNPVATEQYGGVSENLQRGIGR

SEQ ID NO: 22466 - protein, 28 aa, Artificial Sequence
  Description of Artificial Sequence: Synthetic peptide
DEEEICTTNIVATEQYGSVSTGLQRGND

SEQ ID NO: 22467 - protein, 29 aa, Artificial Sequence
  Description of Artificial Sequence: Synthetic peptide
DEEEIRTTNPTATEQYGTVSTNLQRGNTS

SEQ ID NO: 22468 - protein, 28 aa, Artificial Sequence
  Description of Artificial Sequence: Synthetic peptide
DEEEIATTNIVATEQYGSVSTNLQIGER

SEQ ID NO: 22469 - protein, 28 aa, Artificial Sequence
  Description of Artificial Sequence: Synthetic peptide
DEEEIRTTNIVATEQYGVVSTNIQRGNI

SEQ ID NO: 22470 - protein, 28 aa, Artificial Sequence
  Description of Artificial Sequence: Synthetic peptide
DEEEVRTTNPVATEVYGSVGTNLQSGNR

SEQ ID NO: 22471 - protein, 29 aa, Artificial Sequence
  Description of Artificial Sequence: Synthetic peptide
DEEEIRTTNPVATEQYGSVSCDNLCRGNC

SEQ ID NO: 22472 - protein, 29 aa, Artificial Sequence
  Description of Artificial Sequence: Synthetic peptide
DEEEIRTTNPVATEQWGSVSTNEQNRGNW

SEQ ID NO: 22473 - protein, 28 aa, Artificial Sequence
  Description of Artificial Sequence: Synthetic peptide
DEEEIRTTNPVATEQYGDVSENEMRGNR

SEQ ID NO: 22474 - protein, 30 aa, Artificial Sequence
  Description of Artificial Sequence: Synthetic polypeptide
DEEEIRTTNPVATEQYGSVSTNPLQVEGNW

SEQ ID NO: 22475 - protein, 28 aa, Artificial Sequence
  Description of Artificial Sequence: Synthetic peptide
DEEEIRTTNPVATEQWGSVSTNLMIGNA

SEQ ID NO: 22476 - protein, 28 aa, Artificial Sequence
  Description of Artificial Sequence: Synthetic peptide
DEEEIRTTNPTAIEQYGSVSTNEQRGNF

SEQ ID NO: 22477 - protein, 28 aa, Artificial Sequence
  Description of Artificial Sequence: Synthetic peptide
DEEEIRTTNPEATEQYGSVSTHLQRGWE

SEQ ID NO: 22478 - protein, 28 aa, Artificial Sequence
  Description of Artificial Sequence: Synthetic peptide
DEQEIRTTNIVATEQYGSVSTNQQRGDR

SEQ ID NO: 22479 - protein, 28 aa, Artificial Sequence
  Description of Artificial Sequence: Synthetic peptide
SENEIATTNPVATEQYGSVSTNLQRPNR

SEQ ID NO: 22480 - protein, 30 aa, Artificial Sequence
  Description of Artificial Sequence: Synthetic polypeptide
DEEEIRTTNPVATEQYGSVSTNLEREGNDE

SEQ ID NO: 22481 - protein, 28 aa, Artificial Sequence
  Description of Artificial Sequence: Synthetic peptide
DEEEIRTTNPVATEMYGSVSNELQRGER

SEQ ID NO: 22482 - protein, 28 aa, Artificial Sequence
  Description of Artificial Sequence: Synthetic peptide
DEEEIRTTNPVATMQYGSVSTGLDRGNE

SEQ ID NO: 22483 - protein, 29 aa, Artificial Sequence
  Description of Artificial Sequence: Synthetic peptide
QENEIATTNPVATEQYGSVSTNLQREGNR

SEQ ID NO: 22484 - protein, 28 aa, Artificial Sequence
  Description of Artificial Sequence: Synthetic peptide
DEDEIRTVNPVATEQYGIVSTNLQRGTR

SEQ ID NO: 22485 - protein, 28 aa, Artificial Sequence
  Description of Artificial Sequence: Synthetic peptide
DEHEIRTTNPVATEQYGSVSTNLEHGNA

SEQ ID NO: 22486 - protein, 30 aa, Artificial Sequence
  Description of Artificial Sequence: Synthetic polypeptide
DEEEIRTTNPVATEQYGSVSTGNLQVGEER

SEQ ID NO: 22487 - protein, 28 aa, Artificial Sequence
  Description of Artificial Sequence: Synthetic peptide
DEQEIRTTNIVATEQWGSVSTNLQRGNM

SEQ ID NO: 22488 - protein, 28 aa, Artificial Sequence
  Description of Artificial Sequence: Synthetic peptide
DEEEIRTTNPVATEQYGTVSTNDQHGNV

SEQ ID NO: 22489 - protein, 28 aa, Artificial Sequence
  Description of Artificial Sequence: Synthetic peptide
DEDEIRTTNPVATEQYGEVSTPLQRGNV

SEQ ID NO: 22490 - protein, 29 aa, Artificial Sequence
  Description of Artificial Sequence: Synthetic peptide
DEEEIRTTNPVATEQYGSVSNNNLQVGMR

SEQ ID NO: 22491 - protein, 28 aa, Artificial Sequence
  Description of Artificial Sequence: Synthetic peptide
DEEEIRTTNPTATEQYGSVSTNEQNGNQ

SEQ ID NO: 22492 - protein, 28 aa, Artificial Sequence
  Description of Artificial Sequence: Synthetic peptide
DEEEIRTTNIVATEQYGSVSTELQGGNH

SEQ ID NO: 22493 - protein, 29 aa, Artificial Sequence
  Description of Artificial Sequence: Synthetic peptide
DEEAIRTTNPVATEQYGSVSTSLQSEGNR

SEQ ID NO: 22494 - protein, 28 aa, Artificial Sequence
  Description of Artificial Sequence: Synthetic peptide
DEEEINTTNPVATEQYGSVSTDLQDGNP

SEQ ID NO: 22495 - protein, 28 aa, Artificial Sequence
  Description of Artificial Sequence: Synthetic peptide
DEIEIRTTNPVCTEQYGSVSTNLQGGND

SEQ ID NO: 22496 - protein, 28 aa, Artificial Sequence
  Description of Artificial Sequence: Synthetic peptide
DEEEIRTTNPVATEQYGEVSANLQRGDF

SEQ ID NO: 22497 - protein, 30 aa, Artificial Sequence
  Description of Artificial Sequence: Synthetic polypeptide
DEEEIRTTNPVATEQYGSVDCTMNLQTGNR

SEQ ID NO: 22498 - protein, 28 aa, Artificial Sequence
  Description of Artificial Sequence: Synthetic peptide
DEEEIRTTNIVATEQYGSVSENLQDGNQ

SEQ ID NO: 22499 - protein, 28 aa, Artificial Sequence
  Description of Artificial Sequence: Synthetic peptide
DEEEIRTTNIVATEQYGVVSTNLQQGNI

SEQ ID NO: 22500 - protein, 28 aa, Artificial Sequence
  Description of Artificial Sequence: Synthetic peptide
DEEEIRCTNPVATEIYGSVSMNLQRGNF

SEQ ID NO: 22501 - protein, 28 aa, Artificial Sequence
  Description of Artificial Sequence: Synthetic peptide
DEEEIRTTNPVATECYGSVSTNLQNGDE

SEQ ID NO: 22502 - protein, 28 aa, Artificial Sequence
  Description of Artificial Sequence: Synthetic peptide
DEEEIRTTNPVATEQYGSVFTNLEGGNT

SEQ ID NO: 22503 - protein, 28 aa, Artificial Sequence
  Description of Artificial Sequence: Synthetic peptide
DEEEIATTNPVATEHYGWVATNLQRGNR

SEQ ID NO: 22504 - protein, 28 aa, Artificial Sequence
  Description of Artificial Sequence: Synthetic peptide
DEEEIRTTNPVATEQFGSVSTNPQLGTR

SEQ ID NO: 22505 - protein, 28 aa, Artificial Sequence
  Description of Artificial Sequence: Synthetic peptide
DEEEIRTTNIVATEQYGSVSTNLQLEDR

SEQ ID NO: 22506 - protein, 30 aa, Artificial Sequence
  Description of Artificial Sequence: Synthetic polypeptide
DEEEIRTTNPVATEQYGSVSTNLQDFKGDR

SEQ ID NO: 22507 - protein, 28 aa, Artificial Sequence
  Description of Artificial Sequence: Synthetic peptide
DEEEIRTVNPVATENYGSVATNLQRGNQ

SEQ ID NO: 22508 - protein, 30 aa, Artificial Sequence
  Description of Artificial Sequence: Synthetic polypeptide
MEEEIRTTNPVATEQYGSVSTNLQTEGNDR

SEQ ID NO: 22509 - protein, 28 aa, Artificial Sequence
  Description of Artificial Sequence: Synthetic peptide
DEEEIRTTNIVATEQYGSVSTNLQMENM

SEQ ID NO: 22510 - protein, 28 aa, Artificial Sequence
  Description of Artificial Sequence: Synthetic peptide
DEEEIRTTNPVATEQYGAVSTNLQREGH

SEQ ID NO: 22511 - protein, 31 aa, Artificial Sequence
  Description of Artificial Sequence: Synthetic polypeptide
DEEEIRTTNPVATEQYGSVSTCNEQLRGDNR

SEQ ID NO: 22512 - protein, 28 aa, Artificial Sequence
  Description of Artificial Sequence: Synthetic peptide
DEEEIRTTNPVATEQYGSVSTEDQDGER

SEQ ID NO: 22513 - protein, 29 aa, Artificial Sequence
  Description of Artificial Sequence: Synthetic peptide
DEEEIRTTNPVATEQYGSVSTNLQDAGES

SEQ ID NO: 22514 - protein, 28 aa, Artificial Sequence
  Description of Artificial Sequence: Synthetic peptide
DEEEIRTTNIVATEQWGSVSTDLQRGER

SEQ ID NO: 22515 - protein, 30 aa, Artificial Sequence
  Description of Artificial Sequence: Synthetic polypeptide
DEEEIRTTNPVASECYGSVSTENLQYRGNR

SEQ ID NO: 22516 - protein, 28 aa, Artificial Sequence
  Description of Artificial Sequence: Synthetic peptide
DEGEIRTTNPVATEQFGSTSYNLQRGNR

SEQ ID NO: 22517 - protein, 28 aa, Artificial Sequence
  Description of Artificial Sequence: Synthetic peptide
DEEEIRTTNPFATEQYGSVSTGPQRGNE

SEQ ID NO: 22518 - protein, 28 aa, Artificial Sequence
  Description of Artificial Sequence: Synthetic peptide
DEDEIRTTNPAATELYGSVSTNLQRGDR

SEQ ID NO: 22519 - protein, 28 aa, Artificial Sequence
  Description of Artificial Sequence: Synthetic peptide
DEEEIATTNPVATEMYGSVSTNLQREDR

SEQ ID NO: 22520 - protein, 28 aa, Artificial Sequence
  Description of Artificial Sequence: Synthetic peptide
DEEEIETTNPCCTEQYGSVSTNLQRGNS

SEQ ID NO: 22521 - protein, 30 aa, Artificial Sequence
  Description of Artificial Sequence: Synthetic polypeptide
DEDEIRTTNPVATEQYGSVDSATNLQGGNR

SEQ ID NO: 22522 - protein, 31 aa, Artificial Sequence
  Description of Artificial Sequence: Synthetic polypeptide
DEEEIRTTNPVATEQYGSVSTNLGIRGENLR

SEQ ID NO: 22523 - protein, 28 aa, Artificial Sequence
  Description of Artificial Sequence: Synthetic peptide
SEEEIWATNPVATEQYGSVSTNLQRGNF

SEQ ID NO: 22524 - protein, 28 aa, Artificial Sequence
  Description of Artificial Sequence: Synthetic peptide
SEDEIRTTNPTATEQYGSVSTNLQVGNR

SEQ ID NO: 22525 - protein, 28 aa, Artificial Sequence
  Description of Artificial Sequence: Synthetic peptide
DDEEICTTNPVATEQYGSVSTNLQQGND

SEQ ID NO: 22526 - protein, 28 aa, Artificial Sequence
  Description of Artificial Sequence: Synthetic peptide
DEEEVRTVNPVATEQYGSVSTNWQDGNR

SEQ ID NO: 22527 - protein, 28 aa, Artificial Sequence
  Description of Artificial Sequence: Synthetic peptide
MEEEIRTTNPVATECYGSVSTELQRGNF

SEQ ID NO: 22528 - protein, 28 aa, Artificial Sequence
  Description of Artificial Sequence: Synthetic peptide
DEEEIRTTNPVATEQYGSVSDNLQGENY

SEQ ID NO: 22529 - protein, 30 aa, Artificial Sequence
  Description of Artificial Sequence: Synthetic polypeptide
DEEEIRTTNPVCTEQWGSVSTNNLQTRGNR

SEQ ID NO: 22530 - protein, 28 aa, Artificial Sequence
  Description of Artificial Sequence: Synthetic peptide
DEEEIRTTNPVATEQYGSVDTGLQWGER

SEQ ID NO: 22531 - protein, 29 aa, Artificial Sequence
  Description of Artificial Sequence: Synthetic peptide
DENEIRTTNPVATEQYGTVSTMNLQRGNT

SEQ ID NO: 22532 - protein, 28 aa, Artificial Sequence
  Description of Artificial Sequence: Synthetic peptide
DEEEIRTTNPVATEQYGSVSEDLQMGNI

SEQ ID NO: 22533 - protein, 28 aa, Artificial Sequence
  Description of Artificial Sequence: Synthetic peptide
DEEEIRTTNPDATEQYGSISTPLQTGNR

SEQ ID NO: 22534 - protein, 29 aa, Artificial Sequence
  Description of Artificial Sequence: Synthetic peptide
QEDEIRTTNPVATEQYGSVSADNLQRGNR

SEQ ID NO: 22535 - protein, 28 aa, Artificial Sequence
  Description of Artificial Sequence: Synthetic peptide
DEEEIRTTNPVATEQYGSVDTELERGNQ

SEQ ID NO: 22536 - protein, 30 aa, Artificial Sequence
  Description of Artificial Sequence: Synthetic polypeptide
DEEEIATTNPVATEQYGSVSTNLQNRGENQ

SEQ ID NO: 22537 - protein, 28 aa, Artificial Sequence
  Description of Artificial Sequence: Synthetic peptide
DEEEIRTTNPVATEQYGSVSTNLPQDNT

SEQ ID NO: 22538 - protein, 28 aa, Artificial Sequence
  Description of Artificial Sequence: Synthetic peptide
DEEEIRTTNPFATEQYGSVSTDLIRGNN

SEQ ID NO: 22539 - protein, 28 aa, Artificial Sequence
  Description of Artificial Sequence: Synthetic peptide
DEEEIRTTNPVATEVYGSVDTNDQVGNR

SEQ ID NO: 22540 - protein, 28 aa, Artificial Sequence
  Description of Artificial Sequence: Synthetic peptide
QECEIRTTNPVATEQYGSVSTNLQQGDR

SEQ ID NO: 22541 - protein, 28 aa, Artificial Sequence
  Description of Artificial Sequence: Synthetic peptide
DENEIRTTNPVATEQWGSVSTNLQQGNS

SEQ ID NO: 22542 - protein, 28 aa, Artificial Sequence
  Description of Artificial Sequence: Synthetic peptide
DGEEIRTTNPVATEQYGEVSTNLERGNF

SEQ ID NO: 22543 - protein, 29 aa, Artificial Sequence
  Description of Artificial Sequence: Synthetic peptide
SEEEIRTTNPVATEQYGSVGTNLQDVGNR

SEQ ID NO: 22544 - protein, 29 aa, Artificial Sequence
  Description of Artificial Sequence: Synthetic peptide
DEQEIATTNPVATEQYGSVSTNLQRGENI

SEQ ID NO: 22545 - protein, 28 aa, Artificial Sequence
  Description of Artificial Sequence: Synthetic peptide
DEEEIRTTNIVSTEQYGSVSTNLQDGNS

SEQ ID NO: 22546 - protein, 30 aa, Artificial Sequence
  Description of Artificial Sequence: Synthetic polypeptide
DEEEIATTNPVATEQYGSVSTNLQEREGNT

SEQ ID NO: 22547 - protein, 28 aa, Artificial Sequence
  Description of Artificial Sequence: Synthetic peptide
DEEEIRTTNIVATEQYGEVSTNLQRENI

SEQ ID NO: 22548 - protein, 28 aa, Artificial Sequence
  Description of Artificial Sequence: Synthetic peptide
DEQEIRTTNPVATEVYGSVGTNLQVGNR

SEQ ID NO: 22549 - protein, 29 aa, Artificial Sequence
  Description of Artificial Sequence: Synthetic peptide
DEEEIRTTNPFATEQYGSVSTNLQRFENT

SEQ ID NO: 22550 - protein, 28 aa, Artificial Sequence
  Description of Artificial Sequence: Synthetic peptide
NEEEIRTVNPVATEQYGSTGTNLQRGNR

SEQ ID NO: 22551 - protein, 28 aa, Artificial Sequence
  Description of Artificial Sequence: Synthetic peptide
SENEIRTTNPVATEQYGIVSTNLMRGNR

SEQ ID NO: 22552 - protein, 28 aa, Artificial Sequence
  Description of Artificial Sequence: Synthetic peptide
DEEEIRSVNPVAYEMYGSVSTNLQRGNR

SEQ ID NO: 22553 - protein, 31 aa, Artificial Sequence
  Description of Artificial Sequence: Synthetic polypeptide
DEEEIRTTNPVATEQYGSVSDTPLQRGDNPR

SEQ ID NO: 22554 - protein, 28 aa, Artificial Sequence
  Description of Artificial Sequence: Synthetic peptide
DEEEIRTTNPVATEQWGIVSENLQQGNR

SEQ ID NO: 22555 - protein, 28 aa, Artificial Sequence
  Description of Artificial Sequence: Synthetic peptide
DEEEIRTTNPVATEQYGSVDTPLERGNQ

SEQ ID NO: 22556 - protein, 28 aa, Artificial Sequence
  Description of Artificial Sequence: Synthetic peptide
DEETIRTTNPVATQQYGSVSTELQVGNR

SEQ ID NO: 22557 - protein, 28 aa, Artificial Sequence
  Description of Artificial Sequence: Synthetic peptide
DEEEIRTTNPVATEQYGSVSTDLEQGNS

SEQ ID NO: 22558 - protein, 28 aa, Artificial Sequence
  Description of Artificial Sequence: Synthetic peptide
DEEEIRCTNPVATEIYGCVATNLQRGNR

SEQ ID NO: 22559 - protein, 29 aa, Artificial Sequence
  Description of Artificial Sequence: Synthetic peptide
QEGEIRTTNPVATEQYGSVSTNLQMRGNG

SEQ ID NO: 22560 - protein, 28 aa, Artificial Sequence
  Description of Artificial Sequence: Synthetic peptide
DEHEIRTTNPVATECYGSVSTNLQHGNN

SEQ ID NO: 22561 - protein, 29 aa, Artificial Sequence
  Description of Artificial Sequence: Synthetic peptide
DEEEIRGTNPVATEQYGSVSVTNLQHGNN

SEQ ID NO: 22562 - protein, 28 aa, Artificial Sequence
  Description of Artificial Sequence: Synthetic peptide
QEEEIRTTNPVATEQYGYVSDNVQRGNR

SEQ ID NO: 22563 - protein, 29 aa, Artificial Sequence
  Description of Artificial Sequence: Synthetic peptide
DEEEIRTTNPVATECYGSVSTDLEREGNR

SEQ ID NO: 22564 - protein, 28 aa, Artificial Sequence
  Description of Artificial Sequence: Synthetic peptide
DEVEIYTTNPVATEQYGSVSTALQRGNQ

SEQ ID NO: 22565 - protein, 28 aa, Artificial Sequence
  Description of Artificial Sequence: Synthetic peptide
DEEEIGTTNPVATEVYGSVSTNLQHGNC

SEQ ID NO: 22566 - protein, 28 aa, Artificial Sequence
  Description of Artificial Sequence: Synthetic peptide
DEEEIRTTNPVATEQYGVVSTNLQWGDC

SEQ ID NO: 22567 - protein, 30 aa, Artificial Sequence
  Description of Artificial Sequence: Synthetic polypeptide
DEEEIRTTNPVATEQYGSVSTNLQEAGNDL

SEQ ID NO: 22568 - protein, 28 aa, Artificial Sequence
  Description of Artificial Sequence: Synthetic peptide
DPEEIRTTNPVATEQFGSVSTNGQPGNR

SEQ ID NO: 22569 - protein, 31 aa, Artificial Sequence
  Description of Artificial Sequence: Synthetic polypeptide
DEEEIRTTNPVATEQYGSVSDTPNLQRGDNP

SEQ ID NO: 22570 - protein, 28 aa, Artificial Sequence
  Description of Artificial Sequence: Synthetic peptide
DEGEIRCTNPVATEQYGSVSTNLYRGND

SEQ ID NO: 22571 - protein, 28 aa, Artificial Sequence
  Description of Artificial Sequence: Synthetic peptide
DEEEIRTTNPVCTELYGSVSTNWQRGNF

SEQ ID NO: 22572 - protein, 28 aa, Artificial Sequence
  Description of Artificial Sequence: Synthetic peptide
DEVEIRTTNPCATEQYGSVSTDLQRGNL

SEQ ID NO: 22573 - protein, 29 aa, Artificial Sequence
  Description of Artificial Sequence: Synthetic peptide
DEEEIRTTNPVATEQYGSVSENLQNGDNV

SEQ ID NO: 22574 - protein, 28 aa, Artificial Sequence
  Description of Artificial Sequence: Synthetic peptide
DEEEIRTTNPVATEQYGSVSTDLQSGLL

SEQ ID NO: 22575 - protein, 30 aa, Artificial Sequence
  Description of Artificial Sequence: Synthetic polypeptide
DEEEIRTTNPVAFQQYGSVSTPNLQRGDNR

SEQ ID NO: 22576 - protein, 28 aa, Artificial Sequence
  Description of Artificial Sequence: Synthetic peptide
DEQEIRTTNIVATEQYGSVSTNLQRGDE

SEQ ID NO: 22577 - protein, 28 aa, Artificial Sequence
  Description of Artificial Sequence: Synthetic peptide
DEEEIRTTNIVATEQWGSVSTNLERGDR

SEQ ID NO: 22578 - protein, 28 aa, Artificial Sequence
  Description of Artificial Sequence: Synthetic peptide
DEEEIVSTNPVATEQFGSVSTNLQRGNF

SEQ ID NO: 22579 - protein, 28 aa, Artificial Sequence
  Description of Artificial Sequence: Synthetic peptide
DEEEIRTTNPVATECYGSVSTELQRGEA

SEQ ID NO: 22580 - protein, 29 aa, Artificial Sequence
  Description of Artificial Sequence: Synthetic peptide
DEEEIRTTNPVATETYGSVSTNLQIGDDR

SEQ ID NO: 22581 - protein, 31 aa, Artificial Sequence
  Description of Artificial Sequence: Synthetic polypeptide
DEEEIRTTNPVATEQYGSVSTNLPQGGVNWR

SEQ ID NO: 22582 - protein, 29 aa, Artificial Sequence
  Description of Artificial Sequence: Synthetic peptide
DENEIRTTNPVATEQYGSVSTNLMMIGNR

SEQ ID NO: 22583 - protein, 29 aa, Artificial Sequence
  Description of Artificial Sequence: Synthetic peptide
DEQEIRTTNPVATEQYGWVSAENLQRGNR

SEQ ID NO: 22584 - protein, 30 aa, Artificial Sequence
  Description of Artificial Sequence: Synthetic polypeptide
DEEEIRTTNPVATEQYGSVSTNLQRNGEDM

SEQ ID NO: 22585 - protein, 29 aa, Artificial Sequence
  Description of Artificial Sequence: Synthetic peptide
DEEEIRTTNPVATEQYGSVSTNLDIVGND

SEQ ID NO: 22586 - protein, 31 aa, Artificial Sequence
  Description of Artificial Sequence: Synthetic polypeptide
DEEEIRTTNPVATEQYGSVISTNDQMRGANR

SEQ ID NO: 22587 - protein, 30 aa, Artificial Sequence
  Description of Artificial Sequence: Synthetic polypeptide
DEEEIRTTNPVATEWYGQSNVSTNNQRGNR

SEQ ID NO: 22588 - protein, 30 aa, Artificial Sequence
  Description of Artificial Sequence: Synthetic polypeptide
DENEIRTTNPVATEQYGHSVSTILQRGNDR

SEQ ID NO: 22589 - protein, 28 aa, Artificial Sequence
  Description of Artificial Sequence: Synthetic peptide
DEQEIVATNPVATEVYGSVSTNLQRGNR

SEQ ID NO: 22590 - protein, 31 aa, Artificial Sequence
  Description of Artificial Sequence: Synthetic polypeptide
DEEEIRTTNPVATEQYGSVDSVTNLQEKGNR

SEQ ID NO: 22591 - protein, 30 aa, Artificial Sequence
  Description of Artificial Sequence: Synthetic polypeptide
DEEEIVTTNPVATEQYGSVSTNLQRKGENN

SEQ ID NO: 22592 - protein, 28 aa, Artificial Sequence
  Description of Artificial Sequence: Synthetic peptide
DENEIRTTNPVATEQYGSVSTDLQRGDT

SEQ ID NO: 22593 - protein, 28 aa, Artificial Sequence
  Description of Artificial Sequence: Synthetic peptide
DEEEIRTTNPVATEQYGSVSTIEMRGDR

SEQ ID NO: 22594 - protein, 28 aa, Artificial Sequence
  Description of Artificial Sequence: Synthetic peptide
DEEEIRTTNPVATEQYGSVSTNLEDGEF

SEQ ID NO: 22595 - protein, 28 aa, Artificial Sequence
  Description of Artificial Sequence: Synthetic peptide
DEEEISTTNPCATEQYGSVSTNLIIGNR

SEQ ID NO: 22596 - protein, 28 aa, Artificial Sequence
  Description of Artificial Sequence: Synthetic peptide
DEEEIATTNPVATECYGSVSTNLQTGNI

SEQ ID NO: 22597 - protein, 29 aa, Artificial Sequence
  Description of Artificial Sequence: Synthetic peptide
DEEEIRTTNPVATEQYGSVSTDLQDAGNW

SEQ ID NO: 22598 - protein, 28 aa, Artificial Sequence
  Description of Artificial Sequence: Synthetic peptide
DEEEIRTTNPVATEQYGSVSYNLMRGPI

SEQ ID NO: 22599 - protein, 28 aa, Artificial Sequence
  Description of Artificial Sequence: Synthetic peptide
REEEIRTTNPCATEQYGSVSTNLQHGNF

SEQ ID NO: 22600 - protein, 29 aa, Artificial Sequence
  Description of Artificial Sequence: Synthetic peptide
DEEEIRTTNPVATEQYGSVSENEQMRGNA

SEQ ID NO: 22601 - protein, 30 aa, Artificial Sequence
  Description of Artificial Sequence: Synthetic polypeptide
DEEEIRTTNPVATEQYGSVSTTGLEERGNR

SEQ ID NO: 22602 - protein, 28 aa, Artificial Sequence
  Description of Artificial Sequence: Synthetic peptide
DEEEIRTTNIVATEQYGSVSSNLQRGED

SEQ ID NO: 22603 - protein, 28 aa, Artificial Sequence
  Description of Artificial Sequence: Synthetic peptide
SEEEIRTTNPVATELYGSVPENLQRGNR

SEQ ID NO: 22604 - protein, 28 aa, Artificial Sequence
  Description of Artificial Sequence: Synthetic peptide
DEEEIRTTNPVATEQWGSVSTNEMRGNM

SEQ ID NO: 22605 - protein, 28 aa, Artificial Sequence
  Description of Artificial Sequence: Synthetic peptide
DEEEIRTTNIVATEQYGSVSTNIQTGER

SEQ ID NO: 22606 - protein, 30 aa, Artificial Sequence
  Description of Artificial Sequence: Synthetic polypeptide
DEEEIRTTNPVATLQYGSVSTNLQRGELMR

SEQ ID NO: 22607 - protein, 28 aa, Artificial Sequence
  Description of Artificial Sequence: Synthetic peptide
DEEEIATTNPVATEQYGSVSTNLQHGET

SEQ ID NO: 22608 - protein, 28 aa, Artificial Sequence
  Description of Artificial Sequence: Synthetic peptide
DEEEIRTTNPVATEQYGDASTNDQRGND

SEQ ID NO: 22609 - protein, 28 aa, Artificial Sequence
  Description of Artificial Sequence: Synthetic peptide
DEEEIATTNPVATECYGSVSTDLQRGNI

SEQ ID NO: 22610 - protein, 28 aa, Artificial Sequence
  Description of Artificial Sequence: Synthetic peptide
DEQEITTTNPVATEQYGSVSTNLQDGNL

SEQ ID NO: 22611 - protein, 28 aa, Artificial Sequence
  Description of Artificial Sequence: Synthetic peptide
CEEEIRTTNPVATEQYGSVSTEDQHGNR

SEQ ID NO: 22612 - protein, 28 aa, Artificial Sequence
  Description of Artificial Sequence: Synthetic peptide
AEEEIRTTNPVATECYGSNSTNIQRGNR

SEQ ID NO: 22613 - protein, 28 aa, Artificial Sequence
  Description of Artificial Sequence: Synthetic peptide
DEEEIRTTNPVATEQYGSVSTDLERGED

SEQ ID NO: 22614 - protein, 28 aa, Artificial Sequence
  Description of Artificial Sequence: Synthetic peptide
DENEIRTTNPVATEQYGWVSTNLQVGNA

SEQ ID NO: 22615 - protein, 28 aa, Artificial Sequence
  Description of Artificial Sequence: Synthetic peptide
DEEEIRTTNIVATEQWGSVSTNEQHGNR

SEQ ID NO: 22616 - protein, 28 aa, Artificial Sequence
  Description of Artificial Sequence: Synthetic peptide
DEEEIRTTNIVATEQYGSVSTNIQNGNY

SEQ ID NO: 22617 - protein, 28 aa, Artificial Sequence
  Description of Artificial Sequence: Synthetic peptide
DPEEIRTTNPVATAQYGSVSTNLQPGND

SEQ ID NO: 22618 - protein, 30 aa, Artificial Sequence
  Description of Artificial Sequence: Synthetic polypeptide
DEEEIRCTNPCATEQYGSVSTMNLQTRGNR

SEQ ID NO: 22619 - protein, 29 aa, Artificial Sequence
  Description of Artificial Sequence: Synthetic peptide
DEEEIRTTNPVATEQYGSVSTNLQEFGEA

SEQ ID NO: 22620 - protein, 28 aa, Artificial Sequence
  Description of Artificial Sequence: Synthetic peptide
DEGEIRTTNPVCTEQYGSVATNIQRGNR

SEQ ID NO: 22621 - protein, 28 aa, Artificial Sequence
  Description of Artificial Sequence: Synthetic peptide
DENEIRTTNPVATEQYGSVSTDLQAGNS

SEQ ID NO: 22622 - protein, 28 aa, Artificial Sequence
  Description of Artificial Sequence: Synthetic peptide
DEEEIRTTNIVATEQYGSVSTGLERGNV

SEQ ID NO: 22623 - protein, 29 aa, Artificial Sequence
  Description of Artificial Sequence: Synthetic peptide
DEEEIRTTNPVACEAYGSVPTNLQRAGNR

SEQ ID NO: 22624 - protein, 31 aa, Artificial Sequence
  Description of Artificial Sequence: Synthetic polypeptide
DEEEIRTTNPVATEQYGSVSETGNLQSGDNR

SEQ ID NO: 22625 - protein, 28 aa, Artificial Sequence
  Description of Artificial Sequence: Synthetic peptide
DEEEIRTTNIVATEQYGSVSTNLQQGTH

SEQ ID NO: 22626 - protein, 28 aa, Artificial Sequence
  Description of Artificial Sequence: Synthetic peptide
DEHEIYTTNPVATEQYGSASENLQRGNR

SEQ ID NO: 22627 - protein, 28 aa, Artificial Sequence
  Description of Artificial Sequence: Synthetic peptide
SEEEIRTTNPVATEQYGSVSTNEQRENG

SEQ ID NO: 22628 - protein, 28 aa, Artificial Sequence
  Description of Artificial Sequence: Synthetic peptide
DEEEIRTTNPEATEQYGSVSTDLQIENR

SEQ ID NO: 22629 - protein, 28 aa, Artificial Sequence
  Description of Artificial Sequence: Synthetic peptide
DEQEIRTTNPVATEQYGNVSDNLQRGGR

SEQ ID NO: 22630 - protein, 28 aa, Artificial Sequence
  Description of Artificial Sequence: Synthetic peptide
DEEEIRTTNPVATEHYGSVSTNLQIGPQ

SEQ ID NO: 22631 - protein, 29 aa, Artificial Sequence
  Description of Artificial Sequence: Synthetic peptide
DEEEIRTTNPVATECYGIVSTNLQRGNDF

SEQ ID NO: 22632 - protein, 28 aa, Artificial Sequence
  Description of Artificial Sequence: Synthetic peptide
DEEEIHTVNPVATAQYGSVSTNLQRGND

SEQ ID NO: 22633 - protein, 28 aa, Artificial Sequence
  Description of Artificial Sequence: Synthetic peptide
DEQEIRTTNPVATEQYGSVSENLQQGNQ

SEQ ID NO: 22634 - protein, 28 aa, Artificial Sequence
  Description of Artificial Sequence: Synthetic peptide
DEEEIRQTNPVATEQYGSVSTNCQRGEK

SEQ ID NO: 22635 - protein, 28 aa, Artificial Sequence
  Description of Artificial Sequence: Synthetic peptide
DEQEIRTTNPEATEQYGSVSTNDQRGNL

SEQ ID NO: 22636 - protein, 30 aa, Artificial Sequence
  Description of Artificial Sequence: Synthetic polypeptide
DEEEIRTTNPVATEQYGSVSTNLQQYNGNT

SEQ ID NO: 22637 - protein, 30 aa, Artificial Sequence
  Description of Artificial Sequence: Synthetic polypeptide
DEEEIRTTNPVATEQYGSVDSTANLNPGNR

SEQ ID NO: 22638 - protein, 28 aa, Artificial Sequence
  Description of Artificial Sequence: Synthetic peptide
DEEEIATTNIVATEQYGSVSTNLQGGMR

SEQ ID NO: 22639 - protein, 28 aa, Artificial Sequence
  Description of Artificial Sequence: Synthetic peptide
DEEEIATTNPVATEQYGSVSTDLQFGNM

SEQ ID NO: 22640 - protein, 30 aa, Artificial Sequence
  Description of Artificial Sequence: Synthetic polypeptide
DEEEIRTTNPVATEQYGSVSTNLQEQGNDA

SEQ ID NO: 22641 - protein, 31 aa, Artificial Sequence
  Description of Artificial Sequence: Synthetic polypeptide
DEEEIRTTNPVATEQYGSVSETEGLQRGENR

SEQ ID NO: 22642 - protein, 28 aa, Artificial Sequence
  Description of Artificial Sequence: Synthetic peptide
DENEIRTTNPVATEQWGSVSTNLMRGNW

SEQ ID NO: 22643 - protein, 28 aa, Artificial Sequence
  Description of Artificial Sequence: Synthetic peptide
DEEEIRTTNIVATEQWGSVSDNLQRGNV

SEQ ID NO: 22644 - protein, 28 aa, Artificial Sequence
  Description of Artificial Sequence: Synthetic peptide
DEEEIRTTNIVATECYGEVSTNLQMGNR

SEQ ID NO: 22645 - protein, 28 aa, Artificial Sequence
  Description of Artificial Sequence: Synthetic peptide
SEGEIRTTNPVATEQYGTVSTTLQRGNR

SEQ ID NO: 22646 - protein, 28 aa, Artificial Sequence
  Description of Artificial Sequence: Synthetic peptide
DEEEIATTNPVATEQYGDVSTNLQVGNQ

SEQ ID NO: 22647 - protein, 30 aa, Artificial Sequence
  Description of Artificial Sequence: Synthetic polypeptide
DEEEIRTTNPVATEQYGSVSTDLQERGNDM

SEQ ID NO: 22648 - protein, 28 aa, Artificial Sequence
  Description of Artificial Sequence: Synthetic peptide
DEQEIRTTNPVATEQWGSVSTNEMRGNR

SEQ ID NO: 22649 - protein, 28 aa, Artificial Sequence
  Description of Artificial Sequence: Synthetic peptide
IEEEIRTTNPVATEQYGAVSTNLQRGTD

SEQ ID NO: 22650 - protein, 28 aa, Artificial Sequence
  Description of Artificial Sequence: Synthetic peptide
DEEELCTTNPVATEQYGSTSTNLQRGQR

SEQ ID NO: 22651 - protein, 28 aa, Artificial Sequence
  Description of Artificial Sequence: Synthetic peptide
DEEEIRTTNIVATEQYGSVSTNDQRGDL

SEQ ID NO: 22652 - protein, 28 aa, Artificial Sequence
  Description of Artificial Sequence: Synthetic peptide
DENEIRTTNIVATEQFGSVSTNLQGGNR

SEQ ID NO: 22653 - protein, 28 aa, Artificial Sequence
  Description of Artificial Sequence: Synthetic peptide
DEEEVRAVNPVATEQYGSVSTNLQRGNQ

SEQ ID NO: 22654 - protein, 28 aa, Artificial Sequence
  Description of Artificial Sequence: Synthetic peptide
DETEIAATNPVATEMYGSVSTNLQRGNR

SEQ ID NO: 22655 - protein, 29 aa, Artificial Sequence
  Description of Artificial Sequence: Synthetic peptide
YEEEIRTTNPVATEQYGSVSSALQRGNDR

SEQ ID NO: 22656 - protein, 29 aa, Artificial Sequence
  Description of Artificial Sequence: Synthetic peptide
DEEEIRTTNPVATEQYGSVSTDLERGDDR

SEQ ID NO: 22657 - protein, 28 aa, Artificial Sequence
  Description of Artificial Sequence: Synthetic peptide
DEEEIRTTNPVATEQYGVVSTNDIFGNR

SEQ ID NO: 22658 - protein, 29 aa, Artificial Sequence
  Description of Artificial Sequence: Synthetic peptide
DEEEIRTTNPVATQQYGSVSTNNDQTGNR

SEQ ID NO: 22659 - protein, 28 aa, Artificial Sequence
  Description of Artificial Sequence: Synthetic peptide
DEQEIRTTNPVATEQYGVVSTDLQPGNR

SEQ ID NO: 22660 - protein, 28 aa, Artificial Sequence
  Description of Artificial Sequence: Synthetic peptide
DEEEIRTTNPVATEQWGSYDTNLQRGDR

SEQ ID NO: 22661 - protein, 30 aa, Artificial Sequence
  Description of Artificial Sequence: Synthetic polypeptide
DEEEIRTTNPVAYMQYGSVSSTNLQRGINR

SEQ ID NO: 22662 - protein, 28 aa, Artificial Sequence
  Description of Artificial Sequence: Synthetic peptide
DEEEIRTTNPVATEQYGSVSTDLQHGEA

SEQ ID NO: 22663 - protein, 28 aa, Artificial Sequence
  Description of Artificial Sequence: Synthetic peptide
DEMEIRTTNPVATEQYGIVSTNDQRGND

SEQ ID NO: 22664 - protein, 28 aa, Artificial Sequence
  Description of Artificial Sequence: Synthetic peptide
DEEEIRTTNPYATEQYGSVSTNLGPGNL

SEQ ID NO: 22665 - protein, 29 aa, Artificial Sequence
  Description of Artificial Sequence: Synthetic peptide
DEEEICTTNPVATEQYGSVATNEQQRGNR

SEQ ID NO: 22666 - protein, 29 aa, Artificial Sequence
  Description of Artificial Sequence: Synthetic peptide
DEEEIATTNPVATEQYGDVSADNLQRGNR

SEQ ID NO: 22667 - protein, 30 aa, Artificial Sequence
  Description of Artificial Sequence: Synthetic polypeptide
DEEEIRQTNPVATEQYGSVSITNLQRKGNQ

SEQ ID NO: 22668 - protein, 29 aa, Artificial Sequence
  Description of Artificial Sequence: Synthetic peptide
NEEEIRTTNPCATEVYGSVSTNLQRGNDR

SEQ ID NO: 22669 - protein, 28 aa, Artificial Sequence
  Description of Artificial Sequence: Synthetic peptide
DEEEIGTTNPTATEQFGSVSTALQRGNR

SEQ ID NO: 22670 - protein, 28 aa, Artificial Sequence
  Description of Artificial Sequence: Synthetic peptide
DEEEIRTVNPTATECYGSVSTDLQRGNR

SEQ ID NO: 22671 - protein, 28 aa, Artificial Sequence
  Description of Artificial Sequence: Synthetic peptide
DEVEIRTTNPVATEQYGTVSTVTQRGNR

SEQ ID NO: 22672 - protein, 28 aa, Artificial Sequence
  Description of Artificial Sequence: Synthetic peptide
DEEEIRSTNPVATEQYGSAGENLQRGNR

SEQ ID NO: 22673 - protein, 28 aa, Artificial Sequence
  Description of Artificial Sequence: Synthetic peptide
DEEEIRTTNPVATEQYGSASENLQHGNQ

SEQ ID NO: 22674 - protein, 30 aa, Artificial Sequence
  Description of Artificial Sequence: Synthetic polypeptide
DEEEIRTTNPVATEQYGSVSTEPLQIKGNR

SEQ ID NO: 22675 - protein, 28 aa, Artificial Sequence
  Description of Artificial Sequence: Synthetic peptide
MEEEIRTTNPVACDQYGSVVTNLQRGNR

SEQ ID NO: 22676 - protein, 28 aa, Artificial Sequence
  Description of Artificial Sequence: Synthetic peptide
DEEEIRTTNPVATEQWGSVSTNDERGNQ

SEQ ID NO: 22677 - protein, 28 aa, Artificial Sequence
  Description of Artificial Sequence: Synthetic peptide
DEEEIRATNPVATEQYGWVSEDLQRGNR

SEQ ID NO: 22678 - protein, 30 aa, Artificial Sequence
  Description of Artificial Sequence: Synthetic polypeptide
DEEEIATTNPVATEQYGSVSATNLQRNGER

SEQ ID NO: 22679 - protein, 29 aa, Artificial Sequence
  Description of Artificial Sequence: Synthetic peptide
DETEIRTTNPVATEQYGSVSTDEQRFGNR

SEQ ID NO: 22680 - protein, 28 aa, Artificial Sequence
  Description of Artificial Sequence: Synthetic peptide
DEEEIRSTNPVATEQFGSVSTNLQRGMM

SEQ ID NO: 22681 - protein, 28 aa, Artificial Sequence
  Description of Artificial Sequence: Synthetic peptide
DEEEIRTTNGVATEQYGSVSTNDQRGEI

SEQ ID NO: 22682 - protein, 30 aa, Artificial Sequence
  Description of Artificial Sequence: Synthetic polypeptide
DEEEIRTTNPVATEQYGSVSTNLQENGNDC

SEQ ID NO: 22683 - protein, 28 aa, Artificial Sequence
  Description of Artificial Sequence: Synthetic peptide
DEEEIRTTNPVATEQWGSVSTNEQLGNF

SEQ ID NO: 22684 - protein, 28 aa, Artificial Sequence
  Description of Artificial Sequence: Synthetic peptide
MEEEIATTNPVATEQYGSMSDNLQRGNR

SEQ ID NO: 22685 - protein, 28 aa, Artificial Sequence
  Description of Artificial Sequence: Synthetic peptide
AEEEIRQTNPVATEQYGSVPTNLQRENR

SEQ ID NO: 22686 - protein, 28 aa, Artificial Sequence
  Description of Artificial Sequence: Synthetic peptide
DEEEIATTNIVATEQYGSVSTNEQRGNS

SEQ ID NO: 22687 - protein, 28 aa, Artificial Sequence
  Description of Artificial Sequence: Synthetic peptide
DEEEIRTTNPTATEQYGSVSTNPQLGNE

SEQ ID NO: 22688 - protein, 28 aa, Artificial Sequence
  Description of Artificial Sequence: Synthetic peptide
DEEEIRTTNPDATEQYGWVSNNLQRGND

SEQ ID NO: 22689 - protein, 28 aa, Artificial Sequence
  Description of Artificial Sequence: Synthetic peptide
DEEEIRTVNPVATEQYGTVSTQLQRGTR

SEQ ID NO: 22690 - protein, 30 aa, Artificial Sequence
  Description of Artificial Sequence: Synthetic polypeptide
DEEEIRTTNPVATEQYGSVSTNLERNGNDQ

SEQ ID NO: 22691 - protein, 28 aa, Artificial Sequence
  Description of Artificial Sequence: Synthetic peptide
DEEEIRTTNICATEQYGSVSTNLQAGNS

SEQ ID NO: 22692 - protein, 29 aa, Artificial Sequence
  Description of Artificial Sequence: Synthetic peptide
DEEEIRTTNPVATEQYGSVSTNPQHGNTN

SEQ ID NO: 22693 - protein, 28 aa, Artificial Sequence
  Description of Artificial Sequence: Synthetic peptide
DEEEIRTTNPVATEQYGSVETNLDPGNP

SEQ ID NO: 22694 - protein, 30 aa, Artificial Sequence
  Description of Artificial Sequence: Synthetic polypeptide
DEEEIRTTNPVATEQYGSVSTNQQDREGNS

SEQ ID NO: 22695 - protein, 30 aa, Artificial Sequence
  Description of Artificial Sequence: Synthetic polypeptide
DEEGIRTTNPVATEQYGIVSTMNLQRGNPR

SEQ ID NO: 22696 - protein, 28 aa, Artificial Sequence
  Description of Artificial Sequence: Synthetic peptide
DEEEIRTTNPVATEQYGSVSTDLEPGNG

SEQ ID NO: 22697 - protein, 28 aa, Artificial Sequence
  Description of Artificial Sequence: Synthetic peptide
DEEEIRTTNPVATEQYGWVSDNLQRGEA

SEQ ID NO: 22698 - protein, 28 aa, Artificial Sequence
  Description of Artificial Sequence: Synthetic peptide
DEEEIRTTNIVATEQWGSVSTDDQRGNR

SEQ ID NO: 22699 - protein, 29 aa, Artificial Sequence
  Description of Artificial Sequence: Synthetic peptide
DEEEIRTTNPVATEQYGIVSPNNPQRGNR

SEQ ID NO: 22700 - protein, 28 aa, Artificial Sequence
  Description of Artificial Sequence: Synthetic peptide
DEEEIRTTNPVSTEQYGSVSTALELGNR

SEQ ID NO: 22701 - protein, 29 aa, Artificial Sequence
  Description of Artificial Sequence: Synthetic peptide
DEEEIRTTNPVATEQWGSVDTNLMIRGNR

SEQ ID NO: 22702 - protein, 28 aa, Artificial Sequence
  Description of Artificial Sequence: Synthetic peptide
DENEIATTNPVATEQYGSVSTNLQRGEL

SEQ ID NO: 22703 - protein, 29 aa, Artificial Sequence
  Description of Artificial Sequence: Synthetic peptide
DEHEIVTTNPVATEQYGSVSTNLQRGNTQ

SEQ ID NO: 22704 - protein, 28 aa, Artificial Sequence
  Description of Artificial Sequence: Synthetic peptide
DEGEIRTTNPVATEEYGSWSTNPQRGNR

SEQ ID NO: 22705 - protein, 28 aa, Artificial Sequence
  Description of Artificial Sequence: Synthetic peptide
DEEEIAATNIVATEQYGSVSTNLQRGNA

SEQ ID NO: 22706 - protein, 30 aa, Artificial Sequence
  Description of Artificial Sequence: Synthetic polypeptide
DEEEIRTTNPVATEQYGSVSTNLVQIHGNM

SEQ ID NO: 22707 - protein, 28 aa, Artificial Sequence
  Description of Artificial Sequence: Synthetic peptide
DEEEIATTNITATEQYGSVSTNLQEGNR

SEQ ID NO: 22708 - protein, 28 aa, Artificial Sequence
  Description of Artificial Sequence: Synthetic peptide
DEQEIRTTNPVATECYGSVSTDLQRGNV

SEQ ID NO: 22709 - protein, 28 aa, Artificial Sequence
  Description of Artificial Sequence: Synthetic peptide
DEYEIRTTNPVATEQYGEVSENVQRGNR

SEQ ID NO: 22710 - protein, 31 aa, Artificial Sequence
  Description of Artificial Sequence: Synthetic polypeptide
DEEEIRTTNPVATEQYGSVSTNLVEDRGNDR

SEQ ID NO: 22711 - protein, 28 aa, Artificial Sequence
  Description of Artificial Sequence: Synthetic peptide
DEEEIRTTNPVATETYGSVSANLQGGNI

SEQ ID NO: 22712 - protein, 28 aa, Artificial Sequence
  Description of Artificial Sequence: Synthetic peptide
DEEEIATTNPVATEQYGSVSTNEQRGTF

SEQ ID NO: 22713 - protein, 29 aa, Artificial Sequence
  Description of Artificial Sequence: Synthetic peptide
DEEEIRCTNPVATEWYGIVSTNLQRGNDR

SEQ ID NO: 22714 - protein, 28 aa, Artificial Sequence
  Description of Artificial Sequence: Synthetic peptide
DEEEIRATNIVATEQYGEVSTNLQRGNL

SEQ ID NO: 22715 - protein, 29 aa, Artificial Sequence
  Description of Artificial Sequence: Synthetic peptide
DEEEIRTTNPFATEQYGSVHIENLQRGNR

SEQ ID NO: 22716 - protein, 28 aa, Artificial Sequence
  Description of Artificial Sequence: Synthetic peptide
DEEEIKTTNPVATEQYGSVETNLQVINR

SEQ ID NO: 22717 - protein, 30 aa, Artificial Sequence
  Description of Artificial Sequence: Synthetic polypeptide
ADEEIRTTNPVATEQYGSVSTNNLQRNGNR

SEQ ID NO: 22718 - protein, 28 aa, Artificial Sequence
  Description of Artificial Sequence: Synthetic peptide
DEEEVRTTNPIATEVYGSVATNLQRGNR

SEQ ID NO: 22719 - protein, 30 aa, Artificial Sequence
  Description of Artificial Sequence: Synthetic polypeptide
DEEEIRTTNPVATEQYGSVAATNLQSRGNI

SEQ ID NO: 22720 - protein, 28 aa, Artificial Sequence
  Description of Artificial Sequence: Synthetic peptide
DEEEIRTTNPFATEQYGSVSTGLELGNR

SEQ ID NO: 22721 - protein, 28 aa, Artificial Sequence
  Description of Artificial Sequence: Synthetic peptide
AEVEIRTTNPVATEQYGSVSTNLQRGDV

SEQ ID NO: 22722 - protein, 30 aa, Artificial Sequence
  Description of Artificial Sequence: Synthetic polypeptide
DEEEIRTTNPVATEQYGSVSTNLQDTGNDT

SEQ ID NO: 22723 - protein, 30 aa, Artificial Sequence
  Description of Artificial Sequence: Synthetic polypeptide
DEEEIRTTNPVATEQYGSVSTNLQEHGNDM

SEQ ID NO: 22724 - protein, 28 aa, Artificial Sequence
  Description of Artificial Sequence: Synthetic peptide
DTEEIRTTNPVATEQYGDVSTGLQRGNP

SEQ ID NO: 22725 - protein, 28 aa, Artificial Sequence
  Description of Artificial Sequence: Synthetic peptide
DEEEISTTNPVATEQYGSVSENLMQGNR

SEQ ID NO: 22726 - protein, 28 aa, Artificial Sequence
  Description of Artificial Sequence: Synthetic peptide
DEEEIMTTNPVATEHYGEVSTNLQHGNR

SEQ ID NO: 22727 - protein, 28 aa, Artificial Sequence
  Description of Artificial Sequence: Synthetic peptide
DENEIRTTNPVASEQYGSVSTDLQAGNR

SEQ ID NO: 22728 - protein, 28 aa, Artificial Sequence
  Description of Artificial Sequence: Synthetic peptide
DEEEIRTTNPVATEQYGSVSTNLEPGEI

SEQ ID NO: 22729 - protein, 31 aa, Artificial Sequence
  Description of Artificial Sequence: Synthetic polypeptide
DEEEIRTTNPVATEQYGESVSTCNLQMGDNR

SEQ ID NO: 22730 - protein, 28 aa, Artificial Sequence
  Description of Artificial Sequence: Synthetic peptide
DEEEIRTTNPVASEIYGSVSMNLERGNR

SEQ ID NO: 22731 - protein, 30 aa, Artificial Sequence
  Description of Artificial Sequence: Synthetic polypeptide
DEEEIRTTNPVATEQYGSVSCTDLQYGNDR

SEQ ID NO: 22732 - protein, 29 aa, Artificial Sequence
  Description of Artificial Sequence: Synthetic peptide
MEEEIRTTNPVATECYGSVSTNLQERGNM

SEQ ID NO: 22733 - protein, 28 aa, Artificial Sequence
  Description of Artificial Sequence: Synthetic peptide
DEQEIRTTNIVATEQYGSVSTNLQRGED

SEQ ID NO: 22734 - protein, 28 aa, Artificial Sequence
  Description of Artificial Sequence: Synthetic peptide
DEEEIRTTNIVATEQYGSVSMNLQGGNS

SEQ ID NO: 22735 - protein, 28 aa, Artificial Sequence
  Description of Artificial Sequence: Synthetic peptide
DEEEIRTTNPVATEQYGSSSTNLQQGPS

SEQ ID NO: 22736 - protein, 29 aa, Artificial Sequence
  Description of Artificial Sequence: Synthetic peptide
KEEEIRTTNPVATEQYGSVSENLQRYGMR

SEQ ID NO: 22737 - protein, 28 aa, Artificial Sequence
  Description of Artificial Sequence: Synthetic peptide
DEDEIRTTNPVCTEQYGSVSNNLQGGNR

SEQ ID NO: 22738 - protein, 28 aa, Artificial Sequence
  Description of Artificial Sequence: Synthetic peptide
DEVEIRTTNPVATEQYGGVSENLQRGDR

SEQ ID NO: 22739 - protein, 28 aa, Artificial Sequence
  Description of Artificial Sequence: Synthetic peptide
DEEEIRTTNPVATEQYGDVSENLMRGNA

SEQ ID NO: 22740 - protein, 28 aa, Artificial Sequence
  Description of Artificial Sequence: Synthetic peptide
DEEEIYTTNPVATEQYGSVSTNLQHGDS

SEQ ID NO: 22741 - protein, 29 aa, Artificial Sequence
  Description of Artificial Sequence: Synthetic peptide
DEEEIRTTNPVATEWYGSVSTNPLQNGDR

SEQ ID NO: 22742 - protein, 28 aa, Artificial Sequence
  Description of Artificial Sequence: Synthetic peptide
HEEEICTTNPVATEQYGSVSSNLQIGNR

SEQ ID NO: 22743 - protein, 28 aa, Artificial Sequence
  Description of Artificial Sequence: Synthetic peptide
DEEEIRTTNPVATECYGSVDTNLQIGNS

SEQ ID NO: 22744 - protein, 29 aa, Artificial Sequence
  Description of Artificial Sequence: Synthetic peptide
DEEEIRTTNPVATEQFGSVSEIVLQRGNR

SEQ ID NO: 22745 - protein, 28 aa, Artificial Sequence
  Description of Artificial Sequence: Synthetic peptide
DEEEIRTTNPEATEQYGSVSENLLRGNF

SEQ ID NO: 22746 - protein, 28 aa, Artificial Sequence
  Description of Artificial Sequence: Synthetic peptide
DENEIRTTNPVATEQWGDVSTNLQRGNA

SEQ ID NO: 22747 - protein, 31 aa, Artificial Sequence
  Description of Artificial Sequence: Synthetic polypeptide
DEEEIRTTNPDATEQYGSVSTNPLQREGENR

SEQ ID NO: 22748 - protein, 28 aa, Artificial Sequence
  Description of Artificial Sequence: Synthetic peptide
DEEEIRTTNPVATEQYGSWSTEPQRENR

SEQ ID NO: 22749 - protein, 28 aa, Artificial Sequence
  Description of Artificial Sequence: Synthetic peptide
KEEEISTTNPVATEQYGSVSTNLQLGNN

SEQ ID NO: 22750 - protein, 29 aa, Artificial Sequence
  Description of Artificial Sequence: Synthetic peptide
DEEEIRTTNPVAWVQYGSVSSNLQRGDNR

SEQ ID NO: 22751 - protein, 28 aa, Artificial Sequence
  Description of Artificial Sequence: Synthetic peptide
DEEPIRTTNPLATEQYGSVFTNLLRGNR

SEQ ID NO: 22752 - protein, 28 aa, Artificial Sequence
  Description of Artificial Sequence: Synthetic peptide
DEEEIYTTNPVATEMYGSVSTNLQNGTR

SEQ ID NO: 22753 - protein, 28 aa, Artificial Sequence
  Description of Artificial Sequence: Synthetic peptide
DEQEIRTTNPVATEQYGSVSTDLQHGNW

SEQ ID NO: 22754 - protein, 28 aa, Artificial Sequence
  Description of Artificial Sequence: Synthetic peptide
DEEEIRTTNPVATEQYGSVSYELQIGND

SEQ ID NO: 22755 - protein, 28 aa, Artificial Sequence
  Description of Artificial Sequence: Synthetic peptide
DENEIRTTNPVATEQYGSVSTNLQQGEL

SEQ ID NO: 22756 - protein, 28 aa, Artificial Sequence
  Description of Artificial Sequence: Synthetic peptide
DEEEIRTTNPVATEQYGSVSTELQAGDS

SEQ ID NO: 22757 - protein, 29 aa, Artificial Sequence
  Description of Artificial Sequence: Synthetic peptide
DEEEIRTTNPVATEQYGSVSEMNLQMGNV

SEQ ID NO: 22758 - protein, 28 aa, Artificial Sequence
  Description of Artificial Sequence: Synthetic peptide
DEEEIRTTNIVATEQYGSVATNLQRGTM

SEQ ID NO: 22759 - protein, 30 aa, Artificial Sequence
  Description of Artificial Sequence: Synthetic polypeptide
DEEEIATTNPVATEQYGSVSTLNLQPGNPR

SEQ ID NO: 22760 - protein, 28 aa, Artificial Sequence
  Description of Artificial Sequence: Synthetic peptide
DDEEIRTTNPVATEQYGSCSTNLQNGNA

SEQ ID NO: 22761 - protein, 30 aa, Artificial Sequence
  Description of Artificial Sequence: Synthetic polypeptide
DEEEIRTTNPVATEQYGSVSTNLQDLEGNW

SEQ ID NO: 22762 - protein, 28 aa, Artificial Sequence
  Description of Artificial Sequence: Synthetic peptide
QEEEIRTTNPVATEQYGSVSTDLQPGNY

SEQ ID NO: 22763 - protein, 28 aa, Artificial Sequence
  Description of Artificial Sequence: Synthetic peptide
DENEIRTTNPVATEQYGSVSTNEMRGNF

SEQ ID NO: 22764 - protein, 29 aa, Artificial Sequence
  Description of Artificial Sequence: Synthetic peptide
KEHEIRCTNPVATEQYGSVSTNGLQRGNR

SEQ ID NO: 22765 - protein, 28 aa, Artificial Sequence
  Description of Artificial Sequence: Synthetic peptide
DEEEIRTTNIVATETYGSVSTNLQHGER

SEQ ID NO: 22766 - protein, 28 aa, Artificial Sequence
  Description of Artificial Sequence: Synthetic peptide
DEEEIATTNCVATEQYGSASTNLQRGGR

SEQ ID NO: 22767 - protein, 29 aa, Artificial Sequence
  Description of Artificial Sequence: Synthetic peptide
NEEEIRTTNPVATEQYGDVSENLQRGNER

SEQ ID NO: 22768 - protein, 28 aa, Artificial Sequence
  Description of Artificial Sequence: Synthetic peptide
DEEEIRTTNPVATEQYGSVSTNEMQGNW

SEQ ID NO: 22769 - protein, 28 aa, Artificial Sequence
  Description of Artificial Sequence: Synthetic peptide
DEEEIRTTNPVGTEQYGSLSENLQRFNR

SEQ ID NO: 22770 - protein, 28 aa, Artificial Sequence
  Description of Artificial Sequence: Synthetic peptide
DEEEIRTTNPVATEQYGSVHTPLIRGNP

SEQ ID NO: 22771 - protein, 28 aa, Artificial Sequence
  Description of Artificial Sequence: Synthetic peptide
DEEEISTTNPTATEQYGTVSTNLQRGNE

SEQ ID NO: 22772 - protein, 28 aa, Artificial Sequence
  Description of Artificial Sequence: Synthetic peptide
DEQEIRATNPVATEQYGSVSENLQRGNC

SEQ ID NO: 22773 - protein, 28 aa, Artificial Sequence
  Description of Artificial Sequence: Synthetic peptide
VEEEIRSTNPVATEQYGSVATNLQRGNQ

SEQ ID NO: 22774 - protein, 28 aa, Artificial Sequence
  Description of Artificial Sequence: Synthetic peptide
DEFEIRTTNPVATEQYGYVSANLQRGNP

SEQ ID NO: 22775 - protein, 28 aa, Artificial Sequence
  Description of Artificial Sequence: Synthetic peptide
QEEEIGTTNPVATEQYGSASENLQRGNR

SEQ ID NO: 22776 - protein, 29 aa, Artificial Sequence
  Description of Artificial Sequence: Synthetic peptide
DEQEIATTNPVATEIYGSVSTNLQREGNR

SEQ ID NO: 22777 - protein, 31 aa, Artificial Sequence
  Description of Artificial Sequence: Synthetic polypeptide
DEEEIRTTNPVATEQYGSVESTNPLDRGDNR

SEQ ID NO: 22778 - protein, 30 aa, Artificial Sequence
  Description of Artificial Sequence: Synthetic polypeptide
DEEEIRTTNPVATEQYGSASEDNLQRGFNR

SEQ ID NO: 22779 - protein, 28 aa, Artificial Sequence
  Description of Artificial Sequence: Synthetic peptide
DEEEIRTTNPTATEQYGSVSANLQRGDY

SEQ ID NO: 22780 - protein, 29 aa, Artificial Sequence
  Description of Artificial Sequence: Synthetic peptide
AEEEIVTTNPVATEQYGSVSATNEQRGNR

SEQ ID NO: 22781 - protein, 28 aa, Artificial Sequence
  Description of Artificial Sequence: Synthetic peptide
DEEEICTTNPVATEQYGDVSTVLQRGMR

SEQ ID NO: 22782 - protein, 29 aa, Artificial Sequence
  Description of Artificial Sequence: Synthetic peptide
GEEEIRTTNPVATEQYGSVSTNLQDSGNT

SEQ ID NO: 22783 - protein, 30 aa, Artificial Sequence
  Description of Artificial Sequence: Synthetic polypeptide
DEEEIRTTNPVATEQYGSVSTDNGLERENR

SEQ ID NO: 22784 - protein, 29 aa, Artificial Sequence
  Description of Artificial Sequence: Synthetic peptide
DEEEIRTTNPVATECYGSVSTDLQHNGNR

SEQ ID NO: 22785 - protein, 30 aa, Artificial Sequence
  Description of Artificial Sequence: Synthetic polypeptide
DEEEIRTTNPVATEQYGSVSTANLQEIGNI

SEQ ID NO: 22786 - protein, 29 aa, Artificial Sequence
  Description of Artificial Sequence: Synthetic peptide
DEEEIRTTNPVATEQYGSVSTNLQEMGDH

SEQ ID NO: 22787 - protein, 28 aa, Artificial Sequence
  Description of Artificial Sequence: Synthetic peptide
DEEEIRTTNPVATECYGSVSTGLESGNR

SEQ ID NO: 22788 - protein, 28 aa, Artificial Sequence
  Description of Artificial Sequence: Synthetic peptide
AEEEIRTTNPVATEQYGSVSTNLLFGNV

SEQ ID NO: 22789 - protein, 28 aa, Artificial Sequence
  Description of Artificial Sequence: Synthetic peptide
DEEEIRTTNPVATEQYGSVSTDDQIGNQ

SEQ ID NO: 22790 - protein, 30 aa, Artificial Sequence
  Description of Artificial Sequence: Synthetic polypeptide
DEEEIRTTNPVATEQYGSVSTNDVERDGNR

SEQ ID NO: 22791 - protein, 28 aa, Artificial Sequence
  Description of Artificial Sequence: Synthetic peptide
DEQEIRTTNPVATEQYGSVSTNDQRENI

SEQ ID NO: 22792 - protein, 30 aa, Artificial Sequence
  Description of Artificial Sequence: Synthetic polypeptide
DEEEIRTTNPVATEQYGSVSTDLQVVGDNR

SEQ ID NO: 22793 - protein, 28 aa, Artificial Sequence
  Description of Artificial Sequence: Synthetic peptide
DEQEIRCTNPVATELYGCVSTNLQRGNR

SEQ ID NO: 22794 - protein, 28 aa, Artificial Sequence
  Description of Artificial Sequence: Synthetic peptide
DEEEIRTTNPVASEIYGCVSTNLERGNR

SEQ ID NO: 22795 - protein, 28 aa, Artificial Sequence
  Description of Artificial Sequence: Synthetic peptide
DEEEIRTTNPVATEQYGSVSTALDTDNR

SEQ ID NO: 22796 - protein, 28 aa, Artificial Sequence
  Description of Artificial Sequence: Synthetic peptide
DEVEIRTTNPVATEQYGSVSDVLQRGGR

SEQ ID NO: 22797 - protein, 29 aa, Artificial Sequence
  Description of Artificial Sequence: Synthetic peptide
DEDEVRTTNPVATEPYGSVSATNLQRGNR

SEQ ID NO: 22798 - protein, 29 aa, Artificial Sequence
  Description of Artificial Sequence: Synthetic peptide
DEEEIRTTNPVATEQYGCSVDTALFRGNR

SEQ ID NO: 22799 - protein, 28 aa, Artificial Sequence
  Description of Artificial Sequence: Synthetic peptide
DEEEIRTVNPVSTEQYGSVSTDLQRGNN

SEQ ID NO: 22800 - protein, 28 aa, Artificial Sequence
  Description of Artificial Sequence: Synthetic peptide
DEQEIRTTNPVATEQYGSVSTDLQDGER

SEQ ID NO: 22801 - protein, 28 aa, Artificial Sequence
  Description of Artificial Sequence: Synthetic peptide
DEEEIRTTNPVATEQYGSVDTDLQQGNN

SEQ ID NO: 22802 - protein, 28 aa, Artificial Sequence
  Description of Artificial Sequence: Synthetic peptide
DEEEIRTTNPVATEQYGSHSTMLQRSQR

SEQ ID NO: 22803 - protein, 28 aa, Artificial Sequence
  Description of Artificial Sequence: Synthetic peptide
DEEEISTTNPVATEQYGWASTNLQRGGR

SEQ ID NO: 22804 - protein, 28 aa, Artificial Sequence
  Description of Artificial Sequence: Synthetic peptide
DEEEIRTTNPVATEQYGSVSENEQQGNA

SEQ ID NO: 22805 - protein, 29 aa, Artificial Sequence
  Description of Artificial Sequence: Synthetic peptide
DEQEIRTTNPVATEGYGEVSTNLQRAGNR

SEQ ID NO: 22806 - protein, 30 aa, Artificial Sequence
  Description of Artificial Sequence: Synthetic polypeptide
DEEEIRTTNPVATEQYGSVSTNLEDRGEDR

SEQ ID NO: 22807 - protein, 28 aa, Artificial Sequence
  Description of Artificial Sequence: Synthetic peptide
DEEEIRATNPVATEQYGSVSTDLQLGNS

SEQ ID NO: 22808 - protein, 28 aa, Artificial Sequence
  Description of Artificial Sequence: Synthetic peptide
GEEEIRTTNPVASEMYGSVSTNLQQGNR

SEQ ID NO: 22809 - protein, 29 aa, Artificial Sequence
  Description of Artificial Sequence: Synthetic peptide
DEEEIRTTNPVATECYGSVSENLQMRGNF

SEQ ID NO: 22810 - protein, 30 aa, Artificial Sequence
  Description of Artificial Sequence: Synthetic polypeptide
DEEEIRTTNPVATEQYGSVSTNLQDDGNDL

SEQ ID NO: 22811 - protein, 31 aa, Artificial Sequence
  Description of Artificial Sequence: Synthetic polypeptide
DEEEIRTTNPVATEQYGCVHSITENLQRGNR

SEQ ID NO: 22812 - protein, 30 aa, Artificial Sequence
  Description of Artificial Sequence: Synthetic polypeptide
DEEEIRTTNPVAWEQYGSVSTPNLDRGDNR

SEQ ID NO: 22813 - protein, 30 aa, Artificial Sequence
  Description of Artificial Sequence: Synthetic polypeptide
DEEEIRTTNPVATEQYGSVDSTEDQRGDNR

SEQ ID NO: 22814 - protein, 30 aa, Artificial Sequence
  Description of Artificial Sequence: Synthetic polypeptide
DEEEIRTTNPVATEQYGSVSTNLQEHGEDR

SEQ ID NO: 22815 - protein, 28 aa, Artificial Sequence
  Description of Artificial Sequence: Synthetic peptide
DENEIRATNPVATEHYGVVSTNLQRGNR

SEQ ID NO: 22816 - protein, 30 aa, Artificial Sequence
  Description of Artificial Sequence: Synthetic polypeptide
DEEEIRTTNPVATEQYGSVSTNLQERGMEM

SEQ ID NO: 22817 - protein, 29 aa, Artificial Sequence
  Description of Artificial Sequence: Synthetic peptide
QEEEIRQTNPVATEQYGSVSTVLQRAGNR

SEQ ID NO: 22818 - protein, 31 aa, Artificial Sequence
  Description of Artificial Sequence: Synthetic polypeptide
DEEEIRTTNPVATEQYGSVSTNLQDREGNDT

SEQ ID NO: 22819 - protein, 28 aa, Artificial Sequence
  Description of Artificial Sequence: Synthetic peptide
DEEEIRSTNPVATEQYGSVSTNDEMGNR

SEQ ID NO: 22820 - protein, 29 aa, Artificial Sequence
  Description of Artificial Sequence: Synthetic peptide
DEEEIRTTNPVATEQYGDVSTMNLQRGTF

SEQ ID NO: 22821 - protein, 31 aa, Artificial Sequence
  Description of Artificial Sequence: Synthetic polypeptide
DEEEIRTTNPVATEQYGSVCSTNLQCRENDR

SEQ ID NO: 22822 - protein, 28 aa, Artificial Sequence
  Description of Artificial Sequence: Synthetic peptide
DEEEIRTTNPTAYEWYGSVSTNLQVGNR

SEQ ID NO: 22823 - protein, 30 aa, Artificial Sequence
  Description of Artificial Sequence: Synthetic polypeptide
DEEEIRTTNPVATEQYGDVSCENLQCRGNR

SEQ ID NO: 22824 - protein, 32 aa, Artificial Sequence
  Description of Artificial Sequence: Synthetic polypeptide
DEEEIRTTNPVATEQYGSVDSETNLQDREGNR

SEQ ID NO: 22825 - protein, 28 aa, Artificial Sequence
  Description of Artificial Sequence: Synthetic peptide
DENEIRTVNPVATEQYGSVSTNLQTGNS

SEQ ID NO: 22826 - protein, 28 aa, Artificial Sequence
  Description of Artificial Sequence: Synthetic peptide
DEQEIRTTNPIATEQYGWVSTNLERGNR

SEQ ID NO: 22827 - protein, 30 aa, Artificial Sequence
  Description of Artificial Sequence: Synthetic polypeptide
DEEEIRTTNPVATEQYGSVSTNLDRLGNND

SEQ ID NO: 22828 - protein, 28 aa, Artificial Sequence
  Description of Artificial Sequence: Synthetic peptide
DEEEIRTTNPTATEQYGSVSTNPQLGNG

SEQ ID NO: 22829 - protein, 28 aa, Artificial Sequence
  Description of Artificial Sequence: Synthetic peptide
DEQECRTTNPVATEQYGSVSTNLQHGNT

SEQ ID NO: 22830 - protein, 28 aa, Artificial Sequence
  Description of Artificial Sequence: Synthetic peptide
DEEEIRTTNPVATECYGSVSTDLQIGNH

SEQ ID NO: 22831 - protein, 28 aa, Artificial Sequence
  Description of Artificial Sequence: Synthetic peptide
DEDEIRTTNPVATEIYGAVATNLQRGNR

SEQ ID NO: 22832 - protein, 28 aa, Artificial Sequence
  Description of Artificial Sequence: Synthetic peptide
DENEIRQTNPVATEQYGSVSTDLQRGNL

SEQ ID NO: 22833 - protein, 29 aa, Artificial Sequence
  Description of Artificial Sequence: Synthetic peptide
DEEEIISTNPVATEQYGSVSCNLQRAGNR

SEQ ID NO: 22834 - protein, 28 aa, Artificial Sequence
  Description of Artificial Sequence: Synthetic peptide
DENEIRQTNPVATEQYGSVSTNQQDGNR

SEQ ID NO: 22835 - protein, 29 aa, Artificial Sequence
  Description of Artificial Sequence: Synthetic peptide
AEEEIRTTNPVATEQYGSVDTDLQLRGNR

SEQ ID NO: 22836 - protein, 29 aa, Artificial Sequence
  Description of Artificial Sequence: Synthetic peptide
DEEEIRTTNPVATEQYGSVSTDLQREGEA

SEQ ID NO: 22837 - protein, 28 aa, Artificial Sequence
  Description of Artificial Sequence: Synthetic peptide
DEEEIRTTNPVATEVYGSVGNNLQRGNQ

SEQ ID NO: 22838 - protein, 31 aa, Artificial Sequence
  Description of Artificial Sequence: Synthetic polypeptide
DEEEIRTTNPVATEQYGSVSTGNLQIRGDNY

SEQ ID NO: 22839 - protein, 28 aa, Artificial Sequence
  Description of Artificial Sequence: Synthetic peptide
DDEEIRTTNPEATEQYGSVSTNIQAGNR

SEQ ID NO: 22840 - protein, 29 aa, Artificial Sequence
  Description of Artificial Sequence: Synthetic peptide
DEEPIRTTNPVATIQYGSVSTNLTRGLNR

SEQ ID NO: 22841 - protein, 30 aa, Artificial Sequence
  Description of Artificial Sequence: Synthetic polypeptide
DEEEIRTTNPVATEQYGSVCSCTNLQHGNN

SEQ ID NO: 22842 - protein, 29 aa, Artificial Sequence
  Description of Artificial Sequence: Synthetic peptide
DEEEIRTTNPVATEQYGSVSTDLQIKGNT

SEQ ID NO: 22843 - protein, 30 aa, Artificial Sequence
  Description of Artificial Sequence: Synthetic polypeptide
DENEIRTTNPVATEQYGSVSTNLQERQENR

SEQ ID NO: 22844 - protein, 28 aa, Artificial Sequence
  Description of Artificial Sequence: Synthetic peptide
DEEEIRTTNPVCTEQYGSVDTNEQRGNF

SEQ ID NO: 22845 - protein, 28 aa, Artificial Sequence
  Description of Artificial Sequence: Synthetic peptide
DEQEITTTNPVATEQYGSVSTDLQRGNA

SEQ ID NO: 22846 - protein, 28 aa, Artificial Sequence
  Description of Artificial Sequence: Synthetic peptide
DEEEIRTTNPVATELYGSVSTNEMRGNW

SEQ ID NO: 22847 - protein, 28 aa, Artificial Sequence
  Description of Artificial Sequence: Synthetic peptide
DEVELRTTNPVATEQYGSVSTNLQHGNT

SEQ ID NO: 22848 - protein, 31 aa, Artificial Sequence
  Description of Artificial Sequence: Synthetic polypeptide
DEEEIRTTNPVATEQYGSVSTNGGQRGDNDR

SEQ ID NO: 22849 - protein, 28 aa, Artificial Sequence
  Description of Artificial Sequence: Synthetic peptide
DEQEIRTTNPVATEQYGSVSTNLERGEG

SEQ ID NO: 22850 - protein, 30 aa, Artificial Sequence
  Description of Artificial Sequence: Synthetic polypeptide
AEEEIATTNPVATEQYGSVSTNLVQLRGNR

SEQ ID NO: 22851 - protein, 30 aa, Artificial Sequence
  Description of Artificial Sequence: Synthetic polypeptide
DEEEIRTTNPVATEQFGSVSTANLQQGNDR

SEQ ID NO: 22852 - protein, 30 aa, Artificial Sequence
  Description of Artificial Sequence: Synthetic polypeptide
DENEIRTTNPVATEQYGSVSTTNQQRGNDR

SEQ ID NO: 22853 - protein, 30 aa, Artificial Sequence
  Description of Artificial Sequence: Synthetic polypeptide
DEEEIRTTNPVATEQYGSVSTNLQDRGEDA

SEQ ID NO: 22854 - protein, 28 aa, Artificial Sequence
  Description of Artificial Sequence: Synthetic peptide
QENEIRTTNPVATEQYGDVSENLQRGNR

SEQ ID NO: 22855 - protein, 30 aa, Artificial Sequence
  Description of Artificial Sequence: Synthetic polypeptide
DEEEIRTTNPVATEQYGSVDSTNLQREGDP

SEQ ID NO: 22856 - protein, 28 aa, Artificial Sequence
  Description of Artificial Sequence: Synthetic peptide
DEEEIRTTNPVATEQYGSVDTDLQTGNE

SEQ ID NO: 22857 - protein, 28 aa, Artificial Sequence
  Description of Artificial Sequence: Synthetic peptide
DENELNTTNPVATEQYGSASTNLQRGNR

SEQ ID NO: 22858 - protein, 29 aa, Artificial Sequence
  Description of Artificial Sequence: Synthetic peptide
DEEEIRTTNPVATEQYGEVSTMNLQRGDA

SEQ ID NO: 22859 - protein, 28 aa, Artificial Sequence
  Description of Artificial Sequence: Synthetic peptide
DEEEIRTTNIVATEQYGSVATNLDAGNR

SEQ ID NO: 22860 - protein, 28 aa, Artificial Sequence
  Description of Artificial Sequence: Synthetic peptide
DEQEIRTTNPVATENYGCVSTGLQRGNR

SEQ ID NO: 22861 - protein, 28 aa, Artificial Sequence
  Description of Artificial Sequence: Synthetic peptide
MEEEIRTTNPVATEQYGSVATNLQVGNL

SEQ ID NO: 22862 - protein, 28 aa, Artificial Sequence
  Description of Artificial Sequence: Synthetic peptide
DEEEIRCTNPVATETYGDVSTILQRGNR

SEQ ID NO: 22863 - protein, 28 aa, Artificial Sequence
  Description of Artificial Sequence: Synthetic peptide
DEEEIRTTNPVATECYGSVSTDLQAGNH

SEQ ID NO: 22864 - protein, 28 aa, Artificial Sequence
  Description of Artificial Sequence: Synthetic peptide
SEVEIRTTNPVATEQYGGVSENLQRGNR

SEQ ID NO: 22865 - protein, 28 aa, Artificial Sequence
  Description of Artificial Sequence: Synthetic peptide
DEVEIRTTNPVATEQFGSVSTNLQRGDF

SEQ ID NO: 22866 - protein, 28 aa, Artificial Sequence
  Description of Artificial Sequence: Synthetic peptide
DEEEIATTNIVATEIYGSVSTNEQRGNR

SEQ ID NO: 22867 - protein, 28 aa, Artificial Sequence
  Description of Artificial Sequence: Synthetic peptide
QEEEIRTTNPVATENYGNVSTNLQRGNT

SEQ ID NO: 22868 - protein, 29 aa, Artificial Sequence
  Description of Artificial Sequence: Synthetic peptide
DEEEIRTTNPVATEQYGSASTCPQRGVNR

SEQ ID NO: 22869 - protein, 28 aa, Artificial Sequence
  Description of Artificial Sequence: Synthetic peptide
DENEIRTTNPVATEVWGSVSTNLQRGNA

SEQ ID NO: 22870 - protein, 28 aa, Artificial Sequence
  Description of Artificial Sequence: Synthetic peptide
DEEEIRTTNPCATEQYGSVSTELQLGNS

SEQ ID NO: 22871 - protein, 30 aa, Artificial Sequence
  Description of Artificial Sequence: Synthetic polypeptide
DEEEIRTTNPVATEQYGSVSTTNLQDDGND

SEQ ID NO: 22872 - protein, 30 aa, Artificial Sequence
  Description of Artificial Sequence: Synthetic polypeptide
DEEEIRTTNPVATEQYGSVSTNGDQESGNR

SEQ ID NO: 22873 - protein, 28 aa, Artificial Sequence
  Description of Artificial Sequence: Synthetic peptide
GEEEIGGTNPVATEQYGDVSTNLQRGNR

SEQ ID NO: 22874 - protein, 28 aa, Artificial Sequence
  Description of Artificial Sequence: Synthetic peptide
DEEEIRTTNPVATEQYGDVSENLQNGER

SEQ ID NO: 22875 - protein, 28 aa, Artificial Sequence
  Description of Artificial Sequence: Synthetic peptide
KEEEIRTTNPVATETYGAVSENLQRGNR

SEQ ID NO: 22876 - protein, 31 aa, Artificial Sequence
  Description of Artificial Sequence: Synthetic polypeptide
DEEEIRTTNPVATEQYGSVCSDTNLQRGDER

SEQ ID NO: 22877 - protein, 28 aa, Artificial Sequence
  Description of Artificial Sequence: Synthetic peptide
DEEEIRTTNPVATEIYGSVSTNLQRLEN

SEQ ID NO: 22878 - protein, 28 aa, Artificial Sequence
  Description of Artificial Sequence: Synthetic peptide
DEEEIMATNPVATEQYGSVSVNLQRGNL

SEQ ID NO: 22879 - protein, 28 aa, Artificial Sequence
  Description of Artificial Sequence: Synthetic peptide
DEEEIRTTNPVATECYGSVSTNLEIGER

SEQ ID NO: 22880 - protein, 28 aa, Artificial Sequence
  Description of Artificial Sequence: Synthetic peptide
DEEEIRTTNPCATELYGCVSTNLQRGNS

SEQ ID NO: 22881 - protein, 28 aa, Artificial Sequence
  Description of Artificial Sequence: Synthetic peptide
DENEIRTTNIVATEQYGSVSTNDQAGNR

SEQ ID NO: 22882 - protein, 29 aa, Artificial Sequence
  Description of Artificial Sequence: Synthetic peptide
SEEEIRTTNPVATEQYGSVSTNLQLQGDR

SEQ ID NO: 22883 - protein, 28 aa, Artificial Sequence
  Description of Artificial Sequence: Synthetic peptide
DEQEIRTTNPCATEQYGSVSTNLQIGND

SEQ ID NO: 22884 - protein, 28 aa, Artificial Sequence
  Description of Artificial Sequence: Synthetic peptide
DEEEIRTTNIVATEQYGSVSTDLQVGND

SEQ ID NO: 22885 - protein, 28 aa, Artificial Sequence
  Description of Artificial Sequence: Synthetic peptide
DEEEIRTTNPVATEQYGSVSTDLQMGEM

SEQ ID NO: 22886 - protein, 30 aa, Artificial Sequence
  Description of Artificial Sequence: Synthetic polypeptide
DEEEIRTTNPVATEQYGSVSATNLQDVGNF

SEQ ID NO: 22887 - protein, 28 aa, Artificial Sequence
  Description of Artificial Sequence: Synthetic peptide
DEHEIRTTNPIATEQYGSVSTILQRGNH

SEQ ID NO: 22888 - protein, 28 aa, Artificial Sequence
  Description of Artificial Sequence: Synthetic peptide
DENEIRTTNPVATEVYGSVSTNLQYGNS

SEQ ID NO: 22889 - protein, 28 aa, Artificial Sequence
  Description of Artificial Sequence: Synthetic peptide
DEEEIRTTNIVATEQYGSVSTDLQTGQR

SEQ ID NO: 22890 - protein, 28 aa, Artificial Sequence
  Description of Artificial Sequence: Synthetic peptide
DEEEIRTTNPVATECYGFVSENLQRGNP

SEQ ID NO: 22891 - protein, 29 aa, Artificial Sequence
  Description of Artificial Sequence: Synthetic peptide
DEEEIRTTNPVATECYGSVSTNLQNEGNM

SEQ ID NO: 22892 - protein, 28 aa, Artificial Sequence
  Description of Artificial Sequence: Synthetic peptide
GEEEIYTTNPVATEVYGSVSTNLQRGND

SEQ ID NO: 22893 - protein, 28 aa, Artificial Sequence
  Description of Artificial Sequence: Synthetic peptide
DEEEIATTNPVATEQYGSVSTDLQRGEN

SEQ ID NO: 22894 - protein, 28 aa, Artificial Sequence
  Description of Artificial Sequence: Synthetic peptide
DEEEIRTTNPIATEVYGSVSNNLERGNR

SEQ ID NO: 22895 - protein, 28 aa, Artificial Sequence
  Description of Artificial Sequence: Synthetic peptide
DEEEIRTTNPVASEQYGSVANNLQRGMR

SEQ ID NO: 22896 - protein, 28 aa, Artificial Sequence
  Description of Artificial Sequence: Synthetic peptide
DEEEIRTTNPTATEQYGSVSTNPQQGNE

SEQ ID NO: 22897 - protein, 28 aa, Artificial Sequence
  Description of Artificial Sequence: Synthetic peptide
SEEEIRTTNIVATEQYGSVSTNLERGDR

SEQ ID NO: 22898 - protein, 28 aa, Artificial Sequence
  Description of Artificial Sequence: Synthetic peptide
DENEIRATNPVATECYGSVSTELQRGNR

SEQ ID NO: 22899 - protein, 29 aa, Artificial Sequence
  Description of Artificial Sequence: Synthetic peptide
DEEEIRTTNPVATEQYGQVSTNLQCFGND

SEQ ID NO: 22900 - protein, 28 aa, Artificial Sequence
  Description of Artificial Sequence: Synthetic peptide
DEQEIRTTNPVATEQYGSVDTDLQHGNR

SEQ ID NO: 22901 - protein, 30 aa, Artificial Sequence
  Description of Artificial Sequence: Synthetic polypeptide
DEEEIRTTNPVATEQYGSASATENLQRMNR

SEQ ID NO: 22902 - protein, 30 aa, Artificial Sequence
  Description of Artificial Sequence: Synthetic polypeptide
DNEEIRTTNPVATHQYGSVSTNLQYRLGNR

SEQ ID NO: 22903 - protein, 29 aa, Artificial Sequence
  Description of Artificial Sequence: Synthetic peptide
DEEEIRTTNPVATECYGSVSTNLQLAGTR

SEQ ID NO: 22904 - protein, 30 aa, Artificial Sequence
  Description of Artificial Sequence: Synthetic polypeptide
DEEEIRTTNPVATEQYGDVSCTNLQNGHNR

SEQ ID NO: 22905 - protein, 31 aa, Artificial Sequence
  Description of Artificial Sequence: Synthetic polypeptide
DEEEIRTTNPVATEQYGSVSTMNLQILGVNR

SEQ ID NO: 22906 - protein, 28 aa, Artificial Sequence
  Description of Artificial Sequence: Synthetic peptide
DEEEIRTTNPVATEQYGFVSTNIQLGNQ

SEQ ID NO: 22907 - protein, 28 aa, Artificial Sequence
  Description of Artificial Sequence: Synthetic peptide
SEEEIRTTNPVATQQYGSVSTNLQDGNP

SEQ ID NO: 22908 - protein, 28 aa, Artificial Sequence
  Description of Artificial Sequence: Synthetic peptide
QESEIRTTNPVATEQYGSVSTNLERGNM

SEQ ID NO: 22909 - protein, 30 aa, Artificial Sequence
  Description of Artificial Sequence: Synthetic polypeptide
DEEEIRTTNPVATEQYGSVAMVNLDQRGNR

SEQ ID NO: 22910 - protein, 28 aa, Artificial Sequence
  Description of Artificial Sequence: Synthetic peptide
DEEEIRTTNPVATEQYGSVSTNLENGEF

SEQ ID NO: 22911 - protein, 29 aa, Artificial Sequence
  Description of Artificial Sequence: Synthetic peptide
DEEEIRTTNPVATEQYGSVSTDLQDNGND

SEQ ID NO: 22912 - protein, 28 aa, Artificial Sequence
  Description of Artificial Sequence: Synthetic peptide
DEEEIRTTNPVATEQYGSVHTPLIRGTR

SEQ ID NO: 22913 - protein, 28 aa, Artificial Sequence
  Description of Artificial Sequence: Synthetic peptide
DEEEIRCTNPVATEWYGSVSTNDQRGNY

SEQ ID NO: 22914 - protein, 28 aa, Artificial Sequence
  Description of Artificial Sequence: Synthetic peptide
DEEEIRATNIVATEQYGSVSTNLQIGNT

SEQ ID NO: 22915 - protein, 28 aa, Artificial Sequence
  Description of Artificial Sequence: Synthetic peptide
DEEEIRTTNPVATEQYGSVSTNLHAGEL

SEQ ID NO: 22916 - protein, 30 aa, Artificial Sequence
  Description of Artificial Sequence: Synthetic polypeptide
DEEEIRTTNPVATEQYGSASTNLQIREFNR

SEQ ID NO: 22917 - protein, 28 aa, Artificial Sequence
  Description of Artificial Sequence: Synthetic peptide
DEEEIRTTNPVATEQYGEVSENLQQGNF

SEQ ID NO: 22918 - protein, 28 aa, Artificial Sequence
  Description of Artificial Sequence: Synthetic peptide
DEEEIRTTNPVATEQYGSWSDNEDRGNR

SEQ ID NO: 22919 - protein, 29 aa, Artificial Sequence
  Description of Artificial Sequence: Synthetic peptide
DECEIRATNPVATEQYGSVSTDLQRGNDR

SEQ ID NO: 22920 - protein, 29 aa, Artificial Sequence
  Description of Artificial Sequence: Synthetic peptide
DEEEIRTTNPVATEQYGSVSTNLEDRGEL

SEQ ID NO: 22921 - protein, 28 aa, Artificial Sequence
  Description of Artificial Sequence: Synthetic peptide
DEEEIRCTNPVATEQYGSVSTNWQQGNV

SEQ ID NO: 22922 - protein, 28 aa, Artificial Sequence
  Description of Artificial Sequence: Synthetic peptide
DEFEIVTTNPVATEQYGSVADNLQRGNR

SEQ ID NO: 22923 - protein, 28 aa, Artificial Sequence
  Description of Artificial Sequence: Synthetic peptide
DEEEIATTNPVATEQYGSHSWPLQRGNR

SEQ ID NO: 22924 - protein, 30 aa, Artificial Sequence
  Description of Artificial Sequence: Synthetic polypeptide
DEEEIRTTNPVATECYGSVSTNPQERGNDR

SEQ ID NO: 22925 - protein, 29 aa, Artificial Sequence
  Description of Artificial Sequence: Synthetic peptide
QEEEIRTVNPVATEQYGEVSTNLQRAGNR

SEQ ID NO: 22926 - protein, 30 aa, Artificial Sequence
  Description of Artificial Sequence: Synthetic polypeptide
DEEEIRTTNPVATEQYGSVSTTQNLNRGNI

SEQ ID NO: 22927 - protein, 30 aa, Artificial Sequence
  Description of Artificial Sequence: Synthetic polypeptide
DEEEIRTTNPVATEQYGSVSTEPLQITGNR

SEQ ID NO: 22928 - protein, 28 aa, Artificial Sequence
  Description of Artificial Sequence: Synthetic peptide
DEEEVRTTNPVATEHYGSVASNLQRGNR

SEQ ID NO: 22929 - protein, 28 aa, Artificial Sequence
  Description of Artificial Sequence: Synthetic peptide
AEEEIRTTNPVATEQYGSVSENLQVGER

SEQ ID NO: 22930 - protein, 28 aa, Artificial Sequence
  Description of Artificial Sequence: Synthetic peptide
GEQEIRTTNPVATEQYGSVSTNLQNGNN

SEQ ID NO: 22931 - protein, 29 aa, Artificial Sequence
  Description of Artificial Sequence: Synthetic peptide
SEEEIRTTNPVATEQYGGVSENLQRGDNR

SEQ ID NO: 22932 - protein, 31 aa, Artificial Sequence
  Description of Artificial Sequence: Synthetic polypeptide
DEEEIRTTNPVATEQYGSVSCEMNLQRGNDR

SEQ ID NO: 22933 - protein, 28 aa, Artificial Sequence
  Description of Artificial Sequence: Synthetic peptide
DEEEIRTTNPVATEQYGSVSTGLENGNE

SEQ ID NO: 22934 - protein, 28 aa, Artificial Sequence
  Description of Artificial Sequence: Synthetic peptide
DEEEIRTTNPCATEQYGEVSENLQDGNR

SEQ ID NO: 22935 - protein, 29 aa, Artificial Sequence
  Description of Artificial Sequence: Synthetic peptide
DMEEIRTTNPVATEQYGSVSTNLQQGNSM

SEQ ID NO: 22936 - protein, 28 aa, Artificial Sequence
  Description of Artificial Sequence: Synthetic peptide
DEEEIRTTNIVATECYGSVSTNLQVGER

SEQ ID NO: 22937 - protein, 28 aa, Artificial Sequence
  Description of Artificial Sequence: Synthetic peptide
DEEELRTTNPVATEQYGSVSTNLQGGEC

SEQ ID NO: 22938 - protein, 28 aa, Artificial Sequence
  Description of Artificial Sequence: Synthetic peptide
DEEEIVATNPVATEMYGVVSTNLQRGNR

SEQ ID NO: 22939 - protein, 28 aa, Artificial Sequence
  Description of Artificial Sequence: Synthetic peptide
DEEEIRTTNPEATQQYGSVSTNLQRENT

SEQ ID NO: 22940 - protein, 30 aa, Artificial Sequence
  Description of Artificial Sequence: Synthetic polypeptide
DEEEIRTTNPVATEQYGSVSTNDERNGENR

SEQ ID NO: 22941 - protein, 28 aa, Artificial Sequence
  Description of Artificial Sequence: Synthetic peptide
DEQEITTTNPVATEQYGSVDTNDQRGNR

SEQ ID NO: 22942 - protein, 29 aa, Artificial Sequence
  Description of Artificial Sequence: Synthetic peptide
DEEEIRTTNPVATEQYGSVSTNPQLGNTG

SEQ ID NO: 22943 - protein, 28 aa, Artificial Sequence
  Description of Artificial Sequence: Synthetic peptide
DEMEVRSTNPVATEQYGSVSTNLQNGNR

SEQ ID NO: 22944 - protein, 29 aa, Artificial Sequence
  Description of Artificial Sequence: Synthetic peptide
DEEEIRTTNPVATEQYGSVSENLQGSGNW

SEQ ID NO: 22945 - protein, 28 aa, Artificial Sequence
  Description of Artificial Sequence: Synthetic peptide
DEEEIRMTNPVATEQYGSVSTNLDYGNT

SEQ ID NO: 22946 - protein, 28 aa, Artificial Sequence
  Description of Artificial Sequence: Synthetic peptide
DEQEIRTTNPVATEQYGSVSTNWQYGNG

SEQ ID NO: 22947 - protein, 28 aa, Artificial Sequence
  Description of Artificial Sequence: Synthetic peptide
DEQEIATTNPVATEIYGAVSTNLQRGNR

SEQ ID NO: 22948 - protein, 28 aa, Artificial Sequence
  Description of Artificial Sequence: Synthetic peptide
NEEEIRTTNPVATELYGSVSSNLERGNR

SEQ ID NO: 22949 - protein, 28 aa, Artificial Sequence
  Description of Artificial Sequence: Synthetic peptide
DEQEIRTTNPVATEQYGSVSDNLERGER

SEQ ID NO: 22950 - protein, 28 aa, Artificial Sequence
  Description of Artificial Sequence: Synthetic peptide
DEEEIRTTNIVATEQYGSVSTNLGHGNG

SEQ ID NO: 22951 - protein, 28 aa, Artificial Sequence
  Description of Artificial Sequence: Synthetic peptide
DEEEIRTTNPVATEQYGSVSEDLQVGNF

SEQ ID NO: 22952 - protein, 30 aa, Artificial Sequence
  Description of Artificial Sequence: Synthetic polypeptide
DEEEIRTTNPVAFEQYGSVSTNLPQRDENR

SEQ ID NO: 22953 - protein, 29 aa, Artificial Sequence
  Description of Artificial Sequence: Synthetic peptide
DEEEIRTTNPVATEQYGSVSTEEQPNGNR

SEQ ID NO: 22954 - protein, 28 aa, Artificial Sequence
  Description of Artificial Sequence: Synthetic peptide
HEEEVSTTNPVATEQYGSVSTNLQGGNR

SEQ ID NO: 22955 - protein, 28 aa, Artificial Sequence
  Description of Artificial Sequence: Synthetic peptide
DEEEIRTTNPVATEQYGSVSTELQMGDE

SEQ ID NO: 22956 - protein, 29 aa, Artificial Sequence
  Description of Artificial Sequence: Synthetic peptide
DEEEIRTTNPVATEQYGESVSTNDQQGNE

SEQ ID NO: 22957 - protein, 30 aa, Artificial Sequence
  Description of Artificial Sequence: Synthetic polypeptide
DEEEIRTTNPVATEQYGWVSTNPLQMRGLR

SEQ ID NO: 22958 - protein, 28 aa, Artificial Sequence
  Description of Artificial Sequence: Synthetic peptide
DECEIRTTNPVATEQYGSVETNLQQGNH

SEQ ID NO: 22959 - protein, 30 aa, Artificial Sequence
  Description of Artificial Sequence: Synthetic polypeptide
DEEEIRTTNPVATEQYGSVSATNLQVGNDD

SEQ ID NO: 22960 - protein, 29 aa, Artificial Sequence
  Description of Artificial Sequence: Synthetic peptide
DEEEIRTTNPVATEQYGSVSTGDLQRGDH

SEQ ID NO: 22961 - protein, 28 aa, Artificial Sequence
  Description of Artificial Sequence: Synthetic peptide
DEEEIRTTNPVATEQYGSVSENLQLGDM

SEQ ID NO: 22962 - protein, 28 aa, Artificial Sequence
  Description of Artificial Sequence: Synthetic peptide
MEEEIRTTNPVATEQYGSADTNLIRGNR

SEQ ID NO: 22963 - protein, 29 aa, Artificial Sequence
  Description of Artificial Sequence: Synthetic peptide
DEEEIATTNPVATEQYGSVSTMNEQRGNV

SEQ ID NO: 22964 - protein, 29 aa, Artificial Sequence
  Description of Artificial Sequence: Synthetic peptide
DEEEIRTTNPVATEQYGSVDETDLQRGNY

SEQ ID NO: 22965 - protein, 30 aa, Artificial Sequence
  Description of Artificial Sequence: Synthetic polypeptide
AEEEIRTTNPVATEQYGDVSTNLQRGINDR

SEQ ID NO: 22966 - protein, 28 aa, Artificial Sequence
  Description of Artificial Sequence: Synthetic peptide
DEEEIRTTNIVATEQYGSVSTNLDRGET

SEQ ID NO: 22967 - protein, 28 aa, Artificial Sequence
  Description of Artificial Sequence: Synthetic peptide
DEEEIRTTNPVATEQYGSVSTNDQPGED

SEQ ID NO: 22968 - protein, 28 aa, Artificial Sequence
  Description of Artificial Sequence: Synthetic peptide
DEEEIRTTNPVATEQYGSVSTEDETGNR

SEQ ID NO: 22969 - protein, 28 aa, Artificial Sequence
  Description of Artificial Sequence: Synthetic peptide
DEEEIRTTNPVATEQYGSVSTDLQYGEN

SEQ ID NO: 22970 - protein, 30 aa, Artificial Sequence
  Description of Artificial Sequence: Synthetic polypeptide
DEEEIRTTNPVATEQYGSVDCENLQRGNDR

SEQ ID NO: 22971 - protein, 28 aa, Artificial Sequence
  Description of Artificial Sequence: Synthetic peptide
DEEEIRTTNPVATEQYGSVSEEDQRGNM

SEQ ID NO: 22972 - protein, 29 aa, Artificial Sequence
  Description of Artificial Sequence: Synthetic peptide
DAEEIRTTNPTATEQYGSVMSTNLQRGNI

SEQ ID NO: 22973 - protein, 28 aa, Artificial Sequence
  Description of Artificial Sequence: Synthetic peptide
DEEEITTTNPVATECYGSVSTNLQLGER

SEQ ID NO: 22974 - protein, 30 aa, Artificial Sequence
  Description of Artificial Sequence: Synthetic polypeptide
DEEEIRTTNPVATEQYGSVSTMDLQHGNDR

SEQ ID NO: 22975 - protein, 29 aa, Artificial Sequence
  Description of Artificial Sequence: Synthetic peptide
DEEEIRTTNPVATEQYGSVSTNLQDTGDE

SEQ ID NO: 22976 - protein, 30 aa, Artificial Sequence
  Description of Artificial Sequence: Synthetic polypeptide
SEEEIRTTNPVATEQFGSVSTNLPQRGNDR

SEQ ID NO: 22977 - protein, 29 aa, Artificial Sequence
  Description of Artificial Sequence: Synthetic peptide
DEQEIRTTNPVATECYGSVSTNLQRGNEF

SEQ ID NO: 22978 - protein, 28 aa, Artificial Sequence
  Description of Artificial Sequence: Synthetic peptide
DEEEIRTTNPVATEQYGSVSTDLQVGEA

SEQ ID NO: 22979 - protein, 28 aa, Artificial Sequence
  Description of Artificial Sequence: Synthetic peptide
DEEEIRTTNPVATEQYGSVSYNWQYGNS

SEQ ID NO: 22980 - protein, 30 aa, Artificial Sequence
  Description of Artificial Sequence: Synthetic polypeptide
DEEEIRTTNPVATEQYGSVSTNLQELEGNM

SEQ ID NO: 22981 - protein, 28 aa, Artificial Sequence
  Description of Artificial Sequence: Synthetic peptide
DEEEIRTVNPVATEQYGWVSENLQRDNR

SEQ ID NO: 22982 - protein, 29 aa, Artificial Sequence
  Description of Artificial Sequence: Synthetic peptide
DEEEIRQTNPVATEQYGSVGTNLQHAGNR

SEQ ID NO: 22983 - protein, 28 aa, Artificial Sequence
  Description of Artificial Sequence: Synthetic peptide
DENEIRATNPVATEVYGTVSTNLQRGNR

SEQ ID NO: 22984 - protein, 28 aa, Artificial Sequence
  Description of Artificial Sequence: Synthetic peptide
DEEEIRTTNPVATECWGSVSTNLMRGNA

SEQ ID NO: 22985 - protein, 30 aa, Artificial Sequence
  Description of Artificial Sequence: Synthetic polypeptide
DEEEIRTTNPVATAQYGSVSTELQRNGENR

SEQ ID NO: 22986 - protein, 28 aa, Artificial Sequence
  Description of Artificial Sequence: Synthetic peptide
DEEEIRTTNPEATEQYGSVSTNDQRGEM

SEQ ID NO: 22987 - protein, 28 aa, Artificial Sequence
  Description of Artificial Sequence: Synthetic peptide
DEEEIRTTNPVATEQYGSVDTNEQREDR

SEQ ID NO: 22988 - protein, 28 aa, Artificial Sequence
  Description of Artificial Sequence: Synthetic peptide
DEQEIRTTNPVATEQWGSVSTNLMRGNP

SEQ ID NO: 22989 - protein, 28 aa, Artificial Sequence
  Description of Artificial Sequence: Synthetic peptide
DEEEIRSVNPVATEQYGNVSTNLQRGNE

SEQ ID NO: 22990 - protein, 30 aa, Artificial Sequence
  Description of Artificial Sequence: Synthetic polypeptide
DEEEIRTTNPVATELYGGVSTMNLQRGNDR

SEQ ID NO: 22991 - protein, 29 aa, Artificial Sequence
  Description of Artificial Sequence: Synthetic peptide
MEEEIRTTNPVATEQYGSVSTDLQERGNL

SEQ ID NO: 22992 - protein, 28 aa, Artificial Sequence
  Description of Artificial Sequence: Synthetic peptide
DEEEIRTTNPVATEQYGSVSTNQELGND

SEQ ID NO: 22993 - protein, 28 aa, Artificial Sequence
  Description of Artificial Sequence: Synthetic peptide
DEQEIRTTNPVATEQYGSVSTDLQNGNM

SEQ ID NO: 22994 - protein, 28 aa, Artificial Sequence
  Description of Artificial Sequence: Synthetic peptide
DEEEIRTTNPVATEQWGSVSENLMRGNF

SEQ ID NO: 22995 - protein, 29 aa, Artificial Sequence
  Description of Artificial Sequence: Synthetic peptide
DEEEIRATNPVATEQYGSVSTNLQQGDNP

SEQ ID NO: 22996 - protein, 28 aa, Artificial Sequence
  Description of Artificial Sequence: Synthetic peptide
DEEEIRTTNIVATELYGSVSSNLQDGNR

SEQ ID NO: 22997 - protein, 29 aa, Artificial Sequence
  Description of Artificial Sequence: Synthetic peptide
DENEIRTTNPVATEQYGSVPATNLQRGER

SEQ ID NO: 22998 - protein, 28 aa, Artificial Sequence
  Description of Artificial Sequence: Synthetic peptide
DEEEIRTTNPVATEQYGSVDTDLQYGNA

SEQ ID NO: 22999 - protein, 28 aa, Artificial Sequence
  Description of Artificial Sequence: Synthetic peptide
DEEEIRTTNIVATEQYGSVSEALQDGNR

SEQ ID NO: 23000 - protein, 28 aa, Artificial Sequence
  Description of Artificial Sequence: Synthetic peptide
DEEEIAQTNPVATEQYGSVSENLQHGNR

SEQ ID NO: 23001 - protein, 28 aa, Artificial Sequence
  Description of Artificial Sequence: Synthetic peptide
DEEEIRTTNPVATEQYGSVDTDLQAGND

SEQ ID NO: 23002 - protein, 29 aa, Artificial Sequence
  Description of Artificial Sequence: Synthetic peptide
DEQEIRTTNPVATEQYGSVSETELQRENR

SEQ ID NO: 23003 - protein, 28 aa, Artificial Sequence
  Description of Artificial Sequence: Synthetic peptide
DEQEIRTTNPVATEQYGSVSGELQRGER

SEQ ID NO: 23004 - protein, 28 aa, Artificial Sequence
  Description of Artificial Sequence: Synthetic peptide
DEEEIRTTNPTATEQYGSVSNNLQGGND

SEQ ID NO: 23005 - protein, 28 aa, Artificial Sequence
  Description of Artificial Sequence: Synthetic peptide
DEEAIRTTNPVAIETYGSNSTNLQRGNR

SEQ ID NO: 23006 - protein, 28 aa, Artificial Sequence
  Description of Artificial Sequence: Synthetic peptide
DEEEIRTTNPVATECWGSVSTNLQIGNL

SEQ ID NO: 23007 - protein, 28 aa, Artificial Sequence
  Description of Artificial Sequence: Synthetic peptide
DEEEIRTTNPVATEMYGSASTNLEQGNR

SEQ ID NO: 23008 - protein, 28 aa, Artificial Sequence
  Description of Artificial Sequence: Synthetic peptide
DEEEIRTTNPVATEQYGSVSTELEPGNE

SEQ ID NO: 23009 - protein, 29 aa, Artificial Sequence
  Description of Artificial Sequence: Synthetic peptide
DEEEIRTTNPVATEQYGSVSTNLQEWGEL

SEQ ID NO: 23010 - protein, 29 aa, Artificial Sequence
  Description of Artificial Sequence: Synthetic peptide
DEEEIRTTNPVATEQFGSVSATNLYRGNF

SEQ ID NO: 23011 - protein, 29 aa, Artificial Sequence
  Description of Artificial Sequence: Synthetic peptide
GEEEIRTTNPVASEQYGSVSTDLQDRGNR

SEQ ID NO: 23012 - protein, 28 aa, Artificial Sequence
  Description of Artificial Sequence: Synthetic peptide
DEEEIAATNPVATELYGWVSTNLQRGNR

SEQ ID NO: 23013 - protein, 31 aa, Artificial Sequence
  Description of Artificial Sequence: Synthetic polypeptide
DEEEIRTTNPVATEQYGSVSTNLQRKGVNDV

SEQ ID NO: 23014 - protein, 28 aa, Artificial Sequence
  Description of Artificial Sequence: Synthetic peptide
DEEEITTTNGVATEQYGSVSTNLQVGNI

SEQ ID NO: 23015 - protein, 28 aa, Artificial Sequence
  Description of Artificial Sequence: Synthetic peptide
DEEEIRTTNIVATEQYGSVSTELQVGND

SEQ ID NO: 23016 - protein, 28 aa, Artificial Sequence
  Description of Artificial Sequence: Synthetic peptide
DEEEIRTTNPVATEQYGSVDNNDQIGNR

SEQ ID NO: 23017 - protein, 28 aa, Artificial Sequence
  Description of Artificial Sequence: Synthetic peptide
DEEEIRTTNPVATECYGSVSTELQYGNV

SEQ ID NO: 23018 - protein, 30 aa, Artificial Sequence
  Description of Artificial Sequence: Synthetic polypeptide
DEEEIRTTNPCATEQYGSVDTNLQQRGNER

SEQ ID NO: 23019 - protein, 28 aa, Artificial Sequence
  Description of Artificial Sequence: Synthetic peptide
CEEEIWTTNPVATEQYGSISTALQRGNR

SEQ ID NO: 23020 - protein, 28 aa, Artificial Sequence
  Description of Artificial Sequence: Synthetic peptide
DEEEIRTTNPVATEQYGSVSTNLEYGEA

SEQ ID NO: 23021 - protein, 28 aa, Artificial Sequence
  Description of Artificial Sequence: Synthetic peptide
DEEEIRATNPVATECYGSVSANLQRGTR

SEQ ID NO: 23022 - protein, 30 aa, Artificial Sequence
  Description of Artificial Sequence: Synthetic polypeptide
DEEEIRTTNPVATEQYGSVSTNNLQEGMNA

SEQ ID NO: 23023 - protein, 28 aa, Artificial Sequence
  Description of Artificial Sequence: Synthetic peptide
DEGEIRTTNPCATEQYGSVSTNLQYGMR

SEQ ID NO: 23024 - protein, 29 aa, Artificial Sequence
  Description of Artificial Sequence: Synthetic peptide
DEEEIRTTNPVATEQYGSVSTDLQRGEDI

SEQ ID NO: 23025 - protein, 28 aa, Artificial Sequence
  Description of Artificial Sequence: Synthetic peptide
DEEEIRTTNPVATEQYGSVSTTLQREEM

SEQ ID NO: 23026 - protein, 28 aa, Artificial Sequence
  Description of Artificial Sequence: Synthetic peptide
DELEIRTTNPVATEQYGSVSENLQRLGR

SEQ ID NO: 23027 - protein, 28 aa, Artificial Sequence
  Description of Artificial Sequence: Synthetic peptide
DEEEITTTNPVATEQYGSVSTNLQIGEL

SEQ ID NO: 23028 - protein, 30 aa, Artificial Sequence
  Description of Artificial Sequence: Synthetic polypeptide
DEEEIRTTNPVATEQYGSVSTDLEERKGNR

SEQ ID NO: 23029 - protein, 28 aa, Artificial Sequence
  Description of Artificial Sequence: Synthetic peptide
DEEEITTTNPVATEQYGSVSMNLQLGNV

SEQ ID NO: 23030 - protein, 28 aa, Artificial Sequence
  Description of Artificial Sequence: Synthetic peptide
DEEEIATTNPVATEQYGNVSTNDQRGNG

SEQ ID NO: 23031 - protein, 28 aa, Artificial Sequence
  Description of Artificial Sequence: Synthetic peptide
DEEAIDTTNPVATEQYGSVSTNLQRLVR

SEQ ID NO: 23032 - protein, 29 aa, Artificial Sequence
  Description of Artificial Sequence: Synthetic peptide
DESEVRTTNPVATEMYGSVSTNLQREGNR

SEQ ID NO: 23033 - protein, 29 aa, Artificial Sequence
  Description of Artificial Sequence: Synthetic peptide
DEEEIRTTNPVATELYGSVSTNLMNRGNL

SEQ ID NO: 23034 - protein, 28 aa, Artificial Sequence
  Description of Artificial Sequence: Synthetic peptide
DEEEIRTTNIVATEQYGDVSDNLQNGNR

SEQ ID NO: 23035 - protein, 29 aa, Artificial Sequence
  Description of Artificial Sequence: Synthetic peptide
DEESIRTTNPVATEQYGSMSTNLDRGNNR

SEQ ID NO: 23036 - protein, 30 aa, Artificial Sequence
  Description of Artificial Sequence: Synthetic polypeptide
DEEEIRTTNPDATEQYGSVSTINLQRGDER

SEQ ID NO: 23037 - protein, 31 aa, Artificial Sequence
  Description of Artificial Sequence: Synthetic polypeptide
DEEEIRTTNPVATEQYGSVSTCNLQRIGNEC

SEQ ID NO: 23038 - protein, 28 aa, Artificial Sequence
  Description of Artificial Sequence: Synthetic peptide
DEEEIRTTNPVATEQYGSVVYNLDRQNR

SEQ ID NO: 23039 - protein, 29 aa, Artificial Sequence
  Description of Artificial Sequence: Synthetic peptide
QEEEIATTNPVATEQYGSVSAENLQRGNR

SEQ ID NO: 23040 - protein, 28 aa, Artificial Sequence
  Description of Artificial Sequence: Synthetic peptide
DEEEIRTTNPVATEQWGSVSTNLQQGAA

SEQ ID NO: 23041 - protein, 28 aa, Artificial Sequence
  Description of Artificial Sequence: Synthetic peptide
DEEEIRTVNPVATECYGSVGMNLQRGNR

SEQ ID NO: 23042 - protein, 28 aa, Artificial Sequence
  Description of Artificial Sequence: Synthetic peptide
DEEEICTTNPVATEHYGDVSTNLERGNR

SEQ ID NO: 23043 - protein, 28 aa, Artificial Sequence
  Description of Artificial Sequence: Synthetic peptide
DEEEIRTTNPVATEQYGSASENLQRMQR

SEQ ID NO: 23044 - protein, 30 aa, Artificial Sequence
  Description of Artificial Sequence: Synthetic polypeptide
DEEEIRTTNPVATEQYGTVFSTNLQYRGNP

SEQ ID NO: 23045 - protein, 28 aa, Artificial Sequence
  Description of Artificial Sequence: Synthetic peptide
DEEEIRTTNPVATEQYGSWSTDLDRGDR

SEQ ID NO: 23046 - protein, 29 aa, Artificial Sequence
  Description of Artificial Sequence: Synthetic peptide
DENEIRTTNPVATEQYGSVSTNLDDRGNG

SEQ ID NO: 23047 - protein, 28 aa, Artificial Sequence
  Description of Artificial Sequence: Synthetic peptide
DENLIRTTNPVATEQYGSVSTNLYRGNS

SEQ ID NO: 23048 - protein, 28 aa, Artificial Sequence
  Description of Artificial Sequence: Synthetic peptide
DEEEIRTTNPVSTEIYGVVGTNLQRGNR

SEQ ID NO: 23049 - protein, 30 aa, Artificial Sequence
  Description of Artificial Sequence: Synthetic polypeptide
DEEEIRTTNPVATDQYGSVSTMNLQRGFNV

SEQ ID NO: 23050 - protein, 28 aa, Artificial Sequence
  Description of Artificial Sequence: Synthetic peptide
DEQEIVTTNPVATEMYGSVGTNLQRGNR

SEQ ID NO: 23051 - protein, 28 aa, Artificial Sequence
  Description of Artificial Sequence: Synthetic peptide
DENEIRQTNPVATEQYGSVSTDLQRGER

SEQ ID NO: 23052 - protein, 29 aa, Artificial Sequence
  Description of Artificial Sequence: Synthetic peptide
DEEEIRTTNPVATECYGSVCSTELERGNR

SEQ ID NO: 23053 - protein, 28 aa, Artificial Sequence
  Description of Artificial Sequence: Synthetic peptide
DEEEIATTNPVCTEQYGSVATNLQRGTR

SEQ ID NO: 23054 - protein, 28 aa, Artificial Sequence
  Description of Artificial Sequence: Synthetic peptide
DEEEIRTTNPVATEQYGSVSTDLEIGNM

SEQ ID NO: 23055 - protein, 28 aa, Artificial Sequence
  Description of Artificial Sequence: Synthetic peptide
DEEEIRTTNPVATEQYGSVSTAQQLENR

SEQ ID NO: 23056 - protein, 31 aa, Artificial Sequence
  Description of Artificial Sequence: Synthetic polypeptide
DEEEIRTTNPTATEQYGSVSTMNLQLRGNDR

SEQ ID NO: 23057 - protein, 31 aa, Artificial Sequence
  Description of Artificial Sequence: Synthetic polypeptide
DEEEIRTTNPVATEWYGSVSTNLQWRAGNDR

SEQ ID NO: 23058 - protein, 28 aa, Artificial Sequence
  Description of Artificial Sequence: Synthetic peptide
DEQEIRTTNPVATELWGAVSTNLQRGNR

SEQ ID NO: 23059 - protein, 28 aa, Artificial Sequence
  Description of Artificial Sequence: Synthetic peptide
DEEEIRTTNPVATEQYGSVSTNLEQGEY

SEQ ID NO: 23060 - protein, 30 aa, Artificial Sequence
  Description of Artificial Sequence: Synthetic polypeptide
NEEEIRTTNPVSTEQYGSVSVTNLQERGNR

SEQ ID NO: 23061 - protein, 29 aa, Artificial Sequence
  Description of Artificial Sequence: Synthetic peptide
DEEEIRTTNPVATEQYGSVSTNLQEFGEH

SEQ ID NO: 23062 - protein, 28 aa, Artificial Sequence
  Description of Artificial Sequence: Synthetic peptide
DEEEIRTTNPVATEQWGSVDTADQRGNR

SEQ ID NO: 23063 - protein, 28 aa, Artificial Sequence
  Description of Artificial Sequence: Synthetic peptide
DEEEIRTTNPVASEQYGVVSMNLERGNR

(The sequence listing continues in the following parts.)

What is claimed is:

1. A viral capsid polypeptide bearing a mutation relative to SEQ ID NO: 2 (WT AAV2) in a region corresponding to amino acids 561-588, wherein the region corresponding to amino acids 561-588 comprises a sequence selected from SEQ ID NO: 4-41,337.

2. The viral capsid polypeptide of claim 1, which is an AAV capsid polypeptide.

3. The viral capsid polypeptide of claim 2, wherein the AAV capsid polypeptide is an AAV2 capsid polypeptide.

4. The viral capsid polypeptide of claim 1, wherein the viral capsid polypeptide is an AAV VP1 capsid polypeptide.

5. The viral capsid polypeptide of claim 4, wherein the region corresponding to amino acids 561-588 of SEQ ID NO: 2 comprises a sequence selected from SEQ ID NO: 4-41,337.

6. The viral capsid polypeptide of claim 4, which is an AAV2 capsid polypeptide.

7. The viral capsid polypeptide of claim 1, comprising a sequence of SEQ ID NO: 2, wherein the region of amino acids 561-588 of SEQ ID NO: 2 comprises a variant sequence selected from SEQ ID NO: 4-41,337.

8. An AAV2 capsid polypeptide comprising a sequence of SEQ ID NO: 2, wherein the region of amino acids 561-588 of SEQ ID NO: 2 comprises a variant sequence selected from SEQ ID NO: 4-41,337.

9. A nucleic acid encoding the capsid polypeptide of claim 1.

10. An engineered AAV vector having at least a capsid comprising the capsid polypeptide of claim 1.

11. A viral particle comprising the capsid polypeptide of claim 1.

12. A method for delivering a payload, the method comprising contacting a cell with the engineered AAV vector of claim 10.

13. A method for delivering a payload, the method comprising contacting a cell with viral particle of claim 11.

14. The method of claim 13, wherein the contacting is sufficient to allow for expression of the payload in the cell.

15. A method for administering a payload, the method comprising administering to a subject the engineered AAV vector of claim 10.

16. A method for administering a payload, the method comprising administering to a subject the viral particle of claim 11.

17. The method of claim 16, wherein the administering is sufficient to allow for expression of the payload in the cell.

18. The method of claim 16, wherein the payload is selected from the group consisting of: a nucleic acid, a polypeptide, an inhibitory RNA, an antibody or antibody reagent, an oligonucleotide, and a miRNA.

\* \* \* \* \*